United States Patent 6,747,137 (NUCLEIC ACID SEQUENCES RELATING TO CANDIDA ALBICANS FOR DIAGNOSTICS AND THERAPEUTICS) - sequence listing, part 2

SEQ ID NO: 669 - DNA, 1134 bp, Candida albicans
ttgggtgttgatgaaaaacccagccgacccagagagaccgatagtaggtcaaattttccgtatgtggtccacagaagatggaaaaaggtatgtgaacatgtgttggtattaccgcccagaacagacttgtcatgctgtagacgtttgtttttcttaaatgaagtttgcaaaacaggtcaatatagagatcatttggttgatgatattgttggtccctgttatgttatatttttaactagataccaaaagggtgacttacctgaaggagttataccggaatctgcaccatggtttatttgcgaattcagatataatgagaacacacatgtattcaatcgtattagaacttggaaggcatgtttaccagatgaagtcagagaagatcctgaacaacctttgatcccattaaaggagacaagaaagttgatcaaatatgaatctccaattaaaggattgttagctccggatgcttataaaggtatggaaatccccgatgccatccctggtacagctaattcgccacccgtgtcagggtctgtgtatattggtgcaccattgccaaacgatgatttgggtcaatatatttctagtcagaatgttgatgctgttccggaacacgatgaaacgaaaagtggtcgtcgtgcattcttattcacgcccatttcacaattaaaaggtggtggtggttccacaaatacggtgtatgcaactggtccggcagtacctcatgggactatcagtcatgtaccagcaaaacctattgccgatatccctggtttgacgcctctggtggcgcgtaataccaatattttaatcaatcacgaagaaaagcatcagttaccaggaagttataaactgttacaagagcaaattcaagaaaatcaagctaaaaagcaacaagaacaacagttgcaacaattacaacaacagcagcatcagcaattgtacaaaaagacatctacaccaacacctacaagtattgcgccaactgggactacttaccatacgtcgatgtcaacatattcgaaccttttggttggaggtactcttgcttatgggttgaatgaaagtataggagaattgggtcaatttgtaaataagaaaagaaaattggtaataatgaaaacacgatga

SEQ ID NO: 670 - DNA, 1281 bp, Candida albicans
actatgtctgaaagagagaaaaagaagttactgactaaattacagtctttatttaatgggatttataagatcgaagataatggttatttaattcatcctactttccaaacattgccattgagatcaggcactgactattataaggttgtacaaaatcccctttcacttcacgctgtgggcagaaaattgaaaaacttgaaatatgcagatgctcaagaattcattaatgacttggctttaatttcgtggaatgctaggttctataatcattcaaaatctgttatttatcgacaagcacagattttgaaacaatacatcaccgatgtggtaattccgaaattgaagaatgacaaagcagttccgaatgggcactctttgatatatcctcatattggagacttgccagatgatagagataacgatgaattactgggattttcttttgagaaaggagagtcgactcccggcccaagtggggcatcaaacgctggctccagaagagatgagtttgaaatgagtgcaactcctcaagcagattcaatggtggcattatcaaaacctttggtgtcaactggatacactagactgtcgttcacaactcctagtcgtcccacgagacaaaagcacaaggataatcaaattgaaagtggtattagaagaggtcgtccaccaattattgataaaccatttgaaacccgtatcaaattaatcttgaaagggtttaagaaattgcgtgacaataatggtcacccattaaccaaacactttgagaagcttccagatataaaaacccatggcgactattatgaaaggattgctgcacctattagtttgaatgagatcagaatcaaggttagaagtagaaaatattcatcagtggaattgttcattaatgatttggatttgatgtttgctaatgcccagctttattatgaaaatgatccttacagtgaagagtttttggactcgcaacaatttaaaaaagaagcccatcttgtaattcaaacggaattgagtaagtcagataaagaaattatacttgctacttcttcttccagtgatggtgttttgcggttcccattagaagtcttggaagttgacgggtatacttacaaaattggtaattgggtgttgatgaaaaacccagccgacccagagagaccgatagtaggtcaaattttccgtatgtggtccacagaagatggaaaaaggtatgtgaacatgtgttggtattaccgcccagaacagacttgtcatgctgtagacgtttgtttttcttaa

SEQ ID NO: 671 - DNA, 819 bp, Candida albicans
ccaccaatgacaaattatatggtttgcttggctcacttttgtgaattgcatgggcctagtgttatagcttgtactcaaattatagacgaacgatcggtgaaagaaaatctgcttctggcaaattcccgactggctagttgtttgtcatgtcaatttattctacctgactccactgcaaatttagttacaaaactaaccaaagacaatgagaaaaaacctgcaaatctccataaatcagcttcacccatacctacacttacacccacatcaactccaactccaactgatttgatacttgaaaaagtcagcatatcgacccattacccgtcctctcaaaaacggtattcggcattgacaaagttggttatgaaatcgctatcagtggaaacaatgtctgacttgtcaaagccaatgttttatggagatgcaatcaatggatattgtattaatcagatattcaaagttgaagatttgaatgcaaggggaggcgagaggaaatattcactaatggtgatcagcgacaatgaatcagaacttttgatgcgttgggaaattgttagtatttatttcaatgtggttattgaattgattcaaaagaaagttgcaaaggcaaatcaagttaagcaaagcgaaagtaataatagtagcaataattttggtgatggtgattcgagtactaacaagatgtttgataacgagagatatttacgtagatcattgatcaaaccgaaatcgctaactgaattaaccaatgataatgagatatttgttagaatacacttgtgtgttacagaaatgttaaaggatatacttgggtaa

SEQ ID NO: 672 - DNA, 1038 bp, Candida albicans
  unsure (4),(16),(41),(43),(56),(63),(69),(73),(74),(78),(80): Identity of nucleotide sequences at the above locations are unknown.
tcanaaactccaaaanacaccaaaacaaagaacaaaatcananaaatccacaaganccccaanacaatntcannaacnantccacttccaccaccatcatttaccaaatccaaattttttggtaaaggttcgattagtcatactttccgtaaacaagctgctggtgctttaggtccagaattgtcgagaaaattggccattttaattaaaatggaaaaaaatttaatgagatcaattgaaatcacttctcgtgaaagaaaagatgttgctaaacaattatctttatggggtgaagctaatgaagatgatattagtgatatcactgataaattgggggttttaatctatgaagttggtgaattggaagatcaatttattgatagatatgatcaatatagaatcactttgaaatctattagagatattgaaggttcagttcaaccaagtagagaaagaaaacaaaaaattactgatcaaattgcttatttgaaatataaagatcctcaatcaccaaaaattaatgttttagaacaagaattggttagagctgaagctgaatctttagttgctgaagctcaattgagtaatattactagagaaaaattgaaaactgcttttaattatcaatttgattctattagagaacacgctgaaaaaattgctttaattgctggttatggtaaagctttattagaattattagatgaaagtccagtcactccaggtgaaactagaccagcttatgacggttatgaagcttctaaacaaattattattgatgctgaaaacgctttagcttcttggacttttgattctgccgttgttcgtccaactttatcattagctgctcatgatgaagaagcagaagaagatttagaaggtgcttatgaagatgatgaattggctaatgaagctgaaaatttaagaattgctgaaaaagattttgatgaagttgaagctaaaattgctgcttcaaatttccaaaaaatttactacatgtggtcaaccagcgggctggaaagatccaacgggtgcggt

SEQ ID NO: 673 - DNA, 936 bp, Candida albicans
cttattatcatgcatagaacttattcattaagatcttcgaaagcaccaactgcttcacaattacaatcccctccaccaccaccatccagtaccaaaaataagttttttggttctggtgggttatcttcaaccatcagaaaggcagctgctggtgccactggcccagaattgtctcgtaaattgtctcaattcatcaagatggaaaagaactttatgagagctgttgaagtcacttcccgtgaaagaaaagacgttgctaagcaattgagtgcttggggtgaagataatgaagacgatatcagtgatgtcactgacaaattgggtgttttgatttacgaaattggtgaattggaagaccaatacattgacaaatatgatcaatacagaattactttgaaatccattagagatatcgaaggttctgtccaaccaagtagagacagaaaacaaaaaatcactgatgaaattgctcatttgaaatataaagatccccaatctccaaaaatcccagttttggaacaagaattggttagagctgaagctgaatctttagttgctgaagctcaattgagtaatatcaccagagaacaattgaaagctgctttcaactatcaatttgatgctaccagagaattggctgaaaaatacgctttgattgctggttactgtaaagccttattggaattattggatgattctgctgtcactcctggtgaaactagaccagcttatgatggttatgaagcttctaaacaaatcatcattgatgctgaaaatgctttggcttcttggactttggattccgctgctgtcaaaccaactttgtctttacatcaagaatatgatggagatgaacttgaacacgaacacggtgaaattgatgatgctgctcaagaagaattcaacaaacacgatgaaaatgttgaacaccaataa

SEQ ID NO: 674 - DNA, 528 bp, Candida albicans
aatatggcaaaacggaagttagaggaaaatgatatttctaccattgaagatgatgaattcaagtccttttccgatcgagatgaacaaatagatgaactcagcaacggccatgcaaagcatagagagaacaacgcacaggagagtgatgaccacagtgcaagtgaagacgacgatgatgaagacgatgaggaagagggagaaaaatcagtacaaccacctaataagaaacaaaaaaagcagctttctgcacaagatgtccaagtagccagagagacagctgaattattcaaatctaatatatttaaacttcagattgacgaactaatgaaagaagtgaaagtaaagaaagctcacgaagaaaaaattgagaaagtattgcaccgtttgcatgatttgattaaacaagtgccacctgtggaaaatctaactttacaacaagcagaacaacattttaatcccaagaaattagtcatcccatttccagatcccaaacgtcttcaccacgcggctggaaggaccgcgaattgc

SEQ ID NO: 675 - DNA, 1086 bp, Candida albicans
caatataaaaagactattaacgaaccacatggacaaagtatcgaagtagcactaactatgcctaaagaattgtttcaaccaaaagattatttaaattatagagcattatataaaaagtcattttatttggcatacttgggtgagaatttaatccatttgtcgaaaaagaataatttgccgatcaaggtgtcgtatcaattcttcaatgacgatgtattgaaccccgtcttaaaaatagagagtatccaaactgaaaatcccgaagatttgacttttactaaaactaaaattgctattaatttaatagtagcattcccatttggtgtttttgactcgaaaaagctacttcctgataaaaactgtatccgtgtgcaatcagacaccgagactttgccacctactccattgtacaattctagcgtgttatcacaaacatcctacgactattatttaaagtatttatataccaccaaaaaatcaacagaagcattcaaagatgcatgtgtgttgggaaaactttggttgcagcaaagagggttcaattcgtctctcaataatggggggttcggtcattttgaatttgctattttaatgagcgcgttgttgaatggaggtggattaaacggtaacaagatattgttgcatggattttcctcataccaattattcaaaggtaccatcaagtacttggctacaatggatctaaatggagggtatttatctttctcgtctttaattggagaaaacattgcatcgaaatacaaatcagatgggtttaatgttcctaccatattcgataaaaacaccaaattaaacatcttatggaaaatgaccaagagttcttacaagagtcttcaattgcaagcacaacagactttggaattattgaatgacgttgtaaaagacagatttgacgccattttgcttcaaaagtctgattttgatccgatgagatacgatattgtcttcaagttatcagcacctgaagagttgtacgatttttttgttccattggaaaagatagcatacattactttggataatatttccagagcagattatttgcaattttcacaaaagcattag

SEQ ID NO: 676 - DNA, 1737 bp, Candida albicans
  unsure (1694): Identity of nucleotide sequences at the above locations are unknown.
tatttccagagcagattatttgcaattttcacaaaagcattaggtgaaagaatagaactgattgttattaaaaatgaacacctttcacacacatttgccttccacaagagaaagccatcacacacaagctcaacctttgttattggtttgcaattaaatccagaagaatgtgacaaattagtaaccaaaggtccgaataatgaagataaggatgctggtatcaaattcagatccttttgggggaacaaagcatctttgagaagattcaaagatggatctatccaacattgtgttgtttggaatattaaagatcaagagccagtggtaatgaacattatcaaatatgctttagatactcacttgcaatctgaaatatcacaacatttggcatctctgatcagttattttgataagaaattgccagttccattattgccttcagcaacaaatcaagtgatcacatctttaagcagctttactgctttaaggaactcatttgaaaacttgagtaaagtcttgacaaatttagagttaccacttagtgtgaagacagttttgcccgcatcatctggtttaagatacacgtcagtattacagccagtgccatttgcagcatccaaccctgatttctggaactactgtgtattacaatttgagacttcaacaagatggccagatgaactaagtgcattggagaaaacaaagacggcatttttattgaaaattagcgaagaattagctgaaacagaatacaattcatttatttcaaaagatgaatcagtacctttcaatgaaaatataactttgttgaacattttaactccagaaggttacggattcagaatcagagcttttacagaacgtgacgaattgttatacttgagagcagtatcaaacgcagacaaacagaaagcgttagtccaagatgtttatttgaaattcaatgaaaaatatatgggctcagtaaagcacaccagatctgtaacacaacttgcacaacattttcacttttattcaccaactgtcagattttttaaacaatggttggattcccaattacttttgcaacatttcagcgaagaattggtggaactcattgctttgaaaccatttgttgacccagctccatactcaattccccattctgttgaaaatggatttttacaaattttgaatttcctagccagctggaattggaaagaagacccattagttcttgacttagttaaaagttctgctgatgatgatatcaaattaagtgataagttaactatacaagcacatagaatcattgagcaaaattttgaaaaaattagaaaaacagacccttcaggtattaaaacacagtattttattggatcgaaagatgacccttctggaatattatggtctcataatttaactttaccaatttctactaggctaactgcattgtctcgagctgccatccagttgcttagaaaggaaggcattactgaaaccaacttggatttgatatttactccagcattacaggattatgacttcactattaaggtcaaggcgaataacgttactacttcttcaggtattttaccaccaaacacatttaaaaacttaattcaaccattaacttcattccctgatgatataactacaaaatacgatttggttcaaggttatgttgatgaattgaataaaaaatttggtaatgntattataccttcgtattcagacaaggggctggaagtaccgcgt

SEQ ID NO: 677 - DNA, 1509 bp, Candida albicans
attaatcaaccaactaccctcatgtctgataaagtaaagtttctcatattaaatccatcaccggataatttgattaaaattttggaaaaatcaaatactcaatatacgaaaaatggtccatttgaagcaactattttattgggggatgttttaccacagggctatgaattaccaaacgtaaaacctcttggtgtcacgtatttttccagaggtgcaaatggaatatttgaagtaatacaagcaaaagaaagttcaacacaaagctctattgatttggccacaaatttcacatttgttaaaccaccatttagtgttatcagaaccacatcaggaatcactattatgatagtttccaaattagatacaaacaacgagtcagaagagaaaccattagaccttcctgaagttaagattgatatcttgataacatatgaatggccacaagttattggtagattatgtaaattgactacagttggtaatgataaaatcaacgaattggtcacgaaattaaaaccaaggtatcattttgctgttggaaatgaaattgggaaatttttcgaattggaaccatttgcttggtctactggagaaataaccagatttatcagtttagcgcaagagggaggatcaaaagagaaatggttctatgcatttagcataggtttggaacaagacaaaaacaccaatgttattgaaaacccatttacagctacaaacaaaagatccagggacggagataccaacaaagatgaagaaaaggagctatcaaatgcgagagaagttaaaaagcctaaggtggtagctcctgaacaatgctttttttgtttgagtaaccccaatacggaaacccacatgattgtttctattggaacttgctcatatttaactattgcaaaaggtccattaacaaggtccaataaaaacttgcagttttctggtcatggaattttgatcccaattgagcatacacctacaataaaacaagaatctttggtttcagaagaattgttgaaatatcaaaatagtttagtaactgcatttgatgaacaaaaaccgaacttgaaattagtattttggggaatcaaccgagacacaaacattcattatcataaacaattcttaccagttgaagaatctttgttaaacaagttttcaaaatcattggatatgagagttaaactaaataatgaaaaattcaaaaagaatcagaacttgcacttcacaaaatttactgatatggcaaatcctgagcttacaaaaatattggatacttccaattatataatgtttactgtgtgcaagaataaaactgaccgagattattatattgctcctttaataccggaaaagtctatagacatacaatttcctagacgagtactagctcatgtattgaatcttcctgatagaattcattgggataaatgtcaacaacctaaacttaaagaaatggcagattgtgaaaactttaaatcattttatcaaaaatttgactttacactttaa

SEQ ID NO: 678 - DNA, 414 bp, Candida albicans
tcggactcgtccttccgcgcgtgtgaagatttgaatgcattaattaattgttgttattttgctcttattgatgctaatatagccatgaattattcatttgccagtatagttataattattgatcatcaaggaaatttattaattccaattgatggaaatgatttacaccaacaacaacaacaagaagaagattatgaatcaattcatttatgttgttattcaattatagcaaaaaaagttgataaattattattattagaaagtcaaggagattttaatgaatcacaattatttaatgtattagagaaaagtatttataaagtggaaaaatttcataatgaaattcatcgtcaatttattaatgataaaattaagaatgattatatttggaaacaagaaagggaagatgaataa

SEQ ID NO: 679 - DNA, 987 bp, Candida albicans
ccaatgtttcccttcactaaactaacaagcaatatatgcttgaagaaccatttcttcagcaatgggaatctcttatcactctcattgaagaatatgagacaacaaaaggttttgtccttcagatcgaatattcagttattgcaatctaattttataccgatcagaggttacatcagggaaactgtgtatcaacaaacaagaaactcacctttaaggagaagcagcacttggaagcaatacaatctgttttataacagatccaactgggataaattgaaaaagccgttattgttcactattgcattttgtgtggggacaactttagtaacaccatatttgtttacctacactcctttatcctacttcaaacgaaacccacaatcacttctttggtcgcttataggtattaatggtgccgtgtttttgatgtggcgaattccacgattgcaatggtttaccatgaaatacggaatcttgttcaaagacaacttacaatctccttggacattattgggctcggccttttcccatcaaagctttgctcattttttcataaacatgttggcatttcaatcattcggctctaccttggtggcattcttgggtgtatctaactttacaatcatgtacttgaattcggcggttatttcttcatttgcttcgttggcaattcctatgtttttaggatcatctttatcagttgcctcattgggtgcgtcgggtgctatatttagtgtctttggtgtattttcctttttgttccctgcttcacctgttggattgtttttcatcccaattccaggtggtgcttggatgttgttccttggtactacactttggaatgctgctgggaccgttttacgttggggtacatttgattatgctgctcatcttgggggaagtattgttggaatagcttacggttactggtacaatagaaaaagaaaacagcaaattcgtagacgaagacatacattagatttctaa

SEQ ID NO: 680 - DNA, 501 bp, Candida albicans
aacatgaaatccatactaaggtcaacaacaaggaacctaataacaagctcaagaagatttgaaaacttaaaaacaaccgaagaaatccgaaattttttggcagagtctacttggtccatcaatgagttattaaaactgcctactggatcatctcaaccagaggtgtcgccagagattgtgaaaaagatgttgaagctatctgggttgaacgatttgaaagatgatcaaagtgtaacaaaagctttaaatttacagatgatgtttataaaccatttgtatgacaatgatcacgaaactgttaccccttctcccaaacgaaatgaaaacaatggcatatttcggttactagccagtgatcatttaccacaacgacctttggaactaaacaatttattgaaacagattaatgagttaaagccggatccaagtaaaggagaggtggactttacgattagtgatttacaacgagattcgtttgtgataaacaaacggaaagaataa

SEQ ID NO: 681 - DNA, 1737 bp, Candida albicans
ctatcactttgttcagactccatcaaaccaaacaaacataaaatggccagaataaagaagaggggtaccaccgggaatgccaaaaactttattacgagaacccaagcaatcaagaaattgcagatttctttggccgatttccgtcgtctttgtatattcaaagggatttatccaagagaaccaagaaacaagaagaaagctaacaaaggatctactgctcctgtaaccttttattattcaaaggatattcaatatctcttgcatgaacctgtattggacaaattcagacagcacaagacatttgccaaaaaattgcaaaaagctttgggaagaggagaagttagcgatgcctataaattggatcaacacagaccaaagtatactttgaaccacatcatcaaagaaaggtatcctacatttgctgacgcattgcgtgacttggatgatccgttaaacatgttgtttctttttgctaacatgcctgcaacagacaaggtttctgccaaagttgtttctgaagctgaaaagttgtgcaatcaatggttagcttacgttgctaaagaaagatgcttgaaaaaagtttttgtgtctatcaaaggtgtttattaccaagccactgttaagggacaagaaataagatggttgattccgtacaaatttcctacaaatattccgaccgacgttgactttagaattatgttgacgtttttggaattttattctactttggtacattttgtgttatacaaactttacaatgaagctgggttgatttatcctccaataattgagaaatcaattgggttaagtggatacgttttgcaagataaagatgctcctttgaagaagaaagaggaaaagaatgacgaagaaggaaagaatttgtcaaagaaagaattgaacaaggccataaaagcagatcaagaacaacaagaaaacgacgagcaagacaacaacaacggagaatcagtagaagatattgaattggacgaattcacatcgactaaagaggactcgttattacaaccttcaaagtatgcatctctgacagcagaattattttccaagtttatcttttacattggcagagaagttccgttagacattttagaattctgtatattatcatgtgggggtaagataatttcagaaattgctattgacgatttgaagattaatgatcctgaggcatataagaaattgaatttatcaaatataactcatcaaatcattgacagacccaagatcttgcaaaaagttcccggaagaacttatgtacaaccacagtgggtttttgactccatcaacaaacaagaattgattaatgtcaatgaatacgctgcaggtgaaacattaccacctcatttatctccatggggtgatgctggtggttatgatccaaacaaggaagttgaaaaggaagacggtgaagctgtagaagacaccgacgaagaagaagaagaagttgaaattgaggacggagatgaagatcaagaagatgaggaagaggaagaagatgaagacctcaaggctcaaaaggaattggaattagaagctgctggtgttaaattctctgaaataaatgaagagaataagaagagtcactccaaaaaatcgaagggaacttccaacaaagaagctgatgaagaaaaggtattgaagaagattatgatgtctaataagcaaaagatattgttcaagaagatgcaatatggtattgagaagatagaagattga

SEQ ID NO: 682 - DNA, 900 bp, Candida albicans
atcttgctgttttgtattttttcttttgatctctatatcatcaagaaactacacatgtcgaccgaaacagtaacttccaccactaccactagtccttcaacgagcaaacgtcagaaagtgagtgaattcaatgatggtagaaaaaccccatcttatccctggctccaaagtgccactgactggtttaaacaaagtttaaaaccttcatatgctgatgagcaagttgagagacgattgctttcgtatttgccatttttccctgaatcagatggtctgcgccgtgcaagtgtaatcaacacagatattggaaacgggaactatattcatgaattgtttattgaaaatctagaaaaagacacatcaaaggatgcgtcgtcaacaaaggaaattgtattagtgcacgggtatgctgcttccttgggattgtttatagacaattttgattcattgtcgagaataccagggatcaaaattcacgcaatagatttgcttgggtttgggttgagttttagaccgaaattccctcaatttccatcgaaaactaaacaagatatttataaagtggaagattggttcattgattctttggagacgtggagaaaaaaacgtaatattggaaaattcattttgatgggtcattcctttggtggatatttgagttgtgcgtatgccttgaaatataataaaaagatcattgagcgtgggatatccctgaatttgattgaaaagttgatactcattagtcctgttggtgttgaacgcagtcagtattcgttattgaaaaaggaaacaaatctcactccacaggtgtctcccgaacaggaattattggttaatcaagaagatatagtgcacggcaacgaaatagcacaagatccacgaaccaggtcttcgccacgg

SEQ ID NO: 683 - DNA, 1203 bp, Candida albicans
  unsure (194): Identity of nucleotide sequences at the above locations are unknown.
gacgatggaaattttattcatgaattttatcttgaaaatattatggaatgtacatttggtaatcgacgacaacgaccacatatagtaattattcatggatatatggcagctatgggatattttattaaaaatgttgaagatgtaataaagattcctggggtaagattacatttaattgatttaccaggatttgngaattctagtcgacataaattccctaaagaattcatattggaacctaattcattatcagccaaaattaatcaaattttacaaattgaaaattggtttattgataaaattgaaaattggagaattaaaagtaatattaatcaatttaaattgattggtcattcaatgggtgcatatttatcttgttgttatttaatgaaatataatttgagtacttctggaaatgaaaatgaaaaattggtatcggatgtgattttagttagtccaatggggacagaatctaatgaatttagtttaattaatgataaacgatttcaattcaatttacataataaaattgatccatttcaagaattacattttgagaatgaaaacgaaaatgaaaatgaaaacgaaaatgaaaaccaattagttcctaatgatgatgatgatgatgatgatataattataaatgaagaaatcacgaaaatttggtctaaattgggtaaacccaaatttcctaaaaattggttattaaaaaaactttggtcaagtaataaatcaccatttgaatttttacaaaattttggaccattttattcgaaaattttatcatattggtcatttcaaagatttaaaaatttcgaaaataatcaaaatacaattgatttaatattaaaattacataattattcttattcaatttttaatcaatttcaaggatcaggagaaattgctataacaaaattaattaccccggaaatattagctaaattacctcttgccgatcgaggattaattgattttttagtagaaaataatattaataatatgtggatttatggtgataatgattggatgaataaaaatggaggtgaatatatttatcaacaaattaaaactaaaaatgaaaaaattactcaatttaaagtggttgaaaaagccggtcatcatatatatttagataatcctcaaacttttaatcaaatagttattgatttcctaaaacttaaccagttagatttcttataa

SEQ ID NO: 684 - DNA, 1416 bp, Candida albicans
agattatatgattcaagagtattcatgctaatattaaagagattattaacaacttcttgtactttattagacacttctcctaaaaactattataaaattatagctccatcaacttttgaaactaaaaaatgcgaatcatataacgaaaagcactcgtcaaccacgactgaaattacagcaacatcaacagcaacagtagcagatacggttgaagacgagttgacaataacacacaaaacgaaacgaaaatttatatccacttataagcgttcaactcatccaacatcggtcccattatcgaaaatcttcagtaataacttccccttgagtataaacgaatcatttgaagattacaaatatcgtaacaatcctttgaaatttcaacatgatttattatccatattacctttttatcctactcccgatctacaggtaaagacgaaagaagggagatcatctgaagtattgaaagttgaaatcgatgacaagggaaactatataaatgaatttgtcatttatcctgaaaattacaatccacaagtaatgcccgatgacgaatatcatcatttaataatggtccatggatatggagctggacttggattttttttgaaaaattttgatgaaatttcaaatttccaacccaataatacccaaaacaacaaatatattgttcatgctattgatttattaggttatggatgtagttccagacccaatttttatcctcaaaatttagatcaagtggaaaattggtttcacgattcatttataacttggttacagaaaagaaatattcctagtgataaaactattgttatggctcattccatgggggcatatctcatggcaacattagccattaatcgaaatttaaaattttgttccaaattattaatggtatcaccaggagctataatcagacatcaaacccctgttcaagtacctcgatattttgttaaattatgggaaagaaacatatcacctttcactattgttagaaaattaggtccattaggttctaaaatcgttagtggctggtcatcaagacgttttgataaattaactagacaagaaaaaaaattattacataaatattcttatggaattttccaaagtaaaggttctggtgaatatatgttgaattatttattagctcctggagctgatgctcgacatccattggttgatagagggatagatagaattacttgtgatgtttcttggtggtatggtaaagaagattggatggataaaaaaggtggacaaatatgtagtgctatcattaacaataagggggaattcaaaagtgatgttaaaataattgaggatagtggccatcatatttatcttgataatatcaaaaaattcaattccatggtacttgaagaaatgaatcagctaataaacaagtaa

SEQ ID NO: 685 - DNA, 519 bp, Candida albicans
ttttcacccaccaacacagccatgccatcgagtactgcttccccagaccaagaacaattggaattggttcacttgacagatcaagagcttatagattttactagacttcaaaatgctcaagcatggaaaggtgcattgtcaatcaaagaatacgtcttgagagaacaagttttgggtaaatcaaagatggcaactactccccgtaataagttattgatatttatgttaagaaacaaaaccgataaagccccgttgtgttcgattgaattattaatccggaaaagtagaaagtatactttgaacaagcatgagaatgtggttgagcaagaggatattttaagtggatgtattggtggtgtttatacatacccacaacatcgtggtaacggatatgccagaataatggttgacaaattagtagttgaagcaaaagagttggtaggaccactggggtttgtctttttatactcaggacctggcgaatatttttttcaccgacacgatgggcatatatgtccc

SEQ ID NO: 686 - DNA, 777 bp, Candida albicans
ccaccagagttggatccatcagttatagcagactttgaatatcgaagatttaaatgtagaggccgttttgattatgaccaggaaatgttcttaggaccacgattaaaggatggagaattagggtatcttgttgtaacaccgtttattagaaaaaatggaggagatccgattttaattgaaagaggatggattctgaaagacaaagttgtccccagtagcagatcatctggatacttatcacatttggccagaccacaaggtgaaatagaaatagaagcattatttcgggttatgccaaagaaatcgtttttacagttggagcacgaacaaggctcaagattattccatgtccctgatgttcctgctatggccaaacaaagtggatctttacccatttattgccaaatgatctacgatttacacgatcacatagactggaggaaagatgaaaatggacaacagcagaaaccatccgttatcagcagtttgcttttttcaaagaagaaggattcagatgcagcttttattgcaacaaatgccaacaaggatgagactttacagtttcaagaatttgagtttgtaaatgaaggtgtgccaattgccgcaaagccttttattaagttttccaacaaccacttgcaatatttaattacttggtttggcttatcaattggtagtactgttttgttacttttttcaatttacaaaagtaagcagtttgctactgccgaacaattgttggcagctaaaagaaaagacatgcaaaagaaagcatga

SEQ ID NO: 687 - DNA, 813 bp, Candida albicans
cgagaattcccctatcccacatcaatcatacaaacagatttcaaaaatttcgattctgatagtcatgaaatcgatttatttttatataaaaattatcgatttagttcgattgattctataatcaaagaattaactgaattatcgactaatttaaatcaaaatttattggatttagtcaatgatgattatcatgattttattgatttaggtaaatcaattaatgatgggttagatttaattaatgccatagttgaagatttgaaaaattttgaaattgaattagtcaattattataaaaaatttctggatttagataatcgtttatatcaaattttacaaaatcggaaatttttaaataatttgaaaacttgtatcaaattgaatttaatacttcatgatcaaatcactgaatttgataattgtatgaataatcaaatacaggaagagaataatatccaaggtttgaatcaattgaaaactttgactagtttatatttatcaattaataatattgaaattttcttgaataagttcatacaattaggtaatattgatgatgttaataatagtatcgacaataacgataacgataacaacaatggaaatcacagagtgaattctcctttccatgacaattatataaataataaaatcgcatcgataaaactagagtttaagagttatttggatcaattaattagaaaggaattgcaaaagaagacaagaaattcacaaataatgattgaattattaaacatttataaactaataggtgaagaaaagagtgtaatgagtataataagtagtaaatag

SEQ ID NO: 688 - DNA, 843 bp, Candida albicans
  unsure (784): Identity of nucleotide sequences at the above locations are unknown.
agacaagacgaaaacgaagaagatttagaacaacaacaacaagaacaacaccatcgagaagaagaatcacaagaccatcaacattccttatctgaatcatcacttttaatgcccaattcaccacgaaataattatttttctcaagcagatgcattagagtcagaaattggttcacctagtgtaaacagttttggacgaagaagtcatagtggaagcaacccatcagtcaattccctcccccaaccatcaccatcatcattatcattatcatctaaagataacatccctgaaaaacaaccaagtaaattgcattcctatttggtcaagccaattcgatatattcccggggtatttcttggtactttattgaatattttagatggattatcttatggtatgattatgtttcctataagtgaatcgatttttgcatctttggcacccgcaggtttatcaatgttttatatgtcatgtataatttctcaattgatttattcacttggtggatcagcattcaaagctggtattgtatcagaaatgattgaagtaacaccatttttccataccatggcaggagccattgctaaacaaataacaaatgaatcaaacggtaataataatattaataatgatgctattatagccactaccattacatcatatgccgtttcttcaattgtcaccggattggtgttttttttattaggtaaattgaaattgggtgttttagtggggtgttcccctcgacatatttgggtgggatgtataggtggtgttggatatnttttaattgctactggtattgaagtttcatcacgaattagaaggtggtatatcttataa

SEQ ID NO: 689 - DNA, 264 bp, Candida albicans
  unsure (28): Identity of nucleotide sequences at the above locations are unknown.
actcggatcttccagccgcgtggtcaanatttacaacataaatatcataattctttattggtcccactttatttcattgctgtgtttataattttccatttatcagttgcggttgcaccaaattggaatttaaataatgctagaattaatggttggatttttcctatggttgaagataatgaaccatggtatagtttttattctttatataaattcaatcttgtggattgggtttgtattgtacgtcaaattccaacaatgtaa

SEQ ID NO: 690 - DNA, 402 bp, Candida albicans
  unsure (328): Identity of nucleotide sequences at the above locations are unknown.
gctttaacatttttcggtattttacatgtccccattaatgtcccggctttggcagtttcagtcggtatggatcaagttgatgtcgatcgtgaattagtggctcatggatattccaatgcgatttctggtcttgttggttcgatccaaaactatcttgtttataccaattcagtgttattcattcgtgcgggtgccgacgatagagttgcgggggttatgttagctattgccactgctgcagttatgatggtatgccctgtggtcattggatatataccagtttgtgttgtcggtgcattgatttatttattgggttatgaattattanaggaagcaatttacgatacttggggccgattaagagatattgaatatatcacaattataattattgttgtcact

SEQ ID NO: 691 - DNA, 330 bp, Candida albicans
ataaaaaaacagactacgaaatatttaaaaatgtgtatagccatagctacaaccaatcatccagaatatccgtttattttactttccaatcgagatgaatttttcaaacgaccaaccatgccagcacattttcgagatgtggggaatggagtcaaattattatcaccattagatcttgccagacaagaacacggtacttggataggtgtaaccaccaatgggaaaattgccgtactagtcaattatagagagaatgatcaaagaggtatgtctaattgtcagagtttattaaattgtttttttgttactaacaagttgttttctgtttag

SEQ ID NO: 692 - DNA, 552 bp, Candida albicans
gtgtgtgaagaacatcaaaagaaaccgagtaaagacaatgccaatggggaaattaatctcagcagtgatacagatgatgagggtgatgatatacctcataagacaacatttggattatcaaattcattatataataaaccatgggataaagtcaaattgggagaatcactattgagtaaacttattgatgaatccataataaacaattatagtcaagatcaattaattgaaaaatgtttccaattattatctcatgatacatataattcaaaaattctttatagtgatgattttgaaaaaaaatttgcagaattaaaatattcaatttttattcctccaattgttcgaaataattattatgaaactgattccgtggcggttgggaaatattacggaacaagaactcaaacaattatattattggataaatatgggaatcttaattattatgaaaaaaatattcataattctgatgatattgatttgaaagatgttgatattacttcacattataaatttaatatttttaatgatcaaaaaaatgggtgttaa

SEQ ID NO: 693 - DNA, 1431 bp, Candida albicans
cgcaatcgcggatccttccagccccgtggtgaagacaggtcattataccaatatgccaataaagcaattgaaacgcttctgatcaccaatttcaaaatcacaaacacggtttccgtggatggtattataaacgatgaagaaatcacgtctattgttgccccagcaccggatcgtgttttgataggtaattccaatatgatttatctcataaatgttaaattcgcatcgcttttgtcgtcatttaaatcgtcatcgagctcatctcatcctatcccagataaagtgtttcttaaccaagttgtccccgtcaaggggaattcaacaaactcatacatatccatggcagtttatctcaacttgaaaaataaagacaacaatgtatacttgaatgttattgatataaatgttgggatgaacaaattgagtgaatgtttaggaaaatcattgaataaacagaaaccaggtttccatgagatccctgaattattcaatattcaagatgctttaccatcaagtgatgaaatccaagaagtttatctgtatttgaaagacgcgaaagaggcacaggatttgaataaatgggaatccatactcattccctacttgaagaataaaaagacatgggccgaaatcaagagcttactgagagcatccaagaaagataaagtatacgaattcaaggaattcgatgtcgacaatgatagagttattgatattgggtttattgattctgttttacagttgattttcactgaggacccacttgcttttgccaacgagcagtttgttcccgaatatactttgatgtatctattgaccaacccattattccctatccgattcacactgggattgattgaattgttcagtgtaacaggaaatacaacattgttgagacaggcaataaacacatgtcctaacattccatgtcgcgacttgttggaccaacttgtgaatgaagaaaacaaggaaaccttgcttgatcttattaatagaataattggtgaattttctcgtaaggaaatcacaaatacttttaaacaactaattcaaggcaatgccgtggatgtggttgaattgatttccaagttaattggcttgccaggaaacaacaactggtatttggttgaaattttggttgatgtcaatggattgttcaactgggatatgggggatatcaaagccttggatgaaataatttctcaaaaagtagaggcattgacggtgaatagttataacttgactttgtctcatcaagttttgttgcacaataagagattatccaaaaaggctaaggaaaaggggtctacttcacatttggataatcttttgacattgactagccactctacaagtgccaagtttgatgataccccagaagaagctaacttaaaagttccagtctattcagttgaaagagttaacttttag

SEQ ID NO: 694 - DNA, 2475 bp, Candida albicans
aagacgattgggtcccaggatttggctatagccgttctgttcaaatcgtacattgaagaacaaagtgccgatgacattccaatcgaatcaattaaatttgatatttccacaattttattcacaattttaagtaaaatacatgtcctactaaatgccgatgatgagttagaattaagatatgttaacaatgatgaaaaccattatatggcaaacttgcacatttggacaccaaacgaaatcattgcaagcaatgactataatcttagactactttattcgattacctgtgttgtgatttcagccatgtacaaattatttattcctaaatcaggtgattacaacttgactacaaatccttacttgcactattttctcaaactatggaaatgtcacactaatatcataattcttggattagcaatagacagaagaattgaatttctcaatctcgaaaatggcgagaataaggaaacaccgtatataatccagcaaactctaaagggttcaagctcaatacggtgcgttctagcctggatactaaacaagaatccttcgtcggcgccagtattagacgatgatttgtctatacattcagaacagtcgtcagatataaaaaatgaaacagttttcaacttcatacagcctttagccagaagcaacagcaatggaggagcaatactgctagatatgaggttggtttcgatcgccttgttgatgctatattcgggaacatcgttcacagcgggggctcatcaagtcaacgagaaaccttcaattaatcaagagcacgccagtagaagactaaatcaatccacaaaaatatcagaggtgggtgacatactaattgacttggaatatgctgacagatttgatgaagatatcaagtacatgcttgaatgtgaattgtatgacgatgcagaagacgacaaatataatgaagctaacagcaagaaactattcaaagctgagttaaggaggggggcaaaaggtgaagatgtctctataataccatctgagattacagaaagtcttattgtacctgaacttgagtttgacgatttgggacgagattggcgagatattactcgaggaggaaataatgaatttaatgatctgttcttagctaagcttaaagaatttgaagcattaccacaccagagtgattcggatgatttttctgcgttatgggacgaattttaccaggcacttgaatttttaagtacaaattctattgaaggaaattctcaggccgaatgtaaaattggacaagtgataatcaacacgatagcaaagtctattttagacaacaaagaaaagagagattcatcaataacgccgatgaaaatttatcaattttggacgtctctggctagcatggaagcaatcaggataacacaagaagataacaataagatgattgcacctatcttcagcgttacaaaatttgagttgtttttccataataacccactgcttgcgagagcagcaatggacgaaatgttaatgtgtgaaggtcatagaaagttgctcatttggtttttgacccatgtaatgaatctatcgatttcattagtggactacgtttatgaattggtaagcggccttcgtggcactaaagatataacttttccttacaagttttccagaaagggaggaaaagtacacctaagcgaaattgaacagctgatggttttgcatgagttcttgggcaacagtgctgattatttgtcagcaaccgatgggatcgatgtacacgatggctatcgagtcttcctagcagaatcaattgcaaagaagcttttgtctgtactatgtcttatgatcaaccatttaattcagatgggtattatagatttgtctggaaacaagtccgatcatctccatgattatacaaatgagttgcaagtgttgcttataaattggattggcaaagttccagaggcaaggagattatttttcaagattaaaaatggcaatactgaaaataaaaaggcaactaacagttttgatacgacagtttcaaaagaggatgaaataaacttgtttgaaaaatatgaaaaagctacaactgaagaaatcagcacggacatagctaaaaatttaaaaaataaaaggatcatcgagtcgtttgcaaaaagaattgaatgtcatctagaagctgtgttaagccaaagcggagaagcaccaaagttggaagaaataaatgacgacttcagatatttcctaaccaactttaacacgttatgtaaagtcgactatcttgcagaaactctttttgggaaatttgaaccagttatctcatcagggtcgatatcgaagttggatgcaactacagaaattgacgagggctttgacgcagagtttaatacagaattcctaaatggagaaggtagatttgaaaaaaaagaaacagcaaagccacagaatggttctaaaaagaaatcaaaaaagaagaaaaaatccaaaaagaagtag

SEQ ID NO: 695 - DNA, 1245 bp, Candida albicans
  unsure (508): Identity of nucleotide sequences at the above locations are unknown.
gtaggggcgaatagttgtattcaaaacactcttgatgatgaatcacgagagattaaaatagaaaacattttacataatcctttattttataaagattatccaccgatagttagtccaccaaatgacactcaaaagactttaaaaccaggtgaaattcccgattatgttattaaatatgctcccttggtacatctttatagtgaagaaagatatttcccttatgatgttaaaaaatttgtcactaatttccatgtcacttggagaaatggttcaatttatcctggtacagaaaaaaatatgaatttagataaattagcaaatttacctaatagtacagatttatttcttactgctaatagtgattttgattctgatcctgaatggatcacagggttaaaaaataaacctagtttaatcaatggagaaattaaagatgcaccagctactttgattgtcgttgacaaagggaatggatgggtcgatgccttttggttttatttttattctntcaatttggaaccttatgtaatggttcaaggtccatatgggaatcacgtgggagattgggaacattcattggtaagatattataagggagaaccagttatagtatggatgtcggctcatagtggaggtgggggatattattatgataatttggaaaaatattctttagatccaaatcatccaatcattttcagtgctagaggtactcatgccaattacccaagtgtgggacaacatcctcatgatttaccatatactatattgagtgattttaccgatagaggtccattatggaatccatcattaaattatttatgctatagttttgatggcaaacatgtatacccaggaaacaattctaatccaaaacatgttggaagagaatgggattatggcaattggttatcatttagtggtcattggggggatgataccctttctagaaaggattcacgacaagtatattcatttattggtggttataaatatattgaaggtcctacaggtccattgagtaagaatttaatgagattaaaaccctgtgaaagtgctcaatggtggaatttttggaaagtttgtaatgttcgtaatgatattgaatggggggttggggttgaatctgaaggattcaattgtgcacgattaactaataatattagaccaatatggttgaagaaatcaatacaaagtataatgtggggtggaggaatctgttttatagccaatttattggattaa

SEQ ID NO: 696 - DNA, 2271 bp, Candida albicans
acaacttttttactagatatggttttaaaatcaacaactgcagggaatgtatcagtatatcaagtttctggtaccaatgtttctcgatcattacctgattggatagacaagaaacgtaaacgagctcttaaacatgatttagaatatcaaaatagaatagaattaattcaagattttgaattcagtgaagcatcaaataaaattaaagtgactaatgatggacaatattgtatggccaccgggacttataaaccacaaattcatgtttatgaatttgccaatttatcattaaaatttgatcgtcatactaatgtggaaaacattgattttttaattttaagtaatgattggactaaaagtgttcatttacaatgtgatagaagtattgaatttcaaactgctggtggagtacattatcgtactagaatacctaaatttggtcgatgtttgacatataatccaattaattgtgatttgatcgttggtagttcaagtgatgaattatatcgattgaatttagatcaaggaaggtttttatccccattgaaattggatatgactgatggtggcaatattgacagtggatgtaacgccgttgatattaattctatgcatggtttaataagtgctgggttagatgatggtaccgttgaattttgggatccaagatcaaaacaaagagccgggaaactatttgttagtgatcaattaattaatagtactaataacactgaacaaagttcttgtggtattacatcacttgcattccgacctcaagatgcattaaattttgcttgtgggacaagtaatggacaaacattattatatgatttacgtgcatctgaaccctatcaaattaaagatcaaggatatgggtatgatattaaaaaaatcatttggtgtcaagattcattaaaaccagaaatgattttaactagtgataaaagaattgtgaaaatttgggatcatactaatggtaaatcatttgcctccatggaaccgaccgttgatatcaatgatatttgtcatattcctcaatcaggaatgtttttcatggctaacgaagggatgcccatgcatacttattatatccctaatttgggttcagcacctaattggtgttcattcttggataatgttactgaagaattggaggaaaaaccttcaaattcaatttatcctacctttaaatttattactcgtgatgaaatggtgaaattgaatttgactcatttgattgggatcaaagttttacgttcttatatgcatgggtttttcattaatactgaattatatgataaagtcaatttaatcagtaatcccaattcaatttatgatcaacgtaaacgtgaaattgctaacaaaatcaatgaagaaagaaaatcaagaattcttactagttccaatggtaatgacttaccaacgaaaattaaagtcaataaagatttggtcaataaattacaaactaaatttgctgaaaatggtactcctgatggtaatgccaatggtgccaccgattatgttgaatcaattgttaatgatgatcgttttagagaaatgtttgaaaaccctgattttgaaattgatgaagaatctcatgaatataaacaattgaatccggttaaatcaaccaaagatataaccaccaccaatactggtactactaattcaagaggaagaggattgactgcagctgaagagtcagatgaagaaagattgaacatgaaagattcacaccacactggattagattcagatgaatcagatgaagaatcagattctgaatctgaagaacaatctgaagatgaagctaaatcagccgaaactagagaaagagtcggtaaggaattgaataaaatacgtcaatcaaaacaaaaacaacaacagcaagattcaaagaaattccaaaatgaaatgaaaatcttatctcaacaatcatcttcatcttcatcatccttggcaaataccgagaaggcatcagtatcatttggctctcaagtaaacaaattaaacaaaatttctaaacagaacaaaaataataatagtattagtaatgctaaagatgctagattacgtcgacatgctcgtggtgaagctgaattgacatttgtgccccaaaaatcaaaatcaaaatcaactaaactgaaatttaataacaaccacagtgatgatgaaaagctggatagtggtaagactaaagatagtggtagaactaaacagagatttgaaggtcgtagaatagcatccaagaataagtttagaggtatgtaa

SEQ ID NO: 697 - DNA, 342 bp, Candida albicans
cagtttttctatcaagtactcaccatgactccatgccccatttggttcaaatataaacacgcatgtggagcatttgtggtgtttatattcttatgggcttcctataatggtgctacttactatattgatgtgtttggtaaacgtcttgagaaggaagttgataaattgaagaaagaagtaatcaatttgcaacaagaaaatgaaaaaataaaaaactcaccagttcagagaccagtgaatggaagcgttgacgatgttggtgcattggatgaagatttaaattcagaactgaaagagaaggaacaagttgaaagtaccgatgataaaggtgtgacaccttga

SEQ ID NO: 698 - DNA, 741 bp, Candida albicans
tcgacacatatctaccatatcaacatagagaagaacccccccccctcctcacacaacatgtcttcattatcaagaagcaactcaactggttcagtaccataccttgacatgtcaaaattgatgtttgccaacgattttgattttggtttaaacctcaatgaaatgaaaaccaaaacgaaacaaaaacttcatactaaaaacttggaattggacaagttacaggaaataatcaatcaaagactccagaattttgataaacgagtccataaacaacttgaaagttcagcgacggaaaaggcgttttatgctacttcggtctttttgattttttgtgccgggtttatcattggtaaatatccaatttactttccttatttccatactgcgttgtttgtggtgttaatgccaattcgtttttacacttactttaaactgtccttccaatattatttagctgatttgtgttattacgtcaacttgttactaatgttgttcatttgggtattccctgaatcgcctaccttgtttgtttcagtgttttctttgtcgttgggaacgttatcgtgggcagtaatcacatggagaaactcgttagttttacattcgatcgacaagactacatcgtcatttatccatgtgatgccaccggttaccatgtttgtgatggtgcatgaaataacccgaagaatatttcaagctgcgttaaccctggtattggtggctattgaaaactgggaactt

SEQ ID NO: 699 - DNA, 1737 bp, Candida albicans
atcaagctggaggtttatctgggttatctaaacgaagtgtttataaattattccctgaaaatcccacctaaaaacttgaaaaacttgattcctatgattgagaacatgtacaataaagcagaaatgagtatacctcatccaatatattatatgtttgtccgttcattaactttaggggataaaatctccgattctcaaatgcaattgattaacaaatatttccaagaaatatcaaaacaaacagatttgaaaattgaccattatgaaacaatgatacttgcatacgtgaaaaacaaccatatggagaagattgatggaattttggcacagatgaaaaagaaaaacattgaaattctgaaaatgatttatacatccatagttaggggttacattttttatcaaaaagatcaccaaagggcattggatacgtttgattcgatgaaattcttatctcagaaaacccaaccagacgaaaaagtgtataccgatgttatagtttcctgtgttatgcatcgagagattgaaagagcattggacttgtattacgaactcaaagataagggtatgaatgtgaatcagaatttgctctctacattagctaagggatgttcaagactgaaacagtttaaaactcaagcatggaactttttgtttcaagtttatgatcatggatgggttccaaatttgcaaacatatgaacatatgctttatattgctgcaagagatggagatgtcgaattaacaagagtacttttttataaaatgcttcaaacaaattcagttactatccgagcatttagatatttgattttgtcctattccaaatatgttccaccacataagaaaaaggaaaaacatttgatcttattaaatcataagggtcagttgtttagacggaatattttacaagatgttgattttagtaaacctgtacatggattccctttcttgctatcttcacatatcccagactcgaaattgtttttggctgaatcaagtgtattttgggcacatacagttatgaacaatccatcctttttaagacaacaaacattggttgcctcatatgtatctattgctcttgaacttggcgattttactgaatttaaagaccgattcgacagtgcctcatatttgaatactgatggaataccaaaagtaagagaaatagaaattatagaaccccggcaagatgaaccaaccgaaaaagcaaccactaccgaggaacaaaatgcgctgagtgagactgacaacaacagtttaatcagatcgccaattcttaaccaacttcaacaaaatatcaacgataatcaatttaaggcaccgcgtgattcatatctttataatcttgccattaaagcagcaggtaaatttaagaattatggatttgcacaggaaatacttcatgaaagaggacaatttagaaaatctaatagttttaaattattatcaccaaagcagcaaaatcaagatgatttccaatttgctggatatttagtggaatgttggacaaatatgaatttattagaggatgcttatgcagttgtattactgtcagtggatcgtttcccatggagttggcgtgaattaggtgttctcaataatgctgctatgaaacttggtagtttggaattggcagaagctgtaagaaaagtggcgcaagtgactcaagtcaaacatcatggaaaaataaaacgacaggatttcaaaacctacgttatgaaacgtggatactaa

SEQ ID NO: 700 - DNA, 681 bp, Candida albicans
tcttacactatactctaccctggtagcttattaccaaatactacaagaatacccgaccattcccctatttcacctccttctgctaacaatagcaacagcagcaacaatagtagtgtttcgggatttccattttcatctacagtgatttctcctagaaatagtattacatcgtttagtaacccaactaagcaactacgggctaacagtatcaacagtgataatggcaacaatagcaatggaagaaggacgagtaattccaattattcaatcacttcaactccaactacgaacaatcgatactcatttagtgaatattccaatgaacaaattattgatttaatggaaagagaacaagatgctattgtcttgaaattaatgaaagaaattgaatttttaaaacaagaaaataaaatgttacgactgactcctggcggtaatagtgctactagtggcacttgcagtcccagtaatagtatgagtagtccttcaacaccaccagttcgtcgatcttcatcattatcgtctcgtcgatcgtcaatcacaaccaataatctcaatagcacatcatttggtgctggtattaacgaaagttcaagaatggggaattgtggtagcggtgctaataatactgcaatgtctgcccctgtatttaattatccatttagagattgttcatctacg

SEQ ID NO: 701 - DNA, 1152 bp, Candida albicans
aaatttgacaagtttacagtgcctacaaaaatggaagctacacttatacctaatcctaaagataataacgcaacaatcctattaatgggtttgcgtagaagtgggaaatcatctatttgtaaagttgttttccacaatatgcaaccttatgatacattatatcttgaaagtacatctaaacccattactgaacaattttcttctttgattgatttatcagttatggaattgcccggacagttgaattattttgaaccaaattatgattcagaaagattgttttcgtcagtgggggcattggtatacgtcattgactcacaagatgagtatttaaatgccataaccaatttactgatgattattgattatgcctataaagttaatcccaagataaatatagaggttttaattcacaagattgatggattgagtgaagattatagaatagatgcacaaagagatataatgcaaagaactggagacgaattattggatttgggagttgaaggagtggaattgagtttttatttgacttctattttcaatcattctatatatgaggccttttcaagaattgtacaaaaactcgtccctgaagtatcatcattagagaacatgcttgataatttggtagaacattcatcgattgataaagtgtttttatttgatgtcaattctaaaatttacgttgctacagattcatcaccagttgatatccaaacatacgaggtttgtgcagagtttattgatatcactattgacttggatgatttatatgttgaaaatgataagaataaaaataatgaaaatggtggcattggtgggaaacaaaaagaagttaaatccataagtcacttgtcaaatgggtcagtgctatatttgaaacaaatgattcgtggtttggcgttggttgcattaataagaaatgacgacaacaaggaaatacaacaagatgatgataacgccattggaattgcgggacagaacatacaaaatgcagacggttcagtcgtcgattcaaaccaagagaaatctctaactgtgattgattacaatgttaatctatttaaaaagtcgttaatgaagatttggaaaaattcaaaattgaccaacaccaatgtcaatgtatcacaacaacaatctatagaataa

SEQ ID NO: 702 - DNA, 516 bp, Candida albicans
caatatattatggttgtggggaagtctaatataatactgcagtcgagacatttgtcttctacttcaatatgcttaagattcaataaaagagcaacaatggacaagactgtgttgttgaacgaagctaaacagtttttcggaccaactaatgtcaaaggtgaacattgtaaaaacaaatttttctatccaccacaaaataatagaccaaattatatagtgaatgatggaagacctttagttggtgatcaattcccaacgaaaagaccaggaagaaattccaataatagagaaagaaaccctacagtacaccctttccctaataatatttacacgaaaactgcatacttgataccagaaaatataaaggataaaattgttgaagatgcaactactaatggattacatcctcaagaaattgctcataaatatagtataaatcttttaagagtagaagcgattttgaaattaagagatattgaaagcaaattcgttccagatgtatgtataaacatataa

SEQ ID NO: 703 - DNA, 645 bp, Candida albicans
  unsure (577): Identity of nucleotide sequences at the above locations are unknown.
agtgacaacaaaaatttctttctaccaacaccaatgaagggccagtcgaagaacggacaccgccgttcaaactcacgttttgccaatgacgataagcggttagtgtacttgacgagcaaagctatggggaaaaagtgtattgccaccatcaccgacggatcgcgttatcaagggttgttggttgggtcggatctttcgccgttgtcggtggttttgttaaagccacagcttgtgggaagtagtttgcttaatgagaagaacaatctcgataagttgccggagaacttgattattcaggccaaggatttgattgatttggaagttgatgtggatttgagtgagcccgtgaagccgccacacgagtttaagaccgatgcggatatttctggaaagatgcagattaaggaacgtgaacttgagagatgggttcctgacgacgaagttgagttgacgttggaggacgacggaagtgaatgggaccagtttaaagtcaaccaagaaaagtttggtgttgagtctagttatgatgagcatttgtataccactcgaatcgatacgtcagcgcccgactaccacngacgtgttgccaaggccgagagaattgccaaggagattgaagtcttcaccacgggtgagaatccgcgt

SEQ ID NO: 704 - DNA, 1581 bp, Candida albicans
aataaaacttattactataaatctagagtggcgactgaaagtagacaagattcgaaaacttcaaccatgtataaacagatacttacatttttgattttatttctcagatacatattgtcggagttcccagacgatccttatgaagatgatgacacatcggacgacaacaatagtgattatgaaggacaaaaatgcaatccttatcgggataaagcttgtttggttaatgatgaagcattagggaaaaagatttttgaatcatttgcagaaggtaccaaatattttaccataacaagttctacaagaggagtcagatttgggtctgaagggttagctctaacaattcaagatgaatttgataatcctgctttggtttcaagtttttatataatgtatgggaaagttgaagcagaaatcaaaggagcagcaggtaaaggtataattagttcgttctatttgcaaagtgacgatttggatgaaattgatgttgttgaaatatttggtagtgacccttacgaatttcaaaccaattttttcatcaagggcaataccacaacttatgataggggaagatatcatgaaatgcatccttctcctttaagtgaattccataaatatggtattgagtggtctccagatttgattacatggtatttagatgataaaccggtgcgtatgctaggacgtagaaacaaacatggattaccttgttcaccaatgtttcttaaatttattctttggagtgtggaagatgatgacgagggcacaattgcttgggcgggaggagcagcctcgttttcagaaggaccattcactatgcacattaaaaatctcaaagtgcaagattattccaaggcacttacctattcctatggcaatttacgcgatggtaattggttggatttaagggctgatggagggtatttgtatgaaggacacaagtattgtcttccaccgaaaatgttggacaaacttaaaccaacaccaaagcaagaaactgatgacgatcaagtgttaacaagtagtaaactgcaaagagtagcaacaacaattagtgaagataaaaacactgtttcgtattatcctccctctgctaccaattcacatacaacctgggatcgattactggaatgggaaactgaacaggatgaaacaggaactgatgatacggaaaactccgacaacgaagaagaagagtcaataacagctatacctatttcaaaactgagaaaagggtcaacaagaaggttagacatttcaacacaattacctccactttcacagaatgaatctaaaattgcagaaattaaaaacatcacaacaaccaaacatatccataatacaacaacttctttgcaaatcagtaaaatcaaatccaagaaggtaggggtcactaccacaatttatagcagttcaacaccacaatcaacttctaaatcacggatgccatataatatctttttcaactatccagggaaagaaaattcaagattcaaatcaggtgtttcaagtatattggccacatctttcagtagtgttgtgattgcagaaattttagttatcgtggtgttgttactatag

SEQ ID NO: 705 - DNA, 1389 bp, Candida albicans
aaaaacgacacacatcatatattaattatgaagttcactacactcgctactatagcatctactttgttatttgctgctaatgctaatgctgacacatgtaacccattaaagtcaagtgattgttctccagttcctgctttgggatcatcatttttagaaaaatttgacaatggcttgggtcctcatttcgaaagtttaaagaagcaaggtactattgactctggttctaatggtttatctttgactatgaaaaagagatttgataatccttccttcaaatccaatttctacatcatgtttggtcgtgttgaagttgttttaaagggggcagaaggtaaaggtatagtgtcgtccttttacttgcaatcagatgatttggatgaaatagatattgaaatgtttggtggtgatccataccaatggcaatccaattatttcattaaaggtaatactgctacttatgatcgtggtggatatcatgatatcgccaacccattgaaagattaccatacttatgttattgattggaccaaagatgcagttacttggtccgttgacggtagtgttatcagaaccattccaaaggataatgcacaaggtttcccacaatcaccaatggccatttatgctggtatttgggctggtggtgatccatctaatcaaccaggtaccattgactgggctggtggtatcactgattactctcaagctccattcactatgggtattaagtctgttttggttgctgattattcttcaggcaaacaatacagttattctgatcaatctggttcttgggaatccatcaaagccgatggtggtaaagttaatggaagatacgaccaagcacaagatgatatcaagaaattggaaagtggacaatctgttgactccaatgatagttcatccagtccatccgcctcttcttcagattcatcaagcacatcttccgcatcatccagttcttcatccagctcaccttcatctaccacttcatcatcatcatcatcatcttcctcctcctcttcaagctcttcttcatccagcgaaaaatccaatgcagttccaagtgcttctgtgattgtcttcattggcactaaaggaggtgataagactaccgttaccagttcttcgggagtttctgttcctacatctgcatctgtttccactgcagctggtactactagtgggcctgcaaactctgctccagcttcagctgcttcaagtactgcctccactgtgtttatctcaactggtgatgccgctccatcttcctctgcttcagaaaaaccttctgttctgactactgaaaataacggagccgttagtgtcgctaaaactacctccttttttggctttgttgcattgattggtttcttatttgtttaa

SEQ ID NO: 706 - DNA, 1176 bp, Candida albicans
cataaaatgtacagtttcactttcactatcacttttatatatatatataaactctttacattttttgaaggttatttcacattcattttctacgttaataatccccccccctcccccgccatgacagactattccaattcaaaatcattatttttgggatttgatttatcgactcaacaattgaaaattataattactgatgaaaaccttactccattagatacttataatgttgaatttgattctcaattcaaatctaaatatacaaaaatcaataagggagtaattactggtgatgatggagaagttataagtccagtagccatgtggttggatgccattaattatgttttcgatgaaatgcaaaaaagtaaattcccctttgataaagttgttgggatcagtggatcaggacaacaacatggatcggtttattggagtggggaagctaatgaattattaaatgatttaattccttgtaaagaattatctagtcaattacaagatgcattttcatgggggtattcaccaaattggcaagatcattctactgtgaaagaagcagaagatttccataaagccattggtaaagaacatttagcagaaattagtggatctagagctcatttaagatttaccggattacaaatcagaaaatttattacgagatctcatagtaaagaatatgaatcaacgtcaagaatttcattagtatcatcatttgttactagtattttgttaggagaaattgctccattagaagaaagtgatgcttgtggaatgaatctttatgatattcaaaagagtcaatacgatgaagaattgttggcattagctgctggtgtacacactgaaattgataatgtttctaaagaagatccgaaatataaaaaatcaattgatcaacttaaacaaaaattaggagaaatttcacccattacatataaatcatcagggaaaatttcaaaatattttgttgatacttatggtttcaattctgattgtaaaatttattcatttactggggataatttggcaacaattttatcattacctttacaacctaatgattgtttaatttcattagggacttccaccacggtattgatcattactagtaattatgaaccgtcatcacaatatcatcttcaccacggggctggaagatccgcgtcc

SEQ ID NO: 707 - DNA, 645 bp, Candida albicans
gaatttatttccccttggggagaaattatccctcaagcaccagcacaaaccattagagctgtattggaagataatggagaaattactccttgtgaattagatagtcatggtttcactgttgatgatgatgcctcagcaattgttgattctcaaacattaagttgccgattaagagcaggaccaatgttaagtaaatcatccaccactaagaatgggaaaaccaactcctctgaggagttacaacaattatacgacaatttggtggataaatttggtgaattatcaactgatgggaaaaaacaatcatttgaatcattaactgcaagacccaatagatgttattatgttggtggagcttctaataatactagtataattaccaagatgggatcaatttttggtcctactaacggtaattataaagtagaaattcctaatgcttgtgccttgggtggtgcttataaagctagttggtcatataaatgtgaattagaaaataaaatgattggttatgatgaatatattgggaaattatttgatactaatgatgaattagaaagttttaaagttgatgataaatgggaagagtatttcactggtgttggaatgttagcaaaaatggaagaaacattgttaaaacaataa

SEQ ID NO: 708 - DNA, 1059 bp, Candida albicans
  unsure (31),(47),(49),(58),(160): Identity of nucleotide sequences at the above locations are unknown.
gtttcagataaatgttccattgttccaagtnttattgatccttcccntnatgcgaaanagaacaacccacaccataatatcaatggaaaagatgagttacaattttttgatgcacccaaattactgattgctaatgatgctgattcaattagtgatttgnataagaaacaaagtagaactggatcaattattggtggtgttggtggcagcagagttgaaaaattgaaaagactttctacaactatttcgtcaaaagaaggaccaattagtagacgaggatcattgctttataatagtgttcaacagaaaatccgtaaatctgattccaaaaattcagtgaacaaatcttttgcagcagacactagtgaatcaccacagcaacacctagaagatgaaaatttacattttaatcaacataaattacagacatatccagaggagcaacaaatttcaaaaccactgaaaccagaatacattaaagaccctccacgtcatcaacatgataatttaattgaacggaaaatattacaacaagtttggttatggacggcaagagtatttttaaaagttggattaattgatgaatgtgaacaatgtattgttgaagcagaaactatttatgaacctaatttcaaaacctatactgctttgggatttttgactagtaaatcaagaaaatttttatcattacaagaatttgaacgatcattagaaatattaaccaagaaagataattccttagcgtcacataataaattcaatagtaaatatgattatggattaactttattaggattactgaaattatttttaattgatgatgatccaaaaaattccttatttatttcgacaaaagatttgaattcaggtataattcgattgaaaaatttattagaagattactcattgacttggccatatggatataataatccagaaatttggttttatttaagtaaaatttacgaatttattgatgataaaatattattgacgaaaagtttatggagatgtactgaattagaagtcttcacaacgccatgggcgatccatgtcgag

SEQ ID NO: 709 - DNA, 897 bp, Candida albicans
ttgaaagtccaattaactacgatgacaagcctggaaataactcaggaggctatatttattggtgccaataagcaaaattttgtttcagattataaccctactaataacattattgcatttggtgctgcaaatatagttgcactttggaaccccttgagcaaaagtcataatggagtgtaccataccttgaagaaacacgagagtgaagttacaggtgtaaaattcattccaaatagtccttatttggtatctattggggaagatcatattgtaaatgtatggagagaaaacgggaaactgtacgagtttgttcaatctttgcaagatcatactcattcagttacttgtattgctgttataaatgagaatatctttataacaggtggatctgatcacaatattattatttgggtattcaatgaagcaaagcaagagtttgaatacgggaataagttccaagtaaaatcaaattatttcccattagctttagcacttcaagatattgacactgacaactacttagttgctgttggtggtaccaataacaatatatacatctacacttttgaagttaaagatgggaaagtttctgcattagagaaaaaggctgaattaacaggacatgaagattgggtcaaatgccttcaatttgtcactgaagaaccacataaaaactatatactagcaagtgggtcacaagatagatatgttcgtttatggaggttgaaattgaatgatttaattgatgattccgatgaggatccaacaaaattggtgttattgtcaaataagcagtataagtttgaattggcaaatggatcaagggcggcattcagttttgaagctttgattatgggacacgatgattggataagtgggtcttcagccacgggatag

SEQ ID NO: 710 - DNA, 915 bp, Candida albicans
  unsure (706): Identity of nucleotide sequences at the above locations are unknown.
caactaccaataacagcttcattacctgttttgggattatcgaacaaagcagaaaatcagatagagcaaggagatcaacaagatgttgataatgaagataacacaccagaagctgctgaggatgttttggcttcacttgatctgccaccagttgaggagtacttacaaagatatacgttgttccctgaattggagaaattgtatggtcatggttacgagattagttgttgtgctacatctccagatggtaagttgattgcatcggcatgtaggtcaaacaatgccaaacacgccgtgatcagagtatttaatgttgctcaagattatcaacaaagtcagcaagttttactgggacataatttgacaatctcaagtcttgaattttccccagatggtaaatatttgttggcggtttccagagacagacagtttagtttatgggaggtgattaacgaacaatctggcagtttcaaactagtagaattgaatccaaaggcacatgcaagaatattatgggattgttcatggttcccagttggcgattcttttaccactgtatccagagataaacaaataaagttgtggaaagtttctaacgacaaggttgaaatggtggtttctactaaattaaatgatgctatcacctctgtatcagtttacaagggtggtctctttaacaaccaggccattgttgcggtcggactanaagatggaggaatttccatttttgctgttgatgttgcaaatcctgaatttagactaatttcaatagttgataaagaacttactccttcaaatagaattgaaaaattgagctttagcaacaaacttcataatgggaaattgcttttgggtgttgggagcaaagatacttctgctcgtttatatagcattgatctgaccatttttacatag

SEQ ID NO: 711 - DNA, 627 bp, Candida albicans
ttgggaaatgaatttaaataccaagttatgataaagggagcatttaatggtataggtgatcgatctaaggacaagtatcatacattaattgaatcaccaatagatataattatttttgaaggttggtttaatggattttattcattagatcctaccattttacaattaaaatatttaacgtcatcaccatcaccatcaccaacaccaacaccagaaaacaacaacaatcatatatcattacaatcgtttaaattatatgatttacaagaaatcaataaaaacttacaaaattatgaatcattaatttggtcatttttcagaatttctataatttttcaaactgatcaaataaataatgtatatccttggagattacaacaggaacatgaattaattgccacactacagccacaacaacaacaacataaatccgttgaaggaacatgtgaccaagttggtatgataaatgatgatgaaataatcaaatttattgatcgatatatgccaatttatttattatattatgaaaatttatgtgattatggaattaaacattgtaaaaatttgattatatcaattgattttaataggagagttatcaagaatcgagttttaaataatgtgtaa

SEQ ID NO: 712 - DNA, 471 bp, Candida albicans
acagaagtttttcttaggaaactagctgctcagaattacatcaagtacgatctgggcacggaattcattgatacaattgatgacctaccagatgaccctgatttgaaaccattagatgacaagttacgtaatagaatcgaaaatatccgtgatttggttttgtatagatttgggtccactggtgtggttcagttgcttcaagctgcagcagatcttttgaacttggtgccagtttacccagttcgaaacatccacaatttttcaggaaattcaggtgactatgttttccgtgactgtttattagtgaaaaaaggtacatctgtgactgctgtagcaagaaaaatcatgggtgatgtaacaattgcagctgtggaaggtgttggtggtattaagataagtgaagatgacacgatcgacaaaggtaaaaatgacattctatcctttaagatagttccaggaagtcataactaa

SEQ ID NO: 713 - DNA, 1035 bp, Candida albicans
atcgtacacaatatctctcaaatgtctgaagaaggagctcatattgataaaaaagctaaaatagaagatacagacatgtctgaagaaagtaaccaacaagtgttttccactgtgggagaacaagctcaagaagtcgataacgctattaaacaaaccggagctgccgatgctgaaggacacccagttcaagaagttgaatctttatgtatgaactgtcacaagaatggggtaacaagaatgttattgacaagaattccatattttagagaagtcattataatgtcattcgaatgtcctcattgtggatttaaaaatagtgaaattcaaccagcagcacaaattgctgaaaagggggcaagatacgttttaaaagttgaaaacaagaaagatttcaatcgtcaaattgtcaaatccgaaactgctacggttaaattcactgaattagatattgaaatcccaccgaaaagaggtcaattaatcaatgttgaaggtattttacaagaaatgattgatgatttagagtctgatcaaccacaaagacaaaaagttcaacctgaagtttatgaaaaaattgatcaagtgataagcaaaataaaactgttcatcaattgtgacccaaatactgttccattaacggtgacagtcgatgatccagcaggtaattcttggattgaatatgtcccaggtgaaccaactcataaatgggccatgtacgaatataatagaactgctgaacaaaatgtgtttttgggattgatttctgctgatgacgttgctcagcatagacaagccgaattagccaacaaaaagcaagccactgattcaaacatatcatcaaacttgaacaaagaacaatcacaatcacaatcacaatcacaagaagaacattccaatcctcatactactggcttcaaatctgatgcttcggaaattgaaaatttcagtaatgaagtccaaacatttgctgccacttgttcctcatgttataaaccatgtgaaacccatatgtcttcacccggcgtgaagaacacctca

SEQ ID NO: 714 - DNA, 327 bp, Candida albicans
atcgatagaaccacggccatgagtgtgttgaaagtgttaccatccaaagcaagattggcagaggttaggaaaacttcctttaaaatatttgatcagttttggaatcctaatgcaaagagaaaccccaataaaatattaagagcacctttgaaaggtccagaatatgtgaaatattacggtgataataatgctgtacctacattcaaagatttcaaaaaatggtttcctcaattaaaattagtggatcctagagaagcacatagggtatttatagttgcagatagaaaaagaagaaataagggtgctcctaagaagaagaaacaataa

SEQ ID NO: 715 - DNA, 729 bp, Candida albicans
aaacgaaatttcatcgtcaatagtcatactacttcatccaggtcaaatcatagcaatggcagcaatagtaataacaatcatcgtaataatagtacaggcagtaatggatctgtttcatcactgggatccaataatgaaacaactttgggttataaatcgacccataaatccgcatccggatcaggatcaggatcaggatcagggattggtcatatatctatgctacatagaacaaattatcttgcattaataggaggaggagaaaatcctaaattccccattaataaattaattatttgggatgatttaaaaaggaaaactagtttactgttagaattcgatactccggttttaaatgtattattatctagagttcgaattattgttgttttaattgatcaaattatcgtatatggatttgctgctccaccgaaaaaatttcaaacttttaatacgattaataatccattaggtatagctgatttatcagttaatagtcaacaatcaaatgttcatttatataataattattccctgaatctggcccaagctcaagtactgggaactactactacaacgcattatgatttttcaaaacggaaaagtttatcaccaacaaattcatcaaattcatcaagcacttcattaaaagaaaatggaaccaatttaactacgtatccatcaccaattatcaacaacttcagcttcagcttccgtaggatacaataa

SEQ ID NO: 716 - DNA, 756 bp, Candida albicans
tcaatggaaatgggatcatcttatcaaaacattagcattccaggtcgatcaatgggacagatccaaattgttgatgttggcaataatcaccatagtggtactaacattaaacctacaataaatattattaaagctcataaactgaatattcgatgtttatgtctcaatagaacggggacattaatagctagtgcttctattactggaacaataatccgtattcattctactagaacaacggcattattatatgaattcagaagaggtatagatcgagccattattacatcgatgaaatttagtcatgatgatagtaaattggcagttttatctgataaacatactttacatgtatataatattgatgaaactcaatatccaaatgatggtggcagtggtggcacaaaagatggaggaggaggaggaagaggactgaaaaatcgtcatcatttattgaatggattattaccttatttaccaaattatttccaaagtacttggagtttttgttctgttaataccaataaatatcatacttccgatttggaagataatctgcaacaacaacaacaacaatgggttgcaaatggtacaggaggaggaggagttgatgaaggagtcattggatggagtggtaatgatagtataataattatatggaaattgaaaaaaatttgggaaaaatatgttattgttgaaacagaaaatcatcaatatgatttaatacgatcaagttggaaaagacttgatagttaa

SEQ ID NO: 717 - DNA, 453 bp, Candida albicans
gtaatacacacaaatcttgcactaacaacaatgagtaatgctaaccaaagcaataaatttgccattcatgatgctattaaagaaggcaatactttattagccaagaaattaattgatgaacaaccagcaagtaaattatatatatcagatgatgatgaaagaactccattacattgggcagtttcattcaataaccctgatttggtacaatacatcttactgaaaactcccaatgatttagatattgatgaatatgttgatggtagtggatggacaccattacatattgctgcctcattaggtaattctaccattttcaatcaattattgagaagagcaaacagcagcagcaccaccacttctaacaattctactcaaccagaacttgatgttaatttacaaactaattccgggactacatgtttacatttcgctattagtaacgatacttaa

SEQ ID NO: 718 - DNA, 444 bp, Candida albicans
tctcgccggttgttgaaaatttggactgcggacttaaatactcaaaccctggcttttaaaaatgaattaactacaataaaatccgaaatcaattctttaatatatgaaccagtcttacctaatttgatttatattttaactttgactttaactgggagcatttttgttagacaaagaaatattggtattagatttattactcctatattatttggtggattaagtttaaaatatttcatgccgagaacatttgaagctattagtgaaaaatatgataatgtggaaaaagaaaacttacctcaattatatgagcaaagacaagaattacaaataactttgaaaaattggggcaatgatgtcgatcaagggttagaacaagctcaagtgggtgtttatcaagcagttcatgattttagaaaattggtaaaagaaaaatgggaataa

SEQ ID NO: 719 - DNA, 639 bp, Candida albicans
tactcctccacaatggttaaacgttcattttatgaagatgatgaatatataataaacaaaccaggcaccacaactgccattacaccagaattggctgaacaagaatcggttcatggtcaagcaacttttattgatgggatggtgattagatcaacaccaattttagaaaaatatgccaattcaataagacattatttacacgataaattatcaatttggactgctgaattagatactcaaaccctggcttttaaaaatgaattaactacaataaattccgaaatcaattctttaatatatgaaccagtcttacctaatttgatttatattttaactttgactttaactgggagtatttttgttagacaaagaaatattggtattagatttattactcctatattatttggtggattaagtttaaaatatttcatgccgagaacatttgaagctattagtgaaaaatatgataatgtggaaaaagaaaacttacctcaattatatgagcaaagacaagaattacaaagaactttgaaaaattggggcaatgatgtcgatcaagggttagaacaagctcaagtgggtgtttatcaagcagttcatgattttagaaaattggtaaaagaaaaatgggaataa

SEQ ID NO: 720 - DNA, 639 bp, Candida albicans
cttactgctactaatatcactacaccaataagtgatataaaagataatcaagcaccaccaccttcttcttcttcttcttcttcaagaagaaaatcattagttggattaaccgatgaagaattaatggctcttgatccacaatttcaaactacaaaatcgaaaaatcatgatttaaataaatttaaatttgataatcaaaaaacatattatttatctccaagtacaagaaaaggttccacaacagataatactatggggaatgttggagcaggtattaaacgaccagattatcctactagtaatgaaaataattataaaagtattagtttaacagtaagatatggagaaactactcataatgattatactcgtactttattaacaataatatctggaagaagacatacttggcattcattagattggttatttcatattaaacaagatttacaaaatcaaccaacattattagctgatggtgattatttagtaatagcaggtttaatccccataaaatttattaaagactataataataataataataacagtaccaataaaaaaaggaaattagcagtggaagattatttatatcaaaaatgttctaatttattaaattatttaatggaatatatttct

SEQ ID NO: 721 - DNA, 1971 bp, Candida albicans
tttatggctctctttaagttaggtggtaaattaaagaaaaaagaccatcaactggaccctgatactacagtttcatcttcctcatcaaccaattcagcaaaccgaaaatctacaagcaggttttccagcattttgcattcctcagcagctccaatgccactgatttccaatcaaccagcccacacctcaaggccaccgcctcacgccaacttgtcagtgacaaccccatggaaccggttcaaattatttgattcccccttccccagataccgacacgcagccgcatctattgctagcgaaaaaaatgagttgttcttaatgggtggattgaaggatgggtcagtatttggcgatacatggaaaattgtcccgcaaatcaaccacgagggcgatatcatcaactatgtcgcagaaaatatcgaagtggtcaacaacaacaacccgccagcaagagttggccacgctgctgttttgtgcggaaacgcatttattgtctatggaggtgacactgtcgataccgacacaaacggattccccgacaacaacttttacttgttcaacatcaataaccacaagtacaccattccgaaccacattttgaataaaccaaatggaagatacggccataccataggagtgatatcattaaacaacacatcgtctcgtctttacttgtttggtggtcaattggaaaacgatgttttcaacgatttgtactactttgaattaaactcatttaaatcccccaaggcaacgtggcaattggtcgagccattgaacgacgtcaagccaccaccattaaccaaccattcaatgtctgtttacaaaaacaaggtgtacgtgtttggtggagtctacaataatgaaaaggtttccaacgatttatgggtgtttgatgccattaacgatacttggacccaggttacaactaccggagatattccaccgccagtcaacgaacactcaagttgtgtggctgatgatagaatgtatgtgtatggtggtaatgatttccaaggaattatttacagctcattgtatgtgttggatttgcaaactttggagtggtcactgttgcaatcgtcagctgaaaagagtggccctggtccaagatgcggtcactcgatgacattgttaccgaaattcaataaaatccttatcatgggaggcgacaagaacgactatgttgatagtgatcctcacaatttcgaaacatatgaatcattcaatggcgaggaagttggaactatggtttatgaattggacttgaatataatcgatcacttccttgccgcaagtgcacctgttaatgccccaaccattattccaccggttgcctcttacgaagaactcccaaaacccaagaaacccgctgcttctgctagaaatgatctccaaggttacgaccgtcatgcaagaagcttttctggtggtcccgaggattttgcaaccccacaagcctcagctcgtggctcgccatcgccagaaagaacacaaggtggtggcgataattttgtcgaagtcgacttgccttcaactactatttctcaagtcgacgatgatccaccatacgatacaacttcgttgaaccaaccccaagaagtgacaaatggccatgttgacgacgaaccatttagaagaagatcgcttgatcccaagtttgatgatcatagtggggcaccagaggttgcaccagtcgcggtacctgtcacggaaccagtctctgcaccagtcactgcaccagtcgcagaaccagtggtcgcaccagcagttgcacctgacgcatctggaaaagttaaaaagattatttcggaactcaccaacgaattggtccagctcaaggccaccaccaaagaacaaatgcaaaaggccacagaaaaaatcgaacaattggaacgccagaattcgttgttacaccaatcgcagcagcgcgatgctgaaagtcacacctttttcatcctacggaactag

SEQ ID NO: 722 - DNA, 534 bp, Candida albicans
tctaatatcctagagtttacaacgatggctaaaaaaagaagagctgctatattgcctaccaacattattcttttacagaatgttgtgcgtagagatcctgaatcataccatgaagaattcttacagcaattttcccattatgaatctcttcgagatttgtatttaattaatccgaccggtgtggatgctaactctacaaccgagattattgatttaataggatttatgtcagctgtatgtaactgctatccaaaagagactgctaattttcctaatgaattaaaagagatattattaaacaaccatcgtgatttaactcccgagttacgtgagaaaattatccaatgcttgacaatgttaagaaataaagacattatatctgctgaaatgttgatacagacaatattcccattattaattactagtaatgctggacagcaagtgaagcaaatgagaaaacaaatttattccactttgattgcattgttgaaatctgttaatacaggcacaaagaaccggacatggaacagatct

SEQ ID NO: 723 - DNA, 651 bp, Candida albicans
ggtaatcatatgcggtgctggccatcccgaggtgaggacctgggccagaacaagaactttgagaaaggtaaagcaaaaataggtaaagcagaagataacgaagatgaagtttctgatttagagttgtcatcagatgacgacgatgaagatagcgaggagaacaaagatggaaaagcagttgctgattcagaagaacctcctaccaagaagcaaaagatcagaaacgaaaatgcagatatcaatgccgaacaagccatgaatgagttactttccagcagaatattgacaccagccgatttcgccaaattagaagaattaaggacagaagcaggtgtatcgaagattatgggtatttcaaatgaagaagctgttgattctacttccttggtaggtaaagtcaaatacaaacaattgcgagaagaaagaattgctcatgctaaagagggtaaggaagatcgtgagaagtttggctctagaaaaggtaagagagatactcctcattctactaccaataaggaaaaggcaagaaagaagaattttgtcatgatgattcataaaaaagctgttcaaggtaaacagaaactttctttacgtgatagacaaagggttttaagagcacatataacgaagcaaaagaagaaagggttatag

SEQ ID NO: 724 - DNA, 774 bp, Candida albicans
ttttccagccggctggtcgaatacgtctttttaggggctgacaaggaaagggaagacaattttgaagaaagttcagatgaagatggtttcgatatgaatgagttgagacataaaatgcaaattaataaaaagacatccaaaagaggtaagaagttggagcaagctgtaaaagccatgaaaaagaagaataattccaaacattcagcaacttacttgaacttttctgccattcatttattaagagatccccaaggctttgcggaacaaatgtttgataatcatttgagcagtaaaaattccaataaatttgatttggatcaaaagattttgtttatgaatttgatttcaagattaattggtacacataaacttattgtgttgggtgtatatacatttttcttgaaatatctcactccaaagcaaagaaatgtcactcaaattatggctgccgctgctcaagcatcacacgatttggtaccaccagagtcaattcaaattgtcgtgagaaaaattgctgacgaattcgttagtgatggtgttgctgcagaagtagcatcagcaggtataaacaccattagagaaatattagccagagccccattggctatcgacgctccgttattgcaagatttgactgaatataagggttcaaaatctaaagcagtgatgatggcagcaagatcattgatttctttgtatcgtgaagtaacacccgaaatgttgttgaaaaaagatcgtggtaaggtggctagcataaaaatgcagaaagggtga

SEQ ID NO: 725 - DNA, 744 bp, Candida albicans
gaattaggtgtcgcactatggttgtgtccgaaacgaaacacaccgacgtatgataaattaattactgtcatgagttcgttgaataccctatttccagggctgccaccaaagtttgagcctcatattaccattactacgaacataagtttggatttggcagaccaaagcaaaaccaaagatgatgtcgacagaattttatcagcaagtgcagttgcaatgaattcattgccaaagaatcatgagagtttggtgaaattaggaaatgtcaacagtcagcgtaagtttttcaagaaattgtactttgaggtggaaaaagatcccaatttggtgtcatttgccaggataatccgtgaattatttgttattgttccacaagatatcgagaaagaaaacatcaagcaaaatccccaattatatacaaaggacaataatggaaacacaataaggcggaagccactgaaaaagaaaagtaaaacaactgaagtcaaagagtttgatacatccttcattcgacaagcagctgcatacaaggcagcagagtggtcagtacaagaatttgatcctcatatctcattggtttacagtgatttatggccattacacagtgccttatggagaaacatcaatacacgaatactggatatagactgggatattgagtgggaatttggtgttttgaaattagtgctttgtgaaggtgatgtgaatgactgggtagttttaggaagtgttgatatacactaa

SEQ ID NO: 726 - DNA, 498 bp, Candida albicans
atgattcattactgtcaactctccagtaattccacatcccatcctattcttatcatgtctagacgatcagaaatcagacaaaaacaagaacttcaggcacgattccaattagccatgtctgctaataatcaaaaggcattaaattggctaaaaccattgaaatctactgcttccaccacatcgacatcatcagaaacccccaatgcgaataatcccacttctgatgattcatttatggatttacaaattattcctcaaggtgcaagtctatcgaaattggacaatttacaaaaaattggggattttataaattcaaaagatataacaaaaatgaaacaatcaacaacaacaacaacaacaacaactgcttcgaatttaacatccaatagggtaactaaatcaaaaccaatgttggcattaatgaataaaatgagagacagtaataggaaaaatgttcgacaaaaccgacatcatcatcaacaacaacgacactcgaca

SEQ ID NO: 727 - DNA, 1104 bp, Candida albicans
tttattctcgaggagttgtcggtgttatatcaaaaagagaatactatagaatatatggcagaagaaaacatttcgttttcccaaaggatgataagtgcctgttctggctcgcttgtgacatcacttgtggtcactccattcgatgtcataagaataagaatccagcaacaaagtattctaccgcaaggacagccatgttgtcaattacatttcccagagcataatttcccaaaacaaaaggttcctgttgaaatggccccagaattattttggatacatgataaatattgtcaatctgctgaatcttgcacccgtatatattctacgtttcaggggttcagtacagtggcgaaacatgaaggagttcgaactttatggagaggcttatctttgaccttattgatggcagttccgtcaaatatcatttatttcacaggttatgaatatatcagagatcattccccaataagcaaccatcctttgaatccattattttgtggttctttggctagaactttgctggcaacctttgtagcaccagccgagttgatcaagactagattgcaatctatacctactgatctgaaatccgcatcgcatatattattcaatttattaagagatctgagtgcagctgtcaagaaggatggtgttagaactatgtttaaaggtttgggcattactttgtggagagatgtaccattttctgggatctattggtcaagttatgaatatttcaaagcttttttcgctcgaactttgaagactgactttaataacccaacaagaggtggaattgatgattggaaagtgtttgccacttcgtttttatcagggtctatatcaggaacaatagcagcttttttcactaatccattcgatgtcggcaaaacaagaatacaaattacaatgcaagaaaacgagaaaatttcccatccaaatatgttcaaatatttatataagatttacaagaatgaaggaatgggggcattatatgctggatttggtcctcgtgtaatgaaaattgccccagcgtgtgctatcatgatatcttcttatgaagtggggaagaagtttttcaagaatggaaataactcgaattaa

SEQ ID NO: 728 - DNA, 654 bp, Candida albicans
agggcattttgtcacatctttttatttaacgttttagaattagttttattccatgagttcctaattaaagttttaaaaactactggcattctgtttataatgctttcatttaaaggttggaaggttcttctcagtatccctattaagttattggccgtcttacttaaatatccatttgctggaggcgtaaataaaaaattcaaatatgatttactcaattcactcaagttgattctttatcgaacggctttacatatgcctgttagagaaagtgcgttgttgtcaattatgtcaaaccattttatcattaataaattaatcaaaaatttgtatcctacattgacaaaattaccaagctatggtaaaaaatacgataagcaaagctactggcttgtgaagaacagagacagaaaaccaaatgatccaatattgattttcttgcatggtggggggtatttttttgaaacaatgccctgtcagattgaatccctattgagtatctatcatgtgttagatgcaccaaaaagaagcagtttgtcaatattagttttggattacaagctagcaagtagaggatacaaaatcccgtatcaacttacccagttgattgaaacttatactaatttggtgacggatggtaacaccaatatgaca

SEQ ID NO: 729 - DNA, 1122 bp, Candida albicans
ttttattttattttatttcatttcatttcacttcccattatgttaacatttaaaggattattattaatattattactcccatcaagattattatcatttataattaaatatccttttatcaaaggtattccaggtaaatatcaacataatttttcaaaatcattatttattaaattatgtcgattaattcaattattaccagtatctgataaaggtacattaaattttattctgacaaattttttattaaataaaattatgaaattatatcacacgagacattttttaggcgaattaaataatttcggtaagaaatttgatgatcaaagttattggattcatgaatcacctaatagaaatagaaataagaataaaagtgatgatccaattatagtgtatttacatggtgggtcatattattttgataattcattgaatcaaatggaaagtttgataggaatttatcaattattacaaaacaccaccaccaccattaatgatgatagaactagtgttgagaggaagaaaaatttatcaatattagtattggattataaattagctagtaaaggttataaaatgccttatcaattaaatcaattaatttccacatataaaaatttaatatatcaaggaaatactaatttaatattaatgggagattcagctggtggtaatttagcaatcacttttcttcaacatttacgattaaccaacaacaacaacaacaacaacagccctgcaaatttaccttatcctaaaagtttaattttaattagtccttggtgtaaaattgttcctgaaatatctgattatactaaaggtcattcaatgtatgataataatcaatatgatataattgaatggaaagctgttaaaaaattaattgataatacatcaccattaataagagatgatttatcaccacaaaatttaataatttcacccgggaatttaccttataacattgatgattggattgatattgatactttacaaaaatcaaattattcaacatttgtaattatgggtgaatatgaaactttacgtgatgatatattaaattggtgtcaatatgctgtcaattcaactttatcactgcctataaaacatacacaatga

SEQ ID NO: 730 - DNA, 1152 bp, Candida albicans
ttttcgagtcaaattatacttatcacaataatggggcatctagaatataaattgattgaaatttgtcttcaatttcaatatcaattaattaaaacttcaattgaattcatcaaaacactcctgacactatttattatgatttccttaagggcagtaatcgcacttattcttttaccacttaatttattatttgttttaatcaaatatccatttttcgggggtgtaaaccctatatacaagaatgatttggtcaattccttgaaattaaccgtttatcaagcattaatcaatttcccacttgatgatgttcatattttttcaataatttctgctgaatttgttatcaataaagctgttggtaaattatatcctggtttaacatcaaaattaccaaattatggtaaaaaatttgataaacaaagtttttggctcgttgaaaaaccaaatagaaaacccgatgatccagtattgatttatttacatggtggtggttatttccttggtcttgttcctcaacaaattgaatctttagtgacaacttatcatttattagacccggtaaaacgtgaaaatttatccattttagtattggattataatttaacttgtcaaggttatccaattcctcatcaattgtctcaattagttgaaacttatactaatttagtcaaagaaggtggtaaaaactttttattaatgggtgattctgctggtggtaatttagctataactttcactcaatatttaagattatcaaatagttcaaatttaccatatccaaaatcttctattttgattagtccttgggtgaaattaattgctgaaacttatcaaaacactccagggcattcatattataattattcatcgggtgatgtgactcaatatgatacattatctggtgctgaagtatatcaacatattcttggtactgaaactaaacttaattccttaactgtctctccaggtaattgtccatatgattccaaatattggcaagatattccaacttattatccaccaggtcattctgtgtttgttactcctggagaaaataaaattttccgtgatgatattttggaatggtctaaatatgcattgaattatccccttgatgaattggaatttccaatattcccatggggaaattaa

SEQ ID NO: 731 - DNA, 1287 bp, Candida albicans
tggatcattaaaagttcatttatatatacaaggtctatattactgttcattatgatttctttaagggcaatatttgcaattatcagcttaccaatcaaattgttatttgttttaatcaagtatcctttttttggaggaataaacagtatgtacaaggatgatttatctaattctttgaaaatgattctttaccgaacattaatagatttcccgaaggatgatgttcatattttcgcattaatgtctactggatttgttatgaatagcgtagttggtaaattagattcttcgttaacttcgaaattaccaaattatggtaagaaatttgataagcaaagttattggattgttgagaaaccaaacaggaaacccgatgatccggtattgatttatttacatggtggtggctattttcttggtattgttcctcaacaaattgaatcgatggtgacaacatattatctattggatgcttccaaacgtgaaaatttatccattttagtattggattataatttgacttgtcaaggttatccaattccccaccagttatctcaattagttgaaacgtattccaatttggttaaaaatggagctgagaatcttttattaatgggtgactctgctggtggtaatttagctgtaactttcactcaatatttaagattatccaatagcgttaatttgccgtatcctaaaagttgtgttttaattagtccttgggttaaattgattgcagaaacttatcaaaatacaccaggacattcatattataattattcaaaagttgatatgcttcactttgatacattttcaagtgctgatttatacaaacatattcttggtgatacaaaactcaattctttaacggtatctcctgggaattgtccatatgatccaaaagattgggatgatatttcaatttataagcaaccaggtcattctgtatttgtacttgctggagaacatgaaactttccgtgacgatattttggaatggagtaaatgtgttttggattatcctattgataagttggatttcaaagactctaatggtgaatttgatcccaaagctcatagatatattagaaacgatgcaaattcagcttatgttgatgttaccattgttccttggggccctcatgattacttatattttgatcattcattgattggcaaattgaagctggaacctacgttgaaactcaattcaatcaataagaggaaatattttgctactataagtgtagtcaatttcctcaacactgtgttaccaggaaaaaactaa

SEQ ID NO: 732 - DNA, 1254 bp, Candida albicans
aagatgatttcgatacaaggtttagtaattcttcttagcattcctatcaaattattgattgtattgttaaagtatccatttgttggggggatcaaccctaaatttagaaacagtttgattggttccttcaaaatgactatctacaagacagcattgaccatccctgtcagagacagtggattattctcaattatgtccaattattttattattaacaagttgatcaagaccttgtatcctacattgacgtccttgcctaattatggtaaaaaatacgacaaacaaagttattggctcgtggaaagcaaagatagaaaaccaagtgaccctgttttgatctttttgcatggtggtggttattttgttcagaccatgccctcacaaatagagtcattgttgagcatttatcatttacttgaagagccccagaagagcaagttgtcaattttagttttggattataagttggcctgtcatggatacaaagttccttatcaattgacagaattaatcgacacctacaccaatttggtaaaagatggcagtaagaacattttgttaatgggtgattctgctggtggcaatttagctttgattttcttgcaatctttaaaaatagacaaattgagtttgccatacccgtcaagtgtattattaatcagtccttgggttaaacttgcacctgataatttccagaatacacctggtaattcatactatgacaacgctgctcatgacatgcttccatttaatctgcattccagtgaattgttagaatctcttttgggagactcacgtgtatactctttaaccatttcaccaggtaactgtccttataatgaaaccgattggaaagacattccttcattgaatcatccaggctattctgtttttgtgattaccggagaacacgaatgtttccgagacgatattttggaatgggctaatcattcattacaatgtccattgacaccacaaaaaggtgattcccaaggtcgtttcaatccaaagattcatcagtatattagagacactccggacactgcttatgcagaagttttgatagaaccatgtggtgttcacgattctgttttgtattttgaaaacagcattatatctatacttaaaaataatcctagattgaatgcaaaatctttggataaggtagagtatttcggaattactaaagttgtggatttcttaaacaagacattgtcaagtgaagagaaaaaaggggtaaagccattgttatag

SEQ ID NO: 733 - DNA, 1071 bp, Candida albicans
attttgcatgttaaaagaacccccatttttgcaataccacccacagcgaacatgattaacaaaagaatatgtaagactattcccaatatgactaaattgccacattttggggaggagtatgataagcaaaattattggcttgttgaaagtaagaacagaaaaccaaatgacccggttttgatttacttgcacggtggtggctatttccttgatgttgcaccacaacagattgaaactttattgagtatttatcatttgttagagccagcaaagaaactgagattctcgattcttgtgttgaattataatttgacatccaaaggttttcctgttccgcaccaattagctcagttagttgatacttacacttctttggttagaggaggatctgaaaatctcttattaatgggtgattctgcaggtggtaatttggctataacttttacccaatacttgagattgaacaagccaaacttgccttatcctagaagtgttattttggtcagtccttgggtcaaattaatcccagaagtgtatcaaaatactccaggccattcatactataattactctgctaacgatgtgatccaatatgatcgtttttccagtgctgaagtttatcaaggtactcttggtaacacaaaactcaagtcgttaactgtttctccaggaaattgtccttatgatcctaaagattgggaagagattgatacttacagaaaaccgggatactctgtgtttgttcttgccggagaacacgaatcgttccgtgatgatattttggagtggtctaaatacgcgttggattatcctattcctccaaacttgggaaactcggatggtgtctacaaccctaagattcacaaatacattagaaacaacaaagattctgctcatgttgatgtaaatattgaacctttgggtgttcatgatgtctgcttttttgaaaatttgttgctttcaaaattagaaaatgatgctaatttgactattgatggtgttgatgcaaaacagttctttgccatcgttaatatcgtcaaatttcttgatactgttttgccaggaaagtag

SEQ ID NO: 734 - DNA, 963 bp, Candida albicans
atttttttcatactactactactactacctctactcctactacttctttttctttatacaacaatgccttcatcaactaacccaacacaaggtaataacaacgacaattggtttaatccaattccaattgacgattattataaaatcaatgaacaatctcgtcagaatgttccaacttcacctcctaatgatgaaacattaggtaattatactattagttgtggaccaattttaagattggctggtacttgggaaaacaataatgatactactgaagatccaaattatcgtggtagtatattattggtaatcaaaaaagatactgatagtactactgccaatgaaacaggaccagctattacttataaaattggtccttcatcaccatcaactacggttgctctggccaagttttctactggtgaatttcctgggacaaaattttatcaagaaaatgattattcattttatagatattcaattgaattaaccttgacgggaaatgaacaaaaagtggaatatttcattgataatcattttaaacccaatttccaattttatttacctaataaaactcaatcgatgaatgttatatcttattcatgtaatggattcagtttaggttccgatgccaatgagtataaatcatcattatggttagatgtattaactaaacattctcaacaacattatcatgtcatgttaggtgggggtgatcaaatttattgtgatgccattaaattacatagtgaacgattaaaacaatggacagaaatttctaaccctataaaaaaaaaatcattccccgttgatgatgaaattattgatgaatttaaaaatttttatttaaatcattatttaggttggtttggtaaaggattttggaaggggactaattctacagtattagagtctttattcccattaaatgctgcacaaaatcccttgtgtcaaaatttatga

SEQ ID NO: 735 - DNA, 654 bp, Candida albicans
gtggcgatgattctccacccggcggtgaagacatctcatgctcatgctcatgctcataaattcttacataatgttgaaggtgaccatcaactgacagaaaaattaaataaagatgttattgaaactccagaatatgatccaagattaatatttaatattactagttcagctatagttaatgcaccacctcctgatgctatggcaactttattgaataaaagaagtggtattcatcattttaatcgtgatactgatgaagatattgttccattatttattaaaaatcttgatggatcaaatcgtgataataaacaatttttaaatgaaagaaattggagtgatttaattcttgccaaacaatcaattctttataaagatcaatttaccaatgatgatgatgatgatgaaaatccaattcgtaaatttcctcaaccagtgcttgataacaaaggtgaagatttattaaaagatcaaactgttgatagcagacatgtgaaatatccattatattcggattctttggtgactacattaagatttgaaaaagataaatctgatttaagtagtccaagtgttggttatgaagttttaattccaaaattatttggtaaatataaattagacccagctccagttaaacacgttgatcaatag

SEQ ID NO: 736 - DNA, 396 bp, Candida albicans
agatcaaatattacttcctttctatttaaacttggatatccttatttcaataatataggatcaaatatgacgaataataaagattttgatttacctccttcctacgatgaagctgtgcatagtagcagcagcagtaacagtaacagacctaatcattcatcacaaccacccgcgcctccggcaagaccacaaaccaaccgaccaccaccaccaccaccaccaccatcacatcctcctacatcttcttcttcttcttcaaatgcaaatttatatactaataatttgaatttaccatttacatataaacgggggtattattgttctaaatgtaaaaattctggctataacaaaaatggagatttttgtcttaaatgttgggcaaacacttttatttga

SEQ ID NO: 737 - DNA, 867 bp, Candida albicans
  unsure (742),(830),(850): Identity of nucleotide sequences at the above locations are unknown.
aatgaattagcaacgagacatggagaagaattgattaacatggaaatgtcccaagcaatgagatatcctgcggaagacttgaattgtgaatttatatgggacccacatgtaaaagcctatttattgattcaagcatatatgagtcgtgttgaattaccaattgctgattatgctcaagatacgatttcggtattggatcaagccttgcgtattttgcaagcttatattgatgccgcggctgagttgggttatttcaaagtggtgatgtcgtttattcaattgatgcaatgtatcaaacaaagatactggtatgatgatgatccagtttcagcattaccgggattgaaattgattagtgaaggtaaaaccaaccagacattaaaacaattaggttcaatgaagccaggacaattatttggattagcaaagaaattgggtgttaaaggagagaatattgagaataaagaaacaaattatgactatggtgatggtgatggtgatgaaatggctaagaaacaatttgttaagattgcatctcatttacctactgggaatttagaaattaaacaacaagaacaagatctgataaaagttgttttaactcatgataattatcctttgaataatgactttaaagtgtattgtccacatttccctaaaccacaaagagaatcatggtttgtgattttacatgatggagaagaattacatttattgaagagagcttcacccagattatcanataagataggaattgtggcatgcgatcttgatattcctgatgaattgtttgggaaagaattataccttgagtgtgtgaatgatggatnagatattgcttattcaaaanaagattctttactataa

SEQ ID NO: 738 - DNA, 1008 bp, Candida albicans
ataccacaatcggtgcgtccagtaccattacaaatgtacattgatggattccctgaaaatcttgccttttgtccattgatgaagacaatgaataaaccagcatttatggccataaagcaacattctcctaataaaccagtgttgatatttgtggcttcacgtcgtcaaacaagacttactgcattggatcttattcatttatgtgggatggaaagtaatcctcgaagatttttaaaaatttctgatgacgaattacaagatattttagaaaatgttaaagatgatactttgcgtttatctcttcaatttggtatgggattgcatcatgctgggttagttgaatctgaccgtcaaatatctcacaagttgtttgaacaggggaaaatccaaatattgattgctacatctactttagcttggggggtcaatttaccggctcatttagttattatcaagggaacacaattttttgatgccaagatagaagcatatagagatatggatttgacagatattttacaaatgatggggagagctggtcgtccagcttatgatactagtggtattgctatagtctataccaaggaatcgaaaaaagtattttacaaacattttttgaatttgggattcccggttgagtcttcattacacaaagtgttagataatcatataggtgccgagatttctgccggtacaatcaccacaagacaagaagcaatggatttcttaacttggacgtttctttatagaagagcccataataaccccacttattatgggattgaagatatatcacaatatggtatttcccaatatttggccaaattgattgatctgactattgagaatttagtggaatctaaatgtgtatacactggtggatctgatgaattacatgccactccatttttggaaatatcgtcatactattatttatctcatttaaccatgagaaattttgttaataatgttactcctgattttgaatttagagattgtttacgagtt

SEQ ID NO: 739 - DNA, 810 bp, Candida albicans
cttactcctatagataaaattttagataaatttgccaatgtgaccatagattcgttgaagcatattggaaacaaaagttcaggtgccgatgttgtgatacatgaaattgaagatgcatgtaataagattagtaaacaacgtggtcttgaaaaactggagatttacacattagtcaaatcattattacttcaaagtccgaccgacgaagaacttcagtcatcattatttgatatattaggatttgatgaatttgatctcatttcgaaaattatacagaacaaacgagccttcgccactagagaatcactgggattaatgtcgtctgaagaaagagctcaacaagttattgataatcatcaaagagccaagaatcaaacattattacctaaatcaactcatcaaaaatatcccaatgttttcaaaaatcctgatgttggtaatataatttccatcacgggtaagaaatttgctttacctcaaggtaccactagagattcatatgccacccacgaagaattggtgatcccctaccctgaaaacaaaccaaataaatggatttcagagaaaaatttggttaaaatttccgatttagatttcttatgtcagggaacatttaaaaattataagaatcttaacaaaatgcaaagtttagtatatccagttgcgtataacactaatgaaaatatgttggtgtgtgcccctactggtgccggtaaaacggatgtggctttgttaacgatattgcataccattaatcaatttgtcactgaaacggttactgaagatggggatgtctccgttgacattgat

SEQ ID NO: 740 - DNA, 2811 bp, Candida albicans
aacgttattggaagttgggatttctccgtgaacttgattatgaggaatttaaatgttcaatgttgtcctttaaaggcattagcagcagaaattgttgagaaatatagtaaaaaactcaaatggttaggtataaatgttcgtgaattgaccggtgatatgcaattgacaagacaagaaataatcaatacacaaattatagtgactactcctgaaaaatgggatgtggtgacaagaaaactgactggggactctgaattagttgctaaagttaaacttttaatcattgatgaagttcatttattacatgaagatagaggctctgttattgagacattggttgctcgtactttaagacaagttgaaagtacccaactgatgattagagttgttgggttgtcagccacattgccaaactatatggatgttgctgattttcttggtgtcaatagaagtgttgggatgttttattttgatcaaagttttagacctgtccccttgcagcaacaaatattgggtgttcgaggtaaagcaggctcaaaattagcgagagaaaatatcgacaaggtgtcgtatgaaaaattagctgattatatcaaccaaggacttcaagtgatggtctttgttcattctcggaaagatactgtgaacacagctagaacatttattcgaatggcagtggaatatggagaactggaaattttcaattgttctgaagcagattcatatgagaaatacaaacgtgaagcttccaataaaaatagaagtaaagaattgaaagaattgtttgttcatgggtttggtgtccatcatgctggtatgttgcgtagtgaccgtaatttgacagagaaaatgtttgaaagtggggcaattaaagtgttgtgttgtacagccacacttgcctggggggttaatttaccagctgcagtggttattgttaagggaactcaagtatacgactccaaagctggtggatttgttgatttgggaatttccgacgtgatacaaatatttggtcgtgccggtagaccgcagtatgaaaagtttggtacgggtattttgtgtaccaccagtgataaactcgatcattatgtttcattacttacccaacagcaccccattgaatcgaaatttggagataaactcattgataatttgaatgcagaaatatcgttgggtacggtcaccaatgtggaagaagcggtacaatggcttgggtatacttatatgatggttagaatgaaacagaacccatttgcttatggaattgattggaaggaattacaagaggatccttcattgacaaacagaagaagagaaatggtgttcacctgtgccaaaagacttcaccatttacaaatgattatatttgatgaaaactctgaagctttcactcctaaagatttgggtagaattgcatctgatttttatttacttagtaattccgttgaaatattcaatcaaatgatgaaccctttggcaacagaagctgatatattatcaatgataagtatgagtagtgaattcgatagcataaaattcagagaagaagaatctaaggaattgaaacaattggttgaagaagatgcaccatgtcaagttgctggagatgttgattcgcctcagggcaaaaccaatattttacttcaagcttttgtgtcacaagcccatatcaaggattcagcattgatttccgactcaaactacgtagcccaaaattcagcaagaatatgtcggtccttatttttgattgccatgaatagacgatggggtaaattaatgaacattatgttgtcattatgtaaatctattgacaaaagaatatgggcatttgaacatcccatgactcaatttgaattgccacaacccgtgttgcggaatataaaggccaaaaatccatctatgcttgctcttagagatatggaggcgggtgaattgggtgatttggtacataatttcaaaatgggcagcatattgtacaaacttatagggaaatttccttttattgatattgaatcggaaatattccccattacaactaatgtgatgcgagtacatgttgacttacaacctgattttgtttgggatgacaaatatcatggcagtgctcaatttttttggttaacggtagaagaatcagatcgttcagaaattttgcacgttgaaaaattcattttacacaagaaacaattacatagtcctcatgaaatggattttatgataccattgtcggatccattaccagcacaagtagtagttagagtggtatcggacctgtggattggttcagaaaccgtacatgcagtctcattccagcatttgattagaccatcaaatgaaactattaaaactgatttgttacgtttgcaaccacttccagtcacggcattgcataatccagatgtggaacaaatatattcatccaaatttaaatatttcaaccccatgcaaacaatggttttccattccttgtacaacaccaattcaagtgtatttgttggatctcccaccgggtcaggtaaaaccgtggttgcagaattggccatttggcatgctttcaacgagttcccgctgtcaaaagtggtttatattgctcctatgaaggcattggttcgagaaagagtcgatgattggagggaacggatatgcaaaaacaccagtcatagattagtagaattgacgggtgattctctccccacaattcaagaagttaaagaagcacatattcatatcccgacaccagaaaaatttgatggtatttctcgtaattgggcaacaagaaaattggttcaacaagtatctttgggtgattaa

SEQ ID NO: 741 - DNA, 237 bp, Candida albicans
ttcattatgcccaagacagtaaagaaccccaaaaataataaatctagatctagaggagctccaatacaagttgccgaatctattggatcaggatcagctaaaataaaaaagaaaataagagatatagaacgattgatcaagaaaaatcccaatttaccagcagacaagaaaattgaatatgatagagctctcaaggggttaaaagttgaattacaaaattctcaagttcaaaattga

SEQ ID NO: 742 - DNA, 477 bp, Candida albicans
gtattagcattaaaatatcaaatggttagatgtggcgaaagaaagaaagcagtgaggaaattgaaaaatttacgtaaagaatttgaaagaatttctcaaactggaattagaaaagatattaaaaaagctagaaaacaattaagacatggagaaatagatttagcttatgttattttatttcctaaaactgaaaaatatatttcattatatccatcaccaaatgatgaagatcaaactgatccaaatgtcattaaagggttaaaaattactgaagaacgaagacgcgaatttagaaaatatattgaaaaattgatggaagaagggaaattaccattttctattgatgatgcattacaaggcaaaaatattagattggataatgataaaactcaaaaagctgttcttactgaagaaattgatgctccagaacaaaaacaagatgaacaacaagaagaacaagatgatttctttgaataa

SEQ ID NO: 743 - DNA, 1341 bp, Candida albicans
tacaagaagacaaagacaagcaaaagaaatactatgaaaagtgagattgaaattgaacttggagctgatgatccattgagtaaaagcaccgctagattatctatttgtcaagccgatatggaagaagaaacagaaggtaatcagaatccacgattacaagtacgggaattgttgcaaagggaaaaagaaagtatacaaaggcgtgattctgcagtttcgttaaattcctttctagaagaagacgaagaaaatgatcaacaacaactgcaactgcaacaacaacatttactgccgaaaaagaaaagtagaagcaaaaaagctgctgaaaagagaagaagatcatctgctcattcctttagtattgctcaacaacaaccaccgctcaaacgagaaaaggtccacaaacgaaaattgaaaaaaagactacaaccaccaaatatcgaattgcttcttgataaatccgaagaaaatctgaataaagactcagaattgaagcgatttccattcagaaacttaagactgttgatattaaaagtttttaatgtgccaggaaccaataacctaaagtggtgtaacattgaaaatagcgagaaaataccaactgtatgtgtttgtttagtaccagggttgcagttggaggaaaatttagcggaaacagcagataatggccttcaatcaagcaaagaaaaactgaaacaacaatgtgcaatttcaaatttgaaaagaattgatcaattgtcttttatatttgacaattttaccaactttattaagctgtcatctccgggtagtaaagattcaatttttctgtcattgcaaactcttcttaacgtcccattaacaaaaaatgaaaagaactctttattgcggaaactgaaagcgacaaaaatcacaattaaagatttattattgactgagcaacaattgaaaacatacaactatccaacaacgctagttgattcgacttggaaagcaactaaagatttgtataatactgattcaaataataacgagaaatccgattcagaaactcgaaaaagcagaatttatgcgttggattgtgagttttgcaaagctggtgccaaacaagtactaactcgtatttctttacttgattttgaggccaaagttgtaatggatgaattggttaagcccaaggaagaaatcaccgactatgtcactaaatactctggtatcactgaagaattattaagagatgtaacaaccaccattgaagatatacaaaacttatttgtgaatacagtttctcaacaagacatattgattggacactcattagaatccgatttaaatgtaatgaagatcaaacatgacaatatg

SEQ ID NO: 744 - DNA, 1005 bp, Candida albicans
ccttttccttccatccattcctctttccttactttgcaaatgttgaatccagttatattcattaaagatcctataaaatacgattattcacaattcattatatctttactcccgaaattcattaattgtaatcgtattgatttagttatactttgtcaaatcaccgaatcaaatcaattgaatgaaattttatgtttttattatcaattaattcgtaatcataagaataatggagatactgatggagataccgacagtttacctatgtttgattatcgatttgaaattaatatattatttaatttatcaacaaaaaaattgaatcaattatgtttaaataattggaatcatggatatattgcggaaggtgataatgataacagtactaacttgtcatctttgccattgtcaattacacaaatatcaaacattgaaattccaacaatccaatcaagagcaaatagtagtagttataacgatgaggatgataaaattactactagtcggcaatatcaacaatttaaaactactgctgtaggtggaacatttgatcatttacatgatggtcataaaattttattatcaatggcaatttttttaacttcaaataaattaattattggtataactggttctaatttattaattaataaaaaatttaaatctcaattacaaacttttaatcaaagacaaaatttagttattcaattcataaatttattattattgagtgaaaccagtgttattttttttgaaatttatgaaattaatgatgtttgtggtccaactggttatattaatgatattgataatttaataatatctcaagaaactaaatctggtggtgaatttgttaacaaatttcgtaaagatcatggatttaaattattagatattacaataattaaagtgattggtgggaatgttgaagaaaattcatggaaaggtaaattaagttcaactgatattagagaacaagaatataatcgattattaaatcaataa

SEQ ID NO: 745 - DNA, 1236 bp, Candida albicans
tgctctatccggagtgagacagcccaggcccaagctccagtacaagttacaaaacctacagccgctgccccagttgtcgtaactagtgaacaggtatacacgtctgtcgttacttctgctactgctgctcctgcagccgctgcaactgcaagttctgattctgatgattattcagctgaaggtttatttggattcttgtttggtggtggtagtgatggtggtaaagcatcagctgctgcttctgcttccgggtctgtttctttaaacccaattgatggttcgggtttaggctctggttcaggatcaggtaattctgctggtaattctggttcttcatcgggtaccactttaggtatcggttaccaaggaggatcaccaggtaaaaatactgcttctataaatactgccactgctactgctgtcaacgggggtagtgctgctggtgccactgcaactgctggttctttgggtataacttattctccttatactaaatcagatggatgtaaaagtgcatctcaaattgcccaagatattgctaaattatccaattatgaagtcattagattatacagtactgattgttccggaattgaaaatgtgttatcagccatgggttctaatcaaaaattgtttttaggtgtttggaacattgacagtcctcaaggggaattacaagatattgttagtgctatcaagcagagttctagcggttggaacgttgttcacactattgctattgggaatgaaagagttaatgctggtgctgccagtgtggctcaagtgcaacaagcagttgacatatctaagaaatacttgaaatctcaaggatacaatggtccaattgtcacggttgatactttagtggcctatgttggaaacccacaattgtgtgaaatgtctgattaccttgcggtcaattctcatccatattgggatggaggtgttcaaccagagaattctggacaatggttgttgcaacaaattgcacatttgcaaagtgtatgtgggtcttcaaaagatgtgttaatcactgaaacaggttggccaacacaaggtgactcttacggtcaatgtgttccttccgtgcaaaaccaagttgctgctgtgaaatccattgtcaaatccctttctgacaaggttattatgtttaccatgtttaatgattattggaaagatccaggtgcatataatgttgaacaacattggggattatacggtgatccatcatcttag

SEQ ID NO: 746 - DNA, 189 bp, Candida albicans
gccaacattgggaaattattctataattacaactggtctaatgatacctcccgttttgggcatcaatatttaccgaaaatgggttggcaacagggcattggattagggttggtgtcccatgcattaactaaccacgttaaagtttcaattaaagaacataatttggggctaggaacccaattacattaa

SEQ ID NO: 747 - DNA, 948 bp, Candida albicans
tttaaattatatcagttaacaatgtcgtatcgtggtcctaatcaatttggtaatcaacctccacatcatggaataccttctcaacctcaaccacatattggtccaatatcttccagcaaaagtcctttagaacaatttgaagatgttgctaaaaaagttgaagattggatcgatgattattttaaagtcttgaaaccatacgtcccagcaattggtagagcatttttggtggccactttctatgaggatactttaagaatcttcactcaatggaatgaacaagtttattacttgcacaactatagacactattggcgttggttgaccgttttattcttgatcaataatatggtggttatgacagttgcatccactttagtaattgccagaaaaaagaataacattgctactattgcattgatcgttgttgttattatacaaggtattgggtatggtttattgtttgatgctcaatttgttttgagaaacttgtccgttgttggagggttagtattagcattttccgatagtattgttagagataaaagatccttaaacatgccaggtttaccgatgttgaacaatcaagacaacaaaaagtatttccttttagctggtagaattttgttagtattattatttttgggattcgtcttttcttctgattggtcattgggtagagttttcattattataatcgggttaacttcttgtgcttcaattgttgttggttacaagacaaagttttcagctgctatcatgcttattgttttattcttatacaatgtgttcactaaccaattctgggcttatgcatctcaagatgctagacgtgactttttgagatatgaattcttccaagttttgtcaattgtgggaggattattgttagtggttaatgcacgtgctggtgaattctccatcgatgaaaagaaaaagatttattaa

SEQ ID NO: 748 - DNA, 702 bp, Candida albicans
atccttcaacaccattccttttttttggctacaacgatctccggattttcaactcttccttgcctccaaaaaatgattacaagacttattggtatagcaaagtcagggatctatcgcacatacctgaccgcttccttctatgaattgtttcccaaaaactttccacatggtggccccccacaagattcgtttattgtgaatgacaaatctttacgtcgagagtatcgttcgttacagagtgaaagccatccagacatttcgtcagatactattaaatcttcaaatataaacagggcctatacaacgttgaagaatccatatactcgaattgcacatttcatccacttgaaactgcccaatcatgtaaatatcaccgacgatgcggtggccaaaaaactaatcaagaattaccagcaaaagtcaatggaagcgtcaatgaactataaggagatgcttatgcaggtaatggaagcccatgagcaactagaattagcagagctggaaaacgaattggagacgttggaggccgaaaacaaagagcgtataaaaaccaccgaagaaaggatcaaccagtcactaaaaaacacccccatagattgggaagagttaatgatggatgctatccggttaaagtattgggttaatatacaaaacggaatcaaagattgggaaccaggtaaaccagtccatctcactcattaa

SEQ ID NO: 749 - DNA, 375 bp, Candida albicans
tatgcaaaatggaccaaattaaatcgtcaacccgataaattgtcagccgatttgcaaaagctcaaccaagatatccaacagcaaaaatcatctattgacgaagctagcaacgcattgatattggtgttaaccactttgccaatttggattgctagagtattttacagaaaaactcatttattctacataagacagggtatctttcctaaatatgttgaatgggtgttggctttaccatttttgcccaatggtgccgttggattgaccatttggatgtttgctgtcaattcagttgtgagcaacttttcatttttggttagctttccgtttgcaaagagggtttcaaagccagttagagatacaaaggttgaatag

SEQ ID NO: 750 - DNA, 993 bp, Candida albicans
caagttcaacaacaaggacaacctaccacagtggaacaaacttttcaaacaaatgaacaagttcaacaaactactgaacaaaacgatattaccacacaatcaccttccactacaagtatagattacacttccagcacatcctcaacctcaacttttagtccaagtccaagctcaagtacaggttctagtggagatattccggccccaactgctattgtgtactcaccatatgctaatgacagaagctgtaaatcagcagacactattagatctgatattcagttaattaatagcaaaggtatcaaacaaattagatcttatggtactgattgtggatcattaaccactgttcttgaaacttgtcgtgaattgggtattactgttaatcaaggggtttggatatctgctgctggtgttgattctattgatgaccaagtttctgatgttattaagtatggacaatccaatggttgggatgttttcaatttactcactattggtaatgaagctattattgctggatacgtttcaccttcagaattggtcagtaaaataaaatcggtcaagtcacaattacaaagtgctggttataacggtaaagtcaccacttctgaaccacctgccacttatcttaaatatcctagtttctgtactgatgctgacattgatgttgtcggtatcaacccacattcttatttcaacgccaatattgaaccaaaagatgctggttcatacattgtccatcaacaacaacaagttgctgaaatttgtggtggtaaatcagttcttataactgaaactggttatccttcaaaaggttctactttgggagtaaatgtgccttctccagaaaatcaagaaatcgctatttcttctataataaaagaaactggtggtgattgtactattttaactacttataacgatttctggaaagatccaggtccatacggtattgaacaatactttggggtcattcaattatttcaatag

SEQ ID NO: 751 - DNA, 534 bp, Candida albicans
atatcaaagtttggagagtatttctttttgtggctaaaaggagatcatctccaaaagtactttttttttcttcaaattatttttttttttctgtttttcatatacactgtaatagaattggtcaagatgagctcaagttcaaacctacaatacgaagaaatacccaagaaatatatagatcctttagctcctaaagacaaaggggaaggttcaagagttaatgggaaagattggaaaataaagaaagatgcttttcgtgtaaagactttgggagtggtttcgaaaacaaaaaaggattcattcaagcaacgtgagctaaaacgattggaagaagaacaatacaaagcaagattgaaagagttgaaggatgaaaaagaatctgctaagaatcaacgaattgctgatttgaaaagacgaagagaaattaaagcagagaaagaaaggtatgaaagaatggctactaaaatgcatgctaaaaaagtggaaagaatgagaaagagagagaagagaaacaaattattgaaagaacgttaa

SEQ ID NO: 752 - DNA, 1881 bp, Candida albicans
accatcccactaatgagacgagcagtatcaaaaatactacccacccccaaactatttaacgactccgcccatttccattcaaatttcaggcttgagtacaactcagttgatgatttttacgtacagttagataacccacataaggtctggttaccaggagaagaaatctcaggacaagttgtattaatttcgaaaaagaatttggcaaatatagtcataacgttgtcgttggtggggtttattaaaataaatgcatcgtcacatctgaagttgaggcctttgaagcatacgttatttgattatactattaaaatctatggtaaagatgaagaagaacaaacagactcagcagagtttagtaatggacttttgaaaggcgaacatgtgtttccgtttattgtaaagttgcccaataaaagagtatatacgtcgattgattttgggaaaggttccatcaactacattttgaaagcagctataggaaactcgtcgtcctatgtgatacctgcctcgcccgacaatgccagtactagcagtttaacgaaaaagaaaatactacagaatcctagtcacacatcagaaaaagtcataagtctagtaaatccaatagatgtttcgttattgcctcgaccgaaaccaaagagattgattctcaaagatccacgaactagctcaaacaaaaagttgtctcgcacgcaaacgtcaacgtcaaccatcaacaccatgtcttctaacgaacacgaccattcgttgcccgaaggtgccacacctgaagattccgaccacaaatcattaaagtcgatacctgtgcccacgatcaaagccatattggaagtgccgcagcgtggatacttgcgaggcgagctgatcccgatcaagctttctatcaaccatttacgaaagatccaggatttcaatggtattataataacgtttgtcagagtttgtcgattagacaatggcccagatggagttgttgagtcgtttagaaaagatctacaacagttgatacttcccttgtatgttgatcctgttactttccaatccgaaatcaattcgtcgctacgagtgcctgctgatgccttcccgacaattttggggtgtccgttagtttcattccagtactttgttgaagtactaaataacctttctggcaaatcaattgcgcttgattctgatgttgatgcacgcggtaaagccaacccgcaagcaaccaaatcatcactggacaagtttaagtttaactttgattccacccaaaccgagagatctacctatatcaataccgatagttataaacgactgaagaaatttctacaattgacaacagagatctacattggaacccatcgtctgtcaacgcaagaagagcaagcaccacaagcagaggaagtggcatcccgcaggtcgtcgtccatggcatcgaattccaattcatcaccggcagtattttctacatcctcaccacattcaccagtggagcaccagtacgcaggtgcgatcaactcaatacccgaatcagttgcagttagtaattttacaccaccttacgaaaatgttgtgccgctgtatgtgccaccagaattcgtgtctcatctacagaaccagtctgagttgtcagaaaaggaaagaatgagacaacatgaaagtagtcttttgccgtcagcaccacctgatgatgaacaaccaagtccagtcaacatgacttcgaatcaacaaccattctcgttttttacataccagaacaccaacacgtccccgccagtcccattggatgacgatttgtaccaggaaccagttgattcagcgccaaattacttgaacgtcaacaatgaccgtttgatagttccccaggataataactcgaattcagagacgtaa

SEQ ID NO: 753 - DNA, 861 bp, Candida albicans
tcggttccttccagccgcgtggtgaagatactatgcaagattcctttgatcaaaagaaacaaagtattttactgggaaatttcctcaaatagtccagacaatctagatgcatcaccaaaaggaacaatcgatgagtattgtcttccaataatcgatacaataaacagtcatcgagatatggtaaccacttcatcttgttcagggagagtatctatttttcttgaaggtgtgaaaacaaataattctacatcagtagttgcaaagggacatgagggtcgttggctttttgtcacacatgaacccaaagacttgaataattggtatgattctattgatttcaactacgatacatccaaattccccgaaaatgctagtgcaagaagtatactatataaatttgaaccattaattttgcatgttaaatgtcgtaatgagtctatggcacaaaagttgtacgttttggcaatgaataatgggtttcgtgagtcaggtattggaaacaatttcaatgttgcaattagaattaatatcaaattggatattcctataggttttcaaaatgtagatgaagaagatttgaattgttttgtcactaaagaatatttgaagtatatcaccgatatttcccatgaaaggttcaatgaaaactttaagaaattagaacaattacatcgagcaattgagagaatgattgaagatgaaaccaaaggaatagaaactaccaaaaagaaacataaggaatctaaggaagagagaagacaacgtatgatcaaagaaggtttgcaaagacaacaagaattgagagaattaaaagaaaaacaacagcaagagcaaaatgagacactacatgtagataaatag

SEQ ID NO: 754 - DNA, 411 bp, Candida albicans
ataaataataataggttatttattcttgcagttgtcaccaatgcaattaatttgttttcccaagtatttttcaccatcatgtattctgatttagaatgtgattatattaatcctattgaattatgtaataaattaaatccttggtttattccagaagcaggtttacatggtttcatcaccgtgttatttttaattaatggatattggttttgtttcttattaaatttaccattatttgcttataatgctaataaattttataataaaaatcatttattagatgccacagaaatttttagaactttatctaaacataaaaaggaatcatttttgaaattgggtttccatttattgttgttctttttctatttatatagaatgattatggcattggttaatgatgaacaataa

SEQ ID NO: 755 - DNA, 714 bp, Candida albicans
aaagtgttttgggtatggtttgcattatatcaacaacaaattatcaattcaaaaaatttgcagttggagatttcttatatccccaaagttttattgacaacatttttccaatgtttgttattcattgttattaaatccgaagggaaaccaaatttcaagtacatgctattaaccttattaacaaaattgttgacattatctcctgataccgggtatgaattcattaaggactcactaaataattgtccttatgaatcagagtatccttctttgattggagtctataagcaattgttgttgaacgaaaagtgggatgtaaatagtattgaattggagaagttgaatatctcttcttcttcatcaaacactccacctaaattaccaccaagaaatggtatcaagagaaagcatttttcgttaaccaatgaatctttgaacgatttggtagatttgatcaataattccctgaaaaatgcattcgttgaagataattcaaagattgatccaagcaaattgtcgactattgccgcatacttgaatctattagtagctataaagaaagatcccgtgattgttgaaaataaggaaaagttgaccactttgatctcatcaatcgaaaacaagatcaagagtgttaaaaaatcgtcacaaaatcaatttgaattaaatgctgctggtatgcttgagattacaattgaaagattcaatgagtaa

SEQ ID NO: 756 - DNA, 1521 bp, Candida albicans
agaccccgacccatccacatttatcagaatcggaaatcccctccattaaattcacaatttacaaaatatatttccgactgttatccggataaatcctatttatcacaaaatatcgcttataagatttgtaattcttgtcaacgtcctattggaacaaaaagtttatcactgcattatacaaagtgtgttgccatgaaacaaaaaagacaacaagaacaacaagaaaatgctgctttatcgaataacaacaacaacaatactaataattcacaaaagaagaaaagaggtaggggaagtgcattagctgatgttgatgcatcttcagtagatagctcaaggaatgctactccagcacctaatggcaatggtaatggtattggtgctggtgctgggaatgataacagtggtaagccagctactaaacctaagaagaaatataagaaatcacaagctcaaaaggaaaaagaagctgccgccgccgccgcggctgctgctgctgcttcatctggagaaaaaccaccaaagaaaaagaaagctgcagcatcttcttcttctggtactactactactactactgctggagtcaacacccaaccacaatcagcaccaaaacctaaaccagtggcaaaaccaaaaggtcctgttgatgtggaaaaacaatgtggtgtggcattaccttctggaggactttgtgctcggtcattaacatgtaagacccattcaatgggagcaaaacgtgctgtccccggtagaagtgcaccttatgatgtattattacaacaatatcataaacgaaatcaagccaatatagcaaaaagtcatgctatgatgttacaacgtcgagaaaatgctgcatttaatgatcaactggaatctggagcgaatgctactaaagtattacatcctgatgaagaaaccgaatatgtcttagctggtgtttccaaaaatagtactatcccgttagagaggaaagtaataatgccagttagatatcgtcatagatttcttcgagctcgtgaattttatgccaatgcattaattatttctgctcatcataataataataataataataatcaatcgcaaaatcaatcgcagaatcaatcgcagaatcaatcgccaaataatagtaataatgaacaacaaacgttagcaaatcaagccatatcagggtcaattggtggattacaaggtagatgtgctttaattaatattgatgccaaaccaacggatattaattcacctactcaaacatttagtgctatactgggtgaaatgtatcaagtaagagcaccatcgaaaacaattgtcatgacggcacaacataataatatgcaacaacaagctttccaacaacaattgatgaaatatcaacaacaacagcaacaacagcaacaacaaatgttatggcgacaaagacaacaacaacaacaaaaacaacaacaacaacaacaacaacaacaaatatctacatctgggcaacatgtaacaaatcctacagaaattaaaaaagaaacttag

SEQ ID NO: 757 - DNA, 537 bp, Candida albicans
aattggtataatgataataaaaatcatgataaaaatttacgtgccaaggggaaaccgatttttttatttatgggattattagatgaatcagtaggattgaatttacaatcattaaaatttgctgctgatactaaagaagaaacttatcttgatcatcaaggaagatatcaaggtattgcttattatgccgttgatttatcatcagctaaagaattgacagaaaatttaattaattttgttaatgattcaattaataaattgcatgataatcctaatggaacccttgattctaatgggatatttttcactcattcacgtaaacattatcttggatttgaacaaaaagaagcaagtttatattctcaaggagcaatgttattttcttggttgaatacaaataaattttgtcctggttgtggtgaaccaactattccaatttatgccggggggaaattattttgtaccaatgaaaaaaaacattctgaagaagatgatgatcgttatatcttcacccaccgggcctggaaggaacagcac

SEQ ID NO: 758 - DNA, 318 bp, Candida albicans
catagctgcaatttttatttcaacttgttcttttctttctttctttcttttgctcttctttttatgattagaagtataactagaatcatgtcacattcaattcatagttctgtaaaagatattcaaaaagacatgtatttcggtacagaagttttaaatcgagtatcatttttacgtgaagatcccgaatttattcaatcaagtttatttcatccatcaactagatttatattttattataaacaacaacctttaattcataaaaatttacctcacaaattatgtgttattaacaaggggcgtggcagatccgcatct

SEQ ID NO: 759 - DNA, 495 bp, Candida albicans
atacacattttttcatcattgttgctatataacctttttcttcatcttacttatatccaactatttatatatatatacatttatacatttactcatttacttagttacttatctaccttccttccttccttccttccttcaatgtcatcatttaaaaaattcactgattttttattttcaaaacaatcccttagatatgtctgtacaactcatttttggggtccagtatcaaattttgggattcctatagctgctattttagatttgaaaaaagatcctgatttaattagtggaccaatgactggttcattaatactttattctttagtgtttatgaggtattcaatggcagttactcctcaaaattatttattatttgggtgtcattttgttaatgaattggcacaattgagtcaaggatttagatgggttaaacatcactatgatacttcttcaaatgatggtgaagataccaaaaagataactcaaaattga

SEQ ID NO: 760 - DNA, 1230 bp, Candida albicans
tttggtgattctagttttggtttatcaatttttgtcaacggaagtggttatcatactgggattatacctcgttgggatgtattctataatttcactttattaagaatgctttcatataatttagattatattgcacgagaaaggaaacttggtaataatgacggacaactcaatcttaacatacgagaacacatttatggagctgataatcctccaacactacttaatttagatgatcgtcaaagattatcagctccattaccattggatgattataatgtgtcaaattatatcgcttatatttcctatactccattatttatagctggtcctattattacatttaatgattatgtatatcaatccaattaccaacaatcttcaacaacacaaaattatcaacgaattttcatgtatgccattagatttctattttgtttattagtgatggaatttttattacatttcatgtatgttgttgctgtatctaaaacaaaagcttgggatggtgatacaccatttcaaatatcaatgttggggatgtttaatttaaatcttatttggttgaaattattaattccttggagattatttcgattatgggcattattagatggtattgatccaccagaaaatatgattcgttgtatggataataatttttcggcattagcattttggagagcttggcatcgatcttataatcgttgggttattagatatatttatattcctatgggtggtagtggcacggggaaatatagaatcatcaacagtttattagtgttcagttttgttgctatttggcatgatattgaattgaaattattaatgtgggggtggttagtggtaatttttttgattccagaaattctggcaacattgatattttcaaaatataataagaattggtggtatagatatttatgtggaattggtgctgtaattaatatttggatgatgatgattgctaatttggtagggttttgtttaggtactgatggaatgtggaaattattacatgatttattccaaacttttgaaggtggaagatttttcataatttcttcaatttgtttatttgttggggcacaaattatgtttgaattaagagaatcagaattaagaagagccattgacgtaaggtgttataaagagattatggtacaattaatgaatgaatatcaaaaaaagaaaaataagataaactattactattatacattataa

SEQ ID NO: 761 - DNA, 606 bp, Candida albicans
ataatgaattatgtatctcaattagggaaattgttttctttagaaacattagatactcgattaaacccaaccactaatccaattaaacgacaatcaattatcaaaaaagctaatcgtacttcaagatggtcaactttagaatttaagatatatttaaccattcttattattgtggtaccattgatgattaaagctggtatggaatcatataatgaaactaatccaaattatccacgatttcaacatttattaagtgatggatggattttgggacgtaaagctgataattctgatcaacaatatcgatttttcagaaacaatttcccattattatgtggattaatatttattcatgttacattgaggaaattgattaatacattaataatcataccgtatggcaggtacaattataattttaaacggacttattttgatttaatatttggaattatatttctcattggatctcatggaataaatgtttttatcattctgtttcatttattaataaattatttcatagggaaatatatttctaattataaattgtctatttggtgtacttggatatatgggattttttcattatttttcaatgaatga

SEQ ID NO: 762 - DNA, 741 bp, Candida albicans
ataaccaccaaagcaatatactcaagtttctcaatgccacctattccagcagagccaactgaaaatatatctatatttcatcctaaagtattattattatctgctggtgttacaacatcattatttttcggatataaattttataaacgatacattaaacgaattagaacgtatttagatttaactccttcaataattgaaaataatactaaattatatggatatgtaacccgagttggtgatggtgataatttccgattttatcatactccaggtggttggtttttcggttgggggtggttacgtaaaatccctaccactagaaaagatttaaaagatgaaacattaatgattcgtttatgtggggtagatgcacctgaaggagctcattttggtaaaccggctcaaccatattctaaagaagctttatattggttgagagaatatgttgatgggaaatatgtcaccataactccctattctatagatcaatataaacgagtggtggctcgtgcacaaatttggaaatggaccgggagaaaagatgtttcagcagaaatgttaaaagttggatacgctatagtatatgaggggaaagctgaagctgaatttggtgataatgaagattggtataggaaactagagtctcgtgccaagttattaagaaaaggagtttggtcattaggtaaaaatttaacaactcctggagaattcaaacgaatacattatcgaggtgaataa

SEQ ID NO: 763 - DNA, 1911 bp, Candida albicans
  unsure (1786): Identity of nucleotide sequences at the above locations are unknown.
tatgcgctgatcctgcgctcccgtggtgaacacctaggtgaagatatagaaaatgaagctatggaattgacacaaaccattccaatgaaaataataaactcccatgaagataccgattcaatatcaaaaccgtcacctattgttgacgatttgcctgatgaatcattatcacaaccaatggaattaactcaaattgattctaaaattaccactggaaaggaagaatctgatttaggtgatgcctctcaaccaatggatctaactcaaacaatttccaacatatcacatgatgaaatcaatacatcaggaattgaagaaagagtgacaacaacaacgattccacttgccgaaataactcaagatgatattaatcaagaagaagatgaaggaggagaagaaagaaaagaagaagaaaaagaaacagtagttggagaagaagaggaagatgaggtttcatctgaggatgattcatttgatgaagatgatccaaattacatttctgtttcattatcgaaatttttaagtgatattagagtacagttttatgatgatttagaattagatcttaattctattccaagattaagtataaccaattctattgaattacccacgatacatgattatattaaagcaaaaccaaatttagaattattagaattgtatgaattttgttgtaatgaattaaataaaaaaattattcaaggacgagaattatataatgaatatgaaaaaactgttttagtgaataatcccatattatttaaaaaatattattcaatggatgataaaactaaattattaattaatttaaaaattcaattaattcgagattttgctcgattgaaaagtaagaaaacttggtacgattggagaaatcaattgacggaaaatttaattgataaattagatgaagaaataaattctttaaccattgataaacaagaaataattaaggatataaatcgattgaatgaattatatgataaaactcgaatatatttgaaaggattaaatcataaatttaatgaattaataagattgaaaaatgaaattaatgaaatacctccaaatgagttgaataaattacaattggatgttcggaaacggaagcaagatattgttgaaatcaataaagaaattgaaatcaaattatcagaattatcaacgatcaaaaagaatttagataccagtaataataaaaaattaacattacaaactcaattaaatgatttagaaaatcaatttaatcaaattcgaaaatatgataatttagaaattaaattgattttacagaaatatcaatttttacaacatttaaccaatttgaaatatttgaaaactatcgagagtggtcaaaagatctcatttttatttgatgattcaataatttgtgaatttgattttatcaataataacatactgtatactgtgaagcaaaataattttaaaaataaatcattaatcgagatatatgaacaatttgttattgatggtgacaaacaagatcacactataactgataaatttcaaatgtttcaccgaaattggcaatggttgaaaaaaatagattctgatttttattatatttcattgaaattccccattgaattaaaaattgttcaccaccaggataatgataatgacgacgatacaaagaaatctcttgaatttacaattaaatattataatttcaggcatgattataaagtattaatttgtgggaaaatcgatatcaataaatttctaattcatcaattgtgtaatactcacaacaatattgaanttactggagaaataatttatcaacgaagtgaaattaataataaatcatttagagatcaaattagtaatgatcttaaagtatttgataaacaaattttaaataatttaatcattgtcaacaaataa

SEQ ID NO: 764 - DNA, 2064 bp, Candida albicans
aaccacactatggagaacagcaataagatatcattacatccagaacaaaagaaatggaaggcaccaaaaggccctaaaccaatacatcataagaacaaaaatcttattggattaggtcgaaccattgctaatcaaagatccaaagaaaattccattcaatatttacctgatggtgaaatgagattcacaactgataaaaaggaggccaactgggttaaattaagatcagttactcaagaaaatgccttggatgaatttttaagtactgctgaattggccgatactgattttactgctgataaaaatcaacaagtgaaaattattaaggttggaaatacttctattgtgaattctaatggattattaagtactgatgaaatgttagctatgagacaaaaacatatgatgtttgaaaacaaattaactatacctaaacgtcctaaatggaataaaaatcaaagtaaaattgaaattgatcgtcaagaaaatttagcatttttaagttggagaagagaattagcacaattgacagaaaataatgatttattattaacaccttttgaaagaaatttagaagtttggaaacaattatggagagttgtagaaagatgtgatttaattgttcaaattgttgatgctagaaatccattatttttccgatctatcgatttagataaatatgtcacttcattaagtgatccagataataataaggcaaagaataatttattattagtcaataaggctgatatgttaactagagatcaacgtattgcttgggcagaatatttcaaattgaaaaaaataaattatgttttcttttcagctgctaaagccaatgaattgttagaaaaggaacgtgaagagttggaaaatatacaaaacagtaccggtagtagtagcagtagcagtagaaacactaacaataatgctgctgctgctgctgttgatgctgaacaagaagaaggtgaagccaatgattcaattaggatattaaaaattgaagaattggaaaaattattcatggattcggctcctaaatttgaagttgatcctgaattcccagatagaaaattacaaattgggttagttgggtatccaaatgttggtaaatcatcaaccattaatgccttagttggatcgaaaaaagtttctgtttcttctactcctggtaaaaccaaacatttccaaactattcatttatcgccagatgttttattatgtgattgtcctgggttggtgtttcccaatttcgcttataccaatgctgaattggtatgtaatggtgttttaccaattgatcaattacgtgaacatattcctccagtttcattagtttgtcaaagaattcctaaatttttccttgaagcagtttatggtattcatatcccaatacagaaagtcgaagatggtggtaatggggagtatccaacggccagagaattacttaatgcttatgccagagcaagaggttatatgactcaaggtttcggttcagcagatgaaccaagagccgctagatatattttgaaagattatgtcaatgggaaattattatatgttaacccaccacctaaagaggcaactaataaaaatgaatggatattaccaaatttacaagaaagtcgaattttcaatcgagaattatatactttaaatcatctaccagaatctagacaacatcaaatagtgtctgctatgcaacataaacatataccggttgatgaattcaatttggaaaaggatttaactaaattaaatttctcacaacatattgctgctattactggtagtggcgattcaaaagatgaagacaataaacttagagacaacaaccaactgcaatcagaagctaaaacattgttttatggtgggaaacaagcagcattagaaagtgctggtgatgaattggatagagaattctttgctatgaataatatttccggtaaatttgcaactccgttccataaaaagaataacagcaatacagaaaagaacctgaataaaaaacataacaagaagaataagaaacaagataagaaagttagagtagtaggttattaa

SEQ ID NO: 765 - DNA, 897 bp, Candida albicans
atgacaaggaacttggactctttccgatatacagggaatgggaatgatgaaaataacaacaaaccacacagaataaccaaaataataccaaaagcaaaagcaaaacggagggccaattccaaactacattctaataaccagaaatcgtcggtagatttacctgatttacagccttcattgaatgatcacttacaagttttatttgtgggattcaacccaggtactgaatcttcaattcaacaacatcattatgcacatcattcgaatttattttggaaattatttaatcagagtcaattactacataaagtgatatcgaaaaataaaaatagcccacacgagccagtaccggaaacaccaaatgaagttaacaaatctgaagatcaatttttgaatcatttactagaaaatggatgtaatgctactcatgatttcaaactaattaaatataatatcggcttcagtgatttagtattacgaagcacagcaagagctgatcaattgacaatgcacgaaaaattaaataatgttcctcgattgttgctggaatttaaactgtctcacgtggaaaccatcgtgattgtgggtaaaggaatttgggaaattataatcaaatattttatgaatgaattgagtattagtagtaagaatttcaaattggctagtggtaacaggaaaagtggtgatggcgatggtggtgctccccacaaaaattttaaatggggattattacaaaagggatcagattcgacttataatttaataattgattctatttacaaacatattgatgagtcaagtaaaatatacatatttcccaatacttcaggacttgtggcgagtttatcatttgatgaaaaattgaaactttggcaagatatggttaatgatttatag

SEQ ID NO: 766 - DNA, 705 bp, Candida albicans
accaattcactactactcccaacactaattggtttttttttatttcgggctttatatatttatacaatatttttcttctttttgtgtccactattttttttgcttatttgttttgttttgatttccaattattcctccagtcttccctgtaaattttttttttttggttaccacttttattcaatgataaattttcttagaaagagaaatatactggatattttaatcaagactcacatcggactgactagactaggttcaagatcatttcattatagtacccgaattatgaattccattaaagacttgagtgaaaacgtttggcaaccacaggatgctttgcctaaacacattaaggatttacttactcctgggacccaaccagttaattacatgtttgcatttttacaaatcattagatcattgaagtttcaaaaaagaactggttggttggatcatggtatacctgctgaggcaactgagagtatagccgatcacatgtatcgtatgggtgtaatatcaatgttagttcccaaagaagtggactctaataagtgtgtcaaaattgccattgttcacgatataactgaatgtttggttggtgacatcacgccatatgccgggatcaccaaggcggagaaacaccgtatagaattagccaccattaattatcttagtgatttgattaaaccttacaatgaataa

SEQ ID NO: 767 - DNA, 1371 bp, Candida albicans
gccaatatgaatgatactgaagatactatatacattccgattccacactatccaccattcaagcttcgatcatctttaattgataaagatcccgtgatatgggtgcatttacttgaagcttatattcatcttatgacagttttacttgacccagagaccccaaaattaaatgttaaatcacaacaacaattacaattattcttgaaaatattcttatttgaaacatgtgaagaagaaaccaaaattttttctttgggtgccatcaaccctgatattaaaaagaataccagcattttaaaagcatacgttttccaattgattaaaaagtatagttttgtcaaattgaacttaactggagaagcaatatggaatttcacaaagattcatgccccaaaaaacatcagtactgtaagaggattaattgatggtacttttaaatctgagtttaacgacaataaaaaatcggggaatatatcttctatttcaccagtacaaaaacacttggacttgattgtaactaatggaaaatttactaaaactgaagatcttgtgatattatctatgttattaggacaaaacactactagaacaagcacattttctatgggatccaacaaaagtatcaacaagaagcgaaatcgatcattgccctttgcagaaaattttgtcaatgtccaatggatagagttattagaaaaggggtatgccaacggcaaaagtgtcaatgctgatattataaaagatattatgattatatctatcatttcactatctgcagagaaattggctacattgacgatgaatttgggaatcacttcaattgctgcatttaatgtttgtccgttgttcagttcaatcattatttctgaaccatataaggaattgattcccaatttggaaaaaaagttaccatttttgagaaacatagatatcgatgatgataacggttatgaagacgatgatttggatggttacgaagataatatagaagggatttcaatactagttgatttgtggcccaatatgacagaaagaaaagccaagattatactcaagcaacataatggtgatgtagaacacgttacaaatctattattagagaatcctgaattgattgacaagattgaaatgccgaaaaagaccaacaacggtacagcttccactagcaataatactaaaacttttactgggtcgtataagattttttcagggaaaaagaagggaagtctaaacaataatacaaagcttaatgcgcctagtgctgatttgaaaaagaaaacattagaatctgcacttagattgatgtatcagagtgatgaagatgaacctgacgatacttatgatgatcaagaaaaaacaactggtgtataa

SEQ ID NO: 768 - DNA, 1224 bp, Candida albicans
atcatgaaagtaattgtatcagctgatgacactgggtcagctaaagaagtaatttgtaatgaaggcacagatacatcaaaacaaaatgccactcagccgatatctatcgacaattgtttgttagaaccctcgtcatcagtaaaatcaagaatcatccatttcctcagtttcaactatcaatatttgataggagctagacttggcggacaagtatctgtttatgaattgagtgatgaagaatctgaagaaaagtttaaattattacacaattttgaattgccagttgatgctcaagataaacccgttgcattactaagagtggaaattttggatagtatacttgttgctttcgaatcatccaaagtttttttaatacacattaatgattcctttgattttaagccactcgagcttgtacttccagaatacaagccaattagtgcatttgcaatcaacccgcaagccgaaaatatcgtcgccctaggaggaaaggaacacgatcttcagatactccaattatttaacaaaaacatcaacagtacagttttcaaaaagaataattacgagaacgaatttaagccacaaatcattttcaaagcaaaaaatgtcagaaacgatcacctagaattgagagtcccaatttggataacaaatattttatttgccaaggcagcaaagggatacaagcttgttacatctacaagatacggtcaaatcagactatatgatacggcagaaggaagaaaacctagaaaggattacaaagtgacagaaaaaccaatagtaaccttaacatttgctaatgacgaacaaacagaaatcattgtcacagacacccacagtcttatagcaaaatattcgttaactcaagtagacgagaaagcctttaagaccatctctgcttctgcaggtgaaatagttaaaccagtaccgaaattattgggcaaatttacaggtggaaacacaggagcaacatttggggtacatgcctatgaaaggatagttgcctttgctgggttggatagatatttgagagtctttgatttggaatcccgtgaaatattggcaaaagtctatcttggtgtggaagtttcagcattgttgatattggacgacgaagacacagaggacgaggaaacgaaaaaacgcaaaagaaaagaagaagaagacgatgaagaattatggaatcaattggatactaaaaagaaaacacatactatatag

SEQ ID NO: 769 - DNA, 1197 bp, Candida albicans
  unsure (1185): Identity of nucleotide sequences at the above locations are unknown.
tacatgtcaattttagcattaatttcgaattccaatgatagcagcaatttggactgttttcaaaatataaattacttttgtaatgaaacaattaatttacgtcagtgtcacttgattgaattggaatgtgaattacaagctaagggaacatcagccgatgaaatacctgagaggaccaacgaaaatataccttcttctgacagccaaaaacattttggagttattttcccgctacctaatcatatttatggattcttcaaacttgaaaatgtcgaaataacatcaatacaggttttattgggaaatgaaaatataagacatgacattgagaataattggttagatattatgtcaagtaatgatctaattagtcgatgtgaaaacctacatcttgatagtgagaacatcaacacaggaaagaggaaagagagtctaagttcggacattgagttttctatgaaaccgccagctcaaataccaaggctgtcatcatttatgagttcatcatctttatcatcttcacttacaatcaaagatgacgaatctaaaaatacaactttaagtaatgattatcagatggagaagaaaataccaagtgaagaagaagaagggaaagatcaggtgttaccacaagtgataatagagaatccaattgattttttaacaaccagatattattcgacattgtattcactaaataacccattaagttattttcctaaaactgcattaccaagatttaagaatcttatttctacttttaaaagcaacttagatatagaggagaacagcaagtacaatgatgaacataccaattccagctctagcaacattatagaaggtttgagggagttctggttaaatgtcgatgcttttgatcgacgtcataatcaaaggtatggcgtatttggtgatgttaatgatggaagtgatactgatatgaataaccaagtaaatgatgaattgagtaacattgaattgattgaacaacaaaagttcaagtcaaaccatggttttgatctaaatcaaccaaccactttatctgaacaccaagaaaactcagagactatggatatcgatgacaagggaaatgagaatggaaaccagatacacggcattactatggagaaattatcacaattgagtcttgatttacagattcgagaagccccattacaaattttnaataatatttga

SEQ ID NO: 770 - DNA, 1365 bp, Candida albicans
actattctagctccactttcttttctcttttgttttttattacttaccagctggctattattttacaaaatgacaatagagacgatatcaaataatgaaggaatacggcagagatcagccagtgaaagcactcacacacatacttatctagatcaattagacatcccgcaaataacgttgaggtctactatagtcggattactaataggttcattggtccttatatcgaattttcaatttggtttacaaaccggatgggtttcaatgatgtcgttaccagctgccttattagcattttctattttcaagttattaccaatatccattgctaagaatttcaccgatgttgaaaatgtatttgtccagagtatagctgttgcagtaggaacaggacccctatgttatggattcattggcataatccctgcaatggaaaagtttatgactagtgaagaaagtggtttgggtcgacctttgacttttgggttgggccagttaatgatttggtcattgggtctcggattattcggggtattttttgccataccgttgcggaaacaagttattgtaaaggaaaaattacctttcccatctggcagtgcaaccgcaactttaatttcagtgttgcatggaagtgacatttatcaagataaagaggagatcagtgaaaagttggatatcgaagaagaagaagggagagaaacaggtagtattgcaactgaactggagagtttaacccaacaatcgtcaaaatcccaactcataactactaccaatattcaagatgattatgattcaaatatgagatcattaataatcacatttataatatcagccacatacaccatactttcattcttcctccctattttgaaaaagattcctatttttggcaatcatttatcggtcaattatttatggaacttccaaccatctccggcatatataggtcaaggtatcattatggggttgccaacagtttcctatatgttgtttggtgctatcttgggttggggtatattagctccattggcaaagcatatggagtgggcacctggaagaattgacgattggataaatgggggacaaggttggatcttatggattagcttaacggtaatgataagtgactccttggtgtcgtttgttgtggtgagcatcaaatcaattaataatgcattagataatttcagacaaagaagagatttagatcaatttctagaattgcgacaaagtcaacaaagtgaatacttattacaagatcaagaggaaactcgatcactgacttcatccaacgaaaatcctgaaaatagtacttacgatgggaagattcttcacccacaggggctggaaggatccgcgctt

SEQ ID NO: 771 - DNA, 348 bp, Candida albicans
ttagggactggtcaaggattacctcctcaaattcgagaatttgcgtgggttttaggagtcatatttggaattatatcgttattaaagaatactgtgccgcccacttcactgtatcataaatatttggtttacttgccaagtggagtagccgttggtgtaggtattcacaacaccccaaatttcactttggccaggtttattggtgggttgatttgttacaattggcagaatataggtcctaatggtaagattggtatgattatattcagtagtggattggtgttgggcgagggactttttagtggattcactatgcttttaactagtttgggtgttaagcattggtaa

SEQ ID NO: 772 - DNA, 1929 bp, Candida albicans
caaatttacattttcactagtattgtaagtgattataatataaccgcacatcgtagtagttggttacccttatcacaaaatacaacaatactggtagagaaaaaaaaaaaagagacagccaaaattaaagaacatgcacatacaccaagcaacgataaaataaaaatagaaagaagagctatcagctcagaaaatagtttagaagttcaattacatatttgccttgtttacatgtcatttccaaaaacgttaaatgttcccgacaagtcttctttgttagtgcctcaaaccacgaaggcttctgcgactggaccaacaactgcggtttcatacgaaactgccagtctggaaatacgatctattagaggatcaccatatcttccttcctcaccagttgactcacaacaatttgatgggcgtagcataatatccacatctgggatgtcagaatacattgcagatttaaatgatctaccaagtattcgacatgatatcaaccccacttccatcaagacgggtggtactggctcaagatcctttaaatttctgaattgttttcaaacattagacagtgaactatccaacatggatttttttacaaaatacataagcattctgaaaggtgacgataaggctcaatttaacaacaaattgaaacatttttttatcttctccagtgctggcaaaccgatatattcgatgaacggatctgatgatattgtgataggatatatggggattctcaccacaatagtttctagtttccaagaaaattttaatcaagaattacaagtgcttgaacttggccaaggtttaaaaatcgtggcggtcaataaaagtcccataattttaatctcaatatcgaaacttctgtttgaaactgtggaaagtgtgcatttgcaattagatactttgtattgttatttgattgggatactatcgaaatctgtaattgataagcactttaataatcgattaaactacgatcttagaagaatactaagtcctttggatttcgaaaacttggatgaattatgtcttaatttaacttatggaataccaaacaccagcgatagaactcaagattccacttttggattatacacaagtcaagtattattaccattgtcaagagaaagtgttaagatcagacatacattaaggtccaaactaaatagtattgtcaacactaacaatgaggatgtgctatttacaatattgctttctggtaatgggaaaatattaaattatttgcatcttaaacaacataacttgccaaacaaagatctaaacatgttattattcataatacattcgttgttaaagaatcaaagccaacaagatgaagatttgtggttacccttgtgcatgccgacctttaatgatcatgggtttctttatgtgtttgttcggcagtggcaggatttggttttgatgttgataagcggcagcaaaaactcttttgatgcgttaaaattgtcagccaatgaaatctgcactaaattgaataacaagcaagagttagccgttaagttgattaatgaattgagcataccattaagcattgaggtgccatttgtgtttaagcactttatttataaggacattagattaaatcagtttgtgatgagtgaattacctacgcacgagttttccagttttcaatttttgaagtgctataatgagttgaaggtcagtcaagcaaaaattattaaacatgataacaatttgaactacaaaaagttgacatatttgcaggatagggatataactggcttcatgcttatggacaaatactatgagttctactgcatcattgaacgttcaagtgaacaggaaacaatcacatctaagaaattaatacagataagttctcaaattataaggtggtgtaaaaagaaccatgcccggctttttgttactatataa

SEQ ID NO: 773 - DNA, 1059 bp, Candida albicans
atattcatccaaatgttaagggcaaccaatatacttagagaaagaattgctgctgctgctgctgcttcttcttcttctttttcttttcttacgaccaatactgctgcaagatcattcacaactacatctataaatcttgcagttgttagacaaaaagaaggtaagaagaaacaagtattaagaaaacgaattgatccaaataaacaaaaacagaaaaaaactactggattaactcatttaccatttagagatgctgttagaaatttgaatcttgaacaaactgctccaactttgattgctgaaacattatctaataaggaattgaaagctgggacagtgacaaaatatgaaaaatcaattgaaaaaagtttgactgtattaaatgcattcaagaaatatcaacatcatgaaatgtttcaaactccaatatcattagtcacttccaatactattaaaatcaatgaagaatttgttgagaaattagatggagaatctaaatccaatagaatttatattgatggtataaagggaagtggtaaatctacattaatcaatcaagctatatcacttgctcaagaaaaattcaataatgaagcaattgtattatatttaaattcaggtgaagtcattggtaatgggacttcagattatgtgaaaaattctaaattgggagtatatcaacaaccaatgttgacgaaaagatggattcataaaatattatctgctaatgccaatattttcaaaaaattgaaattaactaaagatatcaaatttgctaaagataaactggaaactttattaaaagctaatactgctactttatacgatttcttatcacaaaatcgtgatatgggtaaagttcatcctacttatgctttccaatttttcattgaacaattagtcgaacattctcaaaatgttccaattattgtatcggttgatgaatttaatgccctggcagattatccatggactaaatataaacatccagaattcactccaattcatgttaatgactttgacattgggtcaattttaatgaaattttctaattggtga

SEQ ID NO: 774 - DNA, 816 bp, Candida albicans
gggcggatcctgccagcctccgtgggtgaagacaacaatcagaatcaggaaagcatggccaatattgttgatgccaaaaactacaactttcaaatacaatggttttaccgaccccgagatatttccaagaccacatcggactcacgactattgtttgcttccatgcacactgattcttgtccaataagttcattccgtggattggttgaagtgcggcataaacaggatattgaagatgaatttaaccgtgcccaagcaaaagagaataaacgttctgctaatggtaagaagaatacatcaccaagtacagccccaactgcattggaagtgtatgtacaaaaaccaaatcaattttattttgacaagctatttgatcgttatatgattaagttctatgatgttttactgacagccaatctcttacaatatgctgaagttgaaaatagtaaaagtcgaaattttttgattgcgttgaataaaagatacgagtttatttttgttgagagtcagagaacaaaatcgttgataaattcttttagttcgaatacatgcaattgtgaaagttgtggacaatggtgtgaaaactcaaattcaatacagtgtgttgtatgtgaaaagtacttccatatgttttgccttgatccaccaatgctgaagaaaccgagtcgtggattctcatggtcgtgtgccccgtgtgctaaaaaaaatgaacaggaaaatcaccagataaaacttgttcatgttgctagaaaacaagtcgtcaaattaaggacagttagcaagggaattaagtgttttgagttcaacagacaatga

SEQ ID NO: 775 - DNA, 1500 bp, Candida albicans
gcactttgcccaaaatatgaaatgctagctatagagtttttgaagaaggataaatccatttctttcgcgcaaagacgaatcaaagaagaatggtgtatgcgctatttggggcaacatgcaaggttagaagatggggttgatgttgatgatagatctccatacccaagggcaagtacaagaataggtacaaaacatcaagctacatatattcctgaatgtgatggtcatccattggtttattatgatgttgacaaaccacagaagaagaagaatggtaacgggtccagctcatccagtaggcgttctaaaagcaaaagtgttgaagaccaggatctaaaacaagtgaaattggcagtacctcaagagtatgctgatgttgatcccaaagaatatccagcttggttgcaaccaagaccaaaggggtatattgagcgcggtgtcgatgatggtgatggagagacttgtactttgctttggaaaagttctgaaaaagacatagctgacaattttactacactagaccattacgttggaaaatgctcgcctattgctgaatcaattggattgtcaccaaactcgccaaacttcgtggatgctatattatattcatacatgcagcataaaggtaacgttgatgaggctttcaaagaagctaaaactttaactaaaaaaagtttgaaggagccgattttttctaaagaggaaatcaaaagatttgaggctggtgtccgtgaatttggtagtgaattatatcctgtttacaaaaaagtaaagacacagccagtatcaatgattgttagattttattatttatggaagaaaaccaagaatggaagagagatttggggaaattttgaaggcagaatacaaaagaaagttcagaatatcatcaaagaagaaactaaatcagctgttaaagaggaagccaagaattcgacaaacacggaagatgactcttcatacgaagaatcaactgatcctgacgacgacaagaagtttatctgtaaacattgtaatacacttgaatcaactcaatggttcaagataactggacatgatgctaaaaagaaaaattcggacaactacattatatctttatgttttagatgtgctagattatggcgtcgatacgctgttgtttgggaagacccaaatgaagtgcttaaaaaatataatggcagtagtaaatcagcagggggttggaaaaagaaagtcgaaattgaattgctcgaagatgctgaaaggattatagaacataaccaggcgatctcatcggggttgataacacaagagcagcctaatagttctggtagtcgtgaaactaaaaaacgaccactgccgtcaccgtcaacaacttcacctgcaaagaaaaaacccaaaatcaaacaagaagagttgaaagagaaagagaaggagaaaattgttcacatcaaaacaagtactacttccttgacacctacattgtcgaacttacagaatgaggagaaatttttcccctaa

SEQ ID NO: 776 - DNA, 849 bp, Candida albicans
tgtcaattgtcaacattgataaaatattccttaaataatcatcgtcttcaatgtgaaatatgccagtccaaaaatggtgctttgattaaatgtgagttgtgtgacgacaacttaaattatcacgtgacgtgtgctcaagatacgccaaactttaaattgggattcaaattagtagatactggaaagccagatattaattttgtgacacttgttgatggagatgcttgtggtaaactcaaaccaatactagtgtgtcctaagcacgatcaatccaagaaaactattttaagtttaagaacatatggcaaaagaatgaattccaaactaaatgaactggattatagaccattggttgaattatatttgcaagatttgatcaatgataaaaataacaaacgtggtaaattttcaaaactgatgaattatattgaaaactataaacagttcttccaccgtcaagttgataatggggaaaatactgctattcaagaattatctcaaactgtcaatgaatgttctagatgttcatctacaaattcgcctatttggtggaccgttaacagtacaaaattgtgccaatcatgttatcattctggagggcatgacacaaatgaaacaaaaaaattagagttcaagtcggaatccgagtcagtgaaggatggggtatttacaatgttaaatggggaaaactatggtatcaagaatgaattagacaaattagattcaatttataaacctaatattactgaactacaagaaagtgatgatgaaacaaacaaaatagaaaaatcacatcgggtcgagagtgtgagtagatctaaaatatcattaggcgatatacttagttag

SEQ ID NO: 777 - DNA, 243 bp, Candida albicans
cgtcctattcactcggcaatttattcatgtacctgttgtcttgctaatgaatctaattacgaattgtctatattgggctcaccatttgtacgtcctgaatttttaaaacctatcgggaatggccgttggtgtcacttgttatgtgcgattttcaatcatgactatgtttactttgaaaaggcacttgaaggtggtcatagtttagtgtcaattgtcaacattgataaaatattccttaaataa

SEQ ID NO: 778 - DNA, 744 bp, Candida albicans
agacgggattcaattgcgcttgatattaaagagaaagagattttcactcaaagtggagaaaaattaattgatgaagaaggatcatttatggttccacttgcaaaattgtctaatttacaacgtaaatgtattgaagaatttcctgatccattaatgacaggactggattggagatattatgataaacctgaagatattactaaattaatttcatggttaaatccatggggtaaacgagaatcattacttcgaaaagaattatcacttgttaaagaagccattatatctagtatggaagcgagaagaaaagcgctttggatagatcaaaccccacctgaagaattagaaatatctgataatattaagaaattaaaaacaaaattatttggaggcagtggagacgataatgagaatgaaaatcatttgaaagataagactgatgctgctgaagaagatgacgatgtaatactaacctctagtgctaaacgtgcaaggagatcaactggttctaggaaaagacaaaaagtcgtcactgttcaagatgctttagaatttggtgaaccagaagatataaataaaatgattaaagaattagaaaaagaattaattgaaaagaaagataatcgagaaatcaatcgagtattagaatgggttaattctcgagctttagatttatttgaaaaatcattatatgaaggtggagataaacaaaaatcaaataaatcaaaacaaaaaaagaaataa

SEQ ID NO: 779 - DNA, 1182 bp, Candida albicans
attaatggacataaagaggattgttggcttgatatatatataatgatatggaatacctacaaatacataccactacgaagacagggaagacaatatttaatcaccaccaattatcatctacaacaactccgatttaaatcatttcgaactattgatttaacttttgggtcacataatcacaataatatccccaataaaagaaatgaaaagattttcttttataattatgataataccagcaaaataaaagcccttgatcggcagttcaaaattttaaataaatcccaaaccaaaattcttgaacttggatttatcccaagtaattggttaatatatattcgtgataccatggccaaacttcataatatatctgatccggggaaaatccatcaaaaatgtcatattttaggatttgatattttatttggatcaccacccatcggagtatcaagtattcaaggtaatattttttcaaaattggctcataaaaatatcattaatcattttaaagaaatttcttggactcaattacgtgataaaagacaattagaactggatattgatccaaaatcatatttttctcgagaacaagatgaatcaatgataattgataaacaaattgaacgaattgaagctggacttaaaaatattaccatgtcagatataaaacgtcaacaattacttgataagagagattctttattaccggattatagaattgatttaattttatcggatttatctaaaccaggttatcaacaatcaggattttatgatcttacagaaacaaatccttatcatcgatataataataataaggggttaaatcattcaattttacaaccaggtaaatcgaattttgaatttttagatgctgcattgttattgagttgtgatttattaagacctggtgggaaatttgttgctagattaaatgaaattgatccttatgatccagagatgtatttgttacatgagaaattagagaaagttttcaatgatgttcttgaaatacggaattttggacataccactgctaccactactaccactactattactaccaataataatgacaatgatatgagtttcctggttcaaccaccaattgaaaaatattatatttgcaatgataaaaaaaatgatgatgaatatgacctttacgatatatttaaatattag

SEQ ID NO: 780 - DNA, 1044 bp, Candida albicans
attgctttattcacaattatcatgctatcgtctgtgtttttttcaatattaacattactactttcttgctttgtatcaactactgaagccagaaggaagctttcggctacttctttagtcacatgtatggataattcacaaatttctcctagttatttcaatgttacattcaatcccgatgatagatctttaaggtatgcccttgatttaactacttcaattagtgcatatattactgctcacgttcaagtttatgcttatgggtttttaattattgaaaaagatataaatgtttgttccttgggttggaaacaattttgtccaattttccctggtgctttacaaattgattctgttcaatatattagttcggaatacactaaacaaatccccggtattgcttatcaagtgcccgatattgatgctgtggtaaaacttgttgttaaagaaagagattcaggtgatacattatcttgtttacaagccaatttttccaatggtaaaactattagtcaaaccggagttaaatgggccaccgcatgtattgctggtttaggattgattgtggctgctatgttgtctacttttggaaattctaatgctgcttcccacatttcggctaattcattatcacttttcctttatttccaaagtgttgttgttgtttcaatgcaagcagttgaaagagtcccaccaattgccagtgcttggtcagaaaatttagcttggtcaatgggattaattcgtattcaatttatgcaaaatattttccgttggtatattcaactgactggaggttcaccaacaacatattttatttcgtcaaccaaacaagttttagtacaaaaacacaagagatctttagattatgttgctggtgtggctaaaagatctttagaatatgctttacgttcacatagtaatttatatgtgttgcgtggtattaaaagaattgggtataattccaaaattgaaccaacatctattgttgccactggacacacttggtttgtgtatcttcaccacgccctggaagatccgcat

SEQ ID NO: 781 - DNA, 387 bp, Candida albicans
ctacacaacaaacgccatcagtcggatttatcactccatgtcattcaacaccttggcaaagctattttcataaccctaatttggataccaattcatggttccttggcgtgtgaacctccattacatttgaataaacccagtatggaagaaataaggcactatagagaccaatcagatcagttttacgatgcgcctgaactgtttttgcaaactcatttgggtaaagacttgccgaaaacagaacaattggttgtatttgaaccgttagaaccattaatgaatgactacttgggcagagagtattatgaatgccaaaggttttacaatagctttttccattgggacagtagaagagatggcgatattattgtatattgtagaaactaa

SEQ ID NO: 782 - DNA, 219 bp, Candida albicans
ttcacacccaaatttgtgctacttgggatacttctcaatatttgtattggattattctccactaatgtgcacgaaagaggagtatttgatttgacaaaatatctagctacacaacaaacgccatcagtcggatttatcactccatgtcattcaacaccttggcaaagctattttcataaccctaatttggataccaattcatggttccttggcgtgtga

SEQ ID NO: 783 - DNA, 2253 bp, Candida albicans
atcatgctggaaagttcactggaaactgaaatttccaaaattccattagtcatgacgaaggaacaattggataatattgaacacaagattttgtatcgtcaagtcaagtcagtcaaagctggagatattgagcgatttaaaatccatttcacaccacatgctgaaggagatgaggtaattattccacctacattatgggtgaaaattagaaataccgagccagtatcgaaaagagcaatatatttagctggaccctatatattgtacgttgattgtcgactgctggattatgacccaaatgtgaagtattttgtgactgcagaccaaccagtttttgaacctcaattacttgctggacaatcgttttacatacaattatcatgtcatactttgaaaaaagattactcatggatagtagacgttgtgccacaaataatatttaataacactatatcgattgattttgaaattatgattgggacatccaaacaaatcttacatgaagcatcgttccctgaaaaatcagttccattgtcagataaaatagggtgttttaatgaattattgcatgtatataactgggacacattggatctttggaatttgcccgtcatgagccctgacaagccaaaacatttagtgatattaactcatggactacattcgaatgcaagctcggatatgttgtacttgaaggaacagattgatcgaatagcagaattaagaaatgacaatgaggaaattgttgtgaagggttattttggaaacattggcaagacagaacgaggaatcaaatatttgggtagtagagtggcagaatttattattgatttagtaactgaaaatgaactgttcaataatggtaaagttaaaaaaatctcttttgttggtcactcattgggtggatgtgtgcagacatttgctattgcttatttaaaagtaaatttcccttggttttttgatgtaattaaacccatcaattttataacattggcgtcaccattattaggtgtcgttaatgaaaacccattagtggtaaaatgggtgctactggcaggatttgttggtaatactggtcaggaattaggattgaaatatttggaaaatggtgcaaaaccattattgttattgttaccagctggccctactcacgaggttcttaaaaaatttataagaagaaccgtgtatgccaatgccattaatgatggcattgttcccttacgaacttcttcattaatgtttttggattataaagggttggcagaaattattaattcagaagaattagctcagagtgatgaaacagggaaaatacctgaatcagttgaactggcaaataaattcctggcagtgcaaacttttctaagttatttaatgcctcaaaaacaaacaagtcaagagtatagacgatttcaaactcaagatgataaagtagtggaggaccataagtcagatgggaaggctatcccaaattctacttttcatgattctgccgcttctttgattttaccaccgcttccttcaatgaaatatattgtggatccctcaactagagaaaatgtcataattcacgataaagtttattatgaaaaagatttaccagaaagggatcttgatgtcgaattggattcctttgaatggctcgaagaggaaattgctcgagaatatcataaaaatatggggtggagaaaagtggttgtcaagattaagccggatgctcacaataatataatagtgcgtaggagatttgctaatgcttatggatggccggttattcaacatttagtggagaatcattttggcccaaacagaactgttgattccaagatgattgacagtgccattgtggatctggtgagtaccaattcattagatgaagaaaatgggttgacaagaatcatatcaagagatttgattagtaggcagaataaagagattgatgataatgtcagtgaagaacaacgacccgaagaatatccacatgaatggattaattctgaacataatggtgattcggtgtttgctgtgggagtgacaggattattaggagaagttgctgatatggttggaggatttagagaccaaattacaaaatacagtttaaatcctccatctttaccaatcattggagagattccatttcctgccgctttaatggcaccaactgataccaataatggcaatacaaaatctgaagaagaattaaataaagacttgaaattgtctaatggaataatgaatgattttatatag

SEQ ID NO: 784 - DNA, 1131 bp, Candida albicans
acccctttctccaaagctattttagtgaaccacttttcaaaaatctacttgccctgcttgaaattaagattttgcgaaatgaaggtgatatctgatcaggcagtgactgagtttttgaacaaaactctttccaaagaatcaattctcgatgcatttcaaccaacattactcaagagtttgacaacttattcccaagattctgaccatatagtacctcccagaactgttcaaccatccaataatcccaattcagataccacacacatatatatgccatgcatatctccagatgaagtaggacttaaggtaatcagtggtggtcctggaaataattccaaggggttgggattccaaggatgtgtattgataatggatgaaatcaccggacaattgaaggcagtaattaatgccaataacttgacagcttttagaacggcattggcaagtagtttaggtttgacaaagttaattgcccctagcaatgcaaacattttaccagaattgagtgctttcggtgtcggtttgcaagcttactggcacatcaaactagccttgttattgtatgaaggtaaaattaaagaagtcaatattttaaatcgtacattgaaaaatgctgagacattagcagacagactttccaaggaattcaaaaacgtcaagtttaacagtttcctgtatcaagatgaattactgggattcattcctcatgttcaaaatagttcaattatatttggatgtactccagcaacgtctccaataatcaaaaaggaatatttgaacacaaacccagaagtccccaaattcatatctttaattgggtcgtacaagcctcatatgattgaattggatttgaatttatgtaaagaactcaaacaaaaggccatttctatcatagttgattctaaggagcatacattgcatgaagctggtgagttgatacaagccgagtttgatgaaacccaattgattgaaatccatgagttgtgtgcagattttgatgctactgttacagacgagattactggtattacagttcaaaagattgttggtttgtcaattatggacttatccattggtaaaatgatttcaaacgaaattggaaataatgcagttgttgttgacgatttctaa

SEQ ID NO: 785 - DNA, 531 bp, Candida albicans
agacatgaattatatggatttgtttggattacagggacattgatttttctcatgtttgtgagttcaacggggtcaaatcttttgaatcaatggctacgtggtgatgatacatctaaaccgtactcttatgatttcagtttattaatcaaatcaatttctttattttatggatataatttcattgttccatttttgttatgggcaataacaacgtattataacaaatttcctcatcctattgatttagtgaaaaccgtctcgatatatggatacaccaatgtattatgggtgccaataaccattattaatctactcatagttttcataaatagtgatattttgaaatgggtctttgttggtgtttttggtgctatcactggattcagtaatttgaataaaatcagccctatagtaaagaagaattgcttgattcttaatgaatcaggtaaattgtattatattatacttggtttgttggcagtggtacatttatcatttaccgtagtggttaagattagttttttctcttaa

SEQ ID NO: 786 - DNA, 585 bp, Candida albicans
agaattgaagattttaatgatggtagatatcatgatgatgaagacgataaggagaacaagccaggggaaatggtgatcgatttaaattctgttcaactgatgtttttcacagcatcaggaaaattattaagacttgaagaaagaagttcaccagttttgattattaaaatattgaaaaatggtgttgaagaatggatagcactaggtgaactcaatcaaggagaatttgatgatgatgaagatgaagatgaagatagtcaagatgaagataccaaaaaacccgtgaacaagatcaacgccaaacttattaaaaatagtagtctttcattacttgagtatctcatacgtttatgtcgattacaagaaattgaatgtaaatcaattttagaaatccctgatgaaattttatctttttatcttcatgataaagtaaatgatctcagtgattccggatatttacctaaatctttatcacaaagacaaaaagatgaattgaaaaaaatgaataaagaaaacactatgactatggattctaatattaatcgattaaaaaatcttgatataaaagaaccaaagaaaaattga

SEQ ID NO: 787 - DNA, 2559 bp, Candida albicans
aaaagacgatcattctcgtcgcttgggagcgacaaatcaccgactgctgtgagttttagtgattacgttcattatgcagccccaaaaaccacatacacaacaataagatcagtattcccaccagaagcaataactttaggtaggaatgcattcaacaggattggtgatttaattgctgatattgagttggtctcgtgtaacggtgacagaattccagtgtcgtcagcagtgttgatggagagatggggacagcattttattctgttattggccaagggatatatcaatgctgtagataagtttgaaacagatcaagcacttgggttagacgagaatcaaagattgagatcaaaatcctccaactccgaatccagctcaagtgatatccccaaattaaaattatccctaagtgaatccttactttcttcatcgtcgggtgaacatgacaaaaaggaaaaaatgggattaagctcggcacataaacctcagaaggatgttccacagttcagattaccatttcaagattcaagcgaatcggttaatcgtgaggaagggtctgattgcagcaaggacaggaaaacgggtggttcatccgtttcaacggcaatagatccccatcatgtaatgcccaggaaaaactctacaagctcctttcaatctaattcaagctctttattaacttcccatttgcaagatataccgccccaattacctttgccagacgaacaaatacctgcggttccagcagctccagtatcatataggagcgcatctcggaaaaactcacaagaccatagctccccaagatcatcgttgatacacacattaacagttttaagaaatattcccgtgtcaaaatccccacgcgagtcaccgttttcttctccccgaccttccatgtctggcccaagtggaggctcagctgatttatttagctcaccatttccgagtttgaaggcaaattatggcaaaccaccctccaatttgaggaaaaagtcttatgatatgaatgacggaaccattgaaagctcactcgattcattttcatcaggaaaatcgtcaatggcaaaagtgagcagtgtacctggcgagaatccagattctgacgagagctctattggtttccaagagttcaataaaaatccaataagtatgtttgacaatgcacttttgaattttgataatattgacagtgagaatttcagaatggaaccttctttaattccaagaaaactttatattccattcatgactttgacagtcaaagcattctgtgaatatttatatacgggacaaattgggaacaaatggttactagcacctacattgatggacaatttattgatatccaaattctaccgtgtgccattactttatgatttgataagtgagattttgtttggtgttattgggaagaaagaagcctatattattggtgaagcacgtaaattgaaagcacggtattttaaattactacgtggtgcaaatatccccattgattctaattatgaattcccaatggacgagtatgatgggttcttggatactgtcgatgatggctaccttgatattacattgttgaaaaaagcttcgaaaattcatgcagatagtgtcgcaatgtctttgaaaaagaaatcggttacaagtaataatctgcgaaatgcttcgatacgaaaagaaggttctactacagcagaaagtgttttggaagaaggagaaaaacaagaagagatagttagtaaagatgatgaggacgaatctagaactggctcaacaagtgaagaagacgaggttgacaaagagtatggattagtttatttggaagcaaaagataagtcgttgcccactatagggcccagatccaaatctatttttgatagacaaggtttggcggccattgaaaagctagaagaagaacaaaatgaccatcaagtccatatgattgttgagggagaggaccatgaaaatttgattacgttggacgagttagttgcttcagatgccccttcagattatgccatcgatttaatttttgaaactgcaacattagtaactgatatgaaaatgcttctaagaacatctaacttgaaagccatgacagcaaagtttcgtaaatgtaaagctgacattgaaaaggaaatggcggatattgagtaccaattgactcaaatgccaagtggctcccgtaatttggcaatgaagtcagccaatcagttaaaggaactgcaattgcaactgaagctgtcaccaataatacctacagtatcaacagtgacaccttcacctttaccttcaatctcaggtgtaccttctccaaggctaccgcagcaacagttgccagaagcacaattaccaaaactaacaaagagtacatcttcactctcccgtattgcatcgcatacaagctttaaagcgcttagatcaatgacagacgtcacaccaatggaaaaactgacttctgagaaaagttttagaggtaaattacaacaaactatgcaatcaagaactcctacaaatggcagaccagaccagattctgattagcgacgggaccgattag

SEQ ID NO: 788 - DNA, 699 bp, Candida albicans
  unsure (2): Identity of nucleotide sequences at the above locations are unknown.
anaccccggggtgaagaccgaggagccgagaaattggggattaaacatgttgtcacgggacataatgctgatgatgttgctgaaacggtattgatgaatttattaagaggtgatgtggcaagattagaaagttctactaatattatgactacttcagcgggatctcccattaaacgatcaaaacctttcaaatacacttatcaaaaggaaattgtattgtatgcccattataagaaattagattatttttcaactgaatgtacttatgccccagaagcatttagaggtacagctagagaattattgaaatctttagaaagtattcgtccatcttgtattatggatatcatatatagtggtgaacatttagtgctagcacctaaaaagcaaaaacggaaaaccgttgcctataagaataaaaataagaacaagaagaaatcaaacagtgaacaagaggaacaagaaaaacaagaacaagaagtgaatcctgatggatctatatctttgaatcaaaatggaattaaaaaagatggtaatacatgtgaaaaatgtggttatctttcatcaaataagatttgtaaagcatgtatgttattgaatggattggaaataaatcgagctaaagtgacgattgataataattctgctattgatggtgcagcaaagcttactaagaaattagaacaattgagtttttaa

SEQ ID NO: 789 - DNA, 798 bp, Candida albicans
acctggcagacacgtcaattttccgttttggatatggccccattccacagcaattttaaaaaccaaaagatctttttctttgatatagataactgtttgtatccacgatccaccagtatattcgaaatgatgcaagtcaaaatacacgattactttaaaaaaagtttgagtttgaacgacgaggatgctcataatttacacatgaactactacaaaacatacggattagcgatcgaaggattagtgagaaaccatcaggtggatgcattggactataactccaaagttgacgatgcattggatctacactctgtattacgttacgactccgatttgagaaagacattgatagcaatcaaagaatcatccaagtttgattacttttggctcgtcacaaatgcttacaagaaccatgcattgagagtaatttcgttcttgggtattggtgatttgtttgatggattaacctactgtgattactccaaggatccaattatatgtaagccaatgccagaatatttttacaactgctttgaacttactcaacttgattatcagaattctgcagtgttatcagaacaatatttcattgatgacagtgaactaaatgtaaaggaagccaaaagattgggtgttggccatgttatccattatgtggagttgtcaagtgatgttgaaaaacttaaagcaaaaccagatttcgaagagttttatggcacaggggacaacctggatccaaacaaaatttggattctaaacaaaatccaaaacttaccaaatctaattggttgcacgtag

SEQ ID NO: 790 - DNA, 600 bp, Candida albicans
ctatggccgacaaaaaagttacatggaccaactttagtattcaatccaaaacctaccaagccaaacacaatgaacgcctattctgaaatactcaaacctagaataattccaatttcatcatccaaaaatgatgttccaccaccaccaggatattcagaatccgtgttttctacagcaacaaaatcgctgacatcgtcaggtaagaagacaaagcatgacgacgccgatttgaatgcattaaaatccaagaaaatttgggaattagcaattggtccagcaaagtcgataccaatgaacttatttatgagttatatgactggtaattccttacaagtgatttcagttacaatgacattaatgttgttatggaaccctataaaggcaatcttcaatgaaaccaatcccaccttttccaaactatcaaccaaaaataatggaagtgagattatattagcaaagattgtattcattatatgccaagtgttgaatatgggtattggtgtttacaaattatacaaaatgggtcttataccccatcaagaagctgactggttagcctggaaagaacccaagaaaattatagataggttatattactaa

SEQ ID NO: 791 - DNA, 864 bp, Candida albicans
tttttttccattacttttccaatctcatcacacccattaaagttgatcatattagcaatgggtaaaagaaaagctgctgattccaataatcctcccaaaaaaaagtttaaaaatgtgtctaaattgttggaccctaacacttctggtatttacgtaagttgtgctcgtaggaaggaagcaaattgtcgtcaggaattgctcaatctattgtcagagaaagttcccgaatattttgatttggagaatgttgaagatgacgaagacgaaactcaaattgacaaaaaggaactatcaattgaagacaaaatcaaacaggaattacaagaacttgaggagtccaaaaactcgaaaaaggaattgcttcaacctgttgatgtagatttggagtgtttggtgtttataaaaacgaaaaaacctattgatccagaggttttggtggagaaactatgtaaagaatgttatgagtctggacagaaaacaaccaggtacactcaaaaattggtcccaataatggactcatgcagttcaacgggtgatgatccattagagaaggtgcggcaattggctcgaaaagtgttggcaagacatttccatcaagagaaggatcagaagcctgtcaagtttgctgttcaagtttcaagacgtaatttcaatgttttaaagtctgatgttataattaaaacaatagctgaatgcgtgggtaatagtcacggacactcagttgatcttaaaaattacgacaaattgattattgttgaatgttataagaataatattggtatgggtgtagctaataattttttgaaatatagtaaatacaacttgcaacaaatatttgacaaacaccaggaagataacaattaa

SEQ ID NO: 792 - DNA, 303 bp, Candida albicans
gtgattatgatcccattatgtacagggaaaaaagctaatttaaacacatttgaaagtcttgatatgtataaattgcctcaaaactttacttatgataattctggatctttaaaaatatctcatgaagtttgcacaattctaaatatagttcaaccaacaacaattggccaagcacaaagtcttcaaggaatcacccctacggctataaatgaattgaaaaaagtggccaaatttgttcctagtgaaagtcttttgaaattaaggaatgagaaaaacagcataaaaagtgccatgtttggataa

SEQ ID NO: 793 - DNA, 231 bp, Candida albicans
gactatgacgatggatgggaggatatggacgacattggagttcctaattttgaaaaactaaaaagttatatcaacgatgacgaaaaacatgaggctgatgaaggattgaagaatttgttgacacaatttttccgtgaatgcacagctaaaaacttaggagacttccagagatactacgaggaattaagtgacgacgaaaagaaagtgatcactgaaaacttaattttctag

SEQ ID NO: 794 - DNA, 708 bp, Candida albicans
ctggcaaccacaatgtcaagcttgatagatttggttctaaaccagactagctcagataatgagatcagaaagaatgcagaacttcaattcagccaaatagtcaagcaagatccatctaatgcaactcaaacaattttggagctggctctcgatacatcgcttccactagacgttagacaggcatgtttattacatttgaaacgattagtacctcagtattggtcaatggggtttgaatcgtttattggccctccagtaaatcaagagccaaaacaattaataagatcaaaactattacagttagccacctctgcccctgagtcgaaaattcgaagcggcgctgcctatgctattgttcagattgcttctgtcgattatcccgatgaatggccagaattgataaacgaattatacaatgccactacacaattccaaaacgagacagctttacttggtggattacaagtgttgactgatttatttgatgatttgattaccgaagaacaattttgggaaggcggtgtcggtaaagaaatagttggccatttgaataatatcttgagtcaaagtttggctgctgaagtcaagacccaggcaataaagtcatacgaaagtgtgttggcctatttaagaagcccaaagcgtttacaaccgacgaaagaaaacaattggttcttaatgaaattacatctacaattcaagttttga

SEQ ID NO: 795 - DNA, 2028 bp, Candida albicans
agtcaagacccaggcaataaagtcatacgaaagtgtgttggcctatttaagaagcccaaagcgtttacaaccgacgaaagaaaacaattggttcttaatgaaattacatctacaattcaagttttgatccaattgctttcgcaaagagaattgaatcttgttgacttacatttacgaagtttcatttacaagatccttgctgccatcattagccaattccactccaaacttgctctcgaagttaagcgaacgatattgacattagctattcaagacctccattaccttgcaccagtttatagcaaagttgcattgaatgggaaccatggatttgacgtgtcttccgaattggaagtttcgacagtattcaacaatctccttgacgaattatttcaaactatcaattccatccagcacgatatccctattaacaacgaccaattcgtccaagatttgattgtctgtgcagtattaccaaatgataaattagaagaatacgacctcgacttgaatgcctttgtcagcgacgcaactggtttaaacgtcaacccaactgttcgtgattcaatctatgatttgttgactgaattaaatcctagcgatgctgccacttggttcaaatccatatcctcgcatctcaatgacgataattggagaaaattagaagcacagttggccattctcgaaggcttacttggtaacgacgaggagttggaagatccaggattgtctgtattcacaagatttatcactaaccataacacagtaatcacttccaggtgcttcttattattgcctaaatattttgaaaaattctccaatccaaatgcaaagagagtaatagttgatatgataacatttgccgcaagaagcgtgccaagaattaaggtagcatccctcattagtttcacatattacaagcatgtgatggaattgactaccttggataaatcaattcaacctcagcttttcaaaattgtctattctttgattgaagaatgtgaagaagacggtcttccggttttgttagaggcaattggtgataccataactataaaccctagttatgcttcggcagttagcatcagccaaggtgtcaatgttattgatctaatattcaaaattgcattcaaagatcctggtaatgtacaattgattactgatagttcggaatgcttgacagccctgttggaaaacacaagtgtccaggattatatgattgcctgtgaaaagtcgttgccatttattttcaacattatgcaatcctctaatggcgattatactcctgagttgtatttgtctttggaattgctaagcatcataattaaatcatgccctggaggtgagttaccagcgcaaattttcttgtatgcattcccaatattgcaaaaaatattgctcgactcgtttgataatcagatattgcaaagtgggggtgaagtgtctaatgagttgatcaaaaagggatccaaatcatttcttgattacaaagatccagaaaccaaagagtcgggcattgattgtatgttgaaaattgtgtccaagtttttatcaccagaattatctgacagtgctgccaacaagtgtggatccattgtaatttcgttgattgaccaattccaaaattatttgctgtcggattttttgactcaaattttagaaagtgccgccaacagattagtcattgccaaggagacagcaaccattgaaaatttggttatggtgttttgccagttggttttaaaatctccagcggaaatgattgactttttaagcaatatgcagttgcaaggacagtctggattagcggttgtgcttccaatttggtttgatagttacgaagttaccagaggatacgagcaaatcaaacagaattcattagcgttgggtaaaatattcagtttgggagatgcaagagtcgagaatttagtggttaatggtgatataatcccttacaatggtgatttgatcattacaagatcaatgacacagacaatgcccgacaagtttactcaaatatctgcatcg

SEQ ID NO: 796 - DNA, 627 bp, Candida albicans
cgttcctcttttagcactgccaatttttcgttgttcaaaagctacacctcttttttttttcttttctttttcttgaaaaacaccctaccatcaaacatgacagatactccaactgaaggggcttcatattcagagcaaatattggaatctgcaagaagaaataatacagaattgttactttccatcaaagttgagttaaacaatgatcaagaaaagttggcagagttgatcaataccaccaaagaagtgataactgacaatactcctttgcacctagcatgtcaattgggaaactgggagtttatagatatagtattggacatagaaggcgttgagattgatccgcaaaacagagacggagaaaccccattacatttggctgtaaaatatacaaacaacgaagagccagaacacggatactttattgttgacaatatgctagacgcaggctccgatccaagaatcaaagacaaacacaacttaaagcccaaagattatgtttccagtgatcacgagaaattgattgagttgttggagagtgcagagtatgcgatttctatggagccaactgaggctgaacagttggctgagtttgaagatgaagggtctgcatcagactctgattag

SEQ ID NO: 797 - DNA, 573 bp, Candida albicans
ttggagctttggttagaaaaaacagaaaataggcggagaaaaaaaaaagtaggcgtaaatataatacacgtattcattatgagcaatgaattggggaatgctattgcaagcacagtgattgatacattcaatggactatccataaaatcaggcaaaccggttgttaggtcaaatggggtacaacagtggacagtgcttgctagtgtagttgcaattaccaacaacaacataatgcctatcacgttggcaacgggagtgaaaactttaccagacaaagttagatcctattcaaatggtttaatggtacatgatatgcatgcagaaatcttagcccttcgtttattcaattattatttgcttgaaaaggactgtccgttggttgagcactcgggtctaaaacacgatgtaaagttggcactttttattagtgaaccgccatgtggcgatgcatcgatgtcctacatttcccccatacccatacacaccataaaccctggaaccccccaaaaaaaaagtttaactccggaaaaaaaaatttgggcaaatcagaatttgccccaaacccccccgtaa

SEQ ID NO: 798 - DNA, 699 bp, Candida albicans
tatgattatatgaaacgatgtgaatatgttgggtataaatttgaaacaattgccactattccaaaaccatggagtcaagtatcaagaagtcaaattgaaaataggaataagaaagtcgttaataattacgaacaatatctttctgtgattagaactggtattggtaatgtcaaattggtattagctggggaaattgattgttgttgggattatttacctgatgaacagaataaaaaattgaatcattatgttgaattgaaaactagtcgaatcattgaaaacaattcacaagtggtttcatttgaacaaaaattgtttaaagcatggtgtcaatgttttttaatgggggtcacgaaaatcatttatggatttcgagataataatttaattttaaaaaatgttgagttattcaacactgaagaaatcccaattttaattaaaaacaatccattaacaaatgcagcaacagaaaagaaaatcaattgtactaatgcattgaaatggtatggggctgtagttgattggttgaataccacagttgataaaaaagatgaaaccaagagttatcgtttgaaatatgatcctgtaaggaaatcgttcactttaagtgaaaccgatagtgaaactaatgaaaaattaagaaatggtcaattgctcacgccagaatttaccgaatggagacaaagtttgaaaaaatac

SEQ ID NO: 799 - DNA, 1026 bp, Candida albicans
tttgatgataccactgggttgaatacagtgggagtatcttatacacgacaatcaacgacgaggacacaacacaaaagctatgcgtcatctgtaggtcgaccaaagataattggctctgaccttacgcaagggttcagtgatttcaaaccagaaagtttaaaagatatatacctgttgaatgatattttcaaatcaatacaatatttgattcaaaacaagaatttcacaccacaagatttcaaaattgttactgctagaagacatttgcagaaactaatgacgatacctattcacaaacaagaggttcaattcaatgtgatatattggaaaggaatgatattttttgcatatgattggaagtctgagagtaccaccaaagtggaagatccgtataataaacttatacaatatactggctttaaatttgaggaagtggtatcagaaggaacaagagatctgaacttttatactgttgttcaacattgtgttgataatattcctgtgatttatacagccgaagttgattgtagtattgataaagaaacaggattagagaattatattgagttgaaaacacatacaaaactagctgatgacaaaataagtacaattaacaaattgaataaaaaattgttatcgacatttatccaaaccaagtttattgattgtcaacattccattataggattcaggtcaaccgatttaaaaatagcgtcaatcaaaaaatacacacaaagagaacttgcaggagagatcaattcattcccagtgatattatctgataaatgctctattaacaccaagctgattttccaatggtataaactaataatgaattggatcatactgaaagaaatcactgaccacaacaccccacaaatatttcgattatctttcaaaagagatcaagagttaatgaattcatatttgaaattggaaaaaatactccaagaagatgataatgatacgatatttaatgatttggttcctgaatggttccagtcgtttattatgaatttattctaa

SEQ ID NO: 800 - DNA, 933 bp, Candida albicans
accaacatgataggtgaagaatattcaaatatatcgctttcaggaatagctgtggaatccacaccaatcaaaagaaaaccacaacaagcaagttttaccgaatacgtcaccgttaatgaaacaacggtaaacaataattcaacaatattgccaacaaatgaaaaagtccagaaccagcaacagcaatctagtaaagattctgatgagttagattcaattattgatacccatcccgaattgaaaatagcaagtagagagaatggtgaattcaatcctgtcaatgtggcatacacaatgttcacaccccaaaagcaacaaaaccctgaaataatactaaccccactgaataagcccctacaacaacaagaaagcaaagacaaagatttgactaccacatcaacccaacaagtccaaaatatactacttaatccaatgacaccatatactctaacattatatttccaattattttctaatatgataatggccagtattgttatttatatggcttatttagcatatacaactattagacaagatataaatttcaaaattcaacgaatgacgcttgatttgttagacgagatttctcaatgtctgaaacaatatacattgaataagtgtcatttatcaactcgaccaccggcaattgaacaagaatgtaattatttggataaatgtcaaaatcaagatccatctttgattagtcgatcaaatttgacaagtgagatattagcagaaataactaattcattcttcaataaattaaattataaaagtattagtattgtactaatatttcttgtaattaatttggtgtcgaattattatattattggtaatttccaatataatgaaattaatcggttaaaaaaattagagttcaattcaaacccagaatcaaaattggacaccaaaatagatttagattag

SEQ ID NO: 801 - DNA, 1224 bp, Candida albicans
ttgcatactctttcaataatgttgttaattcttgctgtggttttgtttagtggctgttatgcgtcatttccacatcgtaacttgacatggaacgatataaattttgttcataccaccgatacccacggttggtactctggacacatcaaccaacctctttaccatgccaattggggagatttcatttcgtttactacacacttgcggagaattgcccatagccggaaccaagatcttttacttatagacagcggtgatcgccacgatggtaatggcctatcagatatcaccagccccaatggcctaaaatcaacccctattttcatcaaacaagactatgatttgctaactatcggaaaccacgagttgtatctttgggaaaactcaaaacaggaatacgaaactgtggttaaccattttcaggataagtatgtttgttcaaatgtggatatcagactagacaatggcctgtttgttcccttggggctgaagtacaagtattttacaacaccgattagagggattagagttttggcttttgggtttttattcgatttcaagaggtttaatagtggtactagagtgacgccaatggcagaaaccatacacgagccgtggtttcaggaggcattaaaacatgaagtcgatttgattataattgtgggtcacacacccatttcccataactggggagagttttaccaggttcaccaatacttgcgtcagtttttccctgatacgataattcagtattttggtggacacagtcatattcgagactttaccgtgtttgacagtttgtctacaggattacagagcggaagatattgtgagaccgttggctggacaagtgttaatttagataaagcggatctaaaccttcctgttagacaaagattttcgagatcgtatattgatttcaataccgactcatttaagtaccacaccaatttagataaagagtttgataccgccaaggggaaactggtttccaagttgattcgagaaacacgcaaagagctcaagttagataccttgataggctatgtcaagacaaactattatgttgattacgttcccatcgatcaccccaaaagcattttcaatttgttggctctgaaaattctcaaaacattaccgaaatccaaacatgaagagcgaattacaattatcaatactggctcaatccacgtacgacttgtacaaggggccatatactattga

SEQ ID NO: 802 - DNA, 588 bp, Candida albicans
aaattctcaaaacattaccgaaatccaaacatgaagagcgaattacaattatcaatactggctcaatccacgtacgacttgtacaaggggccatatactattgactccaaatttattgtctcgccctttgaaaacatatgggtcaatattacagtgccaaaatcagttgccactaaagtagcagcaaaactaaatgacgccgactatatcagtgcctctcgattgaaaccacctcatcaatacgatttgcaagtccaggacttgagtacttccccccaccaagctcactttgagatgcaggaaaaactccccaaaggttatgtcactcatgatgactttggggctgatggcgacgatacgttgcatcgtgccgtagttaatttcccagtacccaatgttattcagagtgtggaaatcaacgatgaggtagattcgcctgtcaaccttgtgttttatagttttatcacgccaaatatcatctgggcattaaaagagttgaatttctctactgaacaagtaccaacaccatattctgacatttacttaggtacattgctaaacgaatttgttgccaacaataagatctaa

SEQ ID NO: 803 - DNA, 612 bp, Candida albicans
aaggcattaaactcttctgctggtacttttgatagcttgaacggtggtgccttgtgtgtgcaagaacaacaagagcacttgtggaaaatagggtatgagaaatgcattagagtatatcctacaaaaccagttgaataccgtgagtttttattcatgatgggaacttataacatcaacaatttagactcaaatgtgtttttaacccaatctcatttagatcacaattgtgcttcaaatacttctgtggaaactgagcttaaccgtactgcagggttgaaagtcattgctggtagagatatcaaaagtggcgaggaattgactaccacctatgtcaatcctagccatactgttcaccaaagacaaagagagttgcgtgttaattggggttttatttgtgcttgtgctaaatgtaaagacgatttgaaacaaaatgaacgtcgtaaatcgtcccataatcagcaacaaaatgctaacaatattagagacatgttgaaagaaacaaaagatgccgtaggtgaagaaggaattgagttggaaataccgactgagtttaacggagaaagaagaaaatcagttaggtttgacgagaaagtagttgcagtaaaggaatag

SEQ ID NO: 804 - DNA, 555 bp, Candida albicans
aatagaaatatggctacatactctgaaatgacgttcaacagtcagcattatgacgattcaagaccaaattatcctcaacccttctacaaagaattgatcaagtatcataccaaaaaaggtgacaccaaattggcaattgatattggatgtggttcaggttttgttgcttttcagttagtcaactattttgattctgtcattggaactgatccgtcatctacaatgattgaacaatgcaattccaatattcctccagaatggttgcgaaattctcctaaaaaaattagttttatgaaaggcacagcggaacaccaccccgtgtcaattaaagaaaactcagttgatttaatcactggtgccgaatgctgtcattgggtaaatcacaaacaattttttgatgaatcatacagagtcttgaaatcaaatggtacattagcttactggttttataaagatcccgttttcattggatatcctgaggcaaacaaagtttatactaattacatctacaactcctcttttgatgagagccccgatgaagagtttgagaggtag

SEQ ID NO: 805 - DNA, 618 bp, Candida albicans
ccaacattgggtattaataaccctactctgacactgagaattaaatttattactggatcagtagaagaatttgttaaacaacaacaacaaaataaagatcatagcgttgcttccactctcgaacccaattcaattgatttaataactgctgctcaatgtattcattggtttcaagattataattcattcttccaaaattgtcatcaattattgaaaaatgatacgggtgtcttagcatatttcttttataatgatccgaaaatcgttgaatttctgggaccagcacgtgaagacatccccaaggaagagatactcaaattaagttatcaagtatataataaatatgtgtatgatgatgataattatattggtcaatattgggaacagccaggtcgtaatattttgaaacatttttgtcaacaagttaatgaaaagatcccacgtgacctatacactgatattgttatcaacacatttaaaccatcaattgaaaaaaacaatagtggtaatactagtatagccaatgaagaaattgatttggatttgaagaaaattggaatttcaattcaagattatattgataatatttcaacttataatgggttccataatttataa

SEQ ID NO: 806 - DNA, 411 bp, Candida albicans
acaatcttcaaaacctttactacaagcaaacaagaatttttcagggatcttacccccaatgatttgagtttcaaatttgttttcactttcaattgggttcatttcaccaataactctaccatattgaccagcaccaccagattgctttttgtgtgtgtaatcgaatgcagaaggaacagtgatggcttcacggtaggaaacttgaggtttaccagtgacacagtcaacaccatattcacgtttgattctttcaacataaatttccaaatgcaattcacccataccggaaataatagtttctttggattcggaatcataatgtactctaaatgtaggatcttccttttggaaacggttcatggctttggaaaatgcaccgttatcttttgtctttggggagatagacaatga

SEQ ID NO: 807 - DNA, 1158 bp, Candida albicans
tcaattagtaaccccgatcatcaattcttaccaacaaccatgacttctttagacgtattgattaacaaagcaaccgatcctacattaacatcagataactggcaatatattcttgatgtatgtgatagaatttcagcagatcccgaaaccgaaactaaacgaaccattactatattgaagactaaattaacttcaaaagatgctaatgtcgtattaagatccttatcattattaatatctatagatgaaaattgtgggtccagagtcaaacaagaaatagccaccaaatcatttttacaagatgctttggtcaaaaggttatcggataagaaattgcacgccacagtgaaatacaaaatatgtgaagtgttaacacaattatataatgcatttaagggagatccatcattgaaaccaatgactgatgcatataacaaggcaagactggaacatcctagatattttagtaaacaaacacaaggtccttcaaaaccagcaaagaaggaaagaacacaacaagacaaagaccgtgaagaagatgaattacagagagctttgaaattgtcattgcaagaatttgagcaacagaaaactgggaagaaagaacctgatgtgaataaacctttaccggaaatacaacctgaaccagaatcgcctccagtggaaacagttgctacagtttcaaaagtgagagctttatatgatttagtttcgtatgaacctgatgaattatcattccgtaaaggtgatgttataactgtgattgaatcagtttatcgtgactggtggagaggatcattacctagtggcaaaattgggatattcccattaaattatgtcacacctattgttaataaatcaccacaagatattgccaaagaaattgaaattgagaataagttaatcaccgaggaacaaaggaaaattgaaagattgttagcaatcttgtcgtcacaacaaatagaaactataaacgaagacgaagtaacacacttatataatgagatcattcctttgcgtattcaattaggtaattcaattgataaatatggagctcgtcaggaagaattgaaagtgttaaatcaactgttgaattctgaaatcaaattgtataatgagtcactagataagctgatttcaagcagaaccaaacacaac

SEQ ID NO: 808 - DNA, 1215 bp, Candida albicans
  unsure (752): Identity of nucleotide sequences at the above locations are unknown.
atacccattaaaataatgaattttaagacagaaaattcaacaacaccaaatggtgattggtctcaaagtaaagcatttaccaactcaggctcatcattccctgttttaaacggtacttgtgaattagatcaagaaaaccttgctttgtcgaatagtggtcaacctgaaagtatatttactcaagattcaggattacatggtattgacgttgccgctccactggatataactgatttgaataatcaatctggttaccaatacaataataatcttgctcatgatttatattttactggatcaatggaaatgcctacaacacaacatccttacattacaaatactaataatcatttatcatattcaaattcttcggaggagttttctcctatcggcaacaacatgtctcctgactctacaggaggagcaaattcaaataattttactagtggcaataagagaaaagccagtaatgaatctttttcaccattatcgggtcatcattatggaacagagtctggtaataataataataataatggtacaagcagatcaagccaatactctagtcataaatctaggaagaaattattggatgaaaaagatgctgctttgattgctcgagatgattctgaattgactgaagaggaattacaaatgaaacgtaaggcacaaaatagagctgctcaacgagcattccgagaacgtaaagaatctaaattgaaagaattagaagcaaaattattggctagtgnagaagaacgacaaaaattacttgatgaattagaacagatcaaaaagcaaaatatttctattgccactgaaaatgaaattttgaaacataatggaatgggaaacattaataatgatgttcaaattggtaatttgagtagttatggccgtttacaagttgataaattcaatttccccaagactcaaaaagattttattgaacatgtattacaaggtacaaaccatcaattgaaagatgaaaataaagataaagtatataatgataatcaaggacataaattattagcccttggtgccgtttgggattatttacaaattaaagctgaagaagccgatttggattttaattccattgatttcaacgatgtaatggaaaaattaaaaggaaatgaaaaatgtcatggttatggtccagcatatcctcttgaattagttaatgaggcaattgaaagtagtttgaattga

SEQ ID NO: 809 - DNA, 1248 bp, Candida albicans
aagatccagttcacttgccctttttcattttgtttacccattaaaataatgaattttaagacagaaaattcaacaacaccaaatggtgattggtctcaaagtaaagcatttaccaactcaggctcatcattccctgctttaaacggtacttgtgaattagatcaagaaaaccttgctttgtcgaatagtggtcaacctgaaagtatatttactcaagattcaggattacatggtattgacgttgccgctccactggatataactgatttgaataatcaatctggttaccaatacaataataatcttgctcatgatttatatttcactggatcaatggaaatgcctacaacacaacatccttacattacaaatactaataatcatttatcatattcaaattcttcggaggagttttctcctatcggcaacaatatgtctcccgactctacaggaggaccaaattcaaataattttactagtggcaataagagaaaagccagtaatgaatcattttcaccattgtcgggtcatcattatggaacagagtctggaaataataataataacaatggtacaagcagatcaagccaatcctctagtcataaatccaggaagaaattattggatgaaaaagatgctgctttgattgctcgagatgattctgaattgactgaagaggaattacaaatgaaacgtaaggcacaaaatagagctgcccaacgagcattccgagaacgtaaagaatctaaattgaaagaattagaagcaaaattattggctagtgaagaagaacgacaaaaattacttgatgaattagaacagatcaaaaagcaaaatatttctattgccacagaaaatgaaattttgaaacataatggaatgggaaacattaataatgatgttcaaattggtaatttgagtagttatggccgtttgcaagttgataaattcaatttccccaagactcaaaaagattttattgaacatgttttacaaggtacaaaccatcaattgaaagatgaaaataaagataaagtatataatgataatcaaggacataaattattagcccttggtgccgtttgggattatttacaaattaaagctgaagaagccgatttggattttaattccattgatttcaacgatgtaatggaaaaattgaaaggaaatgaaaaatgtcatggttatggtccagcatatcctcttgaattagttaatgaggcaattgaaagtagtttgaattga

SEQ ID NO: 810 - DNA, 1479 bp, Candida albicans
aagcagcagaattccaatatcatttcaatggcaacccatttaattccaatggaaccagaaacttgtcacgtggtttatgtaaagaccgtacaagtgatgaattcccacaaggataattcagttgttgattcaatgattccatttttattacaagatccattcacatcagctgctgctagtagtggtgagagtggtagtagtagtagcagttccggagtatccacaaataatcataataataattaccatttaatagagttaccaacgtgtccggtgtgtttggaaagaatggacgccacggtaactgggttgctaacaatcccctgtcaacatacatttcactgtcaatgtttaacgaaatggaaggatgacacttgtcctgtttgcagatattcgcataatattgcaaatgaacgggtgcgccgatccactaatagattgcgacagttaagtattcgagacacatcaatcgataccccgctttcacgatcaccagagcaacagcaacagcaaaaacacgcacagatgccctccttacttaaatccgagtttaatgacgatgatgacattgacgacgacgatgcaggagaaatttgtatggagtgtgatgagactgaaaatttgtggatctgtctaatttgtgggaatataggttgcagcaggtatgcgccagagcaacattctctaaaacattttgttgatacaggacattgctttgcaatggaaattgctaccagtagggtgtgggattatgcaggtgacaaatacgtgcatcgattagtcactaatgaaagtgatggtaaattagttgaattgcctgacaaggatgataaactgaacggtgggtcttcaaataggaatgatccaacttttgataaagtcgatgaagttgggtttgaatattcccagttgttgataagtcaattggcgagccaacgagaatattatgaatcgttgctagagcagcaacagacagcaccgaaatctagaagaggatctagtaataacaccaaaaataataatcatattaccaatagtagtagtggcagtaatacaaataaaataaatcaggaaatgcttacagaattggaaattaaagttgaagatttgaattcaaaattatctgatttgacaaatagtttgattccacaattaaaagagaaaatccaatccaaagatgaaaaattaaataaagttatgcgagaattgaatatatccaattctcttaatgaagcattatcgaaaaaagtcgaacatttaaccaaagtaggtgaagattataaaaccaccattgaaaaattaactggagaaaacaaagcattaaatgaacaagttacagatcttatgttttttttagatagccaagaaaaatttaaaaatgaatctcaagaagttaaagatggtactatagttatacaacaacctcctcctcctcctccttcactggtatcacgaaagaatagaagaaagaagaaatga

SEQ ID NO: 811 - DNA, 354 bp, Candida albicans
ttgtatattatgataggtaccgattcctatcatataattattgatatacaagagtcgctccccactacaattcaaatcatcgaactagattccaaaatgccattacaaccaattgaaccactaagggcaaaactgattgggaatggtgtcataagactatatagagagtttgagaatgaaataccaatcactggcgaaacttcactgaatcaaattactaataatccaggcgatgatacaatggtggcgattttggcagtaccaacgtattttactgccacagatctactaggatttattggagaagaagaatgtatccaaaaatatatcacatttgagaatattgaaaagtaa

SEQ ID NO: 812 - DNA, 1023 bp, Candida albicans
aaaattttcagttcattaatctcacaaaaactgatactacaagtcttttcaatgtcagaaaacgaacaacaaccaacagtgacgacaagagaagagctacttcaacgtcataaaaaggaatccaaggatttaatagcaacaataactggattgaaaaagcaagctaccaagaaaacccgaaaaagcgttcttaacaaatgtcaagaactacaagataacttggaccagaaacataaacaagaattgaaagagttcgacaacccaaatggtggtcaagacgaagaagaagaagtaacgcctgaacaattgcttgcacaattgtctcttgaaaaggaatcaccagccgcagagataagtaatactgagagtctagaagagggaataaatagtggtagtggtggtaatgctggcgacagcataaaaccacgaaagaaaagaaatagacaacgagaaagattgaatagacgacaggcagaaattgacaaaatcaaacaagaagccgctatagaagcatctaacactgttgattatcgacagattgaaattgaatcaatggacaaattattatccttgaataacttacaatcatttgaaataaaacccgatggtcattgtttatttgcttcgattcaagatcaattgaaagttcgtcatcaagatgttgaacacctagaccacaatggtcctgaagatgttcctctgatcgatcaattgagaaaattagctggtgattatatcaaatctaatcaagaagattttatcccatttttaattgatgaaaatactggtgaattgagggatctcgatgactatatcaatgaattaacaactacagcaatgtgggggtccgatatggaaatcttggctctaagtaaagttttcaattgtccaataagtatctatatggctggagcatcgactttaaccatcaatgagcacggtcaattgccagaattgaaattagggtattataaacattcatttggtttaggtgaacattacaattccttaagagatctatag

SEQ ID NO: 813 - DNA, 789 bp, Candida albicans
acctgcattgttctggattcaccaataaaaaggcactcatttcccccagaaaaaaaaaaattgtaccacctttcttttccaaccatgttaagacaaccattacgccaaatccgtttccactcgaaattggcacttgcaggatacaacagcaaagaagtgacagtcaccatcaacggcagaacctgtacattcaacaacgtgtttttgagagacgcatgccaaagcccagactcggtagaccccatttctagccaaaaactattcactacagcagatgcagcaaccggcttgcaaattaacgcacccccagtggtagaggattcctcattgaaaatccaatggagcaacaatggcaaactcaccaactcagtctaccccgtgtcattcttagaaaactactccaccaacaaacgactcggcaaattctttgacaaagatagaaagttatgggacaaacaagaactcgaaaacaactttgcctccctcaacatggactacgacgacattctcaccaacgacaactctttcttccagacgttgtacaacttgaataggtacgggttaacatttgtcaacaacatccccaccccacaaatttctgacatgacagaggacaacgccacgcaatggccagtgtacaagatcgccgaaaagtttggctacatcaagaaaacattctacgggacattattcgacgtcaagaacaagaaggaaaaagcaaccaacattgcctacaccaacacgtttttgccattgcacatggacttgctctactacgcgtcccccccg

SEQ ID NO: 814 - DNA, 1260 bp, Candida albicans
  unsure (721): Identity of nucleotide sequences at the above locations are unknown.
atcgataaagtagcgagtaatgcttttttttttgttctttttttttgtactttttgtttgtcttttctttcctcaatgagtttgaatctaccaaatcccagtctaataggtatactactagtcatatcaacccatagtggaccgcaattaatatataaatatccatttgatttatccaatgacccatctagagacgaatcgaagtatgcattggatgacaatgaagacgatgaattatatgaccacgaggagagtgaggatgaaaacgaagtaaatgaaaacgaaatgtatggggttaactcacgaaactgggactcgaaacatatcgattactacatgggcaccaagtcagaccttctaaagtttttagatgaacaagactcccggagaaggaaaatcacaaccacatcaccatcagaagagaaacatacaaaggaaaaacatggcctaacaaagacaatatcaaagtcaagcaccatggctagtctgtcaacgacatcaccgccagaaagctcaatacagggagaaatatttggaacagatgcagcctacatatgtgaaatgttggcaccacccaaacaaatgtgcaatactcgttttgaaatgactattcaagacaagctatttttgggactacccgttcacagactggacaatggacagtggcgtagcattggccacaacaacgagcacgatgaagaagaaacacacactgccaaanacagcttaaacatgtttcacttggtatttgtgatgaacccaccagttattgaaagcaactatagagtagatgaaatgttccattatgtaatatcaaggttgtcgcttgtgttgcgttatgaacagcaaaagcatgattatgtgtcccaacaggtgaagaacattttggcgctacgagaactgcttgaaggaaacgagtcattgttgaccgaaaaatcgtcattgtccagagtgatacgtgattgttttgaagggatcagcacgtcgaccattgccaatctctccataaatgggaagttgcgctcatttcaaataccaatcaaaactgagttccattccctacctgatccgtctgttccctttctcccagcttcatatttgtcgtctacagtggagctacttggagacacaagctttatcaacgtaggagaaacatccagatacggccatgcgttcaattcagtacaagacgaggaaaactcggcagaaaagattattgtttatttcgctctactattattggacgttttcaccacgggc

SEQ ID NO: 815 - DNA, 1707 bp, Candida albicans
tattgctttgcaagaacaaaaagaaaatattatcaattcattgactcaatgaaattagaggcgctgtcttgtagttccaactcaagtgaatcttccacaagtgatttaattgaatcgtttccaccattagaaacaactgtatctcctaaagaaaacataaactcattatactccaataatcagtggcacgacaagattgattcggcttcatctaccttgtctagcagcaatagtggcaaactaaaagaaaaatttaccacaaaacttgctattgatagtgttgcgggaatgacagcatcgaataaggcgtctgaattaaacagcgcttacgttaggggacgtccttctgcttgtgtatttgtcgctagtttatgttccaatatgtctgacgacgcactatgtgtttcagtgactgatcattttaaacaatggggcacattagccacagtcaaggttttgcgtgacacttgtaaccgcccttatgcttttgttcaatataccactgatagtgattctaaattggctattgagaaaggtcacaactcagtattggacggaagaaatattcggtgcgaggcggctaaagttaatcgcacattattcgtgtcatcgaaatcgtttcttagtaaaagtatcattaaagatcggttgtcaaattttggagagatcgaggagttgctccctagtacatctaagggggagctatacaattctggtgttgatactagaggttataagaattggttttgtaagtttacttatcgtgatgatgccattagagcttacgcaaatttgacagaagaaggtatctacaaggttgactggacacagaatattgacaaatccaatgcaccacggaatgttaatgagcctgaacaagaatctttaaaggtcaaatttgacaagtattctatatttgttggtcaattgagtcctgaagtatctgaggatcaactttcacaaagatttgaaaggcatggtgaaattcttgacttgaatttaattaaaagaacgaataacacgtttgcgttcatcaagtttaaaagagagtcaagtgctgctggtgctgttgaaagagaaaaccattctatgttttgtggtaaaacaatgcatgtgcagtatcgtgaaactcatatccatgctccaatacgtactcgaagcaattacaataatggtatcccattagctccacctccaattaatttgaataagaaatcatttcccaaaaatgactacgtcaaatctaaaagtatgatcgaaatgtccaaaccaaaattcaactcttatccctcgaatagcttcaacaaagggtttactaaattgaagcaattcaagagttttagaccaggtagttatgaaaagaaatttggcaataccaaaactgaaagtacttggcatgcatcgcaattgaatcttaaaagtgaggtctcagagtcgagccaggttgaaaagaaggccagcggggatattcgtgttccaagtgctccaaatgaaagcaggggaagtggtgcaagttcaagaaataatagcagtactagtttcccaccgccaccacctaccactaccacacctgggttcccattattttattatgttcctgctgataatgttaattttgctaattcttcttcggcaaatccacctccatcttataatgtttatccacaatattatcttgcaactgctgctgctgccgccgcggcgtaa

SEQ ID NO: 816 - DNA, 1119 bp, Candida albicans
atactcaattgcggatccgtccagccccgtggtgaagacgatagtcagggactgaatcaaagaagaaatcaatcagaggtgcaaaaggatcaacagtcctttaaagtcaataaaactacgttgcccaaaacaggtggtactattgaagaaagagtttcgtattttatctattgtcttcgtaaattgatccctgaattatcccaatatttccatgaagaacagattttgacaaaatttggttgtcttgatgatgagtggttaatttggtggttgaaattttgtggaacaaaagtatggtcaaaatacgatagaggcagaatttgggatttcatgttgggttggaggttgaaaaacccgaaaagagatttcaattactattatgaaaaactaaattatgttaatagaaacactttagaaaaattgggtccggatatcttttggtctgttggtaatgaagaggaagacatcagtggtgataacaatgttgatgccaacgctaatgaaataaataatactgagaaaactgaaacagggaaactagttaagcgtgaaggagatataaagagaagctcattcaaggatttggtcaatgaattgagtaatgagttacatatctcaaagagggtatccactgatgaggtggcgacatctacttcttccccggcaacaacaaaaatggcatcttcatcatctacgtcatcaactctaacaccaaatgtttcaattccattttccagagttgatcctcatgttgcgttaattttcatttcgctatcgttattgaaatcgaaagaaaatatattggttgagcttgatcaacatgaaatcaggcaatttttatctcgattaccttcaaaatcatataaatataatcagaaaagaagcactagacaaaaaagaacaagctatgcatcgaatgcatcatcaacttctaactcacctatgggacaactgcctgtggatcgtgatgaagattccattttccccacgagcagaattgttatatcaaatgattctaaagatcaaaaacataaagttaattttattgataatattattctggaagctggtgaattatggagaaaatggctatggctggaaatggttgaggataattag

SEQ ID NO: 817 - DNA, 1119 bp, Candida albicans
aaaaaagatttgatgttgcagacttcaaaaggttcaaattcttcatcaacttcaagctcaagatctgctagcatttctacagccacaccaaacactatagtggaagatgaagaactattatgtgatcctaaatctgaattgacaccaccagcagttgcaaaccctttgagaccagtatctaaatctaatacttctgtggaagatgattcaaagccgtcattcacctatgatttggacgtgtttaatttgtgtaaagaatacctaaataccaggaatcatcatggattagcattgattgccagacagaagggtatccctccaattttgaggttcaaagtgtggccaatattgctcaagtcccatccatttgttatcagtccttttattcagccagatagtgaacttttaaatgaatctacttcaagtagaagtaattcttcttcttcttcaacaggaagtaataccccgctactgactgcccctggaagcataaaagatgcggcaataattgatggtgatgctaacgataatgataacgatagcaatagcaatagcaatgacgacgataatgatagagacgacaacgatgccaacactaaagaaaaggaagaggacgaacggaataataaaataagagaaaagataaagcgtgatcttgccaagtatatccagagactaaagtattcacaatcaaaatacacagttagtgaaacagaacatgaaatactatcgattttagaaaatgcaattatgaaattcactttgaaatgggggaaaatcataaaatatgatctgtctttaacctggattgccttgaacttggcagaatggttcccaccaataccgaaaactccatgggttttagtcggaaaagagtattctagtagccatcaatcattaattgtaaattttttggacgattattcaaattacattgataatatacctgatttgagagaataccttgaaagactcatctaccacgatgaaaaaatatcaactatttcatttagagaagtatatgaaagattagtgttggtattgttgcattgtccacaacctgtttctcgaagaaaaaaatcggatcttcaccagccggcaggaggcacaacgtcgtgg

SEQ ID NO: 818 - DNA, 420 bp, Candida albicans
ttacctaagcgcggatttgccactcccgtggtgaagacacagcctgatattaataatcaattgtttgaatttgtgtttgatcgattagtgaaaattttccaatcacaatttattgaaaatacatggagatctaaattggaaactacagaaatatttaagaaagtattgacagaaatagaagactcggggaaacaagtaaatgccaatctattaatcagtacatgggagtttttgaaacaaaagtgtctaacggtcgattctattgaaaacgtgaaaattcaatttataaggttatcaaaacaattaaacctctacttgaacaaagtacaccaaacactgactataatcgatgcattggaagagttttccagaacagaaaattcaaatgttgtgttaacagaacttagaaaaactacataa

SEQ ID NO: 819 - DNA, 1359 bp, Candida albicans
actgacatttataaactctataaagaattgattgataattctctgcatgaaatgcaaatgttggtattggcaaactctagttttcgcctaaactcatttttttctctctgttgtaaaaccaaaattttgccactatttttacttttaccaaaaacacgtaaaaacaaccaaaacttctccttacttatgtcttctcaagaattagctttggttaataaggtagagcttagaatagctttagctgaaaacgacaagcaattcgagaatgccttaaacatatatcttgctccagtcctattaaagttagccagtcctcacattgaagtgagacaagctgtactcaaaatcattcagcatatagtaccaagaataacggcagcaaggacaattaaactcccagtggaagctttgatccaacaaatcaaaacccccaatgttgagactgacccaacatctgttagactatattccgctttatttgtttctagaggtgtggataggttaaatgaagaggaaaagaaacaactcatccccactatcattgaaggtttacataactatcccaattccatatcagcaagaattttcaatatcatctgtaagttattgcagaattggaaaatgcctatgaaagggacagacgaatatgacaatatgagaaggtttttacaattagacaagaacccaattgatgaacaatatttgtcgttacttattagcaaatttctcttgctattacccgagtctacaaataaggctacaccgggattgagtgtacaagataatgctttttttacaaccgacgcagcagtcacttataaaacgagagacgatattttccaagtcaaaaataatctacttgaatttttgaaatctggttttattcctgaacaaattgccttgccattattaattgcatcggcagatccttcgtcttcaataaatgaaccatcagagatcgcatttagaaaattgggcgttgattttgatctgattatcgtgtatgataatatatcatttatcgactatatcattctgttgtttcttggcacaaatgctccagcagtcgactcgaatttgcaatgcaaaatcttgcaggttttgattaaaagtcataaagtacattcgcaggacaaaatcgcgtcagctgctcttggatctgataactccagattgagactgttggcaatacagtttataagaaagcttggccagtcaccagtgccagaggaaaatttagaaaaattcaacgaagacatcgctcatcaattgagaaacagtataatcgcagaaggatggccatgtgttgaagtgtcaatggggtcttcaccacggggctggaaggacccgcgctacaaa

SEQ ID NO: 820 - DNA, 891 bp, Candida albicans
  unsure (13),(38),(49),(871),(883),(884),(885): Identity of nucleotide sequences at the above locations are unknown.
tcgtcattgttgnatagattcaaggatatattcagagntaagtggaaanagattgacgaacgttcagttatagcattcgggtatttgaccttaactggaaaaactgggctggattccgaaagtttgagtgatgacgaacaaataattttcaacacccatgtttcaaaacaggtggaatatttgtttacttctggagaagcacttgttgtcgctgctgctggttggaactcaaaattattaagcaaacagttggacattcccgatgcaactgtcgagtatattccccatgatacatcacgagtggcagctttgttgaacaatattctcgctgcttgcagaaacactcagccatccttaagaaaagcaggttgtatttggttattgtctcttgtacaatattgtaataaccttgatgctgttcgttccaaagcagcagaaattcatgttgcatttatgagatttttagctgacagggacgaattggtccaagaatcggcgtcaagagggttggggttggtttatgaaatgggtgattttgatttaaaagaaacacttgtgaaatcattattgaaatcattcacccaatcaaacacttcatctttcacgtcaggatcagtggagcacgatactgaattatttgaaccagacttgttacggacaaacgaggggtcagtctcaacttacaaagatgttttaaacttggcccaagatgttggtgatccaagtttggtgtataagtttatgtcccttgcaaaatcatcgtcgttatggtcttctagaaaaggtatagcgtttggattagaatcaattttggcacaatcatcattagataaattgctcttgaccacgggatggaaggaaccgcgttccncagcagcaccgnnntccact

SEQ ID NO: 821 - DNA, 681 bp, Candida albicans
ccctccatgtcatcatccacattttcacaaacaaggtcacaggcattaagtttggaaaagcaaacagaacaattattatcaaaattttcccaatttcaacaacaacagcaacaaaatcaatcacaatctttagatataacaccagaagaaaccattataagacaacaaatagaagagattttccagaaaagaaatgccgtaattctgaaattaaatcgtattagtgaagtagaaccaaatttatcaacatcaaaattacaacaattgactcgtcataaagaaaaattaaatgatgataatttatcatttacgaaaattattaataatattgaagatgaaagaaataaaaacaatttattattcaatgttcatcgagatataaatcatcataaacaacaaagaaacattgatggtaatgcatatattttagaagaaagtgaacgagtgaataatgttaattccatagctgatagattattacaaggtgcatttgctacaagagatgaattattaaatcaacgtcaatatttaaataatgctcaactgcaagtattaagtactatgcaaaatattcctggattaaatgtgttgattagtaagattaatactcgaagaaaaagagatacattgatattggcttcagttatagctatttgtatattatttttattctttgtgtaa

SEQ ID NO: 822 - DNA, 1758 bp, Candida albicans
  unsure (78): Identity of nucleotide sequences at the above locations are unknown.
atacaattttaccaagtcatgactaaaatagagctgataaataaattattaaaatgggctgagctgaatggtgctcanatatccccagatgttgaattcaaagaaatatcaaagaactatattggtgccatctacaaaggaaataaagtaccagattcacccttttgtcctatcagtatcccatcaaaattaattattactccacaaactgcattcaaagaattctcaaaactgttgaaaaataccgacattaatgacaactcaatattaaaattgcacttatgtcatgaaagattgaatggcaattcattcttttatccgtatttgaacttgttgccctctttgtcagaaatcgattcaccatatacatggtcagcaaatgataaatcttatttacagggaacaaacttggggaactctttaaaggaaaatttggttacgttggtggaggaatggtggaaggcaatcaatgccttacatgacgatcttcccaaacctgaacaacattacattaatatgaagttctactatgagtataagttctataccgatgatgacttgaataagtatttaaatgatgaaaatattgagaattggactagtttcccaaattatttatgggcttcgttgattttaaaaagtagatctttcccagcatatttgattgataaaaataacaaacaagatagtgctatgcttttaccagttgtggacttgttaaatcataattccaagagtaaagtacattgggatgtttccgacaattattttaagtttagttcagaatcgatagtacccgggaaggaaatttttaacaactatggtttaaagggcaatgaagaattgttattggcctatgggttttgtattgaaaataatctgcaagattcggttgcgttgaagatcaaaatgcccgaagagaagatcaaagccattgaagagtatggtattaaattaccaactatagatgattacaccaattcagtagttgcaaatgatgccccctctactgcagaaacaaagcatcaagatggcgttttgttctttattaataatgaaaatataccaagcaacttgattgaaacattccaatttttagttcaaaatgaatgggaaacgggaattacattgcgtatgaaattatcaggtttaaatcatttacgtgccgctttggagactaaaaaaaacttgcttaaacttgatgtgcctcaggactcgcaaaagcataagtatattctatggtatattgaatctcaattcaaaatatttacatcggctataaagagtatcaaaagaatggaaaaggaaatattaaaggatgaaaagacgcatttaactacattgaaaaatgttttcaaaaaagattgcaagttccaacaatcaatgttatttttgggattcgctgattacgatgcagtattagagtcgcaatttcaggatcaatgctggttattgtggttgatccgttgttataatcgcgatcaatacaccaatgactcagagtgtttaccaatgtggattcatgatttatttgtaaaattaagaaaaaacacagacatttctgcacaagaagtactcaactacaaaccaatatatgagaacttgattcctgatttatctgtgcaaattcctgaaatttacggtaagggacaatggaccctaagtgagtttataattgctgcaaaattattagatttggttggatttgtcaggggtaaagaacaagagtgtatattagtcgaacaaacttattcttaa

SEQ ID NO: 823 - DNA, 909 bp, Candida albicans
gcaattatccctgaagaaatcaatgatccatttgttacacgagcaaatacaaagaccaccgcaaccaccaccaccaccaccattaacaaaccaacaccacaagaagcagaattacctagccttgacgaatgttacgataaaaaaactgaacagataaaacataacaatttcatttccaatacaatgaaatccccaacatcattttctaaatatatgattcctccaccccaacgattattccccttatcaagaaatcccgaaaagaggcgaagaaagaaaatattaattcttgatttagatgaaactttaattcattcattatctagaggatcccctcgttcatttaatcctgcaactgcttcgaagatgatagaaataaaattaaacagtatatcgtcgttatattatgtttataaacggccttattgtgattattttcttcaagaaacttctcaatggtttgaattacaaatattcactgctagtgttaaagaatatgctgatccgataatcgattggttagaaactgaaattcttgatcgacaaaataaacgtagttcaaatggttctgctacaaccaaatcaactacaaaaaccacaactaatcagacgaaaattttcactaaacgatattatagaaatgattgtacttatagatcaggagttggatatattaaagacctttcaaaattcattaaagatgaagatttaaaacatgtaatgattttagataattcaccaattagttatgctttacacgaggaaaatgccatttctatagaaggatggattaatgatcaaagtgataaagatttattgaatttattaccattattgaaaagtttaagtcttgctattgatgtaagatatatattaggattaaagaatggtgaaaaatttatagaataa

SEQ ID NO: 824 - DNA, 1080 bp, Candida albicans
aatctttttttaatacccctctcttataaaataatgccagagtatttgaaatttcgttctaaaccatcaggtagacatgaaggcaaacaacatatcataattgttggagccggtattgttggcgtatgcacagcttactacattgtgaaacatcctaaatttgatcctgagaaatttcatataacacttatagaaagtaaaagagttgcaggaggtgcaagtggtaaagcaggaggattactagccttatgggctttcccagaacaaattgtttccttatcattcaatctacaccaacaattatcaaatgaatacaatggagaaaaagaatgggggtatagacgattgaccactgtttcattggaaggagatatatcacatttaagcaataaaaagcataatgaacacggtgacgatgaagatgaggacgaagatgaagacgaggatgaaaacagcgagggccaatatgagtttgacgacattagttttaaacggacaactactcatgatagtgattcttcctcctcaataaccgacagaccacctaaaaagacttccagaaatacaaggtcatcttcaacagttcaattaggatcattgaaaagcactttacctccaacgttgaattggatcacttcatcattaattgaaagttgttcgaaattgggaggtaccgatacaactgcacaagttcatccttacaaatttaccaattttattttgaaaaaagccgttgaagaatcaaagggagcattggaaatgattttaggtaaagtgaaccaaattacttattctgaagaatctggatcggcaaccggtgtagaatatcaacccacttctgtgaaagaggacaagcatcaagatgaaataattaatgttgaggcagatcaaattgtgttgacagtgggaccttggacatctaaaatcttacccgattgtccaatatcggggttgcgagcacattcaatcaccattgccccatttaaagatcaacctgttagtccgtatgccatctttactgaatttaaaacaggtccatattcgtacatatcgccagaaatttacgcccgtcaggactag

SEQ ID NO: 825 - DNA, 927 bp, Candida albicans
tccccgacttggatcttccaggtctggtgtaaaacgaaaaacgaggagttcattgtttatttaacattattagataataatgatattaaatatattgaatcaaatccaattagtgatgggataaattatttaaattttaattttaattgtaatgagtccaagaaaaacaataacatggatgatcatattctgacatttaatcaaatattgaaaactccaattataccattccccaatgctcaacctcattatttaaatttaaaatcggttgttttcgctccatcattacatttcccaattggtcccgtggaaaacattgctatttcttcatggataaaattaaatgatcggatattaacttatttgaaattattttctagtggattaattcaattaattagatcacaaaattcaaaattgattttattgactccaacaatattaagtggattatatatgccttattattgtccagaaactttatttcaacaaaatttaaaatcaatattcacaattttaactcgtgaattaaattatcaaaatataaatgtaacacaaattcgtttaggtaatttatatttactgaatcaaaaattaaattcaaatgcaagaattgaaagtttggtgaattcagaaattagagcttggacttcagaaatgaaacaattatatagtgaaaatttcactaaattacaatttaaagctaatccattgaaatcatctggtggtaaaggaactcatttagtacatttatatcatttattatttgatttgatttataataatgataatgataatgacaatgataatgataatgctaatggtaaattaaatcctgcagtggtttattgtggaagaggagcaagaatttatgattggatttcaaaaatattacctgaatcttggattcaatggttattaaaatag

SEQ ID NO: 826 - DNA, 978 bp, Candida albicans
aaaagaaaaaagagcacccagaaaatttttttttggatgattcatgagtcgtctttagtaatgtcgttagtggaagagcaagaaagtattaccttacacccgaaaccagggtttgtgattaaaaccaaaatcttagagtccaaagacttgtcgcgaacattaaccaaagtgtttatcaatgtatgccattctcctgatgtacccaaaccagatgtcgatttcgaaccggaaattgtattcccattaatcattgacaacgaatgggaaatacccattatcctatcgaaggaaaaaaagtctaaagataaaaaggggttcccgtcatttgtgtatgattgttgcataaactccgagtgcttccaatggtgtcaaatcagcaccgacttaaagtctatccttattgaatggtgtattgaatcggtcgaattggtatactcgctcacattagaacgggaatactcaatgcctaaaatgctagccaagggcgaactatccaatacagtagtcaccaagaaagaacttttggggtctgggctaaaagatagacttaaggaactacaacaaaacgaaaccttggggttgattaaagaaatggaactggaggaagaggaagagttgcccgatttgatgaatataaacaaaacccccgctaagccattaatagaggaaatcaactaccaactcaaaccaagcccaaaactgaaaccaccaaaaccagttaaggagctaacttacacggttctgttcaaaaatgtagctgatccaaacttcaacctagcagtgattgttacttacgatgaagaaattgacaataacttctcaatcacctactcttcggaatcttcttccctactcgtcaaatccagcggcttgaaattcgcttctggaaatagtttggaaattccagtatcccctgacataattgtcaccaacacaaaatgctttgcagttcataatactatgtacatttttatatga

SEQ ID NO: 827 - DNA, 1107 bp, Candida albicans
aacagagaaaattcaaaggtaatttcattactattgtcgttttttaggttttcacttacaattaatggtctattcttaatgcctagtcatgttaccaatgtatataacgatattgatgatggaatgcttctactgtctttgtcattaaatgagagatcaaatgatagaagaggtttggaaattgaagaggtatacgactccagttttgatgatcctatggatattgatgatacaggtgagttgtcgaatcacatggatatagatgatacaacttttgagatagatcacgtcgcaagtgataactacgcaaataaaagagaagacgacaatgatactaataacgaagaagaacgtcgggaagatgggttgttttctttactatctcctacgttgatgggggcaaaacttgcaatcaaaaagccattactattaatgcctccgcccactgtttcggaacaatctgattcaaaaactgaaagtgcatcttctgttgattatgaatatgacactagttcattcaaacccatgaaaagcaatggattgattacacgaaaaaccaatagcagtacatttcagccaagcaatatagactcgtttttattccacagtgatggaatttcactgggtcagctgttaggtggttatcaagatttacatagcaattatcaacagccagtgactatccataatcatcaccatcactattactattacaataaagatgaatcagtaccgtcgccaccttctaacaacaatttacaatcacttgaacacgagcaaagaaatttgcagatgcaacaatacaaacaacaattagaggagcatcagttatatttacaagagtataaacgtaacaatcaaatacttttaccttctccttggcagcataatatatctccaatagaaagagtcccctatctattgatgtcctacttacaaatgttgataaatttcattgcttcgttatatggtgtatatcttgtttattgtttatttcgaacgataaatacagacatcaaaaccaaaatagaggaacaacaaacgaatttgattatcagcatcgagtccgttcgtcgtcttcaccacgccctgagatcagacccgccc

SEQ ID NO: 828 - DNA, 1023 bp, Candida albicans
tatatgttgctggtactttgtctaccagacgatatcgtccttacaatatttaaacacctatcacctgatgaatgcagtgaaattattaccaatattgaagacatccatatagctcagccatttgtcgacaaattatatcagcgactactcagtgggaagttattgataacaaatgatcaacccaatcatcggtatatagcagactatcaactaacactagaaaagttccaaaacaaatttttggacacatccgtggaagccttgatgtttcgactgacacgtccaaattatatggaattcaattttactagacagcattgtgactacatgaatttcatttataatttgaagcaatttcatgagctattgaaagacccaaattgtcaagaatactttcgaaaagtattgcaagtgaacatgtatcttgatgctaacttggtcttgattgaaaatccagacaacttaacagccatcgtcatcaaactggtattggaattaagtgaccaccccgaacttgcgtgcaaagtgaagcatttgactataaaggcaggtgatatagggaatatgtgtgtgccacagtggtctcttttacttcccaaatttacttcacttgtttctttgaatatgctgcagaatttactcaagagtaactatggacaatacttggatgtttggggccgacaggaaaaattccccaacggtttgaaactgttaaacctcaactacaacatgctcacatatgtttctaaacaatttctatcatgtcttccacacacattagaagaattactaatgaatcagaacgacatagaacttgtcgaaaattgtgatttgggattgcttctaccaaatctacgaagatgggaactcaattataccaagttaagtgtcatcaatcctcagatgataatatcttgcaagacaggattcaccctagaattaatgtcaacttatttgccgcaaccagatattaatgagctacaaagaatagcccacgaaaagtctttacatattatagtatag

SEQ ID NO: 829 - DNA, 831 bp, Candida albicans
atagtaaaactggcgaaaaatgtgtttaaacgtacccgaaatcaatcacaagcctcgggtaacaagagatataagcgtaatgaagaagataacaccgatatacgaataacggcagtgaaaaagatatttttaaatgatcctaacattagcattaaacgggaaaacactttaatagtcctgatacccatcggcatgtcaagatcaaatacaaacaaaacagggtttgacaaaaagttgaattcatttgtgtggactatagaatggataatgttaaacgaacaaggtgaacaagtgacaaaatttataagttatagattaaaggagtcattggttttgcaggactcggtgccaatgaatattatcaataacaaattcaccaaacccgtggaaaaatgctatttaaagttctatttacatgatgtgatacataagggcaaaatgatacgattgaatggtggagacaaaatatccgatgtgttgaaagataaaattgtactcgaatatcccacaatatatgttgctgcaaatgacgagtgtttacaagatagaattatagatagccttcaattggccgaggaggaagaagatgacaccactgactcaagtgaggatgattctagtgactcggagagtgatgatgatgatagtgatagtggtagtgaaaccagtagtattggagacggttcaggtgaagataacgattctgattcggcaccggaagagacatctctgaaactaccacctttttcacagaaattctttgaagcgtcagctgagccaaaaccaataatagaagagataggatctaacaagactgtagaagaaccataa

SEQ ID NO: 830 - DNA, 1419 bp, Candida albicans
aaagaagacccccccccccccccaaaaaattttttttttcatttcatttctcaaccaagacagttgatcatgactcaagatgcattggtgataatatgtgggctcttagctcttatgtatttagggatctactcactacactatttccaagatgtccctgatttgtatttacaagaacagtcaatcagagaacccactcgattaaccaatgaatccccgatttatcattctaacaaaagcagcaacttaagagttgggttggatattagatacgattcatataaacttagaagtggaaatttgaatgatatctgggaaattgcaattcaatttgccaagaagaccgatagaggtataaatatcgacaataatttaattaccattggatatattaattattgtattgaaaacctacaattgggttcacacaaagttatttccattcctaaagattataaaattgatagtaaatggttggttgtgttatttgttgggtttgttaaacaattgactgttgagttttatattgacaagccgattgctgatgatgctattgatatttcaaaaataagtttaccatcacctccgcaaggctcttacaagtttattaacaattatacaccagagaaagatagaggtattgccatcagattacacaatcaaatctctcaaggaataaagtcgatagttgattttacacaattgaatatagtcagtggggttgcatctacaattaaacacttgccaaattctgatacttacaggaattcaaaaatggtgattgtatcgaacaattcaaccaacgaggatatcactaacttgattgttaaattattaacggggttaatattgaattgcaacataaccatatgtgacaagttttccgaagtcgattctaatgcggcaattatttccgtcccagaactgaagttaccatttgttagcaacaagagtgatacaattacggaacgactccaacgatatttgttaacaaaaagtgtattcccgtttagaggtaccaaaaaactaatttacatcagcacctcgatcaataagaagtctgccttatcgttgtatgatttgaatacaattagaattcaacatcaagcaagagttgtgaaggaattatgttactataatattgtgggtcccattatccttactgattattatgattaccgacaattcaatatcaaagtcaataaagttgggtgtattgcccagtcgttagaaattaaactaattaatttacaggatgagtgggggaatctactggtccgaggatatactattggtaagactttgaatgttgttaacgaccaacaagaaaagttgcaaccgaaagacgatgatgggtttatgcctattagtatagttaaaggtaaatggggtaatgatggttgtttatatgtattataa

SEQ ID NO: 831 - DNA, 453 bp, Candida albicans
attcaattaaaactgaatataaatcatttgaaaaaaaacgagaattatatcaccaattttaaaatttttttagtcgatgaagctatattaaatattatgccaaatactttaggtaaagtattttattcaaaaggttcatccaatgataaaatccatatccccattaaagttacatgtaatactacagggtcacaaaccaatggtaaacaattatcaatagttactttaactaatcaattaaataaagtattgaataatacttattatttaccaccaattggtaataatattactattaaaattgggaaattgaaatttgataataatgatttaattgctaatattaatgatgttgtgaaaaatttagatttagatactattaaatcaattcatgtgaaaacttcaacttctccagcaatcccattgttttatacaaaatcgctttcacaataa

SEQ ID NO: 832 - DNA, 558 bp, Candida albicans
aacaacattccattctattctattccatttcccatttcccattgcctattgcccataaccgtcaacagcaacacaaataatagtttagctcaagtacccatactctttatcatgtcctatgatttgaatataccatggccagtaaataattatgataaatcgccaacattacaacaattaaccaatcttcgaaatattatcatcactaattattcattaggtataactcatcaagcaatcaatttccaaatatcaatagaatcagtgaaaataccaaccacaactactgccaccaccaaaatcaatccaatacctataaatcaattattaaatgaattattgcctaaattccccaaattaaaattattttctcgattaactttaatagttaatgattcatcaaaattacctcaactcaataaattacaaaatcaatttgatataattgctattcaaccattaaatgaaaaagttttacaattatcaatattaaatttagatattgatttaatatcaattaagtctcaccacgggagtggcgcatccgcgcttatgata

SEQ ID NO: 833 - DNA, 819 bp, Candida albicans
  unsure (18),(46): Identity of nucleotide sequences at the above locations are unknown.
ggtcgcctattatggaanaaaccgaaggttccgagtgcccatgaanttgcaaaaatacatttcaaacaattgaagttggcagctgaagactttattggtaacaacattgaaggtgtggtgttaactgtgccaacagatttcactgaagtgcaaagacaagagattgccagaattgcagaagatgccggattaaaggttttgcaattgattaatgagccatctgccgcattattggcccatttgtctaatgatgaagatagattatcacaagataaaatttatgtcgttgctgattttggtggtattagaaccgatggtgcagtcattgctgttagaggtggtgtgttaacaatcttggctactgcccatgaatacggcttaggtggtgacaatttggatgccgcattatctgaatattttgctaaagagtttgaaaagaagtacaaggccaacccaagaaacaatgccagatcattagctaaattgaaggccgaatctattgttgtcaagaagacattgtcgaatgttcaaacatctacctgctccattgagtcgttagccgatggctttgatttccataccagtattaatagattaagatacgaattgaccgctagagacccattaagcaaaatgactgcttttgtcgaaaaagtcatcgccaaagctgacttggacccattggatattgatgaggtgttattagtaggtggtgctgcccatacccctaaattagccagcaacatttccttcttgttcccagagacaactaacataatatccccatccttggactcgaaagctttgaacccatcttaa

SEQ ID NO: 834 - DNA, 549 bp, Candida albicans
ggggggtggagtctatgtcttcgccggctggtgaagacggttcgagtaagtgatgattcagtactagtcagtatatggagagattttatattccagtctgaagaggttttgaaggaaagtcgaaccttaacttacaccaatgaactatacagtccagtggagaactacaaacttgcagaaaatgtatcatccaatggaccttcatttcatgtatcgagtattgacttgttaaagtatagtatgttgacatataacctccacaaaattcatattgatgccaattattgtcgttctattgaaaatttaccaaatatgatcgtccatggcccattacaggtgacattattactatactggtttgccataacgtatccagatgtgaaaccagttaatttcaaatatcgtacttatgcaccaatgtttgttaacgatgatacttcaatactgattgaatctaaatccaataattcgtttgtgctcgagatttataaccaggagtctaaaaagctctacttacgtggtgatctgacaactacttcatcaacgtga

SEQ ID NO: 835 - DNA, 816 bp, Candida albicans
  unsure (2): Identity of nucleotide sequences at the above locations are unknown.
anacaacagggtcgcacacaatcggcatcagcaacagcaacagcagcagcaaattcaattgttacaccaggtgaactaataacagaagatccaacatggatgaaaggtcatggaacatattttataaatgataaaacctattcatccgttgcagggagtatatcaagagtgaatagattattgagtgtgattccattacgagggagatatagtcccgaaactggtgatcatgtcattggacgtattactgacgttggtaataaacgatggaaagtagatattggtgccaaacaagatgctatattaatgttgggatcagttaatttacctggtggggtcttacgtagaaaatctgaatctgatgaattacaaatgaggaattttttaaaagaaggagatttattaaattgtgaagtacaaacaatttttaataatggtattgcttcattacatactagatctttaaaatatgggaaattaagaaatgggatttttttgaaaattcctagtccattgattgttaaaactaaaaatcatgcatttgatttaccaggtaatgtttctatagtgttaggaacaaatggatatatttggttatacaagactcctaaaattaataaatctttagaaaataataccccagggataactagacttgaagaagaaagttcatgggaaatttatagtgataaaaatgaatttattgatgttcaaacaagaaataatattgccaaatattataatatcattaaatcattagctgaaaaggaacaaaaaattaataatgatgttctcgttgaagcctttgattattaa

SEQ ID NO: 836 - DNA, 930 bp, Candida albicans
ctgttttccttctattatacaatgcaatctccaacttctcctatttcctataaagaaacaagtgtaccatccttttcaaaggaatcaaccaccacagaaacaagtaaatcattaccacacgctaacttgttaactcccccaactttaagtccaccaacaattacatctgatttaccaacatctactttatctccaaaccatcacaactactacactcattatttaaataaggcacaatttaattctattttagtcaactgttctattaacttattaaaaatcttgtacaaaaaccagaaatttgatgaaaagtcaatcaaattattcattattgaaattctcagaagatctaaaacttccattcaatcacttcaattaagttgcttttacatttataaattgattgttgccaaacaaaaaatcacttttgacgccaaaaaattatttctcggattgattattattagttctaaattcaaccaagattataattattcattcaaatcttggtgtaaaatctgtggattaaatgaaaattccaatgttaaacaattggttcatattgaatcaacaattcttcaatggttaaattacgatttatgtttaattggatcaaaatatgaaaattggtgcaatttacttttaatttttggttatgattttattcaatatcaactaatttttgataatagaactgaaatagtttggaatcaagaaattaaagataaaattaatagttggcaaagttttttcaatcaattgaatttagataatttgaatattatcaatgttaattttaacaattatttcaacaaccaattgaacaagaaagttttcgttgtcaaagacgaacaaccaaccctcttgtcaaaaaagagaagttctacaagcttatttgacactgaacaaccagttgccaagaaaggttaa

SEQ ID NO: 837 - DNA, 2148 bp, Candida albicans
caaatgggtaaatatatcactgttgccacttgtaacttaaaccaatgggctttagactttgaaggtaacagagatagaatttttgaatctatcaaagaggccaagagacaaggtgcaaaattgagggtaggtccggagttggaagtctgtggttatggatgcctcgatcattttgctgagaatgatttatatcgtcacagttgggaagtttacggagagattttgtccaatcctgaaactcatgggattttattagacattggtataccaattatccacaaatcaatcaaatataattgtagaatcatttcgtacaatggcaaaatcttattgataagacccaagatatatttggccaatgatggaaactatagagaaatgagatactttactggttggaatagacccaaataccacgaagaatatcaattgccaaaattcattagtaaaattactggtcaagctagagttccatttggtgattgcattgttcaaactttagaaaccagattaggatgcgagacttgtgaggaattgtttacaccagaatcaccccatattgccatggctttagacggagtagaaatattcaccaattccagtggatctcatcatgagttgagaaagttggataccagattaaagttgatcactgaagcaaccaagaaatgtggcggtatttatttatatgccaatcaaaaagggtgtgatggagatagattatattatgacggatgtgcaagtattattgtgaatggtaacgtgttggcccaggcatcgcaattttctttgaaagatgtcgaggtcataagtgctacagtagatttggatgacgttagagcttatagaaatcaaaaatctgccagtgtacaagcggttaatcaactggaaaaattcaaagttatttacacggatgtggaattatctccaagtgattatgtatttgatcattcaatcataccatcgaaaccacaaccaatcaagtatcatacacctgaagaagaaattgctcttgggccagcatgttggttatgggactacttgcgaagatctaaatgtggtggatattttttaccattaagtggaggtatcgattcctgtgccactgcagttattgttcacctgatgtgcagattggtcgtagaggcaattcctaatgatgaacaagtgttgaaggatattcaagcaattactcacgacgaaggatttgtaccaaagacaccacaagatatcgcccaacgcattttttacacttcattcatgggtactgaaaactcgtcgaaagaaactagatcaagaagtaaagaattggcttcaaagattggctcatatcacgttgacttgaacatggacaacttggtcacttcagttgtttctcttttcgaagttgctactgggaagaaaccaatattcaagatatttggaggatcaaatacagaaaatttggctttacaaaatatccaggcaagattacgaatggttttgagttatctttttgcccaattgttaccatggactagaggtaaaaatgtccctggtttactagttttgggcagtgccaacgttgatgaatgtttacgtggatatttgacaaaatatgattgctcatctgctgatatcaatccaattggaggtatttctaaaactgatttaaagagatttattgcctgggccgagaaaaattttgacttaccaatattgcacgagtttttaactgccacaccaacggctgagttagaaccaatcaccaaagattatgttcaaagtgacgagattgacatgggaatgacttacgacgagttatcgagatttggtactttacgtaaagtcgacaagtgtggcccattagcaatgtttataaaattgtatcatgaatggtctcaacctccttacaatttgagtgctaaacaaattgccgaaaaagtgaaacgtttatggtttttctatgcaattaatagacataaaatgactaccatgacaccagcataccacgctgaacaatattcacctgacgacaatagatttgatttgcgaccatttttaatcaatcctaaattcccacatgccagtaagaaaatcgacgaattggttgaagaaatcgaaaagagactacatgaaatagattctagcaataaaagtgtagattaa

SEQ ID NO: 838 - DNA, 1107 bp, Candida albicans
tactgtacttccttttacgcaagaatgtcagaactacataaagcattccttagaagaataaaagaacaagagacggctttgggattgtccggcttagtagatgaagatgacataccagaacctgctgttatgccgccgactggcaatagcagctccactgcaaacactgaagacgagacaatcttaagagattacaaacaattcaaagaaaccaattttatacaagaattttatgaaaatgagttaggtcacaagtttaaaacgtattacaaaccttcaaagaaacctggatcaatacttttctgtcaccatggggctggttcttcgtctatgacttttggaaacttggtgaatcacattgaagatgagtctgtgggaatatttttatttgataccagaggccatggagaaagtgtggcaacatccgatttttccctagatacattggtacaagatgtatcgtttgtattggaacaattcagttcaaaacatcagcagacatcgatatttttattgggccactcattagggggtgcagttttggcaaaatattctacattatatcctagcgatattctcaaggggttaatattattggatattgtagaggaagcagcagtgcaatcactcaatgcaatgcccctgtttattgctagaagaccactcctgtttccctcgctatctaaagctattctgtggcatatgaattttttgttattcaatgaaaaatctgctagactatcagtgcctgatttgttcaccgacaagttgacctggataaccgatttaaatgctacccaaccttattggcagacctggttttctggattatctgagaactttttgggttttaaagggcccaaactcttgatgctttctacacatgaaagtctagataagcaattaatgattggacaaatgcagggaaaatatcaattggtactcttcaagaataacgaaaagtctgggcattttgttcatgaggatttacctaatcacgttgccgtgtgtcttacagattatataaaacgagctgttgcgccagaaatatttatgaaagaagatttgggagttgttcccaaatggggaggtaaaataaacaagtag

SEQ ID NO: 839 - DNA, 672 bp, Candida albicans
gagtttgatcggaagccagatatgattcttcagccaattcgacgtgaactttgtgcatcacttaggagacaatttgaatcaggtactgagagtaatccaaagcagttactatcattggcatttaaagaagttttgtcttctccacaagtggaaattggaggaacaactgcctgtttaggtgtgctcacgtctgacttgaaattgcatgttgctaatctaggcgactcgtggtgtggattattcagagactccaaattgattaacgaaaccaactttcagacgcataactttaacactccatttcaattggccaaaattcctgaggaaattgtaagacaagcaaaattgcaaggtaggagatatataattgattcgcctgaagctgctgacgagtacacctgggacttgaaaagtggagacgtggtaatgtttgctacagatggggtaacagataatgtgataccccaagatatagaattatttcttaaagatcatgaagaaaccaaccagttggacgatgtagccaacaaatttgttaaagaagtagtaaaagtaagtaaggacagtaatttccccagtgcatttgctcaggagttgtcgagactaacaggtcaaaaatatcttggtgggaaagaagacgatataacggttgtgttggtaaaggttaaatag

SEQ ID NO: 840 - DNA, 2217 bp, Candida albicans
ttgaatatgcctgatttgacaccacttgacaatgatgaagaggatgcttggtcttattcgttcccaccttcaaccgaatccttgccaatactgcaacaatcgcaatcgaaaagatctaccacacagccttcaaattcaactttccggacatggcaaaatggtgatactagtctgactaatctgcaaatgaaactactgatagatacaacaaccacttccagtaaatcatctctaccgtttccatccacaatacagaaatctattcctttagatccattgactacgaaagaagatgccaattcagtgatctcaaaagattccaagggcaatgccctcaatgaagcttctcaaactgatgataaaccaaaattcatgaaagatttagaagaatatgggtctacaagaaatatttcaaactcgccattatcacaacaatccaccaatggcaccaatttattgccttcacctaaattcatatcgtaccgtaaatcaaagagaactgttagtgaaggaacatttgattcgatgttagataaatcaccaatgtcacctccagcttctagatatgaccctaaattgtatgttgacgaattttataaaacttcaaaatttcgatatgcaacgattaaaagaaacattgatttccataataatttccattcgttagacttgacagatagattagttgatgattttgcatgtgcattgagcagagaaattttgttacaggggagaatatatttgagtgagagttatatatgttttaattctaatttattaggttgggtcaccaatctagttattcagttagaagaagtggttaagattgagaaaagatcaactgcaggattgttccccaatgcaattagtattgaaactgttgatggcacccttcatacatttgcaagtttcctttcgcgagatcaaacctatgaactaatgctgactttatggaaaggcaaaactgggaaatcaaacaatgatctgacacttaccagtgaagatgaattagaaaataacgctattgattctcccaataaaaatattgaatcatatatattatcacttgatggagacgatgaagaggataatgatgtgcaatcattagataacagcggtgaggacgaagaagaagaagaaagtgaacttgacattgaagaagtgctaagtaccaaattaatcaaactcaaatcagaatcaccctatactaacaacggtccagatgcacatgctccaactacggcaaattatgaaaagttagaagcagagatagaattagttgatgaagttattgatgcccccatgggtattgtatttgccatattgtttgggccatataccaagttccaaaccaatttccttgaaacccatgatgggtcagaaatatcagagattagtgatttccgtccatcagaagaagacccggctgttcttgaacgtaaatatatttatcgtcgtgcattgggatattcaatcggtccaaaatcgactaaatgtgaagtcactgaaaccattgaacatttgaattttgccgattatatagttgtggtttcaacaacagtgacaccagatgtacctctgggtggtgtatttagtgttaaaacaagatatgttttttcatgggccaacgagaatcacacgaacttgctaatttatcatcatgtggaatggacaggaagatcgtggatgaaatcagttattgaaaaactgtctttatcaggactgactgctacgacaaaagagttgatcaaagaattgaaagaggagattgttaaacaaacgtatttcatagatggaccaccagccatcaaacaacctgccaaaaagaaggttaaaaaagtggaaccagaagttaaaaatgaacctaaagctgaaatcaaagcatcaacagttgatgtgtcatcttatttacaacaaaatatcacgacagcttttttcattctatttacaattgtgacgattattttgtttatgcaaatcagattgtatggtcttttacgaaaatcaaattcaatagctgaaactcaacttttattgacacttcaattaacggatctacaacaaaaacctcaagttgaagttcaagataatgtattttggaatttaatccattctaaattaggtagaaaattaacttcattagaaaaattgcaatttttaacgtatcaattgcaagctatacacatggaaatctcgccagcgctggagatccacgtc

SEQ ID NO: 841 - DNA, 651 bp, Candida albicans
atccacaatatatcaccaccaaaaatggagtacatagagaatttgaaattatatataaactcattatcacaatcaatatcagcttatgaatctgcattaagtccattacaaaacaaacaattatccgacatgattctaaatatcaacacaacatcatcaaccacctctaccacttctacatccgaggaacaacaaattcaaatattgaataattttgcatatattttaatatcgacattattcagttatttaaaatcacttggaattgatactgattctcatcccataaaaatggaattatcaagaatcaaatcatcaatgaatcgattgaaaaatattaaaaatgaaataaatggtgataccaataaacaagaagaagaggaagaagaaaaggaaaaattaaagaaactgaaagaatatttatcaagaactttaggtgtaagagatgttggactgagtgttgatgttaaatcaatgggcacttctgctataagtaaacaaaatttccaagggaaacatataaaatttgatgatcatgataatgcagatgaaaagaaggatgatggtaacaagaatgatttgaaaaaatctaaaaataaaaaaccaaatagtactgttcttcaccacggggctggaaggatccgcgcttag

SEQ ID NO: 842 - DNA, 855 bp, Candida albicans
actcatctcatcaatactctgttcaatttagtatatcatagtcacaccaattatcttcaaaaacaaaccatggcatctaaaagaaaaagaaaggaaaaacaaaaagattttgctaaagcaaaattaaaggttggtaaaactgctcaaaaaccagataattacactgatacctcattcaaatcaaaaactatctctttacccaatcaatctattgcgtcgagttctaactatggtgctagctcaggtgcttcaagatcatcattatcaacaggtccctccttggctgtgttgactcatcagttatcattaaccaaacatcattcttccaatacaagaaaagaagtcttaaactatttacaaactcaattacccgagaacccttcatattacaagaatataatgacaagtatcttaccgctaatcttagatgaggacaaggaagtacgaaaagctttaatgagtctactttcggcaatttttgcaaaacaacctggattaattgatttgcatttacgatcgactatactatttattttgtcggccatgagtcacattatacccaatattcgaaccaccagtactcatttcttaagaattattgttgagaatagtcatggaaatttgataaattcctattttgttaaaataatgagaaactggtttgttttaatgggttggagtttaaatgaacaagattcaaaacagttaagtatggctgtgacaactcttagtattacagctatgaatgctaattccaaacaagcaagaattggccatttgcagaatttgaataaatttttactgaaaactttacaacatgaccaagataaagataagaataaagatatgaaacta

SEQ ID NO: 843 - DNA, 402 bp, Candida albicans
actatcaaacaaagaaacaaaaaaacacacaacacaatggctaaaacttctccacataaattattctacaaaggtgctgaaaacgattttgtcattttcatcgatgatgccgatttgttagccaaatataaaaaggaatttagtaccaaagggtcatctaccattcctataattgatttggtttcgattttcaaagtgtttatcaatagacaacgtggtgctgaaggtattttagatgaagctgctaaactggatttagagaatgaatttaaaacctcaaacgcagatcaagttatcaagataattcttgaaaagggtgaagacaaatctaaaacaggatcaatcggtgaaattggtggatcccacaatgatagcataggtaatggtgacgctgctaattaa

SEQ ID NO: 844 - DNA, 924 bp, Candida albicans
attgaagtcgatcaaccacagcattatacaatcatgggtactagtacaagtgaagcattgaagaacatcaaaaacaaacagcgaagacagaaagtttttgcagaaataaaacatgaaaagaataaacaacgtcataagcaaagagccgaaagagctaaggaagaaagagaaaaccccgaattaagagaggaaagaatagcagctaatatcccagatactatagatagcaaacgtatttatgatgaaactatagctgctgaagttgaaggagatgacgagtttcagtcatatttcactaatttgttggaagaaccaaagattttgttgacaacaagtgccaatgctaaaaaaccggcctatgaatttgcggacatgatcatggactttttaccgaatgtgacatttatcaaaaggaagaaggaatatacaatgcaagatatggccaaatattgctcgaatagagacttcactgcattgcttgtcatcaacgaagacaagaagaaggtcaatggtataacgctcatcaatttacctgaagggccaacattttatttttcgattacatcaatagttgatgggaaaagaattaagggacacgggaaagctggtgattatttacctgagattgtattgaataatttcaattccagattgggtaaaactgtgggaagactatttcaaagtattttccctcataaacctgaacttcaaggaagacaagtgattactttgcacaatcaacgtgattatatttttttcagaagacatagatatattttcagaaatgaggaaaaggttggattgcaggaattgggtccgcagtttacattaaagctaagaagaatgcaaaagggagtacgtggtgatgttgtttgggaacacagaccagatatggaaagagataagaagaagttttatttataa

SEQ ID NO: 845 - DNA, 300 bp, Candida albicans
aggatcatttaccgtatgagggaggatcattgggcgttcaatggaaatgtagcaatgagcataaatagtgcagcagatgcaaatggtccaaacggcgaagatgctgataataatctatattgtttttgtcaacgtgtttcatttggtgaaatgattggttgtgataatgaagactgtaagtatgaatggtttcattggagttgtgttgggatcacatcacctcctaaagatgacgaaatttggtattgtcctgattgtgcttcaaagatggagaaaagaaaaaagaaacggaagaactga

SEQ ID NO: 846 - DNA, 501 bp, Candida albicans
atagctggaggaacaaatatgaccaaagacgatcaattaaatcttgcttttggaaattaccacgaagaaaccccagttatcaagaccaatagaacacaaaatgacccaacatcaagtatttataccccaaaacagaatccttcagtgatcaattttgattccaataccaattctactccaattcatgggtctactactgctggtttaggatcaactacgtttttggatggtgcacctgcacccaaaggtgatgaacttttgaatccaaacgctggtgtgggaaggaaaaagtcaatagtacaaagattaagaaaaaatagtggatctgaaagtaattcaagaagaagttctaatgaaggattacaaccaccttccccaccataccaagaacctagaagaggatcattaaatacattagaattagataatgatgacaatgaattgaaaccacctggtaactcatttataagaagagtaagaagtttgaaagtaagaaaatga

SEQ ID NO: 847 - DNA, 2763 bp, Candida albicans
tcacatactcaccactatcaataccataaagtattatcacagtgtttgctttccacaatgtctcataaccagtaccaacagtcatatactgagcggctggacaatggtgccaatacagcaattaatggcaacgaattgagtgaaaacttacatgcattaaatttggatcaaccacaatcattaagtgcacaacaacaacaacattcttccaaaaagaagtcaaggcgtcctgtaagagcttttcataccgagttcaatagtccaatcccgacaactagctctactcctgcttttccgtcatcacctattgttgcaggatatcctcaaaactatgcttcagtttatggctcgcccgtagtgaattcaactggccagtttcaacaatctcctcttgtgtcacaagcacaagatcaccaccatctgcaatttgcaacagcttctaattcaactgaacttgaccaaacagttttacaggattctaggaatttccatcaaaatcacgacttatctttgcaagaacatagactcgattcacaacgagaatacaacactcctgatgctcagggaacctataagtcatttcaaacatttacagatacagtgcctcctgaggcaggaacacaattccatgcaatagatcaagggaacgccctgtctaaattcatgagatcaacaatgtattatgtccccgagtcagaacaattaagactggcaacaaaattaccaatgtcgattactgtaagaccatttgcccccttattactgacagaagaaaaagttcaaaccgtcgactttagtatgaatgatccaaacaataccccagaagatccattaagcattggccctatcagatgtcatcgttgtcgggcttacgtcaacccttccatgcaattcacacataatcaaaggtttgtttgtaatatatgtcagtttgctaataatgttgttccttcagaatacgcttcgattttggatgggcgtgggtatagagtcgataaatttgttcgaccagaattgcataaaggggtgtatgatattgtggtgcctaaagagtataactttggcggaccagaaaaggattcaaacccattacatattgtttatttgattgatattactgaaaacagcatgaagcagaacttgcctattttgattacagatgctatccgtgctactttatttagctacaataactctagtgaagatgctaccaatggatgcaatcatgatcggtcatacaagacaaaagtggctattatagcatttgataaacgaattcatttctttaacttgtcttcatcattggaaacaactcagatttctgtatctcccgatttggaagacccctttgttccattcagtgaagggttgtttgtggaccctgaagagagtagatttgtcatcgaagatgcattgaactatattgagaacttggcttcacaggatagagtttctgattcggaaccatgtttttctgctgcttgtcgtacagcaagtatgtgtttagatttgtttggcggtgggaaaattatttcgttattaagtaatttgccatcttgggggcctggcgggttgaaatataaagataacaaaactattgggagaacagctgctcctgaagttgagaaaaaattgttctcggctgataacgaatattacaaactcttggcaagagaatttattgaaaaaagtgttggtcttgatgttcatgtggtgtcacatacacctgtcgatctttctaatgttggctggttagcgtctgtcacaggtggagaaatcactcgttgggccaattttgattttgaaagagatggtagagccttgactgccaagatctataattctgtgaaaaatatcagtggttatcaaggtcaattgaaattgcggtgttctaacggattgcaagttacacaatactatgggacttcgtcatctattagtgacactagtatagttggaaatattcaagaccctgtaatcccggtattaagcgaggacctgacatttacgattttgcttgaatatgacggaaaattaagtcctaaattggattgtcattttcaggctgcccttttgtacactgatccaaacggtgtaagaaaagtaagagtgataaacttggtactagctgtgagcaagagtttagaagatgtattccattttactgatgaaaatgcagttgtgacaacaattgtgagagatacactatcttttgttggtcaacaatcattgcttgaattacgtgaatcgatcaacaacaaattggtagatatttttactcattatcgtgcgatgaatgagtttgggcataatcgtgccaaaactttatcaaataaaatgttgttccctgattctttgaagcatttgccattgtacatgttgtcgttccttaaaagcacagtaatgcgtgcgtctgccggtttaactgcagatgctcgaatggcagacatgtatcaaatgttaacaatgcctatcgaaagattgatgtatcatctatatccagcattggtagagttgcattctttgcagccagaagatggtattcttgatgagactactggatttgcaaaattaccattgtacaaggatttgactattagaaatttggatcgtggtatttacattctttgtaatggtgagcgtgtttatctttggattgatcctgacacgaatccaatgcttttgaaagatttatttggaagtgatgttgatgatattaagaacataaacccaatgatggatgaattggcacaattgtctact

SEQ ID NO: 848 - DNA, 1224 bp, Candida albicans
gatgaagtttccaatttgaaagctaaaatattctttttgaaaaaagttttcaatccaattttcatttatgagtcggtaaacaagggatcagtggatacattttttaccaacacaaaacctgaatggcttgaaaaattgaatgatagcatttggaaatcgacaaaagatatcattaccaatcacacttctggttcgatggatagttatcgatacgctcttcttgaagtcacagcattactccttaaattagcctccaaataccttggtgatttaagaaaagatattatcaagttcagttggaactatatcaaattggaagacaatatcactaaacaagttgcttatgtcacgacttcttatttcatttcggtttatgagactcctgcaaaattgacaacccaagtttttgttgctcttttaagaacacatcaaaccgattctagatacttggtgaaacaagctttggacatattggctcctgtgatgtcagaaagaatgaatgatgctgattcatccgataactggttaaaatggccacgtcgtatattatcagaagatggatttaatgttactcaagtgttgaatgtatatcaatttattgttcaacatccagatttgtttttcgttgccagagaacattttgtttctaatataattactgccatgggtaaattgacaattcttgccaaccctgctattgaaaatcaagttttggccattgaattggcggaattgattttatattgggaacgtatagcaaaagattccaaggaagaatcacaggcgactcaagaagatgaaaacattgaagaagataaagaagaagctgctgataccactaccactgctgcagacaaagtcaaacctgagggagatttcaccacttctccaaactattcaattccatttggtcaaagagaagcatgtgtcacatttttgattagatatgtttgtatcagccctcagagagcatctgagagtgaattgggccagaaagctttggggattttatatgacttgttgagtcctgaacattgggcagaagtttctgtcaagcttacatttttccgaaaaattcttattatctcaagatatcaattccagttatttattgggttattgtttgaatgcattacaaattttaggggttgttttggaatggaaaaaaccaaaatggattgtttccaattttatcatatcttccaaaattacttgaaaaattgg

SEQ ID NO: 849 - DNA, 192 bp, Candida albicans
gtcctgaacattgggcagaagtttctgtcaagcttacatttttccgaaaaattcttattatctcaagatatcaattccagttatttattgggttattgtttgaatgcattacaaattttaggggttgttttggaatggaaaaaaccaaaatggattgtttccaattttatcatatcttccaaaattacttga

SEQ ID NO: 850 - DNA, 345 bp, Candida albicans
  unsure (82): Identity of nucleotide sequences at the above locations are unknown.
ttggagaaactgggttggaaggtgttttattcggtttatgttttatgtattgctcgagcattattggaaccagaatctgatntggaacaatatttgactttgtttgtgagagaggaagttatgttctggtattcacaaaatgataaagcagcgttatccaatgaagaaacaatgagtgatattgtacgtttgaatgttgaaagtataattagaagagtaatgactatgggacatatgtcatcggcaaatggagtggtaattcgacatgttttggagttgatttcacaagctgttaatcgtggtaatttagcttcagctgataccttatggatggcatacttttaa

SEQ ID NO: 851 - DNA, 768 bp, Candida albicans
attccaaaattggaattattgttcaatgaaaaaatacttataggcgatgggttgacatcatacgagacattaagaccattagcatattctactgtagctgatatcattcataatgttagaaatgaattaactccagcacaaatatggtcgacagtaaatatttattgtgatttattaaaagatgattcattggcattcacagtacaaataatgagtgctaaattattacttaatttggtggaaaaaattatgaaattaccaaataaattagaaggtagacaattatttcttattataattgattcatatgctaaaagatttgttagtttaaaccgcaaatataattatatcatttcaaaacataatgaatttgaaaataaaaaggcttctaaagaaagaaaagctaaaaaggcaattgaaagatattcttctaaaatagaaccggaagaaccggaggaacaacaacaagaaaaacaacagaaggaagagcaaaaatctgataatgccaatgaagatatgatggacattgataaacctaatcaagatgaagtttcagataaacaagaaactccttcacctcttgatatgtttaatatcgatacccattctccaattgctgctattcctgtttcaaacaataccgatgttttaaaagatgcaagatatttatttagaaccttaatgacatttttaaaatcggtgatttttggattgaagaattgtaaccctcctgtcccacctctaccaacatcatctgatcctaattaa

SEQ ID NO: 852 - DNA, 414 bp, Candida albicans
ccaagactacaagttaattatgacaaatggaatgattcagcaaaattgattgcctatgaagaagtggatatcttgagagcattatttaaaggtggtataagttgtcttcgatttttttccatcaccaaatcaaaaccgccgatggcgaacaaaacaattgatttttcaactggtggacccaatttacctattacatcgtctaaagaggaaaaagatttaatggaaattttcgctactattttcattcatattgaccctgcatcatttaatgaaattgtcagttctgaatatacatttatgtttgaatcgatgttggaaaatgcggcatcattacatttaccacaattttgcttagctagtgaaattacttcagcaaatttttccgggattttaatatcttttttaaggagataa

SEQ ID NO: 853 - DNA, 642 bp, Candida albicans
ataatgccaattttaccggtattattagagaatttaaataaaatgattactaatgctataataccttatgaaagagatatatatgtggaattgtgtttaactgttcccgtcagattatcagtattggttccacatttgaattatttaactagaccattagtatacgcattgaatggatctcaagaattggttagtcaaggtttacgtacatttgaattatgtgtcgataatctcacggcagaatattttgatcccatgattgaaccagttattgacgagattatggcagctttgtggaaacatttagaacccgttccttatcatcatcaacattcacacactgccattagaattttgggtaaattgggtggtagaaatcatcgtaattttaaaccttgtaataaattggtgactcaactggatttagatcaagaagttaaagcattatttgaaattcatggcttgaaagggtcagttccagtttctattacaccgggtgttgaatcagctgtaaaacttcttgaagatccaagattaaaaattcattacaagataagtgctttcaaatacttggcaaatattttgaaattattaattaataccacacctattcctggaaattcccacaatttttcaccaggc

SEQ ID NO: 854 - DNA, 1392 bp, Candida albicans
gatttcacccgattcatgattattttgttgtctaaagactaccacactcgtcaagttgatatgagaccaaatgttatccaatcattattagaaggtgtttcacggtgtgacgatcttcaattgcctccatttgctgttgaatgtttagcatccaactttgatgcttggtcacaaggaatccatattcttgaaaatattgatgaaaaattggttaatgccaatgcagaagtacgcgaagtaacagaggacgccttggcaaaattgtatgcaactttgaaagaagatgatatgttttatggattgtggcgcagaagagccaaatacgctgagacaattagtgcattgtcatttgaacagcttggtctttgggacaaagctcaacaattgtatgaaactgctcaaattaaagctaggagtggtgctttaccatatggtgaatcagagtacgctctttgggaagatcactggattctttgttccgagaaattacaacattgggatattcttacagatctcgcaagacatgaaggtttttcagatcttcttttggaatgtggttggagagttgctgattggtataatgatagagagactttagatcaaactgttaaaaatgttatggatgtgccaacacctagacgtcaagtgtttgagacatttttgtgtttgcaaggatttggtcaagagaaagaaacattacaagacttgtcacgtttgtgtgatgaaggtattcaattggcattacgtaagtggcacggattaccagaaagatttgccaatgcacatattccattattgcatacatttcaacaatatgttgaatttatggaagcaagtcaagtatatgctagtttggtgacgacgaatgctcaaaatttggatatgaaatcacaagaattaaagagggtattacaggtatggcgtgaacgtttacctaatgtttgggatgatatcaatatttggaatgatttggttacatggcgtcaacacgccttccaagtgatcaataaagtgtacatgccatttattcctgttttgcaacagaatagcacgggaagcaatgctaactcatatgcataccgtggattccatgagattgcttgggtcatcaatagatttgcacatgttgctagaaagcataacatgccagaagtctgtatcaaagagttgacaagaatatatcaattgccaaatattgaaatccaagaagcatttttgaaattgaaagaacaggtaaaatgtcactatcaaaatgccaatgaattaaatactggtctagacgttattagtaataccaatttggtttattttgcaacacaacagaaagccgagtcttttactttgaaaggtatgtttttgaacaaattaaatcaaaaagatgaagccaattaa

SEQ ID NO: 855 - DNA, 1824 bp, Candida albicans
ggtagcgttggtccttccagccgcctggtgaagacctccgggacattggcacaagcatttgaaaatttcagaggagaagttcctgtatggtattggatcacttttataccacaattgttgacatccttgtcacagaacgaagccaaattggcgaaacagattttggttcgaattgctaaaaattatccacaagcattacatttccaacttcgaactgcaagagatgaatttgctgctcaacgacgacgtgttgttgaccttgctcgtcagcaagctgctcaagtttctgctgctaccgctactgttccttcttcttcatcttcacctaatggagtaaatgatactaatagcaccaaccaacaatcaaaattgaatggatcactggcaggaaatggggacaagacacaacgatctccaacttctcaaccacagcagccaccacatccacaaattaacattccaaattctgttcgtcaaccattggaacatattgatgagattatggctattttgaaaactgcttatccattaatggcactttctttggaatcattggtggatcagatcaaccaaagattcaagtgtactgcagaccaagatgcgtataagttatgtgttgcattgcttaatgatggtattcagtatttgaacgaaatagggaatcctaaggaagatgccaaattgccacctatccccgaagctaatataaccagatttgctgacactgtacttcccaaacagattagagctgaatttgaaaaagatttggtaatttccaaaccacacttggaaacttatatttctaaattaagaaattggagagataggttagaggacaaattagatagacggttttcgcaagtcaatttggagaatttatgtcctcatttgagtgaatttcatcatcagaaatttgaagaaattgaagttccagggcaatatttgttgaacaaggatagcaacgcccattttgttaaaattgaaagattcctttccaccattgatttagctcgtggttctagtgcctgttataagagattgagaattcgtggtcatgatggtagtttacacacatttgcggtccaatttccagcggctcgtaattgtcgtcgtgaggaatcggtatttcaacttttcagaatatttaacgacagcatttcgagaaaagttgagactcgtcgtcgtaatatccaatttactttaccaattgccgttccattatctccacatattcgtattgtcaatgatgatactagagatgtgacattacaaagagtttatgaagatttctgtaaaaagaatggtaagagtcgtgatgaaccatttatttatacagtggagaaattaagagccgcttttgaccaaagattacccaaacccgatattgctagtgttaaagttgaaatcttgagtgcaattcaatcattattggttccctccacggtgttgaaaaaccattttatcaatttgtatccaaattttgaagatttctggttattccgtaagcaattcacttcacaatatgcgtcatttattttcaccacatacatgatgtgtattaatgctagacaaccacagaaaattcatgttaatagaggttcaggagctgtttggacttctgatatgttaccatacagattatcaaccagaaataatggtgaaattacccataataaacaatctcctatatttgttaatactgaacaagttccatttagattaactccaaatattcaaaaattgattggagaaactgggttggaaggtgttttattcggtttatgttttatgtattgctcgagcattattggaaccagaatctga

SEQ ID NO: 856 - DNA, 402 bp, Candida albicans
caaacatggaaaaaattaaaggaaatatatccaaaagatcatttattaattgttagtaattctgcaggaaccgatgatgatataaatcatgcccaagcaaaaacattagaatcaaacactggaataaatgtactttgtcattcaattaaaaaaccaggatgtttaaatgaaatcactcaatattttgctaaattaaatgttaaaccaaatgaaatcattgttattggtgatagattatttactgatatgcttatggctaatatgatgggatcatggggatgttggataaatcaaggtgttgaattaagtgataaaattttgcctaaattagaaagagatttatataatagattggttgttaatcgtcctgaaaatccctattttccaccaactccaaattaa

SEQ ID NO: 857 - DNA, 276 bp, Candida albicans
aatgtgtcaagattgctttataatccaagtttatgtcttcctcatatcactgtgaaatcatttgatcaacttgtgttaccattcacaataccaacagcaccaaatgttaccattaaaggcgtagtgttagacaaagacaattgtttgccaaaggatcatgacgacaaattctggcccgaatatgaagtatgtttgctatattcccgaccaactgattatattattgttgttttaaaaccattatcttcaattactaattctttcccccacacatag

SEQ ID NO: 858 - DNA, 1644 bp, Candida albicans
ctggactatgatttgttatcgccgggttggacgatagatctgctgggtaccatatctcaaccaaatgcaaccgtcaccactactaatcaagcactacaacaaccaccaccacaaccacaaccaccgctgcataaacccaatattaaatcatcgtcagcttcacatatacctacaattacccccaaaattagaagagctcattcaatttctgccatgcaaacattaactcgtaccaaaagtaaattcatttcatctagtgaagctaaacaacgacaaaaattacgtaaaaagaaatatgatgaaaatgataatgatgattacgatgatgaagagattctggaagaatttttatttaatgtccctataattaaaaataaagcagaattatattcattaactgctgccaattcaagtaaaacatctcatgaaaactatggtaatggtaatggtaatggtagtaatcatggttcggctaattcatcatcagtgactatattatcaagaaatgatcttgtttctgatcgtgatcaatattgtactataaaaccatgtccattacctgggaaattaggatcactgacggatttattagccagtgttggtaatagatcaacgtcacacaacgatgaaagtattatcgaggaagaagaagaagaagaaggagaggaggagaaggagaaggaggaagaggatcgtactgaacaaggacatcaacaggatgaagttggattaggaattgttaatgatgatacaacaattatatctaatatatcaacttattataatcaacaggttgaaatgaagaataaattagctcgtcaaaatgtcatgtataaaatccctaattttattaaatctaatagttcattagaagatcttcatttaatatcacttgaaaaattaagtgttattgattcaactagaccaagtcatttaccaccaaaatcaatggatgaaaggaaaaaacataatcaacaaattgataagattttacataataaaaacaatagttcaccccatttgattaaatcaccaacaacaagaactagctttaatgggagtgactcccttagtaacaatgatgttgttgttgtgtataatcaagaatttattaacttggtggaagaattactacaagcaacggattctaaaacatttagtaagaaattccaatctcaacgtgatatgattagaacatttgcatggactctgaatattcctaatgatcaatgtttccaatttttattaaaaattttgtcattgaaccaaagttgtcaagattctttaaacacgataaaaaattcatttttattatttgaaaccaaatttaataatttacctgaatttataaaatctaataaaatgatggaatttaataaattatgtcaagaaataatgacaaaaccattatttaaaaccatccctttggaggaacaagttgaatttatggataaattaaaactgatttggaatattaaagctatatcagaatcagggttaaatcaagatgaaatatttttaatttctatattattaaaagttttcccacagaaatcatgtcaagatatttattgtttattagaattgattaatctagaagttttgaccaaagaatttaacaaaaatttaattaatatttattga

SEQ ID NO: 859 - DNA, 507 bp, Candida albicans
acaatgaatagtgatactacacctactcatagaaataagtccaattcaatatcacaacttaataaagtattaccagtgcctatagaattacataatggagaatcattagaacaacatcaacaaaatcatttaaatcatataactaatgttatcgttggagaatatcatttaatttctggagaatttggtaaaagctatatgacttggcaaattaaaatcactataaatgatttagattattcttcaatagttttatataaacgttataatgaaatttatcaactacgacaagatttattgaaaattttcccacctcatgatcacactataacgacaaatattgttccatcattgcctccaaaagataatttaagtcttgatagattaatgatgtcgaaaaattggttagaagaaagaagaaagggacttcaatggtttttgagtaacgttttattaaatccagtgtttcaaaattgtagtgtggttaaacaattcgtactaagttaa

SEQ ID NO: 860 - DNA, 966 bp, Candida albicans
gtcatgtcgtcatcatattccttggataaaatcaatccaaaattattaagaaggatttatcgagcatgcaggccaaccaatgatgaaccaaatttggcattgaacttagaaatctgtgattatgttaatgcgaaaaagggttcggcaccacgagacgctgccattgctgttgttaaattgatttctcaacgtgacccacaaaccagtgaattggcaattgcgttattagataatttagtgaaaaactgtggttatccctttcatttgcaaattctgagaaaagagtttctcaatgaattggttaagaggttccctgaaaggccacctttgagatataccagggtacaccggttgattttggctcagatcgaagagtggtatcagaccatttgtcgcacttctaagtacaaagatgattttggctatatcaaagatatgcatagattattgtctaacaaaggatatgtgttcccagaagttaaagttgaagatgttgctgtgttaaaccctaatgataatttgaaatcgttggaagaattgcaacaagaagagtcaattgttcactctgctaaattgcaggagttgataagaagaggtagaccccaagatttacaagaagctaataaattgatgaagattatggccggtttcaaagacgataatgttaaagaaaataaaaaacagatcaaacaagatatcacgagattaactagaaaagtggagattttgggagaaatgttaacttcaattgaaagccaaggtggcaagattgatgattcgtctgatgaagcaattatagaattatactcctcggtaaagagttctcaacccataatcaacaaaatgattgaacaaagcagtgatcatgacgataatgaggaagatgtcaacaaattattagctttgaatgaaagtgctaataatgtaatcaacaaattccatttgttaaaaaggtggcatgtttag

SEQ ID NO: 861 - DNA, 681 bp, Candida albicans
ttgagtgacttgtccaatttgactttttcagagaataataatgcaaccactgcttccagcagtaccaatgttaatccccttaatttatatggtgctggtggttcaatttccttaggtggcggatctggattccctaccatttcaaacaccccatccatttatcaaccaactccatccgctgcccaaggaaaacaaacttcttcatcgaattttgatttattggcagatttaaactccccttcacctcaattacaatcaaatacaaactcatcatcgttagacccatttggattacagttcccagcaactacaccaagtcaagttactggacaaggtgaaggttacattagaatgattcctattaatcaaacatcaaacttgaaaatcgaaattggtgtgaagtcatcttcagcaaactcattgaaagggaagattttatttagtaatttacaaacttcaactatttccaatttgaaattcttgattgctgtgcctaaaagctgtaaattggaattgcgtccacaaacaagcgacaagatatttggatttaataaccacggtatacaacaagactttaacattgaaaatcctttgagtaaacaattgaaaatcaaatggaaggttgaatatcaaattaatggttcagcaaatgaagaaactggcgtcagcgttttagaatag

SEQ ID NO: 862 - DNA, 822 bp, Candida albicans
ttattatccatggattactttaatgttccaccaattaaagaatcggaattaattattaatttcttgaattgcatggagccaaccactgaaactcatattttgataacctattttcttgcttttcacacaatcaaaaagtttcgtcaaagattgtctcccaaatcgccatattatcaagaatcaccagttatgcaattgaatacctatttgaatattttaagtgcaacttcaacaataaaataccctgcggatcatttccacaaaaagctggattacatcagtagggatattgacgatgagtttgttagtacctattgtgaaatgagtcaaaaaatcaaacttgaatatgaatcattaattgaacaattgcacgcattgtatcatgatgtaccacttttcgatattgcaaagttattatcgtttgaatcatatttccaaatttgtcaagcggttagatcaagaatcctcgaaattcctcgagatgctcacaacgatattgatgatgttgttggtccacctctcaagaaaatgaaagcgcgtgaagctcaaggtgagccactggaaaacgctgtcactactggtttacaagagctttccattaatccagaggaagggaaatccaatgtcgggtcgggacgcaatgacactgaacatactaataacaccgatgattatgtaattgacgtttctttggttccgattttggattttgtcaaccataatcatcatagcaattcttattttgatattgatagacgtactaacgatattgtattaaaattgaaggtccaatgtgcaaatgatggccaacgaaaaatttga

SEQ ID NO: 863 - DNA, 1101 bp, Candida albicans
atgaataaattattgaaaaatgcatcaattattgaacgtaattctgccgataaagtcaaagagaagttacatgccattgatcaaactattgaacaaaataatccaaaattagatatcacaatgttcattaaacataatgctgtagattggaaagaaccacaagatttttattttatcccctgtagtttttggcatgatgatgaaagtttaattataaaggaacctgaattgacggaattgaagaaaaaattgagcattgcctcaaatgaatattataaatttgaacaaagttgtattgatgtcaaacagaagttagaagagagtactaataaaagaaaacgtgataatgaaaacattactttgaaatttgatactggattacaaggttcattatcaattttacacaaattcatgaaagaagatactaatagggttaagaatgaagtggaaattgaagtaattcaaaattttgctggagataaagatttgacatatgttgctccagtaaaggaaaagaaatcaagatttggatttttaactggaaatcataaaaaatcacaatcaggaggtggcggtggtggtggtgctacacaactggatgcatcgtctgaagttcattcattgaaccctgtgaaaacaagtacttctttgcatagcggaatttttgatttgcgtcgtaataagagtattgcttctacggtttcaggtggtgttggcaatggtgcagcatcaattcaagcaagagcactttatgactatactgccgcaggatcagacgaaacaacaattgtggcaggtgatcaattatctgtcattgaagaagatgatggttcaggatggactatggtgaacggtccacaaggtcaagggttagtacccacatcatatatcgaaatcacaagtcgaggaccaccgccactgtcccaacaacctcaacagaagaaaaagggaccaagtgtagcaccacgttgtggagctaaaaaagttcaatatcttgaagcattgtatgattatactgctgatggggatgatgaaatatctatcacagccggtgatcgtatagtattagttcaagatgatactgatggtaccggatggaca

SEQ ID NO: 864 - DNA, 648 bp, Candida albicans
tttttgacaacatacacaatgtcaattgaaaccatatcaatagggaacgaacttaaagattcttataaactgacatcaaaatgggtgaataacggtataaattggttacaagatatatctgatttttatcaagaacgatccaatttggaaaaggaatacctgacgaaattaaaggaattgacgaaaaaatactttgataaaaaaagtaaactatctgctagtttatcagtaggggatgaaccagccataactccaggttctttagaaaatgcttctttagtactttggactgatttattgacacaaacagaagctattgctgacgaaaaatctaatttatctcgagaatttcagtcgaaaattgctgataatttaattacattgaagaataaatgtgaaagagtagccaacttagccaattctattaatgattacttagtggaagaaaagaataaatttgaagatgaagtgaataaagctaaaaagcattatgattcattatgtcaaactacagaaactgctagagacaaaaatgaaaaggcacctaatgataagcatcaaaagaaattggatgaaaaacaagtcattatgaataatgggaaaaatgaatttttgataaagataaagttggccataagaataaaaaaa

SEQ ID NO: 865 - DNA, 492 bp, Candida albicans
tttttctttattgggttgccaatttatgtatttactttgttggatagtaaactggcccccatattcaaagcaatgacggagattactgaaactaaaaaggaagcagatacacccataattccaaagaatactaatactactgctactaccacccctaccacaaaacagcaacccacaaaattgatatcagatgaagtggaaaaagatacttcaaaagttgattttactaaaggtggtgtagaggaatttaaattctatcctgacaatcctaaaagtcatagacataaatacaaatggtcaatgaaagaaccttctaaattttatgacccatgtgaagagagtagaatggcttctatggattgcttatatcgtaatcaggatgacaagtatgcatgtcaagagttttttgatgcttatagggaatgtcggaaagatttctttagaaaaaagagacaagacaatagagatggagccaaaggatggggttggtaa

SEQ ID NO: 866 - DNA, 687 bp, Candida albicans
gttaacatcatttacccaatgagtgatcctattaatgctaatccaacaattatcgatgtggcggatttacccacaagattaaataatgacaataacaacaacaatgataataattatcaaacaactaataaattgaatctaaaaaaaaataaacaaatgatatcacaacttgtttctttatcattattaaaccctgatgaatcacctgaagcagcagatgatgaaacatccttgtcatccgatgaagaaaatgaagatgacgattttgatcctatagatgaacaagaaattttcgatcttatagcaacaatatctgatcctgaacatccattaacattagctcaattagccgttgtgaatttatccgacatcaaaataactaacccaccaaattgtggtggtgatggtggtgatggtggtggtggtggtatatcggaagtattaattaaaatcacccctacaattacacattgttcattagcaacattaattggattaggtatacgagttagattagatcgtagtttaccatcaaggtatagaattaaaatattgattaaagaaggtactcatcaactggaaaatcaagttaataaacaattgaatgataaagaaagagttgctgctgcttgtgaaaatgatcaattattaaatgtaatcctgcaaatgttaagtacatgtaagtag

SEQ ID NO: 867 - DNA, 477 bp, Candida albicans
aagaaaattaatttattcactactcataaaattgatcctaaatttcaacaaaatcaaattcaaggaactggaggattttcttataatcaaaaaggtcgattaagaaacactcctaatgggattaaatatggtactgtagttccaggaagaatcattgctaataaagaagcagcaatcatggggtttgttgctagtgttactgatcgttcaatcactttacaatcaaattatgctaaaaatgctccaggtaaacatcatcgtcaattcaccgttccatttaaaattaatgaagctgaacttggtgaagatggttcaattagattttttgctgaaggtatcaaaactgggaaatggatgaaagctaatgataatagatatgttcctacaaagactaattttgctagttcttcagaaagaaataaagctgatggtaaaagtttggaaagtttattaaatttaattcttccaaccaaataa

SEQ ID NO: 868 - DNA, 1557 bp, Candida albicans
tatattcatgacagtatgagtgtcgaatcaacaatttctcagaaaccaatagctttaccagcaactatgcacattcaaccactacagccaatacccattgccaatactcgtgacataaaatatgcttggcctcaaacaaatagaagtcccagtatatcgtcttctgcttcagacgacgaggaagaagaagataatgatgatgacttatcattagagattatcgcagacagatcatctacaccaccaacgccctgttcgtctgtctgccatgacaaattcatgtacacatcttcctgtgatagctatttacaatatattgagccaaacccagtctcaccaccttcctatgacacattaccaccaggtggttgtccaagatttccagtatcggcaccatcaattttcccctattccgcggaaatttcgtgcgagaataatgatttacaaccacctgcatataaaccggctatttataaaataggagtcgttgcaagaaaaatggaatggatcaatcctaacgaattatcaccacatagatcatggaagtattacattatagaattaaattctactcagttgaatttttacaatgtgcctgctaaatatgaacatcagcttgtcacgtttagccctgactcgttgacgagtcaacaaccatttcaaaactacgatacaaacttaaactcgctatttacttgctccgctgatcatcaattttatgatatggtgaaaaaaatggggttaatagaaagaaatttgggttgcagtaagaagggaaagtgtcttgttcgttcatattcgttgcaaaattcgaaaatcgggttagctactgattataaaaaacgtgcaaatgtgttacgaatgaaattagaagatgagcaaatgctacttaattttggtaatgtggatgagttgatcacatggaacttgctgttgaatgttggtaaagatgtggccctcgatcttacagacagagaatttcccaaatacagaacggtgcccagaagaagacggagaaatagaaatacagagggcaatggaagcagttcgctcctcagtgccattcatccaaatggctctcttgcaagacttagatctgtttctgatcctaacaagtttagaggaagattttctagattaaagtcaaaattatcatctgccaaattatcgacttataacaacaggcaagtcgtggaaccagctgcaatgtatctgaacaacagtcttccacgttcgatttattacattcaattacccacgccagtaagtacaccatcaagtgaatctatagttgcaacaactagatcaaattcagtttcagattttcgaaatgtatcgactgcagaaagttctgaaactgaaccacacgatgatgatgacgaagaggaagaggaagatgacggggagtttgatcaggcatcagtaaactcagctacgaatgtgcatgttgaagaaagtccttcatactgctacaaatggaatccagaaaaaaagtttgataagcataaatatcatcgcgattgtttgagatgcatcaaaccacttttgtataattaa

SEQ ID NO: 869 - DNA, 678 bp, Candida albicans
ctattatacgaatttagtctacttactagcatgaactgtatcaaactcatatcactacttcttattcaactagtggtcactcatcagattcaaatcccatttgatttcaatggcctattctcttcaaaagatgttactcgtccccattacacatcagtggatcctcaataccatccaatagatttatcacaatataatgataaacacgtagtcagaattgactactccaatgatccagatttaggaaaatatttgataagtctgcctctcagaggagatgcaaatgttcactttgcaaaatggagtcatgcaagtaacttaaagacaattgatatacaaattgacaaagaaagcttggctaaattgcatgagatgttcccttcaatgtcttttaaagtaattgttggagacttagcccaaaagatatttgaaacatacccgctgcaggttaatcaattgaatgaagatccagtggttgctaatgaattgtttttcaaagagtaccgatcattagaaactattgatgcatggttggacctattacaagcaacatatcccgatataatcagtgttgaagagattggggaaacatatgaacatcgtaagtacaaggtagttcattcactgttcctagctcggaaggtaatgatgatcatggcgacaggagaactgttgtag

SEQ ID NO: 870 - DNA, 486 bp, Candida albicans
gtacaaggtagttcattcactgttcctagctcggaaggtaatgatgatcatggcgacaggagaactgttgtagtgagcggcggtatccatgcacgtgaatggatttcaacttcgtctgtgttgtactccatatatgcattaattgaattctataaaaatgctcctgattcggatatctggtctaaattggactttatatttattcctgtttctaaccctgacgggtatgaatacacttggaccacagacagattgtggagaaagaatcgtcaaccagctattcatcccaaatgctttggaattgatattgatcattcttacgattatcattggacaagatcaagtgattgggcatgcggtgaagaatacagtggtgaggcaccctttgaagcgtttgaatcccaaatttggacagaatatttgaataataccaatgccaaccacaaaatatggggttatattgacttgcattcttactcacaggag

SEQ ID NO: 871 - DNA, 930 bp, Candida albicans
caaaaggttatggttaaagaaggacacggtgcatttcctgttcctaaagccaatgacataccgcctcctgcaaatataaagaagatcggggccttgaaacgtttttcagatgaagcttatgcgaagtctttgctctatgatgcagcaagattagttgcaccaataatacacgagcagaagttcaaagttggaaaattatatgaaatgtatcctgataaggcggaactatggggcctaaatgtcaatcacggacaaaagatatacctaaggttaagagaacatcacaatgataaactgtttctccccatgggtgatatagtagggaccttacttcatgaattaacacacaatttgtatagtgctcacgatagtaagttctacaagtttttggacaaactaaagtcgagatacgacgacatacattgtaggggagccaaaacaaaatatttatgcgaggaaaacaaggttggtagaggtgtattattatccggaagtttagtatctgtcagagagcaaaggctcaaggaattaagcaaaccaaagtttgcgaatgaaagcaaagttttaggactgaattcaaaaattaataaacctatcggtggctcgccaagggatcttagacaggcaattctagaggcggcagagcgtcggttgagagattcaaaatggtgtcatagtgaaaatgcagaaaccgaaagtgttcccaaagaggacgagtacgacacaactcaggtggagcttatcggtcctacagaaggtaaaccagttggaacatttgctaatgatatcattgatttaacatcggacactgaagaaactccaattcaacctgataacccgaaacgccgcatactccacgagataattgatttaacttcagatacagaagacatagagccaacaacaccagaggtaatatgtatagattaa

SEQ ID NO: 872 - DNA, 432 bp, Candida albicans
atctttcctttccttccccctaaagaaaaaatagataaagagaggatcaaaaaatatttattttatctaatcttctcctacttttcttctttcttttctgttttgatgaatcaaaataagaaattaactggtttaatattattagcgattatatcaatcattactttattcaactttaaaacaatttcccaaataactgtcatcagatcatttgtctcccctgcctcttccaccgctactaatactaatactaaatcaacaatgtcagattccaaaggttacattatcactttgaaagatacttgtgctgattccgaagctagttcaattaaatcaaagattactgaattgggaggtaaaatcactaatgaatttagtttaatcaaaggattttctgctcaattgccatcttcaccacagggctggaaaatc

SEQ ID NO: 873 - DNA, 777 bp, Candida albicans
gttcttttttttcatcgcatatatctctctcccccttttttttttattcttttaatatacctaccatttctctgcaaaaaaagatgtctagaagggtcggttggaaatcatgttattttaggaattaatgctgtatcaattgttgctgggttgtatggggcgtggcggattttcctgattgagttgtcggatgatttaaagggagcgggccattaccagtttcttacgaatttatcgttgatatattcgcttgtggtatttggattagggtttgtagcccatctcacaagatcaaagacgttgtatgattttaagaatcttcttcatccgattgggttggcgttggagacgattgtggctatggtgtactggccattgcgtttatttatgttgcatttgctaacccctgacccggaaaatttcaacatccccttggggcttgatttgtgtatacacttgatgccggtagtctcgttgcttattgattacttggtgtttatgccacgctggactattaagagcaatactgtattgttgttgattactgcgctttctactggctactggtgtttgttaaagtatttagtggatactgagaatggcgggaggtatccgtatgcgtttatggatatggaagatgacgggttaagggcacttgtgtttgtagctgttgggttggttgcgttcttacagtttcattttatgagaaatatttatgacgttgttgtgaagaagaccgaaacagtggatatagaaattgatagaaagcttagatag

SEQ ID NO: 874 - DNA, 855 bp, Candida albicans
ataatgtcatttgggtcatttgatcatatatgtaataaaacagctttacctttatgttcagttgttggtgctgttaatcaatcagcatttttccaacgaggtatagttcctgattgttatgctcgatcagttgaattagccaataccatgatttttcaaattggtaatgcatttgttcattttggtggattaataattttattgattattatatttaatgttagagcaaaatatactgctattggacgtaaagaaatgttattctttttatatttagccattggattgattgttagtagtttgattgttgattgtggtgttagtcctccaagtagtaccagttatgcttattttgttgctgtacaaattggtctttctagtgctctttgcatttgtttattatataatggattcctatgtttccaattttgggaagatggtactagtagatcaatgtggattttacgagtaggatgttttgcatggtttgctgtcaattttattgtttgtattatcacttttaaacattgggatacagcattagattataggaaaactactacattatttatctttgcttatgttttgaatgctgtcatattggctgtttatgttgtatcacaaataatattggttgttttcgcattagaatcatataggtcattgggtgctatattattaggagtattctttttcgttgctggtcaattgttgaaatatttttttaatgaacaaaatttttcttgggggctctccatatttttcatggaatattctttggaaattcattttacgttttccacccgaagaaaaattgccaaatcctggggaatgatatccaatttaataaattca

SEQ ID NO: 875 - DNA, 1197 bp, Candida albicans
atggatactacagatcaatccagcgattcgttacagcaatcaccttctatttcatcttcaatatcgtcgaattcatataaggattttgctattgacgttttaaataaagctgttgtcaaaggaaatagtattgcagagtcaaatccaggtagcaaacgagcaattgccatcagtacagcatcaacaatagtagaaatgagtcttgaaaagtacagttccagcaatttaagttccagacgcagtggccgcagcggttcaattgacttgactgatgaacaaatttcacagattgagtcagttcctagttcagctgacgataatggcgacggcaataaacgtaaatcaggtcattttgccgatagaatgattgagaaactattaaaatcagttttaccacaagatattcccgaaagagagatattcgaaaagcgattaaatgatccagaaaggaataaacgaccaggattgtctttcggaatattgacgtccaatgtaaagcagatggctagtaaaatgaccaacttttttgccttacaatatgaggttctttatattattgcatggaagaaaccgacgaaaacaatcagtgcattagttttgtacactgcagtgtgtttatggccccacttagttttagcttatccattattatttgtattatttggtgttttgatccctggctttgttcacagacatccacaaagaaacccggaattaatcaaagttaaaaaaaggggccagtcgttgttaagtttcctatttgaaacaccagaaacaagtatagtggaagatttgatcaacgaagaatatctacaagcaagtgatgaggtagcttcatctacatattcgatatcagaggagacttcagaagttactgtttcctcactgatgcccactgactccgagtcgccaaagaaagacgatgttgccaaacatagaaaatcacaaattgccttattgatcaatttgagagattttcagaatttaacgacagatattttaaagggtattaataatgcagaaaagttttattacgaaacaggtgggttcaaggacgaaagattatccacttttattttttatggtgtcttactatccacatttgggatactatttgttggaaagtatgtgccatggcgattaatatttattcaaaggaagatggacaggggcaattttatgccatcccaactgtaa

SEQ ID NO: 876 - DNA, 624 bp, Candida albicans
tatttattcaaaggaagatggacaggggcaattttatgccatcccaactgtaaaaaatttctcgttgatgccagcaaggccagaaaagccagagcagctatagaaaaagccaaaaaggaagaaaaatctgtaccagaaattattattgaagaagccgatgatacagttacacagtttgatcgtaacgatatcattgtggatgattcaccagaggctagaactgttgaaatctatgagttacaaatcaagagtattttaaagcattcatggacattttatcgctattccaccactatatatgataaaaataacaaagcaagaattgctgggaaacgcccacctggcgttgatcatttatccaaagtgtatccaccgaatgactggaagtttgattttggacttgtcaataaatggaatttagataccaaaccaaaagagtttcttcgtgagagatctttgaatccgaatctatttattgtcaaaaatgatgaatctcaaggctggatatatgataatatggaaggcattgtttatctggatattgtttacgagtttaggagaagaaggctataccgagaatgctacagatatggtcgtcctcacaaacaacccagcaagtattga

SEQ ID NO: 877 - DNA, 1671 bp, Candida albicans
aacagtgattcattatctaatttgaatggattattaaaagaaaatgtagatggggtgatgattgacttatattggaatgaattcacttccaaatggcaactatgtccagctccttttccaaataatataacatatactactgctagtaatcgaattgttgatgtgctgtggaataacaaaacatataaatgtgaccctaatctatctactgataatatcatgtccattcttaatagcttcattcgtgataccaacaccgatgttgaagccaatttcatgcatgtcatgtataatttaaagtcgattcattatgaaaaatcaaatcaaacaattagtttggaaaacatctacaaagaaaagaattcgaatctcaatgttgttggaatggacactttgaatgatacagtaagtttattgagttcatatatcttcacacctacacttctaaaacaatatcaaagcacatcaaataaatataccaattcaagttcaagtattcgttacattgatagtcttaatgaaacacaagctatacaagacttttatagtcaatcaaccattcttatgccttctttacaaaccgttttattaactcaatacaagagattaatggttcatgtcgtaaccaatgacatggcagaatctagtcgatcttatcaaatcagttctagtgataaagatacaatatttttcaacagtgatctccctgctctgattttccacacagataatgccctggcagatgaattatgttatgaattatctgatgcatataatgggaccgatgtaaatattgcggaatttaataaagtactgttaaatgcaacactaagacttgttgtcgatgatgataaaactccattcacaacaaagagtttatcgaaatatgtgagatgtggatattgccccatattcaatagcaccgaatattcatcgcagaaagtaacagaaggtaatagtctgattatcagtcgagaatttgcatctaatcttttttggtcttgggccccagggcaaccttctggtcccgataactgtataaattgcacacgtccaacgaccaacaatacctcgaaacatagcgacgacaacggagaggaggaagaagaaggtaataatattgcatataaatgtgttgcattgacagaagaaggttgggaagtgtccaattgttatgaaaaatatttatttgcatgtcaaaataaattatctagaaatgaatggaaattaaacaactccaccaagagaaattattttgatattgatgatgatgattgtcctgaaggatattttttcagtttacctcgactgaatattgaaatgctttcattgatgactactgttaaacaagaaaatgtcaattatccaatttggattgatttgaatgatattacggtggagaattgttttgtttccggtggaccttatgctcaatgtccttatcaggaaactgtgactacagataaatttgtccgtatgattgatcctagttttgttgtggcaatggtggttttggttttaatatttattgaaaaagtgtttcgtaaaacaccaatccaaaccaataggaaacgatattggaaaaaggcaatacacgaatattatgccaagaatgattatgaaggtggtaccctccctaagtgttgtatagtccaatttggtcaatttttt

SEQ ID NO: 878 - DNA, 795 bp, Candida albicans
  unsure (28): Identity of nucleotide sequences at the above locations are unknown.
aaggaaccgaaatttgaagcatttcatntgacagtagatacccacatggggaaatttgataatgaaggaaattatatacccaatgaacaaaaagattcctcggatgctgatgatgatgatttatggcttgaagattataataataaatcagaaatatataaagctacacaagctcaacttttacgggaaagacaacaaagagaaaaatctaaatcaaaatcaatggagaaagatcataatgttgaaccattagaagttttattatctgatttgatattgttattagaacctgttgaatcaccaatggaagcattagcaagattgaatcctaaaaacttgagaaaaaagaaaaagaaaggtgatgatgatgataacaataaaaatggtatagcaaaccatgaagaattaattaataaaatcactaatgtttgttcgattttaattaatgataaacaaattgatgatatatatgaactaactagagaagaattgacgaggaaatttcaaacaataactggacaaagttttaatgttgaacgaggtcttaaacgatcaagagaagaaagtgatgacgaagatgatgaaaattctcaaattaataatattgattatggtgaaaaaatatgggaattcagatggattggagatgaaaatgaagataaagttataaatggaccttattcaagttatgaaatgaatcattggaaagaaacttattttgaaaataaagtagaggtacgaaaaattggtgaaacaaaattccaaaatattgaatatattaatgaatttacataa

SEQ ID NO: 879 - DNA, 549 bp, Candida albicans
agacacccagaaagccaccccgtggtggctaagttacaactgcaagtcgacgagttgttaaagattggtaaacaaaacgaaaccacattctctcaggaaattgaagctctcaggaaagagttgcaagaaaagaccacttcattaaagaccgtggaagaaaactaccgtgaatctatacagtctgtcaacaataccagtaaggcattgaaattgaaccaagaagagttaagcaaccaacgaattctaatggaaagattgattaaagaaaataacgagttgaaactttataaaaaagccagctccaaaaaacttggctctcgtgatggtacccccgtcgttaatgaataccaacaaggagaagatagtcctggtgtcgacgagcttaataacgacgacgacgacgacgaagacgttattagtacagctcattacaatatgaaaatcaaagacttggaagctgacttgtatatattgaaacaagaaagagatcaattaaaagacaatgtcacttcgttgcaaaaacaactttatttagctcagaatcaataa

SEQ ID NO: 880 - DNA, 1656 bp, Candida albicans
ttattaacaatgattccaaggctatatcggagtttttcaatatcgactactttgcgtaatgaactactagacacggctaagctgttacaatcgagttccctgaacactttaaaccagcccaaaaatttcaaaatccacaccactaaaccaacatcgccagaatcttacgaacgaaccgtttatccaaccaactacaataaaccacaagatgaaaccttggaaaattctgatattccaatgatcaaaataaccgagctatctcgtgatttaactacgggtctaaccactgccactacatccattgcagattatttctttggtaatactcatcattcacatcatgtattctacctgaacctaactgttcttaaagctaaacgtgctgcaaaagttgagaacaaaaaatttattgatttaaaattgattaaattgaccagtgggaatggtggtaatggatgtgtttcatttttcaaggataatttcaaaccaatgggaccaccggacggaggtgatggaggcaatggtggtagtatttatttgaatgttgttgataaaaatatcactagtttacatggattacaaaagagatatgtagctaaaggtggacagccaggtaaaggatcacaattggatgggaaaagtggagatgatataattattgatatcccgttggggacaatagttcgatggataccagatcctcaagattttaaaaaattcgttagtcaaagagaaggtgacgcattaaatgatgttttcatggaatttgatattgatgatcgtgattttattcagttgaatcgtggaggataccgtcctggcgaaggatggatatttaaagagcatgatgaagaatattttagagacaaggattttttccaagatttgaatgaaaaagttactggttatgatgaggaattactatttgaagaaagttataatgataggttccccattgtcggcttagattgtaatcaagttacgcagaagcctctattattgttacgtggtggtaagggaggacttggtaatatgcattttttgactaaagaaatcaaaggaccaaggttttgtaaaatggggagaccaggaattactgctaactttttgttggaattgaagctaattgctgatttggggttggtgggattacctaatgccggcaaatcttctttgttgagagcaatttcaaaagctcgaccaagggttggtcattgggaatttactactttgcaacctactgtggggacaatctttacaaggattgataaggacccattcactgtggctgatattccaggtattataaaaggtgcatcccagaataaaggaatgggtttggatttcttgcgacacattgagcgttcaggaggattggtgtttgttgtttcgttggagtcggcaaatccagtcgatgatttgaaaatcttattagaagaagtgggtcctcgtcgtatgaaagataaaaatgtattggtggttgctacaaaagctgacttaagctctgaaggtgctaatttcaaggtgctccgtgattacattgaacataatcatagcgaatggaagattgtacctgtttgtgctccaaagggagagaatgttgagaggtgtatcaagttgatgagtgaaatagctcagacgaagaagaaaccttaa

SEQ ID NO: 881 - DNA, 1896 bp, Candida albicans
  unsure (4),(5),(6),(8): Identity of nucleotide sequences at the above locations are unknown.
tcannnanatatattctcaatcaatcatttgttgaatcgtctttctttaccaagttatctgaactaaagttagtaaagtacaaattggattcgtcttatattgccattcatggtttccaaacacacccaaccaaattgaacaaatttaacgacacacccgtgttgaacttagaccaatctagttttgatgacacattgaacgatctgaggataaacattcctggagagttgtttaatgtcaatacaattgaagaattcaagtccctagataaattgaaacttttaaacacatgggggcaaaatgtttacctggaagtgacaaacgctactagttttgactacaaattattcaataaattttatatcttaacgtattcagatttgaagaaatacaaattctattattgggttgcgtaccccacattgagcaatacttggacagttgaaagtgaatcccaagaaactgatactacaataactcagcttgttgagacagagttggataacgaatatggtcaatttttccaatactatggaggaaaacttcacaaatctgttcaagcggacaaagaacatacatttgtattcatagatacgtgtttaagtaaagatagaaagccttcaagtcagctcaaaaactatttatatttcattgcgtataagggaattaaagaaatagatcttgttacttaccgcaataataacttgtcatttacacagcatttgaaattagatgcttttaccgattccccgaaaatcagtggttgggaacgaacaaaccaaggaaagttagggcccaaacttgcagatttgggatcattgataaatcctttacaattggcagaacaagctgttgaattgaatttgaaactaatgaaatggagaattgcccctgatattgatttggagattattaaaaaacaaaaagtgttgcttcttggagctggtactttaggaagctatgtcgcaagagcattgttgggctggggtgtcaggagcattacgtttgttgacagtggtagaatatcgttttccaaccctgtgagacagccactatttaactttgaagattgttttagtgacagtggacaaggggaatacaaagcattgagagctgcagagaatttgaaaagagttttccccggtgtagatgcaaaaggtatttgtttagcagtccctatggtgggtcacccagttactgatgaacataaagaaagggaaaattatgaaactttagtaaaactttttgaggagcatgatgttatattcttattgatggattcaagagagtcaagatggttacctactttaattggtgcagccaatgaaaaaatagtaattaatgctgccttgggttttgatagttatcttgtcatgaggcatggagtgacgaaccaaaaggatagattggggtgctattattgtaacgatgtggttgctcctaatgacagtttatcggacagaacgttagatcaaatgtgcactgtaacaagaccaggaggtgcattgatggcttcatctttagcagttgaattgttggtggcgattttgcaacatcctgaaaggaatcttgcaccacatgatgctgaaacaaaatttgggaatataccgcatcaaatcagagggttcttacacaatttccaacaaacaaagctatttgcccctagctatgttcattgttcagcttgttctccacgagttattactgaatttaagcaagaaggatgggaatttgttagaaaatgtctcgatgattctcaatatttagaggatatttctgggttgaccaaagttcaacaggaagctgagttggctgccaaacaattgctcgaagatttgtcgttggatgatgatgttagcaatgatattgatgaggattctgagtggttaagttga

SEQ ID NO: 882 - DNA, 1761 bp, Candida albicans
  unsure (199),(208),(1731): Identity of nucleotide sequences at the above locations are unknown.
actaatcacacaacagcttcaactttaatcttaccaatcaactgtacaaatatgaatacgttttcatccccaccaaacgtgatacgagagtataatgactccacatatcagctgccattgaattcacaattccaccaatcaccattcttgcagactcaatcaccagactatgtcagcttacgagcagaagaggatgatnataatgatnagaatctagacatcatgtcatcatgtatagtagattcagttatatataaatcacaaaaaattgctggcccactattgagttcaatatccaatttgaacattcagcaagcattgattatacgagaactactattcacattgttaggacatgaaggtcattacattcaatatagtaaacgttatgatccaacctcacaaatcagccgaattgaaggaccggactataagattgcaaagaacttggatataagtcttaaagttatcaccaagaaattggtcaaatttggaaagttttacagtgggttaaaatcgtttattcaagtatttgataataacaaatttgggaaaattgtgcaaaagttttgctctgaagtgagaaagtttttatcgagttatcaacaagtgctaataaatgttgagcatgagttcaagtttaataagaattttaatttgaatatgttggatctgctcttacatcaagaaatatcgaatgaaatgactcatttatatcaaattggaatagagattagtcggataacggaagaaagacagaaaatgtcacaggcggaaatcatgggtaattttgaaccaacgactttggcaaacacaagtatgaatgggatcaattccgagcctaatttgtattatggcaaatttgattgttgtaaaggtggactattacttcaagttattcaggaaagaatggtttattataaaggtgatcctacatctctagattttttaactcaactttttgatattgttagttcggattatattgggatgttgaatcagtggcttttggaaggtgtaataaatgatccgtttgatgagttcatgattagagaaaaacgagtgccagactcctttatggaaatatttcaaagtaaaagtgaatactattggaacgaattgtttttaattaaaatagatggattactcaatcaatttcagaattcaaccatacagtcgaaaattctcaatacagggaaatacttgaatatattcaaacgatgcacagggttacacaattttgaatcattaaaagaaaaattgacaactataactagtttggcagctcctgatttggaacttaagattgatgagttttatcatagagcaaacaaaatgttgatgaagttgcttttcgatggatataatttcccaagtgtggtgaacatatttcaaagattatttcttttcgctgattcttttcaaatcgacaactttattgatagtactttcagtgaattgaaacgtgggaaactcaaaatctcagtttccagactacaaaagcaatatgatgatatattcaaagaaaaaattgaaaataaagttggagtacggccaagtgtatacgacgtgttgaagaaaaatcagaagctatcggtaacgtcggagtcattgtataaagtggttgaggaattaatggaaaagaacctggattatttgatttcagacaacaatttgcgtgggatatttcatcgagtggcgtctttaagagacgacccgcgacttaccatnttcctaaacgaccgggatcgtagtagttgc

SEQ ID NO: 883 - DNA, 300 bp, Candida albicans
gaccttcgagcctgggctggtgaatacaacaacccttacatccctccattggaagtgagattgataccatactatgtaccgccacgaatccccacttttgttgaaatatgctcgttctttgggttattaatttggcttgttccttttgcattgtttgttagtttgagtgctcatgacaatttgttgccacaccatttatataaaccatatgataagaataaaaacaacggtttggccaaagtgctcgtaggtaatttgagagaatatatttacgcaattagtataaagtttggctactaa

SEQ ID NO: 884 - DNA, 3549 bp, Candida albicans
tccccactaacactcgatatacaccaagaactagattgtttgtctgttttaaaagattgtatgcgaaaaccacattattgggccttacgcgatcatcatgtcatcatcacaagaattatacacatctctttcaagggaacctccgcaacaactctaaatgacaaaatgagacatgggtttgacattgattacaattctgaaaaattcttaaattcattagcaaacactttttacatatatttcgatgataaacgtcaaaacacaaatgggaacccattgacagaagaaatgaagcagtccgctgaatactttaagaactatcaacctatatccgattggaaagtcatgaaagagcgacaaaagaccatcaatgcaatattagtgctatgcttaaatttgggtgtagcaccaccggatgtaataaaaccttcaccatgtgctagatttgagtcatggtgtgatccgacaacttttaatgataccaagaaagcaatagaaaatattgggaaaaaccttcagacacaatacgaaaacatttcatcgaaaacaaggtaccgccagtcattagacccctgtgttgaggacgtaaagaggttttgcaatactcaaagaagaaatgcgaaagatgaaaggatcttgtttcactataacggtcatggtgtacctaaaccaaccgctagtggagaaatatgggtctttaatagaaattacacccaatacattcctatatcattgtatgacttgcagacatggctaggtgcccccgtgatatttgtctatgactgtaatagtgctgggaatatagttcacaatttcaaaaagtttgttcaaaagcgtatagatgatgataacgacgggaaccacgatcaaagtgcaccttcgcccacttcggcctatcttgattgcatacagttggcagcttgtaaaagtaatgaattgttacctatgagtcctgatctaccagctgatttgtttacatgctgtttaacaagtcctatagatgtaagtataaggtggtttattattcaaagctctttgaaaaaagggtactatgacgcattacctagaaactcaatagggaatattattattcctggtaatttaaatgataggagaacgccattgggggaattgaattggatatttaccgctattacagatacaattgcatggacctctttgactagacccatctttaagcgtttattcagacaagatttgatagttgctgcattgttcagaaattttttattagctaaaagaatcatgccacatttgaactgtaatccaataagtgatccaccgttgcctgattcggttaggtttcatccaatttgggattcgtgggatttagccatagaccaagttctttccagattattgaaaagtgccaaagaagaaacagttacaatgccacttgcaggtaacattcaaaatggctccactaaaggagattctgtgtcttctgcccaacaacaacaagccaatgggtctcaatcggcggcattatttccaaatttgggaaatgttcagtacactacattctttgaacaacaattgacagcatttgagatttggctcaaatttgaaggtccatcgtcgaaaacgccgcctgaacaattaccaattgttttgcaagtattattatcacaagtgcataggttaagagcattaattctattatctcaatttttagatcttggcccatgggcagtctatttatcattgtctattggtatctttccatacgttttgcgtttattgcagagtcctgcacaagaattgaagccggtgttgattttcatttgggccagaataatggcagttgattacaagggtactcaacaagagttatgcaaggataagggatacaattatttttactcgatcctaaattcgccgccaataaatcatgtgggggtgaatggtaatgtagctactactaacacgggtactatgttgattaatgatgatcataaagcaatgagtgcatttattttgaccttgtttatcaaggactttaaaaatgggcaaaggttgtgtttttcttcagaaattgttaccaattgtctaaaatttatacaaaccagtgataatccgttacttagacaatggtgtaatctattattatcgcaattgtggaatagacatcctgaaggtaaatgggtgatttataaaaacaattatatcaccaaattgttgaatttgattgatgatccgatacctgaggtgaggacgtcgattcttgttgcgttgaccacttatctttctgaccctcctcatttggctcctcagcaaccaactaaccctgttgctgtcaacaccaatgatttaagaaaagatgaaattagacaacaagatttgaaattagcgaatacagtgcttggtcttttgggtgatggctcgcctattgttcgaaaagagttggtatttttcattaataaatttgttcaaacatatgcaaaattctttttagttgttgcatttaaccagttgcaagaagaaattgtattgattgaaaatcctaattatttgaatgatttcaggaaaaggtcacctgcgtatgggtcaatattcagttcagtctggaaagcattattgatattgtcagaagatccacactgtgaggtgaagcaattggctgaaaccttgatagattatgtcatggtacagttgaacgaaagtgagttatcaggcttggtaaaagagatgcaagattatttgttaagcaaatcaactatcaacatcagtgaaagtttcaagccaaccaaaccggttgttaataggcaattgggtgaaaaacgattagtctcaagtgcctctattggtaatagacgaaatactttgttaatcgatggatcgtcactaacaacccgatcagcttctgctaacaatatcactagcaacagtaacaatagaaacattaaaggtaatatggatgattcagatgctgagtccattacatcaaagattaaaaatttgtccgtttcaaagcttttcaaaagtttccacattaccgaagaaaacgatttgaatagtttcacaagaatcttgaatcctggtccagttcaatcaaattatggaagtgaatatataccgaaaactgcattttttaagaaaagggatttgtcaaagactcctgaattgccatttgaatctgggtttttcgagtatagttgtgaatattttcaggaaccgcaaatgtcgaaaaatgaaattgatgaaccaggttctaaagagtatgtaaaacgtttatggcgaagaaatagaaatgaatctattattcaagaaactcaaccacaaaaggagatggctttgaggggagaatggaataaagatattcagatccttaacaatataacgcaaccaaaatgtataaagtttacacaatttgaaaaaatattagttgcaagtgatgagaaagataatatgaccgtttgggattggggaaatggtcaaattgtcaaaaaattttcaaacggtaatccttttgggacaaaaattactgacataaagtttctaaatgaagatgattcaccgttattgttg

SEQ ID NO: 885 - DNA, 783 bp, Candida albicans
tttttttttctatttggtttgtttaattcgttggtgacaagttcttcagttcaactttatttctcattactcatcttctacaatcagtgtaatatgtcatctacctcacaaaatgcaactgtgttattgactcgattattatcactcaaagaaaactcctctttccatttgattttggattcattaactcagtcatcatattatttaattcaagagtacatccacaggtgttctaaaactactagcaagattatttatttgtcatttgaaacaataaataaaccgcattactgcagtgaattcatagattgttctgatatcacattacatcaaattgttgaaaaagttaaccctttgcgagaatccaatgaaagactgttgatacttattgattccttgaattatatcaataacgacgagttggcccattttgtggcgcaattggttggtccagaaataaccctagttggtgtttatcatactcaatgtcctgttgctgcatcaaaatatccaaattatccatcatctgaaaccctattaagttatattgcaagcacaatctttgagttgtatcctttaatacctgactctttagatgaagaagaactagatgctaaagttaaaaaattgacatttccaatcaactctaatttgaatagtgccattttcaaagttatacttacaaatcgaaggaaatctggtcgttcattaacatatacacttctcatcaatagtgtaaatcaggaatatgaaatttggaaagacaaacaggaatcaggatga

SEQ ID NO: 886 - DNA, 975 bp, Candida albicans
ctgtggagaatgaatatatcaatactattggtgtcattatttctatcactcgcgtgtgcagatgaaattaaaccaagtggagaatttcacgagcaccttcatttgaaacctttgtccaggaacaggctattaacaaattttgaatttgatgttgaatcatcaccatttcaaattgattattacaactcctcctctcctgttgaagcctccagaagaagtcattacaactactttccaaactctttaggtttgataatagagtctacgaatactaaagagttgcaattgagattcacacaaggatggtgggatgctagttcatggggtcagttaccttttaatggtaaatacagtggaggtacaggagtagaagtgtctgctgtcattgaagcacctaatgtcgaagttgccaaacgtaactggctaaaattaacgaaaactttatctgggttcttctgtgcatccttgaactttattgacgatcacattacgacatatccaaagcatgcagtcaaagaaatcaaccttgctgaatatgcaccagaaaagggtaataaattgtatttgttacgtgctgcattacccagtgaaccagtttgtacagaaaatttgaccccattcttgaaattattaccaacaagaggaaagtccgggattagctctttattagatggacataaagtgtttgactcattgtggcatggaatgtccattgatgtcaccaccaattgtgatactaataatcaatgtactttaaagttgcatcaaactgttaatcaaattgttgatatcataaggtcacttcgtaaacggaaggaaggagcaattcccaaacccacaccaggcgaccaattaagatgtgatacagagaaaacttacaactcttggcaatgctttccgttaagtgatccagtgaatcttgaatggaatttagaaacaattaatggaagaggtatttatgttccagcagaacgg

SEQ ID NO: 887 - DNA, 852 bp, Candida albicans
ttgcggatccttccaggggcccgtggtgaaaaatccattgtaaggaagttcattaaccaatcaataagaaaaaatcatatagtccaatatttgcatgaaaatgtcaaatttgattttcaattcattgctcaaaatagttctatcgttttaccaattgataccccaccgttatatgcatctcgttctttaactggctactcattggataaaggggggttgcgtaccgtgtttaccaataacaacgacgagccagttaaatttgtgtattttgaatcgactccttggttcatgatattgtatttacacacattgagattgacattgaaaaactcaactgggttatttgatatttttgaccatgaacaatatatcaaggacgtttatttccgccctgctgttgacagagagaggccatctcacatggagttgattatggaagtacccgctaaactgacattagctatatcgtatgactttgacaaatcattattgttgtatcgtgagtaccctccagatgcaaatcatgggtttgacgtcgagcctgcaataatatctgtttttgataaggacagtgaaaaagtatatgagttccgaacaactagtttattgttgacattacctacaccggatttctcaatgccttataatgttatcataatgacgtgtacagtcttatctatggtttttggtactatattcaatttattaataaagaaggttgtcactgaggaggaatttgaagaaatagcggccaacacaaaattggccaaattaaagagaggcataaaatcaactattcagcaactcaaaggtcaaaaacaagcaaacatactaacactaactaagcaataa

SEQ ID NO: 888 - DNA, 474 bp, Candida albicans
ttactgatgccatcaaaaaggaggccagtcgatataagaaccccgaagtacaagaagaaacatccaaatatgcgaacaagactaactgcagatgattatcatgatattctgaaatactttgtattggatttaactctacgattaaacaacgtgagagcaaaagtcccattcaaatctcccgaattgtcatatatcaattatgctcttatcaggccgattgttgcatacataaactcaaaaaacacctttattgaaatacacaatagaatagttaaaaatctacaggattttagtggatcatggacaatctatgactctttactaatggatgacatatctgaggaagtgtacgacaattttgcagaatatgttgccgacgaagaagctcgacttatacggttgaaacgaattgggttctggtcgcttcagttgttggttcaactagtattgtttggagttggggctgtggcataa

SEQ ID NO: 889 - DNA, 1851 bp, Candida albicans
atgaataaatcattagtaccatcatcatcgtctttgttgaatgtcaacagaatactagtgcggaatgttgcaactaaacaactagccccatctctttccgttttatccacacgcattttgaaaaatcactttacaaccaaatttaaacaacattctatagcatttaacaagcaaagatatttttccacattcagtcgatcatatcaagagcctttgaataaacacacacaaccaaaagatgaattgaaacaaactataacgaaagcaactttactttcgcaggcgaattcaggcttatcccgtatgttgatacatttaaagtggccattgtcacgaaatacaaatacaaccagtacctgggatatgacgtcggcatttatttcatggttggtcatgggaaatattttatggattatactagggaccacaacttttgggttgactttgatgtattctttgcactatttggatagcttagtgggtaaattcagtgacgacaaagaaacaaccgacaaattgaatcaaacaaaaagtaagacgtcaactaatgtaatgagttatttgattggaggaatcatatcatttggtataggagtagatttgaattttgaaaaggggtcatcgttaccggaattaaaagatggaaaattaagattcaagaatgtaggtatagtatcccatgatggtaataacaagcatgtgaagtgtaagggaacggtggaagccatggatataacgttatcttttaacaaatggtatgaaggaaatggattgatttatgatttagagttgtatggattaaatggtaagttgtataagctgagatcgccttcaccgcccgtggccaacacaactaagaaatcgtatagattcaatgaaaacatccattaccaatatgacttggatcataatgtcgaagaaatagcaagcgggtccagttctattattgataacaattatacctttgatcatgttaaaattcacgattcgtatttggaaatctacgaggaacaatccagtactccaataaaaattaatattttcagctgcgatctaccaaaattaaggggtgataagctagtgttggatttttttaatgcaaataacgctagtggcgctattaatgatgcaatgtttactttgcataaacgtcagaatttggatccagaaaacaaaaatcaagacaagttaatacggttcaaattggatgcgattgatttgggagagatcaacaagtatgacccaaatctgaaatttaattggataataaatgggaaagcagaagttattgcagatattactttgcctgaagagcaggacgatttaaatgagtctataacagaagtattgactaaaatgtttaccaatatgtttcaaactgcagacatgtctcaaacatcagaggattcattgttgaaagatgctatatctgcgatttatcatactttcagaaagccagaagaaactgctaaaccagcagaaaattcttatgttatggtaaatgtcaaaatgaaattgtatgatttgaaagcaagtttgcctcaagttttaccaagaacaaataatggtataccatttatatctttgacagatttgagatcattgattagttttatcaacacggaaaaccaaccaattacaatcaaatccacggtgattgaaaaaataactgatttatcgaacattcaacatttgggacaaactaaaatgtttgattatattatgggtgatgcctatgaggagcttacgaatttggtgagagatgatgcaagacgaataattaatgaaaaatcatggagtaattcgattgcaacacaattgttacttttaggattaggtgcaatggtttga

SEQ ID NO: 890 - DNA, 1416 bp, Candida albicans
gaattcaaagtccaatttggtttcttgcttgctcaatcgctcgtttcctgtttaacaaaaataaaaactgatttggcgattcccagaagattaagaatctttaacggggaatggcatcctcaaatataccttaattcccatatacactcaacatttatgtcactaaggaacatattaggactactgaagcaattgaataggcaaactttgttgtttctgaaaacttgtcaaaaatctttgattcgtccaactgtaatatcagcaatacaaccacatcgacaattttccgcttcattatttgcatctgacaggaaacaagtcaaccaatcagacaaacaaccaaagttacattcaaaagagcaatcagaagacaaaccaaaacatgagacggagcttatcccaacgaaagaacagttattggcgaaagcaaacaacatgtactcaagattgaaaatacgcttgaaatggcttctcaaaaaatccaatcgtcctttcaacaccgacgactattcagctttcttttcctggctagtagttggcaatgtttttttgttttttgttgccaccaccacttttgtatcaattgtcatttttacggccaatacggtgtttgctcaagaatttgtggccaggaaattgggggaatttatcacaaaaaactctaatttaaccgtaacttttgaaaatgcaattgttccaggatggtcagacgggaaaatcagtttccgcaagtgttttgtaagtagaagacccaaaagagtggaaaaatttatcaagggttcccaacaggaggcatacgaagagagtttacaaaacgaaggcactaacgaagacgaagaagatatttttgaggatgacggcaattacactcagtttgatttgacgatcgaggaagtgaacatatctttatccctcaacaagtgggttaacggtactggcatgatcgagacattagaattgaaaggaatgagaggagtggtggatagaactcatgtccattggaaacccgacgacgatgccactaattacaagaatatacaccaacctggtgactttgaatttgaatcattcagaatggaagatgttttgtttacactaatgcagcctaatggatttaggaaatttaatgttgcaatttacaattgtgagttatcgaaactaagaaagcattggttattctatgactttttgaatgctaatgtcatgagtggcgcatacgataattctcttttcacaatacataaaaaacagcggttgaacgattttgacgaatacacccctaccaatagcaacttgcagaaatggaaacgagttacacggatgagagtcgactctttgaatattgatcatttaaacactggtttggagggcccatttggctggataacatcttcaccacgggtggaagaccgcgtc

SEQ ID NO: 891 - DNA, 1086 bp, Candida albicans
aataaattgaaaactaaattaattaatttaattgatggtggtggtggtgaagaatttataaattatcctcaagatttacaattatcaatttataatacattagctatgcttccaattattgaaaaaattgaaccagaaacaaaatggtataatgatgtgattaatattcttggagaaattaatggattaattcaaatttatcaagaatttttgaattttaaagatgatcaagatttatctaatttgattcaaaaattacctaatcgaccaacaacaacaacaacaacaacaaccactactaaactattaactgatttatcaattgattttaataaacctcaaaccattttatctatttctaatcatttaaatattcttatgggtgttttaaaaagttatttgacggtggaaacttcatttacagtgaaattacctcttggattgattttaacaacttgtgaattaatatgttcaattaatacaaaatttttatcatttaaaggagatattcgtgatgaaacaatcaagaaattaatcaaatttagtttaattgaaaattataaaaccacactaggagttttaattgaattaattgaattatataaagggtcattaattcctcatttaactacaatttggtcatttttagaaacattaattccatttcaaaatcaaaataaaagaattgtcaatgaagaaattattgaatcagaatcattatacgttgaaatattacaatttatgaaacaaagtttatctttattaggtaatgtttctgaaaatactcaattattaagatttgttgatatggcattaatattagttgaaccaagaatcaatccaactaccaccaccaccaccaccaacaacaacaacaacaacaacaatactaaacagactaacgtccaacaaggtaaaaaacaaaagaaaaggaaaaatacttcatcagtggcattatcagatatattatctcatgaacatttattcatgaccaatattcctactattacaatcactaccgttcgatcatttattaatcaaatcattaccaaaattatattaccaccaactcaacattataaaatc

SEQ ID NO: 892 - DNA, 744 bp, Candida albicans
ttttttttttttttactttgttcactaaccatgtttagatacgttcgttctgcgtttattgtttctgcagttgcagctactccgttgtttcatccaaagattcttctggaggtgaagcaggttgtggtggattcttcgcttaacccgttcccaaccgagattcccaagggattgttccataacgactttcaacttttgggtcatggtgtgagatcggtcacgtttatttcgttcaaggtttatggagttggaatatacattgccaagaaggatattcccaaagcaagttcagtgttgatgggtatggccgacaagctcaaagacccacaagaatctgcgcaagtcattgaaaagcttttggatagtgatgttaaatttttggttcgtttggcaccggtgagaaacaccgactttaaccacttgaaagatggcttgattaaatcgatattggcccaccccaagagtaaggaaatgaagacagagttgggggtggggttggacgagttgagacaagcgtttacaagacgagggacagttccgaaaaaccatttgttgtacctagaaatgctcgatgggggcaagatggagttgagttatgtgaatccggaaaagaaaccatacaagatgggtgtggttgactcgccattggttagcagacaattgatgttgcagtacctttccggcgccaaacctctttcgccttcgttgcgtgatagttgtatagaaggatttattaatttataa

SEQ ID NO: 893 - DNA, 1152 bp, Candida albicans
attattaattacaacgtggtgcctgtctgtgatcgggatacttttcaaggagcaagttgtaaatatgttgctttgacagatgaaattagagacttactagtaagttttgatatttcaaaagcggtggatgtgacacaaccatttgctggtcatatagcttcattgttgaacccattactaggtactattactgcagacgtggtttttcaatttaagcaacctgggatccctgaagatttaagagtattcaaactgcataggtttttattggcatctcgaagtccttattttgaggaaaaatttaatggggaatgggaaaatttgactgtgattacaatgcccatgagtgttgatcctgcagtattcaaaagaataataaattatttttatcttcgaactcatgctgttttgaatgacagttatgctattcaagatcagttgcttaaattggcacgaatgtatgagctcgatgatttggtagacggtattgaagagataaagggaattgaagacgaaaaagcaagagccaagatagggcatgatttgtcattcaagtttgttgaaaaggcgagaaaagatttggatgatttcttattgcaaaagattcttggtgagaaattgagcacggacatggacttgaaagatgatgttgatttggaagatatcgattgcacagagtttttgagtgatgcccagagagaagcattacttgaagcagactctatcccagacgtaattctagcttgtgtcgattccgagtctgaatctgttatttattatcctgtgaacaaatcaataattgctcgatctgagtattttgatactatgtttaaatcagaaatgtttacagttgcagaagaagacttgccattatatagagaggctggagttcaagtcattaatcgtccacagctagatacggaccatcttgcaataattcaagtttccacaagtactgccaatcagaaaattgctgaaatggtgttatcctttttgtatcatgacaatatcaacaacattccattggatttgtcactagaattactatttgctgctgacgaattgtttttggaaaggttgaaaacaatgagtgctgtgaacatcacttctcagttccaaaagttcaacttccgtcttcacgcccgggactag

SEQ ID NO: 894 - DNA, 1095 bp, Candida albicans
ggttccttccagccccgtggtgaagattattgttcgcacgagaataaaaaagagaggaaccgccggagtgtgcaaccaagtccaaagtgggccggtttttttttgttttttcttttcttttcgctttcaatatttcatcggtttgccttcctgcccatttctcgattaatatattctattgtattattactaatattattcttcactgacatgtcgtcggaattgttacaggaagtccccaaatccatagaacatgtcaaacatattattttaattttgtctggtaaaggcggtgttggaaaatcttcagttacgacacaagttgcattaacattagtcaataaggggtttaatgttggagttttagatatcgatctaacgggaccatcattaccgagaatgtttggagtggaaaacaaacaagtacatcaatcaacgcgaggatgggtacctgtttctgtgtataataacaataataatcaaggaacagattctaaacgtgggaacctttcattaatgtccttagggtttttgttgggcgatagaggtaattcagttgtatggagaggccctaaaaaaactgctatgatcaaacagttcttgaaggatgtagtatggggcagtgcagaaacccccttggattatttgctaatagatactccacctggtacatctgatgaacatattgctattgccgaagagttacgatgggcgaaccctatcgatggtgctattatagtcaccacgccacaacaggttgccactgctgatgtccgtaaagagataaacttttgtaaaaaagtcaattttcagatattgggtatagtagagaatatgtctgggtttatatgtccacattgttctgagtgtactaatattttctcaagtggaggtggtaaggctttgagtgaacaattaaatttgacatatttgggtaacgttcctattgatcctcaatttgttgaattagtggagttgcagaatgagcaagaaaacaaaaagttgattgaattgtatgatgattgtgaattgaaacctatactaaacgggatcgttgacaaaatactagataagaatctaccatctagaatttga

SEQ ID NO: 895 - DNA, 726 bp, Candida albicans
ataatatacacacgtattattgacaccatgacagtagatgagctggatgttagtgggtcttttcaaggcttaatgagatcattgaatttggatagtgaacaatttaaggaatatgacgatattgatttcgaatctcttaatttcatacaactttcacatgtcaaggatgagatagaaaaccaattaaatatattatttgacttattgagacacaagtacaatgccgatatggatactccgttagttacgcctgatggatttccaagaagtgatcttgatgtggtcactattcgattactacgaatccgaattattcgattgagaaatgatgatagaaaagttatacatttattagatgacaggatggcccaagagtttgctactcgaagagaaagcaacatagaggcaggagaagaagaactgactacatcctctacatcaaggtaccacattccatttgcccaagtgagagaagtagtctctggcggacctgctttcaattcagggttgaaagagggagaccaaataattgtttttgatgacgacattcatgctgctaataataacaagttaggcagtttagtgtcaagagttcgttcgaaacaaaatgaagaaatcaaagtcgatttgaaacgaggcgaagaaagaatcactttgaaactaattccgtcggataattgggacggacaaggtttattaggatgccgtttaatacctatatggtga

SEQ ID NO: 896 - DNA, 321 bp, Candida albicans
aagagggagaaaaaaatggcaatcaaaatcaaagttgagtttttaggaggtttagatataatatccaattcagtaagagaacacaaatgtgtgataccattcgaagaaggtgaagctacagttgctgatttgataacctacatcaccaagaatataatatcagatcctaaggatattcccgtatttatagaagatgggaccgtgagaccaggtattttggttttgattaatgataccgattgggaattagaaggtatggaagaatatgttattgaaagcggagatgtatttacttttaccagtacattgcatgggggttaa

SEQ ID NO: 897 - DNA, 654 bp, Candida albicans
ggtgaaaaaattccagatgttactttgttgaaccaagatggtgaagagataagcttaactgaagttgccaagggatcgaagtatgtagttatttttgcttttccacgtgcatcgaccagtggctgtgctagacaagtatctggctttcgaaaacttgacaaggactacaaagacgtctcaatctttggtgtttcttctgatagcgtcaaggctcagaagaactttcaaaccaagcaaaatgcagagtacgatttgttgtccgatcctgagaagaagttaatcggtgccttaggtgctaagaagcaccctctgggaattattagatcacactggatttttgttgatggggtcttgaaagtcaaacaaattcaagtatcaccagaagtcagctttacaagtgccgaagaagagatcaagaaatttatcaatgaaaatgagaacgggaaagaagctactgaaaatgatgtcaccaaggaagaagttaaagaggaatctcaacaggatgacaaggaagataataccgaacaaactgacgagaaagccactgaacagactcaagatgaagtgaaaaaggtttctgacgaaactaaagtcgaagatgaaaccgcagacaaaccagtcttcacacacgccggtcgaaggatccattgctac

SEQ ID NO: 898 - DNA, 960 bp, Candida albicans
aagctacaaaactgggctataatgagtgaagatgatgaatatataaaggcattggagatacaaagaagaaactttgaagcccaatttgggtctattgaggatatgggatttgaagacaaatcaaagactcaagtagaattggaagatgaagacgaacgttcaagccaagattcaccagaccaatcatcgggagaagacgaagaagattcggaatttgatgaaatcgattctgattctaatgaagaggaaatggactttttaggcaatgatgaagagcaggatgatatccccaaacctaaagtgtttaaactcaacgatagttctaatacaccacttccagttgtttcaaaacaagatcgaaagctattaaaatcaggacgagctccaacgttgttagaaatatcgaaaaaagaaaaactcgctgccaaacaacagtccaaacaacaatctgcgaagtctaaagcggaagatgaggaaaaccttgccaacgacctcaaactacaaagattgttaaaggaatcacatatcttggccaatacattagaatattctggtgcagacttgactttgcaaacgattgattttgacgatccaacgggtaaagcacgtagaagagcgttggattcgagaattcgtgagttggcaagtacaaattcaagaactggaggattacccaagaaattagaaaaaatgcctatggctatgcgaaaggggatgattaaaaaacgtgacgagagaataaagaaatatgaacaagacgcaagagatgctggaatagtattatccaaagttagaaaaggagagttgcgtgatttggatgctggaagaggttcgacttcatctattgatagattgggtaccggtaagaaaattgataagagaattagggatagaggtttgaaaattaatggtattggtagatctactagaaacgggttagttatatctcgggggaaatag

SEQ ID NO: 899 - DNA, 885 bp, Candida albicans
  unsure (403),(428): Identity of nucleotide sequences at the above locations are unknown.
agatatactcgaaccaatattagtattagcccaattcagccaaagatgaccaaatttaggggctgcattgatatccattccggacaagttaagcagattgtgggtgggacattaactcaagatgattcagcatcttctgagacttcatcaactaaagaaaactttgtctccaccaaaccttcctcccagtacgcacaattatataaagattataatgtgaaaggatgtcatgtcatcaaattgggatccaatccagccaatgacgatgctgcgaaattagctcttagtacttggccacacaatttacaagtaggtggtggaataaatctcgacaatgcacagtattggttggatcaaggggcatcacacgtaattttaactagttggttgtttactaaaatgncacaagataagatgaaactcgattntgggaatttacgggaaataagtaaattaattggcaaagaaaaactaattgtcgatttaagttgccgaacagtaattgaaaatggtaaaacaaactggtatgtcgcaatgaataaatggcaaacaataacagacactattctttcagccgagtttttattaaaagtcagtgcctactgcgatgagtttttaattcatgcagcagacgtggaagggctctgtaaaggtatcgacgaaaaacttgtggaaaacttgggtgaatggtgcccagtcggatttgaagaaaaaatagtgtatgccggaggtgccaaactgatcaacgatttagatactgttgctaagctaagcaaagggaaagtcgatttaacttacggaagctcgttagatatttttagtggaaaattggttaattttactgacttggtggagtggaataaagccaacagcaagacgaactag

SEQ ID NO: 900 - DNA, 1524 bp, Candida albicans
aaaacaagaaaaaataccggcgaaggtttaaggaaaaatagtacagaatttatcacatcaactctaaatcaacaaccattaaatatggcaatttcgcccaaaataaaagcccttgttgatctagcaactgttattgcaatattgctcaacttttttgtttacttttatccagatattgtcaatcctactgagaaatgcaactggtacaatgctcctgaacaaaaatcaaaatacacattcttgaataacaatttgccgactgattgggtgaataaattggttttgaacttccccagcctcaaggaacaggaggaagttgtaagcaatgatattcatatgttactatttggggaccctcaaattaatggaaactggcccctgacgaaatatatcaagaggttggataattatggcaatgactattatttaggacacatatacaacacaatgaaaagaagattgaacccctcacatgtcactgtaatgggagacttgttttcgagtcaatggattttagattcagagttttacaaccgtacctaccggtatgtcgagagattgttccctcaaccattggaatacaagcaaaatgcgcttgaagtgcatgcaagacacgagaactataactggcaacagtggttagaagatgaaaaggcaatggatcctattcacagattccagtctcgtgtatataacgatgtttatgattgggtttatagaaacaggtcaaccccaaactatgatcaacccttatttatcaatttaactggtaaccacgatattggatatagtggtgatgcaacttggcaacatatggctagattccatttattgtttggccaaaacaactatgttataaattacaaaaagggctccccagatgaatggagaatagtggttttggattcactaacattagaagggccagctttgcaagaggaatttgtgaactacacttggtcatttttagagaatttgcgtgatagagaaaatccaaactttaaagggtctaccatcttgttgacgcatgtacccatgtataagaaagctggattatgtagagatggccctgaacacaagtactatataaacaatgagaaagagccctacaaaaatggtaaattgagatcgcacaatcatttagcctatgaaacaactcaaaaagtaatggatattgtgttccccaacaaaggcaagagtggaattatattaacaggtcatgatcatgaagggtgtgatgattggtacaattatatcaatggcgaatggatagcttcgaaggagaaacagtctgctgaacgtgaatctgtcagggaagtagttgtgcgtgccatgatgggagaatttgatggtcaaacgggaattttaactggtcattttgatgatgctcgtgatacctgggatttccatttcagttactgctcgtttgttattcaacactggtggtggggcaaacaaaattgctttactggtattaatcttctaacaacccttggtgaacctcttgggtggaatataaattaa

SEQ ID NO: 901 - DNA, 576 bp, Candida albicans
tacatggtcctggcactgcgtttgaaaacattaagtacagccactgatgcatcaattttgactagtgataaatctcaagatccattaattaaaggattagatttatattcttcaaatttaaacaaaattgccaatgcgagattaggtcaagatcaattgattaaatctaaattcaataaacctttattgacaacattacgttcattaattagtcaatcaaataatattcaaaaaaaagctgaagataaaagaattgattatgatttaactagaagtaatttggccagttgtacaaatcctcaaaaggaaccaaaattaagagttgatatggaaaatgctgaagatgaatttgccaatactgtggaagatgcaattaatattatgcaaaatgttttagaaaatgctaaacctttggaagaattcttggaattaattaaagctcaattggcttatcataaattggctactgaattattggatggtatggttaaagattttgaagaattaattgatgaacaacataaattgagtggtagtgctactagtggcagagaatccggtgattttgacatttaa

SEQ ID NO: 902 - DNA, 1128 bp, Candida albicans
atactatctatatataacttgttcttttatttttttacaaaagtacaaacatattcaccttccatttctgttttttttttttggtatagttattcaataatgtcatttaagttcccatcgtttgattttaaatcaattcaagaatcgttaccatcagttgatcaagtcaaagagtctttcaccaagaccagtgatcaattgagcaaatcaattcaaccatacaccactaagaccacacaattgatctcagaacaattgaaacacttggagcagttggctaacaatacaacagatgacattgatgtcagtgagttgccacaagattatttgcaattggaatcaaattgtgatttgttgttgaaattgtacactgatttaattcaaaccaccaatgaaacctatggtaaagtcagttatgattacccacctggtaactatgccatcaacaagataaaggacgccaatgtcagtggtttgattggacaaaaatttaaccaattgaagaatgtttcgtcacctcaagaattggaaaaggtgttacttggacaagatgtcgatgctgaatctaaagatgaatcaggagtagtgagtattcaacctacttcaccacaattgccaaaaaccttgtttggtcatttagctgaaatatgtgccaaacacagcgacgaattgaaatcttcagaacacccattatcatttgctcttttacaagtttcatcaacttatcaagaaattgctgttgccagattagatcaagataagaagattatgtctggattgaatgcggaattaattagaacattgaatgaaagttttattaaagtaaatgagttacgtaaaaaagtgtacgcaaccagaggcgaatttgatttattaagaagcaaatacgaaaaactggatccagaaaatgaagagttaatcgctaaagaagatgggtttgttagtgctaccgaggtagctgtggtggaaatgaaaaagttgttgaaaccttctaaaaatattgatttgttgaaagttttagttgccgctcaaaaagattattttgaagttggtgctaagaaattaaaggaagtattagataatttggataagattccaactactggtgaagaagaagaggatgattaa

SEQ ID NO: 903 - DNA, 825 bp, Candida albicans
cagtttttcaattcaatggctatttatgacagtcagcttacagtggttgcactatatctgctaattattattgcaatatattcagcaaagtttattacaccattgaacgagttgttacagtatgggaaaactgtatctcaagatgtaagggaacatgctcggttagagaacaatcttatcaaacaaacaattgggtttatatccaaatattttgtggttcccaaggcatggtttgttcatttttatatcactttgtttgctttatcttctttgatttttttggcgtcattcaatgaaccaatatcgtccgatcctgaaaaattcaaaaacttgattttgattcatcgattactatgggtccaaggaataagaaggttaactgaatgtctcactattaccaatttttccaaaacctcaaagatgaacgtgagccattatgtagtaggattaagtcattatatcttagtgacgtgggctacctatttggggctaagtacatatggatcacatcaagtccctaacaactatactgtatttgatattgtattaatcatagggtttgcaatttgctctttgctacaattccaagctcactatcacttgtcaaccttagtgaaatacactttgccagacttcaaatttgtttcatcaccccattatttctacgacatattgatttacacgatcttgctcagttttgcaattaaagatggtttcgatatggtttcagtaacattcttcactgcctggttatttgtcataagtaatctaagcataagctctcttgaaacatttagctattaccataaaaagtacaaagaataa

SEQ ID NO: 904 - DNA, 900 bp, Candida albicans
cctgtggtgaagacaaataaattgagtagtgaactatcattgagtaaatttttccgacagctagatccagtgaatacaaatggtataaatgatgagacagcagtgatatctttatacatattattaggtgctatggtgaaagattttgggtttgaagaagttattttccccatctgtgagattttgtatgcatcagtgttgcaagaatatccactaatggcgaaaaattcaatcccatttagaaatgaagatcagcatttaggcagtaataatattgcctacccatcagagaatgatgtttactcacttaataaacttgcagaagtggcatctcatttgcaaaacactggtagtgatacgtcaatgtcaactatggaaccgtcaagaagtgtgactccaacactgtcgttgaccggatcatacaagaaacgagtgtatttgaaatttttcaaccaaaaacttgagtttttatacccagttagaattgctgccacgccaagatataatgaacttttggagaatgcaaagtctgcattcaagctaccagatactacaattgtttttaaacaccatggcaagattgttcaaagtgatttagaattggaaagagttttcaagagtgacgaagatgagattgagttagagatatccactcataatcctatgccaatttacgaaatgcacaagagattatcacaacaagattatcaacaacctactgaatcacaacgaattatattgccgcctcctatagcttcgaatacagcaatgagcaatggttcaagtttgaattcaagattaggtctgtttaatttcttgagtaattcagatgatgttccgggtccaaaaccactacatcctcagcaatcaattctacccaaattccaaccattattataa

SEQ ID NO: 905 - DNA, 1431 bp, Candida albicans
acatcaaaaaagcagtgctacaataactgcgagattttggaaatacgattggtaaaaaaaaaagtaaaaaaaaaaaatccattgctaaatctcatctctatttcaaccaagcatactctaacaaatatgtctgccaatgatgagtattcttctgatgaaaaatcatttgatgaatctaccaaatccaaggtccttttaggttttgttgatgcccctataataagtgatggcaaggatcctgaagataatgatcttccaacgattgaagatacctttattggaggacaaccagtgtggttgcatccagattctaaacctgctgaaaaatcattaacttgtgatgtttgtaatgggaaattggctttgtacttacaagcgtttgcacctatagatggcaaattatatgatcgggtgatctatgtatttggatgtaaaaatacaaagagttgctctggtaaaaagggaaccgttaaagtgatcagagggattatcaaggactctgaaactgtcaatagaatcaaaaaggaaaaccaggaagcattgcgaaaggatatggaagctaaattgaagttggagaaacaaaaaaagtttaatgatgaattgacaaaagatttgtttaaaaaaaaagatacaccagaggcatcaaatccatttggtgggaatagcaatccattctcaaatccatttggtctgaaccctttttctaagaaacccgaagaagaaaaagaagaggaaaaggagaaagagaaagagacaagcaaatccaaatcgtatgcagatgttgcctccaaaaatgctccaaagccaaaatcagtgaaaaaattacaagacgatcttcccgagtatcgtggattatttgtctatgttgacaatgaaaaatttaaaaagatacagcatgaccctgaattggaaaaatataaacatttgatagacaaagaagaatacgatgagctggatattctagagaaaccgagttcctctgcatcagcttcaggattagataaccctcaagctagtcagatttcaaacatgttgaatgataagtattttgaaatgttttccaacaccgtcaaacacaatcctggtcaagtcttgagatatgatcttggaggtaaaccattattatacagtggcaaagatgatgttgctaaaaaatttttggcacaaccagcaaacattcctagaccaagtttcaatccgtctagtgaacgtagatttgaattacaattgatgcctaaagcaataatggatttagaagatcttggtaacaatagaaatgtgggaattaatgatatacttaacggaatgtcatggggaactattatagtatgcactgatgaagaagatttcataccagaagaaaattttgatgctaatcaagtcggatatatagaagaatggtgtggggtccaatgggaagaaagtgtataa

SEQ ID NO: 906 - DNA, 633 bp, Candida albicans
agcaacaacgataacaataataatactagaatagcaatggtatctgaagattggagaagcatagatattgatgcattagaaccagacgcccatttaacaaaggaagacttgcttccaactgatattcctccaactaccaatgaacaagtccaacaagttgccaatcaaatccgatctaatttatcatcaggacagtttcaacaagcattgagcttggcattagacaatgttccgtatgtggctgacctgagtacaaaagaattacattcaaagactgtatttgaagtgttgtgttcaattcgtaataataacaatttgaatgatttgactggattcgtcaaatcgttgagtagtgaacaacaagatgttttggttaaatatttatataataacatgtcaagtccttatggacagaagcaaggtggattgttattgaattggtttgagaagacaattgaggtgactggtgttggttctattgcccgatacttgactgacagaagaactgttaaaagagatccccagtactctacgaattatgatcatgaaggtgaaaaacagtttaccagtatagtgtttggaatgatggttttaaacataagaaagcaagtatgtcatatacatatatattag

SEQ ID NO: 907 - DNA, 534 bp, Candida albicans
atacgtattatagtgcgccaaaaaaacaaaaaaatacacaagtttatgatctttctttctttatcaaccatgtttgaaaaagcagtgtatccggcattagacgcattgcaacaaccactctcacaagaaaaatttagaatcttaaaggatcaattaaattcagaagagccaacgccctccgcacaaacaaagttcaattatgcgtgggggttgataaagtctaaccaccacaaacagcaagagtatggagtacagatacttactgagctatacaagagcgagaaaagtatgagaagagaagtgttatactacctcagcttggggtctttaaagattggtgactataccaatgccaagcgatatgttgaggcgttattggaaatcgaaccagaaaaccaacaggccacagggttgttaaaaaccatagacgataaaatcactaccgaagggttaattggtattgggattgctggtggcgctcttgcagttgggcttggattgattggagctttggttagaaaaaacagaaaatag

SEQ ID NO: 908 - DNA, 1491 bp, Candida albicans
  unsure (30): Identity of nucleotide sequences at the above locations are unknown.
acatattctttaataccaataggagatcanagaatcaagtatcgtggatattatattgggggtggagacaaagtcaccaaggaaatagatgataaccagattacaaatccttaccgagccgactcctatccatgtggtgctggggttcacgcaggtgtcatatcaccattttggggaggctgtgcaagaatgtcctatgaaagtggagaacaatcgtattttaaagcaagcaaaggttattatggagtaagtgattcaatcgagttttcctcgtttttcaagttctcttttatttttaaaaatttaaagcttggtgaaaaagtttcatttgaccaatgctacgatcctaggttgtcaattttattgatcaatattattctaggaattcctgttgtttatctttctagtggatctgtggcttattggacaataagtgtcgtaggcttttggactatatgtttggcaactgatccgccagtagatgttaaccctaatagggctacagactttcctcgcttgttatcggtggcgatggaaagattcttaccatcatgttgtgtattatttgtgttatggcatgtttctgcaaaacgcactttatctgatttacccttaaattctgataccaaagtatcttacgtgagtagagtcatattatggtatccactattttggcttggcgtacttaacaacatgacatttgataggttaccagtggacaggctaactataagtgatttgaaagagcaatcaggtgcaatattggctgttgggtcgataattcttaccattaccacatgtgcttttattcaagcgtataagatttggttatcaggaagattcaagaagtacttgtttgtttactcgttgttcattattggattggtgtttttggcacaactacctggattgactttacgtgtacatcactacatattagcaatgctattgattcctggatgtgcaactcgtggaagaactgctttaatgttccaaggaatattactaggactttttctttctggtgccgctaaatgggggttggcagctattgttgagacagcagactctttgcgacgtgatgaccctagaggaaatattattcctccgattttgactggatacaacgatactacaggtacgttggaatggaccaacataccaccacaactcgaactaacaaaaatcaagtcgaaattgtatgaaaaatacagctctatatcccttttggttaatgacattgaaagatttgtaggtgataaagcgaagcgcatcaatttaaaggagttgcttacaagttccgatgatttaactgaagagattaaacgggcattggttgacggtatgaaagatgaaaatggcgacatactgatatacttgagaattggtcgcaaaattccaaacacacatcattatagtgatttctccaacgcagctatattgaaatggccaagcggtcaattaaaattacctcttcctggaataacatag

SEQ ID NO: 909 - DNA, 861 bp, Candida albicans
ccacctacacacatttattttcgtttaataaccaaccctattcatatcaatacatctaatataaccatgtccagattattatcaactactttgcgttctcaattatctaaaagattggtagcttcagtttcaagaccatctaagactgttttggccactttgccaaaagccattgccaccacctcattacgttctttccataatactccaattactttcaatcaaactgctgaatctgatttgaaacaaattctcgacaaggaacttcaagttgtagaagctattcctaatgaattggatcaaagtcatgttgatttcttagaaacatcaggattcaaagttgtttctaaaccaggtaatgctaatgtcgaattggttaaaaaagatgaacaaggtcacatcattcatgtttattttgatgttgaagatgttactgatattccagctgaagaattggaattagaaggacaagaattagaggaagaagctgaatcattagatcaaattttcagtaatgttaaagtcttgattgaaaacccaactaaaaatgaggggttatttttcagtttaatgttacaagcttccgaatcagcatttttagttgattatgttaacactcaagctgatgttcaaaaattcatttctaaaattgataatgaaggtgaatttgctgataaattcaattatcaaggaccaaagttcggattgttggatgaatctttgcaagttgaatttgaaaactatttagtttctaaaggtattgatgaacaattggctgattttattataggctacagtgatgttaaagaggaaaccgaatacagaaattggttgaactctgttaacaagtttttcaaataa

SEQ ID NO: 910 - DNA, 1863 bp, Candida albicans
ttaacacttattaaatcaattggcactccagaaacccaacgcgacatcaaaaaagcattcagccatatgcaacatcagtttccgaataaatttgaaatgtattgtctatattttgaaatatgcgatgatgcagaagaagtggaaacagaagacgtgttaatgcgtttagtaacttctgttgatactgctgcatattttgaaaaaacagtcgacttgctaaaactaaatgtaaacaaatgctttcgaggggtcaacaaatgcatagattatttgcttgcacatattaattctaacccttcttttagtgatactttgataactaccaaattcgtagtcaacgttttgttgaacaccagcaaagattctgaagaaaccctaaaagagctacagctgttcttgcaatttgcagaaaaatcgctacaaaaacaattatcaggaactacaaaaacgagtattgttgcaattatatggtcacagggaataaagttttataaacaagctgagtatatcgaaagcttagaatggttaaagatagctttatcacgacttttctataccgattacaaggagaatcaagacagagggaaagttttgagggtcatccagaacaattactttctgcttggagaatacaatcaagttatttccacagcttcgcaaatggatcctgaagataaaaatgcaccgcttacccagtttaatttgttcagagccaacttaatgttaggaaatgaaaaattggcactagaatgtattgacaaaattctcagtaatgatgattcactaactgttttaactatcgctgtttgtatacttgaaagtaaaggtaaactacccttcgaggctatcaggtcaattttcttaaaattagttgagcatatatgtgagatggaattgacaaaagaaagcatatctaaacttgaatctcataatgttgttttaccaatctgctgtcggtgtgctgttgtgatgtaccttactgaacttgaaaacagtgggaatttgagtgaaagtactttacattctttgaaagaattgcttgaaaatagttgtgcaattgctaaaaaaatagcaccaacacaaattcacatatttacaattgatgacttggagtggctcgctagcaagtcatacaatatagccatgtcttgtcaaaatggagagttgaattcctttgttggtctattctacaaaatttgtattgcgtttattgatttgatttctccagatattgaagcagaaagaggagaacagttaatactctggaaagtaagagccactatttttggtattttaaacacttgtttggattgctccctaggagcgagtgagtggattgcaatcagagaaaaatgtcttgagttaaaaggcgttgtttataagcaaaacgatactgattctaattggaaagaatgcttgcaacaaataatcgtgattcacttccaagcggagttgtcactggggtccagtcaaagcttgcatgatatcgttcttgaatgtaaaggctttaaaccagcagtttgcaatgacatgtatgatttatttatccaattaatcacagattctgaaatacagatttctaatcaaaagagaaaacaattgataggtctggtaatcagtcaagcaatcaaaaacatagagccctctcaagttaaaaacataattacttggatgaggttgctcatggaagtttcagggcataattttagttccgaggaagaagttttgatgttacaactgtataaattgatcaaagcaaatagaaacgagataactattccaactttcgagatggaatggcttgcaacaaaatcatggaatcatggaatctatttgttgatgtatgtattttgcatttattag

SEQ ID NO: 911 - DNA, 1077 bp, Candida albicans
tcaaggaatcaacgaatcaaccactcaacaatgacacctccacaactgaaaaattttcatactgccaatcctgaatttgaacaagccattgatcgtagtattcccgaatttgctgcagcacaactttccgatgaagataaatatttcaaaaatcataaaccaccagtatatttaccggaaattgctgttgaagttcaagattttgtgaaatatcatcttgaacattcccataaaagaattgccttggtgacaagtggcggcaccactgttccattagaaaataataccgttagatttattgataattttagtgctggaactcgtggtgctacttcagcagaatattttttagaaaatggttatgcagtgatttttttacatcgagaattttcattattaccatattcaagacattttagtcattcaactaattgttttttagatttcatgacggaaaaagataacaaaatccaaattaatgatcaatttgctgatgaaatgttacaagtttggcgtaaatataatgaagctaaagataccaattcattattattaatccctttcacaacagttaatcaatatttatatactttaaaagaaattctggagaatttacacattatgaaatcaaaagcattattttatttagctgctgccgtgtcagattttttcatcccacaatcaagaatgcctcaacataaaatccaaagttcagctactcaagatggtgaattagtcattagattagctcaagtaccgaaatttttaagtcgattagtagaaaattgggctcaaggagcaatgattataagttttaaattagaaactgataataatattttaattcaaaaggcagaaagtgcattagaaagatatcatcatcaattggttattgggaatttattacaaactaggaaaaaagaagttgtatttgttacccctggtcatcatcaagaaaattggattagattgactgatcaagaaattaatgataatgtggaaattgaaagtaaaatgattccagcagtaattaaagtacatgatgattggattgccaaaaatgataataacaactaa

SEQ ID NO: 912 - DNA, 936 bp, Candida albicans
ccacataatcaacagtccacaaccacccccttaccccactcacccaggatgaagattcaaactgatgcagctaatgttttacaacgtgcatcagcacaattaaaatctggattattaaaagaaaaaccactatggtatgatataattgccaaatatccaccaacttcaactaatgatttaattaaaaaatctcatgtttatgaaggtaaatctgatccaagaaataattcaattatttataaatatccaaattcaaataataaaaacaataatgttttattcaagactcgtccactgaataaagaattaaagtcaaaaaatcataatattcataaattaccaaaattaaaatttattgaagattcattaagaaaaattttttatcaacaacatccatgggaattatctcgtcccaagaatttaattgataatggtaatggtaataataatgaaaaatgtgattggagtcatatgttacaattatataaaccattagatggtgaatcagtagtacaacgtacattatggttacttaagaataacactactaaaggtttaactatggtggaagcatatgataaagctagatttgaattttataaattaagaatgagtgaagaaatggaaagtcatgtagctaaagaagaaagtacaatgtatggaagtgtattcactagtactactgtgaattggaatttatctaaagaacaagaatatattaatgattggacaattattgctaaggaaagaactcaagttattgaagctaatatgaataaatcttcagctccaattggttctgttgttgaagaagaaaaatctcaatcttcgttatttgaagatttattactgaatgataatttacaatctgaaccggaagttgaacaatcaggacaacaacaacaagagcagcaaccaaaacaagaaacaaactaa

SEQ ID NO: 913 - DNA, 1104 bp, Candida albicans
ccatccacccaccaaccaaccaaccaaccaaccaacaaaatcatggcaagaaaattaaaggggaaatcaattcaagcaaaaggtttaaaaggagcacttatacgacatcaacatagtgaaaaaataacctccaaagttgtaaaaaatgttgaaatcacaaatcaaaataaaatggataaattaaaatccatgaaaacatcaaaacttgcccgaaaacataacaaagctcatcaaaaagaagggaaaagtacaacaaaggggttaatgccatttaataaagatggaaatgataaagtattattgattggagaaggagatttttcatttgctaaatctttaatattacaaaatttcattcaaccagaaaatttaattgctactagttttgattcatttgaacaattaattaataaatatgaaaatgtcaatgaaataattgaagaattgaaaaatatgggagtaattataatgcatgaaattgatggaacaaatttattaaaaagtttgaaattaaatcctaataaattaaaacgaaataaccaaaatagtgatgttggtaaagtgaaaaaattgaaattatttaaagattatggtaatgtgaattatataatgtttaattttcctcgtaatgggaaaggaataaaagatgttgatagaaatattcgtgatcatcaacgattaatgttactgtttttcgaaaattgtcaacaattatttgatgtgattaatactgatactatttctggatataacactttcaacagcaacaacaacaacaataataatgccagtggttcatcatcaacagggaaaatcattatttctatgtttgaaggtgaaccgtatcattcttggggtataaaaatattaggtaaaagtcaaggatggaaagtagaaagatctggtaagtttgattggtcaatgtttcctgaatatcatcatcgtagaactacaagtatgaaagatactacaaaaccagcaaatgaaagagatgctagaatgtatatatttgaaaaattcaccaaacaagatactgtaaaacaacgcaaacgtggtaatggtgatagtgatgatgatgatagtgatagtgataatgatgattag

SEQ ID NO: 914 - DNA, 1080 bp, Candida albicans
ttcaataaagtatttgtatctataattaataatcatgatttatctttaattgttggttggtttaatgaaaataaaaatttattaaataaaatcaattccaatttagaatttgaaattaattattgtaaattcttaacattaattgaaaaaggtgatatcaatgaagcaattaattattcacgagagaatttatctgggtatggaaataaagaaaattatcaacaaaccaataataataataacaatacttttagtaatggtgatacaaccagtaccaatcatttaaccaatttggaaagattaaaagggttaggaggattattagtattcagatcaatggaaaacaataacaaaaacaataatgatttaaattcaaatgatactccattgtcaagtaaattgatgcttaattcaactccatttaaggagtatcaaaaattattatcaaatgaaagatgggaaagtttagcccaatgttttattgaaaattttactaaactatatggaataagtaaaaatttccccatttatatttatctttctgctgggttatcaagtttaaaaacaaaatcatgttatcataatgttgaaaacaccattttcaaacattctactggtaatggtatagattacgacaacggcaatgacgactacgatgatgacgatgacgatgacgatgaaggaggagttatagatagcaatttgtcatttatatcagccgaaacaacaaccaacactaacaccagtagtaattctggtaaactgttattgaatgatccaaaatatcgtggcccaaatcattattataaacttttgaataaaataaataattgtccaatttgttcacctgaattattcaaattaagtcaaaatttgccttatgcacaattgattactagtatattcaacaatccatttaaattacctaatggtaacatatacccatttgataaattattggctccaacagataaatatttatcggaaaagaatactttattaagagcaaataaagttaaagatcctttaacaagagaaatatttacaatagatagttgtataagagttttcccagcctaa

SEQ ID NO: 915 - DNA, 1497 bp, Candida albicans
agacatatacaatatactcctcagtttcacctagaaaacttgccccaaaatacaggacaatttcaattaaaccaacaatttataaattctccacattttttggcagagcctgtcagaaacgtaccaaactttacatttcctgccacgactcccacaatttctaaaactgaaaaggtaattaatttcaattcaccaatgatggataagaagattatgaaaaatgggccaggcaaactgcaatacaagaaacaaacctctaaagttaagaagaatgataataaactgttcaaggttacctcgaaaccaaaaaccaagaagccaaaacgcaaccattctttgataccaaataattcaataaacttccctatccaaatagtatcacctaatgatattttatctgttgaaaacaacagctttcttaacacagttatatatccaaatattgaaatcaaaaagtattcaacgtctgctattgatcctcagagaaattatttgacggcatacgaatatcctttgaacaatcattgggtcatttgggattacgagacaggctgggtacatttaacaggtatttggaaagcatcattgaccatagatggatcaaatgttagcccttctcacttaaaagcagatatcgtccaattgttggaatcaacaccaaaagagtacaagcaatactttaaccggataaggggttggatcttaaaaattcaaggaacctggttaccatacaagttgtgtaagattcttgctaaaacgttctgttattatttgaggtacagcttaattcctatatttgggactgactttcctgattcttgtttaaaaccaaatgaaaaaggatatggcgaattaaagttggacgatttggatagttttgaaaaaagagacttgcctgcaccaataccaccagtatcacctccaattgaacaaatggtgcaacagccccaacaacaacaccaccaattcaaacaaaatgataaggcagctgctatttcttcatttcagcaaatgggctctttattacctttgccacagaactatgataattcagctgcagcaatgaactcggaaaactgtcttacatccaatactcctgaaacaccaattgttcatcacttttctgatacagccagtaccagaagcacgtcatcatcatcgtcgtcgtcatcattatcgattatgtcgggaggaaggacagcttcaaatgcgtctgaaagagagtcattggaaattccgtcattcaatgaaatgattgatattgtgaatgcttcaaaatgcttgcaaacattgagtcagaaagcacagagtcctcgtagtgtacccatggatcaaccaaatagtgctcaacaattgtccaaaaatcaagatataggaatatcagcaatcttagtggcagctggtataaactccactctgaatcaaagcagcaatatttctgggctgtctcaacctatcaataaggggtctatgccaattagtgatatgttaacatga

SEQ ID NO: 916 - DNA, 945 bp, Candida albicans
ctaatattaatcatgagtccagtagagaaacctgtggaggtagaaaaaccaaaagtacccaaacgaagatttgtgggaaagaaacctcaaaacattaccatcaaagatggtgaacaaccattaactaaaactatcaatccagcaagacatatcggtagagttatgaatcaaatcccagatgatattttgaacgataaggaattaaatgaagctatcaaattattaccatcgaactataattttgaaatccacaaaacgatttggaatataaggaaaacgaattgtaaaagggtagcgttacaaatgcctgaagggttattgatttactctttgattatttctgatatattagaacaattttgtcaagtggaaacaatagtcatgggtgatgtgtcgtatggagcttgttgtatagatgattataccgcaaggtcattggattgtgatttcattgtacattatgcccattcctgtttggtacccatcgacatcacatccattaaagtgttgtacgtgtttgtcactataaatatcgatgaaactcatttgataaataccattaaattgaattttgaaagagggacacaaatagctatttttggtactattcaattcaaccctactattcacagtgtgaaggcaaaattggaaaatgataccgaaaaaccaatgtatttaattccaccacaaacaagaccattatctaaaggggaagttttgggttgtacatcggccagattggacaaagaacatataaaagcaatgatttatataggtgatgggagatttcatttagaaagttcaatgattcataatcctgaaataccagcttatcgatatgatccatattcgagaaaattcacccgtgaatactacgatcataagcaaatgatcgatgttagaaaagatgctatctcaacgacgaaatatgccacgaaagtatga

SEQ ID NO: 917 - DNA, 279 bp, Candida albicans
ctaatactaggcgctttgggaagacaaggaaatcctataacattggataaattagaaaaatcattgtctgaaaaaggtatacaagtggtgaaaatcattttgagtgaaatattgcctcaaaaattggccatgtttgatgatgtggatgcttttgtccaaatcgcttgtcctaggttatcgattgattggggctacgccttcaataaacctttattgactccttatgaaccaatggtaatgttagagaaagatacaatgggtgatcaaaaaatttatcct

SEQ ID NO: 918 - DNA, 1593 bp, Candida albicans
tttcttgaaatccagtttacattcatttcctacgagtatccacctattatttcttccactacaatgattaccccatttttcacaatatcacaagatgatgaatttatttatattgatgtgaaaatatctcacattaggttcagtgcaccaaatattgaaatgacggtggaaaatgaattgtttgtattttccttacctccatactatttacgtttaaggtttccgtacccttgtattgaagatgatagatcacacgcagaatatgattccaaaactgaatgtgtgaaaataaaaatccctaaagaaacaaaaggtcaatttttccctgatttagacttgacagcaaaattgttggctagaaccaatgaaccaaaagtgggtgatataggacaagccaattcatcgaaaccattgattgaagagttagatgtcgacaacactaacccaggtgctcaagcagaaagggatttggcagaacgtgaacaattcaattgggaggttaaacaagatgtgccaaccaatccggatttaacatctacagctactgacaattctgacgttaatttgaaaccaataaagtatggatttaataaccaatatgataatattgtcggcgtatcagttgctaatggtaacgatattaatgaattagctgacccagagaatacacccgaaaatgctcgtataattgaaagactaattaaagagaatataaaatttgatcctgaaatgtatgctgccgattacataatgaaagtacatccagaacaagacgacgaaaacaaaaattttaaggaattaattgattggaaaaatccattaattcagaaattcctaaaatggtataaagcagacaagcaattacccgaagctgaaagaacatcaattatgccagtcgaattttcaaaagaggaacaagaaaaaatgatgaatttaccaaggaaatcatatttgaaagatgatagtgataaaccagagattttgcttactacaatatgtttattgtttgcttatcattttgatttgagggaaaatgaaggtgatcataatattgaaagtgcttggacaattggtaaaatagttcctcaattttcatttcttgactccaaaattgtgattgaaaataactataatgttttgagagcggccataataacatgcatcagacgtgcactaacttatccctaccacagaaattttgacatgataactaaagtatgggatgatgtgtattataatttgcgcggtgggaaacgacttgtcctcaaagcgttattggacttgaaggaattattccgttttcacgacatttactatgtttacgataagatatggttagaagatttgtgtgcatatttgataagcgataatgtttctgaagcaacaatcagaaatctcgcccatgatatacaaaaagaggtgtcaagcattaagaaagcagatatcacctttgaaaaagctaacctagagagtgctgaaactgttgatgataatgaaggcaacggcgaagacagcgaattgattgcgttaagtttaccagaaatagaggtcatggctgaagagatgttccaacaagttcaatcacaacaataa

SEQ ID NO: 919 - DNA, 870 bp, Candida albicans
atattcatttgtcttatacattataaactattgactaccattttgaatatggcacttttccagaatttcaatactcattccttgagatctactcgtgggtttaaattaaaacaatcatctccgatatctagtcctcaaccgataggcaactcggttctaccacaaactcccttcgacaacagtcaacgtcctcatcttgaccaaacagagcaaaacccgtatcaaactataaattttaataatggtaatggccaacctgtgtcatctcacaaagatattcgaaactatgcagaacaaactttgggatcagataacgccttgatccaagcggttaagttaccacgagacgaagacgtaaatgagtggctagctatacatgtggtggatttttataatcaaataaatatgctttacggtgccataactgaattttgttcaccagctacgtgtccacgaatgatcgctaccgaagaatatgaatacttatggcaagagtctgctcctacaaaccaggatggaactgttcaatctccgaaaagaccagtatcattacctgcttgtgagtatatcgaaaacttgatgaattgggtgcagaactttttcgataacgataacatattcccaactaaaatcggtgcaccattcccacatcaatttcctacattagtgaaaactatattcaagagattgtttagaatttatgcacatatatattgccatcatttccatgaagtaagcgagttggggttgcaaagtcatttgaacaccagtttgaagcactacgtgttgtttgccaacgaatttcaattaattagcaggaaagactacggtccattagaggacttggtagacacgatgcttcaaagataa

SEQ ID NO: 920 - DNA, 2238 bp, Candida albicans
tacagacaatctcaaaccatgacagtatcatttaattatcaaaataatgaaattgtttcctcacccacagtcattgttagtggctctacatcaacaagattatatcgtggagtagtttcatttacgaacaatcagaataaagtatttcctccccaatatttcgaagtcaataatggtcatttcaaagcaataattcatgtttcaccaggggaaagaaatattttccaagttgatatactggataatggatatataaacgattttggatttgtcgaatatggtaatggccgtggtcccaacatcgttgattcagggtctttaacattatctttcaatccattaccccaaaataaacctatccatttatgtttaattcgaggcagggattccaataatacttatgatatgcctaaatatagactacaacgaggtgaagtacctaatttagaaaacgcaattaaaaaattaaaagttgctggtcgattaatgcaagcttacacacaagatgaaatgagatcagcaggatttagtaatcgatgtttccaatttgttgaagaaacaattcatgatcaaacgatatttggttataaagtcaattctcctactccacatcaagaaattaagatccatgttcttacgtctccgaaaactgtagcagaattgagaagtccagaattagcacaacaaaacccaaatgctaaagattcaggggggctattagatcatgctatagatttagtgaaaaattgtccagaaatttacaatcaacgaaatggtactgccgttcaatgtgcatgtatgtatttggattcaacatggcaaaataatttaattttgactcatgctgctttaggtggtggtacaaatgaagtgaaaatggcgatatttggatctcatggattacattcatatcctcaaaatttcccgttggtaacaccatcatttttagatgctacccatttgacaacaacagaagttgccaatgattgtaatgaatgtggaactagttgggaatgtttaaatatttgtcttggtgcctttttacacgaaattggccattcattagggtgtcctcatcaagttgatggagttatgttacgtgattatgtgatgttgaatagatcattcatgactagagaaaatgaatgtttaagaacgaaatcacgaggacaaataattgccaataatggaacttggcctaaagtttgtcattggaatagactagatttagttagattcttgcatcatgattcgttttcgttaccgattgatagatttgggaaaacttatagtacgacatggaaccctgataatagttaccaagataattcggcacctagtctgtatgcaatgcctctgaatgaatcacttgtgaaatcttcagccgggattttcttgatagaagtaattactgatgatcttgcaagatatcacattgaatttttacctaaagaatatagaggtcctggattacaacatgcactggatttggaatttaataatttatataatgcattacgatctcggaaaaatgatgccaaagatggatttaaattacgtatattatcacttggaggtgacttgaatattgacaatttcaaagaccattgttccaaacaactgaaacaagtcattcaaagtgattttggattgaatagaggacatttacaaggatttaaatcagccactttgggacgtactgatgatcttaaaatggaatttgttggttttgatataaagacaatttataaagtccgggtttatcatggaagtgctttagatggtataaaattttattacaagtcaggaacaggaacagcaggaagatcaagtaatggcggcggcggtgctcccaaaatcccgaaaagagattatttgtcaaagatgtttcgtagtaaacttaatatttcaaatcaaagccatcataaacaatcaccacaacaattaacaaatggttcaggtggagagaaacgtactgctttagttgggaaagaaactgggaattactcggaattcattttcaatccaaatgaatatataacatttttcaatttccgtgatggtgcttggatggatgcagtacaattcggaactaatcaaggaagaatctcaccaatgtttggtaatgctgatggaggacatttatctacactcgatgcgccaaatgatgattttgaaattgttggcatgtatttttatttaaaccaaatcttgccaaaggggctggaaaatccgcgt

SEQ ID NO: 921 - DNA, 2328 bp, Candida albicans
atcaattgttcaaacatgtctggtagaagaagagcatatccacaacctcagtatgcaacaggaccagctgaaatggctacaccaccagctcctaatcagttccaacaacaacaacccgtacaacaaccagtgcaacaatatggagttgaccaaatgcaaggccaatttcagcaaatgaatgttggtggagtgggaccaacaggagttccaccaactccacaatacccatatcaacaacctgggcagcctcaacaatcgccccaactcagttatgatccatatcaaccccaacctcaagcaaatactggtgtgtacggacaaggcatgggcggtgttccaccatcagcagtgcctgctggcggagctggatatggcggatatggtcaacaaaacaacatcggtttaggtgctcaattgaatgctttgtataccactgacttatcaagggaccttccaccaccaattgccgaattgtccttccaaccaccaccaataacattaccagataatgcaactttgattccagcatctaagactgctaatgcaactcctgagtatttcagatcaactttgaatgtggtaccaaccaattcatcgctcttgaagaaatcaaagttaccattggctattgttgttaatccttacaacgctttgaaaattgaaaacgaaaatgtaccagtcacctgtgatactgtcattagcagatgtcgtcgttgtcgtggttacatcaacccatttgttactttggctgagaatggcagacgttggagatgtaacttttgtaatttgttgaacgacattccaagcgcttttgactatgacgaaatcagtggccaagtcaaaaacaagtttgacagagttgaattgaaccattcagttgtcgaatttattgctccaaaagagtacatggcaagagccccacaaccaattgtttacacatttattattgatgtttctgtacacgctattcaaagtggtttaaccggtaccataaccagaactatcttggaaagtttagatagaattcctaacgaaaataaaacagctagagtttcattcatcggtgttgactccaacttacattatatccgtttcaacgaaggattagaaggtaccgagattttggttgttgctgatatagatgagccattcttgccatctccaggtgggttgttggtcaatttggatgagaatagagaagcgattgaaaaattattgttagactttccttcttattttgaaaacaatgctaaccaaggttttgctttgggaccagctttgaaagcaggtcataaaatgataagcaacattgggggtaaattagtatgttttgctgccactttaccaaatattggtgaaggtaagttgagtgtaagagacgaagctagcgttgcaggtaaagctaaagaagccaaggctttattagctccagctgatagtttttacaagtcttttgccgtcacatgcaattcttcacaggttacagttgatttgtttttgacctcttcggcataccaggatgttgccactttgtcaaacttggcaagatatactgcagggcaaacccatttctacccagcatggactagcaacaaatacgaggacgttgccaagttatctaaagaagttagcgatcatttgtcacaagatattgcccttgaagctgtgttaagagtcagaggttccactggattcagaatgtcttcattttatggaaacttttttaaccgttcttctgatttgtgttcattcccaactttcccaagagatcaatcttaccttattgaaatgtcgattgaagaaacaattaacaaacctgtggtttacttccaagccgccgttttgcactccacatgttttggagagagaagaattagggttatgaacttggctttgccaacatcatccaagttggtagatatttatgcctctgccgatcagttggcaatcgcaaattatttcactcacaaggctatcgaaaaagcattgtccagttcattgccagaagctagagaatacttaattgccagagtcgtagacatattgaacgtttacagaaaagaattagttgccggaaacgtttctggtgcttcaccattgcaaatttcgactaatttgagaatgttgccattacttttgttctgtttgaccaagcatttggctttcagaggcgagagagtgccttcagaccacagagcagcagctttaaacaatttgggatcatctccaattcctcaattaatcaaatccatctatccaactgtatattctttgcataacatgcctgatacctgtcttcaccacgccctgaagatccgaattgcgcgc

SEQ ID NO: 922 - DNA, 741 bp, Candida albicans
tgttttctattattgaaaaaattccaatcaataaaagaaagtaatcaactccaatcttcatcagactcagggttaagattgatattatcggattttaattatgatgtacttcgattagtcaccgtacccaatttattaattcattgggcttcaactatatcaattgaacaattacacgaattaacatcaacgacaaatgatgatggtggtggtggtgataaaattgagtcaagatttgttaatgatgaaatcttaattacgacaaaattaattgatcaatttaaaaatgatcttaataattataatattgaattacaatttatatcaggatcatggggtaatgaatttattaatttaccggctattaaagataaagatactaatggtattgatattgatgttataataagttcagaaacaatttattcacttgatactttacctattgttgctgaatctataaaaactattttccaacaatctagtagtaagagcattgctactagtaagaataataataataataataataataaattagctattattgctgctaagaatatatattttggagttggtggttcattaattgaatttttaaattattttaatcaaatcaccaagaatgataatgatgaccaccaaggccaagggtttaatgtttctgtggaagaaatcaatgattctcaattgaaaagatcattagtttatatagattatagaggaggttattcatcatag

SEQ ID NO: 923 - DNA, 3399 bp, Candida albicans
atgattcacgaaagagttccattagtgatatctcaagccaaaaattttcaagggaaagttccccttaatgtttcacgggaaagcagcaggcggagttcaataataaaaattgatcatcatactaatgtggacgtgtcaacgaaaccggaaaatataaatagcagagataacaaaactgagaagaatatgactttgagttcagggtcaaccaaaccgagtgtcgaagaagttagtaaatctttgaaaccaacaattaccaagaaaacttcattcactgattacttaaaatctgccaaaactaaagctaaagaagaaaaggtaacaatcgaaaaaagtgacaaaacgattaattcagaagaacgaaaaacggaaccaattcaacaaagcgagcaacttttaacggacaaaaaggataataaagtggaacccaatagtgaagtaaacttgaaagacaatactgatgacatgaaagctacagctggctgtgccctaggacctgataagaatactggaaaaaacgattcagataaatcagaaacgactcaaccaaaacttgcccgctcagaatcatttgccgatacatcattattgtctccagttaatgaaagtgatactgatttcaatttcaatgagttagcagagataccggaagcaaaggatggttcagttgtggcagcaaatgtgctggagaacattgatgagaatgaaaatatttcggaagctgaaactgttatagcagatgaccttccacgtctcgatgaaggaaagaaacttttacgtgaacaaacagcagatgtaaagagacacaaattgaagaaaacaaaattgaatactatttttagttccgatgaagaggaggaggagattcaagaaccagatttcaaactccaagaaccagaaaaactaccagaagatgaccaacatcctgattttcaaaattcaaaagcaacaacagaaatcagtaacgataaaacagaagtaaacaagccagaagtgaaagaggttggcgagaaagagagaaatcaccaactagaagatagattaccaattaaaaaagagaaaatgcggtcggagaatgcaaagacatctgaaaacggtgtcagttcaaaatcagaatctaagatttcaaagtcgaagaaactaccttacaaagttaaacgtgattcaagtggtcgatcattattacaacgagcttgcaagaagggtaattttgcagatgtccaagattacatagagaggggtgctagtgccaatgaaaaggatttctgtggattcacatgcttgcatgaggcagcattggaaggtcatacacaaattgtgaaatatctcatcgaaaatggtgctaatgtaaatgcgaaagctgatgaagctggtgattccgagacaccattgatcgatgcagctgaaaacaaacatcttgattgtgttaaagtgttactagaaaatgatgctgatcctactattttcaatattgatggattcaccgctttaactaagatttataatgaacatgaaggagaagaaggatatgatgaaattattcaagttctagaagaagcaactgcaaactataacagtcgtttaccaagagaagttcagtttgtatcagatgctcctattggtagtggaccaatcatggaggatccaaatgacaactattttgcagagctaattaaaggtaagggaatatataaatacgctgcagagaattcaaaagagaaaacagcagaatattttgttgctggtcataatttagaaggaaaaccagatattttaattttagctgctagaaacggccacacagaacttgttgatattatactagggctaaaccctacaccttttaatattgataccgagtcaagttgtggtgttactgcattattggccagtattggacgcggtcattttgaagttgtcgattccttgttgtccaaaggtgctgatccattcaagacaagaaaaaaagatgggttgaatgctttagaaattgcacaacactcgccacattttgattcacgggaagttagtgtaataatgaaattcatggagaagaagagtggaaccaaaattttgtctggtattccgtcaagggtagtatctcgtgcaacatctcgtgcaccttctgttcccgtatcatcagacgaagatgacgtagtggaagaaaaagaaattacagcacacacagaaaataaaagtgctgaaaagaagctggaggataaaatcacgaaaacagttaatgagcatgtcagcaatcggaaaccccacgagtctacaggtcgaaaacttgaaaagactcatagcaatgaggaaagaaagcggaaacgtgaatggtcagacgatgaacctaaagaaccacatcttttgaagaagtcaaagtctgatttgaaattgaaatcactacatagagaattcacttctgatgatcaccacaccagtgaaagccattcagattcttttgcagaaaaaagaaaacatttatcggcaacgccacctgctcctccgccaccaccaccaccttctcaagcagttatcaaggcacaagaagaacaaaaaatcaaagatgctgaagaagctagattgtggcaagaaaaggtcgaagctaaaaagagggctcgaagagaaatgtttttaaagtccgagaaagaaaaagagcagaaacggaaagaagaagaagaattgcgagcacaagaagaaaaacgaattgccaaagcaaaacaggaagaacaggagagacttgctagagaagcagaagagaaatcgaaagaactagaagaaaagaaagtggggttgcgacaacagttgacattagatcattatccgattggattgcgttattgcaagtttgatggaaacccaaatatctcggctgttgataaatttttgcctttctatgtatttgtaatcgacgataaaaagtatgctgttgatttgcaagtctccttgatcacgtcaacggttgtcagcaaggttatcaatactgtacaacctcatcagaagagagaaataaatgcaactgaaaaaagcaaattgtggaagctctttttcaagtttattggtattgatcctaggaatccaaattgtgatcaaagaagctcaataacaaatggtcaaaaacagtttcaaaatttgttgcttcattttgtggaggtagatttagctgaagaatttttaaaggaatttccagaagtacactcaaaagcaaaagataaccaaattgatgttagtttagagtctttgagtgggttttctgattgcgtcaaggatgatataatagttgatggaaatcttgaaattgatattgattccaagaaaatcgaaaagtttattcctcctcatttgaatactaggaaagacattattaggactgtcagtactttagcacacccactatggtga

SEQ ID NO: 924 - DNA, 1035 bp, Candida albicans
tacttaagcgcggatccgtccagtcccgtggggaatattatattgttgttaaagattttagatagtcaatatgggtcaggatttaataatgaaagcaattctttattttcattgggttcaagtaaatctcaatcttcatttgggtttcatttcaactacgatcctacaccccaaactactaaagaagttcacatacaattgtttgccactgttattgaagccattccatggggaattgtaggagcatctggcgataacaatcagaatttgattccttttaaacaagttgttgatatattgattagaggggcaatccatccagattcacgtatctcaatggcctccatcaaatcattgaagtatttggcttctaaaaagaaccccacttccttgatgactatttatgccaagcttgcgttccatttttctgacaaaacaggcccaacttatgatacacaatatttatactcagaccaattcaccaaattattaaagttgtacaccgaattattagattgctggttgattctgttccaagatttacttgaaaagaaaaaagcagaccagtccataggtgtgttagcaggaaatgacaaactgaataacagagatgctttaaacaacttgtataagatcaatcgaaaaaatgccgatttatcagattctcaccccacaagattaaaccctagcgatgaatttgaatggaaaacaataatcactgccatcgaagatatcgaaggaaacgggttgtttttcctttgctctcaaaatccaaaaacgagatattatgggattaaagttcttaagttggttgaacagtttgatcaagcagtttataatgtaactgattcagctactgatactagttcgggaacgaagcaacattctagaagctcgtcaaaatttgctgccgacgttgggacaagacttattcatattttggaagatcttgattttgttgaattgatacaaccttaccgcaaagagctaagcgttccagaacgttcttcaccacgggctgccgatccgactggc

SEQ ID NO: 925 - DNA, 3318 bp, Candida albicans
atgccagtagcaatgtgtcgtaatcttgtttgtgtttgtttggttcaaatgcatgagtttgtgttggagttttctgatagctataaatcatacacatcgtcattattttccaagtctgccacaaacgtgcctcctgaggtgttggtcaatcaatggaaattatatctcatatttgcttgctccacattaactgctacgaatgatcagaagatatcatttcccaatcagccgacccacgggcgtaaaaagtctttgcagatgtttattcaacatcaaaaaattaccagtgcaaaatcggtatttaaaatggtattacccttattaaagctgtcacaaccaatggtaaaagaatctgtcatagtggggttgagtcacataaatatcaatattttgaaaagctttttggagaatatcccattggcagtagaggaatggaacaccaatatcaaaacccgcaatcctcaagatgatgcgttcagaattgaagtggttcatatattaaccaatttgacggagaagtttggtctgcacgaattgatatatactgatgattcgattgtggccaacttagtagccattgttaaaaatgtgaagaattttttgtctgaaccagcaatacagactaattttgagtgccaaagattgcgtcgttacttttgtggattcttagaaaatgtctatactggacttgaagcaaaatcagacttggaaaaatggctaccatttgaagcgagagtagcttgttttaattatctcaaggaatggtgtggatatggtgatagcagtgctgttactgaggaacgatataacgctataatcagtagaattaaaaccgaaaaggctgggccatcggcacttgccatacttgaaattgaacggaaaaaattacaattagcatcattaaaatgtatggcaattttatgttcgggtcaaatcaaaaagaaaatagaaataccaggaaacttggcagttgtctcatttgacattccaggtttgatgaattggattcaagcgttattagaatcgaacgttgaaaaaataaaggaaattggtcattgcgcttcaaggaatgttattgagaaaaattttgaatttcaagacattattagcgctgttgttcaaagatgctatgttagtcaaacttctttggaaagttacttttgcttatttgttgagatatttatggagaaaaacacttttgaaatagtttcagatgaacttgtctgtttggcttcagtattgacagcaaatgagagtttccaagtgagaaaatccgcaattgctttactcaagtatttcgaaaagaagagtcttgggtctgaatcattagaacgatacactgaagccatttgcagtaagagttcagttgtgtacaaaaaagttttatttgatctttcgaacgatgtccaaaatataaaaccagaaagtttgtacaatagaatcagttacttgacgcagaatattaatttgatatttcctgctgcaagagaagctattttgtcattattagtgcccatggtttcaaaggttacattaaactacgagacccctttacctgaaaaggacagtaccacagacatccatgaaaaagcatttgatagctcgtcattaatggtgttgagcaatctttttgaaattacggtaaattttggatctagtatgtccaatcaggtagaagtattgtggatatccttgagcaacaatgttcaaaatattgacaaaattgtggaattcttattacaaagtagtcttgaactgaaaaatccatcatttgttgagcagtcaagacaaatcattgattatttggcgtttgcaagatctgacccagcctatattattgataaattaattaacaatttgcaacctagaatgatggttccacctcaactaggcaataaatcaacagctcctatcagtaaagattatccctatgtatgcgatatcaaaagaattattcaaacaaatgaaaaggatgtcatattttcattaggccaattaagcatggtatttttggttgatatagtaacactcaaaaatgatttaatgatagagaaactccctttgttattgcatgtgtcactttccttgatggatcactatttgccaattgttcaagaacaggcaggaacttttttagtccatttaattcatgcattagttcgtgatgacccaaaggcacaagaaacaattctgtcacttcgagaaaacgatcatatcacacatttatgggtatatgacgatttaaacaacgacaaaaagggtgttagaacaccaaaaaatatggatttgttgataagaagtgctataaaaatgtttgctgccgttgctccaaatatacaagatgattggagtagagtgtcattgcattgggctactacttgtgctgttagacatattgcttgtagatcatttcaagtattccgatcattattgtcgtttttggaccagtcaatgttgaaagatatgttacatcgtttgtccaacaccatatccgatgaaactgttgatattcagggatttgcaatgcaaatattgatgactttaaacgctataacagctgaacttgactcagaaaagttgattgattttcctcagttgttttggtgtagtgttgcatgtctcagtaccatccacgaacaagaattcattgaagttttgtcgactttgaacaaattcatttccaagatcgatttggatgcagccgataccgttgcttgtttgacaaaaacatttccacaaaagtgggaaggtaaatttgagggtttgcaacaggttattttggtggggttgcgttcatcaacttcttgggaaccaacgttgaaattccttgataaattgattgttcataaggacagtttgattattggaatgggtgactccagagtattgactgcattattggcaaatatgcctcggtttttacatcatttgagtgaagagaatgtgacaccagaaattgaaaacacgggtatggctttaagccagttggcagaggatagtggtaaatcgtcactagcaaaacttttggtttcatttgataaaagacggtttagatccaagtctgattttcttgatcaatctatttcgtgtatcaagaatgcatttttcccagagtatcaggcacaaacattggtattgcttttagggttgttgttcaataaaatgccttgggtgaaaacagaaacattaggccttttgcaactgattttcccattagttgatcttcaaagagatgaatttattggtgttggagctgacttgatatccccattattgaggttgttgctcagttcttcaccacggggctggaaggatccg

SEQ ID NO: 926 - DNA, 1830 bp, Candida albicans
aataattattccgcttccaataaggttacaccagaagagaaccacagggaggtggaagttaacaccaccaccacaataacaacacgaacagttcacatttcaaccacaacagtccatccactcaccactgatagagggggatgttattttcaacaccaacaaaaccaattacatcagtatatgcaacaacaacaacacaatacattaaccccagagctgcgtaccatctcagactttaccaaagatcaattgccgccatcggcaatttattttcaaaactcgaccattggctcggatatactaggtgaaacaattgcattatacaacagtctggcgaatagcagtaatatacacaagtctcaaccacaactacctcaagaatcatcggaccatttgacgcagaaagagacatcaacagtatctgcatcaccacatccaatgttagatcaagcaccacaaatgatagacgctcgattagagagaatagagcatgaagtagacaacttcaatgaaagggaaaacaactaccaacatccacaaatgcaaccatattcacaagatacagaatcaggattgtctctcggtaccgaagattcccaaaatatcagctcacaaaaagtggactatgttcaaacaaaaaattcctctttggaatttgatgcaccaataggactagtgtacatgcctgataatttggatgaacacaaaacatcatttaaattgcaacagccccccattgttacagattaccgtgacacaacaacaacaacaccagatttggccagcgaatccaatgatcaacttggccaactcgaaactccacttatggctggatttgatttcaacttgggaacaaatacttctctggcaaatcaattatcatcacccatgtcctcattcccacttcacaatcgcgtggagccatcaccgcaattaccccctccaatgtcttctgcgtctttacaaaaactcactttacgaaatggtgaagaatttggatctattagacgtgatttagcaactgattctaaaacttctgcggagtacacattgcacattattttcactcagtttgttcgtcatgccgaacgtaaactaaatttatgtcttgattatccattaaatgaggaaccacccattttagacttgattgcagaaggggtggatactgaatttgacaaaatcatttctgccttggggtacattgctcgaagaaaacccaaaccagttatcgatagtgtaatgttttggagaaaatccaaaagtgaagttgcttccatggcagcaacagaagtcgaaaaagctgtgggtgtggctcaaacgaatttacttagaatttccaaaacatcttcagcaacagcaactacaaccacatctccgattagcccatcaaacccaggaatagctaaaaatagcaacacggcttccactgccaagcgaagtttaagtttgatgagaaagaagagtttttcaagaatagcccatcgtcgaaatgtttcttcttcagcagcaattcagtcatcacagaacgtacctgaatcagaaagtgtattcatgaaacaaaaacaattctacgatgaccaaatttctcaagcaaaagaaactgctgtccacgctgatagaaaatcattagcatcaatttatatattatgtcgtgttttgattgaaattgtgaaacaaacaccattatcagtgatgggaagtgatctcagtagtaaattagaggaaatagtttacactcagttaaagactaccgatcctatcagtacaagtcagtcattggtacgtgctgcaaattggaatttgtttgccgaactattaggatttatg

SEQ ID NO: 927 - DNA, 1308 bp, Candida albicans
ttaaagccaaaaatacttcgggataataatgaagatagtagtcatggtgagaaaactaaattgatcaatttaatgatgactgatcgatctattgaattagatattgattatcatcaattgataaatataaatactggacataaagggtattatcgtgtattatatgatcaactagacgttggcaacttgtcattaatggatccaaaagatattatcacaataatttctgatttagggacagttataggcacccctaattccaatagtcaagatttgattaattttattattttaatgagcaatttattaaaattggaaacccaatttaattgggaaatatgggaatgtgctttaagttatttagaaccaattattgatattttacgtcattttagtgaatttaataaatttaatactaattggttaaataagtttgttagtgatttatttaatgcaattaaatgggataataataattctttggataatatttcaaagaatcattataatagtttagaatggaaagttagatcatctattttacaattacaattgaatatcaacaataacaacaacaataacaataacaacaacaacaacaatggtaatcatactactggtgatgcggcatataaagtggcccataagtattatcaaaattttatgaattcaggtattaataagaaatttacacccaaagaattgttaccagcaatatttaacgtcaccatgaacaaaacttcgatgaaagaatataaaaaagtattagaattagttaaaaatgccaatgtatcgcttttgaaacaaacaaatgctactcaacaagatttacaaacattaagtttgacaagcttatcatttgtttatgggaataatagtggtagtgctgccgattttgaattggttaataaaacattaaattttgtgaacaataatatagattcaaaattaatagaattaggattaattggattcacattcacgaataatcaacaaattattgatacggttttccattggtttaaattaaattatgataattggatcatgagatctttacgtaaaggaagtgattggtccaaacaaattggtattactatacaaaatattatgaaaatgattattatgaaaatgatggttaataatgaaatgaataaattgaaattaaatgaatttattcaattaaaattaaaaaatttaccaaatcatggattaaaagaattggttgatgattggtatttagaaaataaagaaaatattagaattggtactttttataatgatttatgtgatcatatttgccaatag

SEQ ID NO: 928 - DNA, 1785 bp, Candida albicans
caatcgcggaccttccagcccgtggtcgaaaacattcgggggaaagtcatgtctgatccattgataccattgagtatttccaatgaatatattccaattgaatatcattataaattagatatcaatcatcagaaaccaaactttaatggtgttgcaataattaccattgacaaaaatcaccatcaacaaataagccataaatacaaacaatctgaaaaagaaaaacaagaaaaagaagaaaaagaagaagaaaaagaagaagaagaaaaagaagaagaagaaaaagaagaagaagaagaactgtcttttagtatcacattacatgccaataaattggtaattattagtgccaccattggtgatgaaaaattatcaatcaaatatgataaattgcaacaaagagtgacatttctgagtagtacacaaacatattctcaattagtcactaacaattgtttagttatggaagttaaatatatgggacaaattaaaaccatcaatacttataaagatgaaactcaagggttgtttaaaacaaattttttggataatgatagtgggaaatccgacaactatatacttacaactcatttccaaccaatgggtgctaaacaagttttccctattattgatgaattaactcataaaccgatgataaaattagatttgaaaactttgaaaaaatttcaagtattctgtaatggtgatgaagaggatgttgtgtccaatgatgatgagtggaaaataagtaaatttgtttactcaaaacctatacatcctgctataatgggatttctgattggtgattttacttggcaactgagtaaaactgtcaagacaaataatgttgaagattcggttcgagtatatgcaccatcaggagaaatatcaaaaactaatatggcattaagaatcattgaaaactatttacccaaattagaagcagtgtttggaaaatatccattaaatcatttatattttgttgccgttccatttttaaaagatggagtaatggaaaattggtcaatgattaatgtaatcgctcctaatttgttgataaatgatggaaattatcaatccaactacaacaacaacaacaacaacaacaacaacaatcaatctgaaacttatcaattaactgaattgattgttcatgaattggttcatcaatggattgggaattgggtttcatttgataattggggttgtttatggtttaatgaagcatttgctacttgggcagcacggaagattatcggcacagatactaccacgtcccgtagcagcaacaacaacaatatgttagctattgattgtttttatgatgatggtgatggtgattttaaaataggtagtattttccagtatatggaacgtcatcaaaatcctaatttaaatgctactactgaatcgatattcagtactaatatttatgaaaaaggtattattcttttagatatgattgatgggatttttgaagctgaagggaaaaatttccttaaacaatttgccaataaaataattgaaaaatatcaatcaaaaacaattaaaatctttgatatttggcaaaatttaaatgatgatattctgattgatttaccaagttttgtttattcttggacaagaagtaaaggatatccattattaagagtcactcataaacagaacgacaatgattcattggcaaaaaaaattgttattgaacaacatacttatttccataatataaccactgaaaaagctggcattgaagaaattctttatcatattccattaattaattaa

SEQ ID NO: 929 - DNA, 1017 bp, Candida albicans
  unsure (952),(988): Identity of nucleotide sequences at the above locations are unknown.
aactgtaaattatttttcactcaatatcactattcacaagaactacggccacgacaaaaaccaccctacagtatatcaatgagtcaaacatcaaatccaatatatggattaagaagaaataatggatttgctgggggttcaaacccctccaacaacaacaacaacaacagcaacaacaaccataatggcaatagaatatctttagggtcagctactagaacatcatcgatcatatctaataatcttccatttagacaatcattattacatgggaattatgataatgctatcaacaatactccttcaacttcttctttacaaaagcaatcacaacaacaacaacaatccctgcaaactctgcaaacaaaaagaagatcaacattattatcaaccccagcaactacaactaaacgaagacaaagtatgatgggtaataacttgcatcaacaacatcaatatggatctactgctttacgacattcaactcaaccttcatcatcaatgaattctcaattcaatcaagcattacaacatgtatcaccatattataatccaacgtcatattcatcacaaacaccatcttctcaaccttcatcgcaacaatatcaacaacaacaacaacaagcaaatataccatcatctgcatcttcttcacaacaacaacaatctatggaccctcgaccattaaaagataagaaatatcaagaattaatccaaaaggaaatcattcgatatttaattgattataaatttgaaattaaaaccaatattgccttgacagaaaatattttgaaactgccgacgcaaaaaaattttaatgctatatttaaatttttatataatcaacttgatcctaattatatgtttataaaactgtcaattgaacaagaaattgtcacattattgaaattattaaattatccttatatgcatacaattactcgatcacatnttagtgctgttggaggcaataattggccaacatttntaggaatattatattggttagtagaattg

SEQ ID NO: 930 - DNA, 696 bp, Candida albicans
aatacaaaaaattgttttagtaaagaaataagaatggaaaaaaattttaaacagaaaaatgtaaacctctttaaacttagtaatttgtttagaccttcaataatgatttcaagacaattaatggggttagttccgaaaccttcaatcactgttaggagatttttcagtacgtcatcaataatattacaaaaatccgcaacaccaggatcgtccacatcaatccctcatccacatgttacatcagccgattataaaccaccagtcaccattgatagagaattacctgatccattttccaaaaggaaaaccaatcgtcgttatttacttatttatggtattggtataacattatcatgtattgctattttcaattatgaaaaaactcaatcaccaattataacatcatcattatattttttaagacggtctcaaccatcaattgaacttttaggtaaagatattgattatagttctagttggccatggatttggggcaaattaaacacggttcaaggaataataaatattgaattttcggttaaaggttctaaaggtaatggagtggttaaattaaatgctagtagagaatcaaaagctcacccatttgatgttcatcaatttgtattagaagttgaaagagatggtaaaaaacaagttgttgatttgaccaaggaaccaaattttgatttcatgtaa

SEQ ID NO: 931 - DNA, 738 bp, Candida albicans
  unsure (72): Identity of nucleotide sequences at the above locations are unknown.
gacaatatggcttattatcaacaacaaatgggtaatccccaaaacatgcagtttcaccaatcaaattattcntatcaacaaccaactaacgcgcaaggaacctctggtatgatgggttcaatggattccaattttggttctaatatagatgtgagtggagtaatgggtaatggggaattgactccgggcttattagcagcattcggtacatcaggttaccctggagaaccaccattactagaagaattgggcatcaattttcagcacatcagaagtaaaacattagttgtgttaaatccattgactaaagatattccaagtgatataatggcagatctggatcttgctggacctatattgtttgtattgttatttggtacattgttgctattagcagggaaagttcagtttggttacatttatggggttggattgtttggaataataggtttacattatttattcaaatttatgagcaatgaaacaactattgatttgatccgatcggcgtctgtacttgggtattgcttattgccattagtcttgattagtgtattgggagttgtcaccagtttggataacttggttggatacattttgagtgctatagctgtgatgtggtgcacatattctgccagtggattttttcgtgagcgttttgaaattgcacaatgtcaggccattaattgcatatccttttcttccaccacggggagctgggaagattcccgcagttac

SEQ ID NO: 932 - DNA, 954 bp, Candida albicans
accactttaatggatagagttgaagaattactgaaaacattaacatatggtcacccaaaaatagaggcgttaatggaagaacttgatgattttttcaagaaccatgaaactgctggttcaagggttattattttcactgaattccgtgaatctgctttggaaattgttcaatgtattgaaaaggcaaatgataatagaaaaccacatattttcattggtcagtcaaaagaaaaggagaaatttgacgttgaaaattttggtaagaagaaacagaaaggtcaaacaaagaagaaaaaggatgaacgaccatctactagatcgagttcagagaatgcccaaatgactgggatgtcgcaaaaattgcaaaaggaaattatcaaaaaatttaaaaaaggtgtgtttaacatccttgttgcgacttctattggtgaagaagggttagatattggtgaggtggatttgattatatgttatgattccacttcgtctcctatcaagaatattcaaagaatgggtagaactgggcgtaaacgtgatgggaaagttttgatgttattctccagcaacgaggaatcaaaatttgacaaggcaatgggtgggtatgaatatattcaacagcatatcatgaaaggtgatttcatacaacttcgcccgcagcatcgaatgatccctgacgaatataaacctgaagcggttaaacagctaattcaaatcccagaagagaacattgaattgaaagcagaagatgatgaagatgaaattataagaatagctaccctgtatatgctaggtggtaagggtaagaagggaaaaaaagccaataataatagcaccaagaaaccagctaagacctttttcatgcctgataatgttgaaactgggtttaaaagtgcagccactatggttcgtaaagttggagataacaaatcattggccgaaagaaacaaagtataa

SEQ ID NO: 933 - DNA, 792 bp, Candida albicans
ataaacatacaaaacataagtccggtatttttttccatgatcatctttgcaacaccaaaagtttgtaaaggaaaaacgcgcatactatatttttatctttcaaaattattcttttatgtttactttttctttctcatttattactcaatacaaaagcattcctatatcaattcaaccatgccaatcattccattggaagatgataaagacgatgactggattttagaggacgaagatgatcctgagtttcaagctattttacagggtaactcttcaaaaggaccagcacaaagaacattagaaggatcggtggctgcagtatcaacgcgtccacagaatgacaagtatgaaaccataccagttcctgtaaaaataaatacccctactcatcatgctatggattttgaaaatttaaaaacgtacatttaccctacgaattttgaaatacgtgattaccagtacaatatcgttgaacgcgctttttatgacaatttgttagttgcattacccactggtgtaggtaaaaccttcatagcttcaacagtgatgttgaactttctacgatggttcccaatttcgaaaattatatttatggcacccactaggccattagttgctcaacaaattaaagcgtgttgttcaattgcagggatccccagctctaaagtagcaatattgttagacaaaacgcgtcgaaatcgagcagagatctggaactctcgtcaggtattttttacgactccccaagttgtcttcacctcggggctggacggatccgcccttaagtctcgc

SEQ ID NO: 934 - DNA, 822 bp, Candida albicans
gaatcaagtcaaagagatacacaagcatccgtgaaactgaagccaccaccaccaaaacctaaaaaattgtcatccaagattgctgcttttcaacagcaattgttcaaccccgctaatgcttcctccgaagaagatgttagttcaactgggtctaaacaaccagagtcaggcattagaaaaagatctactgaaaatagtgtattactgagatttggtgggaaagcgattccattaccaggtatgtttaatcctaatcaaatgcccaaaccttctatatctcatggggaagaaacatctgatgatagagaggaaaaacaggaaagtgcaactgcaaatgcacctgttagaagaactcgaggtccaagaggtaagaaattacctaaagctgttgctgatgcagaagttaaaacagaaagtagatttgccatagaactgggtaaattgtggagcattgaatttaaaaagaaaatagtagaggagaaagaaattacttctactagtgttgaagatttggaaaagccaaagatactttctgaaaatgatgaagctggtgacgagggcaaagaaactgcggttgagaatgaggtaatagataacccggagatccctgttaaagatgagttgcaacacgatgttgtagatgttgttggacatcctgagaaagatgtagttactggcttagatgatgatgacgaggatgtacctcctgaagtaaatgagagatttattaaagatgaagagatttcaaatgtcggtgttgaaagaactattgcactggaaacaaccacagaaaagcattcaactgatgaagaagaagtataa

SEQ ID NO: 935 - DNA, 2454 bp, Candida albicans
atgtcgattccacaaatgaaattacctgccactccctatatgccgagctatgaaggtgactgtaccgatcccgacaatatatttttcgatggagataacgtatcgtttgtggggaggccattccccttacaagaagctagaatgcaccttcagagaatcaaggactgggggtatactacgattagatacttgatcacatgggaagcaatggaacatgcgggtccagggaaatacgaccgtgagtttgtcaactataccattgaagtattgaaaatcattgaagaagttggtggattgtatgtgttttttgaatttcatcaagatgtttggtcacggtattctggaggcagtggagcacctatgtggaccttttatgctgctggactagacccaaaatgtttcgccaaaacagaggcggcaatcctacacaatgaaccaaggttccacgattcttccgacacctaccacaagatgctttggacttccaactacaaacgcttggcttcacttgtcatgtttaccttattctttgccggtaagatttatttccctgacttgatattaaacggcgaaaacatacaggactatttacaaaatcatttccttggagcagttgagtttctttggaaacgtatttgccgcaaactcccgaaattgataaaaaatgggacaatccttggatttgaatcgatgaatgaacccaacagtggacttattgggtaccctgatttgagtcgtgttcctgattaccagcaattacgtgttggaacaaccccaacagccttccaagcaatgaaattgggtatggggttcacctgtgaagtagacgagtaccacataagtgtgacgggtcctcgtaaaacgggtatcaaaattgtcgatccaaagggagccagagcatggatctctcgtgctactgcgcaaaaaatagacaaacattatggtttcaaaaggtgcacggactggcccattggcaagtgtatttttgcccacaagggtatctggaaatggaccgacgggtttgattttaactctttacaagaactcacacaagagcaaagattggaggtgagctctaaatgccaaatgcttgatccagaacacttttcaaagctgcaatctactggccgcatagacgctgagtattttgtcaacaatcattttgttgaccattatattgcattcaaaaatgttgttagaaaaatataccctgatctgtttgtgtttatgctgacaccagttttggaaataccaccaactctcaaactcgatgatagaaatattattgataagaaaaccgtctattgtccacattactatgacggcttatcattaatgttcaagtgctggaacgtcaaatacaatgtggacactcttggaataatgcgtaatcgctacttaaacccggtcttgggtatcgtttttggagaaagagcaattagaaactgcttaaagaaacagtttatggaaatgagaaacgagtgcaacacccatttggggaacattcccatcttgatgtcagaaactggtatgccatttgatatggatagaaagcgagcttatagagacggaatgtttgactcccaaacagctgcgttggacgccattagcaatgctcttgaaggcgcaaatatgtcacacacttattggtgctacaacagtgccaacaatcacaaatggggagacaattggaataatgaagacttttcattttggtcaccagatgatcgtttactaacgtttgacgaggactgtaatgaaaaccaaagtattagctcacgaagacgcaggcgaagatcatttaaaaaggatccacgaactgcacttcggcgtgccgtggtagctacgaaaatggggttgagtgcatcaagaggcagtacacgatcagcagcatcggagtcatcttttacttctgaaaaggattcttctgaaggctacgagtccgacgatacatcgtctcagtgttcattgatcacttcacacagtctgaatatttaccaccgccaattcaaaaaatgctacccttcaccagacggtgttagagctgtatcagctactataaggccatacctcatggctaccaagggaagtgtagttgcagttgagtttgatatcaaatcagtcaaatattctttgctgttgtcaatcgacaagtcagatttgtcgcttgaaacaacaccaagcattattttcgtacccaaatggcattacccgtttttagactatggcgacatttacttgacttccgggtacgtcaaatacaacgaggaactccagtatcttgaatggtaccactctagagatccgacacttcccgaagacgaaaacgaaaccacccaaggcatttctacagaaacaatcatcatcaaaaacaatagcggatccttagaggattccaaactagtagaagagaaaggtgtgtttggaaacgagataggatgtcccgttacatag

SEQ ID NO: 936 - DNA, 1359 bp, Candida albicans
  unsure (1083),(1206),(1238): Identity of nucleotide sequences at the above locations are unknown.
ctgacactacctgagccgcaatcattacaacccagaaaaaaaaatttggaagctcatcccagattactaatttactttcttttgctgtaccagctatttgataaaatgtcacaccaacaagaagacgtcgtagacgatactcaagaagaatatatcaatgttaatgaagtggctgaggaagttgcagatgatgatcaagcgccacccgatgaagaagatgaggagatggaattagatgatgagcatgagactttagaaattgacatgtccaacaattcatggacttattttgataaacataccgatagtatatttactattttttcacatcctaaattgccaatggtattgactgagggtggtgacaacacggcatacttatggaccacacacacccaaccaccaagatttgttggcgaaatcactggacataaagagtctgttatatctggagggtttactgcagacggcaagtttgttgttactgcagacatgaatggattaattcaagttttcaaagccacaaaaggaggtgaacagtgggtgaaatttggtgaattggacgaagttgaagaagtgttgtttgttactgtgcatccaacattaccattctttgcctttggtgctaccgatggatctatatgggtctaccaaatagacgaatccagtaaactgctagtgcaaattatgtctgggttctcacacacattaaaatgtaatggtgctgtatttatacaaggaaaagatgaaaatgatttgacattggtctctataagtgaagatggtactgtggtgaactggaactgttttacaggacaagtgaattataaattgcaacctcatgatgactttaaaggagttgagagtccgtgggtcacggtcaaagtacatggtaatcttgtggccattggtggcagagatggccagctatcaattgtgaacaatgacactggtaaaatcgttcatactcttaaaacattggataatgtcgacgacattgcagaactctcaattgaggcattgagttggtgtgaaagcaaaaatattaacctcttggcagtgggtttggtttctggtgacgtnttattatttgatactcagcaatggagattgagaaagaacttgaaagttgacgatgccatcaccaaattacaatttgttggcgaaacccccattttggtgggaaatagtatggatggtaaaatntacaaatgggaacctagaactggtgaaaaatngtttgctggtgtgggaacaaacatggggagttatggactttgctattttaaaattgaagtaaaaaattggttactgctggtcgatgaaaggtgtttccattggtctttgttcatgaaataa

SEQ ID NO: 937 - DNA, 465 bp, Candida albicans
agtgatacattatatcaaatcatcaatagactcattaccatggctaaaggtaaaggcaaaggcaaaggcaaaggcaaagataaaggaaagtctgtctccaaccgggataattatgcaaaaatatcatatttgtatcaaattagtaatcaattttacctagcccatccagagtaccaagccttatctagaggatataacagaaacttggatctaattgccaaaaaaactgtcataaaactatcaccacacataaaaaggacattatgcaagaaatgcaatactatgcttattcctggcttgactatgtcaatgtatattgagaatttatcgaaacaaaagtcacagcataatgatgtatttgttaacaagtgtttaaattgtgggaaatgcaaacgattccccgttggaaaagatagaaactacattttatttaccgataaacagaatgaaaacataccaacctaa

SEQ ID NO: 938 - DNA, 723 bp, Candida albicans
ctttggatattagatcttcttaatcttgattatgaagtgaaaatatatttaagacatccagaaacttggcgtggtccattacaattatttgatgctcatcaattaggtaaagcaccagtattggaagttatttttggagatggaagaccaccaattaaaatatctgagctgggatttataattcaatatttattaagatactatgattgccaaaatattttataccttgccaatcttgatcaacaattggaagttgattattatttacattattctgaagggtcattacaacatatacaaatggcattattaattaattcttcagctaaacatattgccccgtttgccacgaaatcagtagtgaaattagtgactaaagcaataaataatggttattataaacatgaatggtttttgaatatgaaatatttagaagatcgattagaacaaaatggaactgggtttttcgttggtgacaaattaagtggagctgatgttattttaagtttcccaatctatgaaaatgttttcgataatcttgaaggaactaaagaaatattgggtgataaagtcaatattaaaaaaatgttccccaatttatttaattggagtcgaatgattaaaaataatttaagttataaaaaaattactgaattaatgaatgaagaagttgaagatttgattgcattgaatcctcgatttgattatggcagagaaaaataa

SEQ ID NO: 939 - DNA, 762 bp, Candida albicans
caacttatcaggcttgatgattcaagaacacacagaattctttggttactagaaatacttcagcttgattatgaagtgaaaatatacctaagacatccagaaacttggcgtggacctttgcaattgttcgatgttcaccaattaggcaaagccccagttttagaaatcattttcggtgacgggagacccccaatcaagataacagagctgggattcatcattcaatatttgttgcgggtttacgataaagaaaatattttaaatccgataagccaggagcaacaattagaggtcgactactatttacactatgcagaaggttcattgcaacatatccaaatggcgttattgattaattctgtggctaaacatgttgcaccattcgcaacaaaagctgtggtgaagataattaccaaagcaataaacaatggatactataaacatgaatggtatttgaatttccaatatttggaagatagattagcacaaaatggtactggtttttttgttggaaacaaattgactggagcagatgtgattctaagtttcccagtttatgaaaatgtttttgacaatcctggtggtgttcgagaaatatgtggagaaaagagagatttacgcaaagtttaccctcatttggcaaaatggagtcggatgattaaaaataacccaacctataaacgggtaaccgaaatgatgaatgaagaagttgaagatttaattgccatgaatccacgatttgattacgggaaagagaaataa

SEQ ID NO: 940 - DNA, 771 bp, Candida albicans
tttgctagacattcctccccgtttatcctactaacacgtaaatacgtaaggcttaactattcccgttcacaaagagtcctttggttattgggagaattgaatattccatttgaattaaaagtctacttgagaaataaggaatttagagctcccaaagagttggagaatgttcacccattgggaaagtctcctgtcattgaggttattgatagcaagactggtaaatctgaaatcattgctgaaactggtcatatttttaactacatcttatcaaactatgacaccactaatatcttgattcccttcaatcgtgatcttcaaagccaagttgactactttttacattacacagaaggaacattacaaccaaaattggttgcgctaatggttcacggagtagccaaaaagaaagctcctttcggagccagattcttaatgggattgttgatgggtggtattgatgatgcattctatattccagatttgaaaaagaacttgaaatatttagaaaatatcatccacaagcaacatgaaaaaggtagtaaatactttgttggcgataaactctcaggtgctgatattattttggaattccctgtgattaccaacattttccaaaacaaacgtggggctgaacagcttggtgctggtgacgtcgaaaaagagtatccacatttgaaccaatgggcagaagacataaaaaaggaacccaaatacatcaaggctcaagaattggttgctaaacacgaaactgttaagcctaacatttag

SEQ ID NO: 941 - DNA, 777 bp, Candida albicans
ctacactatgctagacattcctccctgtttatcctactaacacataaatacgtaaggcttaactattcccgttcacaaagagtcatttggttattggaagaattgaatattccatttgaattaaaagtctacttgagaaacaaacaattcagagctcccaaagaattggagaatgttcacccattgggaaagtcccctgtcattgaagttattgataccaagactggtgaatctgaagtgattgctgaaactggccatatttttaactatatcttgtcaaactatgacaccactaatatcttgactcctgccaatcgtaaacttcaaaaccaagttgattactttttgcattacgctgaaggaacattacaacctaacttggttgctttattagttcatggatttgctaaacaacaagcaccatttggaaccaaattcttaatgggattattggtcaatggaattgatagtatgttttacattcctgaattgaaaaagaacttgaactatttagaagacattatgcgcaagcaacatgaaaatggtagtaactactttgttggcgataaactctctggtgctgatattattttggaattccctgtgattaccaatattttccaaaacaaacgtggggctgaacagcttggtgctggtgacgtcgaaaaagagtatccacatttgaaccaatgggcagaagacataaaaaaggaacccaaatacatcaaggctcaagaattggttgctaaacacgaaactgttaagcctaacatttag

SEQ ID NO: 942 - DNA, 270 bp, Candida albicans
gctaagcgcggatccttccagccccccgtggtgaagacgccttccagacgggctgcgctgagactggggtttacctttgaggggatctttcggcagcatatggtgattaaaggaaggaatagagatacggcgtggttttcgatgctgcgtgaggaatgggaagggggtgtcaagggggctatggaggagtggctgcaggagagcaactttgacgaaagtggtgggcagcagaagagtcttgaagagctgcggatgggaaggcagccataa

SEQ ID NO: 943 - DNA, 879 bp, Candida albicans
gtattcatgactataacatttattccaggagaagtcaacaagagtaattattctgttgcgcattccaattggaagaaccaccacattatagcatatggttccggtaacaacttgataattaccggtggcacggttcagccaactaacaaaaacccaaatccatttaatgtagacaagagcttgcaaacaatatatttggatagagatccactggctattgatatcaaccctgaaaacggatacatactagtttctattgagtccaaaattctcgtctataaaccaatgaacgagtatatgaaaatacctaaatggcaactgagtattgaaatagatgtcaacgagtctacaataaactgtattaagtgggcatcagaggaaaatgaaattgtcgtaggtacggattcgggattatacttgttttatttgtacgaggaatatggggagttgaaatatagaaaacgatggcaagcaaatcaagttaaccctgttactgaaatattggtaacccctaattcaaaaatgataatgacgaaaagtggactgtttgatcggttaattaaagtctggacaagaatcagctatggtgatgaaaacactttgtttgaagtaacctatttaccacatccacaggggacgtttgtgatcgattatcatttgaagaaacaaatcactgaagaagacaaaaagaacgaaatagatgcatccatggctaacatcaaaaatattcgagactatttaaacaatgcgaccgatgaaggtgaagttatctattcgttttgttcggactacaaattcagaatgtgggctgcatgtgaacatagtggtcataaccagataaataattgggctacacttgatttgaaggaagtttcctga

SEQ ID NO: 944 - DNA, 2853 bp, Candida albicans
tttgaaggaagtttcctgaagataagtactgttattgtgatagagaattaccatttacgtgagacattgatccctgccttgaagaatagtgattgcactttattcaacggtttagatattaatgatttagatttattgtttgttgtatcagatactgcagaagtaaagatttatgctatcacaaatatctcacagtgtccaccaaccaaaattctttttacaccaatatcagggaactaccattttggtaagaatgaatatccattgatcaacacacaagtaaaaacagagaaaatatcaagcagttatattgaatcggaagagtttatcactaccgtattgaaaccgctattagtgaaagaaatttgcatattaaatgaaagagtgccctttttaacctttttgctacatgacagagttaaaaacacattgagatttaatattatgaatatcgaaaagttagcacgtggctccaaacttgaatctgtattgataaacaaataccaaggccacaccaaatcaattagaaagttagtcaagtcaaactcgtctttctcacagaacaatgtgttgctttccattctgaatttccctcaacataattatatttgggaaccaatgttgcttcaaactaataccatgtcggtgactaaaagattccagataaatgttgagtcaggtatagtgaatgcagtgataatcaatgatgtagagccaccagttgattggaaacgaagacacattgttgttaccacaggcaggaacaacgaaattagtgtttgggattgtaatggctctactaatgatgatcaacccgcagatttaattaccaaggttaaaactggggttgagaaagatccattggtgtttgttttaaccgagtatcctgataatactcaagcagaaagaaagtattgtgttgtggcattgtatgcccatgatcaaataaaatcatggaaactttccttacattataaacagaataagattactgatatattatttgatgaagaaagcgtagcttcgcttcctcaagaggaagagatttatcaagccactgccgtggatgcgtttgtctccgaggcaaacaaaagtttaattgcagtgatttccaaaaatggattgctaaagagctattcgttaaattttgacgagtctattagatggaaaaaagtcagtgaacttgaaacaaatgtttccgctgctagcaagattcatggttcaactgttattaacaaatttgctgttgtggattctactggttataaattgtcaatatgggatgtcatgcagggggtgttggaatatgaagaaaccttcccagaatcaaatggtccagttacggatttggactggacgtttcttagtgcatcaaagatgaaactgacctcaaatgctcttttatctgttggattcagtcgttttgtattattgtacactcagttacgttatgattatacaaacaaaattccagcatatgctacattgaagaagattgacatttccgattttacatcacatgaaattggagacctgatatggctagatggaggctacttaatcattggtgccggtaatcaatttttcattgatgatacgtgggtgaaattagggtcaagtgctatcgacagtaccatacgtcaattgatgagtgggtacacggacgacgatgaagaaatggtttctgatatttcttatttagttagagttcttaatggtccattaccaattttccatccacaatttgtgatacaagctttgtttattatgcaatttactgcggtgaagaaaatacttgtacaattattccaagtcattcgaataggagatgtcatcacatgggatttgaacactgatgttgataacttatttcgtaatgatgaaatctaccagcctaaacgaacaatgtcattaactttggatacattcactgagtataatgatgaggtggctgatttattgattgatagacttatgacaatatccttacctttgttgacccgacaccagcaatcaactttgatttccacaattgttatagttaaagattttacaaaggatatgttggtagaattggatcctaatggaatcagatatttaattctgttgaaattatcgagtactgcgactgccacatcaacatcttctgcaaccacaaagaaacgattagcccaaatacaatgggccatgatgtgtaagactcctgacattctattagaacatgttactaagcattatggaggtaaaattaaatggaaggaaatgaaagatagtggtatgccattttgggttgaaaaaaattcattcaccaaactatttgaaaaaatggctgctttggagttcaaggatgcaccattgggtagaatatgtttgtattatcttctgttgaagaagaaagatattttgattagattgatcaaacataaagacgataaagaaaagaataaaattattggctttatgcaaaaagattttacgcaagcttctaatagatcttcagcattgaaaaatgcttatgtgttattagggttgcatcgatatttggatgctgcatactttttcttattagcagatgctcctaaagattgctgcagaatacttgcagataaagttgattctgatcttgcagttgccgttgctaaagtgtatggagttgaagatatagctgaaaatcaattactgatttcaaacatggattatttacacgatccaattcttttgttgaatagtgataacttttacaaatcagagttatcggagacgcttattagaatttgcatgatttacactagaatgggttgtgattatattgccttagagttattgaaaaattggaagtttgctgataagtag

SEQ ID NO: 945 - DNA, 1143 bp, Candida albicans
  unsure (4),(25): Identity of nucleotide sequences at the above locations are unknown.
acanactattgtatttacactttanacaaatgcaacacccaaaattttattactgtaaggtggctattacaggcacttgtaatgttgccacctaaatcattgtcttttgaaaatgtcatttcctgtacaaaaagattagatccaaatattttgaaagacaactctattcaatccacattgtttcaattgatttgcaagacaatagactttaactacaagagtttggtctatgttttgagtttgtttgtctctttgctgtctgggagaaatacggagttgtatacagtgttaaagtcgttatttcaaaaattttctaaacattcgcagttatattttgaagtctttgatttttttacccgttcaattgatgctgtcccagttgaattcaatttaagttttgcacagattgcttccatatttttgagcacagttccaaaagacgcagatgccaatcgctacaacagcaaatgttttactttttatgttaacgctttacaatctggaaacgaatgtgtggccatgcagattttgactagcttaaaagatttgttgactaaccagtcctggattttcaaacaaaatttgctagaaataactttagttattgttaaaaccggattgcaaaaactaaactcttttgccaaccaagaacaaatttatattttatcaacccaaattgtttcccatatcttgttgtatcacaggtttaagattgccactagacaccatcttgttttgaacgtgatgtcaagtttattgaagtacctagcagatggaacttcaaagttatcatcaaacacagaagctgcatctgcctatgctcgtttattgagtaatctatgtgaaccttcggagagagttggagataagatgtttcacttaacaacttcggcaagttatttcaaaaaattgttaagaaaacatttgtctgttttattaagcaattatatctattttaatttgaagtacacttttactcgtactgtgaatgatgctataatgccaggaatttacagtatgtttactgttttgtcacaaaatgaattgagagtagttaatgattctttggactacggtgggaaagcattctataacactttgtataatgattacaaagatcatgggaaatggaaagatcaataa

SEQ ID NO: 946 - DNA, 1464 bp, Candida albicans
gttgtatttttctccttctctatattgcaaaacatactcttctttgattctaccatccatatatatctaccactatcaagatccctatatcttgttgatacacactttttggttaaaatggggaaggatttgttgactgcagaagcggtgactaaactattaagatcgaaggacacctccatcacagagattgtcaatactgcaaatagtcttttgaataatacattggatatatatttacctggaaaagaagtgtttgtattgaacttactatgtgacagattgaatgacaaatcaaatggtaaatttggaaagtggaagtttaacaaggatgtatggaatttgcttcttctggtttggtcgaaattaaatcaccagaaggtagacagacaaagggtaatacagagattgaaaatcattgagattataattttggttttacagcagaacaatgacaatgaagtcttctcgagcttgtttgagtttcttggtattatgtttcaagagtcttacattattgcagatgaaaattctgctacacaattattgaaatgctttgttgaacacatggatgttctccaagctagcgattcaattgtgagttggactgaactagttcgagatatatatactcgtgcctgcctgaaaatcagtttagaaggatcaaagaagttttacaataagttttttgaagattgttgtttccccttgatcgagtatttagccatttctgaaggtctgtctgtctcaccaatattaaaggagttgttaattcaaggggtgttcaatgcggattccacaaagtactaccaatcaagtttagagcgggagctcaaaaagaaagacatcaaagaggtatcagtgatatatttatacaccttaacggtgcaacttttcagtgccaaacatatggaaatatgtgaaggggtatattctatcatggcttcaaagtgtcctgacttggcagaaaagctattgtctattttggcaagctgcaggaaaacaatttctaaaccatttatagagctgatttacaaagtagaggttgctgataagccttttaaacaattaaattgggacatggttaaacatatatttgcaattgatagtgagttggcaattagcaaatcagggtttttgttcaagacttacaagtctgaatttcagttggatgacaaagttgtacctgttgctgaagtgattgttgatggttttgcaagaaaccgcgaattgctggatttttttacaaaagtgtggcccaaagccataaagagagacgagatatgggaatcagatgagttcatacatactgtatcacagcatgttaagactttttcagggaaacagttaattgatgtcatcgaaagctcgttttatgcggataaggggagtcaacgtgcgatttttacagcaattacaaagggactaaccagttcatctgcaaacctaattgatgccgtctaa

SEQ ID NO: 947 - DNA, 447 bp, Candida albicans
tacaaaacaataatgaatccattgaataaaattatatttttatcggcatttttagcatcaggctttttattgatattattgtcatgtgcattatacaacaactaccatacactttgggtaatattaattttccttctagctccattaccaaatttaatagccaattccattgagctggcacgagattataatttcttgacgttcaatgattatggcaatagtaatgattcaacacaatcaccattacaggagtttggcaaatacataactgggtttttgactgttagtggtatagctttaccattgacattttaccattgtgggttaattgaattaggggcaaccattatgagtataattggtggtctcattgtatacagcgacattattatttttatctggttttttaatactgaagaagaagaacacgatgactttaatttctaa

SEQ ID NO: 948 - DNA, 762 bp, Candida albicans
agatcagtacctgaaatatatcgattagatgaggaattggtaattaaattttcttcaactacacaactttctcgacgtagagaggttttcattaaaaatatcaataaatggattgaaacccatcaagagttaaataccataccaccaaagaaatcatcctatactacagaagcaacatttgaattgtgctcatcctcattgccatcttcaccggtatcgtttttgaaaacttcacctaataaaatcattaaaccacgatcagccaattcatcaccaaccaaaataaaaaatcgatcattaaatttctctgatttgaaaaatgattcatcaagattcaaatttaaagaaaaattggaatcaatagaaagtaataaatttaatggattatcattactagaaagaattaaattaaaagagaaattacgtaaacaacaagaacaagatgaaatatccaaacaacaagctccacaagataaatatcaaaattatttattgacgaaaatccccatgatttataatgccatttatcaattatatcaatgccaaccaaataattgtaaaacattttccacaaagaaactcattcaaaccatccaagatagttcttcttatccggtgatccctgatgaaattcatgatggtatgaaacttttatccaccaaactaccgtcaaaacttgatatgattgaaaaaaatgatattaaagttattcgtgttacccatttaaatagagatcaagatttaaagatattagatatttag

SEQ ID NO: 949 - DNA, 870 bp, Candida albicans
gagaatagaaatataacatcctattacagcaacagaactacaaccccccccattcattcaaaaactaccaaaacaacccacagaaacatgggttccaaaaacaaacgatatagctatttaccagcatcaaagaatgatcatttcaatgcagaaaatgagattaaaaaataccatttagatgtatcaacatttgatgttataagagtgaataatttccgtaattacaactgttcgactttgttttggtatttttacatgtgggttctaatctttttatcatttgcattattagcaacagatatctattcttgtctaaatatccttgtattccatagatgggctagtgatgattacaagccgtacgcatattccattgccaaatggattttcactggatgtataatatttcagtttgtgctactattttatcattggatatgggccatacatattgccaggacaagaaatattgccttggtttatctaaattccatagccaaaagactctatctgataaaatattatgataatttttgtttattaaacagtatcaacgaaggtcatttttttgattggtgttgttttttaacttattatgagatagataatgcattacaaatattagtggctgacaccccaagacaagttatcaatatattgacattaagatactatgccactggtggagagttaaataacaatattttgaataacattgaacaaattgccaatacaaatttgtacttgtctattattttgagtttcatgtgtttatcggtgttcatcctatgctatattcttcttgaggtttgtatttgggatgctttgttacattccattaaagatccaattgagcaacgatggctataa

SEQ ID NO: 950 - DNA, 741 bp, Candida albicans
aaaaacattcatatggacctatctaatttatcaaacactttgcctctggataatactagaccgggaaacacaaccgctgtgcatagttctactcccatctcaaatatcaaccaagatttaactaatcacttcaaggatgctgccaagtcagttgcttcgttatacaatatatcattaaacaacacagttgataacaatgtcaataacaggaatatcaagacagaatttgctaatgctgccaaggcggtcgcgtcattatataaactaggacaatcatcacagcagacctcatacacaaagggatatctacaatgtcttgacgatttattggctgttttgacgaataatgaggatattgaagactgggtattgacgagaagaattgaattaatgaatcatatgaccaatccgaatagcaaaccaccgtcaagtggtgacgcaagtcaacattctgaatctgacccttttagtatcccacacgactacgaatttacctttaacctggatatgaaaccacctacccattttagacctagtatgccgcctctttcagttcagcataactcaaagcaaagagcgtccattggaaatcatcacttaaagcacagtaaaaaaatacctttttctgaagactcgataatggttgatgatagtgataacgaggacaaagaggtcaagcaacaacaactattccccaaatatcttaaggaaagtcctttgaaaaagaaaaggaagatatga

SEQ ID NO: 951 - DNA, 831 bp, Candida albicans
ggtgagaattttgtatttgagtcccataaagagagaatagacaaattaagagacaactatgagaaatctaaaatagatccagtggttgaatttgaaaaattaacccaaggatctaactcttataaacccaagccaataatagatatacccttgagtgactttgagtatgaaaaagagtttgtcctcgaatcaataaagaacttggaggcgaaaccagaattggaccaacaccaaaaatcatatttgtggtcaatgaaaaaatctattgcgattcaggaatctctggactcagaaacaagatatttcaatgaagcgactatgactgtgggtaatgggaatgaagactcgggatggcattacgattggagatttttcaatgggaaactcagagatggtgcacgaaccgcgatcatattggaacgattgcttcgcaactggtttagattcactgaaaagtatggtgttgttagttggattgctcacggcccgttattgagttggtattggaatggagccatctttccttacgataacgatttagatgtccaaatgccaataaagcaactagcaaggttgggtgagttgtataaccagacgttagttgtcgaagatttacgagaaggatttgggaaatatttaattgacgtgggtacgtttattcacaacagggacatatcaaacgatggcaatcacattgatgctaggttcattgatgtggatactggtgtttatattgatattacgggattaagcaacgtactagtgaacagagcatcaagatacgatggaagagatattcatgatcggtcttcaccacgggctgaagaccca

SEQ ID NO: 952 - DNA, 2463 bp, Candida albicans
ttattcacaaggaaaccaaaaaaacctacactagttatggctgatttcagacaatttagaaacatattcttagttgtgttatttttcaatctttgttactttctaaaaatctatcgaaacaacaagatccaaaacgaaatcctaaatttccgtcattcatattacaactattacaacgacgatcaaatctccatcggttatctcaaagaagaagattcactccctgaggaacaagaactattacagttgcttcacaaagtcaaacgtaatgaaaacaatacatattggttggctaacactaccatggaatacccatcgattatgttgaatgcattagatttcttaccaccatctgaaaatgaaccacaatatattacatggtataataatccaaaactttactacgaacctaggctcacattggcagtgtatttagatgaactaaaacaccaacttaagttgcataatcctgataattctaaaactaaagaccacatgataaaattaccattttcgtggtcagattgggttgatttaactatgctaaatagtgaaataatgaagccaattggtctaaaaaataattgtgagtggttgcaaaaagaagcaaataaacgaactagatttcctgatttttgtaaagatttagttgatttatcagacgaggagattgatgaaatagggttatctaaggatcaactacctggatttattgtaaaatcatcacctatgaataaggcaccacatatggaggtgatgttgcaaggtaaatcatatttatatacccaacaagaaaatccactaacactagtgtttttgactagtaatggcacttatgaagcacagctcacagagaaaagagaaaagttactacaaacagatttattccaccggttcttgaaaagaagaaagattgactgtaaacaggcccatggcgtggtaccagttgaatttaatccacaatctgaattccgaaaattgttacgcgcaatcccaccaagaccactagatccaaaagatgatttgcatggcattagtaaaatcgtctcaaataaaggtgatagaaatattttgagacaactcaatttagacccttcaacattccattatactcaacagaatgttgaacaacaaatcgccagttatgaaaccagattaagtaaaatcgagaaggtaataacagatgagctaaactatgatctaaatgtcctcgaagcaaatagattaactaggcacgaattaaatcattatcgtgggttaaaatacgccaattccttctcggttgatgtggaaccaacctattataaattggcaacattgaaaaaaaatcaatataaccttgattcaggttggcattatgagtggagatttttcaatggagctatgagatatctaaaagacgagacgtggtcatatgaacaaatggaagtgagagaacaaataatcttggacaggttattgagaaattggtttaaatttgctgaagcaaagggtatagtttcctggatagcccatggtcccttattgtcttggtattgggatggtttaatgtttccctttgatatagatattgatctccagatgccatcgtcggaattgaatcggttggctgccaattataatatgactctagtcattgaagatttaaatgaagggtatgggaaatacttgatagactgttccacatttatacatcacagaaatgttgctggtagagacaaccacattgatgcaaggttcattgatgttgacaccggcacatatattgatattactggtatgggcttgaatgatgaaaaaccacctccgcaatatgacaattatattaatgaaaaaacggaagccaatgaatctgtcgaattatacatggatagaagaaaacattggttaaactatgaaaaaatcaatcccttgaggtattccatgcttggaggggttcctgtatttgttccaaatgatattatgtcaatgttgaaccatgagtaccctaggggtaccaagagtcattattatgatggatattattatgttcctttgttgcgattgtggcttcaagagtcaaagattctaactgctttcaagccagaacaatatgaggcagtgacagatgaggctcgacaagagaatatacttgaacttatcaaaaacctaaggcatgaagatgcctttcaattattgacactgagcaatgatatactaatcgagtactacttgacccaaaaatacactggattgcatgtaagagaaaaacaactaatgatggacgaagcttcagaacgactgatacttgatctagaacacaatgaacaatacaacagcttaacatcaaatttttatattggacctcctttgaggaaatgtttgtttgatttcgagtattatgggcgatttaaacatatggcgaagcaaactgtgtccacaattgtagaaaatgagaagatggaggagtctaaaacattttga

SEQ ID NO: 953 - DNA, 645 bp, Candida albicans
aggcagccgaaggctctagggggctcttgggtgataaaagagtctttaccattgttggagaaatattttaaggaagatcctttattggaaatcagacaaacttgtgagttggctattgaaagaatacactgggaaaactcagaaaaagctaaaaacgaagttttggaaaagtcattgtacacatcgatagatccagcaccacctttagccacaaatgactccacatctaaagtagaaaagttgaaggaaatcttgaatgatcaagacaagccattatttgaaagatacagagcaatgttcagattgagagacattggtactgacgaagcttgtttggctttggcttctggttttgatgacccaagtgctttattcaagcatgaaatagcttacgtttttggtcaaatgtgtaatcctgttaccgttccttcattgatcaaggtcctaaaagatgaatcagaagctggtatggtgagacatgaagctgctgaggcgttaggttcaattgccactgacgaatgtttgccagtgttgcaatcgttccttaatgactccgaaccagtggtcagagactctgcaattgttgcattagatatgtatgagtacgaaaactcaaacgaactagaatatgccactgtgaaataa

SEQ ID NO: 954 - DNA, 1377 bp, Candida albicans
aaagatatagtgcataaatttagtttacttaaatattgtgtatcattagtaatcatcatcatcaccatcaccatcgtactctctgtaaccttccaatgtatgagaacagaacatcgcagaaccgaaaaaaaaaaatacaaaattaatcattcccttcttctcttcgatttaaaaccatcaccaatattatacacagcaaaccatcatacaatgccaacaccaccacctacgattatatgtattggaatggccggaagtggtaaaaccacttttgtacaaagattaaattctcatttgcattctaagaaaacgccaccatatttaataaatttggatccagcagtattgaaaattccatttggagcaaatatcgatattagagattcagtaaaatataaaaaagtcatggaagaatacaatttaggaccaaatggagctattgtaacatcattaaatttattttccaccaagattgatcaagttataaaattgattgataaaaagcaagataaaataaataatgttgttattgatactccaggacaaattgaatgttttatatggagtgctagtggttcaatcataactgaatcatttgctagtgaattccccacggtgattgcttatatcgttgatacaccaagaaatactagtcctactacttttatgtcaaatatgttgtatgcttgttctatattatataaaactaaattacccatgattgtggtgtttaataagactgatgtaactaaggatgattttgctaaagaatggatgacagattttgaaagtttccaaatggctatacagaaggataaagatttaaataatgaacaaggtagtggatatatgagttcattgatcaattcaatgtcattgatgttggaagaattttattcaaatttggatgttgttggagtgagttcatatactggtcaagggtttgataaatttatggaagccgttgacaataaagttgatgaatataatgaattttacaaggcagaaaaagaaagaattttgaaacaaaaggaagaagatgaaaagaaaagacaaacaaaatctttgaataaattaatgaaagatatgaaaatgaaagataccaaaggtgatcacaccaaaaaagatagtgaagtcttgtctgattatgaagaggacgataacgaaattgatgacgaaatacaaggtgaagttttacgagatgaagatgaaccagaaagagaatatacattccctgaagatcgtcaatcagaggtcaactctagaaccgatgctgatttacaatctcgttatcaacaagcatttgaatcaacagcaaaacctgcttcttccaaaactgcagaaaatattgccaattacatcaatagaacccaataa

SEQ ID NO: 955 - DNA, 870 bp, Candida albicans
ggcacaattgtccgatcgatttcaaattcaataattgccattgataacagtagtacggaccaggcaccatataatgaagcatttattgtgaacaataaacattcagttattgattatcaggaaatatatagtaaatgtgatcttaatttgattatacagggtaacaatgagaataacttcaaattgattgaattgaaaaatcaacagctgaaaagccaagatgattggataattcttcaagattataatttgattggttggattgataactttaaactaaatattgaatcaattgatttgttagacaagttttcaagcttaaaagttaatggtaatgggtatgttttaattgatggtggaagcaatgaagtatatgagttggatttagatgaaaacgaagacatgttggtcaatttgaatagtttaattgccattaataaaccatcatcaatatcacttgcaactgatttgaaatatcaagtgattccttatttcaatggtatatataacccaattagttcatatgtacggatcccaaaattttcaattcctaaatatggaataactagtgaagtgtttaatccaataagaaaatcaatccacactttaactaataactataagaaatttgtacaaaacatcaagactgaagctgataagtatcattggttgaccatcattcgagcaaacacaactaaaatttatcaatatatttatagtaaattgttctataatagtgaagggatattactaagaagaaacccaatatttatgaaaattaaaggtcctgctaaactaattatgaataataatgaaacgataaataataataggttatttaccttcaaagaaatcaaatcgatcaattaa

SEQ ID NO: 956 - DNA, 549 bp, Candida albicans
atactcaataggagagaaaaaaacggcatgagactttcacggggattattcttttccttgttgtttttaattccgagcacacaaattcattttttttttgcttctcactttttttttttcaataataattattatcactcttggttgtcaaaatcaaataccaactactactactttttccttcctaaatcaatatacacacagacatttaacacaatgggattagatcatccagcatttacattatcaggattatgtgccattggtggtatcatgggttatgcccgtaaagggtctttcccttcgttagttgccggtattactttttctgctctttatggtggtgctggttatttattgaaacaaaatgctgattatggattagaattagctttaagtacaagtacagtattattaattgctggattagccagatctattccaacgggttttgccaaaccaatcccacttgttctattagtattgggtggtgcttcaactgcttattatgctaaaaaatataatgaattttatccattattcaactaa

SEQ ID NO: 957 - DNA, 1197 bp, Candida albicans
aatttcaaaagtgtttcatctaaaatttcgtcacaaacttttcctaattcgtcggacatgattcctatgactttgcttttgaaggtgactttatggacgtgccatatttacatttttgttgtggtttttcttcctttctcggtctatttcacagccgacagaaccaatttcgcgagaaaaaaaattgaaccaattcaaagggcagaaaaaaatgcacagctaaaaaatgtgttggaaatacatcattcaaatcaaacgttgacaacagtataccaccccctcaacccaatgtcgtcagatccaatattagttaagaaaaagttgttgcaaattgcctcaactggaaaatatgccacatttactccagaacaattacatacccattacgaagaattacaagattttttgatcttaaaccaagattctttactagactcaattgaattgtttaacctatacgaactccaattttatttatcaattttgacattacacgatattgaggccaaaaatgtgttagacaagatatgtgatcaatttgatttcaaggatagcaacaagaataaggggagatcacaaagaattaaaatcttacaaagtgtatatgttgaactgaaaggcgaaatcgaaacggcatccaaattgttgagtgaagaccccgatgaacttagactactgagacgtttaacaacattaagcagacatgacaagaaccccaccaaatacataaataatttgatatattatttgaatttacaacccagtgatttaattgcatgggctgagttgtctgaacagtatcaaaaattgggtaattacgacaaatctatatattgcttaaaggaagtagtgttgcagaatcctttagcttatcctattttttacaagattggcttattatactattatttgtttttgcagaatgaaggcaatttgaaaactgacaaaaaagataaattgtttgagttgatgaagattttgatcaattctagagacaactatttgtattcacttgaaattaatgacaagtatgagaagaattgggttggtttgaaaacaattgcgagtttacccttcaatgataaattaaaaaagatcagtgaaagtagtaaagaaatcaaggattatttaaactataatgaaaagttgacacctataattgatcgtaaattgaaggaattgaatatttcaatataa

SEQ ID NO: 958 - DNA, 1053 bp, Candida albicans
ggtttcacttccgctatgttcagcattaaaggttatcggaacattgcttcgaaagcattagtgagaagaaacttacacacaacaactctattgcaatctcctagatttgtgaatagcaatttcaatagccgtacaagagtaaccaaagagatatcacctgaagaagtacgacaattccaggaagcacaagcaagagctagagaacaaggtcaagctccacggaatccatattcacatcaatttaacaatgacccatattattcattccatttacctgacaacaccaacggaataatcactccgcatgatccaatatatgacattcttaaggaacctactttagtgatagaacgtcaaattgaatttatgaatcttttcattggatttgaacaagctaatcgttatatcattatgaatgcactgggtgaaagaattggttacatggaagaaaaagatgttggatttggcaaaatgttaggtcgtcaattcttcagactacatcgaccatttgatattgatgttttcaatgcaagaggtgaattggcaatgagcattaagagaccattttcatggatcaattcacatatcaaagcattgttgcccggttatgatcataataatgaaattatgtatgaagttgttggtgaatcggtgcaatcttggcatttgtggagaagaaaatacaatttgttcaaattggaagatgaaacaaccgatgaatatgaacaatttggtgctgttgatgctccatttttgtcatttgatttcccagtgaaaaatgctgccggtgaagtagtagcaagtatcgacagaaactgggtaggtttgggtagagaaatgtttactgatactggtgtttatattttaaggtatgatccaaagagttttgaaggtatggaggctgcctatggaactatttcaaaacaaggaattacattagatcaaagagcagtgatcttgtcttgtttcacaagtatagatttcgactatttttctcgacacagtggaggacacggtttgttctcatttggtggatcttacgatgatgtatag

SEQ ID NO: 959 - DNA, 822 bp, Candida albicans
ctttcaagtactttagatctaccacaactaatcatgttcaattgtataagtcgaggggtatttgcatcttcaactagattcacaagagtagcaagatttttgcatcaagtgcccaaattggaatctcatgaaacatggactcaagaaggaataccaggttttttgtctccaaaaggttataacttggcttggaccgattatcaaaactatttattaactaatttaactttattgacaaatggaacatcactggaatataaaacaccatatcaaacattgttgcacacagccaagcaaactacacaacaacatgttttccattatgcatcgatggctcacaataatcatttctttttccaacaattagacactaaagaaaatgcatcgaaaaccaaaccatcgagatttcttatggaaaagttaatgcatgaagacattttggatcttgatcaattaagaaataagttgttgacgatggcagaaaatacatatggccaaggttggatatttttggtggaaacagaagacaaaaatttgaaattcatcaattgtcacaatgacggtactccatattattatgctaaacaacaattattagacttaaatggtggaatagatgaaggaaactttagctatttagagaatttgaaatccagagcattgaacaacgaaaaagattatactttaccaatattagccataaactactgggactatatgtatattccagactatggtgtaactggtaaatctgattatttgaataagttatgggatcacattaattgggacgttgtaaataagagattgttccaaatatag

SEQ ID NO: 960 - DNA, 489 bp, Candida albicans
tcatgggtatcaataatattacactattgcgagtactatagaatcacgtcattatcaattgaaggaatacccaaacactcacaattagaggttccactttcactgctctcttctatattcatcaataaaaccataaatcgtcaagtcaattcagatttccaaaaactaatagtaatacatctaattcataacaaaaaagcagaattcattaatcccaaaaaaccagagttgggtgtatatatatattggagatcactagtcgattggggtgacttattatatcaatatgtcgacgatacgggtcaaaaggggacagttttgacaatttacgaacttacaaaaagtgaagaaaccactgtgccacaagatctccacaatttggatgaaacttttctagtgaaaatcatcaaagattatttgataaaacaagggaaagcccagttgttgatagacgagaataacgaaattggtggtgtgaaaattgtatag

SEQ ID NO: 961 - DNA, 1398 bp, Candida albicans
tcaataatcaatttgaaaactgggaggatggataacgttttcaaagtggaaaatgttattttaaatagacgaggatatcatattccaggaacacttatcttgtcttctttccatttggtgtttagtttcacatccaatacatcgacatccaccaatccaaaagaaatatggatatgttatcccatgatagagaaaatgtcaaaggctagaggttcctcatggattaatcacaataacgggaatagttctaagactaggaacacggggtcgcaggtggataatactccgaaaatagtgatgaaaggatttgatcattatagtgcgtcgcatattcggttgcaatgcaaggatttcacatattactcatttgatttcatgaatgatttaatttgtagcgaagtgtttacaaagttgagctcacttattacaatttccaagactgagaatgatattaaacaactatacgcatattcttacaaaccaaatatgcttgaacagaatttggatgtcaaaggttggcaattgtacaaccccattgaggagtatcaaagattagaactagtacaagaaaacagccagtattggagagtcaccaatcttaatacagagtacaagttttcgccaagttatcccaaggtattaatagtacccagcaccatatcggataatgtattaaaacatgccggtaagtttagatcgaaacagagaataccagcaatcgtttacaagcataaatcaggcattaatgggaacgttatagccaggtgcgctcaacctctagttggtcttaacatacagaatagatcaatacaggatgagaagttgattggagaaatatttctttgccaagagagggaaaggaaggataaaattgataattcttgtggaaagagcaataacgttgatgatgagttccagcgtgaacagccacaacgcaacttgttggtagatctaagaccggtaacgaatgctatggcgcaacatgctttgggtgcaggtacagaaaatgttgattactatcgtgggaaacagaatcttaattccaaggagagcagtaaagataagggtgatggtgaaagcatctcttcgcaacgtataaggcatattgacaagatattttgcaacattgataatattcatgtcatgagagatgcggttaataaattgtcttccatattgaacgatttagatagataccctgctacttatgataaactgtcagcatctgctgctttattacaacaagcattgacaaagacacaatggctaaacagattatctataatcttacaatcagttgatcgtataaccaagtcaatacatttgaataatacagatgtaattgttcaattgttcagaatggttggtggttaccgaccgggcgggtgtcaatcagcg

SEQ ID NO: 962 - DNA, 525 bp, Candida albicans
aacctaagcgcgtatccggctactcgcggtgaagatgctctggttcaagatgagaataatcaaaatgaactgaattctggacagtctttggaaagttcgatgtatggtgaatccccgcaaaatgataattcacaaagtgtaacaagtatcggcagtggagcagcagcaagtgtatcttcttttttccagagagctgcaagagctgccagagaaatcaaaaatacagcccagaatgggctttcatcatcaccaagtcctgaggatggtgctgatggtagtggttacacatcgtcatcttccatctacagtggcagcagtgagaagtcacctatatttcaccaatttctcgattgtgtttaccagatatatcgacaaaatccaacacaattcgaattcaatagtcgatttctcaaaagactattttatcattattactcgtgtcagtacggttcatttttgtgtgattcggaaaaggagttatatgaagtatataaagttcaagatagcacagtgtcagtgtgggaa

SEQ ID NO: 963 - DNA, 396 bp, Candida albicans
atacctacagtcatgacattattaactgcggaaagattggttagattggcttacaaatatccaagtttatctaacacctggtacttaattgccactgcttgtttaacagtcataaatcaacctgatgaaatccccaaattgtatcattttgccttgcgtcaacagttattacaagaccctaagtcgtcatcttcttccacctcgttattaactgataaacatttgattcaactagcccaagattcaattgactcggccaaaaaatatcaagatttgactgctgtggggataaatttacctgatgttttaattcccagcacgtattatccagatttaccattaagatttccaattttccacaaaagaaagatttttccattttccaagataaattga

SEQ ID NO: 964 - DNA, 1158 bp, Candida albicans
  unsure (1110),(1111),(1144): Identity of nucleotide sequences at the above locations are unknown.
acatcgcctccagctacactattatctccatctcccttctcatactcgtcagaccatgctttcttccttacttactcttccctcctcctctctcctctaacattcctcccctatgcccttcattactcttgccacacccttcaatgcggaccgccagtccgtgggaaaacggccacaaccaccactaaccctagtattaccccggaactattacttaaattggcttactcttatcccaatctacaaaattcatggtatctaatcgccgtggccacattgactcaattaaacttatcagaagaaatccctaaagtcttccattttgctttacgacaacaattgttagaatttcaaaatgattctagtttgttgactaatgaaacaatgttgaaattagctgaagattcaattagttctagtgaaagattccctgatattcatcaaaccggggttaaattacctgatgtattgatacctcatacttatagtgaaaaattgcctttaaattataaatattatcaaggtaaagatatacgtcaaacccaacaatcaatagttgatcaaattagagaggtattattgaaaattagtatgttcagtggattacccaaatcgatcaattcattattaatattaaaatcagtaactccaactgcattaaccaattcaaatacagacacaaacattagtttgcctaaacgtaagaacattgttgaacccattgaagaaaataccaccacaaatacacaaaatgttgttgatacaattggtgggaaaatatcaaacgggtctattgttgtggatcaaattgttactaatttaattgaaggattagaatactggaataaaatatattcaaataaattaaatattcgaatcaaaaaagaaatgttacgagcttatccagatttatggtattttgtatatcatcatatttatggtccattgatcagttttacagaaattttgtgtccacagaaaacttcatttagtttgattgcatgtatgatacctcaagatgtgaattctcaattgaaaggtcatttaaaaggtgctattaataatggggcaacaaaggaagaagtaaatgagcctattgtcttcacctcnngggaagtggccacgatcgcgcgaatattacctnttaacgggggtgga

SEQ ID NO: 965 - DNA, 960 bp, Candida albicans
ctgtcacccattggttattatacttcaattgtatctttccaatttatacagactattgcatcgttgcttgctaaaataatggtgctttcatatatacttgaaaaaataccagtagtgactgaagatccatttttacaatatagaccattccctgaagttccaaaaactctatttcaaaaacattggcatgaaatctttgcttcatttacgttttattttattatccaacaattgtctggtccaatattctccataataatgggtccacggtacaccaagttatctagatccaccagagtgaattttgacgttcatgtaacttccatggtgcaatgctttgtttcatttgcacttatggtccctcatttgaacaacccacactgggtaaacagattaaacgatccagccaattcattactacgctcaactgattttggtggattagtctgtgcacttaccgtgggatactttatttgggatctttacgtgtgcgctaagtacttttctttgtttggagttgggtttttatttcacggatttgctgcaatgtacgcttttgcaacagggtttgttccatattgtcaaccatgggctggaccatttttaacctttgagttgagtactccattcgtcaatattaactggtttgcatccaagttgccagcaggaactttttcagaaaagacaataattattaacgggatattactcatggtgaccttctttatcgtgcgtatagtttgggggttttatgctgtttcccaacttgcggttgacatgttggcttcgttggaccaagtgaataaattattgccgatctcattgttggttttgaactttttacttaacagtcttaacgtattctggttttataaaatggtgatgatagccaggaaaaaggcaaggggtcaagagtcaactagagaagcagctaaggaagttagagagaaaatagaataa

SEQ ID NO: 966 - DNA, 516 bp, Candida albicans
tcaatcgtgatgcaattcttgtctgctaaaatcttgttatacatcagggtctttgccttggttgtcatatctttctttttaatcaaagatcctgatgctttgtcaatgacgggcttcatcgtgttattgggacaagcaatgcaagttccattgattagactaacacccacaaatccattactaggaatggcttccattgtatttatttccttggccctaagtgacttgattccattattggccgaaaattggtcttattttgagaacttggttcctatcagattgctgggatatttctgtttagcagcatatatttattttgtccctacaagtatagttagcaacagcttggtgataacatacgtattgttcgagatatggggtaatttcttaatctataataatttgagagatgaaaagtattaccgtatgaagaaatttgtggaagaaaatagcgaggccattagaacagcacacgacgagcaagtcagggtagttgaactagatgaacagtga

SEQ ID NO: 967 - DNA, 1308 bp, Candida albicans
  unsure (166): Identity of nucleotide sequences at the above locations are unknown.
ttttgtttttttttaaaaatagttgctatgaactggactgaaatggaatcaaaagtagtggaagccaccaataatgaaccatggggagcaccaataaagttgatgccacaaattgccaatgggacttataattatcgagaacgtgaagaaattgttgcctttatantcgtagaatttactgaaaaggctgccaatgaatggagacaaatttataagtcgttacaattattggattatttaatcaaaaatggatcagaaaggattattgatgatgtgagagcaaatatttctttgattcaaatgttgaaatctttccattatattgactcaaagggaagagatcaaggaataaatgtcagaaacaaatccaagaatttgattgcatttttaaatgatgataatttgatcagatcagaacgtaaaaaggcaagagctaatgcaaagaaatttggtggtgtttcatcagctgcttatggtggtgcatcttccatgggaactggatttggaagtggtggatcaacttttactggtgatgatgaagattttgccaatagagtctatggagatggtggtgtatatggtgaacgatttgatgatccagcttcggcttataacaatggtgccactggtaatgacaattttgaagaatatgatgtacaagcctcttcatctcaagcaacatcaaaacctacaaccagctcttctagaatcaatgcaaaagcatctaaaaaagaaccacaaaacgatttattaggagatttgctttcgtttgacggagatggacaacaaacaagtacaaacacagcaactgcttcaagaggaacaggagcaaatgatgatgacgatgatgatgattttgatgactttcaagcagcaccatctcaacctcaaaagccagccaatttatctaataatttgaataacttgtacaacccctcatcacaacaacaaaaccaagcagtttctggtccaaattataatgtaaactatcaagcatctcaatcaactggtccagcaaaaacaactagcaataatgatgccttttcatcattgttttcctcagccaagacaaaatccaagacatctacagggaatacgagtacatcatcctctaccacaactccagcagcagcagcagcagcatctgtaaatgcttcaaatcctacaagtagtgctaatgatgatttctttggtggatttagcagtaacaacaacagtagcagtaataataccaatactaaaccagctaccaatggaaatgggacaaacaatactaatagtggtgacattgatttattaagcttctag

SEQ ID NO: 968 - DNA, 984 bp, Candida albicans
actactcttacaatgaatagacgttttttttcattgattgaacaaagagttcccgcaaaatatatatcattcactgttgatgatttgaaatatgactcacaactagagtttgttaaccgtatccagacagtgttgccgttaaacccttattatgtcaaaacagtattgaaagagtatatcaaacacattgaatcttcaaatgaagacacttcagacgaactatacgaactatattgtgatcctgacgttttgaactcaaaggagctaaacccagaacaaacagatgttatcaagtatttcatatctgggtttaatcaacaatatagtggtgatggcaaggatacgataacaataaaagaaacacctaaactaatctcaggaagtaatacaacagggttaagaacgtgggaagcagcactttatttatctaattttttgaatggcaaagatagcccgccatacaatctcaaaaacaaaactgttatggaaattggatgcggtacaggcttggtgagtttggctcttgccaaaaattatcaccgcaaaattgacaacatcaaaagattgatcatgactgacggatctagtaatgtgtttgacaatctacaagaaacattgaggttaaatgagttaaacgattccagtattatacaatgtcaacaattgatctggggtgaaaatacaacaattgaggatgatgtggatttcctcgtggcggcagatattacttacgatacaagaatcttggacccactatgtcaaaccattcaagacttgtttgctaacaacaatttacaatttgcagtaattgcggcaacagtacgaaacatggacactataaaagaatgggagctgaagctagatgtatggtttgccggcaaatggttagttagagccaccgagtcagacccacattctattcaatccaactgctggtttaatgttaatactcctcaaatacgtatttatgaaatacatgtgtag

SEQ ID NO: 969 - DNA, 696 bp, Candida albicans
agaaatcattcccgtccagagtttgttacagttcactatgacagagttcataaccctgaacattgctatcatataagattacagtggttgaatgcaaccaccaaatttattgaagatactattactgcttggacaagattgtgcgaacgtcatggattgaaattagtggagactccgtggaatgagttatgctctcttccaaaacttagtccattccattcttttgttgacataaaattgctggttaatccatggacagacccggacctttgtgacgatcgtatattgtcatccaacagatattattatcactcatatttcctaaaacaaatgggatactatttggacaaccgatctacatctttttttctgcgtgaaaacatcgacattggctatagttgggggaaacctacttttagatatgcacaatttattcacaagactggattttacattgtggagttgagagataatggtgatttctttttggcaccaaataatatgcatctcacacgggtaagatcgtctactacattggttggagactatgaaaattattctaaaggtgtccttgctgattcgcaaacagtgatgcttaattttagagcggcttgtcaaaacaaagaatttttgaaagaaacttttacattagctaaatccaattggaaggatgattacttttcacagattatatag

SEQ ID NO: 970 - DNA, 666 bp, Candida albicans
  unsure (2),(9),(10): Identity of nucleotide sequences at the above locations are unknown.
anagaagcnnaatacaacatgattcgtctcaaaagaaaaaatctcgccgtggaaatcgatgtttatttttatactggcaatttatatgattttttgaacgaagaagctccaaactatgatatcccaggtacacaaccggctttgatgattccagaatcgtcaagatttaataaaacaataaaattacccgaattggcacaagagcttcaagatcgaaatactggtttaacgttggttgaccgaacatggcatttcaaaaggcacttgtattgctttgttggaagcgaattggtatcctggttagtagattgttttgaagatattgagacacgcgaagacgccacaacttatggacaaaacttaatgaacaaagggttattcaaacatgttgagctgcgacatggacttttagatggtcattttttttacgagtttctggacgagtatgttgacaagacagatcgagaaaaaccttcttggtttggatctaagaaaattgatggagctagtactccacaaagcaattcctctccaaggatagcgggacaaaatgatttacaaaaaataatttcagccctgaatcttagatctgagacgtcatcaacaactgattctatgggtcggaaacgtaagaagattatttttaagtcgatctgtgaaatttga

SEQ ID NO: 971 - DNA, 2508 bp, Candida albicans
  unsure (2401),(2403),(2419),(2421),(2428),(2429): Identity of nucleotide sequences at the above locations are unknown.
aaagatttattcaatttggattcagtacaagttgattctgttgacatattcatcaaagatgtacacttatctcgagatgccatgtggaacttttcagcatcaatgatagggaattgtgtatatattgaccaaagattattgtatctaggtagcagggtcggagttaccacacacatttacaaaaatgggaaaaatgtcacctcaggatatgttgacaaaaataccaaaatcatttatcgatctgaaagtgccaaaattactttgtttgtccaactatcaagggaaatgtggcattttgaagaagatggagaaatcatgtttcacaaattgatcaataatttattccccaaaattttccgtcgttggagagaaacgaacacccaccattcgatcactattgttttgtttacaagtattgacctcacagatataccgtggactaatttaggaccaggacagagaccacctcagcgccgagacttttttagagtggttgtcgatcaagttaatagcatgcattgggatcgaataatggaggacttgcgattagaatttgctaatttcaaaagagatacaatgcttaatctcgatgacgatgggaaatttataattgaaaatggaactttacctgcaataaagggaaatttactcgaagcagttaatttaggtttaacatcattgaacaacaggttccaaaatacagaccttaaacattcaatatcccacataatggttataacccctggtacaggattatttgatgttgaacatgacttactattggaaacaagtaaaaaaatgtctagtgttgattcaagtttggatataatatgtttgagccaaccacccttgcatgtgactccattattcagatacattaaagaagggaaagtttgtcattgcgtgcccttatggtgtgatatatcatttttcattgacaaggtgcaacaagaaagtcaatggatacctaggtgtaagatttatgaattgcaaatgatgggtgttatggagaatgaagccagtgacgctagaatccccaggttacatttaaacaattacggtaaaacgttggtagaaattatggatgagtacgatagtgctgttttcaaaccgataaaacgcatacccaagccagcacaagtagagtttaaacaggtaaagccaaaatttcaagctcccgagttgaaaaatgccaccgcaacactttctttaatgtttgagaataagcccttgttacaacctagcaattcttcgacaatttcattagccacggggaccgttgctaatccatcaaaagatacatcagccctttcttcattgtattatattaataagaacagcgaagaaattaaatctcctgcaccttcagtaagaagtgaaactccagtgtctactataagagccatagatagttatcgaaaatcagctggatcacctagattgatcagaggagaaacaatgttcaaaaggaaagaagaaataccaaatactgaaccaccttcagctttgagtgagaaaaacgcagcttcagctagaaagaaatcatcaattttagcagaaccagaacaagaaatttcaacaggatcgttttggatagaaatttctaacccgtcacaagaaaccaccaccaatgtactccagaggtctcaaagcagtcgatggagtaatatatttcctaacaagatacaaagaaagttgatcaaatggagatcgttccaggcaccagcatcacttccgacaacaacaggtgtattcccgtcaacaaatcaacttcaaactgattacacattccaaatttatactgtttttctcaactctgataattattgggaattaaaatcgacacattccttaatgagagaaatgattcaattaagattgatgttagggttccaggtttgttatggtgaaagagttgacaaagctgaagccgaaagaaaaccttctggaaatgttgatgcaataattaaatatttccctgaggagcacaactatcttgggtcaaggatatacttagcgtttggtgatgagatacatcgtatattttgcgactataatggcaatattaatgttcaactatacagaaaaatcatcgaaaacgatgagaaaaagataactttaggacaaacaaaactcaaaccctatttcccacttataagaacaaggtatactgacgagtatacacctgctagaatagatgcaattgccgacaatccacaaaaatttaactggaatcagtttgatcaattattggccgggtttgatgatgctatgccagaagagaaaaagcaatttcacaaaatgaaattcgtagtaatgcctaccgatatccccaaaaatgcatattttgtaagcaatgaaaaattaacaccagaagaaattagagtagaaagtttacgananatgattggggttatananagaagcnnaatacaacatgattcgtctcaaaagaaaaaatctcgccgtggaaatcgatgtttatttttatactggcaatttatatga

SEQ ID NO: 972 - DNA, 447 bp, Candida albicans
gacaaaaaccaacacagcaaaaccacaactcctctttataacccacctttcacccaagcaatgtcatacagtggtaaccgtgtgtttcgtggaaaaaaagagcatgaatcttacgacaaaacgttggcaggcagatacgtcaagctcgtaaagaaaaaccactttttattttttggtcttcccttccttgtatcaatagttgctggctcgatctatttgcaaaagttcacttcagttaaatgggagaaatactacgaaaagtatcaacagctatgcgaagaggaaatgctaaatttgatagaaaacaagcgtaccgtcgacaagaagaatgactactaccgtttacaagggctacttaacgatcacacaaaccaagtagccgatgattatgaaatcgtacgtgtccagcgaagaaaagaggacgagcctgtctgggataggcaataa

SEQ ID NO: 973 - DNA, 990 bp, Candida albicans
  unsure (696): Identity of nucleotide sequences at the above locations are unknown.
attttattttacctgcatataaggaagggtgtgtatctttttcaaatttactttttttttttttcacctttattacacgcatcgcaccgaactgcacaaaatactttcttgcgaagagcatcgaatttctcaaaatttattattcaattctttgatattaaagtcccactaagaatcaataaaccaatactatcaaatatgggtaaaactaaatctagagggagaagagctgagaagaagaataaaaagaatgagccaggatttaatgaagatgtatcaaatttagattcagatgtaactattacaaaccaagaaccattatcgtcatcaatgtcttcaacttctggtattcctaatacattttttgggcttgtggataacaatgagttagattattttaaacaagctgaatccacattaaacattaatgcatttgaaacagatgaggaaagacaaggatttataaattcagtattagaagaagctcaaggtaaagaattgaaattggtgactaatcaaatttgttctaaattaatggaaagattaattttatttgccaatcacaatcaattaaagaagattttcaaacaattccaaaaccattttgtttctttggcatttcataaatatgcatcccacgtattagagacattacttgtaagatcagcagctttgatcgaaaaggaattgactcanacagacgaagaaaaacttgaagaagcagaagaagaagaagcggaagaagaagaagcggaagaagacggtcttaataatgacgtaccaatggaggacttatttataagtatgctcaatgaatttaagcctcatttgactaccatgatagatcatcggtatgcttcacatgtgttgagactcttaatattgattcttgctgggaaagatttccaaccatcagtaacattcaattcaacttttaagatcgaaaaaaatcccaaattgcccgaaaaattgatggagatttacagataa

SEQ ID NO: 974 - DNA, 324 bp, Candida albicans
ttctacaccataaaagttaaggaaagtacttatggtagattagtatggaaaaattggggaatggaattgtttgtacgtaaaaagtatgattggaaagcattgataaaacaacaagaacaagaatattatggagaaactgaagattctactgaaaagagaaccaaaaaaccaatagaattgaaaatggaaagattagctgaagaaaaaagacgtcaagaagaaatggctgaaagagctcaaagtggatataccaagcgtaagttggaagaagctacaggaactgcttccgaaaagaaacaaaagcttagaggacgtagacgttga

SEQ ID NO: 975 - DNA, 654 bp, Candida albicans
tggaaacagcacatcaacaccaattccaagaagtttgataagaaatggaatcaccaaaaatatttcttctcacatataaagaaagaaagaacgaaaaaaaaaaattacacatacaatcccaaaagtcatctcaaaatatgcaaaccattacaatataaaaccatgaaagtactaacggaaagagattcatttttatcaaactatgaagtattacaacatttacaaaatattaaaaagaaatacaattggtcgtttaacccaaatgatgaaaaattcatgaagaataaaaaaaataaacatcatttcacaggatgtggaatcaatttagaaatcataactagagatgtattatcatgtttagaaaataatgaaagtagtttaatacaatcaactaaaagttttaaacaattgatggaatttttaaatcaatttgaattaatgaaagttgaaaaattacaaattgttaatagtttaccaagatcattagtggtgttatatgctttagttgaagaatgtgaagatcgatttggtgaagaaacttcagaaagtataatagagaaaataaatgaattattccccatacaagaagaagaagaagaagaagcaggagaaggagaaggagaaggagaagaagatgcagaaattaacgaatag

SEQ ID NO: 976 - DNA, 1710 bp, Candida albicans
gacaatgatggcatttggaacaatgatttggaagaactgttccttaatgcattagaaacagaattagacaaagtatattctttcactaaagtcaaaaacaccgaagttaatagaagaatcaaagaaagcgaattttatgtttatgaagttgttgatgccttacatcgttatgaaaatcacgacccttccattactaatccaccactggaagaagatttccaagatttggaagaagaattgtctgacattattgctgatgttcacgatttggctaaattcaccagattgaattacactgggtttcaaaaaattatcaagaaacatgacaaaaccacaaaatttacattaaaaccagtattccaagctagattgaacgccaaggctttctacaaagacaattacgataatttgattgttaagttgtctaaattatatgatttggtcagaactagaggtaacccagtgaaaggggattctgctgctggtggaggtcaacaaaatttcgttagacaaaccacaaagtattgggttcatccagataacattactgaattgaaattgatcatcttaaaacatttaccagttttggtttttaatgctgacaaagaatttgaaccagaagatagtgccattacctctatttatttcgataacaaagatatggatctttattatggtagattaagaaaagatgaaggtgctgaagcccttagattgagatggtatggtggtatgaaatctgaacagattttcgttgaaagaaaaactcatagagaagattggaccggtgaaaaatcagtgaaagccagatttgcattgaaagagaaaaaggttaatcaattcttatccggtgaattgactgctagtcaagtttttgaaaaaatgagaaaagaaggtaaaaagagtcctcaagaaattgacaatttagaaagattagcaaaagaatgtcaatatagaattttgaaagaaaaatatcgtcctgttatgcgttcattctataacagaactgctttccaattaccaggggacgccagagtaagaatttctttggatactgaattaacaatggttagagaagacaattttgatggttacgatcgtactcatggcaattggagaagaatggacattggtgttgattatccattcccgcagttgccagaaaaggatgtgtgtcgtttcccatatgctgtcttggaagttaaattgcaaactcaaatgggtcaagaacctccagcatgggtcagagacttggttacatctcatttggttgaagctgtacctaaattttccaaattcattcacggaggtgctacattgttgaccgactatgttaatttattaccattttggtacactcaaatggatgttgatattcgtaaaccgaagattcaacaagaatatggtattagaagaaatgctcctttgcgaattgagagttcaacatcagctaatgaattggacgaagaagaattgtctggttacagtggaagtggtgttcaattctctaatgatattaaccctctcgaagaagatttagaagaaacgagtcctttgttgttccagaactcacatcgttcaagacaaggaaactcattctttaatcagttgatgagttatttcaaagatgaccgtgaattcactgttaaagatagaactaatttcgatttgaatggtacatttaaagacaaattaccgaacgggatatcc

SEQ ID NO: 977 - DNA, 942 bp, Candida albicans
  unsure (63): Identity of nucleotide sequences at the above locations are unknown.
catttaacacaatcccctttggccagtttacccgagattaagttcaaacaacaacaaccaacnattaccagttgggggaaccacccaaaaggggctgcaatgatttccccaagcttggttggctcaaatgaagaggaaaacgcaccaacagtaagaaaatcgttggactcgactgttacgagatcgaaatcgttgagaaaacattctaccgttgcttcacaattttcaagcaattttgcaatgaatggttggtggttagaagatgaattacctgatgaattggcttctcaacttggatctgatttggtttatgaagttgatagtaatgctctcgccaaaagaggaaacagaaccgttgaatacaaagactattatatattgtggtatgatttatctcaattggtaattgaagttgcttacgacgttaatgattctgaaaattctgcacgtttgattaatcaatatgttaaacctaccccaccattggggactggacaagctttccctattttagatcaagctacacaattattgggggatagagtggataatgatttagttcgctatctttttgagttgaattcagatattttaccaattattggcaacaaatcgtttggtgttacagtttataaagttgtcagaactccatcggttaacaattctacaaaattaggtgaagttcttcctggagatatattatatattaaaggcgggaatttttcacataaagggttaattggtcataaatcgactaccttgggtgaaggagaaccatatactgctgtgatatatgaatttgatcctgtaaaggagaaattcaaagtcatagaacaagatcaatctgggcatataattaaaggaagttacaagattagtgatatgactagtggtagattaagagtatttagaccagttggaagacaatttgttggttggtaa

SEQ ID NO: 978 - DNA, 1605 bp, Candida albicans
tcactcgacacaactatgagttctgaagatcaatttacttctattcaatgggatagagatgatggcgaaaatactaacaacactccaactgatacaactattaaatcaaagtcttctaaatctaaaaaatctaaaaaatcatcatctaagaaaaagaatgggaataaaatatctcctctgtcaactactgaaacttctgatgctgatgatacaatgaaagaagtgacagatcaattggaatcgacacaaataaatgatgataatcatgaagtagatgacggaaataaagagcaaaatgttgatgccaatcaaattggtaatagtgatgaagatccaacaaattcattgttgttaccagtaaatcctcaacctaaagaaccgcaagaagagaaagaagacttacaacaacaattacaacaaccacaacaacaattggcatctatacaacaagaaccagcaccaattcaacctcctttcaatgcagttgtgaatgatgaatcattgtcaattcaacagcaacaacaacaacaacaacctactggatatgttgatatttcttattatgaaaaatattctataaaaacaactgtgactcatcctaatcgtgatttagatactgcatcaaaaccgtttatttcatatttggtcactactactactgataatccatctatattaaaattaactaaagagaaaaaacctaaacagggagaggaatatttgacatttagtgttagaagaagatatggagatttccgatacttgtatgaaagtttaagtaatgatttccctaccgtgatgattcctccattaccttcaaaactgaatttcaaatatttgactggtgatacattcagttcggaatttgttcataaacggttacattcattggatagattcattaggtttattttacaacataagattttatctcaactgtcaattttccatttatttatttctaattcaaatgattgggctacattcactacatctttaaaacttaaagattcaagttctgatgaatcaggaattgttggtagagtagttaatgaagatttaataactgaaaccgtgatgaattttttaactccatcaaaacataaaaaggagacaaataaagatattttagaaattaatgataaattgaagaaattatatgaaaatttaattaaattagataaaatttttactaaattaaaaaaaaaaaatcatgaattaggtaatgattatgatcaatttctgaatcaaattttaaaattatcatcagtacaaaagggtgaagattcaatcatgacaacaaatttcaaaattttttccgattctttaaattattttctgaaatcttataatgaaatgtatcgatacattgatgaaaattttttgatttctttacaagatctagcgaaattttgtttaagatttattcaattgattaaattaaaaaatgataaatctactgatttggccgtattacaagattttttaaataaagaattagccaacaacctgggtggtagtggtagtggtagtggtagtggtggtagtggtctccatcaaccacctaatccagttattagttcatatcacagcgcctattgttaa

SEQ ID NO: 979 - DNA, 1176 bp, Candida albicans
cattcatggtgtcaattgatagagattttggttactgacagtggaatcaattcgctgaatttcatcttggaagtgttgcaagttattattcccaaaatcaatgactattttgatgtggacatactgttttctgaagaaatggtttcattatgtgttttattgtttgatctttatgatcagctgactcttgcggacagaaaaggtgaagattttgcacttggaattgagagattgatccccttatttcagacttgtattgcaggtattcttaattctaactcaacacccagcttacgctcagacttgtatgtagttggcaacaagtttttgttaaaatgttttgagagagagtcgtttttgaaacaagtgatgcatatcatcaagtcggtagataaaaagtttttccaggtgatttgtaatgacgctatctactcagagggtccatctagaatcacttctactttattcctcgagtcattagttcacttagggactttggtcaaggttgattttattttgaatgcgttgatcaaaaataacgcattgctgttgctagtcaggtcagttaagcggactgatgccatgatcaaattgtgccaggaaaaaaattcaggagtgactttagatcatttcatatttgacttgatggcattcaaagcaacgctatatttttttgttagagtggccaaatcgaaaaacggggcattgcagttgattcaaaatgaattgttttcaattttgcatcagtcgaagtttttgcagattgatccagatattggtttaagtttacgaattgaagaagttcaagatcacaagactgtcaatgtaaatgttttgctagatactccactttcgataactgacttggtggatccatacaagttgcgaagtgaaaacactatatcatattttgagttccttgtaccaatatttcagctacttacaacagtgttattgtcaatgggaccaaattatcaacctgcaattattcaaactagagaacttatgaagagtgtaaatcgattggtggtaggtgttatgaaaagagatttcttggtagagaccaaacaaattggtcaagggttgtacaaggaagagagtcacgagttggtatcgttgaaagaattggtgaagttgtttattttgattgattcattagctcattatagtgtgtag

SEQ ID NO: 980 - DNA, 1131 bp, Candida albicans
aattgttatagagttgccgaggattcattgttcttcatttcagggtttaatcaattactctcgccaattgtgaagaatttgaacattaagactgaaagaagcaaagaaatcaaatccgtgtataacactagattctcaccaatcattaaagggtttttaaaattcgataatttgatcaatggtagcaggttccttcaagttgatgctagcattcaaagcacaaacaaccccaaatttattgatttgccaaatgttttcgtcagtgatgactcgagaattatattgacgaacctcattctaacctttttaggcgattttgttaccaacgatagtgatccgtatattagatatgagatttggcgtttagtcgatcgatggatgtaccaggggttgcatagtttgccagaagataagaaagatgatgcttttagacatattaagagaaagtatatcagtaagaaaaatgtccccatcaatcaagcattttcaacaaacctaactcatcttagtcagattgggaatttcactgtcttggtgaaaaaattgttaaccccatacgcagatagtaatgaagcattcaccaagtactcgttgttgtatccttgtgatttaggatcagggtatagattcaacaaccaacttggaatttggccatacattgaatttttaatgcaaaatgtgtttgcaaactctgctactattgctaataaacgagatagggtcaacttgcaacttaatttgctagaattatttagcaatgcattacaggaagttgactggaagtttcttattgatgtggcaccgaaaattattcgtgacttgaaaaattttaatgggatatttgactcgcttattcctggtgttcaattggactttgaagtgtttgtcaaattgcatcattcagttgctgtgattaactatctatttgaaaacaagacattttctgctttgtttaagcttgttaatattggagttgattctgtgaatgaatcaggtgaatcggctgcattagtgtcacatgcccttgggttgattaattctttgttgagagttcaaaattcttttataaacaagttgttaccaatattgcgaaacaaagatacgcagcaacaattacattgtgggtcttaa

SEQ ID NO: 981 - DNA, 1062 bp, Candida albicans
gtcgctcgattgtgcgaagcaaaaaaaaaagaaaaatttgtagacatttttctttcaaatcatccgtcattctttatttacatcccactcaaccaacgacaacgaacaagaatgagtggcatatttaattggtcgctggatgtgtttgccgatatttataacaccctcaagtttgagtccaatatagatttggatacaatcgacttcaccagcatcaagaatgatcttgcaaatgttttgattacaccagtccctctggatcaatcacgtagcaaacttggagacgcatcaaaaccagtggcgttgcccagtggagatgaggtgaaattgaatcaagcatcaattgaaattactggagttttatcaaatgaattggatttagatgaactaaatacagcagagttgttatataacgcaagtgacttgagctacaagaagggaacgtccattggcgatagtgctcgattggcttattatttaagagctcattatatactaaacattgttggatacttagtttcgcataaacgtttagatatcatcactaacaacaaccaagtgttgtttgacaatattttgaaaagtttcagcaagatttatactttgagtggtaaattaaatgacatgattgacaagcaaaaagttaccggcgacatcaacaatcttgcatttatcaattgtatcaattattccagaagtcagttgtttaatgcacacgagttattgggacaagttgtatttggattagcggataattattatgagagttatggcacactaaacaactataaatccttagtggagtttatactgaaaaatatcagcgatgaagatgtttttgttatccattttttaccatccactttacaattgttcgagaaattacttcaactaggtgaggaatctttagtcgatcagttttacaagactataacctcttccatactaaaagattatgaagccaacaatttttccaaaagtgaagatattgacttgtcaaaatcaaaattgtctggctttgaaatagtcacaaatattccccacgggctgagatacgcgtct

SEQ ID NO: 982 - DNA, 711 bp, Candida albicans
agagtcgatcagatttatacaaggcaaaagacgtacttggattatataaagtgttccctgccgatatcaacgtcaaatcagaagatgcgatcgatgattcttcttgctggtggtattatatgtgttggtagaggtgcctataaagagtatttatctggtgtccatgaaggattattaggtccacttgaaaagccacaaagtgtgattgatgaagaaactaaattggccgaagaaaagaaaaaggaaaaagaggagaatccagacaaggatgatgataacgacgaggaacaaagtaatttgaagccagtcccattgaggtacatcaaaccggaagattatgccaatgcccaactagccccagagctcgatttatcaacggttgtaaaggatgacaagggggtgcctgtattctttgaacaaccagtgtacacattcccattaccaaaccttgttggattcaccaatattccacgtaaaatctatcgatactttaccaaaagatttcttgttgacgactttggagagagaacagctactattgtaaataataaatcgaggccttttgtatataaggacgtcttaatggccaaagaagaagaaatggattggcctaaaaagtgggtagaaaagggtaaagaacgtaactctgaatgggtacaggagttggaacacgatgaaagagtaacatcgcgaatgaaggtgtttgaataa

SEQ ID NO: 983 - DNA, 663 bp, Candida albicans
gatccccagaataagctacacacaagcagcacaacgactatgccagatgcaaatgaggtcaagcctaaaaagggctggtctaatcctgctttacgaatgatgggaataccaagaatatctttaccttcaagaaactggatgattttttggacagtagtgacaactattggtggaggtattgcttatgataagtatgaacaaaagcaaatgagaaagaaatggatggatgctgttaaacaatttggtgaagtgagttatggtgcagatgagatacctcgtaaacttactatttttattgcaccgcctcctaacgattttttggatgaatcattgaaactattcagaaagttcattaaaccagtattgaacgcaggtgtggttgattttgaaattttcagtgaatctagacagggtgatattcgagcatctgttgctgaaaagatcagagaattgagacgtaaacaattggttgaagagactcccaagaagaatgaatcaaatggaaatcaagataatgatgaagaggaattgaagagtcgatcagatttatacaaggcaaaagacgtacttggattatataaagtgttccctgccgatatcaacgtcaaatcagaagatgcgatcgatgattcttcttgctggtggtattatatgtgttggtag

SEQ ID NO: 984 - DNA, 699 bp, Candida albicans
catttcaaattcaattacttttattcaactatgactcaaaaatccattaaagtttgtgttttctgtggatcttcatttggtaacaaacctgtatacgctgaggaagccagtaaattcggtaaggcattagctgataagaaatgggggctagtttatggtggtgggtccaccggattaatgggagccgtggctagtggatgtgccactaatggtggatacgttcatggaatcatccctgaagcattaatcagtagagaaagaactgttgatgaagaagcattcaatgctaaattgaaatcatcaattgataatcatgatggctcaactccaattcctgattctaaacaatatggcaaaacaacactagttaaagatatgcatactcgtaaaagattaatggctcaagaagccgatgcatttgtggcattaccaggtgggattggactgattgatgaattggcagaaataactacttggtgtcaattaaatatccatggtaagccaattgtggtttataatgtcgatggttattatgataatttttttaaaatgattcaaggttttgttgattgtggatttttaagtgaaaaaaatggtcaaattattaaagttgctaattcagtggaagaggttcttgaaatcattgaaaattatgaaatcccagaaggtagattcaatttgaaatgggaaactacttag

SEQ ID NO: 985 - DNA, 666 bp, Candida albicans
tatcaacaacaattacaagatgaagcaagatctcaaaacattgaatcgatacgtgaggtgaaatattctgtgaattacatgagtaaacacgttcaaaacacaatacataaaatcactccgcttattttaccttatatgttaccattaaccacagtttatatatctgaatacgtgatcaatcaaggtatctcaccaacgttgttattccccttgaaagaggtaccacggtggttgatatcaagttatcgagatatttatgttgtctatgggtttttataccaattgggggttttcatttctcgatcatcagtgacaatgggaatcagaattaaaagattgtatttgttgtcggtattacagtttataaatgtaatgatcacactttatcaatctatatatgatttgcctttccatctgatttggtggttatttttattaattttttatgaaggattgctaggtggagcaagttatgtaaacacttttaaatcggttagtgaacaggtttcaagaacaaaaagagaatttagtatgggatgtgtaagtattagtgattccttgggtatagttattgctggatgtatcaattggtggttggaattgaaattgtgtcatttacaagtggctcgagggagagattggtgtctcaaaggggggtcactataa

SEQ ID NO: 986 - DNA, 2040 bp, Candida albicans
ttgtcgcacgctgatcttccagccgcgtggtggaagactattctaaatgtagctgatgatcaagacgattcacagggattacataaccaagactcgtgggttcatcaatttagacatgcaaataataagacaataaattttttcggagatgacacatggttaaaattatttcaagatcaatttacagaatttgaagggaccaattccttctttgttagtgatttcactgaagttgataataatgtgactcgccatttagacgatcaattgagtagtaacaaatgggatgggttaattctacattatttaggattagatcatattggccataaaggtggaccagaatcaccttacatgaaaccgaaacaaatagaaatggataaaattttacaaagattgtacacatacgtcaccaagaatgacgatacattgatagttttaatgggagatcatgggatgaatgaaataggcaaccacggtggttcgtcacctggtgaaacatcagctgcactttcatttatttctcctaaatttaaccacaaaggtgaatcaccattaccgtataattcagactactcgtatcaccacaaaatcagccaaatcgatttagtacccacattagcagctttattgaatttcccgattcctaaaaactcacttggtgttattgccaaagagatactcgagatttggcccgaaaaccagagaatcaaaatattattagagaattgtgcacagattatgaacttgtatgaagcaaaatatggaccatcaggagaagtttggacacaatgggaaaatttacaagctaaacaacacccaattgctgattattatgaatttcttcaggatattcaatcagaaatggcttcttcagcaacaaattatggttataaagacatatatgccggtgcattaatattagtaattactgctctagctgtgattgtggtgtttaatcggtattttttgacagcatcaaatatgaatatttcttcagtgatgttttatgaattgtttgttgttttgtattcattgcatttccatggatcatctttaatcgaagaagagcatcagatttggtattttttcacaacagcaacacttttgtttttagcaattaccttttttgatacatttaaaagtttacaaaattttatttcctttggagttttatttgcttgtattagatttatgagatcatggaacaatagtggtcaaaagtattcttctcaatacaacattgcttattacttgtcacattctaatccaaatttaatgtgggggcttataattttaacctattttgtgcttactttgtgtatatacatacaaggaagcttagtgccaacatttgcattttcttttgggaaacgattaccagatgtgaaagaccctggtgggttgatttcatttattgttgtatttgtggcaacttcagtgtcattcctgttcaaattattgcaatactacattgatggtaacacaataccaaaatggctcaatagatttcttttgtggattatagaatcacatcatatagatttgtcaagtgcaactcttgaagataatgaattgaagtttcaattacaaagtgttagtatccaattatcaaaattcaccacaattattctattgctattggtgatttctcgtgtgataattggcaaaatcagaaaaatccgttatggaacaatcactgatattacaaacattatgacaatttaccttatacatcaaactagacatgaaaatatcccaatttttttggcattgatgtttgccaaatttgctttatcaaaattaatttatcgcaagaccaatcgaattgatcaatatattttaacagtgacaatgactgttctttgtttacaaaatttgacttttttctgtatgggtaacacaaatctgttagctactgtggacttgtcaaatgcatataatggagtcaaggcatacaatgtatttttggtggggttattgacatttgtatcgaattttgccggagtcctcacctcgggattggccgatcgccgtaaa

SEQ ID NO: 987 - DNA, 453 bp, Candida albicans
tcaatgtccggttcactaaattctagatgggttgttcaagtctctttgactataatcaatataattggatttcttgtatttctaagaggttttttcccatccaaagttgtacttccggggttcaactcatttcaagattcaacgaaatctccattttctgatcaatatggaaacccacaattcaacaaatttattcttatggtagtagatgcaatgagatctgatttttgtttcagtgacagatcaaatttcctgtttttgcaccaattgataaaccaaggccgtgccttaccattcactgccttttccaatccaccaacagtgacattaccacgtttaaaaggtatcaccacaggaggtacaccaaactttttagacgcgattttaaatgtcgctgatgatcaagacgattcagtcttcaccacggggctggaaggacacgcacttgcgtaa

SEQ ID NO: 988 - DNA, 975 bp, Candida albicans
tcaacaatgtctaataaaaaagatcaagattctttcacctccgacaacagtaataacaactccactaaagattcagaaaagtatactgagagtattgataaaattgtttccaacttaggtgcattaacacattcaattcttgatgtgactaaagatgtgggtaaagatttgaatgcaaaggcgaaaaagttatctgactcatggctttcaagaatttatgacgatgaagaagaagatggaagacttttcgaatacccttcattttatcagaataggggttatttggaagatgaagtaaaatcccatccaatttttggtgacttgtggaatgttttcccatttctgcagtttggacaattttctggaagctttaaaagtggatcaactccctttggatattatgcctatcatggcccatcgattcggaactataatgaatgcttgactaaaaatggaaaatcagtttgggatgatcaagggtattggagatgcctctttccaaatagcgaagtccccgtcgagcttttgaattttaaaaagaagtacttgaaagacgaaatattaaccaaggaagattttatgagtgcaatgagaaagaactcagcattagatagcttccaaggtgatggtatgattgacttgaaagaacatggccgattcttcgactcatatgataagtatttgaattggaagaatgagcaatacaaccaaagagtcaaagaaagagaagcaaaatggaaacaattatctcttaataaaggagacaattttgctacaagttcttctttcagtacatcaatcaaatccgatatgtacactgattcagaaaccaatgaagtcaagtttacaaaggttaaaactgaatgtgacgcagatggtaattgtactgtaacaagaattacaaaactgaaaccagttggatcctctgtgtggaccaatgaggaagaaaatgttgaacatgtcaaaaaactgtaa

SEQ ID NO: 989 - DNA, 279 bp, Candida albicans
acaagtataccgaatctacgagccatgagaagagaattggttccgttatgggtagcattaattttaaaatcacaagacaaatgtagtatagttccaccaaaatggctaacagtggcatatttaaaagaacgataccaagatgaaatacgtaaaccactacaatttagtgatttaccttggaattggttagaactttctaagatattacttgaaaaagctccagatgaattactggatcccgttgaatcaataaacgtcggtgattcaagatttaggaga

SEQ ID NO: 990 - DNA, 204 bp, Candida albicans
agatacggttcagaaaatgtgtataaccatttcacggcaattgtgtggaacaacactaattctcttggttgtgcttacaaatcttgtgatactactactaatttaaatgcattatatattgtatgttcatattaccctccaggaaatgttattgggtattcctcacaaaatgttttcccattaaattcaaagatggtcaactaa

SEQ ID NO: 991 - DNA, 420 bp, Candida albicans
aaccaaagacgtgctagacatggtgttccagatttgacttgtgatgttactgtttaccaatatgctcaaaaatttggtgatcaatacagttgttgtggtaacttgcaacactctggtggtacatatggtgaaaacttggctgttggttatgctgatggtgctgctgctcttcaagcttggtacgaagaagctggtaaggacggattaagctacagttacggtttttcttctgtatacaaccatttcactcaagttgtctggaaatcaaccaccaaacttggttgtgcttacaaggattgtcgtgctctaaactggggattatacgttgtttgttcctacgacccagctggtaacgttatgggtactgatccaaagactggtaaatcttatatggctgaaaatgtcttgagaccacaataa

SEQ ID NO: 992 - DNA, 879 bp, Candida albicans
aattcgaatcaattcatacccaccgttctcactgcccttgcctttccactcgctactacaactatgaagataacaaatactttacttaatgctgctgcattattagcagtcacagaagctgccactatcaccaaattctttactgcctcaactcaaactctttttgtcacccaaactagtcaaaccgttgtggccaccaaatcatttgttgaaacaatttattcagctccaccaaaacaactcactagtaaaactcaagactctacctccccaactactagctccgtcaactcattaaccagtagttcggccacttcatatgtcgaaactacaactccagctccatcttcgtcaactttgacaacttccactatatcttcatctactgctagtgaagattcagacgctacacctaccgccgatgttgaatttgccgaggaaattttgaaagaacataatgtcaagagagcactccatggtgtgcctgcacttagttggagtaacaaattagccgaatacgctcaagattacgctaacactggattcgattgtagcaatcttaacttgaaacattctggtggtccatacggtgaaaatttggctgctggttatatgggtggaattagtcctgttgatgcttggtatgatgaaatctccatggttgattggaacaatgtcgatttcactgagtctaccggacactttactcaacttgtatggcgtagtaccactcaagttggttgtgctaaaatgatgtgttctactgcctggagacaaatcactgtttgtgaatacttgcctcgtggtaatgtcattggtttgaatgtcacttcaggacactcatactttgttgacaacgtcttgccacctttaaagtaa

SEQ ID NO: 993 - DNA, 990 bp, Candida albicans
gtggataaaagagataaaagcaaaagaagaactgtcatgaaattccttcaatcttttccggttattcttgctgtattttcatttgcagcaaatttagtcagttcaaaacttgtgtatgaatatgaaacaaaatacgtcacggtagaaattgtcacaatagtaagtggggagactacttataccacagaacgacttgaaactaatggccctacaagtacaacaacaaccatagtgattcccagttccaaaccatcaagtccagaatcaaaaccaaagtcggattctcagccaatgtttcaatcaccatcaccagtacaaataacaccaagtaccacatccatcaataatgcccccctgccaactaaacctgaaacaacagtaactgcaagtcccgcggttattgctcacacatcagtatttgtagtcacaccaaattcagcccctactacttcatcatcaccacccaatattgttcaacaggtgaaagcagcaataacaccactggcacccaaaccgcaaccgcaaccgcaaccgcaagaaaataattctggaaccaatgatgatagtcaattatcactgtttagtcgccaaattcttgaggcacataacataaaacgagcaagtcatggagtgaatccattgacttggagtaatgagttatacaattatgccaacaaagttgccagtagttatgattgttcaggcaatcttcgtcataccagtggaccatatggagaaaatttggctttgggatattcctcaggggctaatgctgttagtgcttggtattctgaaggatttaattttggcggtgccggaaagttgaatcattttacacaagtggtttggaaatcaactactcaattaggatgtgcttataaagattgtcgggcaaaaggttgggggttatacattatttgcaattatcaaaagccaggtaatatcattggacaagaacttgctaatattttgccattgattagatcgtga

SEQ ID NO: 994 - DNA, 1131 bp, Candida albicans
acttttaaactttcaaactttcgaactttccattattatcaaattattctagaaatgaagttttctcaagttgccactactgctgccatttttgctggtttaaccactgctgaaatcgcctatgtcacccagactcgtggtgttactgttggtgaaactgccaccgttgctacaactgttaccgttggtgcaactgtcactggtggtgaccaaggtcaagatcaagttcaacaatcagctgctccagaagctggtgatattcaacaatcagctgttccagaagctgatgatatccaacaatcagctgttccagaagctgaacccactgccgatgctgatggtggtaatggtattgcaattaccgaagtctttaccactaccattatgggtcaagagattgtttattccggtgtttattacagttatggtgaagaacatacctatggagacgttcaagttcaaaccctcactattgggggtggcggcttcccttcagatgaccaatatcctacaactgaagtttctgctgaggctagtccatctgctgttactacttcttctgctgttgctactcctgacgccaaagtcccagactctactaaagacgcttctcaacccgctgctactacagctagtggctcctcttctggtagtaatgactttagtggtgttaaagatacccaatttgctcaacaaatcttggatgctcacaacaaaaaacgtgctagacatggtgttccagatttgacttgggatgctactgtttacgaatatgctcaaaaatttgctgatcaatacagttgttctggtaacttgcaacactctggtggtaaatatggtgaaaacttggctgttggttatgctgatggtgctgctgctcttcaagcttggtacgaagaagctggtaaggacggattaagctacagttacggttcttcttctgtatacaaccatttcactcaagttgtctggaaatcaaccaccaaacttggttgtgcttacaaggattgtcgtgctcaaaactggggattatacgttgtttgttcctacgacccagctggtaacgttatgggtactgatccaaagactggtaaatcttatatggctgaaaatgtcttgagaccacaataa

SEQ ID NO: 995 - DNA, 1668 bp, Candida albicans
aacagccatgatgttggtgaggatgatagtagtagcagtgacaatgagtactgcgatgctctggaagagtttgatattgaagataccctcaatctccctccacctcaaatccactctagtgcacagtctgtgctttcatcaattgaaacatcaccaagtctggcccaaaacgcttccgacaatcatttgcatgtgtccactattgatgaatatattcattctggtgttcaattatgtttcggtatattgcaagttgtcttgtctttaatcccacctgccattgggaaagtgttgtcaattgttggttttagaggagatagggaagttggtttgaggttattgtggagaaccgctataacatgtagaaatgtacatggtgaattggcattgttatttattctagtgttttatgatgggccagtgcaatttgttgataatggattccgtttgccagatcaaggaaatgacaaaaagatcatctcattggataacaaagcaactgtttcggaagcagagttggatataattttagagagaccagaattgtacacgagtcagttgttgcgcagagccagaagaatgtttcctcataatgctctttggatattacaagaagggagaatgttggccgcagaaggggatttagctttggctactaaaacaatgcaagatttcactgatgatccagccaatgaaatccaaatgcaacaggctgaggcattgttggtctttgaccgtgctacaatctatatttatcaacacgagtacgacaatgcagccagagatttaatttatttgattgatattaactcttggtccaaggctgtgtatttgtttatggctgcttcttgttatttggaaaagtatagaatgattaaaatggatatcatttcagttgacaataaagaatcggaaatggccaagtactcgtcgcttttcgataaatatcttgatcttgctttgagttatgtgcccggtcatggacacaatgctgttggcaaaaaaggtggtattggtggaagcaataagcaaatgccatttgacaaattcttattacgtaagagtcgacatattgaagctagaaaaaagaagtatccaaatttgcctactgccgatatagtgggaacatctttgattcatgaattgatttatttttggaatggttataatcgaatgagcagtcatgatttggagattgccttgaaattgttaggttactcgggtgcccctaatagtgagtactctgctaacactaatggaaatttatacgcgttgatagaagaaacagaagacgaagcgatgattagatattttttgcaaggaataactttgagacagttgggtagtatcaatgatgggttgggtttgttagataatcatgttatttccaagtatgtcatatccgaacctcttcatcaattcaggttccacaagatgacatacagtccatatatttatccgactgcattgtatgagaaaacaatgtttgtttggctattgaggactaagaatactgccaaattggatgtacatcaggctgtccaagaaagtaagagctggctcaaacgagcagagattgtgggagagggtgattacgaattgagtaatagaactggtatgagaattaaagctgccggtgatagattagagcaactagcaactctttag

SEQ ID NO: 996 - DNA, 882 bp, Candida albicans
tacattgttgataatcgaataagcatttttcacatttccagatcaaccgctatgcttaaaggtttaagaaaaaaggcatcaatattgtccttggggtctatggcttcccagcaatcaacatcgtcagcaataaactcagaatccaactatgacaaaatattgactcaggtgtacgattttgaaatagcgcttaaggccatggactatttattggacgataggaccaaaacagggacagacttgttacagaatgaagcatcaaaaaacaataattctgaacaaccacatgctattttcccattagcattaggagtaatggaatttattgaagctacattagggtttgaaccagaagttatggcaaaagcccataaaacattatcagaagccgagaatgcctcgttaaataattcaaaatataacctcaagtatcaattggctacttccatgatttaccccccaggaactgagttccaagtgacatttgctgagtccactttattaaatgcattattgatgttgttaacagaaaacaacgggatggtagaaagtgccaaggcgttgtttaagttgcgtcgtgcttatcaaactttggatgctgtgtataaaaaaatcaaggagctggaaccaattttcaacaaaaacttggccaaattgaaaaaagaagcagcaatgcaaggaaatggtactaagtcaaacagcataataactacagaaaacttttctataagtactgttgatctacctggctatagttcgcaaacaagctccactagttcccttaccgcaagatatttccgtgatgaagaatttggagaagatttatttgatgaggaaatcccgaatcgaaggtgctactttaccatattatgtgaaccctga

SEQ ID NO: 997 - DNA, 3030 bp, Candida albicans
acacaccacaacacaacagataatccctcaaactgtctaatgaatatacctaattcaccattattcgcgccgcagcaactttcaaatcataatagcacacctactaattccagtaatgacaaaggaaccaccatcacatctactcccacttctaaaaaccatctaaataaatcttcatcttcgtcattagcggtgttaactccaactttgcctgaaaaaccaactgtatcaacttcatcattggcagtatacattgttccgtcagaacagaatctatttgtgcaagggtttgaagagcatgtatatttatccagaccaccaactatattacgaggatccttagttgtgaaagtgttaaaaccaactaaaatcaagtcaataagtttgacatttaaaggaattcaaagaacagattggcccgaaggtataccacccaaaaagaaccaatataacgaaataaatgaagttatcacccacacttggccatttttgcaaggaaatatcaacgacaagttaccccacaatggcgctgattatttcattgaaaaagacggaacaactcaccagggtggtattaatgctagttttgaagatgacttgtcatctgtgaggtcaagcacaccacctccattggggcatctggcaaccagtccatcagctaatctttctcctacccggaaatcacactatgacgaacaatcaagtaacaatgcaactaatttcttcactcgtaatttatcaccaagttttattcgaagagggaaatcgtcttctatttcttcaatggcagagatagggaaagccagttcattcactgatttgatgccatccacttcttctcctagtcctggtgacggtcattcaaacattattcattttgcccctggcgattacatttacaactttgaacatccattgccagcatcgatccctgagtcatgcaatgcgacattcggaagcacatcatattatttagaagtgaatattactcgaccaggtgctttcaaaaccaatttagctggcagattaccaataaatataatcagaacccttgctgaaacaagtttggaagaaaacgaatccattgttattaccagagattgggaagatcaacttcgatacgatatagtgataggagccaaatctgttgtgttggatctgtatttacctttggcgttcaggtttgtgccactttgggggaaagtagctttacacagaatcagagtatacttgacagaaaacttggaatattattgttctaataagaaagtacaccggatggaacctgccaagaaatacttgttgttagaacataaggccaaaaaggggagatcgttactttcatctaaaaaccccgaggatgaatcatccactgatagtttaaatgatttcgatgatgatattttaccgaaagaactagaatttcaattattcgtacccactgaattaaacgcaagaaccaatagccgtcttcatccagatacatcctatgaaaatatccaagcccatcattggattaaaatttgtttacgtatcagtaaacaggatccagagaatccagaaaagaggaaacattacgaaatcagcattgattccccgttacatgtattgagtcatttgtgttcacacaacaacacattattaccagcttacgatgacctaattccggggatgtcattggttcacaaccaaagtgaactcccacctctctcacctggggtcacacctgttgaacatacagcaagacctcgtaatggaagtgttggcaaccaaatcttgggtattttcaacaataatggcagtaatggaaacagtcaatcgcgtagtagtagtgtgccaccagaaaatgaaaacggtcgtccactgactccaatagaattccatcatatttcttctggtcttgaaagcgctggtgctgttgaaagagaggccgatatgcatttagaagctaatttgtacctgcccaaagaaaacgccattactgctataaattcaccacaagcattaccacacccggacacgttctcatcaccagtacttctgctgccagtgcaacgaccaattcatttaattcggaaaccatcagtcaacccacctccctttgatgcagatgtgccaccaccacctgccacgattcctccaccagcatacgaagaacgagattcaggaagtagacgtggttctgttggttatgggagagggttatctgataatagtagtaacagcagatcattaagtttatccccattgagaatagacgaacccagtgaagatagaaacaccacttctactagacctaatgttgctactaatggcttccactctaccgctgcagctagtaacactcctgttagagatttattgattcaacaattgaatggttctggaagctccagtcttgttacgcctactgaattggttgagcctacaactagaatcgacgacaatattccaattgacagttctatcccacagattgaaatacacaatgaaaataacgtggagatccatggcaccgacgcaagtaccatatccaattcttctgcccgtcgatcaagtgttaatagtgaacgtggcggcactattaatggacacagcgaggacagggcactgaatcatgaaactgaaactgaaactgaagaagaagaagaagatattgcagattatccttcacccatactaccacctacagcaatacatggaatggcaaagatatcgcgtacctcatcagccgcgtcagctacgtcagctgcatcagtaaactctgcagagattcccgtggaacaaactattccactacttagtcttgttccgtcgcacaattctcaagctaatatagattcttataataagggtcggaatgagtcaacgggttctttgttgtatgaagttgctaagcctaccgaattttataatgggttagagtctagtgctggtgtcgataacgatttttttaaggtaatgagcagtagtttaagtaaattacggaatcctcggcttgctaaacattatcaagatcaacaaagttga

SEQ ID NO: 998 - DNA, 1467 bp, Candida albicans
gttgttaccatgtcatcgtctttaaaacaattgaaagaacaatttgtctcagatttgactggtggcacaattgaagaaatttatgctgtaaccagtatagcattatcatcttatttgtcctttagattgttgaaaaagtctcttggtgatttagctttgatttacgactacattcttaatgtgttgacaattctagcatccattactgtttatagcaacagcccttcttatttgcattattttattgttattccatcattagttatatatctagtgaattaccatgttgagaaaccatcttcaccccatagacaaaatgatacaaaagaagataaatcggacgaactattgccgagaaaacaatttataacagcctatcgttctcaaatgttgataattactaatctagctatattagctgttgattttcctattttcccaagaagatttgccaaagtggaaacatggggcacgtcaatgatggatttaggggttgggtcgtttgtgttctccatggggttggctaattctcgacaattgatcaagaaccacaccgacaactacaaatttagttggaagagttatttgaaaacaatcaagcagaactttatcaagtcagtgcctatacttgttttaggagctattcgttttgttagtgttaagcaattggactatcaggaacacgaaacagagtatggaatccattggaattttttcttcacattagggttcttgccaattgtattgggaatattagacccggtgttgaatttggttccacgcttcataataggaattggtatctcaattgcttatgaggtagcgttgaataagactggtttgttgaagttcattttgagcagcgaaaacagacttgaatctctcatcaccatgaataaagaaggtattttttcgtttattggatatctttgtatttttataattggtcagtcttttgggtcatttgttttaacaggctacaaaacaaagaacaacttaataaccattagcaaaattcgtatttcaaaaaaacaacacaagaaagagctgctgctgtttttctcagtcgccactactcagggattatatttggcatgtatcttctatcacttagctttcagtttgttcatcagcaacttatcattcttgcaaccaatttcaagacgattggccaatttcccctacgtcatgtgggtcgtttcgtacaatgctacgtttttattatgttatgacttaattgaaaaatttatcccggggaaccttacttctactgtattggactctattaataacaatggtttatttatcttcttggtcagcaatttattaacagggtttattaacatgtccatcaacactttggaaactagcaataaaatggcagtgattatcttgattggctatagtcttacttggacattgctcgccttatatttggataagaggaagatctacatcaagctttag

SEQ ID NO: 999 - DNA, 465 bp, Candida albicans
attcttttaatctcatcagcaatagtttattacataaattcaacaacagattatttccctcttctttttttttttgcttttacctttgtttgttatttactattttataaaatgaaggggtaccttatcttgtataatagtgtgtcagcaatcctctggggatatattttatttcagtgtttccgcgattggaatattggttattatgaagttgaagaaatccctcataagttcatggtttacacccaaatattcaattcttcaattgagattttccattctatgattggcttagtacctaccccaatcccaacattattgttacaatcattcgctagattgattatcatggttggtatttgtgtcgtcatacccgaaagtttagccaattatgatataacggtattttcaggattaacattagcatggtcaataacggaggttattcgatacggttttacgtta

SEQ ID NO: 1000 - DNA, 384 bp, Candida albicans
ttaattacttctcggtgtttacaatatgtcattcattacttttattatgcattcaaagtgaaaacaaagagttcatttcattttttgttttggttagaatacaataatttttacttgacttatcctttgggtttggtttctgaaatgattcttttattcttaagtcttgcctttgttgaacaagactcgatatatgattacgttttaagagcagcattcttggcttatattccaatagcatattttgcttggggtcatttgaaatcaagaaagaagaaaagatacaccgaaattatgaataaaagaaatgttagacaagtagcaactttagaaagtactactactggtactaagaatacctctattgaactaagaaatatgtaa

SEQ ID NO: 1001 - DNA, 936 bp, Candida albicans
tttgctaatttaactatgccctattcaaatcccgactcatcagtctccaatcatgacatgaattcagtgtcccccaaaaccaccaccacaaataatacttctccattcgccacactagcttctaccatggggaaaacgacaatagaccctgaaactgaaactgaacacaaccagggagaaggaaatgacgaccaagaaatcactatcaacgggaaagcaacagcactggaatcaactaccagaccaatttttcatgtaaattcattatctaaaagttggcattatgatacatcaaattcagcaagttctaaatcagctcctaatacaccgaaaattaaatctcaatcacaaccagtttcaagaagagcaagtgtggatgatattcatttccaacatattccatcacatcaagaaactcataattatagttttaaaaattccgttttaataccagctgcaaaatgggcctatctgccaatttcaaaaataagaggtctgacaagttctagtattaagaatacaccattacatgaagaatatttgattgaatattctgtattccgtcctattaaaggattaccagaattaaattcccataaagatattttaattcatttacgagatacaatagaatcagaaactaataaaccatttgaattccctgaaacatacatatctgaaattgatttccataatttattatttaaaatcacaaaaatcattgaaactgatcatatttatcctgaaagaataagtactggttcatcaggtagttattttatatttgatattgatttttcactttataaaattggtatttttaaacccaaagatgaagaaccatatggtccattactgccaaaatggacaaaatgggctcatcggacttttttcccatgttttttcgggagaagttgtttaattccttactcacca

SEQ ID NO: 1002 - DNA, 525 bp, Candida albicans
ttgaaagatgtctttatgaaagataatgattttaaagaaagaatgtggttaaaacaattggcagtattaaaaggtcaagcatttaatattgtggaaattttgaaattaacttatgctggtcctttagaattgacaagacgggagaatttattagttattgatgatataatgtatatgcctaatgggaaatgtgattatgattttatgaaatcgtctttatatgaaagtgatatttttaaaagttatcgagtcaaaagtacaaatagaaatcatggaggaggtgatgatagtgacgaggagggaggccaaagtgagacgattactcaaaatactccattgttgacacatcctcataatcattatcttgaggtgattaatgaatcaatggatgatactaataatgaatctggatatgaacatatgaatagagaaaacaacgttgctgctactgataaaggtaaaaaagttattattgaaagattaattaaagaaaccagtaaaccacctgttttcacttggtgttaa

SEQ ID NO: 1003 - DNA, 384 bp, Candida albicans
cttgttttaccttttcaaatggctcacagattattagttaacgtgatattcactggtgcttccgtctttggtcgtgctttcactgaagcttatagacaagctgccaaggcttctgctgccggtgccgcaggtagaccagccaaagctagttctgctggaggtatacctgtagaagaagcaatgaaaattttggatttagagaagagcgagttaagtttagataaagttgaagagaaatacgaatatttgttcaatgtgaactcaaaagaacaagggaattcattctatctccagagtaaagtatattatgcgatggatacgttaaagaaagagctagagtatttggagaaattgcaaaacgaaaagggagcggcgtccaattag

SEQ ID NO: 1004 - DNA, 2166 bp, Candida albicans
aataatgttcataagaataaaaatggagattcgcaatctgttgttgagtttgtgcatggttacatgaagtcgttttctgccgaagaacaacttgcaggaattgttgcattcactaaattgtggaatgatatacccctcaatcaacttgaacctggttccgaagagtttgaagttttgaataatcgcccagtttttggcaccacaattgcgacattgggccaatccggtttagctgtgttgagaaacgatttgttgcaatttttagatgaaactttgagttcagaaaataagcatgagctttcttctttgaagacaaagatggctttggttttaattgatgatgaagatagcgaggtttctaagaaagaactggttttagataaatttagagcaattacttcatttgccttggccagtttagacactttcacaaattcacatgctgatatcaagttatgttctacattgtattcattattgggcaatttattagatttgttacctttgaattattttattgattcaattgttgcttcattggatgtcgatactttgtcagattccttgtcgataaaagttgctagaaactatgcaatcttggcaagtagaaaatttgaaaccgaattgaatgttgcccactgtgaccaagttgttattgaatccgtaattaacaatttgttaccaatattgattaaaggaatcaagaaaaatgttgatgttgagttgcaacaggcttacttggatactttttccaccatcgttaataagtttggagcatcaggtactgaatttgcgctgagtgacgtttctaaagttcttattgaatctttgggtatcgttactacagaccgtggtttattgaatgagcaacccgaagtcatcattgcttccattaacgcaattacaagtattgtcaatatcttgggagttaagacacttggattgttccctaaagttgtccctcccgcccttaaaatttgggaatcgactaactcattgggggataaggagagtgctaaattattgcaaggttcagtgttagttttattatcgtgttacatcaaaaagattcctgcatttatgtcaactacgttagaagctgttttgcttactattttgtcaagtgatttgattgataaccatatcagatcaagtgttttagatttgattgttgaccacatggatttggctcaagttttgaaatccttatgcaacgtttggcttaccaagaagttttacacaaatgacaattctggtaacattggtttattcttaaaaactttacaagctacaataaataagatggagaagaagcaagccacaactcaggcaacattgtttatgagatggcttatcagtgcctttgaattcagacagtattcggaagacaatgacaacaaatttgataacaacaccatccatagattagaaagctctttccatggatgtgccatagcatttgtcatgaaattgaatgataagagtttcagaccgttgtttgcaaacttggtgagatgggctgtcgatggtgaaggtgccaccttgaaaactaatgaagtgtctaggttgttggcatttttccgtttcttcaacaaattgcaagatgaattgaagagtattattacttcatatttctcatacttgttagatccaacatcggcattattaaagagatttagcgaaggtagtcttgttgcaaccaatttaagaagaataattttgattgggttgacttcttcattcaaatacgatcaagacgactactggtcacaacaaggaagatttgatagcatatgttctccattattgagccaattgtccaatattgaggattccattggtaaatacttggtaaaatcagttagcacatttgttacagatgtttcctcagacgaatacaatgaaacgttggtccacgagttgatcaagtatatttctaatgccaatgaaaattctgctgctaccaagatctggagtattcgtacattgaaaacgattttccagaaaatgggagagcagtggttatcttacttgccaaccttggttccatatattgcagagttattagaggatgacgatgaagaagttgaaatggaagttagacgtggtttggttagagttattgaaaatgttttgggtgaaccattagatagatatttgagttaa

SEQ ID NO: 1005 - DNA, 603 bp, Candida albicans
acaaacaccatgtctagtttagcttcacaattacagtcaatcaatgagaagactgcttctgttgctttggatagaaagcaacgctcaaagttgcattcacgatcattaatatttgatcccaaacaagcagcaactcaggactatgaatatatttatgaaattgctacagaaggtcttgaagatttatgtgagttagattccagattcaataaattcaaactgacattgttttctgaaacttctgtcaacttggatagaaatttacaaacaaaagatgttattagtcaattggataaaaatattgatgccttcttgacattagtggggccatattatgggttgacatcatctttaaaagcagttgaatggcttgttagaagatttcacgcaaatatccataatgctgagttaatgattttaactgcattgccatatttccaacatccagtatttgtagaggtattgaatgtgattccaaaacaaaacttgccacaaatatttgaatggcttgtgggatataaagatcaattgaaaacaccacctgcgtcgtccattcttaagggcatgtcggcaatgaattttcaattttttcaacttttatag

SEQ ID NO: 1006 - DNA, 2268 bp, Candida albicans
gggcatgtcggcaatgaattttcaattttttcaacttttatagtaaatttttggaatgaccaaatcaaaaatcacactgtttataaagagcaattggttttctatttatctaatacggtacaacttttggcatccttttccaagaacattgaggagttgaatgaaactcatattcctgttgttcttgagactactgccttaatgttattaccacagcaaaaacccaaatactcctcgtctataaactcagacttgaagttgacatcatattcgattatttctgtacttagctcaattttcccattttccgctgatatattgaagtcgttgactgtaagcatattagaagatgaggatgccctcaagggatttaccaagccaactttaattgttttatcacaattatggaagcattttcaaggaaacttggaagtcattgaagccttcaagaattttaaaattggccaacatgaattgggtgttttagatgaattaaaaaatgaaaattatcaattgagtactttcattatattggttttcatttcgactttcccttctaatgaatcgtacaagttgttgcctttcattgatttgtcaaacaagacagtttttgaaattataaccaagttggttttacaaaactcaaccacacaggaagactcaattagatctaatttgactaagattgcccaatctctaaccaaatctgatcctaaattgttccaaacaactcttgaaagtgagaactggaaagtagacgagttagaattgaagctcatgtctgtacttgttgaaagcaagaatgacgaagctgagtttgatgcaggtgatgaatataatgcagtggaagatattgaaattgtaaagactgtcgattttactaaattgcaatctactgctaagagttactttaatacagaatacgatgaagagtttaatttggtattaaaagaattgaaaagtgttttgtccgcatccgatgctaaattacacgtttctgtcatattgacatttttgcaaaaagtgttttcaactcctgaagtggcattgacatttgctttccgagttgcattaactcctgcagtccccttgtctatcagattatcggccatcaagagtattagaattaaaattaaaaatgctgcaaatggtaaaactgacttttacttgttgatcccacttatattattggcattgtttgataattcaaaattgattagatcgggatttgctcaactcttacgattagtcattgaaattaaaactaaacttactactggtgctgccttatttttggaaagagagatttatgggtctgtttctgataagaaatacccaactcctcatgactccttgtttctttgcagtttgttgagtgaagacaatgttaaggatactgtattagacccatcaagagtcatcaatattttatttgacagcattttcaaagcaaagaatgggaaatcaaaaccaggaaagtacttcagatcatttatcttcactcagtggtcgttgtgctcattgccaattgttttaaaagcaaatgcttggaaaattgtggcacaagctaacaaagcaggaactgacgataggttctttttcttggatggagacattgagaattattttagcaagcgtaacgtttggattgatcaggcatctattgctggcattgcattctttgataatgccgaagtctcagttgttggtttagttggtggtgttgcttcaaatgataaaaatagtaacacagagagtgaatggttatgtagagcattggaaaatccatcaggtaatttacagatgacagctaataatcgtgttcttgaaacttttgacacattcaaaccaattgagtcaagattgaaaattgtcaataaattggtagatatattgatcaacgatgatattgttgagtttgatccaatggcaactttacaagaattaaatattgaccgcaatttattcttacaggctttgacgagtgtgcaaattggtgatcaaatcccagaacaaggtatcgctaaaagaagaagaaggtcttcaaactctaccaagcaagccatggtgcgagatgaaattaacaacatggcatctggacacttgaagaagctcacatttttgttagaaatattggaatctagtctgcgaaagaaaagaaatgttgctggccctgatttgctaaaggtgttattcaaaattttgactgacttggaatacttagggaacgatggtaacttgcctgttctttatgcccaagaaacatga

SEQ ID NO: 1007 - DNA, 465 bp, Candida albicans
gatgcctttacaacatcttcttttccaaactatccaacaatggcaggtagaaacgctataaataaaccaaaaatcaaactccatgctcagagtcatgctaaatcattagggagaaaaagagctgcacgtagaactacggctacaagatcgtccacttctcgatatgccgccaaaggaaccactgcaccaagaccaacagactccaaagcagttgctttatatactggaaatgctcctcagccaacctcgaccatgacaacccagacattatctaacaaaagagctaaaaagattgccagaaaccagcggtatttagctgctaacaaactcaaggataacgacacggccatggaagttgacaacacatcagaacaagagaagcaaacgaagttagatcaaatcaagaaggcactatggagtgttattgagaaccatcaaaagatatgggtattcagttgtttctga

SEQ ID NO: 1008 - DNA, 573 bp, Candida albicans
cctagccaacacaaattattacaatcacctacaggcacaaccatgacgaaacccacaaaagataataatgacgatgtattagattttatcaattcattacctgattctaaaccaggtactcccaaaccatccaaaacttctggttcaaatacaggaggaggcaatgattcgactgaaaacaaggaggatttattagattttttggatgaattggaacaacatgaaaagaccaaaaagaccaaaaaaccatctaaattagcccctaaaacagcaagtaaaccaacaagtagtgatgctgacgatgaaccaaccacaggaactactactgataagtcagacactaccaacgaagatattgaaccacaacaaccccaagaaaaaactgaggaagaaagtgataatcaagatatacctaatccaatttcctcaattaccagttggtggaacctggaagggtctaataaagttaattcactttggggaaaaattactgataatgctgaaaaattatctgaacacacatatcaattggccaatgatgcaactaatcaattaaatactcgagctagaaac

SEQ ID NO: 1009 - DNA, 504 bp, Candida albicans
aatccccatggtcaagtacaagaacctgacgagattttaaatgtatctattatcaatgaaattaattatgatgccattaatgtgaatatcttggtattagataatttcttaaaagtagttaatcaagttgaaggtagaattcacgtcagactaaatgaatttaatcaaggtcaagaagaacagatcaaaaagaaccaagaggatcaggttgaacatcatcaagaacaatcaaatatagttattacttgtaatgccaaccaagatgaagagaataaacttgtttatttcgaaataactttgaaagatattactaatggtattactatcactaacaagagtcaatcattaccattacaatggtggaaatggattcaaggtgagaaattagaatttgacgaatccattgatcctaaagaatgggtgaaaacttgggtcaagaatggattggatttgagtgttggaatactggtccaacagtacattattaacagaatgggtgtttga

SEQ ID NO: 1010 - DNA, 1317 bp, Candida albicans
tacatcaccaagaagtttaatagtattatgagtttaagaattatattgaaacgtgaattttcacaatgtatcagagtacttgaatcagggagcaaatcaccaactatagctaatcgatttcaagctcaatatggtaataagaataataatctgaaaagaaacaccgccaacaatggtactggtaatgggaatcgatttcataataaatataataatgaatcacgccgaccttatccaaagaccaaatatcaacaacaacaacaacaacaacaacaacaaagaaaaccacaacaacatcaacaatatattatagatccacgtaaaatcaaatttgataatggtacagaactggcaagaaatgctattgaagaaatcattaatcgagtatatcaattacaaagaaattatcaaattcaattaattactgattcaggattgaaaaaatgtcatttatcagaaatattacaaaaattagatttatcaataaatggtcttcaattgattgataaatcaacaacaacaaccgcaaccacaaccacaacaaccactaatactagtgatgaagatcttccattgattaaaataatcactgttcgtgatatgattaatcaatattccacatatttaaataatttaaaacaattggaattaattaaattaggatcatcgaaaacattaaaaactttagatataaaattaaaattagaacaaaaaaaatccactaccaaagaaattttaatgaaatggagtattaataataatgattttaaattacaaaaaactaatgaaattaaaaaattaattaataacaatggtggtaatgggaaatcatttttaattaatatggtttataataaacgaaataccaataaacctatagatacaatttttaaacgtcgttcaaatactgaagaagttgaacaagaattaattgaaatagaattacaaagaagacaattattaattgaaaatttacaatcattattaacggaattgaattgtaaatggacaattgaaggtgatataaatactaaaatgacatttaatgttacaccaaaaggtcaaccaacaacaatagaacccagtacgactacgaatattgtggatgaagaagtagaagattataataataataataatgatgatgatggtgattgtgatgaaaagaaaatgaatagaacagaacgtaaaaaacggaaatctgaacaacaaaaacaaaaacaaaaacaaaaacaacaaagtaaaactaatactaatagtaatactgctaaagaagaagatttagatgctttatatctgtttaaaattgaagattaa

SEQ ID NO: 1011 - DNA, 1512 bp, Candida albicans
accagcataagccacattcccttgatctatattaccatgcaagaaggagttcagtttgcagcagcaactaatttgaaatccagaaacaaacaggggaatggtacagccgctgaatctccatcgttgtctccacagatatccgatcacagcaatgatgctggaaacaagtcaaacaatcattacaaggagagattgtccccatttagatacaaattgagatcgctcatattgccattgattcgtcaagaaacaatatatctagccaagatgcaatcatttttgcggtgttctgtttttgacttttattttgcatggacagcaaaccttgccagccacacattctatgttttgatgttgccgccaccaatatggtttggagggagttatttgaccagggacttggtgtatgttttgggtctaggcatttatttaactggatttttgaaagacttcttttgtttaccaagaccacgatcgccacctttgcatcgtatcacaatgtcatcgtacactacacaagaatacgggtttccctcgtctcacctggccaatgcaacaggtgtttcattattgttgttgataaagattctttcacttgagaatgtatctaacactacgtactactcgctaatcgttgggttatcattatattacatttctttgatatttggacgattatactgtggaatgcacggatttttggacatcattatcggtggtttagtaggtctgtttgtgtttttgtttcgacactattttggactacaatgggacaagttgttgtttgacaatggtttaggacttgtcgccagtacggtaattataattgcagtatttgttctgttgatccattttcattcagaaccagttgacgactgtccctgttttgacgattcagttgcatttgttggagttttaattggattggatttagctcatttggtggcttatcagacaaagtattttgcaaagatgaacttgaccggtaatccttatttgattccgtttgatgtaaatcgtggagtattaaattcagtttccagattcttattaggggtcgccttggttgtgacgtggaaaaccttagccaagccaattgtttttaccattttacctcctatctacaaagctgttggtgtgtatttaccaagaagaagctatatttcaactgctcatacacagacatcaactcgaaaaattagatcaacgtcaatgtccaatgactcaaatatgggaattggtgatataaacaatttcataaagggagtgactgaccacaataagaaggacgaagttggaccggaaacagaaattgattattacgaaatgctatcctatagccagaatcaaaatagcgacaacacgacaattcaaactccaccaaaatataacagtggtgtgttcaaatatcgttatgatgtagagattgttggaagattgattatatatgcgggaatatcgattactgcggtgtggacttttgcatttgcaagtgactatcttaatttatag

SEQ ID NO: 1012 - DNA, 1029 bp, Candida albicans
gcccgtggggcagtcctcacattcttttccttacggtataagaagaagagaaacactcaacgaaaaatgtcatcatctatcgaggaagtcaaagcaacaatcaagtcagttaaactaactgacagtcaagctgagaagctttcgaaattgattgattctctccctaaaattttatcgggtttagacaaccctgaatacgacgagatttttggctatagaattaacacaaaggataagccgtatgttgatgaatctatacgtaatgaaatattattgaagtttttagcggctgatgattataatttggaattactggaaaaacgtcttattgattcgttgaattggagaaacgaatttcaacctttgagtgccgcattcgaagaaacttttgacaaagaattgaatgaattgggcgttattacaaacttccccaattcaaatttaaaaattactacatggaatttgtatggtaatttgaagaacccgaaaaagatttttgaaaaatttggggctaacaacaaggtatcaaagttaccaggaagtcaatttttaagatggagggttggattaatggaaaagtctttacaattgattgactttacatcaaccacagataacagaattgcccaggttcacgattacaacaatgtatcaatgttcaaaattgatcctggaatgaagaaagctacaaaggaaattattaccatctttggcgccaattatcctgaactattatctaccaagtttttcatcaacgtgcccttgattatgggttgggtattcacttttttcaaaactattagagttattactgaagcaacattgaaaaagtttcaagtgttaaaccacggcaacttgctggaatcatttaatccagatgaattgcctaaagtttatggcgggaaagttgaaaagagcttgtttgatattgatgtgtccgatgatatcaagttgagtgaataccgagaaatgatattgaagaaagtacgtgatgaaaaaattaaccatattaatgatgacgtacagtaa

SEQ ID NO: 1013 - DNA, 675 bp, Candida albicans
acccttatacacattatggcaccttcatataaatccagcgaatacattgatgattctgattctgaattatctgctgaagaaagagaatatgaaccaccaaagaattttcaaaaagttactccagaatccaaagagttctcatcaaatttgaaaggaaaagaagtttggttgataaaaactcccaaaggtttcccattaacagatttgaagaaattgccaatatcttttagtggtaaaagtgccgaatcattcaaagtcaacaacttatcataccaagtcaccgaagatcttggagcatctgccagtgacacaaataataaacataccatattttcactgaaaaaaagaagtttcagaccactaggagagaagatctcacgattctacagtatccatgaagttgtcgatattcctgagattcagcttgacaaagtggtggtacctagacagaatgttcctaaaataaagaaactaagaatgagacatttccctactggttatggggcggacgattaccagttcgataaagaagaagaagaggaggaggaggaagagtcagaaaatgacgatgttgaagcaggcaaagttttaaaaaaggcaaaggtagaagaaaaagaagagaaggaagccaaacacaagaaagacaaaaaggaaaagaaagaccagaaagactag

SEQ ID NO: 1014 - DNA, 834 bp, Candida albicans
tgcagaggaaaagtaaggataagtatgactggccaagtatccagattatcacaatttgaaaatttgtttcatttatccaatcctcaacttccactaaatatattttttatattcttttattatagcatagttatgaaatcaacaccagtgtctataattgatttccctgatgagcttttagagaagattattcgctcattaaatcaaaaagatctcatacaattagcattgactcacccacgtttctccaacatttgtcaattatcattattacgacgtatatatatttataatgatgacaagtatttcaaattcaccaaaaaggcaacttacattcaggaatacttacacatgacaacggtggggttatccaatttcctcaaattattgacatcaccaaattttcaaccatctttgactaaagagattgttattgccaatgatgataatgcgtatcttcaatattttgaattgatggaaagacaacaattgccagtcaaatacgatcgaataaaagatattgatgttcgaaattggttacgtgaagtcaagccgagtcggaaaactaaattagccatggaattagcagaattgaaaaggagatcacaatttgttgccgatatcaatcgaaataaaacagattattatgattcaaatgatcaattcattgtagtcattactatcatttttgtctttgtaggggttttagttttcattgttatgtggggtaacaaatgggatcttcaaatgatgaatttgttcttgactggatctactccatttggaatactgaaaattgataatgcaaagaaattatttgctagcctattttga

SEQ ID NO: 1015 - DNA, 1062 bp, Candida albicans
tcttcacagtttaacactgttaagatcttaccagcattatacatatcgtcacaccgtaatatgtctatgaaacgatttttgtcaaggtcatcgaataaaacaactgcaggtcagggtgatgacacttctgctagcataggctcagatcttccaatagtcccgcttccgagcaatcaatcaggtgaatctcatgactctatcaaggagttgggtcccatgttcagacaacaacaaaacaagcaaatcgctgataatgatgacagctatgatatgatgcatttgaatttgaatccaaccattctgaacttgaacaagactgtcccctcaattaagggctctaccattcaggactcattattttcaagcagacaatcatattccacaaatcagtcttcgtataaaactggtggtactaataccagtggcggcagtagtagtaacagtcagtttggtaaacgaaagcatgacctaaacacttctcagccattgcagaccctcaaaatattggaagagaatgaacatcaaaatttggaagagttgataagggataatttgaaacagttgtatcaagatttggcatacactatgagtcagttctacaactctagtgccagtctatcaacaactgttataaacattattgattgtttgaaaaaatttaatgttttcgttgaaaaagctaccattgccaagccaaatgaacaatatattttcacaagttataattcatcgagtctacggaaaattttgaaaatttatcttgagttgtacgataatttgctaacagatcaagtttatatcaaattgaaattgttgttagttaaaaatttcaatgactttgccatgttattaaatagtcaagagatgaaccaaataagcgaggaaatgatcaaaccaaagaactaccccataggctctagcaaagggaaactgttaccaaatgaagaaatattagtgcgcataatggaaaaagtgtcgcacagcaatttgtctatgaaggaacaaaatggatcattcattgccccaataactcgaggtatctcaaacaatttgaacatataa

SEQ ID NO: 1016 - DNA, 1506 bp, Candida albicans
tgtctatattttggatatcctgagcctactgagtatcaccatagtctaacacaaagtttacgtgaattgtacgacgacgtacacgttgttctcgctaaaaaccagattgagttagccagtgctacacgagtggatgcagcaagtactttcaataaaccagcagcattcaacgatggattcccgccattgcaagcccagagcacccagaaattcaagttaccatttagagtaccgacagacatccaccatgtgcctatgtccatgtcaatttcgattgaaaatgccactcgaacatcggggaccatgggaggctatatttaccccattattgatttacaaaagcaaccgcatttgaaatcctatgccaattccaaatttgcaatttcatgtggtcacgtttgtttagattccgacaaccctgagaactaccctaatgtgtcctcaccgtcatcggtattgatctcattatacaaacaagcgttaactgaacaataccacaagagtcttaataggaataacagtactgctggtgtgccatctgaaactcgagttgcgttcggtgccgttcttcaacaattggaggaaatgttccccttgaagcaaataaaaaaatcaagcactagaaacaacaacagtgcttataaggacgattatgaagttcgtaatttaccaaagtatagatttggacaaataatttggggtgaaagaactttaatcaaattgaatggtgatactaatggcaatagtagtaataaccaccaaataaatgaaatgagtgggattgtggagaaaaaattatctgatttggccattatcaaagtgaataagaaattgaaatgtgagcataactatcttggtgatgatgttcaattcaatgaatatgaccctagtttgatgtttgataatttatatgtcagaaaagttatcaacttgaaacgatatgttccaaaagtaataaacactgctattgaagacgtcgattctgatgtttcaaataatagtgaaatacaaacgtattttggaattccagttttcaaatacggttccactactaaatatactaaaggacatcttaatggtatcaagttggtttattggttagatggtgcaattcattctagtgaattcattgttaattccattgaagcaaattcatcgtttgcgtcaggtggcgatagtggatcatggatattaactaaattggatgatatcgaagacaattcaaaaggtttaggggttttgggaatgttacattcgtacgatggtgaattcaaacagtttgggttgtttactcccatgaccgaaatattgctgcgattagaagaagttacccatatcaaatggggagtagttgggtgtgacaataagcatgatgaggaagatgatgatgaacttcatggatttgatactgatgacaatgatgatcgtcactcggcattcctggatgatgatgatgatggtgtttctgagaatagcgatgctgcatatccaccagatatagaataa

SEQ ID NO: 1017 - DNA, 387 bp, Candida albicans
  unsure (30): Identity of nucleotide sequences at the above locations are unknown.
caatctggattttctaccgccgtcgttcanaatccatcatccaactcgactctatctgatgaagatgaattatcttcaacaattcctaaagcttgttcatctgcaaacaatttagaaatgacattacatgattctgttttaaaagatactcatgaacgttggggtgctattgtagctaatcatcaatttcaattcgatggaccaattcctcaagcaggaacaatttatagtgctggttggtcaattaaagatggatatttatatttgggtgattctaatatcttttatcaatgtttatcaggagatttttataatttatatgatgaaaatgttgctaaacaatgttcagctgttaaattaagtgtcattgaatttgtcaactgttaa

SEQ ID NO: 1018 - DNA, 852 bp, Candida albicans
tcaaatcacttatcacttatcattatgagattttcaattgctactttatctttagctgctttaactgttgtcagtgccagttatgttacccgtggtgaaggtgtatccagaggtgaaaaatacgaatgtgatttcgatacttttgaatggaaattcggtttagccgtcaaagaattaaaacatcgtggtaaaaattggggtaaagatgttgatttagatattgtttatgaaagtgatgatggtcaattgtatcatggatgcaaagatacttacgatgcttctaaatgcaaaaactgttatgaaacttttgaattcagtgatgatgatgatgaaggaagtgattgtgatgatgatgattgcaaaaagaagaaaaaggctcacagatatactaaacgttgtggaggtggcgatgatgatgactgtgaagatgatgaacgttgtaactacccatactgtgaactttatgacgacaattgtgacttggtcatcactttaagagatggtgttttacatgatgaaagacacgctactggtgaaattgttgccaatcatcaattccaattcgataaaccaccacaaaaggatgccttacacaagaaaggattctccattgtttacactgaaggtaattactacttggctcttgaccacaagatcaaattctggcactgtaaagttgatgacaatggattatacaagatctatgataaatctattggtgaacaatgttctgaaattgaactcattattttgaaatctgacaaaaaagctgaatttgaattcagtgacaacgaaggtagtgattgtgatgatgattgcaaaagaaagaagaaacacggtaaaaaatactaa

SEQ ID NO: 1019 - DNA, 288 bp, Candida albicans
agaatactgtcttacacgaatgaaaaaggtgctactggtgaaattgttgctaaccatcaattccaatttgataaaccacctcaaaaggatgcattatatgataaaggttttactatcgttgaaaaagatgattattatgtgttggctttgaaaggtaaaaccaagttctggaattctgctattgacgataaaggtgctttcaagatttatgatgaaaaaattaatgaaaacagtaaacctatcgagcttattattttgaaagttgaaaaacatggtaagaaatattaa

SEQ ID NO: 1020 - DNA, 855 bp, Candida albicans
tcaaatcacttatcacttatcattatgagattttcaattgctactttatctttagctgctttaactgttgtcagtgccagttatgttacccgtggtgaaggtgtatccagaggtgaaaaatacgaatgtgatttcgatacctttgaatggaaattcggtttagccgttaaagaattaaaacatcgcggtaaaaattggggtaaagatgttgatttagatattgtttatgaaagtgatgatggtcaattatatcatggatgcaaagatacttacgatgcttctaaatgcaaaaactgttatgaaacttttgaattcagtgatgatgatgatgatgaaggaagtgattgtgatgatgatgattgcaaaaagaagaaaaaggctcacagatatgctaaacgttgtggaggtggcgatgatgatgactgtgaagatgatgaacgttgtaactacccatactgtgaactttatgacgacaattgtgacttggtcatcactttaagagatggtgttttacatgatgaaagacacgctactggtgaaattgttgccaatcatcaattccaattcgataaaccaccacaaaaggatgccttacacaagaaaggattctccattgtttacactgaaggtaattactatttggctcttgaccacaagatcaaattctggcactgtaaagttgatgacaatggattatacaagatctatgataaatctattggtgaacaatgttctgaaattgaactcattattttgaaatctgacaaaaaagctgaatttgaattcagtgacaacgaaggtagtgattgtgatgatgattgcaaaagaaagaagaaacatggtaaaaaatactaa

SEQ ID NO: 1021 - DNA, 762 bp, Candida albicans
ctcactatgaaattctccactgttgctttatctttgccattaattgctatggttcaagctggtatttccagtccaacttattacaagccagagcatactgaagaaattggtgttgaaactgttgattatgaatttgctttaggtgtcagagaaaaatgtgatgaagataccatttatttagcttatgaggtcgatgatggtcaattggaacgtaacgataaaaaagttgattgtaactgcaaatcagaaccagttgtttacccaaccccgcgtccaagcaaaacttattgggatggtggtgacgacaacgacgaatgtgatgaagattgtgacgatgaagacaaaaagaagggacacaaacaatacaaacgtggtgaagttgaagagccatgtgaaactagcgattgtgacttctgtactattgagaaatctttctgtcaagaccaatttactttatgtgaaggtgttttgaaagatcaacgttccgctattggttcaattgttgccaaccatcaattccaatttgataacccaatacaaaaggatgccttacatacttgtggctggtcaatcgttgaaaaagattgtgtcaagttgttagctcttgatggctgtactgatttctgggaatgtccagttgatgattgtgatacttacaaattatatgattcttccatcgatgataaatgtaaggaaattgaaatcattgtgattttatttgaggaagaagaagaagaaaagaaaaagcataaatcttggtaa

SEQ ID NO: 1022 - DNA, 1044 bp, Candida albicans
ttcattatgctatccctaacaaaaaccccaacagaaacagcaacaactaaaactcatactgaaacaaaaactataaatacagcccaaatatctctccaaatattcagttttttttttttttcttttcatcactacttaatcaagtatcaaatcaatcaattaactaattcaatcattatgagattttcaattgctactttatctttagctgcttttactgttgtcaatgccggttatatttcccgtggtgaaggtttaacaagaggtgagaaacacgaaagacatgaatgtgatttcgattcttttgaatggaaatttggtttagccgttaaagaattgaaacatcatggtgacaagaattggggtagagatgttgatttggatttagtttatgaaagtgatgatggtcaattataccatggatgcaaagatgtttataaagcttctaaatgcagaaattgttatgaaacttttgaattcagtgataatgaaagtagtgatgatgaaggtagtggtagtgattgtgaagatgatgaatgccagaagagaaagaagacagtccatagaaactacaaacgtggtggttatggtagtgaacgtagacaaagtgattgtgaatctgattgtgaaagatctgaacgttgcaactatccattctgtgaactttatgaagataattgtgatttgcttcttactttatgtgatggtgttttacatgatgatagacatgctactggtgaaattgttgctaatcatcaattccaatttgataaaccaccacaaaaggatgccttacataagaaaggattttccattgtttacactcatggtaattactatttggctcttgatcataaaattgatttctggcattgtaaagttgacgataaaggattatacaagatttatgataaatctattggtgaacaatgttctaaaatcaagcttattgtattgaaatcagatgaaaaggccacttttaccgatgatagcgatgactgtgatgatgattgcaaaaaaaacaaaaagaaacaacatgattag

SEQ ID NO: 1023 - DNA, 573 bp, Candida albicans
agagaacaaattgaaaacaataaagccatctcatggatcaatcgtccatcggtttatattcttggattagtgatttgtattttcatgattgcttttgcttccaccattggagttaaacaaattatactttttaaattagcttgtaatacagtagccaattctaaaggatattgtgaccctattgaaactcaagtattagtttcatcatatgaaatgtattctatggttggtggtacattagtttcattaatccccgtggctaaagcaggtgaattaagtgatatatatggtaagaaaccttttttcattgccatgtttgtatcggcgacaacatctcatttatgttcatatcttatatttcatcattataatactttcccatttaaattattattaggagcacaatggatttcttcaatatgtggaggaatgattatggttccagcattaattggatcatatatatccgatattgttgaatctcaaggaagaatttatgctttaggtttaggaatgtcatcacttttcattggccaatcattaggaccaatgtttggtaattggataaattca

SEQ ID NO: 1024 - DNA, 687 bp, Candida albicans
agattagcgaacagagaagaattaagaattcaaaaggaaaaagaaatgaaatttattgaaatgcaaaatcgagatcgtaaacttaaagaattgattgaaatgagtaaaaaatcaatgaataacattggtggtagtagtggtactaccattactgctgctactattaatggtttatctgataatggtggaaataacaatgggaatattactggtatttatggagatgataaacactcaaagcatcatcatcatcatcatgataagcatttgaaaaatggtcctagaaataccagcaccagcagtagtagtggtaataatgttgagaaaatttggaaacgaatatttgctaaatatattcctaacattattaaaaaatatgaatcagaaattggtcgtgataatgttaaaggatgtgccaaagaattagttaatattttaacacaaagtgaaatcaagcatggtaatagtctaccctcatcatcttcttcgaatggttatagtatggaattgagtgataacaaattgaaaaaaataaaagaatacagtcatggatatatggacaaatttttaattaaatttaataattccaaaaaacacaaatctacaatggggagtaagggaagtgataatcataaacgaaagcataatggtgatggagataatggagtaaaacgtagtaaagtatag

SEQ ID NO: 1025 - DNA, 1626 bp, Candida albicans
caaatcatgtccaataacaactttcaagagagttctaataacactagcctgccttctaaacgatcgacaccaatgttgtttcttgatgccgaaaacaaaactcaagaagcattaacaacttttgaattactaaatgcatgtacatatcaaaacaaatatgttggatcggccaacgtcaccactactgccactaccagtactaaaacatctaactcaaccctgactaaatctcatcaacaacaacatcgtcggaaacttgaatatatgacatgtgattgtgaagaggaatgggatagtgaattacaaatgaatttagcgtgtggacccgattctaattgtattaatcgaattacttgtgttgaatgtgttaataggaattgtttatgtggggatgattgtcaaaatcaacgatttcaaaaccgtcaatatagtaaagtcaaagttattcaaacggaattaaaaggttatggattaattgctgaacaagatattgaagaaaatcaatttatttatgaatatattggtgaagttatagatgaaattagtttccgtcaacgaatgattgaatatgatttacgacatttaaaacatttttattttatgatgttaagtaatgattcatttattgatgccacggaaaaagggtcattaggtcgatttattaatcattcttgtaatcctaatgcatttgttgataaatggcatgttggtgatcgattaagaatggggattttcgctaaaaggaaaatttcccgtggtgaagaaattacatttgattataatgttgatagatatggagctcaatctcaaccatgttattgtggtgaaccaaattgtataaaattcatgggtgggaaaactcaaactgatgctgcattattattaccacaaatgattgctgaagcattaggagtaacaccaagacaggaaaaagcttggcttaaagaaaataaatcaattagaaatcaacaacaaaatgatgaatcaaatataaatgaagaatttgttaatagtattgaaattgaaccaattgaaaatcaagatggggtgactaaagtaatgtcagcattgatgaaaactcaacatcctttaattattaaaaaattgattgaaagaatatttcttagtaatgatcaagatgatattaatgttatgtttgttagattccatggatataagacaatatcaacaattttacaagatttattagtggccaagaatagtggtaaagaatcagaaacaactgataacaacgatatcgacaactctactggagatgacgatcaagataaagatgagttgattattaagattttgaaaatattggtgagttggccagcagttactaagaataaaatagcttcagctaatttagaagaagttgttaaagatattcaaaccaataatgaaaatagtaataataatgatgaaattaatcaattatgcactagtttattagatagatggtcaaaattagaaatggcttatcgtattcctaaacaagagagtgtacctaccaacaatgctgctgctgctgctacaacaactgcaactgccaccggcaccactacttcagcatctccatttgaaagttttcaccggcggatgaaaacaatgtccaaagaa

SEQ ID NO: 1026 - DNA, 1413 bp, Candida albicans
acacggaaaggcagaggtagggtgggcaataggtaccacgatggtagcgtagtgggtagtatactagatggcagtgtataccaggtggtggcacttgtccatgttattgttttggccagattcggatctttaattgagaatattttgcttctgcgaaaaaaaacggaagatttccaagccttgttttatatcccttatactatatatagcacagcatcgccgagatttggcaattttttttttcttgtacatcaaaccatgttattttcatcattgttagtatctacattagtttcagtggctactgctgccaaccaagaagttgaagctatccagtttagtaatcttgggttttctggtacttataaccaagttgaaaagttgagtaatatctataaagattcgtgttcatgtgaagttaacaaaacgccagtatcgttttctgggacgaacgcaccattgaacgaagaagtttctgtgcatttccgtggtccacttgtattgaacaaatttgcgtcctacgtttcagatgggttcaagtatggtgatgatagttctggcgactggaagagattgagttactacgaagggtcgagtggcaccagtgagaatgtcacgtttttgacaagtgccggtaagaactcttcgtgtttgggtattgggttgacatatgctggtaccgatggtatttccaaagccgactcgtcgactgttttggccaaaaatacgttgatcaactcgaacgacgagtttgtgattttctccaacattagctgtggcaagtccgggtacaacaacgattgtggtgtctatagaagcgacattcctgcctaccatgggttttacggtaccacgaaaatgtttttgtttgaattccaaatgccaaatgagacacatacgtcaaccgatatttccaactacaacatgccggccatttggcttttgaatgcgcatattccaagaaccgcacagtactcaatgaatgttaattgttcgtgctggagatctgggtgtggtgagtttgacatttttgaagtgatgaactcgaccgagtaccttcacatgtacagcaccattcacgattaccaagggtccgatgatattcaaactggtatggctgcacctgcctatattgagcgtgacttgactggcactatgagtggtggtgttgcctttgacctgagtggcaatgctgttgtttgggtgtctaactctacatcgtttgattctaccattcaagcttccagtgtcaactcgtgggttaagcaagctggtgctgatgttgccactacattggctaccgttactggccaatctgccactactacaagtaagaagagcggtggtgttagttaccaaccatcgtttatcactaacttgcttatgacggtgcttacactttgggttatttag

SEQ ID NO: 1027 - DNA, 795 bp, Candida albicans
ttgcttaacattttgcttggaatcactagtacaatcatgattcttgcatctttattaacatttgctaccgccgcgttagcttttgattgttctgacaaagaacttgaacgttataattttgaaagtatcaagggagttcattcctataccactcttaaaaatacgccaccttcgcaaacaaacgtcacttggaatgtcggaatatgccagcctatttctgctatcaaagactgcccagcaaactcggatatatgtggtgtaacaagcattttgcgtaaagatgaaaaacctgttgtgtctgaagtagtttcattcaagtctgatttgcaaaaagcttatgagtcatctgacaacggtatcaaagtcatatacaagggtgctaattggggagatgttcttgtgaatgccgaattgaactttcagtgtgataaggactctcaaaataacgaatttactttggatcaatgggatggaactaatttgaaactttcgatgaagaccaaagccgcctgtatcactagtaaagaagacaagaagaaagaaaaacacgacaatggtgaatcttggggatggttcacttggatatttatctttttggtgttgtttttaagcatttacataattggtggtgcttggtttcaatacaataaagggaacgctatagatttccagagtgccttgaaagaagttgtcgagaactttatcgaattgctaaagggattacccagctttggcaaagaaataattgaaaaatttactggacgtagtaatagaggtgaatatagtgctgtatag

SEQ ID NO: 1028 - DNA, 822 bp, Candida albicans
gacgcggatcttccaatccgtggtgaagagtcaaaatatccaaaattagtgattgttactgctgttgattttaataaatattcattagatggattgactaaaattgttcaaaatcgagtagattatgctcatttacaaaattatggagtttatgtaagatggtcagaagaatttttaccaatacttaataatttccaatatttagaagataaagaacgagctaaatggattcgagtttattgtatgaaagctgctatgtttgcctttccgaaaacaaaatggttttggtatttagatgaaaatggattaattatgaatatgaatataaatattcatgattatatgttaaaaccagaaattttaaattcaataatgttaagagatttacctttaataccaccagatggaattattaaaacttataaaaatgctcgagctgattcaattcgatttatattaactcaatcaaatcaaaaaattgaaactaattcatttttaatgaaaaatgattatattgggaaatcaatgattgatatatggggtgataatctttttttccaatatccgaattttccttatggaccagattcagctttaactcatattttacaatggcatccttttattttaagtaaaactactattgttccaattaaaactattgctgctagtcataaatttaaagataatggtttacctggtaatctgatttatgaagatggagattttgttgctcaatggagtgattgtaataatccaagtgaatgtgaaaatattttaaatatttattataataaattgaaaaaaaccccaaaatcatag

SEQ ID NO: 1029 - DNA, 375 bp, Candida albicans
ttgttgacaatgaaattaacaccaacagccatatacactgctcctgatatagattcacctaaacatttccatctttctaaaaatgaagatcattctactaatgggaaaacaactcaaatttccgatatagtaattaaagctggtggtgaagatagagataaaccaagtgatcataaagatactccattaggtaatttacgagctgaattaactactttacaagatcatcttaatatatttttaaccgaaagaatgaaactagagaaattgaaaaatggtggtggtggtggtggtggtgacaacaacaaatctaatgaacaagatttagaaagaagaatacttgatgaaggagttgaagaagaggaaattgaataa

SEQ ID NO: 1030 - DNA, 783 bp, Candida albicans
ttaattaatttattagatctattttacttgaccctattaaggctttcacacatacccacatacattacacccacacactcatcccccctccctccctccctccacatggataggatattttataaatcggatcttcgggatccaaccaccaattatcccatatatatatttgatacatcatatttaccatcacccgatataataaattataatgaatttttaataactttaatgagttatttaccgataaaaccatatgttttaattatgtttagttgtggattaaataaaatatcatggatttggggcattaaatttatacaaaaaatcttgaatcgaagagatttaaaaaatttaattaaagtctatactgttcatgatagttggtttttaaaatcaatgacttcaatattacaaaatttcaattcaacaaggaaaaatttagaacaattagatcaattattaggtgcatttacatttgtcaatgatttatctgataccaaaaatgatagacaaactttagttattcattgtcaaacattaagtgaattgagttattatttagatataaccaatttgaaaatatcttataatattttcaaacatgatttacaaatttccgaattgaaattatcaatgagatatcaaccaattattcatcccttaattacattaaatgttcaaaaatatccgattttccatcatcatttatatcaaattttcaaaatagtagagaataatggcaataaagtggaattgatattatataaaccagggacataa

SEQ ID NO: 1031 - DNA, 300 bp, Candida albicans
caagatattttccaatcgattcaacattgctttgttgaattaattgaattgataaacctggatcatttattgcctgggtttgatcgtgctttgacttatttacaaacatataaccctaaatcaccagcatataccaaatcagataatgaaagtatcgatcaaccattgattttatttttcaatttaattaatatggccgatattattatacaaatgattgatattttttataaacaagaaatattaattactcaacagaatgaaaattctattttaaatccaagtttacaaaataagtaa

SEQ ID NO: 1032 - DNA, 1257 bp, Candida albicans
ttattgttccaagaatggattatatatgatcctaatttaatggaaggagaaatcacatttttccgagatttgttgaatttaatcatttctaaaaatttgaaaatctcattagctagtgtttctccaacttcattgaccaccgatacaattttcccatttaatactagttttgatttatattctggtgcttatgaatgctattacgaattattgaaaatacttggtgttgacattttgactcaagatactattaatttactttgggtatcgatgaatattaaaccttgtttagaattgaaacaatttatcaaattatggttagaaagcagtttagacaaaaattggtttgctatattaaattctttattcaaattaagttccaagaaattgattggtccatttatcgaaactaattatcaacaaaaattgttacctttactgcaacgtcaaaaaaagaagaatgcacaaaatgttgattttagagatgaagaaattgaaaatattgttggtggtgatgaaagttccgatatggataaaaatgaacctatatcttgggaatttaaattgttcatttatgaaatgttaaatcatttgttggatttagcactggggaattcacaattaatcgaaagattgaaactgaaaattcctgatattgtcaaactttcatttttaggatcaacttcttccataacagaaataaaattaaaaggtattgaattgttgaatagatcattagcgttatttggagaattagaagatccattgtatccaagtgtttctattttggaacaacaacaagcacaaataatcagtgcattaataccttgctttagtcctggtaatgattataaagttattgtcaatgccatcaatgtgtcttccaaatttattaatcttccaagaattaaattctattcaaagcaaagaattttgaaaactttgatttatttattagaagaaatttcatccaataaatttgttcgttttggatttttagaaagcatgtcagaatttggtagaaaatctattcaattggcaattttaaattgttgggcagtattaaaaattgattcttatgaagatccagaaaatattgaacccgagtttgaagagacattaaccaattattcagcattattgacatcactttggatattggtgttacgagaattttctacattgaaatatagtgaatcatcaagcagagaattggagatctatggtaattattggataaatttgattagtatattg

SEQ ID NO: 1033 - DNA, 1113 bp, Candida albicans
aaaaaggatgagaacccaacaaataaggatattccagtgggggaagaagaggaagaattagaattggatctcccccacgtttcgtcagaaacggggtcatcatttataagagggatattgcttaatttgattgtcaacaataattactatattagaagctatgcaactcaaacgttattagtatatgcaaagaataatcaagcagagataaatcaattgattttacacacatttagattggtggatcaagaacacaaacattcagataaggagacacctggaggagatcaaaacatcaatcctatttcctctgtcagattattgggttactctttagcattactgtcattaatcaaacaaacagatcctgcgttacttcaaaatctgactatagtcaaagtattgagtttttgtacacaaagtttaaaacataatactcaatcaggggttaagaattctagttgttggattatattatcatcacttgtcactttacacaatttttccgaatatgttaaattaaattcatcacagtttcttgtgttttggaaaagtttattaacttcacagtttatgagtacttcaataagtgccagtacccctgaggggcaaactaaagaagtaatttttaatttaatgttgagaaattttagtttggtttgtttattgaattatttgaattcagttgaattgacaccagaatcattaaaacaaattcaatttttacttactaaatcatacaattatttgacatatcttgaaagcaacattgaagtagttggtgccgttactttattcaacaatactaatttcaatgagttggattataatgtaaacatgcttagtaatttgctttacaccaattatgcattcaataataaattatcaaccgacagagtatttataagtctcatattatacagtaaaaaaatcattttccaaagtttcaccaaattggccactttgctcaaaaatgaaataaattccaatatggtgatttttttaatcaaagtatttagtgatgccaaattattttcaagaattccatcaacagacaatgaaaaatccaaatctaaatccaaaagtcttcaccacggggtggaaggtccgcgt

SEQ ID NO: 1034 - DNA, 792 bp, Candida albicans
ttattggaggagactgaaatagcttttgaccgtacatccaaaccggttccggtgataactgaggagtcgacgcagacattggaagaccttattcgcaaacgtatcaaggaagacgattttaatgatttgcccagacgtataataacagacatttccaagttccacaagacgccacgagccgaggtttctgaacaaaagtcgtccaagtcgttagctgagttgtatgaggatgagtataaccatgttgatgcacaacaagaatcgatcaacgaagaggtgaagaaacagcacgacgagattagtgagttgtttaccaaggtcacacataaattagatgcgttgtgttcagctcatttcattcccaaaccacaccaagccaagaccattgatattaaggttaccgatagtattagcatggaagatgcgcagccattgcatgtgtcaaacgagtcgaggttggcaccacaggagatatataagattggtgatgatgaggctaagggtgatggagttaagggcaagacgcaagtgcaattaaagtctggtttgtcgtactcgaaagatgagttgagtcgtgaagataaacagaggttaagacgtgctagcaagagaaagaaggccaagacgtttaaccaaagacaagagaccaaacgtcaaaggaaagatggtgttgtcgatacgttggctggtgcaaagaaccttactgtcattggcaataagggtgagatgagagacattaaaggtaatctcaaaaaggccagcgggccacaaagctcatatagttttaagtag

SEQ ID NO: 1035 - DNA, 195 bp, Candida albicans
gacaatgcagtcaactcggccatgctagatttatttgccgaggaggagccacagccaaaggaaagttgttggtcgtttgaaaggcagcaaaagtctatccaagcggaaattgccaggttagaagcagaattgtgggcagataagaaatggacaatggaaggtgagatcaagtctaaagatagaccgcaagaatag

SEQ ID NO: 1036 - DNA, 462 bp, Candida albicans
ttacgcaagttcggatgttccatccgcgtggtgaagatttggaagcaagtggcgcaactgatggttaatttcgaatttttggttaaaacattacaattattaattatgggtaaaagttttttcaatattgattcaagattatcaatgtataatgattatattcaaaatgtatcttctcaaatcaatcctgaaactaaaaaatcatctaaagggttattaacagagtcaataatattaggatttttaattaataatgatcgtgaatttgcatctttaatatttgataaagctatagaaaatcaaataattaaagatgaattagaaattagtcaaattaaaaaaatttttaaaatttatagtgattgctttattgataatgaaatttgggaaaatcatgctcaattgaaaatgatagatgttgccttgaaatatatagagaatattgattccataaagtattaa

SEQ ID NO: 1037 - DNA, 1026 bp, Candida albicans
ttgtctgaggcagtgttaggaaagatagcgataaagctgtgttccggcgttctatcttttattttgttactgacaacaaagttacacaccatacgttacaaaatgagtattcgtcgtgatacccacgcaggtttttggtatagcaacaatcctacaaaattaaagaaccaacttgatcagttttttgccaaggcaagatcattgaaaacaccccttagtggcgaagatgccagcaatggcattgatggcgcaagaatactcataggcccccatgctggatatacctattctggtgaaagattggcagaatcttttaatgcttgggatacctcaaaagtcaaaagggtgtttttactaggcccttctcatcacgtctatttcaagaaccatgcattactctccccctttgaatattacgaaacaccgtttggcaacattcccgtggatgtctctaccattaaagaattgttagatgagcaatgcaaacacggacctgttttcaagtacatgtctgaagaaatcgatgaagaagagcattcttttgaaatgcatgcaccatttatctattacaaaggcgaaacagcgatccatggcttaccaaaaattattccaatattaattagtgggatggatggtaagttacaagaaggtatagtgaactcattgcttccatatttggacaatgaagagaaccatttcataattagctctgatttttgccattggggttcaaggtttggctatacaaaatacttgtcatctggagaaactactttggatacgttgagtgataatatcacatcgctaggtagtttgcaccgaccaaaagggttgcagatttacaaatcaattgaattgctagataaaattgcccttcaaattgctactaatggctcctctgctgcttggtctaagtatattgatatctccggtaacactatttgtggacaaaagcctattctcattgtgcttaaattattggaaaagtacaataataattccttcactgcgaggaaatacatttaa

SEQ ID NO: 1038 - DNA, 1278 bp, Candida albicans
aattttttttttaacgtcagccgattccaaattactgaaacaccccaaatctttgttttcccctttaattggaagagaatcatgagtcaattgaaatatctcatcacattttcaattctattaagattcgggtttttcttttttggattgtatcaagatgaatatatgcccgtgaaatataccgatatcgattatcttgtattcaatgatgcatccaaatttgtttatcaaggtctatcgccatatcttagagaaacatatagatatacccccattttagcaattttgttaatacccgacaattttggcaagtactggtatcattttgggaaattgttatttatggttagtgatgttattactggactaattatattgaaacttttatcaaagcaacaacaattatcggaaaagaagaaaatgatattatcctctatttggttattaaatccaatggtgataactataagtacacgaggatctgcagaaagtgtattgacagtaatgattatgttgtcattgtactacttgttggataaagacaatgttatactatctgccatatggttgggactttctattcattttaaaatttatcccataatatatttaccaagtatactttattatttatcttcccaagaaaccccatttttggcgagtgttcctggaattaaccttgttaacgccaaaaacttgaaatatattattattactttgactacattggcagtagttaattatttaatgtttttaaaatacggatgggaattcatagacaattcttatttgtatcatgtcacaagactcgatcatcgtcataatttttcagtttacaatatggtattatattataaatcggcattattagaagattctaatgggtttgatattgaaaaaatcgcttttgttccacaattactattatcagcagttataatcccattgatatttgctaaagaggatttaatatcaagtttattcattcaaacatttgtgtttgttgcattcaacaaagtcattacatcacaatatttcatttggtttttaatatttctcccacatttcttgtccaaaaccaaactattgactacagataagattactggtataagttgtttattattgtggatcatttcacaagccacttggctatattttgcttataaattggaatttttgggagaaaatacttttgataatgggttaatgtattcatctgtgtttttctttttaagtaattgttggtgtacaatgaagtttatacagagtttatag

SEQ ID NO: 1039 - DNA, 567 bp, Candida albicans
gagaatttatctaccggcgctacccctgacgaactgaataaaaagtccaaaccaaatacaactgatgaaaaagatataactggggaaaccactggtggagaagatggatctaatgacgatattgtaacgaaaaaattacttgaaaaaggagtatcagaattatcaatttctaaagaagaaaaattacaacaagaattgaataaacgagcagctaaagaagaattaaaattagaaaggaaacaacttgaaaaaatttcaaattcaaaaatcattattaaaaaaatatctcgtaataaaaaaaaatcaattgtttctatatctggtttagaaattttagaaactactgctggtacaactggtacctctaataataaagtatcaattaaaagtttacaaaaaaaattttcatctaaatttgctacggggacaagtgttgttaagaatgctgaaaataaatcggatatattgattcaaggtgatgttttcgaagaagttcatcaatttatagttaatcttttacaagaacaaggattaaatgatattaaaattgaattgaccgatgattaa

SEQ ID NO: 1040 - DNA, 855 bp, Candida albicans
cttcttctccaattggtagaactctataactattcaataataatgtcagctccgtgtcattgtaaacatgtagatgactcatcatctaacgacaaactttcagcgttatcaccagaattacaacaagaattcaaagatccaaatcatcctgccaatttgatttgtgaattatgccgtttattttacgataataattgggtcactggtactggtggagggatttcaattagagatgtcgatggacctaatcccaatctagtttatattgctccatcaggtgtgcaaaaggaaagaattcaaccatgggaaatgtttttggttgaattgcccgatgaaaaaatcttacgtactcctaatgatattcctaaagaattgactaaattttataaatataaacctagtgcatgtactccgttatttattagttgctatacattaagagatgctggtgcttgtattcatacccattcacaacatgcagtaatggtgacattattttttgaaaacgaaaaagaatttgccattagtcatattgaacaaattaaagctttaccaaaattgaaatataatgatgaaactgggaaaattgaaaaaatcggtagtatggaatattatgataaattagtaattccaattattgaaaatactcctcatgaagaagatttgactgattctttacaagaagccattaaaaattatcctggtgcttctgctgttttagtaagaagacatggaatctatgtttggggtgaaaccgtatggaaggcaaaagtttataatgaagcaattgattatttattagagttggccgttaaaatgaaacttgcaggtatcccattagttaaacaagaataa

SEQ ID NO: 1041 - DNA, 621 bp, Candida albicans
tggatctcatggcgtggtgaagaccgaaaaagattgcaaagtaagaaaagtacaggactagtagctgaaaatgcatccggtaccaaagagactaaagatcaagatttgcagaaagcaaaagaacgtctagaaaccttattagattatcaggcaacaggggaagagagaacaaaaattatagacaatgcgtctgacttcgaaatgccatcgcaatcgttatggttgactcctgaggaaagggctctaaatttaaagaaacaacaaagattaatgagagaaagcttagtgaacaaggagaggaaatcacgtggggaaaagactgttgaaatgactatcaaagatggcaaagtaaccatggttgaaaagtacgttactcataccgaaggcacgtctcatgaagagtctgagttagaaaaatcaatcaaggagaaaaaaatgcagtcacaaactagtaatctggtctgggattatgaaatggacaaatccaaatgggagaaacccatatactttgccagcaaaaacatacctcaagttgacaagagtgaattgaaaattacgaaaaatagagtgcagtttccaaaagaagatgcatctgaagtgattgcaacagtaataaactag

SEQ ID NO: 1042 - DNA, 864 bp, Candida albicans
tcattactcgaagcgaaatacataattatgagcctgttattcattaatgaggaggatgatatgactcccgaaccatataaaccatcaacatctacaatcagggaggaagaagaagaagtgcaagtgaaacaagaatttccagacgagaagatggttgatccagatgaagatgatccaatagtcgaatcgataccattacttataaacacagtaccagaaagggcgaaacagtcattacatgttttgcaatatgccggtcgacccaaatcacgcccaaatagagctggaaattgccatgcctcaataaaaccagaatcacaatatcttcaagtgaaagtaccccttgatactgaaaaattctttaacgtcgacaaaattcaagaatggggtgaacaaattgttgaacaaaccattctgggtgtgctagatgggtcttatgaagtaggaaactatgctgcaaaaataataaatgacagcgatggaagaagagttgtattgattccagtggatagtacagtccaattaaaaccttcattcaagtacattgacgatttggaagcccaaagtatccaacaaagaagacaacaagagagtactaatgaaaaaccagcaaatgtccaaattttacaatcagctgctaagcattctactcaatctggagaatttctgcattctttgggagactcattgaaactggtaaagcattttgaagaagaggaatgccaaaatctaatttggaaaagaggcgatgatgatgtaaccaagagtataaagtttggtttagatcaccacacagatactaatattgaattaaaaacaaacacttcatatgatgaatacatagacatgttaataaataactga

SEQ ID NO: 1043 - DNA, 603 bp, Candida albicans
acccaattgcttttccttccaggcccgtcgtgtgaaaacgtcaaaccttatacagataatcagaagcaaaaatttaatggtatttccaaattagcgttgtttatatccagtaatggtggtggcagtggtgggggttctctcactattccagagaatactccaataattgaatacttgggagaaattgatttgtttaaaaactattgtcgagattcaatcaaccaatatcgtatgtggggtagtccaaaaccgaaagttttaaaaacaacaattccaacgcaatacagtgatgagactttggatattgttttggattctcgatttgttggtaatgaaagtagatttattcgtaaagcgtgtccgtcatcagccaattgcagaatagagacggtatatgtaccagaacaaaataagtttcgatttttggtgtttacttccaaaccaatcacattaaaatcagagaatcaagatgaagaattgagattaccttgggaatgggatgtggatcatcctatcttgaaactttatgccaataataatctggagaaatttgagaatttgacaaatgaagaaaaatcagcattgattacttacattgataat

SEQ ID NO: 1044 - DNA, 315 bp, Candida albicans
atttcattcccagacagcagattaccttactataccattatggtcgttgatttggacaagtatcttaaaccaggaaaagaccattacttggctcttggattggaagggtcggcaaacaaacttggtgtgggagtaatcaaacacaacaagggcccattatcatcaacaaaccgtgcagaagtattatcaaacatcagagatacttatataaccccaccaggggaaaggtttctaccacgagatacagcaagacaccatataaactgggtggtaagaatcatcaagcatgcattatccacagcaaaaattgcatga

SEQ ID NO: 1045 - DNA, 1218 bp, Candida albicans
taccatatctatcatatccatcatatccatcatatccactataaaccccctaccgccatgtcatctgatgttaaacaactactaccgcaatggatttatattatatcattttattcttctataacatcaaccatcattatcttattatcaatttatttccatttacttaattatcgtaaaccatttcaacaacgattaatgattagaattcaattaattgtaccattatttgccatatcatgtgattcaatgttaattaatcaaacttcgcccataaataaatgtttattagaaccgatacgtgaagtgtatgaagcatgtgtgatgtatacatttttttcattattgacagatatgttaggtggtgaacgacaaatcattattgttactagtggtagagaaccaattagtcatcctggtatattaagatatttattacctaaattagatatatctgatcctcatacttttttaaatattaaacgaggaatattacaatatgtttggttgaaaccaatattatgtattactattataatattagaattgattggattatataatgttaatgatttaagtattaaatcaatttatttttggttaacattgatttataatgctagtgttacattatcactttattgtttagcaattttttggaaaattttatggaatgatttaaaaccatttaaacccgtggggaaatttttatgtgttaaattaattatttttgcaagttattggcaaggagtcatattagctatattatcagtattgaaattattacctaatggagatatagcagaaaatgatggtgaaaatattggtattgctatacaaaatgcattattatgtattgaattgattggatttgctattggtcattggatttcatttagttattatccattcacaatatcacaattaccttatggtagatttcaattcaaatatgccataaaagattgtttaggttttaaagatttaatatcggattttggtttaactttccatggtgattattataaagattataaacaatttgattcagtagaagcaatggtggctcatccagaatcaaagggaagaatgagtcgtattcatcaaggtttaagatatccatatgattgccaacataaacattggttaccagaaaatcattcattattatcggccaatactcttctttcccaacaagggctaggtacaggacaatga

SEQ ID NO: 1046 - DNA, 690 bp, Candida albicans
acaaactcaaaaatgaaatcatcagagtttatattaggtgaaacagcttataaaaatgctaaaaaatcattacaatccttaataaaacaatataataaccaacctgaaacaattaacacaccaccaccaccagatgatgatgatgatgatgatgatgaaacttcaactcctattcctaccaataaccaaggtatggcaattcatttagtaattagtattaaaatccctttatcaaggaagaaagattatataccaagaatcatccctattagttataaattagatgacgtaaccaataaatcaatattattaattactaaagatccatcgactccttatcgatcgaaattaatgattaaagattcacctacagaagatttatttctggatattattagttttaaaaaattgaaatccatgattaataagacaagtactagtagtactaataataaggggaagaaacaaaatttaattaaaattttcaaaaattatgatataattgtttgtgatcatcgaatcatgaaattcttaccaaatgtattaggtgaattattttatcataagaataaaaaattaccatttttaattcaaatggcaaagccaatacttctcgaaacttcaaaactaaaagctcaattgaagcctaaaagccacattttcaccgccgatggcctaacgggggatatg

SEQ ID NO: 1047 - DNA, 522 bp, Candida albicans
aaacttttacttccttccttctctttttttttccaatttgagagatacaccatattagtacaacttcatcctttaatattatatcttaaaatgttttcattaggagtacaaaatagacttttcactagaagggcattattttctggtttcagattcaactcaactacaactacaactacaactgcatcacaaccacgtttaacatgggtcgattatttccaattaaagaaacaaaataacagaatcaacactattgctggtgtattcactggattaggaggtgcttttatcacattgagttatttaggaaatattgaaattgatgtggaaaaaccaattatgggatttgatccattgatggttatgggtggtgccgtgatattaggtggtttagtaggattcttggttggaccattcattggatcatctattttccgtttaactaatagggcacaattgaaacaatttgaacttaaaaatacagaatgtcttcaccacgggactggacggtcccgcgcttga

SEQ ID NO: 1048 - DNA, 198 bp, Candida albicans
gtcatcgggtctgtggtgagcattaagaatacagaatttgtgtcgagaattagaataaaaagaacagatccttcatcacaaagtttttctaatccaattccagattattatggtgaaaaaatatattcattaaaggattataaacaatggttaagagattgtaatgcattcagaagaaaatcaaaggaattcctttag

SEQ ID NO: 1049 - DNA, 1203 bp, Candida albicans
attacaatgcttattagaaggttaccaataattccaactagagccattcctagaatttcttacagtcaattccacaccaccgtcgttaatttgaacaaaaggattaccggttgtgatcacaagggacacgattttgcttttgttttcgatatcgatggagttcttatccggggtaagaaaccgattcttcaagctaaaccggcgttggaaatactaaacagtcataagattccctatatattgatgaccaatggaggtggagttctggaacgaagaaaggctgaagaagtgagtgagataactcaattgaacccaccaatttctccattacagatcgttcaaagtcatacccccttgaaagcactagcattacatcatgcctttaatcgagttttggttcttggaggagatggtgataatgccagacatgttgccaaacaatacggattccaagatataattatgcccattgatatcgtttataataacccatcagtgtctccacaccatagatacacacaagaagaatttgataaatttgctcaacctatagatgttactaaaccaattgaagcaatttttgtattgaatgaccctagagatttgaatagtgacatgcaaattgtacaggatttattgaattcagaaaatggtcttattggtaccaagagaaatattcatcataatagaaatttacatgatccttccataccaataatttttagcaataatgattatgtttatgccaacgattatccattacctagatttggtcaaggggcatttagaataattactgagagattatataaaatcactaatgggttaaaaaaacatcaacatttaaattcattaattttgggtaaaccattcaagattcaatatgattttgctcatcacgttttaatcgattggcaaaataaattaatcaacgaagattttaatagtgagcagatattaccgattttaggttccgaaccaacaaacaccccatttaaaaagatttatatggtaggtgataatcctgcctcggacataaaaggtgctaacgatcatggatgggagtccgtgttattgaaaactggggtttatcgtgacgaggatgcaattgacaccgaggcagctaaaccaacagcaggaatatttaataatgttgaggatgcagtgataacaattttagagtcgcatggaataaaagtataa

SEQ ID NO: 1050 - DNA, 978 bp, Candida albicans
aactctgttgttgaagaagaagatggtggtgctcaatttcaatcatatttgaataatgatggtattgatgaattaactccgctggttcgaaaacatagagtctcatctttatcgttgtccgatttaaatcaatggcaaaatggattaaccaaattatcttcctcaacttcactttcgaaaaaaaattcatcttcagctaatttgaaaaaagtcgattcattagctaaattatcaagaaacgcatctataatcaagcgtaagaagaaggaaatcattgatcatgaacgtgttgcttcatatgccttttgttttgatatcgatggtgtcatattaagaggtccagataccattcctcaagccgtggaagccatgaaacttttaaatggtgaaaacaagtatcatatcaaggtgccttcgatatttgtcactaatggtggtggaaaaccagaacaacaacgtgctgatgatttatccaagagattaaactgtacaatcactaaagaacaaatcattcaagggcatactccaatgaaggatttggttgatgtttataagaatgtgttggttgttggtggtgttggtaatgtttgtcgtaacgttgctgaatcttatgggttcaagaatgtttatacaccattagatattatgaaatggaaccctgctgtttctccttatcatgatttaactgaagaagaaagagtttgtactaaagatgttgatttccacaaaatcccaattgatgcaattatggtgtttgatgattcaagaaattgggctgctgatcaacaaattattttggaattgttattatcagtgaatggagtgatgggtactcaatcaaaaacttttgatgaaggtccacaaatttattttgctcattccgatttcatttgggcaaccaattacaaattgtcaagatatggtatgggtgcattacaagtttcaattttcttcacgcacggcggctggaaggtcacg

SEQ ID NO: 1051 - DNA, 522 bp, Candida albicans
  unsure (35): Identity of nucleotide sequences at the above locations are unknown.
aaaagaaaacaactactagtaataccactaccaanaaaaaaatcattgccgttatttaaaaaactaaataaagatgaaattaataattctgataaagatattaacaatgataatataactaataataataataataataataaaagaaaattggtggagacaaaattaacttatttcagtagtgatgatgaaaatagttctgatggatcagttttggagaatgatgacattgatgatgatgaacttatagatgaaaatgatttacttaactttaacaacaacaacaacaacacaaatggtgggagtttattatctgataaattaattacaccaagaaaatgtgatatatcattaaatggaggtaaaaaaagaaaaaaagcttgtaaagattgtacttgtggattaaaagaattggaagaattagaagtatcaaatcaacaaaatttacaagatcaaattttaggtaaattagctcaatcagcaactttagaagctataaaaattgaagaaagattaaaacaa

SEQ ID NO: 1052 - DNA, 204 bp, Candida albicans
aagccgaaaaaagcccatggatcaaaatctatgaatttggttattaattttgataatgatgaggattgggttttagtgaatccaagtaataacggagataaacaaagtttgtgggatttagatataaggaatgaaacagaattaagtttatttaattgggatgattatgttgcatataaagagaaccccgttgagaaatggtaa

SEQ ID NO: 1053 - DNA, 2760 bp, Candida albicans
tttaacggtttgatttcactaaactatacaaagcgaagagtatttcttcaaaataccttccctttttccaatcgttctttattttcaacaagttttatacattctgggaaataccacctacacacttgcaatacccaactaagcaaacctagaacgccaaatagtccagttgcaaaggggacgctgatgtttaaagttactacaattacacatttgacagatgatacaacgagacctctaatatgtttaaccacaagaaaagggttcaagtatctttttggaaaagtgccagagggaacccagagagtggtcaacacatttgggtctgaagtcaagttttctaagttacaagggatttttcttaccgggtcaattctctcctggtcagacattggtggattgcctggattcttcttgactgttagtgatgcaaccaaaaatgggcttactgtaatgggttgtgaaagaatactatcatacattctagcaacatggagacaatttgttttccgaatgggtattaagttgcacattttggatgccgagacaaaccccactatagtcgatgaggaagtcgttatatccccaatcatgatcgatccggccaatcaaacatctccacctgaaaactccagcaaactagtgcgtcaaatcaaaaaattggcatccttgatgtttcccttggataccagtcaagtcaacagcagagatccagaatcttacaaatcagaccctacccaaaatgatatccatacacatgttcatttgccctcggcatcggagatagctacaactcaacaatcaatttcatattgcatctcattcgtgcctgtgcttggaaaatttgatccgaaaaaggcaaaggaattaggcttgacacccggccctcaatttagggatttgactaacggattgtctgtggttaacaaaaatggcgataccattactccagatcaagtgatcgctccaaatagagttttccgcaagattttagttatagatgtgccaagtaacgactactatgaaaatacaataaattccgatcgttggtttgaacatgatcaccccaaaaatgcaggtgaagttggcttggtttatcatatgttaggccaggatttggatttggatttactggactacaaagaaagatttttatcaaaatttccctcagacacataccatgttattagtcatccttcgatgacaaataatgtgattatgaatgatcgtttcatttcaaatacattaaagataaagtcaatcttgaacgagaactttaatttagtcaatctggaaaatttcaaaccattatctaacagtcaagtcgatagactacacgccttgcaactgtatcatctcaacgacaatggtgtagtaccagactcttcatctgctatcaagactacaaataaatcgttattcgaagaagaggtagaatcactagacattccaaatgctgccaatttcgagactatggaaaagaccaagattgaattggattgtaacaagcatactaatttgaaagatagagttcaggtttttatgttaggaacagggtcagcattgccggccatctgcagaaatgtgttgggtaatttaattagattgccatatcaggatgactcgggggcaatctcttatcgttcaatagtgctagacggaggtgaaaatacaatcggcagtttactccgtctatttggtcacgaaaacgggaaagagtttgttcagatatttcaagagttatcattaattcatttaagtcatttacatgcagaccaccatttggggattgtgtcgttaattaacgaatggttcaacatcaaccaagatgaatcgaaattattgtaccttgtggtcccttggcaatttattacgttcttaaaagattggtattctttagagctgcaatataataaggtgtttgatatgaataggttggtatgcattagctgcgaagattttatgatggataacagaactccagaatttataaaaattgatatggacaagtttgaagagttttatgatgaaggcggcctacacaaaccaatacctagggatagactattgctggtggatcacaaaaaaataaaaaatatgtatgagacggtaggattgaattctgttactactgtgcgtgcattacattgtgcctgggcatattcgactacatttgatttcaagttgaacgaaaatggggaaacatttaaaatatcattttcaggagacacaagaccgaatcccagattttctgaatgtggttatggaagtgaccttttaatacacgaggcttccatggatgggaattggatcgaagaggctatagccaagaaacattcgacaatgattgaagctgttgctgttagcaagcttatgaactgtcctaaattgatattgactcatttcagttctcgttatggtatctcgaacaactgtgttcctaaaaatgaattgcaaagttgtgctgataacttggacacttaccttaacaaaagtcattgtgagttgaatatatttcaatcacaatcaccaagtgacttgagtctagaagagatagatttgtggtttgcctatgatttaatgggtgtttgttatggcgatatgcataaacaagagtatgtttggccaatattgagtgaacttttcttaccaagtgctgaagtagaccatgagaaaatcaatgagaagaaggaagtaaagaggcttgagagattggcaatgatgaagacaaaaaagaaaaggaaaatgagccctaaataa

SEQ ID NO: 1054 - DNA, 210 bp, Candida albicans
aaaaagaatgtcactaccgatttcatgggtgataaagttgctcaaatacatgtgggtaaacaagatttgagtaaattacaaacaagaaagatgaaaggattgaaagaaaaatacgatcaagaaagtgaagaagaagatgtgtatgtttctgatgaagagtactttggtgaagatatagaagaaccagagactaaaagacaaaaagtatag

SEQ ID NO: 1055 - DNA, 573 bp, Candida albicans
aaaccaatgtttgtttttaatggtccaatttttgatagtcatccagtttatcaacatattaaatctttatttcttgattttttccgtggtgaagaaactgatttacaagatgttgctgggttacaatatgtgattgccttatctgctggagaagtcgaagatttaaataatgataaagtattaccattagttcatttcagagtgtataaattgaaatcttataaatcaggtcaaaaattaccaagaattgaattggatgaaattggtcctcgttttgattttaaaattggtagaagaattactcctactccagatgttgaaaaagaagctactaaaaaaccaaaacaattggaagctaaagtcaaaaagaatgtcactaccgatttcatgggtgataaagttgctcaaatacatgtgggtaaacaagatttgagtaaattacaaacaagaaagatgaaaggattgaaagaaaaatacgatcaagaaagtgaagaagaagatgtgtatgtttctgatgaagagtactttggtgaagatatagaagaaccagagactaaaagacaaaaagtatag

SEQ ID NO: 1056 - DNA, 423 bp, Candida albicans
ttgcgccaagctcggttgcttccatcccgtggtgaagactttcaaatgctgaaaacaaatactgctatataccaaaagattgctgaaaaaagagcaaacttggaacgatttagggaatttaaagaattgacagatgatttggttttacaactagagtctataggtgacaaattagagacgatgaatggaggaactgccagtgtagcattaattttagcaaactggaagagtgtggtacaatctatttcattagcatctctagctttaatgaaagagtctaatgataataacaaagaggctttccctgaaccattagtaagagtgcgtgttggacaatcaaatgaagaaaatcaagacgatgaagaagcagatgaagaagaaggtgttagagatagtgaagaagttgaagaatccacggaataa

SEQ ID NO: 1057 - DNA, 810 bp, Candida albicans
ggaaataacaagagtaataacccaaatcattctcaacatcaatatcaaccacttgaaatagtgacaatgtttggctccaagatatttctgcgtttatttttcaaacgaacatatgccacctataaacggtttgataataccacatcatcatcatcatttaccacctcgtatgctcatttattgactaacaggaaaaccttatacattgggggaggattattgggcttttatgtttacaaccttcatgatgccccatatactcatcgtagcagatttatatgggttccatattggctagaaacaaaaattggtgattattcttatcgtcagatctaccaacaattccaactgcaaatattaccccactcaaacccattatataaccgggtgtcaaccattatgaacaaacttcttgatgtggcgctaaatgacaatatcaacgacgatttaaatgccaggtttttgaaccatttgaaaagtttaaaatgggagatcgatattattcagaatgatagtttgccacgtaatgcatttatattacctaatggaaaaatattcattttcagttcgatcatgcctatttgtaaaaatgaagatggattagccacggtgttgtctcacgaattatgtcatcaattagcccagcattcaagtgagcaattgctgaaacaaccgatctatatggttttgtccacaattttgtataccataactggggttagttggttcaatgatttgttgataaatggagttttgacaatctcagcctcgagagatagtcctgacagagcccgagggaaacatagggcg

SEQ ID NO: 1058 - DNA, 1092 bp, Candida albicans
tttacattgccacgccctccacaattacaccaaccaactatgccacaactcccgacatcttctgatcgtgagtatcggtacaattataatcaagactcatccttttctaccttaagaaatgtcttaactaccaaacttgccgcagtatcagacattatccaacaagctcgaacatggtacttggaacaatcaaccattaagcaaatactattgggtggtgctcttgttgtgattggtgtcatatcggtgttgatggttatttttcatatacatattattcgattcctcatatatttgtctgacgaatggcataatttgaaatatgggtcattgataatatttgccttagtatttatggttgggttccccccattgattgggttttctgcattgtcgtttttaacagggatgatatatgggtgcccacaaggttggccattgatagcaagtgcctccgttttgggttcaacttgttcatttatagtataccgttatgttctccataatcaagctgttaaattgatgaatcacaacgacacattcagagcatttgcagaaattttaggagaaggcaattcgttatttctattaattttgatcagattgtgccctttaccttactcgttatcaaatggtgcattggctgctattccagaattaccattactcacctattttttggctacattgattacatcgcccaaaattttgattcatttgtttgttggtagtaaattgaaacaaattggtgacgacaaatcaagtggaggaacaaaaattgtggatattatcagtatcgtgattactggaactgctgcaactttagctgcctatttgatttatgccaaaatgcaacaaaagttggcaagctatcattcaagaggtatagcagccgatgatgttatggtatttggaaattttgaagatgacttggaattggggagtaatgaaatcgaattaaactcggctgattttgatgctgataattttataattgaggatgatgataatgaagatgatccaaaccaacagggaaatggtaataacgttaaaaaagataatggtgtacagacatctgaagaaatactttag

SEQ ID NO: 1059 - DNA, 1803 bp, Candida albicans
  unsure (63),(92),(95),(116): Identity of nucleotide sequences at the above locations are unknown.
ttatttgaaggaaccccaaaggttttaaattggttcgggcgtaagggccaagtgtttcagttnccaggaataatacccttcaagtttggttnaangagaaaaacccccaaaaccanaggaaattccacgaatggaataatgacgagttttatgaagtatgtggacggatcagtggataatgatttgccaattacgagattactggaaatgtttaatgttgatcatattattgcggttcaagttaacccacatgttgtgcccatattgagagtgtcagtgagcaatataggtggtcaagtcgaaaacgatttgatatacaaaatgaaacatattttgaataatgtctatgattttgtttcgtgtgaagcaatccactatttgcaattgctcaatgaattggatgtttacaagaatttgtctaataagatgatatcaattttgtctcaaaactattctggtgatatcactattattcctgaatacaagatgagcgactttgttaatttatttgagaatccagatacagaattcatgcttgattttatatgccgtggagccaaagtgtcgtggcccaaagtgtctataattcataaccactgtagtgttgaatttgcgttggacaaggcaataacgattttgagaggaagaattattacgtctgcaaactatcgaatcacatccaacagtagtggtgttagacgcagccagctgtactacaaaccaaaacagcaaataatgaacttggttacttctccggtaatgaatgacagtactcaattcaacacggcaccagcaacgccgcttaaacaaaagcaaagaccactaggagttcaaagacaccattctacgtcgaatacaatttccaataaacaccaaccaagatccaagagaaattcaatgagtgccacggatggcgggcaagccgaagccgttgctgctgcgtactcaactgtaggcggtgcaactactcctcagaaaaagcttttaaaagggatttcaaccacagcactagtgcaattgacacagggatacgtttctggagattctacattggtaaacgatgattcagaaaattccaatggaccagcaactacaactagacgcgggattagaaaagctaggagttcagggaatattagaaataatatggactacaataatgctgatcgtccagtatcaaggctgactattgataggattccctataaaaacaatccatatttacaacaaagatcaaaagaatcgttggagtcattcagtaaggccgaggaaggtctaagtcaaaggaagaaaccaaatttaccaagtgtatcaagatccaattcccaccgaaactcgtatattgggttgaacaggttgaaagataataatctatcaaagcagaataataatctgtactacaacttaaagcagttaggtaaaggtcccaacaaccaagaattgatcaacaaattggaacaagaaagaaaaggaatattgaagaacggtaatcgagagagtatagcgaatttggagttgtttgctaatagtgacgatgatgacttgtgtaaactcgaattgtctcatgacagtagtttaggtgatgatgaacatagcaatgagaaagagtatacaccaggtgatgacgatgacgatgatgatgactcagatgaagaagatagccaatctcacagtgacgaagaagaggaggattacggtgaaaaggccaatggaagcagcttgaaagtggcttttgaatctgtggagatgacaaaccgttcagagagtgttgttgatgatattgatccgtattttggtaattga

SEQ ID NO: 1060 - DNA, 879 bp, Candida albicans
tcgaacatgagctctgaagtaacgttggtacccactgtatcaacaacgtcgtcagacgccatcatcaaagaattattccaacaatacatatcgttacatccaaacgacaacactacttccaacaacaacaaacaaacagagcgtactggtttttcacttcgatcgttaccgattataggtaactttttccccgagatggacgataagaaaaaagccattaatgagttattagagatacaaaaagtgacaacttcgtatcgagaatggtacgatacatctttgaaactagatgagttgttgggtaacaatgcatggaaatctgatccgaaaagcgatatatacgactatgatttgatctacaaaaatctaaatgaaatgaggcgagccagattgaaccacgattacaaactacttttgtattacattagaacaaaatggataagaaatataggtaatatgggagatgcaaatttatacagacacgcttatgtgggaaccaagaagttaattgaagagtatgttcgagagtgtcaattatcgttggagtatttggtcaccaacgacgaagtcaacttgaacgataggtatttattgggtatgttgatccaaactagaaaaaatattggacgtaccgcattggtgctttcaggaggtagcacatttggaatattccatatcggtgtgttgacgactttatttgaagcaaatttattaccaaggattataagtggttcatctgctggttctattgtggcaagtattttgtgctgtcataataatgaagaaacctttgagttattgagcactattaccaccaaaaaattcaatatttttgatgttgttgactgtgacacctcccaaatgtcccggatcttttaa

SEQ ID NO: 1061 - DNA, 3180 bp, Candida albicans
  unsure (289): Identity of nucleotide sequences at the above locations are unknown.
cttatttcattccttcgtttagtttatgttatttttcctgtcatgatgactccacaaatgatgtcttttccaaatttcattagagaagcggaacaaactactagaccattagatcatgccttcccacctttgaaagtagaacacaagtataaaagtgtttacgaaagagccgggtttgatgtaaataaaggtgacaatagtcaccgtaatcaaagtgataataaatcgattggttcaggtatgaaaaagaggaatttttccaatcctaggatacaacatggcagtacanacaactcatcatcatcattgccacaggtaaacactagaaaggcaccaattcctccaccacaattgaagactgattcttcggatcgagtagtgtcccccacttcgtctagttcatctaaatccagcaaatcgctgtcaatgaattcaaattttactggcacacataaaagcaatagctctcacaccactttgagaaatactgctgaattcaacggtgcatttgaacaaccattgacaacagggtcttcaacaacaacatttttcggtgaaaatgatgtacaaccaaagccttcaaatggtaacccaatgtctactgtcgatgttgggctaacagcagctaacactaatgttccaacaaagccacattttgacaacaaatcaatgcatgaacaccaccaaatcggctcaaacgtactatcagaaaataagaatgcaccaataacaacaagaaatgaggataattcacctaatagacctgcttttgacgcacataacgaccaatttgatttcagtccttcacctagtcaaagtgggaaaaacttgaagaatttaaaacttgagttaaatcatgataacttgtccgatactagcagcttaccagatgtgaaccagaaccaaaagtttgaatcttcaaataatccatatcaatctagaaactcttctagtgatggtccagcaaaagatatttatgcacaacaaggatatcaaacgcaatcacaaccaaattctcaacctggatctgctaattcaggagtcagatttgatcctagaagacagcgtcatcaaccagcaagtgctacttcaagtaaatttcctgctcaaaattcccctcaatatccaatggtacacccacaacaaaggggaccagctccttatccagcgagtccaatgggcacgcctggtcatggctctcaatatcctccgccaccaccatcacaacaacaacaacgtaatatgtcacccacaagtggacactcacaacaacgcattgtttctcctgtaagtatgcattcacaacaacgtcacatgtcaccaacaggtatgcaccaccaccaacaaatgcaaaatcaaagaccaaatcaaccaccagtgccacgaatgggaggtatgcacccaaatccgaaacaaccacaattgccattaatgactcttggtggtcagaaacaaccatactatccacaatcaccaggtgccccaccattaagactgcaaaatagaccttatccacagccccaaggaaacgtgcatggccatccaccagctcaccaactgggaatgcagcaacaacaacaaggttatccacgcccacaaggtccaccacaacagactagacaaagacaacaaacttattctcaaataagagatgacaagttgtcatctgcattgaatgagtttaagagtgactatgaaagtcataaaggaagtaacgattcacctacaacatcaaatacagaaacagatttgccaagttcttcatcttcagacttggatttatataaatctacgcctgcaaaggactctttgaataatactcctgaaatcaatgattatagattttcttatgaagccactaaacaacaacaacagcatcaagtaaaaccagtggcagcaacaaccgccaccaatgatccttctgcacaattccaaaatttcactacacaacaattggccaaagaaggtgatttaaataccgaatatcaacaatttttgaaacaaaaagaaattggtaaacgtgataattatgataatcgtcatttatctatggtcagttctataatcagtaaagaatccaataacagtaatgaggatgaaattgaaaaggaattagaaagacaattggaaaagttgaaaatgtcaggcagtagtattaatcttagtaaagttgaatcacaaggtggtaatggtagtaatgctggtactgattatgctacacctgatactactatgataattcccaaatttaatatccaagatgttgatgacgatcctgaaccacaattggagaatgtacaaaatgaattagaattagaagaagagactactagaccattgactattactcgtacaaattcaacctatgaagatgaagtggcaccagcacaagtggaagaaccaattgctaaaagtgttaaattcactgaattacaacctgaagcaaaaatcacatctaatgttccacaacctcagcctggttatccaatcaatgattcatttggaattgatgatgatgataatgataatggagatgatgaatatgttaaaccattatcacctaaaaatcatttaattgaacaagaattacaaagtatgaatttccaaatatcacaaaccactgaatcaccaacgacattaatcaatcaaacatttgaatccaccaccatcgccaccaaggacccattaccatcaggtactggaccttgtagatcgtgtcatgaatctatttctcctgatgccaaaggtcaattacgtgccatttattctaaaactggtgaattatcaggtcaatggcataggaaatgtttccaatgttgttatcatgaaggtgatgctacagacggcattaaatgtaatattcaattcaataaacatgttcaatgttatgtttttgatgatcaaccatattgtttccaacattatcatattttaaataattcaatttgtcaacattgtgaagacggaattgaaggagaatgtatcgaaaatgaattgatggaaaaatggcatttacaatgtttgaaatgttcaaattgtcatatggggattagacaagattattatattgttaatgaacatgatattatatgtcatgaatgtaaaacaaataataatatgggattaaatgttcaagataggattgaaaaaagaaggacaagaatttataataatgtgtaa

SEQ ID NO: 1062 - DNA, 237 bp, Candida albicans
  unsure (25): Identity of nucleotide sequences at the above locations are unknown.
ggcggacgcggatcttctagccccngtggtcgaagacagatattaagtaaagtattggatgaaattggtgttgatttaaatactactttgaaagataccccaactggtataaatgcagggaatattgaacaagctgatagggcaagaatggctgaagctgtgggtgcaaatggtgccagttctcatgatgctgatgaagacgatttacaagcgcgattagatagtttgaaaaaataa

SEQ ID NO: 1063 - DNA, 1116 bp, Candida albicans
acacaagtgcggatcttctaccgcgtggtgaaaattgataacaatttaaccaattatgatttaattttatttgatttatatatgaaaattaataataatattgatagtggtcaagattttaaatggtggaataaattaactaataattctaattcatttttcaccgtgttaattaaatttattatcacaactcaaaccattcataacaacagcaacagcaataattcacaagttataattgtaaaaatttatcaattattgaataaattatgtaatgataaaatgttatttaataatcaattattagtatcaccaataatggcattaatttattccttagatgataacattagcaacaacaaagatgctaatcaatttttgaacaagatttggaatatgttggatgaaacaatatcaagagtagttagaactccttataaatatcttgatttaagtcattcacaatatcaagatactagtatatttaatgttgctttgattgaacaatttaaatttatcctcaacaaaaaggaatcatttaatgttgatgataaagatgaagatgatgttagatatattaattggttatttaaatttttcaaatatttgatattaattggtgaatccaaggaatcattattattattagttaaaaatcaattgaatattgatgatcatacccttgaagatttaggtttgattaatagtttgaatttgtccaccaccaccaccaccaatcaagataagaataatgaattgaatttgaaggattcactgattatggaaattattatgaattgttcaattgatgaattaattaataaaatgggattatttgaaaagaaaataatttcatcaaatttggattttttagcatgtttattattaattgatttattaattcaacaaccaccaccaccacaacaacaacaacaacaacaacaaggaaaagttaaacaattgattgaattgattttttcaaaaatttggagttttttaatgaattcaactatcaacaatgaagtagataatgataatagtgatggagcaattaaatatttcacatcaattaaaacttggaatccatttttcaaatccatgatcaaaccaactaat

SEQ ID NO: 1064 - DNA, 1191 bp, Candida albicans
aataagacgaccaagacaatgactaatttatcatatgatgaaaaatggaatcaaataaaagaattttatcaaattagtaatagtattcttgatgtgaataaattagcttatgatcatgaatttttaatgatggttattttaaataatgatgaattattgaaatatcatgaaaataaactgaaacctgaaggtaacaataaagatgagaataaatcaacaactctaaaagaatcatcgattaattattcatttaatattaaaaatttaattgatacaggaattttacaagtgattgtcattagtcttggtgataacaataataataatgaatcaattaaaaaaattgctcaaatcattcttggtaacattttacaatcaataaattgtaacattgaagaaggtgacaataacaataacaataataatgacattaataaatcttttaaagataaaaatatttatcgaatttatttatcaacaatattattcacattaagaaatcaacaaacaacaaccattcctcatttgatttggtatatatggagtcaattcattccaatattatctaatcctggtcattttctttatgataaagtcactcgatttgtattatcacatcctatgattaaacccaatcaaatcccattattcaattcaattattaatcattcagataaatataatgaatcaattagtataaattctcatgataataacactaatagtggtggttatttttattatcgagaattaaattggttaattgaaatcattaatcaaggaattttaactcaattagatttatcattaatttgtaattatgataatgggattataattgaatttttcattaatttaatcaatttaaaatatttgaattttaaattaaaatcatcaattttgaaatttatttataaattacaatcaattgatcagggttcagatttattaattacacgatttggattattaagtgatttagaattaatcatcatgccacaacaagcacaagcacaatctaaagtagatgaagatattattgataaacaattgaaaatcaatattgatgaattgatattacgatttggtattagtgttggatcaagtaaacgagttagagaatggattggtggtgatgatgaattagagaaaactttgaaacgaattcatcaagaatcacaaatgtcatag

SEQ ID NO: 1065 - DNA, 831 bp, Candida albicans
  unsure (659): Identity of nucleotide sequences at the above locations are unknown.
tggctgaagaataaattatcaaaaatcacttttcaaattgatcaaattaaatcttatttatcaattccaatcaaacaattaattaatgaattttataaacaaattttaaataattctcaatatatgaaaatcatatatcgagcattaaataatatgaaaccaagtataactatagctaatattcgaattttaattaatatgattaaatttgatcctttgattattggacaagaatttttaaatggatttgatttaacattaaatgtattaccaaaattattaatccctaaaaaatatgaattagaaacagaagcaaattccttgtcagcaaatgaaagtttccaatctagtactattagatctaattttattagattttggtttgaattatgttctaatgtatcatttattcatcgtcaagatttattacttaatcatcggaaaatccttaataatatatggaaatatttatcaattgattcaattgaattaattgaatttattattgatttcattgatttgaaaatatttcaagaattgaattttaaacgatcaattaaatgtaaaatattgaatgaaaatttcatttataaaatatcaattttattcactaaatttagtaacagtactaatactagcaaatccaagtttattacatntattgataaattagctattgattctaaatatggtttaagttttcctaatgataaattatgggaaaaagaatctaatattggagttataattgaaattaataataaacaatttaaaattgctaataaattattatacactttagttactagtcttaaaccaatgaatcaatga

SEQ ID NO: 1066 - DNA, 1353 bp, Candida albicans
ttagtatatctttatttaaaatacaagttctcatcttcatataaattttttttttgtttgtatttgtatttgtggatttgtatgctggcctttttttttttgcaacaactagcaaatacaccacaagttcaagtaatggaaacaaagaacaattggtatacctatggttccaattacaccacaaataacatcacttacgacttggcttcaatttcaccgaaaaagtccttagaatgtgaattgacaattgaatttcttaaaataatctacatcattgatgaggcaccctacaagtcatggcaaaaaacaatcgattcctgtcaaacgatccataaatcgttcgaacgaatatcagaaatactcataaagcaaccaaatctagaaagtaacgtaacgaatttcttgaaaaacaatcgactcaagtacattcttgaaaatgttatacttgagagtttaaagtcacaaatttcgaaatgggatatattagtccacattaataatttgtatccggtatctttacttatcgaagcagtttatgactggtcaaacatttatttggttaatattgatgaagaattatcactagttctattatgtacatttcaagtgtacagaaatattgaagatgaaacacatgaacttgacgttatgattaaggagatgaagcaacgacacagttacccagaaatacgagcaagaaatgttaacaatctcattctattaattttaagtaaaatgaaaccaacattggttttctttgaacttatcaaacaactgatattgtatgcgaaaacagaatgtgagattagacacttaattcaagattttgcaactctattggagaatttaaaacaaactactaatcaagaaaacaacaatgaattaacaaaaataaaactattaattcaagaaattattattattatcctaaaatcgtcttacgaaaagataaattggaattgctttcagcaagctcaatcagattatgagagtattttccaaactttactgactgcctatcaatcccaacttgctagttctacaatggttcaaaattcagatatacagctatttattgacgactataataatgatcctaatccaagtttaaatagagaaaacgcagcagaatggattaataatgtattttgcaattcagaaaatctcgaagaagatgatgattactttgagcccgaattcgaattaccaaaaatgatagcagaaggcagcaacacatcgataagacctcacaaaagatcattaactgaacccattaaacgcttaatactgaagagaactccaaaagacaagtcaaaatggcattttctggagatttgcatgtctcaccacggg

SEQ ID NO: 1067 - DNA, 1281 bp, Candida albicans
tttatcagaatcggacacccagcacgattattaatgacaaatttacaacattcattagaaatattatcgaaaacttatggtcgtgatattattaatgaaatactaaatgacattcaatcggtgttaaccaaaattaaaaaatgtaaaaaatacggtgaacggaaagcattgtactcagaattaaagttgttgaaaaaagaattacgacaacgggaacggaaaatcgttaatgaattgttggtacaagcacaggttgttgttgctactttacatggatctggatcatatgaattgaaaaacagtgttggtaccaataacaatgaaggtattgtatttgacacaatcattattgatgaagtatcgcaatcattggaacctcaatgttggataccattactattgagtaatagattcaaacgattagttatagctggtgacaatatgcagttaccaccaactataaaaacacaaaagagcaactcatcgtcgccgtcgtcgtcgtcgtcctctgcttcaatattggcaaccactttatttgatagattaatgaaacattgtcacggtgaaaagtacaaaaaattattggatgtccagtataggatgaataaaagtataatgcagttccccagtatgcagttgtatgataatcaattgaaatgtgatgattctgtgcgagaaattagtttagttgatttaccaggcgttgaaatcaacgatgatacaatgacgaaatgtatatggtatgacactcaaggtggtgaatttcctgaacagattagcgaatcaattgatggggattctaaatacaatgatatggaattattagttgtcaagggacatattaagaaactattatctagtggggtccagccacaagatattggtgttattgctccttattcggcacaagtccaaaatctaaaaaaacaaatggggttgggaggtgaagttggcagtagtgctaatggtgataaggacggtcaaattgaaattagcactgttgatggtttccaaggacgagaaaaagaagtgatcatattgacattagtaaggtcgaatgattcacgagagattgggtttttaagtgaacaaagaagattaaatgttgctatgacaagacctaaacgacaactttgtgttgtaggagatttagaattgatgaatcaaagtggtaataaatttctacaaagttggagtaagtttgttgaggatggaaataatgatggtgacgttattttcgaaatcgagtatcccaatttggatgattatatagagaactga

SEQ ID NO: 1068 - DNA, 675 bp, Candida albicans
ctccgtggtggacacgacaagacttttctaagttcaagttatgatggaactgtcaaattgtgggatttaaaatcatcatcagccgtcgggaatctaaaagttgggcaaaattccgtcattgggtttgatccacatggagttgtttttgctattgggaaatattctcaaggtgaaacaggaacagtgtccctatatgacttgaaaacatttgacaaggctcctttcttgcatgtggaaatacctatcttgccaggacaaatatggaataaattggagttttctaacaatggtaaactaattcttatttctacagattctgctgaacattatgtgcttgactcgtatctgggagaactattagcagttgtcagattggctatagggagtgttgctagtaataattggatgtcattcaaatacccttacactgggtgttgtaccttttctccgtgtgggaagtacttgttggtgggcacacccaaatccacaataaatatttatgatgtttccaatctacacaactccaacaataaaccagtgatattatctagaacaaaccacattctacaaagcacaaatggtattcccaaaatcgtttcttttagtcccaaaatgtttactttagcaacggcagatactacagtaaccttatggctgccaccagaaaaagtgtaa

SEQ ID NO: 1069 - DNA, 1206 bp, Candida albicans
tttctgataatcttggattatcttattgacagcataagcttgcagatgtcagtggctagtaatttaaccccaatgcttccaagtattcttttgatcattgtaaagattgccggaatccaattattggagtcgaatcaattgcacgatgttttgactgatatgtttgtgatacttgactcctttcatggttacaataaactcgttgaaagttttttcatagtgtttgaggctttgatagatcagatccatcataagttcgacagtcaacttaaagttgaatttaaggagtcttcgaaaacaaacacttcattgtataagccatggggaatgaccaataaggatcaactattggaactacttaacgagtcaaacaaaatggtcgataaatatgaaggttatgatagtaacaaggagtattttaaaagaaaagctgacttgcctttttcggagatggatgcagattctgatgacgaagaagaggaggatgaatcaaatattgatgacaatggagaaaaagaagaagaaaaagaggaaatatggagctcacccgtctcaaaggacatttatatgatttcactacgaatatttaattatggttttacattggtatcacaggaatcttacacattgaaaacacaaattatcaaaacactaagattgttattgcctttgctttgcaccaattacaaattattattacctgtattagccttaaattggcagatgctaattgctttagtgacaggttcaaaatctttatctacaagtattgaaagcaatggtgaatatgcttcggaagatatcggtgtcatgaccgtggcccttcaattggtgaccgaaatattagaagaggataaaaggagatatgaacatttcttcagtaaaaagtttcaggaagcttgggaattcatatctcgacactcaaaactagtgcgtcaaagagaagtcaaatcaacaactaatattagagaacaaaagcaactagttgtttctgaaaaagcgatatatactttcagaaactatccattactaaagacatcactagtaacgtttttaattactggtgtacaaaattatgaaaaaatgatccctgatattcaccgctttgagattatcaaattgtgctatgaattgcaaattcctcaaagtattcctttatctagggatacaatcggcgtactagaagttcttaaaaatacaacgtaa

SEQ ID NO: 1070 - DNA, 714 bp, Candida albicans
  unsure (32): Identity of nucleotide sequences at the above locations are unknown.
catcgcgcgatcttccaggcccgttgtcgaanatatattcataatttgaaaacagtttcccgcaattggaataccaatgaaattaataactcttctggtaatacactaattggtataagttctaagttttcagagacaatactacagaactttattaattatttatcaagcttaaagtacgaagctagcaacagttcaacgttaacagaattggagaatatttttgaattagctgacgataatgacatgattactaaaagtacctctctttgggttgcttctaattattacaaacgatcaacccttggcaaagtgatcaattttgatttaggaaaatacttggttttagatgatgatgaagatatggaaatagatgatgataccaaagaaatgtcatttttagttttatcaagggcagaagagttacttgaagagatttccgagaaccaagaaaagtactcttcacaaacttatatcctagcttacaatgcagcattacaatcaattaaagttgttgctggctcgatcccacttgatcagtttagaaccaattttttgatggatcatttgttgtcagtatttcaagcattaacgtataatgatatgccagaaatacaattacaggcacagtcgacgttgaaagtgatattggatacatattataatggttcgatggtcaacttgatttctgataatcttggattatcttattga

SEQ ID NO: 1071 - DNA, 408 bp, Candida albicans
aggaaaatgaggccggtttgcatagaactatcagaagcttcaactctgcaaccattcaacacaaacaaagttgtcaatttgatgatatcaatggaagacattcttaaaaagcaccacgatgagtataataaggatggaaattttagaatctatcagctatcgcccaagctagcagattatatcttttaccctttatccaatatattgaaacagccggctttagatgatacaattatacagcatttgttcggaataattagattcctagttgaatactcttggagcttcaacgttaattttgttcttaccgatcagttacttcctttagtgatatacctttccagtggagatttgaacaaggaaccattactcataacaaagaaatccatacaattcaaaattaaaggc

SEQ ID NO: 1072 - DNA, 1428 bp, Candida albicans
gagaaaaaaaaatatatatgtttggccgttttttttttctttccattgccaccagtaacaacaacaacgacaacaacaacaatggctatcgatagacagacccttgtattttttataataatgtttatattcttgtctttgccttcgggtaatgagcaacctcattcggacaaggatagagaaacgttacagacataccaacaactgatacgcaactctctgtcaatactacaaaattcaacgtatgcactggggtacgggaatatcaccgggtaccaactatcgtacaaagaccagttacaaggcaagtcagttgctgactggccaatacacgagtttagtccgtcacatccgtgggtggagagccaagagtattctattttgcctgatgaaattagtcacagggtgcgcaagttttgggggattagtcctgttaaggacaaggcatatttgttgaatatatctggcagagcagatggcgagtttcaattgatagagagcaaagtaaaacctacaaaattatcaattccaaagtacttaaaagagtattacaagtcccgggaaaattcgtttaccaatgacgagcctacggaagataatcgtgaatactttaaaaaaccaattgataaaaaagggaatgtcaccactaatgaaggcgttgtatcgatagcaattaaagggtcgcagtacaattttgacgacccaaagctttcaagatttgttggcccggaggataaagttgataatgctatttgcgtgtctatggatttggatattaaggattaccctgaaattgaagatcacagcttggtgttgaacggagtttattttcaagagacggggtctttaattggagtcacaaactctgttaagttttatggaaattacggactaagtcacctaactatgggtgataaaaactttgcaattgccaaaacacttatgactcagtttagtaatatgactaatgacaatgaacttactatggatgatatgaattatggtatagtcaaggcacacgagcagtgcgagtacattgcatttatccaatttgcgaaaactaatttcacccacgaacggttgcgggagatagacgaagagttggaaacgcctacaggtagaccgttacctcatgaaattccaaagattgttattgaagaatatatactttactcgccagattgtggcaaagtgttgtctctaaaacccggaagtgtgttttccggcaaaaagaccgaagtcactcgagcacaaatgagaaatgtgttaactggtatattggtgttggtcgggtttcagttatttttggtattgcgtcagattaaaaatgcccaaacaccaggacaattgtcgcttatttccagcaaaacattgtttttacttggttatcaagattcgttggtggcaataatgacattgttgctttca

SEQ ID NO: 1073 - DNA, 624 bp, Candida albicans
atgagaaaaatcaatcaattacttcgtaagaataaaagagaactagatagatcgatgaatcaattagtcccactcagaaagaaaacagagtcattaatcaaaaaatcagctaaggataaagattacaagtcagcgaaattgtacgccagagagttgattaatataaataaactatataacaagctttacacatcaaaaacaagaatcgagtcaatcacaatgtccatcaatgaacaatattccatgaataaactaacccaatctattcattcatctacttcaattatgaaagacgtcaatctgttaattcatattggggcagtactgcatactatgcaagaattatcaaaagagcttatgaaggccgggattataaatgagatgatggatgacatggttgacttggatgaaatggatgaggaattggaagaagagtcacaagaagaagtaaataagataattgccaatttgacagaggataagttttccaaaattgaaaatgaggtaccaagcaatgagtttaatgaacaggtaatagaaccaccggcagaagtggcagaagaagacgaagaggatgaattggcattagatgaaatgagagaaaggttaaaggcattacaatag

SEQ ID NO: 1074 - DNA, 381 bp, Candida albicans
cctcagactgaacctgtaattactaaatggttagttgactcggcaaatggagctgctggttcatgtagtggtggttccgatggggttacttgtgggttgtcatggactgactggtctcaaggctgggacggtaaatgggggttaggtgaacaaatgtccgctttagaagtgatgcaaaacttgatggttcataaacgtccagctccttacaccgccgatactggtggttcatatattggtaatcctgcagctggttatggtaaacttactagtgatgctacacctttgtctatagatggtggtgataaagcgggagcgggtattattacagcaataattggtgcatccttagtagggtcctgtgtgtggttgatattatag

SEQ ID NO: 1075 - DNA, 948 bp, Candida albicans
actacaaatatgtcatcaaaaccacttattcgtttccaagtgatacactactatctcattccaataatagcactaatagtatggtgggggatgttaatcgccatgttgtcatgttggggtgcccaaggccgaccaatctattcatttatgaacggagaataccaaaacccagtatacatttccgatatcggtgccactaatcttcaaccattattcatctcctgttctggtttccaggcaattttctttgttggaacattaataatgggattttatttacgttataagtctggtaaaattcaaccatatatttcgaaacatcaacctcgtttagccattgctagtataatttgtgctgctattggacaattgggaattgtgtttgttgccatattcaataccaagaatttccatcccgtacacatttcaatggtgggtgtgtttattgccttttgctttttagcttgtgtttgtgatttcaccatttcatttatatttggtaccaatccttctaaattagatccagttcatgatcaagtggtatttggcacttcgaaatttgccgatttatattttgtttcattcatgttgaaattagtatggttatttgccgcagtggcatttgccatttgttttggggtatatatgaaaaacgatcaaaattccaaatcagctatttttgaatggttaatttcattctggtatggattattgttggtcatgtggtcaatggacttgttacctagtgctttaagaaaatacagattcaaacatcctgatatgtatcctcgttatgtccaataccatggtaatgtcaataataataaagccaacgattatgaaagtcaatggattaaagatgcaagagaaggtaattcatcttcagaaatcgatgataaccggacttatgtaggtaatggaggtccaatgtctcctagattgtcttag

SEQ ID NO: 1076 - DNA, 645 bp, Candida albicans
ccttattctaacaccctatccaatccaatagaacccttcttaaccgtcatgtcctctgtagtatattataaatttttgcatcagaagaataaaagtgttatacattttgatggaacctccataagtgtatttgatttgaaaaaagagatcattttacaaaaccaattgggttcaggtcaagatttcaatttgagattatatcattctgaacaacccgatcaagaatatgaattggatcaagatgtaatacctcgatcgagttatgtattagctaaaagatctccagcatttgtcaaactgggtaaatataataatgctctgagatatataactggtaaaccaagaataaatcgaaaggcaattacttcgactgttggacataattcaaattcaaatcctttagtgtcagcacaacttcaacaacaacaacaacagcaattggatgagaatgccactgaagaagatagaattaaattgatgtttcaaaaccaatcgaatgcttgggaacaaacacaagaagatttagctcatcataaaatggtgttcaataaacccacagcatcaagtacggcgaataaacaagatgatcatccacatacaggtaatatttattatagatgtgggaaaaaaggatcattagattaa

SEQ ID NO: 1077 - DNA, 852 bp, Candida albicans
gaacaactggtattccagaaatattatttgaaaaccatttccagagaagaagtcgaaagtaaagcaaatacattaactacaaatgataatggtgatgttgttgatagtgaaggtaatgtgatattaattactgatgatggtgattatgccattaccatggctgattccaaaacatggcaaaattatcaagaaaaattgcaaaatgatgctttaaaatcaaagagagaatacgaactgaaattagttgcggaaattgaaaaggataataaatgggaatttttggatccattggccaatactaaagcggttttaacatcaccaattgtcatgacaccatgttgtactgatagttccaaactacaaaacttgaagaatttcaattataatcaacctgaactagaaagagttttaattgataatgactttcattgtcctaattgtggtaaagctgatgtgtttcttgattcagttattcccaataaggatttagaagagaaattaaaagaatatgtatcgtcaaaagaaaaagaacttaacataaaagatccaagtaaacgtacagcagcagaaatgacggctgatgataataatgatcctcatcattcaggagaacctgatgctaaaaaacaaaaaattgttcctaatactgtccaaccaggaatgttcccagttggtgttatgccaccaccaccaccaccaatgccatttgccttaccaccaggacttcaaattcatccacctggatttggaatggtgccacctcccaattttatgccaccaacccaaggacaacaatttaataataataataataataataatagtaataatcagtttaatcagcccaaatag

SEQ ID NO: 1078 - DNA, 555 bp, Candida albicans
agcccaaaacagatacaacttgtaacaatggtgcacgctgattattcaaatctcaaatctggagacttttccaaagaagaaaccctccaacacgttctagattcctacaaagcattagaaaccgacaattgggtagcaaacttatccaattgctcatcattattatggcatgcgtacaaatcattaaatattaacgtcaattggactggattttaccttacagttgaaaacaaaaacgaaggtcaaacctcacctactgaattaattttgggcccatttcaaggtaaagttgcatgtcagttgattaaatttggtcatggtgtttgtggaactgctgcgtcgaaaaaattgacacaactagtacctgatgtagaaaaattccctggtcatattgcctgtgatggagaaaccaaaagtgaaatagttgttcctattgtgaaaaatggtgaaaccaagggagtaattgatttggattgtttagatcttgaagggtttgataaggtcgatcaagaatatttggaaaaattagctgaattaattgctcaatctttgtaa

SEQ ID NO: 1079 - DNA, 1182 bp, Candida albicans
acaattggccttctatcagtctgtcgaaaaccccaccacctagatcgggttcgtactttgaccgatgggaaagttgagattgttaccccaacaatcattcaaggtgtaacttttaatgctcaaccaccaagtacaactaatggattagaatattgggtttcattaaaagatgatggatctccgaaaaccatcaaaccacaaatgaaaaatggacaaatcaaaaatggacgtcctgattatagtacatggtttcaaactgccactactattgtttataataaagaacaattaaaagcacataatatggcagatgatgaaatttttgaagaagttaaatatattcaagaaggtgatttagaaaatcatttattaagtccaattattagatgtactcctgatagatataagaaaaagggaattggtagagataaaactactgaaccattttgtacacctaaagatgatgctagattaacaaaagataaaacttattttgttacttggtattcaagatttttcgatgaaaaaaaagttgataaagttagaattcatttatctaatattaaagaaagtttaaaacaaaaaggattaaagaaaagagatgaacgaacgaatcaggaatttgataaaagatcaaaagtacttgaaatgggtggtaaagtcactgatttttcatttttcacttctgattggatttcaaatgatcaaggatatttcccattatatattgatgaaaattggtttggatcagaatattggcggaaagttttgatttcaattcaaccagataatattcctgatgaagaatttaatgttttacaaaattctattgttgtagaaatttggaaaggtgttaaagtatcaaaagatcatttaactgatttgaaaaaattagaagaaaaatatgctaatagacatatgcatgatattgaagttgaagaaggagttgattttgaaaaatatatgattatgatgggattaccaacttgtgtattaattgctggatttggaatgtggttatttgtcacgattaataaaattgatttgagtagtattaaaaaacggaaatttgctagaaaaaatactactcataaaagaatcccatttaaaactaaatctaataaagattatgatcatttacctcaattcaatactgaactcgatgaactaaaacatgattaa

SEQ ID NO: 1080 - DNA, 1353 bp, Candida albicans
gaacgtctaaaaactcattcatcagcatttgatggattattatcattaatcccagccaaatattattatgatgatgccactcaagatcaatggcaacagaagaagaaatcaaaacaagaaatcaaacagaataaacgagccaaactaaatcccgaaagtgttaataatgctaatgaatattcaaatggacaagctagtgctaaagatgtcatggataataaagctaaaaaagctactagtgtatcattacccaaaaaattaccaaaaccaataactcaagaatctgacgaagaagaagaggaaagtggggatgatgatgattctgatgaagatgttgaaataccggatatggatgtaagtgatgatgaagatgatgagaaacaagcaaaagaagatgatgatagtgatattataaatagtaacaatcaattaatatttgatgatgatggaaatgaagttgaattaagttcatataaaaaacaagaaatacaatctactaataataatagcagcgatagtaataataaatcgaagaagaaacaattatctgacgaagaacaacgtaaaagacaagaaaatttagctaaattaagagaaaaattagaatctaaaattaataatttaaaagagaaaagaaaagctattggtagtaaatctaatggagcactcaaatctcgtgaacaaatcttggctgaacgtcaaagaagagaagaattgaaaaagcaacaaaagagaaaacatgacgagttagataatgatgatgaagaagattcagattcaggttcagattcaggctcggattcagattccgatattgatgatgataaaaatgtattgtttggtaatatagtattcaatgatggatctcaagtgacgtctgatttatcgaaaattcgtaattctgctgaaaagaaaaagcaaaaaggcccagctaataaagatattaaagctcatttacaaaaattagagaaaaagaaacagaaattagcctcaatgagtgctgaagatcaagaaaaacaacgtgaaaaagataaatggcaaagagtaatggctcaagctgaaggaattaaaattaaagatgatgaaaaattattgaaacgtgcattaaaacgtaaagagaaaaagaaattgaagagtgaaattgaatggaaagaacgtaaacaagtggttaaagatactgttgctgctagagctaaaagaagagaagaaaatttgaaagctagaagagataataaaggtaaaaagcatcaacctaaattgaaaaaattcactggtactgttaataaagctcaacttaaaaagaaaagagctggatttgaaggtagtgccaaagttaaatccaaaaagaagtga

SEQ ID NO: 1081 - DNA, 456 bp, Candida albicans
ccaacaacccagaaactttctttcaaacaacttttcaatctccaaaacagaactaaaatccacacaattgtttgtttgtttgttcccttttctttcataatgacaaaatctgaatctcaaattcaaaaaatatctcccaacatatccctaataggacaattggtcgacaaccacacaagatgtactcattatcatactaaactagatatcattgctataaaattcaaatgttgtaacaattattatccatgctttaaatgccatcaagaatcaactaaccatgaaccagaccgattcgataaaaatgacaatacaaccaaggctgtactttgtggtaactgtgtgaatgaattaaccgttacagaatacctcaattgtggctatacttgtacttattgtggtggacaattcaaccctggttgttctttacattatgaaatatatttcaacaattaa

SEQ ID NO: 1082 - DNA, 408 bp, Candida albicans
acgttcaaaatgtctatgtacacatcgagattagctacagaatatgttcccttgtcagaaatcaaaagaccaattccaccggtgttggattatcagaaaatagatgcaatgctctccacgttgaaaggagtgccaatggaatcggcaacttgcaaggtcgaagatataactgctggtgaactacctccaatagatgtcttcaagatcagagaaaatggaaaaaacttttattttgcatttggtggttgtcatcgttttcaagcatacgatagaataagcaaagaaacagaaaaggaagttatggtcaagtccagaattctaccagcaactagaaagtcattgaggatatatttgggagcctcagtggatgctctctttgatagtgtggattctgaatcatcaagttag

SEQ ID NO: 1083 - DNA, 1539 bp, Candida albicans
aaaaccagaactgacaacaacggggctgaaaatggtggtactggtgatgggaaatgtaccaacggtagtaataattttgatataaataatgaaacaatcaaaatgattgaaagtttatgtgaattattcccaatgtttacaattgatgaattacgagatcatccaacgaatgttgatcattcacaagatttagtgacggaattatttgatgaagctacagcattaattcaatctgaaacggaaaaggaaaagaaagaaaaagatttacttctgcaacaatcaaaacaatacattacaaatgttggaacaccaatatatctggatgccgtctatgaattacaagcaatgttcccttttattgcaattaaatctgtggagaaaatattacaacagaataataatagtatagaagatgcagcaattgcattgttagagttatcatcagaaacaacaacaacaacaacaacgggcaccactagaattccacaaaagccaggagctaataataacaatgaatgggtagaagagtctcctatagtggtcaaagtttgtcgatttttgcaatcaagttctaatgatgtttatatcgataaaggagatgttttacattatgcacggaaaaatggaggggattattataaaacattgtatgatgttgttatgaactgcaaatatatgacgatgtcgaaacaacagccatgccattctaatcccacaaagactcatatacagaaaaatagtcgaaaagtgcaacgaggaggagctagaggtttgggtggaggaaatagaatactgcaagacaaagaaacccagagagaaacttcaataaacggaaatgatgcaaaaccaataccaataccaagcaattatcgatatgatgagcattcaatggaggctaaagaattatggagcttagtacctgtgaatagtaaatatagcaatcggatgggatcaataccaaatcaaaaattcccaatcaatgaggtatttgccataaaggcattggagttttttcaaggtgacgtatataaagtagttgaattgatttcagaactatcatcatcaccaatttcttcaaacaagcaatcaaaacaatttaatgagaaacgacaaccttttgatgtcaaaatcaataagtcttcttctccttcatcaacattagagtatcaatcagacagtgtcagttttaattccgatgacgaacaacaactattcaataaatatcttaaaacagggacagttgatttccatggatttaccgtagtagaagcaatgaaattagtaccattaatccttaatcattggtggaatcaagaattaattcatcgtcaatcaattggtcaattacaaaaatttgggaattcggcatcattaggatcagtattgataataactggtagaggtattcattccactggtggggtttctacaattaaagcatcagttaatcgttatttaattaataataattatatatttaatcaaccaactagtggtagttttgaaattactggtaaaagaatgaataacaagaaataa

SEQ ID NO: 1084 - DNA, 918 bp, Candida albicans
ataatgactaccgttgaaatcccatataaacctaaaggtacaccagaaattgaatttgtcgaacataatggtgccaattttaaaactgtcacctggaaagtcccgcaatcagtctcttacaagggtaaaataatctatgttcatggatttgctgaagaatcaaatgtttacactgaattttttgataatttgtctcaaaatggttacgaagttttctttttcgatcaaagaggtgctggtgaaacttcaccaggtaatttagttggcttaactgatgaattacatgtcttcaatgatttagatttcttcattaaacgtaatttggatgctagaccagctgctaatagtaatgagaaattcttcttacttggacattccatgggaggtggaatcattttgaactatggtattagagggaaatatttaaatgatattagagccattgttgcttctggtccgttgattcaattacatccaaatactcaacctaatattgttttaagaactttgcaaccagttattagtagattgttgcctaattttaaaattgattccaaattaaactttgattatattacttccaacgagagatggaaaaactacattatagaacatgataaaaaattgattggatctgtgagacaattcaatgatatgtttgttagaggtgatgcattattgaaaccagaatatgttgctaaattcaaagatgatttacctttgttaattgttcatggtactaacgataatattaatgatattaaaggcagtgaacagtttttcaaattagttcctaatgatctgggtaataaacatttagagaaaattgaaaaaggtagacactcattatttattgaaaatgatgaattgtttaaattgatttttaaaagagtgatagatttcttaaatgaaaattag

SEQ ID NO: 1085 - DNA, 1104 bp, Candida albicans
ttctttaacatcatggagaacttatatacagcattatctatatcattaattacagacgataaacgattcgttattgtttcagatgattccaataaagccattcctaaatttacaagtatgttagtcaatacttgttcatttgatacatcgcaatactgtgtgattgatctactaaatgttcacacgactatcgatttaatccatcaaatgactaattttcgtgacaatcaatactttttgaaaaacattattatttggcaaaatgttcagtatttgacaaccaaccagcataaatcattgtataaactaattttacaaatagaccaatttggattgagaggagttaggggcaagccaattgatatagccattggaaatgatgaaattatatcaattaataggccacaattgttcacgattattatggcttttgattataaggcattcagcaaaaagttgtatatatatttaaaagaaaaattctggtttgctgtaaattacaacaacgtggaagaggaagatgagcaagagtcagatggacttccacaggattcacaatatcaagagactatattaggatttagaaatagcctagctgatgtgtttatctcccctgacatcaagggatacatatattcattgattgttttcacccgatgtcatagattagcatctttatcaccaaaactgacaaggctaccaacaatggcaattgattatatgcatgatttctgcaaatgtttagcattatggaaaaaccaactgaaattaaaccaagagttatttatcaccccagcatatgtcaagttggcattcagaaaaattggctactggttagtcgattgggagtataatgaaatgtttgctaaagacactcaaagtagtgtgttagttgatgatgatagtaacactttgaataatgaaatagattatcaaaagagattagaaataagtatgctcacgggtgattggtatggcagtgattatttttttgttaatgaatatttaaagagtagtaaaagtaagttggataaaaaaagtcccactggttatacctacaagatcattgaagatgtaattagttcagtaaggccaccattatag

SEQ ID NO: 1086 - DNA, 1113 bp, Candida albicans
aacaaaatagtacattcaattacgttaataccaacaaaatttcattatatggatatcgttgaaataaaactgaaaataaaggaatgggagtatgcgttccgtaaacaacataataaacttccatcgaaagcggatataaaagatgatgtggagattcataaattgtactcgttatacaagtccataaaactgggacagcaacagaaaccaagcaaacaagaaactgttaacgagccggcatcagtccagtcttcaccagtaaagcgaaacgattattctcctagaggtgaactaggacctactccacaagctaatggtcgagtactatctatatttgatttgaaaatgactccaccggattcatctccattaaaacacaaatcggacaaagcatccccgtcagcattcgcaatgcctcctccgcaatctcctgtgaagaacataatagagacgcctactaaatcaaagaataaactgtttgtgactcctatcaagggtcggaaaatagtatttgaaacaccgtcataccttaacaagcatcgacagaacccacagactccggattcccataataataataataataataataataatactgtaatcaatttcctggtctctccgtcaccattcaaaacacagagaagcatagggaaaaggttgactgaagtttacaatacatctttaaaagaagcagaggatctaaaaagctttaatcttgaagaagaattccagagtcatgaggaacaagaatctgaggaaacggaaacaacgaccaataatgacagaaagattgcaccaagaagtaaaagaacccagaaacgtctgacgagaagagttaaaatggcaccacgacctgtaaactcgaagccatcgttggaaaacgtaaatcttcaagaccatatcacaaaactagaggaaggtgaaagaaaacaacttgttgcatatatggattcagatgaagatgatgagaatagagatggagaggttggcattgcttctgtattcgaaagtccgacaaagaaaaccagaatgccggtgagtaataatttcaagaggctaaagatcaatgaccctagatcaaggcgcttcaaacaacgtatgagaaggtaa

SEQ ID NO: 1087 - DNA, 306 bp, Candida albicans
gtggcatgttttgttgatttgtatcctgcagttggatgtttttccacaaatgctaaatttcaagtgaatttaggacaattgggatttgtatggattgaagcaaatgtaagaaaatatggatttgtatcaaccagtgattataaaaagatatctggggatagaggtttagcttcattaccacaatacgacaaagtgattgttgaaggtgataaagttttggataaaggtgaagaattaccaccaagataccctgaagaagaattagatttctttggacgtactgttaacgataatgttagagtatga

SEQ ID NO: 1088 - DNA, 414 bp, Candida albicans
aacactaccaacttatccatgagtaattattataataaaaacaagaaatcatattctgatgtagaattacccacaaatcctaatttaccaagttggataatcactcctaaagaagaaaaagccgtatttgaacgatggagaaaaagagcatttgctagatgtgatgaattaattaataaatatattgaatgttccaatagctattctaatcctgtggatgccgttaagaaatgtcaaaaaataaatgaagaaagtttagcttgtgtagcacaatatcaaactaaagaatatttagatattgaaaaagatttgtttattaaagaaaaattggaaaagaagaagttatacaaattatatttagaaaagcaaatgcaagagaaacaacaacagcaacaacaagagaaacaaggttga

SEQ ID NO: 1089 - DNA, 369 bp, Candida albicans
  unsure (107): Identity of nucleotide sequences at the above locations are unknown.
actttattgttttccgtaaaggtgaacacgaagtggatgttcaattcatccaagtttttaatccaagaaattacgggttccaataaacgagtaggtggacaaggganaactttaacaggagcaattgcaactttggtcaatggttcaaataattatattggaagattatgggacaatccagttgatttggatcaagaagatgctaatttattagcatgtttggctgctagttcggttgttagaaatgcaagtagtaaggcatttaacaaatacgggagatcaatgcagacatcaaacgttcatgaatatttacatgaatcgtttacagaattatttggtgacagtatatttagaaccagtaatatttga

SEQ ID NO: 1090 - DNA, 330 bp, Candida albicans
caacaatttccactcctcattataactatgctacgcaataaatctcaaaaagaactccttcatttatctcgtcaattgatccaaccactattgccaaacttccacaagggtcaagcgggtaagattgttgttattgggggtaatgaagattatactggagcaccattttttgcaagtcattcagccgctttagtaggtgctgatttgtcccatgtaatatgtgaaaaggctgctggtccagtgataaaatcgtattcccctgatttaatgatccatccttatttactggatttggacatcctcacacaggcgatggaaaatccacgtccg

SEQ ID NO: 1091 - DNA, 483 bp, Candida albicans
gctcgtgaattgggtgaagatttcgagaatgaattgaatgaaatatttggtactgtatctgaagtagatttgcaatttgaagacgaagattctgaagagcttgaagtgtttgatgttaatactccacgtgaagatatgtatgataaagtggattatcatttatcagtgattgcaccatgtccacaccatcgtaaatgcccattacaacttggagaccctaaatattacaagattcctgatcatagacatcgattgaatttttgttcattttccaaaattgttgctcgaccaccatatgttatagaattgaaaaaggggcagaaattagctattcgttgggataaatcagctgaagatggaattggctccatttccagaaacgctgtaaaacgtttagctggaagtggtagacctggggggcgtgatactgaagtggggtcgtattctgtatttgttcttcacccacaggggctggcaggatcc

SEQ ID NO: 1092 - DNA, 591 bp, Candida albicans
ctcatcggcggtgcccatactgaggggcgtgatcctgaactggggtcgtattcttatttgattgttgaaagaagtgccaatgatttggaaacgattaaaaaaattgaagatctcagatcatatagtgataatgtaattgatgaaaatgatatcactaattggccacgtataattgccacaccaaacaaattgaaaagaaatgttaaattgactgtttgttcaactgaaggtaacgttgaaacttggcaagtaccaaaatcattggggaaacaaacctatcatgacgctagaaaaagtcaattgggagattcttgggcattaggtaggaaaaccagaactattaaaaatcaaattccagaagctgtgaaagataaattggatgtattatacaaaacttctaaaaagacatttaaaaaggaacaacaaagaaaacgttggaagaaaaaagttggtactagtgttgaagagtttgaagatgggtttttcgctactgaagttatggcatctcaattggaactgtctaagaaatataaacaacaagctagacaagcacaattcgaagaggatccaagtaaatttgatggtaattag

SEQ ID NO: 1093 - DNA, 396 bp, Candida albicans
atcaacaaaatgggtaaaagaaagtcatcctcacgtaaaccagcaaagaaaatcaaacaaacacttgataccacattcacatgtttgttttgtaatcatgagaaatcagttatttgtacaatagataagaagaacttattaggtgaattgcattgcaaaatatgtgggcaaagttttcaaactgctatacattcattatcacaaccagtagatatatatagtgattggattgatgcttgtgaggatttagctgaagaagcagaaaaacatggtaatgatgaagaaggtgacgtctactctgacggggacgataatacggctaccaataataattctggaagacatgagaaagatcccattctagattctgaggacgaagacgatgaaaatttttaa

SEQ ID NO: 1094 - DNA, 1287 bp, Candida albicans
ctaatcatggctagaggtatattgaaacaacaattgaaaagtcatcaattaatagatgccattgataaggcaaaatcaaaaccaaccaagaaaaccccagtaacagaaaaaacagtagaagaagaaaaagaaatcatagaagccgccccagtgaccaccaaagtgaaatcaaacaagaaatcgaaaaaatcaaataccaaaaaagatgatgatgattatcaaagtgaagttttatctaaaaaggaacaaagaagattgaagaaattacaaactaaacaacaagaggaagaaaaagaagcagaaaataacgaggaagaagaagaagaagatgatgatgatgacgaagaagaattggatttggaaaaattagcagctagtgaaagtgaaagtgatatcaatgatgaggaggaagaggatgatgacgacgacgatgaagaagaggatgacgaagtagaaaatgacgatgaagcagaagatgatattccattatctgatgttgaagttgattccgatgctgatatagttcctcataccaaattaaccattaataatatggcagcattaagagaatcattagcacgtattgaattaccttggtcaaaacattcatttattgagcatcaatcaataactagtgctgataaaactgaatcagaaatcaaagatatttatgatgataccgaaagagaattggcattttataagcaaggtttagatgctgttaaacaatcacgtaaaacattattaaaattgaaaattccattctctcgtcccatggattattttgctgaaatggttaaaagtgatgaacacatggataaattgaaaaataaattattaactgaagccgccaataaaaaggcatcagaagaagctaaaagacaacgacaattgaaaaaatttggtaaacaagttcaacatgctactttacaagaaagagctaaacaaaagaaagaaactttagaaaaaattaaatcattgaaaaagaaaagaggtgctaatgaaattagtaatgatgatgatttccaaattgctttagaagaagcaactgaaaataaccagaaatatggccatggtggtagtggtagtggtggtgataataaaagaagaaaaccaaattctaaaagattggctaaagatgctaaatatggatttggtggtaaaaaaagaggtaaaagagaaaatgatgctgcttcatcagctgatattagtggattttcaacaagaaagatgaaaggtaaatcaacttcaagacctggtaaaagtaaacgtagtagaagacattaa

SEQ ID NO: 1095 - DNA, 1068 bp, Candida albicans
ttgcccacccacctttacacagacaacccatctacatttatgattgaaatattacataacctatctcaaggttggacattaacattattatcatcatgtctatgtatattaggtacattaatcatattaattgatgatatttattatacttgtttaccaaaattcattacatcaaaatttaaaattcaaattaaacaaaattatcgatttttaaatgggtcattagcttttagttctggttgtttaattttcacttctttatatcgtttattacccagtgctcatgaatatttagccaatagcaataacaataacaacaacaacaacaacaacaacaaccatcctgggcacacacataatttagatgaaaatggtgagggggcagatgataatcatcaatggaatcaatttatattgatattatcttatatcatggggatattaatttgtttaagtttcaattatatattacatttattgactagtgaaagtgttgttcattgcaatcatggaggtgatgtaactactgatttacatgacattaatggtgatctagaaaatcaaataggtgttcatcatcatcatcaacatcatcaccatggtgatacattgtttaatgacaactataatggatcagacggaagaggagaccataataagaattcaaatagtgtgacggaaactactccattgattgataataccaaaaatggagttgctagtgttcctgttgctactgcacgtaaacgaaaatcaataattcaattaattttaaaacatgatgatattgaagatggatcaggtggtgaatgtaaaggttattcatcagctgaattatgtactttccataacaacaacaacaacaacaagatactgactaaattaaatggtgatggaaatgaatgtgatagtaatattagtgaagaactagatggtggacatccgggtgatgaagaagagggtgaaggagttgttgttcaacaaactcaacaattgcattattgtgagattccaactttatctcaagaattaatccaaaatcttcaccaagtggctggaaaacccgcg

SEQ ID NO: 1096 - DNA, 1587 bp, Candida albicans
tataatcttttcaccatccccattttttttttcaactttccttctttttttttttctttttttcttttttggatgttaagattaaacaattctattagtttattgaaacaagtcaggaaaatagccaccacttctattaacatgtcatcgaaattatccaccaaccacacttctggaggtgaagagccagttgtattgagttcagtgaaaaaccatgctagacttatcaccctcaacagagtcaagaaattgaattcattaaacacagaaatgattgagttgatgaccccaccaattttggaatatgccaaatcaaaggaaaacaatgttatcatattgacttcaaattcccctaaggctttgtgcgctggtggtgatgttgctgaatgtgccgttcaaatcagaaaaggaaatccaggatatggtgctgatttttttgacaaagaatataacctcaattatattatttctactttaccaaaaccatatatctcacttatggatggaatcacttttgggggaggtgttggattatcagtacatgcaccatttcgagtagcaacagaaaaaaccaaacttgccatgccggaaatggatattggatttttcccagatgttggtaccacattctttttacctagattgaacgataagttgggatactatgtggctttgacaggctctgttttacctgggttagatgcctattttgctggattcgcaactcattacattaaatctgaaaagattcctcagttgatcaacagattagcagatttgcaaccaccagcaatcgaagatgatattacagttttgtcgggcaacaatcaatatttcaaccaagtcaacgacattttgaacgatttcagtgaaaagaaattaccagaagactacaaattttttctttcaacagaagatattgcaacaatcaataaagcgttttctcaggacaccattgatgatgttctcaagtatttagaaaatgatggatccccatttgccagaaagacacttgaaacattattgaaaaagccaaaaagttcattagctgtagggtttgaattgatgaatcacggagcaaagaattcaattaaaaaacaatttgaattagaaatggtatctgcaaccaatatcatgagtattccagcagaaaagaatgatttcgctaaaggtgttattcataagttagtggataaaataaaggatccatttttcccaaagtggagtgatccaagtactgtcactcagcaattcctctcaaacattctcagcacttcgaaaaacaccgacaaatacttgaaaactccatttatcaagaaatggtttggcgttgattttgaggactatccacatcaaatgggattacctacaaataaacaagtagctgattatatttctggatctgatggatctaatagaacctatttaccaactcctgcagaagtttttaaacatttcaaacaaaagacaaataataaattgggtgtcgacgagaagattaaacagatattggacttgcacggtgagaccgccaaatacgatcataagtatgttactttggaaagaagagcctaccaaataattaga

SEQ ID NO: 1097 - DNA, 654 bp, Candida albicans
gacaagtttataatatacgccggtggggacaaattttccctttcgacaaatactgatttatctgatctaaatccggtgtcggtatctttatttgtacttaacacaaactttatagtttggttcaacagaaacaacgtgggtatcgagatagcttatcctgcaataatcttccatggtttgaatgaagactctatatatttaaatatagaagacaaccagataatagggacttacataactatcagatgcaatcccgagctgcaaaacaaccaaaacccattgttcaacatcattgattccaaaatcacaaatgtatatgaagctatatcatatgtatctgaattacacgcagtttcctcagatgatgattatgatgaaggtgaagttactggtattccggcattggaaatatcacatacaaactcggaattagaaaacagtgttttaaactgtcttaacaattctggacaggcggacgatttggatgacaacatgattaatgacaatgatggtatccacaatgttgcgggaatgcatgttgatgttggttttacttccattgctggggtaaagaccaggcgcagtgaacaagaagattacaatgggtggacagctaacttgaattctactaataaaaggaacaaattgcactaa

SEQ ID NO: 1098 - DNA, 273 bp, Candida albicans
tttttcgatgatgccaacaatttgaaattgaccatgcttctattgagtgacaagctgaaaaatttgcaattggaagggttccatactttaaaattctttgttgctaaccctaaaaggtctcaaaaggtgacagatattttaattaaaaataaggctaatttcattgagtttttcaaaacttttgatattgcaagtttccatgatagcaatataattgaagaacgagattacactttaggagaaattaaaaatctaccagatagaatacactaa

SEQ ID NO: 1099 - DNA, 378 bp, Candida albicans
gttttacccgcttataatcatttcaattatcaacaacatataattatggcatttttattcaagagaaaccccaaaactccacctgagttagtacgagcattaaatgaccaagttctgaaactagattacgcatcgcctgacaacgccaaaaagtatcaagatgaatgcgcgagatacttgaagaatatgaaagtgatattgcatggtgatgatgaagtggaaccacaaccagatcaaataacccaattggctcaagagatatactcgaccgactgtctatactatttagttgtcaatttacgaaaattggatttcgattcacgggaaagatgttgttatattgtttctgacattattgcgacgaactatggcgaataa

SEQ ID NO: 1100 - DNA, 261 bp, Candida albicans
ttcaaggaagccttttcctgttttgtattttctgaaactgaaccaaagggaattgattgtatcaagaaatttgaaaacatgagatcttgtttcaagagatatcctgaacattataaggatgaattatatgatgatggcgaagaagaagcaagtaccgaggtcgttgaacatgttgttcttgagacttctgaacctgcaattgaacaaattgaacaaggaatcaaggaagataaggtcaaaccaaacactaaatctgattag

SEQ ID NO: 1101 - DNA, 234 bp, Candida albicans
ttaccgaaaaattttgaaattaaagataataattataaacctgctaatgaattattacaaatttataattgtcgtaataatcattttaattcatatgatgaattatcaccattaatgaaatcttctgtcgaaggtgaaattggttatatcccatcaaagatatccccaaatattaacacgtttaatatcgaactgggattatcatccaattctcatggtgggatatattttcat

SEQ ID NO: 1102 - DNA, 552 bp, Candida albicans
aacatgaaatcttcatctggtacttcattgaggaaggtattcaatcctgatttgaagcactctactttgataattccttccgtctcaattggaaatgtaccacaattagcaatagatttgttgattcacactcataatttggagaaagtagacagtttggatgatttatatttatatccctttgcttctccagttgattatgtgacagaaccaaagaagggaatatctcatgctgctgaagttttccacaatagagatttaaatttaacgttgattcaacaacggtcaccaatactaccatataatactaaattatacgtgactaatatcatcattccatttatcacatcacacgaattcgatagaatattgattttggactctctggatgctgggttagtagagcatatatctagtggtggtattgaattatacaccaaagaagatttgttgagtgaatccttagaatccatgaaattgagtaaagaagaatctacaacagctgcacatgaggacaatcgcaattcaaaatacgttagatgtcttcattga

SEQ ID NO: 1103 - DNA, 600 bp, Candida albicans
  unsure (184): Identity of nucleotide sequences at the above locations are unknown.
aaaaaaatccgttatatcaaccggaagattttgaaaattagaaaagaaaaatttcaatggaaaatggaaattcaaatgaatttccatgtaaaatcaccaagtgaaaataatgacaaggatccacttgctgcattcaatgacccaagttcaaatgaagcattaatgcaaatggcaaaaggtaatntaatgaattatatccttcagacattaataatgggttgggttaattatttttttgctggatttgtcattatgaaattgccattcccattaactgatggatttaaaagtatgttacaaaatggggtcatgacaccagatttaaatgttcgtaatgtttcagcaatttcttggtattttgtgaatttgtatggattaaaaccgatttattcattattaatgggatcaagtgaagctgaagaattgatgcaacaacaagctcaacaaactcaacaacaacaaatgcctaatttgagtggaccaggggcaccaaaagctgaaaaagtttttaaagctgaagcagaaaatattcaaatcttgtcacaagaatcggtgtttaatggtattgtagatagatttttagaaagatatagtgcataa

SEQ ID NO: 1104 - DNA, 1089 bp, Candida albicans
tcgatggaagtacgagcagttacccaagacaatgaccagttgccaattataagagaattatatgaagccatcacatcatcttgccgctcacagaaaataatccaaatagtccagataccgcaaaatgaaaatagaattgccacttacgatgacaaagctaatgacacactagaaattggcatttcgaaaccaacatatttagctatgttcaagcagtcccatgattattggtatagatacacggagagtagccaatgcacattagataaaatagaaataacaattttgagagaactatatttgatgacattgggatatttgataacagcgaatgaccaccacagtataatgaacttgcacgaactgattgtacagatattagggaattttgagactgatattgaaattattagctgctttttgacaagcagattgaagcgaatcaataagagcagtttattatggcattggatgaaaaaaatgacaatcttggtcattttcaataaactcgaagaaaagcagggtagccaacatttgtctgacagccaattctacaataaaattgtttccagggcattcaggagctgtgaacttcattacatgaactactatgccaacaactttatacattggattatacaattcaatatgattgtgctaggtattgaggatggtgattatttgtttcatcagttacaaaagcactgtcgccaggcactcctggatagctcattatggatgaatatgaagaattacattaagtgcatacaagggtcagtacaacatgataaccaaattatcgaagagtataaccgcattaacttgagttacggagtacctttgcggatacattccaagaagcaattgatttcaccaaataaaagtgacgaggatataattgttggtgaatttcagtggttagtgaaagttcaatgcaagaatgtcgctccattttctaatttaattgagctggcgcaaacaaaaacagttttaaaaagattaaatgagcttatccagttacatggattcaagcacaatgctgcaaagatcgagtctttgattgaattacgtagtcgtatgataggataa

SEQ ID NO: 1105 - DNA, 348 bp, Candida albicans
acgaatgcccagttgttgtctcgttgggaacaattggcaccagaattgagatctgcttcattgttgccaccaaatgcaggtttattaggacacttggcatcaattgttttttctaaacttttattaccagtgaaaggtgttaaagaagatggcaaagatattgaatctgtcattggaagagtagaatcaagtttggccagaggtgaattggatattgcagttgaagaagctgctaacttgaaaggatggagtagaaagcttgccaatgattgggttgttgaaggcagaaagagacttgaaattgagttcgtacttggtttaattgaaagcgaatcaaagattatttaa

SEQ ID NO: 1106 - DNA, 1059 bp, Candida albicans
  unsure (931),(955): Identity of nucleotide sequences at the above locations are unknown.
tcattaagggtaatagctactcagaaactatttataaaaggaaaggatacaatgattagaattacgagtcgcagcgtgaaaggagctgcaggtattcgtagtgtttcatcaagtactgtgagattcaatattgccccaaaagtagtttcaccaccagttccaccaccagtcaaaccacagggatcagaaattccaccaccgccgccaccaccacctccacctccaaaggctaagagattctcattgtttggatttcttttcaagactactttgttagccacggtggtttatggaggaactttatatgctgccacaaagaatgacaaagttatggattttgtaattgataagcaattaccattccatgaagaattgattgatttaattgagaatggatccaccgaggatttacaagaagcatgggaacaattgaaaaacaaattcacagatgtcaaattgcctactaaagatgacattgacgaacttactcaaaaattggaacacaggggtgaagacataatcaaggaaaccaaaaagaaaatagcttctactcacattgggcataaaagcggtacagacttgactcccactgaacaattacaaagaggtgttgaaattgaaagtgttaaaaaagacgttgcccatttgcctttgattgaattaaattctgaccttggcaagtcggtcgacgaaacagttaagcaaacaattacttcattcaacaactttatacaatcaattgatgccagttcccttgccaccaaagatgacaaactaattacatcgataaacactagtgttaaccaattggcctctagattgaacagcttgaccaaggattttgataatgagttacagaacaaattgaaagtatctcaaacagaattgttttcatcgtttacaaaaaaagaattggaattaaccgagaatntgttgcaccaatttaacacagaanagccacaattggaagctaaattgaatccaaaattgagcccagaaattcaagcagctagacctgctatttcacaagccgcaagtaatgcaattggcatgggttag

SEQ ID NO: 1107 - DNA, 696 bp, Candida albicans
  unsure (612): Identity of nucleotide sequences at the above locations are unknown.
tcaagaatttttaacaaaaaaatgggggtttcagatgatgataatattctgtttgaatatgatgacgatgtagataacgatgaatcagaaatttcttttgtctcagaggacgaaaatgacggaaacaatcttgaacctcccaacaagaaactgaaatctacttacaatgggaacggggttgatgacgattctgttgtagctggctttaatggaactatttatagaccttggacatttgaagaattcatagaacaacgttttttgaatcctttgaagaagttggaaaaagtacatttgaatggttgtactgaagacgatttattaatcatgttacaatataagaaatggaatctggatgaagtgataaactctttttttgaatcgcatgataagcttatggaaaaatgtgggttaccagtggggaagccatcaaacaacacgtttgaagaggttgacaactatgattgttttatctgctgcgagctgtacccgaagacaactgtttattcgttgacgtgtggtcatcaattttgtttcagctgttatcaacaatatattgggaatgaaattgtacggggagagctcatcacatgcatggatccagaatgccantacaccatacctcacagagatatcgatcaattttatgccccaaaagacaaggaaaagaatttgattgtcactgttaaatcttag

SEQ ID NO: 1108 - DNA, 1971 bp, Candida albicans
  unsure (122),(238): Identity of nucleotide sequences at the above locations are unknown.
attaataatgtctgtctttcttgcttcctgttatatatatttataccaagtttgatgtctggaaacagtgctgcaaatgcagctgcattggctgcatttaatggcattggaaagaagaaganagaatctacgacaaaattaaatggaacagacaataacacgaatcatcttggtgtaattggaagtacctcaaatcaaaccaaacaacatcaacaacagcaacaacagcctcaagcgntacggaccccacttcctgcccatccgtcaagaaaaaagagtaataaattttcacagctcaaaagactaaatacagctcctgccatggcctctcttcagccagctttgcaaattgcactgccgtcaataagcccgactcaaccttcagctccagcgtcggctttggattcagaccctgattattttacacttctgccacatacaatcccatctaaaaatgaaattgcaaaatctcctcaaacacctcaagatatgattaggaatgtaagacaatcaatagagttaaaagcaatacccaataatgcacaggctaaacggctttctgtggattactcgccacaagaaatgttaaagaatttgcggcattcattgcattcaagaacaaaaacatcgcccatgttaacaaccagtgataaaatggggcaaacaatgttggctgagatgagagacagacttgagaatacccggagaatcgcttccaacagtgtcgctagtttatcgttatctcctaacttggatttcaataaaagtactagcgacgtaagtaacttaagtcatcactatgatgtcgacacggtgtccacagattcttttgcttcttttagctcaagcattaatgatcgacatctaccacacggaataagcattgacgtcacaaatcatgatagtgatgaggacgaaattgatgacagagaaagggaggaggaccatgaaccattagataatggtgaattgaaaagtacaaataataaggtgacagtttctagtcgtcttcggaggaaaccgccgcctggagaagactttcaaatgcagttaaatgacaaatcgcgagatactatttcaagtggatcgtattctctaaaccctgatgaagtctactcttttacagaccccgatctgtacgagaatttggtatctgaggtggaagttggagaaacaaccaggcttttcccacaatttccagacgcaaatcattatcatcaacacagttcaaagtttcggaaaaaacatcagaaagtaaaaccaattaatgggatttactatcgtgatatggatctgagtaacaccagtgacactgaagagtctaccagcaatcttccactgagatcaacaacgccattacttggacaaccacaacagcaagtgcatttcagaagcacgatgagaaaagcaaatactaaaaaggacaaaaaatcaaggtttaatgagttgaagccatggaagaatcataatgatcttaattatttaactgatcaggagaaaaagagatacgaggggatttgggctagtaacaagggaaattatatgagtcaagtggtgatcaaattacacggggttaattatgagacgcagaaggatcccaaagaggaagctaaaatggagcactcgagaacagctgcattgttatctgcggctgctgttgaagacagtaattataatggtaacaacagcttacacaatttggattcggtcgaaattaaccaattaatttgtgggcctgtagtaaagagaatatggaaacgtagtaggttgcctagtgatacattagagaaaatatggaacttgattgattttcgacgagatggtacattgaataagaatgaatttttagtgggcatgtggttggtggatcagtgtttatatggaagaaaattgccaaaaaaagtcgataatgtcgtttgggatagtttaggtggaattggtgttaatgtcactgttaaaaagaaaaaataa

SEQ ID NO: 1109 - DNA, 660 bp, Candida albicans
tccagctccatgtttaagaagagggtcataaaggattcacgggtatctaagcgaaagataggtgatataaatgaagccagtgaagatgcacctgatactcaggtaacgaaaaagagtaccctcatcaccaagaagtcagacatacagaaaaaatcggtggtgatgccccgatcatcaccacaaacccctttgtccaaatcttctagtgatgatgctgctgctgtggaggttgtttctcagaaatcgaaaaagggcgaactaaaaccgcttgcagcaaatatcaaaaccaccattatcaccgatttccaaccggacgtgtgtaaagattttcaacaaactgggtactgtgggtatggtgatacgtgtaagtttcttcatgtacgagatgaatctaggcaaaagatccccattaagaaagactgggaaattggtggccaaaaagaagttaaagagaaagaggatatcccatttaaatgtgtcttgtgtaagagtgactataagtcaccaataaagacagagtgtggacacatattttgcaaagcctgtttcttagaccgatataaggctaaaaagaaagggacgtgttttatatgtcacaaggaaactaatggtactatggtaccagtgaatatagacaaattgagcgcaactcaagtttga

SEQ ID NO: 1110 - DNA, 966 bp, Candida albicans
gacaactgcagaaaatacacgtgtggaactcccaagttgtccaattcgaaccttgacaataaccgtgatttcgctttaactaaagctggaaatggtagtgctattagtggtggcggtaatgcatttggcggtgcttatccactgtttggtaacctcgcatcagctaacaagccaattaagagattatctcaacaaacattgagaaaacctccaccacaaactcaaagaggtggtgccagaccacattcaatgcaacacatcgaaaagcagtctggaatgagcaatcgttctttgcgtcctaattcagctgtacaaccaattccatctcacccagcattgcaacctggctatcagtcaccttctaaattgaaagctgaagctctatatgccaaggctcaagccagaccacattctgaatttaaaccgtcattagcaaagaagtcgtcgttttctcgagaaatagaatttaatgggcacaacaaccatggtgttacccctagatctcaaggaagaagaattggcgatcgacctgctagaacgacattgagagatccaattgcaccaacagcaactcaaagtcatgcatcaaaaccatttactcctgagactacagcagcatccaaaccagtcaagtctcatacacaacaaaaattacaatcacaatcacaatcacaatcacaattgctgaatcatcaacaagcaaagccggtccaacaatatcaactgccaaagacattcaaatctaggtttaatgattccgatgatgaaggtgttgattcattgccaacaagaaattttacttcacgctttaatgattctgatgaagatatttcgacacctcgatcatctgctccttctcctgctgttgcaagtttaagaagagatacagaaccaaaagattcatcacctaaaaaggaaaagaaatttaagaaattgagaaaattatttggatcttcaaaggactaa

SEQ ID NO: 1111 - DNA, 456 bp, Candida albicans
  unsure (28): Identity of nucleotide sequences at the above locations are unknown.
tctaacgcaagcttggttccttcttgcnccggctggtgtacggacacaatttcgcaagcaggtgaaaaagaggtagagatagggttaatctcccccactcctccacaaagtccgggttataactctcctgtactattcgtcaggaaatcggatctgagttatagactttgtgtcgattatcgtttgttgaatctaataatcatatcgaaacagtttagtattccgagagcagaagaattagtgagagatattgccggtcatcgtttctacacaagacttgatatgacagcggcctttcatcaactcaggttggaagctctgtctaaatactatactagttttagtgcttttggtagaaggtatcatttcaatgtgcttccgtttggtttgtctatatcgccagctagtctttgtgaggtgatgtcagaagtattggatggtattgaaggttgcaag

SEQ ID NO: 1112 - DNA, 1371 bp, Candida albicans
ttgacacaatgtagtttaacttataccttaatttttgggttttgttatatatatatatctatatatttgtatactttatacaatgtttgcaactcaactaatttaactagcaagctttatagaacacaacaagaacaaaaactaccatacctaattatgtctaccactgttattaaaacacaagaacgtactcgtaaaagattgagaaccaacacctcaggaatagtttttaaagaactgtatcaagaaaaatctaccaacgacgaacaagaagatgtcgccattgtaccacctacagaaatttcttttgataaaaaacatcaatccatcctactgatcactcattttaaagatccattaaaagtgcaaagtagatatccaattccagaattacaaccatatgaaatcttagttaacaataaagccataggactaaatccaatagattggaaaggaaaaaaatatggatttgggatctatcatttcccctggattaatggtcgtgagtcaagtggtgatgtggttaaattaggtgatcaagttgataagttttctattggtgataaagtgatagttagttccaccagttatcgtgataatagaacttcaactttccaacaatacactgcaattgactcaagattagtttggaaacttcctgaaagtttcagttatgaagatggtgccacgattggagttggattagtcactgctgggattattttatataattcatttgaatttgaattaagtgcaaccccaaccaaacaaactaccacagctagtaacaataatacaattttaatttggggtggggctactgttgttggactttacgttgcccagttagccaaaatatatggattgaatgttattgctgtggcaagtactaaacacgaaacatatttgaaacaattaggggttgatcatttaattgatcgtcatttatctgaagatgaaatcattaacgaaataaatagtattgatggcattgaatcaattgaatatggtgttgattgtgttggtaaagaaacttccaaaaccgtattgaaaattcttgatctaaaatcacaaccacaacaaaagtctaaagacgaacaaattgttaaaccaaagttttcaggaatagttggtgtacctaaagaatatccagaaagtgttgacgtgagaaacgtggttatcaaacgattccatgaagatgtatcatttggtgaaaaatttattgatgtcactagtgaattattaaataaaaaagtcattgagccagttagatttaaacaatataaaggtggtcttcacatcattgataatgctctaaaagatttagagaagattggtgccaacggagagaaatatgttgttagtgtataa

SEQ ID NO: 1113 - DNA, 2058 bp, Candida albicans
atgataaggacattaattacaaccacaattataccaattattgcttacataataaacaataccccaagttatatatgggctataattgattttataatggatatttgttttttttgggtcaaacaattatatcaaatttataatcggaaagaccctctcaaggaatatgttaaacaattgaaaattgcacctaattataatgattggaaagaagttgcttatgaagttgataaattgaccaatatggatctttggcgacaaaatttcatatctaaacattatgattatgtattaattgatgaaagattgaaattattacgtgaagcaagattaaatcaaaattctcaagtcatgatgtcattattacgaagtggattaataagaaattttgctggagtggctcaaaaaagattatatttgaaatcttatatggggacgaaatttaaaattgaagaatatattaatgaagtattaaattgtttggattatttaaatgaagcattaaataatgataataatgatgaatttatcatgaatagtaaacaattaaaattggattttttccatgatgcaagacaatcatttggttgtagtgcattattattacaaggtggatcattatttggattatgtcatttaggggttgttaaagcattatattttaaaggtttaatgccaagaatcattggtggaagtgctgttggggccgccgtggcatctttagtatgtacattaactgatgaagaattaattcctattttagttaatattggtgatttaatgaaaaatatcgatttattaaatcatgaaattgatgaaagatatggtaatgttattgaaaatgttgttaaaaaaggttattctcaagaaattttattatttctaaagtttgttcgtgataccattggtgatttaacttttgaagaagcttatatgaaaacggaaaaaattttaaatatagtggttcatccaactaatcaatgtgttccttcattacttaattatataacggctcctaatgtaattatatggacagctatttatgcatctattggtaccggagtattatcggatgatgtggcattatatgttaaagattttaataatgaaattgttttacaaactcctgatgttgatgtgaaatttttaaaacctcaagatgtaacttatcatcaacaatattttaaatttaaacctcatgatagttttggtgggggagtcggaggtggtggtggaaccaacagtggtggaaccaacagtggtggaagcgatactactggaattggtagtggtggtgctactggaattggcaatgatataacaggtgatggggaaaaacctacctctactactactacaactaacattgttttacaacaacaatcaccatatacaaaattaactgagcttttcaatgttaatcattttgttatcagtttagcaagaccatatttggctccattaataagtaatgatttacaacattatcatgcatatggtaaaatcagatacgataaaacatcttctactactactccaactactagcactactacaattgaagataagaataatactaatactaatactaatactaatggtagtggcagtaacaagcggaaaagaacatcttctggaggtggagtagaagtttccaaaaagaaagatattgaaaaatatgctcaagataccactagttataatttaatgaaaaaaattaaaacaataattggcatggaaattcaacatcgattaatggtaatgaataaattaggattattaactgatgtaatgaaacgatttttcattgatgaaaaacctccaacattacaatcattagcatcaattcgagaagttaccatagtgccagaattacgatatttaatgaaagattttggtcgagtatttgatgttcataaaaccatggaaaatataccttattgggtattagttggtgaaagatcagtatggccattattcccattattatggtcaagatgtgctattgaatttgcattggatgatttatataatttacatagaaaacgaggtggttaa

SEQ ID NO: 1114 - DNA, 1386 bp, Candida albicans
aaacaatgcacaatgtcatcatcatcgtcacctacaatcaatttcttcattaattacaatcaaccattacaaggtaaaaaaatcacagtaccaaaatcaacatcaattaatcaattgatattacaagctttaacggtatataaaatcgaccctaataattatgaaggacaactttatcataatggaaaattattagatggatcattgcctattcgattaaccaatttattaaataatgccaaattgaatttaaaaaccattcctaaactgaactcctctacaaatgtagacaccaccaccaatactggtagtgccaatcatcataagattaatgttaaatttattaatgatgatactggttcaagtaaagtacaaaaatgttctagtggattgaatttaattgaattgattgaaaaattcaatggggatatttcccgtcaatcagatttacgaattgttaatgttattattgaatcggaaaaatatcgtgaaactactttagaatcaattgtggggaaatctaataatgttgttgttcgattgaaatatagaaaaattgataatgatgataatgatagaatggttaaagaaaaacaagaagaagcaattagattacatattgaacaagagagtattagaaagaagaaggttcatgaacaggagaaagtagaacaaagtttgaaagaacagcagcaacagcaacagcaacagcaggtccaacaacaacagcaagagcagcaagacaataaaaatgttgatgctgtggaagacgctattattgaagacccaaaagaagatctaccacatgaagtatcttccctgaatgagagacaagcaattcaaccaaaacaggaaaacttgtcacatccaacaattgtacaaccacaacaatatacatttcaagaagaagaaatcaaagatacaccacaattatacattccttccaataagcaacaagcattgtatgaaaatcccgacgaagattacgagttgacgttaaatcaagcgaaaacatatcaaaatatgattagagattctgctaaaagaaaacctaaatcaaaaggagataaaccaattagtttacctaataaatatcaaattggaatcaaatttcctgatgcatcaattttacaaatcaattttattgaaaatgttcatgagatcaaatttggtaatttaattaaaaaaattgatgaattattattaccaaaatttattaatatttataatttaaaacatggtcatccaccatttaaaaccattgatatgtcttattctaataataatgagtatttatattatttacctgatttcccacaagaaagaatcctgcttattttgggaattacaaaaacccgatttgaatttaaaaggaccctattttaa

SEQ ID NO: 1115 - DNA, 1428 bp, Candida albicans
agttcgctcgatatgttacaacatattgtttactttacaaaagacgacaatgaacaattgcggaagttagcgattgaagctattaacaaattaatttccaacaatagtcaagaattaataggtatggattctcaattggatagaaaattggttgatggtgttttatttgcttttcaaaagcaaactattcaccaaaagatatacctcacctgttttgggacattggcagatgccttgaacgttagattgaaacctcatttaaattcgatattgagtactatcttgtaccgaatgaaaaataaattggcagaaataagacagcaagcttcagatttgattgctattattgctccggtaattaaacaatgttcagaacatgatgatgaattgttaatgaaattgatattgattttgtatgaatcccttggtgaagtctaccccgaagttttggggtcaattttaaatgctttatattcatgtcttgattcaattgacaaatcaacattatataccatgtcaaatccttcaattaatcaaatcctaccaacattaacaccaattttaaaaaatcgacacgaaaaagttcaagaagcatgcataaaattggttggattaatagctagaaaaaactctgaaactataaacgcaaaggaatggatgcgtatttgttttgatttgttggaaatgttaaaagcccaacgtaaaagaatacgtattgcagctaataatacattcggctatattgccaaaactattggaccccaagatgtaatagttatgcttttgaataatctacgtgttcaagaacgtcaattgagagtttgtacggctgtggcaatgggtatagttgctgagacttgtttaccatttactgttttgccagcaattatgaatgaatacagaatccctgagaaaaatgtacaaaacggtgtattaaaggcaatgagttttatgtttgagtatttggatgggaaaatcacaaaagattatttgttcgctataacgcctttattagaagatgcattgacagacagagatttagtgcatcgtcagactgctgcaacagtaattttccacatagcaatgaattgtattggattaactgataaggattatagtgatgttttcattcattacttgaacttgattatgcctaatatttttgaaacatcaccgcatgtgatttcaagaattttggaaagtattgatgccttaaggttggttattggtaatggagtatttacaaactacatttggtctggattatttcatcctgcaaggaaagtcagagcaccgtactggaagattttcaacaatgcttacgttcaatgtagtgatgcattggttccatgttacccaagaatcgagagtttaccggatgaagatgaaataagttacaaattggaagagttggatttgtttttatag

SEQ ID NO: 1116 - DNA, 756 bp, Candida albicans
tttgtttttctaaaggaaattatattaaatcaatggatgaaatacgttcaatcggaattgattcaatcgagtagaattttaggaattgatcaagtttcgatattggattatcaagatggtatgaatgaaacttggcaattgaatgatattgtacaaagtttacatgaaaatctttcacccacaaatagtggtagtgatactaatagcaataacaagccatcagtgttgattacatttgatgatcaaggagtatcaaatcatcctaatcatatttcattatttcacggtacgaagaaatatattcaagaattacgacgcaaactggaaaataagaataaaaccagaataaaaactactactactactactattaattatattgacattgatagttccagttcaaccaaattttatgttcttaaaagtttgaatttttttgaaaaatatagtttcacaatacttggtaatattgaaattttatttaattatatttcattattaattaaaaaatttataaatattaatattaatgttagtttttttagtaatcaaattattaaatcaaaatttgataataacaacaataatttacaattacaaaatttaaatgatattagattttattctgatttgaatatgcttagtttgagttatgcagctatggcttatggacattttagtcaaatggtctggtttagatacgcttggttattattaagtagatatcttacatataatcatctcatagaacaataa

SEQ ID NO: 1117 - DNA, 1563 bp, Candida albicans
tctattcaaataatgggtaatgtaccagctaaagaaacaagaagtagatcaagttcttctgtttccgattatcggaattcaacgtcttccaccacccatggttcttcatcgtcaaatttttctaaacgaagaaacacgacatcgtcattatatggaatagtttcttctgcaacatcatcatcaaaccaccataatcgatctggttcacacgatttacggaaattgaaacgacaagaagaaaaggaacaagcacaaatacaacattatatgcaattaattgtaaaatttaatgaaagtgttgatggaggatatttagctccatttggcacatataaatctaatcttgattatgattgtgatatagttcgaaatttaattataaatcgaaaattatcaccatttttcactcctttacaagattttgatgaaagttggactgatgatgaattatgtatattattaggacaattgacattacatgcattagaacctgggtataataatgatgacgatgaagaagaagatgacatagataatcataaaattcataaatcagcaaattattataaacgtcaagaagaaaaggccaaattgaaatcgttaattaataaagttaaagaattacaaaaagatgaagaacagaaatattttgatgagaaacaaaaaaactttaacaaggattgtcccagtcgtgatttattattaagattatatcgaaatgctagtgaatgtccgatttgctttttatattatcctaaacatttaaatatttctcgatgttgtttacaaccaatatgttccgaatgttttgttcaaattaaacgattggaccctcatccacctcatgatgatcaatctaatcaagaagcgggggaactacctcatcgattgatttctgaaccagcaaattgtccatattgtgcatcacctgattttggtgtcacatatgaacctccaatcgatattcatactggtattgatgggattaagccaggtgattataaagttagtccaccaatagtggaagaatcagaactggcaatagatgatgatggtgataattcttcaaatggtagtactactggcaaaggagaaataacttctaattcagcaacagcagcagcagcagcaacagcaacaccaccaccagttaatagtatatcacctaaaaaaaattcattgaaaaagagacgaggatcattagctgctaatgcacctggggttataactattgatatgattagacccgattgggaaactaaattgaattcagcaagaagtaaattggcaagaaaagctgctacagcaagtgctattcatgcttccaatctattacttgatgataatagtaacagtaacagcaacaatggtaatggtaatggcaataatagtggtaataacagaagaagaaataattcatcatcaggtcgttccggtagttttggtggatctaataatagatatgccactgttgaacaaagaatgattgaagaagccatgagattatcaattttagatgaagaagaacggaaacgaaatgccaataaagagaataaaaaatga

SEQ ID NO: 1118 - DNA, 882 bp, Candida albicans
ttaacgcttctctattttttttttctgctcttcttattcttgatatcttgctgcatctaccactgtttatttcattatcaaacaatggcaacaccagttccatctgtatctgttgagagtggcttagaccctcaaaaccaagaagtcacatacgtttacgatgtatataacgaaatagctagtcatttttctcaaacaagatacaaaccatggcccatagtagaaaagtttcttatgctgaggtcaaaacattccgtcggcttggatgtgggttgtggtaatgggaagtacttaaatgtcaataaagacgtttttatcattggtacagatagatctgaagggttgatcaaatgtgcacaacagatttccgaaaacaagtacaatttgggtgttgcagacgggttggcattacctcatcccgacgggacttttgactttgctatatccatagctgtgattcaccattttgctactgaagaaagaagaatagaagccgttcagcacatattatctaaattaagagaaggtggggaagcattgatttattgctgggctctagagcaggagacttctcgtcgtggatacaaggaaggcgacgaccaagacgttttgataccgtgggtattgaaaaaacaacaaccactgaagaaaaaaggagccaacaaaagaaaacaaaagagcgagtctgtgctggaacaaccagaaagcacagagcaacctgctgatgccgaagaaacagagccagatgtcaccaagtatcgttactaccatttatacaagaagggagaattagtcgacaattgtctacaaactaaatgttgcacgattgtggaggaggggtacgagaaggataactggtgggtcattataaagaaaacatag

SEQ ID NO: 1119 - DNA, 315 bp, Candida albicans
cttggtggtttaatagatgctaatggtaattttaagataattaataagataaatgctcaatgtgagataatagtatctattaatgatgagaagttattaaggcaaatccagaataaatatggaggttctattaaattgagatcaggtaataaaactttaagatatagattaattaataataatattaaatatttaattaaagatattaatggtaatatacatactaataaaaggttagtagaattacataagatatgtaatatattaaatatatcagtacttagacctgtaccattagataaggataatggatga

SEQ ID NO: 1120 - DNA, 207 bp, Candida albicans
agaattaaacgaaacatgaaggttgtgtttacatttttcaatcttttctttttggcagggaccgttcttttattgatattcacagtattatccggttcatctaaacatttcccattaaacaaattctattggctcgaagctgatacttcaggtattaaaaatgctccagctaacagaagtgcttggacattggggccggggttctga

SEQ ID NO: 1121 - DNA, 618 bp, Candida albicans
atgttcggatccttccagccgcctggtgaagattatccaatttctccagaagataattttggtaccaccgccgatattccaaaagatttcgttgataatgaaaactcctattattatttgagtagatttgcctttgccttttgtctcattgcccttgcattcagtggattggctttcattattgatattttaggtttctgttttgaaatcattgataaagttgttatctttttgattaccattggattattgtttttggctgggtttgcttccttacaaactgctgttgttgttttggccaagaatgctttcaagaatgatggcagatatgctcacattggtgccaaatcaatgggtattatgtgggctgcatttgcttgtttactcatttgttggttattgattttcgctggtactatttctaattcttataagaaacacattgccagagtcaaagctgaacaaggacaatattctcaaccaactcatggaccagctggtgatgaatcttcatttactagagctgccccaccaactaaagatgaagaaaacacaggcggtattagattcttcaaaatcaaaagaaaccaaaaagtttccgatgatgaatcagtataa

SEQ ID NO: 1122 - DNA, 321 bp, Candida albicans
ctgattgttgtcaaaaatgaatcattggttcaagaaatttatagcaacaaccctgacattgaaaagctagatgtcattaccaatggacctatagaagattggggtggtcacaataaaactgtaccgtattggaggtgtcaaccatattttagaaaagttgatggtgtcaaacaaaacaccgcccttttgaaaatggatggagaaaatgaattgattaaatcaattcctcaagcaaataacaagagacaactagaggatgaatccaatgatgatgagggccatagtaaactcaaaaagcaagcaacattagttcaaaattag

SEQ ID NO: 1123 - DNA, 432 bp, Candida albicans
aatttatttatgaaaagtgttaatagtcaaactattagcaatctactaaaagtatctaaggtcatgactactaccaaagcaacatctacaacaacactggtttccacaagtgtagccaccgattcagccttcgtgaaaacgaaattaacagggcgccagttatacaatgcaataggtcaaccaaaaactattgttgctcccatggttgaccaatctgaattggcatggagaatattatctcgtcgttatggtgctcaattatgctatacgccaatgttccatgccaaactatttgctacacaagaaaagtatcgtaattccatgtggaccactaatttggatgggaataaagatttagatcgacctttggttgtacagttttgtgctaatgatccagactatttattacaggcggccaaattgattgagaat

SEQ ID NO: 1124 - DNA, 795 bp, Candida albicans
aatacagcacaattaacacatacctttaaaaaaatggctagaccaggctctgtaccactacacctcaatccattgagattgaaaacagcgttgaaaatggcaataagcaaattgaggtttattcaggagaagaaaactgccataaccaaacaacaaagacgtcaactatctgaattgttatcacaaggtaaagaatcgagcagtaaaatccgtgtggaaaatataatccgtgatgatatatatatcgaattattggaaattttagaattgtattgtgagttattgttggcacgtttaccaatcttgttaaaacgaacaacagttgagaagaatctacaggaagctgtcaatagtattatttattctgctaaccacactgaattaaaagaattagtcacaatcaaagatattttggtatataagtttggtggacctgaatttgcccaaccaatattggataacaaaaatggtgaagaagtaccagaaaaggttgttaaacgatgtgacattgaaccgccaagtgaaacattggtcgacttgtatttgtgcgaaatagcaagagcctataatgtaccctatagtggattaaaggaagaagaggcaactaatgcctcaggcgataatagcgatgatgacaatgatgacggaggacaaaaggaatttgggttggcagaaccgttaggtggtgtggcagttaaacctgtctttaagaaccacgatcctaaacaacaagaagaatctgatttcgatgcattaaaagctcgatttgctgcattgaaaggaactttgccatag

SEQ ID NO: 1125 - DNA, 1665 bp, Candida albicans
agtcaaatttttattttgatcattggatatttcagagattcgttttctgtgaaaaaatggaattctttgcatgtggcaatgatatgtttcaaggagttgttacaaatttccaattcagtgtttggtaaggaaatcactaaccagacaggcgaaggcgatgaaatctcacagcatgaaattgatcgagagttggcagaaggtattattagaaagctattttcatttaatgattttttgagtattattgttcaaatacctcagactgcggccaaacattctccagattatcttagagtctcggtttctgttgttcatattttattaaaggcttttgaaacttttgccaatgaagatgttcatttgtatattcaatcaaaacgtaaacaaagtaagagaaaccgtaagcgggtgaacaatttggataagtctactgaagataggttaagagatgtgatctatgcatcagatgaagaattagaccaatcaagtgccaaagaaataactcaagaacgtaaattagatttcaagaaaacagaagcaaggtttttccatcaagcgattgtatctacatatatcaactacttatcaagatatgaagatttatcaaaccaagaaatcaaaacgtgtctttcatattttcatcgattatttgtggtaagaaaagatttcactgggttgtatagattggatttcatgcaattgttacaaaagttgagaaattatttgcaacgaggaagtagtctacgtttacaagttgaagaatttatttattattttatgaaaaaattcaagactgcatttgaaagattccccatgcccattgaagtattatttcctcgatttgaagataacgagtgtaaggtttatctagctacaggagaagtatatgagaaggaagaaacgacatcaacatcacgttctccaagattagctaaagatttggaatttgtacgtgattttggtttagatgatcaaattaaaatcttggtgagtcagttgcatgttcaagagaagcaatcgttactcaaatggttgatacaggaattggagagaataataaatgataggattttaaattcagattccattgcagaattgaatgcatctaatcagcaccgtcgtttattcattaacaatgggtatttgcgtttcttgttacgtataattggatttgatttgccttatactatggaagaagtgccagagttggcaactaccgttgatatggaacatttgacaaaagttaccgaattgattaaaaaatgggactcttctcaacctgtgatatttgaagatgataaggtgccttcttattttgtacgtacaagagaagcaggttatgatgaggaccagtataacgaaaatgatcaagagtatgattttaatgatgattctattgcatttgaaaccgaggctaatccaaactctaaccgaaatcatgtttctgaattggatcacttggaggaattagaaagacaattactgagtaatggttctagagttaattcaaaagaacgtaatggtacgaaagggaaagcaagaaagaaatctaaagaaaagaaacgccctgaacctaagaaagtacgtggtcttaaacgtagaagaatacgtacagatcgtcttcacctgccggaactagacggatccgcgcttaatccagggaga

SEQ ID NO: 1126 - DNA, 1755 bp, Candida albicans
cattacacgtctatttttttttcgtcttttttttttcaacgcgttgtttatttctgtgggttaaaaaaaaatcttacaacacactcgactttccatcatcatatcctagcattgtacaaaatgagtgattatgaatcaggatcagacatagataactattatgaagcagatgaatttgacgattttattgaatacagtgataatgaagttgaacaagaaaaatcaaaaccaaccccaggccaaatagaagttgaggaaattgaagaacctgaagaagatagaataagaactttgactacaactttaaaaccaaatgagacacaagcccagaaattattaaaagcgcatatttctgttttagtatcagcccttggtggtcctgaccacacttcagatattcaaccaccgccttataaattgggccatgatgcacttgcgtgtcttaaagatattaaacgctggataagagctgttgatgaaaagaaaaacaattatgaggttgccttggcatgtgctgaaagtggattagtgacaaatgatttaattgtgattatgtgtcaatgggaagataaaatgcaaaagaaagagaccattaaaaacaaaactaccactgagaaaacgatgttggcgtgtcttgaattgttagtactattaacatggcctgttgagtttggtaaagatttatctgagagccaaaaattactttattccgaaattaaaaaagtgcatgtatcttataagaaacaaatattaatgtttaataatggacaactattaaaagctgctattagattagttttgccaactatagcaaagtcgaggatagaccgtgaacctagggacaaccaaattttgaaactagttttgtacctcataagaaatttattagctattgaacctgcaaacttgtcgatatctaacaagtcacgtaaaggtgctagtgtaactgcatctgatttaccactcggtgtcacacaagacgatatatcgatcaataacgtattgtctgtattcaagaaaaacaaggtattgatgttgcttttaaccatatcaggatcgctcggaactgaatttgatagagacatgtttggcgaaatatgtttggaaagcatttatctaataataaaggggttatcagcatctgaagttttggtgaaaaagaatttgggatctacacctgttgctgtgccttctcaaaatacggttcctgatgccatcaatgcctcacagccattgcaaccagtgacgactactgttggaatgcaattgcaagatttgttggccaccgagaccaagaaaaagaaaattcaaacacaaaatatagcttctagacatggtcgatttggatccttactttctatccgatcagccgactcgaattcttttgtcgtatcaggacaagaagcattaatcaacactgatagttctttagctaaattggacaagtctaagaaatggaaagatagaacctatttcaagtatgattccgatgaatacgtcaatacttccactcctgtttatcttaatttaactggacaagacattttgtacaattttgtggaacaatttttatcaggggggtgtttcaataatttgattgagtgtatgggatcaagattaaccagtcaaactgatttgaatatggtagatgagcttacacttgctagttattttttcactatttcatggtttttaagttatcaaagagaaagaattgggttggatcttcacgccggggctggaaggaaacgcgct

SEQ ID NO: 1127 - DNA, 1713 bp, Candida albicans
actgcccctagtaattttttttcagtcatggggttatcgttcagacattttaattattttgggtatgggatctataatgatatcaagagtagactaccgcattataaatcagatttcaccgatgcattcaattatcgagtaattccatcaacggcattcatatttttcacaaatttattaccagcaattgcatttgctcaagatatgtttgataaaactgatcatgcttatggtgttaatgaagttttaatgctgagtgctcttgccggggttgtatttggtttattttctggtcaaccattatgtatagttggtgtcacgggaccaatatcgatattcagttatacggtttatgaattgatacatcctcgtggaacaccatatttcccatttatgtgttgggtttatctttggtcaatggttttccatataattattgctgttggcaattatatttcattcttacgaattataagtctttatagttgtgatatttttggatttttcatcaatatggtttatattcaaaagggtattcaaatattgagtaatcaatttgatgatgttgatttagccagtggatattgttcagtaatgattgcattattaatggtaatatgtggggttggatcaaatatcttgggtaattatttacattattttaaaccttgggttagaaaagtatttgtagattatggtgtggtggtgctggtgatttttttcacgggatttattcatttcggtggtaaattagatgatacagatttggcaagattaccaataactcaatcttttcaacccacaagaaatggtgaaatacgaccacacggatggtttattcatttctggcctggagaaaatatttctgttggagatgtatttttagctattccatttgctattttattgacatttttattttattttgatcataatgtatcgtctttaatgtgccaactgaaagaatatcctttgactaaacctgcatctttccattgggatttcttattgttaggattaactactggtcttgctggaatattggggatcccagctcctaatggattgattcctcaagcaccattacatactgattcattagttattcatgataaaaccgggaaacgattgtcggtagtggaacaacgagtgacaaatactgctcaaggagctttgacatttttaatgatgtcgagaccatttttggtagttttgggtcttgtaccacaagctgtactttcagggttatttttcattatggccattggtgggttacacgggaatattgtcaccaataggattaggtattgctttttggacaaagagtatatagaaaccgatccccaatgtcctcaagtttggaaagatattcatcgattacccactaaaaaatggttttatatttacactttgcttgaaatcattggtggagtagcagaatttgcaattacattaactaaaggtgctgtggggttcccaggagtattattgtttcttgccttttgtgccaaatgggtatggccattgattataccgaaagatgaattggccaaattagatggagatgtagctgatgaattcattcttaaaaatttcacagttgcatctgatgaaaaaaagagaagacgtagaaggtctgatgctgaagaaaaagaacgaggaagtaattatcatgaatccactaatgagcaaagtgaaagtgtaacatcgtga

SEQ ID NO: 1128 - DNA, 2067 bp, Candida albicans
ttcaaaatgttaggaaatactcctccagcgctgccaatatatcgcagagttagatctcccttggctcaacctccagctacactaaatgaaaatgctcctgcatttacaaccccgtctcctccaccactccctactaaagattttacaatcccatctccagtaggatttttggctaatagtgataagagtaatgacagcagtatcgacgatagcaaaccaggcattaccctcccaaaaattaacaccacaatttcatctaaccaagcatcagagtcatcttcatataatgaaactggtttgcacagacgaaccttatcggatcgaataaagacaacaccttcttcatttgttcgacaaagtcgaattttctccaacgaagacgctgattcaatttattcatcacattcagtcactgggagatcattattgcttcaaaacaagattcaaacggaatcattatctccagaattccatcctatcgtaactttaatcaatgctcagaagttaagaacttactgcattggttcgttgcagatccccggtgtcattggttcagaaagagtttggttggaagttgaggcaaaattatcgggaaatgagttggctatttggagaccactgaccgatgaatacactttagaggaagggaatgagttcaaaccaaaatatatcaatttaattgatgcacatatcgaggttgtttctggtttacaaataaagatctaccaagattatcgcgaggatgcatcggtagcagtacagttccacgacaaaaaatcgtttgaccaatggatgagtgcaatcattctttccaaatttgagtatgtgaagttaaacgaagcatttactgctgttcttttatcttccaagggatccaaattactggatattcatgtcttgttgggcaataaaaagagattcccacaatacgaatggtgccatattagattacccgaagtatccactaaatggatcaaggtgtacatggcggtgttgccaggggataaaggtcatgttggtagaatagagttttatccatcggacaaaaaattgcagaaaaagaatctcattgcctatatttccgatttggctggggttttcaacgtttatccagaacaatcgagcatgattgacttcaactcaatcatgcgagctgcaggagaaatctacgtgaacaaaaattatgaatacttgttccctcacaatagtgatgaacagcttgatccaagaaagctcattgccaaaaatcacggcgtttctcgttctgattccaatagctcactttcatcactttctaaccaagctcccaatactccaaaaaaccgttctcggtcaagttctttacattcgacaagctcatttttcaatcagtcgacttcattatcgcccaaacaaacaaatggacatacaagaaaccgttccttgtctaacttaggtaagtcgccagctaacccaagtcaaactccactgagccacaagaggacaaactctagttttttcaaaaagcacacagaaagttttgttttaaccaattctgtgtacattatgcccagtctgcaccctggtgtcacagcagttgaaaccatgattcgtaactttatccctattgttgacgcattcaagttgtatggccgtcttaagcgattaatcagtgacaaatcagatacagcctcaatgttgtttggattaccttcattgccacactatcaatatttgtccaacaaggatgcagagagagcttttgctcaaaatttcaagattggctcaaattggtttgaatggccagaaatcattgctcatgaaataaaacaattacaatcatcgaacaccaaaggttatcgtggtcatggtgatatagctaaattgtacgagaatttggatttggattacggtgaaattacatctccagttttcaagtttggcaagtttgaagatgatttaccgagcttgagcgattcaattgagtttggcggaaaaattgaaacaccaccacccgggatttcaagcccaataagttttgctgaagatggatctccttacgagccactaccaaagattgttgtataa

SEQ ID NO: 1129 - DNA, 1557 bp, Candida albicans
atttgtttactaaatgcagctttaaagggttcaacagaggtagctcttgatgcaagcgaaggtgttattcgagctgttaacgctactgtggtatcggcaacaaatgacattgagagcgctctaaaggttctttccctgattattaatgatttggtgactggatttaatgccataaagaatatgttcactggatccaagtcagacccaactcagtatcaaaataaaatcaatattactttaggagatttaaagagtaaaatcatgatccctagtgaagttttaaccaaacttgataatttcaaaaattctagtttgtatgggttatcacaattaggtaatggtactcaaaccatagtgtctaccccttttgaattggccattaagaaattaaacaccatgaaactgagttataactttaccacaggtgcaccaagtcccatcaatttccgtgaagagtgtttgaaagatatgagtaaattaaaggatgtacaaaccgacttagcaaagttagttgaaaaaattagcaaatggctttttattggtttagtgcttgctatggtgggctccatcttgtatgtgagttatatccaatggagacattggagacgaatggacaaatttatcaatgaaacgggtatagacaaagaggtacaatttcgcaaccaatataatatttacaacaactttttgatatatacaatagtgaaacgcatgggaatagatcttaatgaaagagcaatttggatgttgagcttcatgtttagtaagatttccaggaatgtgttcttttttggaataatgggagttgtttcagtagtggcacgatatattctactaaattcagttcaatcatttatgaataatcatatcaagtcgtttgatattacaagcaacagtacctccatgtcagcatctacaatttatcttcgtgatatgaacacttacattgatgatacacaagacaagctaaatcaagagttattcagtggtataaaagaaatatcggtgtcgttaaactcgacaattgtagagttcttggataagcttaatgaaacactatctgatatatttgggaatacaccactagcaggaccaataaacacggttgtctactgtacaattggaagaaaactagaaaaggttgaaaagggtttaacctggatgaatgataacttaaatatcaacataccttctattagcagagatattgaagatggcttatctcacatgacatttttgcaaccgcgatcagttttagcaagagcaaataaaattatagatttataccgaaaatctatattgttagagttatacataagtctaggacttcttggcgtttggttatttcaaatttttgttgggagtgccacacttactattcggcattggaatagtaccagacagggaaacaattcttacgccataagtagcccacatgaattgtcagaacaggagaaacaagtatatggctatcctttgtcacatcctttgattgacggcaaagacttaactacatcgtcaagcttctatccgactacagaggagaaactgaaataa

SEQ ID NO: 1130 - DNA, 447 bp, Candida albicans
cagatgattaataggcattggattgacaaaaactgtttgccctggtccaaagactatttgaaggagaatataatagacactacatacgaagatgacctgttcagatttgtagtcactgctgttgattctgtcagtggtgattgtgatgtgactcaaagaaaggggaaggtgttatgcatatacgatatgagattacaatttctgttatctggagctatcaaaaagggcaatgagaaggaggaagaagaaacaatatcagcaacaattgttataccagaatttgttcatgatcaagataaagacgaatacgtttttgagatagaatctgcttctcaaaaatcagaaattagaaagtactttgtaccaatcttaaaggagaaattgatgaaatttcaacctgatttacttgaagcacatgcaaaagatgttcaacacgcaactgattaa

SEQ ID NO: 1131 - DNA, 726 bp, Candida albicans
caacaacaacaacaaactccatataaatcaaaggaaaatatcatgtcttcagttggcaatcctgtacattcattagcactgaccgattctacggcttcctcttcatcctctaataaagctttaaatgatgaacaaatttatcaatggatatcagaattagtaacgggcaacaatagagaaagagcattattagaattaggtaaaaaaagagaacaatatgatgatttagccttagttttatggaattcatttggagtcatcacggttttattagaagaaataatatcggtatatccttatttaaatccaccaaatttaagtgcatctatatctaatcgagtttgtaatgcattggcattattacaatgtgtagcatcaaatgttcaaacgagaacattatttttaaatgctaatttaccattatatttatatccatttttatcaactaatgctcgtcaaagatcatttgaatatttacgattgactagtttgggtgtgattggagcattagtgaaaaatgatactccagaagtgattaattttttattaacaacagaaattgtccccttatgtttaaatataatggaaatatcatcagaattatcgaaaacagtggcaatttttatcttacagaaaattttattagatgatcaaggtttattttcaccacggcctgaaggtccgcatcaacaccacagtggagaccacgactctcgacgcccctaa

SEQ ID NO: 1132 - DNA, 1248 bp, Candida albicans
aaaaatagaaacctgaagacatctcaaaaaaaatactattggcattgcttcactttatcttgtatgctcagactcaaatctataaaaatgaacggagtatttgcagtatacaaaccctcaggcattacatctgccaaatttattgaagcaattcagaataagttcacaaaatccgaagtgttcgccaaagacttacaagagatgaaagacaaaataagatcagatcttagtcgtgatagaaaatggaaaccgcaaaagattgagaaaaagatcgcctcaaccaaggtgaaaattggccatggaggtacattggatcctttagcaagtgggattttggtggttggtgttggattgggaacgaaaaaattacaatactatcttgctgagtgtcaaaagacatatgaaacaaaagccttgttgggaatatctaccaccacgggggattcagagggggaaattgttagtaaaaacaaaattgatcacattaccctggaattaatagatagtactgtggaaaaatttattggtgatattaagcaaaccccacctattttctcagcattaaaagtcaatgggaaaccactttacgaatacgcacgaaaaggattgcctttgcctacaaatatcaaagtaagagatgttactgtcaataatattactgttatcaaagaagactcattgaaaactgatcacgaatttacaaaattggaaagcgagttagacgaaaatggtgttcccaaagaacatgggttgaaggataatccaactttaaatgactcgccattattcttttccaagcaatatttggaaaaagctgaaaaagagggtctacctaaggaaactggaaaaccaaagttgttagctgacgacgaatctttaccagagaaattgccaatgattcatttcattagtgatgtgtcatccggtacttatattagaagtttgattagtgatattggtagagctatggagtctagtgcatacatggtggagttgattagaacaaaacaatctgaatgggaattgggtaaaaatgtgtttaaatttgaagattttgaaaaagatgaaagaatatggggtccagtattaaagaaggtttttgaaaaaggtggtgctgaaatacaagacttggacaaagaatttgaagaagtggccaagactgtagaatttctgttcacaaaggaaaccaaagagtcaacttcagaaactattcctcaaaaaagatctattgatgaagttgaaaaataa

SEQ ID NO: 1133 - DNA, 1056 bp, Candida albicans
aatgtaaaaacgaaggataccgaagtcattgaaagagatttgaatcgtactttccctgataatatatactttaattcatcaatcaaaggtgtgttttcatccttagaaactttgcaacaagaaaaggaacaagaaacattattgatcaagtcattaagaagagtattggttgcctttgcacagcatcaaccacaaataggatattgtcaatcattgaattttttggcaggtcttttattattgttcatggaagaagaaaaagcattttggatgcttgttatattaacagaaagaattatcccaaaagttcatctggcaaatctagaaggtgttcatactgatcaaggggttttaatgttatgtgttaaagagtatataccccaattatggcaagttttagggaaaaatttcgatggtgaaactctttctgaagacaagattttatcaagattacctccagttacattagtcacttcatcttggttcatgtcagtatttgtggggattctacctattgaaacaactttaagattatgggatatactttggtatgaaggttcgaaaacaattttcagattctctttaaccatattcaaaatgtgtctggattcacccgaatttaatacaaaacaaaatcgtcgtagtggtagtggtagtggtggtggtggtgaatccgaacaaattgaattattccaatttatgcaaaatttcccgaaaaaaattcttgatgcaaatttactaattgatctttgttttaaaaaaattggtggtaatgggtttggctctttgtcacaagatgaaatcaacaaatgtagagcatttgtatctaagcaaagagagaaattgactaaaaaactgaatcaaaaagggttaaccgatatgactgatgaggaaagaaacacgttattgaagtcttctactggatttgagacttcggatattcatgatgtttatggatttaatcgctcaattatgagtgggatggtttggaataaaaatattagtaataaaatgaagaaaaagtttgtcgttgggaaacgtaacagctcccgataa

SEQ ID NO: 1134 - DNA, 1020 bp, Candida albicans
  unsure (1002): Identity of nucleotide sequences at the above locations are unknown.
ataatgtactggaagaatgcctggtgggtgggcaccgtctattcttcatgtgaaccaattgaattacctgaaggtatgctaatatcaaaacaatatgagacatatcccatcacaactgtttccaaagccatatataaacaaatgtgctaccgaaattgtatcccagtattgaacacaaatgtggggtttgtcatagatacatttgcaaaaccactacccatagtttctcagagttggcgtgaattcaccaaggattcattacgagggtcatttgcctatagtgttgtttctatcatatatgctattgcagtactggcagtgataatctggtttttaacaatttttgtgttaacaaactatacgatcaaaccttcgtggttattgaaaacaagtacaatacttctcacagtgtacatcctcgttgtggtgataaaatcaattctcatactacacggacaacaacgagatggttatttacatggagctaagcttcttagtgaactcaacgactataacccgatccaaatcatagatttaattgtggtattgttgctacaaatcaaccaagttcaaataataatgcgaatctttcaaagacagaaagacaaacgaatggctttactcattggtatagtggcgacattggcatctcaagtgatctgggcaattgcacaattttatacaccagctgacgctaatgaagcaagtgatatattaccggcttttatatacttggttagaatagccatggccttatgctatgctgctattataacggtgtttttcattagcaaaattcaaattatcttggcaaacaaaaaaatctggttgttaactttgctaacgtttattttgatatacagcccagtggcattttttgttgccgatgtttcgaacgcatttgtttatgaattgtcagaaatcttttcggtggtgaactatgttatcggcgtagtgatcccatgggaatggtgcaacaagtttaacgtcttccaccaccgngctggaagatccgcagct

SEQ ID NO: 1135 - DNA, 1557 bp, Candida albicans
cacatatacagattccatttgtttaaagttcttaaaaaacaccagatgtctaatgttcagctgttgattggagacctcaatggactattaacggattccaaaagaaggtttcctgatattagactgtcatgtgaggctgcaattaaagtactaaaaagttattcactagtagtcccaattcaagagattaataaagaggatcacaaagaggaaatattgaaaccgtttattttatcttgtaaatcaggaaacatcaaattgactaatatttcaataccagtgattcacaaattaatattggctcatttgattcctgaactggatattactcaggttttactatgtttactggaagcttctaatttagctgttgacattcaattgagaatcttacaatgtttaccggcattgatgcaaaaatatccaataacgggaacaaatttacttgacatgttagccatatgttctagtttgacagcgaataataaatcctcaatggtggtaaatactgcttcagcaacattgcaacaattgtttacaaatatatatgatagtattggtgaaagttctaatgaaaagaagaaagagcatgaagtggtgatagataatgatgaaaccgtgaagttagattcattgtcgcatgaagggtttttaatatttcaggatttatgcaactttattgataatgaatcacccacttatttgaaagactctatacacataaaattatattcagtgcttgaaatcgtggagagcattgttcatgggcatcaagttttatttcaaactcataaggaattgacttacttgttgcgagtacgacttttcccatcaatgttgaaaatcttaaattctgtcacaaaaaacttcccattagtgaatagaacaataagaattatgaatgttctattatcaacccaattagaaaacctcaagatagagagtgaaattgtcttgtcctttttctgtcatttggtaattgatggaggagaaacggaggaaagagaatctaattgggaaaagtacatggttcttgaactactcaaaaatttgtttagtgattttctggtacttaaattaatttttcaacaatttgattataataagctgatgaagaatgtattgaaagaattattcagtgtgtttatggtatatttacaaaaaagcaacaccattgttgatgacattgtcagaccagtttcaagattggctccaggtaccttttcaactgatggatctagttctagtggttctgctttacatggctccaacggcaattacttatcgcgtacaacttcaaatttgaaaccactggtccttgatcatttggataaattagaaccacctggcaatattccatctacgtatgggatttatttgatttatcaaatattaatacttttttctgatggtgtggctaattttgtttataatttgaacgatgaatctaaagatccaattagtttagaagctgatgtcgaattagcaaatgcattgatcgaaggttgtggtgttgattcttcacccaccggcgctggaaggacccgcacttgcgta

SEQ ID NO: 1136 - DNA, 2976 bp, Candida albicans
cgcgggatcgtcctgccccgtcgtcgaagatggatagcccttcaatggtgtgggtattatctcgatggacctgatcagtttagtccatatttcaacaacaccaaggtacagcaaacattaaaggaatcaaagaaaccacaaatcagtgcacaagatgtgacaaatgtggaaaactccataaagaaattatatgtaagcattggtgatagttcagttgaaacgtttagaaccatactcatcaccttaactagattatccgattttgctttggatgttgataatgagaaatatgaagatgaattacatatatccagttttaacaagagttattttgtttcaaggttggctcaagttagtgaaatcgatgaatttcataattggttaattaaagatgaggaatcatgggacatcattagttcgtatttcattgatttgggaacgaaaagaaatattcatttcagtttaagaaattatgttgttgaaatgtatatgaaggttattgagactgtggcagtttttggatttcaacatgatgatttgattgaagaaacttctcaaaaaacattgaatgggttgaatggatatttggaaaaattatttggcatgggatcgtcgaaagaattattaatcaataatcgtgaaacagaaatccatcttttgattcttaccacattgcatacattgattgacaagtatgataaaaattatcaacaaacatggaatgaagtatttaaacttttgaatacgcctttccgtgcagtaaagaaagatgaagtagaggatactatcaatggtgatgataccagatctgatgaaggggttttactcaaggacaaaactcagcttttggttgaaaaatcatttgacactttaaaattaattctcgatgaatttttgtctactctcccatttaatcaatttaaattgttaattgatacattgtccaactttgtttatcaacaatatgatttgaatatatcatttagttcagttagttatttttggttgattagtgattcattaaaatcaagaatggtatcattcaaatgtgagacagtcctgaaatcacatgataagcaaactgaaatacatggtgatgaaaacaaacttcttgaacttattagtggagaaaaaattgaaagttataatttttacatttatttaaacatttatttattattaagtttggcgaaaatatctaaacatgaaattaatagagcacaagtaagagatggtgctattcaaacattttatcaaatcatagatgttcatgggaatgtgttgaagaataaatcttgggatatgatttatgatattgttcttttacccaattttttcactattgttcctgaatcaagaggtaaagattggttagatagtttacaattgattttcacaggattaattagtctttacaacaaatttgttttgaacgacgataatggtaatggcattgttgtgaaatggcaatatttgattgattattttgataaattattgaaattacaatggattgatttaaacttgaaaatttttaaatcattacaagatttaatgacttcctatggagggagtaagaacataaataagcaagtgggtgatttgtttttcaagatttggtcacaattcccaattgagtacgatttgattaataacaattatcaagagtctttggttcaatacatgcaatgcttcctacctttatataagataacatcaaaagatttgtcaatttcagatatggatttaataatcaatattttcaacaaatgtggaatgtaccctgtattaccaagtaatcaatctgataatgtaaaaccaaccaatttgcaaaattctattttgcagaatttgaaacttttgagtaatgttgacaacaatattaatttgcgtccagaatttgaacctttggtgatacaacaattgagtaatattattatttatccctatggaattagaaatagaattgaaaccaaattacaaaacaatgagattgtcaagaataaattacctacatttgttgcatttagtcatttgagtttgaatttattaaatgaaaatttgaacaactttgatggggttttctcgagtattggaaacgataatgccataatgaaatgtttgaaatcattacttgaaattattgaaaataagtcaattggaataaataattccgggaaagaacaatcattatcatcactctggattgaaagtgatcttatatttgttaaaattatcaagaaattgatcaatcatcgtgacaataacaatttattaactaatgatgaattttggaaattaattattcaaagaattgaaattagttttattgcgtatgatgaaaaaaaccaagaaatcaatattactcaataccacgaattgatagaattagtattaccagaattgttgaaatatgaaaacagccagcacatgattgaagatttggtgattaaactttatgaaaattcatatttgtataaatttaacgatttagaaattagattaatggatcaagagaaatatactgttgacaaaacgattgataatttgacattatataaatttgatgaatttttcggtacgactgaatctattgaaaaatatccaaatttacgaatcagattaaattgtctagaagaattgataaattttctgcttggaaaagataccaatactgattcacaaaaaattgttttgaaacaattgtgtgaaaagtatttgattttgagagctagttttacatttagaagaattttgaatgatatcaaattagtatataaatgtccaattccaattgttcaacagaaagaattgttaatgatattgaacgggttgaatgaattgtcagtgaaaaataacaataatgatgatttgaagaaattatcacgtttgttgattcaattaattccttattcatcaagaattaataatttagacaaagtattgcctcaagtgttgatcaaaatctcactgtaa

SEQ ID NO: 1137 - DNA, 675 bp, Candida albicans
aataagcactcagtacttcgcataatcatgttttcgggtataagcaagttggttttgggaaagtctgccatatcttcggcgtactcaattccaaaaccttttaattaccaaaccatatcacgaaccttgtcaacatcatccacggtagcaagcgtacagagagctaacaaaaatgcatcaatgtctcaattagcccagaaattgaataaaaacaaaactaacgaaaaagtagtttattggaaactatacgctacatttaatagacacaacaccagatgcacattagtggccgtggttgaagacttagatttcatggagaagaacaaagatttaccatataacgacaaagtgttatactacttacagttgcctcataaggttaaatatagtgtaactgctggacaattaggattcagaaaatcccagagacaagaatacgaagctggtttccaagtttcgagtaaaatgtttaaaaccatagaagaaagaaactatattggccctcacgataagattgagttgattttgaaaaactttggtaaaggaagagaagccttccaagctgccttgttgggtaaggaaggttcaaaaatcaagaacaacatcgtcagagtctgtgatgctacagtcttgaaattcggtggtgatagaccaaagaaattacgtcgtttgtag

SEQ ID NO: 1138 - DNA, 1818 bp, Candida albicans
agattccaattgctactttccggagcaaaggcaaaaagaacaaagtttcagaattttttcacatcaaacttgattgtgctagcaaagagtagccaaaacactctctacgaagttgaaacttccaccccagaaagttgtcagttggattctgatttgttattagaaaaaccacaatacgaatctttagaggatcttgagattgaaattgaacaagacactaaaagaataagatatgattcctttttgttacaacaaaataccgctgacgaaaaattgcttcccttagctatgaaacaggaagatattccagcagatttgaaagatcttgacccaaacaaccagccagccttgaataatctcgataacttgcagttgttgttaagactaaccgtgttgaaacaaacatcgccagcaagcgatccattggtagaggaggaactttctgcattggtgggtcgtgttttatacgcaagtgcaggtaaagtgaattggtcgattttttcacgtgccttatgggaacggtctttgctcgaaacaaacaagtctagaactattgaaagaggtatactccaaatgacttctttgattgaagaaatgggaattaagattaaaaccagaattatacccgaatcgatggaggaggacaccagtgccactacagcactgagattgagattcattcatttgctacctcttctaccccaatgggctatggatgccaagcttgcagaaaagtacatgtctttgggagttttacgatcggctatagagatttacgaaagattgcacatgctgtgtgaggcggcattgtgctatgcagcagtggacaacgaaagagaagcagagaatattatactacaacgtcttgcaacccatcctgaggacgctagagccatctcgattttgggtgatatccgacaagatccttcattatgggagaaagcatgggaagttggccattatgcaaaggcaaaggcatctttgtcacactattattattcgccaccaagaaaagatattgacttagcgatcaagcacatgtttgattgtctcacagtcaacccattgagctatgaaaattggtatttctatggatgttgtggtcttgaatcgggtcaatttgaattggcctcagaagcatttacacgatgtgtttctcttgacgattccaactcctatgcgtggtctaatttggccagtgcccttttgaaattggacaagaccaaacctgcgttcaatgctttgaaaaaagccattagaagcggtggcgaaagtcgcaagtcttggagaatttatgaaaactacgttaatgtggctgccaagctccatgaatggaatgatgtattgcaagggtgtcgtgaattgattgagattagaaaaaacgaaggcgataccgccattgacattcctgttttggaaaaactagttgaaattcttgtatccgaagaattccctggtgacggagagagattgtcgcactaccaactgtcttgtattgatttggtttgcaatgtgttgccaaaggtaataacttcatcagcgcgatgctggagaatagttgctagagtcgaattgtggagaaaaagaccatgggcagcattggaatgtcacgaaaaggcatacagagttatggtgcataacccagagttggaatccagtgaaactatttggaacgagattgtcgatgcttgtgaagatttggtgagtgcgtttgaatcactcggtgagttaccggggaaacatggagctggtgacttggtatgtaaagactgcaagtacaaggccagaactacaatgagcctcttcaccacggaatga

SEQ ID NO: 1139 - DNA, 852 bp, Candida albicans
gcaaaaaaaaaaaaaattccaaaaaaaaaaagaaccaacgatggcgtacttacaccagacatggattgtttgaaaaaatatttatcgcaactattattactagttcctccagggacttttgaagttggatccaatgaaagagtcggatactcaattcttagtattttagaggggaaatcagaacatttatttgaagtgagtgatttcaaagaaatattgcatttgcctcaattacagaatattttacagaaatactcatcgaacaacttaattgatgtcttaaacgaatatgttgaccagttgatagctttactggataagtactttggcaaagatagtgtcatctgtttgcagatattgggtgttgcatgtttgcagtcatttgtccaagcaaattttactggtccaccagtttcgaaaacagcacagtctttgtggttcccaaatgagaataccgaaaacgttcaggctgaagctattaaattgcttagcattgaaggacaacaagcgtacgacttgatgcaagaacctctctttttagtgatgtcagaattgattttcgaaagattgttacaaacacctcctcaattatcccttttcagcagaagcgatccaaccaaactcttggattttgttaccgaagcctccaaagtccaagacccaattactgcttctctttgttggtggaaagtcagaggattgcaagtacatttatcagtagtatcggaaccaccgagcatcatactgtcggtttgtggaataattctcaactcatcattagtgaatgcaattgcaccaccagacctccccgagttcttttcaacacgccgtagaagagcatgctcgggacat

SEQ ID NO: 1140 - DNA, 900 bp, Candida albicans
aatcaaactatgtatagatctcataataataataacaattatcactctcgtaatgatggctccaatggacgaataaacaaaccaagggaccctaaactgcaagataaatacgtggcgtatcaacaaaacattgaacaacaattggcaagtcaagaaaagaaacaagcgtatagaagaatcaccgatcatgggaataatatgggacgatggtatattgagaaatcattaggattaactaatagatcacaacaggcaatcggaactatacgaccggaatcatcatatttaattgatttattaccttcattggcgtatagttcatcattcaatttaaatcgaagaaataataaaaacaatttagctgtattagatttacaaacgaaatttgttcatttgtcttcaaataaagttaaacacacgataaacactgttaaatggactcctgaagggagacgattattggttgcttcacattctggagaattcacattatggaatgggatgacgtttaatttcgagactattatgcaagctcatgaatcgccaattttaacaatgaaatattccaatcatgatgaatggttattgagtggtgatcaaaatgggacagtgaaatattggcaacctaattttaataacgttaataatatttctgctcatgctaatggagtaagagatattgctttttcacccaatgatctgaaatttcttacttgtggtgatgactcggcaattaaaatatggaactttaataatggtaaagaagaaagacctttgagtggacatcattgggaaatgaaaagtgctgattggcatcctaacttgggtttgattgtcagtggctccaaagataatttatttaaattatgggaccctcgactgggttactgtgtttctaca

SEQ ID NO: 1141 - DNA, 828 bp, Candida albicans
gtgtgttgctttaatggatggaaacttatcagaataattgatttatccagcttcattgagaccgaacatgggtattgtgcgaccccagatgaatacaacatgccgtatgaattaatcaatttacctactgaagatggagagttattacaatgttatctgttgaaacaagatccccatagcccctcgtattctaataagacaattttgatactatcacctaatgctggaaacattggtcatgccttgcccattgtatctatattttacaagaaatttggttataatgtgtttatttacagttatagaggctatggcaaatcaacaggaagcccatcagaaaagggattgaaaatggatgccgatagagtaatgcaatacttgacaaaggaagatagtcagtatcaacaatcgtctattatattatacggaagatctttgggaggtgcagttgctatatacattgctgctactaaaacatcttctattcatgccatgatattggaaaacacattcttgtctattagaaaaacagtgccacatgcttttccattgttaaagtatgtggctggatttgtacaccaaacctgggatctggagagtttagtacccttaatctcaccgaaagtccccgtgttattgttgtcggcaagaaaagatgaaattgtacctccactgcacatggatcgaatttacgagttgctcaaaagtgaaagcaagggaatgtttgaatttgagaattcgagtcacaacgacactgttgtacaagaaggctactgggatagagtacattcttttataaaaaataaggtaaaccctgtagggttttaa

SEQ ID NO: 1142 - DNA, 2172 bp, Candida albicans
gatcgtggttccttcgagccgccgtgggtgaagaaagtggctacccgtgccgaagaagacatccacgatttcgacccacgtaaaccaacagcaaggatttactggggcgtaaagttgaccaacatcgtatggtccttaactgcgggattactcatctgcctcatctgcttgcttggcgcagcatttgtatttatcttttcggggtttgctattgagagaaaactgagaccttacgtcaaggcattgttaaagttgggacattactggttatacccatttggtaaatttgtattgttgaaccgagaacaaaactacttggacgaagaccaattagaaggaagaaccatcaacgaattccatcaatggagactccaggaagaaggaagattgtttttcgccccaccaagaaggtacactggatccgaatcaacacgaccattgctaaaagaccaccgaggtcgacctttgcgagatgcatactcgctgttggacgacggtatacaagaagaagaagacgagcaggacaacgacgctaacgacatcaaagtcaggtttttcggacgtggtgactggagttttggaagaatcgcattttacgtatacttttacggtattatccagccaatttcctttttcatcggcatcttgtgctggctcatcgtgttcaccatccccatggcgaaaatcacaaacaccatgaacgaccatatgagacgacacccattggcattggactacgagctcgaaaaggattactacaaaagggttgaacgcaccccaagaaagaagaaccaggtcatcttgttatgtacctacaggtgctgcggattccattactacaagtataccatcgacggtaccaacatctttttcataaacctattgtcagtggtcatctttgcaatcttggactactacttcctaaaggaaaccatgcactgggactcctggataaccgagtccaactttattttctgcttgtcgttgttttcaatcataccattggcatatttcattggccaggccgttgcatctatctccgcacaatcgtcaatgggcgtgggtgcggtgatcaacgcctttttctcaacaattgtggaaatctttttgtactgtgttgccctcaaccaagcaaagggaaaattagtcgaagggtccatgattgggtcaattttgggtgcagtgttgttgttgccagggttgtcaatgtgcgggggtgcattcaaacggaaaactcagagatacaacccgagatctgctggtgtctcctcaacaatgttactgtatgccatggtggtgatgtttgccccatcgatcttctaccaaatgtacggaagctacgaaatgaaatgcaaagactgcacatcccccggagtttgcggccggtgcagatttatccagcccacatttgtcttggactccctctactcaacagtcatcaaaccattttcgttgattgtcacagtggccttgtttgcagcatacgtttgtgggttatttttcactttacgaacccacgcatccttgatctgggcaactacgtctcacgaaccaaaacgcgacgactatttcagatcaaacagtgttgtcagcatgagcacaccaacccaaacaccaaaacccaccaccccattaccggccaagccagaagaagaccaaggtggcggccacgacgcacccaattggtcaagatcgaaatctacaatcatattgcttggggcaacaattttatatgccattatcgcagaaatcctagtcgacaacgtggactccatcttggcagatttccccataaaccccaaattcttgggactaacggtttttgcattggttccaaataccacagagttccttaatgccatatcgtttgccgtcggcggcaatgtcgccttgtcgttagagatcggtagtgcatacgctttgcaggtggtgttgatccaaattccgtgcttggtcctctactcaatataccagaactttgaaaatgtcgagcagacattcacgttgattttcccactgtgggatatcatcgccacactcatttccatatacttgttcacctacatctacgccgagggtaaatcaaactactttaaaggtgtcattttgatattgatctatgttgttgttctctctgggttctggtttaacgatattatcgatagcatctag

SEQ ID NO: 1143 - DNA, 705 bp, Candida albicans
agggtgaaaatgttaaacaaaaaaaaatttcttcggtttctttttgtcacttaccaacccatgtcaaacacaccaatacagggatcatcaagcaaaccgaatgtggctgccgaggactactcacgcagctccagccgtaccaacatactgtctgtaaggaatcggtcagccaccagaatgaaaaagaactcaagacccaatttaaaacgacttggctcggttagccacccccaaggattggtttattctgttgacgacgatataaatgaaaatgacaaggacgacagcaccaaagagtcggaacccaaaagcgacagagactatttagagggatacaacgacgccttacgagcattgtcaaaccgcaaaggcagaacatcttctggccacctttcgatcgctggaacaccacttaggtctcccgaggaaattgccaccattgaatctaaactagccaaagatttgacggacgcagaagaacaaatgaggttactagaagatctcgacagtggccccacccccaatgttaccgacgagtttgttgagcccgaagacaacaacgaagatgctgggtcaatcaagtcgacatccacagtcgagtcgctcaacttaaaggaaagacaaaacgccatcaactcgacccacccgtttggtataaagatttcgaaaccttggttatacaaaaagagccgtctcttcgccaag

SEQ ID NO: 1144 - DNA, 1041 bp, Candida albicans
cagagaaatctggttagcttaacacgactgaacaggacaaaagttcttatactaaggggacgatcggatatattttttccaaccaataggacagataccaggacacatagcccctgtttcattatccccataatcatgtcacgaacagcagatgatgcacaacaaattgataatggagatcaacagcgagaaggtgtattagatgagtatgcacaggagggagaatatgaatcatcttcagattacgatgacgagctgtttgttgacaagaaagaaaagtctagaagaccaaaggaaaactcatttacacagcaaagattaaaagctataaacccagtgttgactgcaaagacagttattccgttgttagttgccattgccatagtgtttgtacctttgggtgcggccatgtggtatgcatcacataaaattgaagacatcacaattgattacagtcaatgccaaaatttggctaggtttgattactggtcagaaattcctgataatttcactacttataactttagaaatattgatacaaactctgagctgaagccaaaattttcatggaaattaacaaatgacacatcgcaacaatttgatgatgaaaagttagtatgccaagtgcagtttgaggtagtggaaaaaatgaaaggtccaatttatctttattatcgtttgcataatttctatgctaaccatagacgttatgttaaatctttcagtgaagaccaattgaatggaaagccagcaaccttaaataccataaagaacacggtaggacagaattgtcagcccctttcagatgtcaatgggaaaagaatttatccttgtggattgattgccaattctttgtttaacgatacatttacagaagcatttgaggcggtcaatgggacatccagtgacaatacacttgtatttgaccgattaagggattgcctggttccactggacgaaattgatttagaaaactccatccatttttctgaatttgtgcaccccccaattgggtttaaaaagttcccaaatggatattat

SEQ ID NO: 1145 - DNA, 1170 bp, Candida albicans
tttctttatatggcagcaatactatataaatatcccatggctaccaataataacaataataacggcaaccccatcctcagatctttggaaacatcttgttgctttttagcaactttgtttcccaaagtgttttgtacattagttttaacatggtcattatatgttctattatttattattccaaattatatcaaatcttcgttgaattccacaatattaaatataattggtataacattatatgtgctatgtattatctcctattataaaatcattttaattggacctggatctccattagattatccagaattaagaatcaacgatttgaatagaatgattaatgaaaatccatataataataataacaatgatgaagaaccaggagatttaccaccagaatcaatgataatacataccatgaaagttaatggcaatcaagggtataggtattgtacgaaatgttctgtatggaaaccggatagatctcatcattgttcatcatcagggaaatgtatattaaagatggatcattattgtccttggttttccacttgcattgggtttcataattataaatttttcattcaattcttgagttatgttgccatttattgttggtttttatttattattagtggtaaaatactatataattttattaccgaggggttatttgaagatgaaatcttatcacttaatttagttgctgttttgattctttcatttgcatttgctattgctgttagtgtatttgccatgtttctgatttatttatgttgtaaaaatttaacaactattgagtttcaagaaaaacgttggaattatcgtggtcaagcaaatgatgaaagattcaattatgaatttgataataatggtaaacgtaagaaaataaatacaaatatttttgatttaggaattatggaaaattggaaactggttatgggtccaaattggataacttggatattaccaataacagttactgtcaccgccaatacaaaatctatgatatctcaagatgaatttaataatggagttaattttaaagttaatgaagaaatatatgccaaatatcttcataatgcagaattacaacaacaattgaatcaacaattgtctagttataaagatagattaagaagagaacgtcaagcaaatatagtgtaa

SEQ ID NO: 1146 - DNA, 447 bp, Candida albicans
caacccaatttttatatggtgttacctataattgttggattaggggccacaatagtggcgttaactgccaaagcaacaatcaccgcatataaacaatatcttcatctaacacctgcaatgatagccacgctcaataacatcaaactaattaatttagaatcttcaatgtctataaacaaatctgatccacgatatgcacattataagtatttacgactgaaatatcctaatcgaccgtttcttgatcccatgactgaacaagaagcattattgattttaggtattgaaggcaatgatattttaaatcttgataaaaaaatgattcgagatcgatatagaaaattaatgattttgaatcatccagataaaaatggtagtcaatatataagtcaacgtataaacgaagctaaagatatacttgataagagttatatggtcaacaaatag

SEQ ID NO: 1147 - DNA, 2106 bp, Candida albicans
  unsure (341): Identity of nucleotide sequences at the above locations are unknown.
acttcaaacatgtcaggtttgaaaaatagaaaatccactactaataaggacaaaaatgcaaaaacaacatcatcatcgaaagttgccgataagaatgaattgaaagatccggtagaaacaacttcatttgacactgaagacaaaatcgcaaaaccaattttacaagatgaaccccaaaaacatcatcaccaccatcaccctcatcatgaacacgaccacgatgacaaagaatcaacatcaatgtcaagaaccaattcacttcaaaaaaagaatcatagtaaaaaattaaagcatcatcagaaaaagaaattgtcagaatcaagacgagttatgtttatatntggtgcattgattggattgatattagcagcattattcactaccaattctgaatccttcactagagatcttgataaattggtcaatcttgatcaatttagtgatattttcgatgattggaaagatttgaaaaatttgaaaggattattacctaatggaattcaatcatttttacaagataagggtgttaacactcaagatgatggattcaatggatcagctgaatcatttagtgttggattaagacttgaaaatctgaaaaatttcacagctgaccataatgtagttatggtccctggggtgatttctactgggttagaatcttgggggaccaccactacgggggattgtccatcaattggtcatttccggaaaagattatggggatcattttatatgttaagaactatggttttagataaaacttgttggcttagacatatcatgttagataccactactggattagatcctcctaatattaaagttagagcagctcaagggtttgaagccgctgattttttcatggcggggtattggatttggaataaaattttacaaaacttagctgtgattggttatggacccaataatatgattagtgcctcgtatgactggagattaacttatattgatttagagaaaagagatggatatttttctaaattgaaagcacaagttgaaattgtcaaacaattgacaggtaaaaaatcagtattagtgggccattcaatgggttcacaaattatttattattttttgaaatgggttgaagccaaaggagaatattatggtaacggaggacctaattgggtcgaagattacgttgaagcatttgttaatattagtggatcttctttgggtacaccaaaggctatcccagcattaatttctggtgaaatgaaagatacagtacaattaaatgccttagcggtgtatggattagagcaatttttcagtagacgtgaaagagtcgatatgttgagatcatttggtggtattgccagtatgatacctaaaggtggtgacaaaatatgggggaatttgacttatgctcctgatgatgaaatagttgcatttgataccgaaaaggaagatattggtgaaaagaaaagatcatttggatcatttattcaatacaaaactgccaatgactcttctagagaagtaactattgaccaaagtattgaagaattattagaaaattctccagactggtattccaaaagagtgcgtgaaaattattcgtttggcgttgctcacacaaaggaagaattggaaaagaataatcatgatcaactgaaatggtctaatccattggaggcagcattaccaaatgctccaagtttgaaagtttattgtttttatggtgttggtaaccctactgaaagggcttataaatacatgcctgctgataagtcaacaaaacttgattatgtaattgatgctgattctcctgatggtgttgttcttggtgatggggatgggacagtttcattgttaacccatacaatgtgtcatgaatggcaaaaaggtgataaatcaagatacaatcctgctaatgtcaatgtcaccattgttgaaattaaacatgaacccgatagatttgatttaagaggtggagctaaaactgctgaacacgttgatattttgggaagtgctgaattgaatgaattggtgttaaccgttgctgcaggaaagggccacacgatacaaaatcgatacgttagcaatttgaagaaaattgtagaaaatatgcatttgtaa

SEQ ID NO: 1148 - DNA, 1338 bp, Candida albicans
aaaacaccacctattactctatccacacatcacaatatgattgaatatgcaaataaattatgtcttgcccccatggtaagaagtggagaactacctattcgtcttttatcattaagatatggttgtgatttactttggactccggaattagttgataaaaaaatcttacaatcgactcgaatcatcaatcaagaattaaataccattgattatattgtatctaatcatcaacaactggacaagaaaactgtgattttccgtaaacatcctgttgaaaccgggagactaatattacaacttggatcgagtgatcctcaattagcagtagatgctgctcgaaaagtgattgatgatgttgatggtattgatttaaattgtggatgtccgaaaaatttctcaactcatagtggtatgggagcagagttattgaaaactccagataaattatgttctatcttgatcaatttagttgaaaaaattggtatcccgaataaaaaatccattagttgtaaaattcgattatttaataattatgatcaactgaaaaatttaattgaaaaaattttacaaacggggatatctaatttaacgattcattgtcgtactccaatcatgagaaatcgtcaagatccagtatggaatttcttacctaaattgatccccattattcaaacagcaggagttaatttagtgattaatggtaatatgcaaaatgttgctgatttgaaaaatctccaatcagcattgaatgacaacggtggaggaaaattgagtattatgattgctgaagcagcggaagcaaatccttcagttttcagccattcaccaaaaccacaatgtttaattatacaagaattatttgaaatttgtcaaaaatattatcaaaatttcctggcaactaaatttttaatgttgaatatgattcctagcaaatcaaaatattttcaaaaattatctcaaacgaaaagttttgatcaaatgggtgttatattgaaagaaatatctcaagaatatgaaaagcagaagcaaatgtctacaaaagggttggataaaatttttactataatgaatcgtgattgtcaaaaagccaattttttcaatttagatcaatttcaaaaacatattgcccaaagaggagaatatatgacgaaatttttccatgaatggcaagaatcaactatgttggaagatttcgatgatactcctactaaacgaccactcctgaatgataataataataatgtgtctaatcaaccatccaaacgacaaaagaaaaagatggcaaaaagccaaactcaacccctgtcaagtatagaaaaccccatcaaagtaacttga

SEQ ID NO: 1149 - DNA, 591 bp, Candida albicans
tcacaaagtcatcttaattccacaatgaagatcttatccaaagaagaaaaagacgctcacatttcacatattatttcagaaggtgccaaagggttgttttatggtggtgcactttcagtcggtttgtaccaatatttaaagcatagacatccagcaagatttgcaacattcaatccaagtatcaaagcagccataattgctatgccaacaatttctgtggctgcctttttcgctgatcaaggttctgttgaattcgatagaaagatgcatcaatcggagtatcaggaagctaaatatttggaagaataccgtgaatggaacagattatcgcttagtgacaaatgtttcactgtgttgaatgacaataaatataaaattatcataagtgcttgggctggttccttatatggttcttgggtattggttaacagagacaaaattatggataccgcacaaaaagctgttcaagcaagaatgtacgcacaaggtatcaccattatattattattgggtactcttttgttggctatgaaagaagaggagataaataaaaagaaaccaaaaccaattccagaatggaagagaattatc

SEQ ID NO: 1150 - DNA, 633 bp, Candida albicans
  unsure (9): Identity of nucleotide sequences at the above locations are unknown.
tcaattgtngaaaagtccagctattctctgttaactctacttaccatgaagcttattactgaaaatgaaaagaatgaccataaaagtcatattatgaaagaaggttccaaaggttttttgattggttcagttattggtttaggtttgattagatatttcaaattcaagcaaccacttaagtacaattcattcaattggacagtcaaagcatgtttatacaccatgcctactttagggtttactgcatttttaactgataatggtggtactcaatttttcaaatctcgttatcgttcaactcatttacaacaggaaaagcaagtcaaatctcaacaattggacaatttatcgatgctggaaaaaatcatctatcgtttaaatgaacataaatacaaattggttgttggtgcttgggctggtttccttttcggtgcttggaaaataatcaataaggatttattgttaacaaagactcaaaaattgattcatgctagagtttatgctcaagcatttactattggagttttgttgagtactttgtatttgaacatgaaggaagttgagttgaataataaattacctcaattgccacaaagctgggaaagagtattacaggataaaggtgaattatag

SEQ ID NO: 1151 - DNA, 792 bp, Candida albicans
caaaaaatttcccacgagaaagagtttagtatcttcatcaataataaccacgacaaagttcaaattgaatctaacatgtcgactgctgccccacaagaaaattctcctgaattgaagttatcgccgagttccaaacttaatggattcgaatggtggagaagaacacttctgtaccaaactgggttaggattaaatgctgaagaaaaagcacagtatgaatttgattacaataatagaaatcttgcagagaaatgccagcaatgcaatgagtatcgtaattggatgttagaatattctccatctgttttgtttatgatggatcatatcaagaaattgactaaagataaagaaccaatactaaccaaagagaacattacttgtgatgtgtgtgatttcacaaaaggtggtggatttcatcctgatgaaggaatattattatgtgccaactggataagaaataagtggcaattggaagatatcctaacacatgagctagttcatgtttatgattacttgaagtttaatctcgatatgaacaacttgagacaccatgcatgtacagaaatcagagcttctatgcttagtggtgagtgtagaatctggcaagaaatcaagaaaacaggattggggaattttgggaaaaaattccaggattgtatcaagagacgtgctgttttatctgtctctagtaatccgatttgtaaatcacctgaagaggcagaaaaagtggtcagtacagtttggaattcatgttttaatgacacaagacctttcgaaagagtctatagatag

SEQ ID NO: 1152 - DNA, 990 bp, Candida albicans
agattggagcttagatttttcactttaggctttattatagtcttctctctcattaacaaagctggtgatttatatgacaagtccattgttaccagattcctatcgggtatttctgaagtcatgaacaaacaattttaccgatatggtgttagtaaagatcaattgtacatcaaagacaattctgaaaactattcatcgtacgccactggtagagttaatgttgccactgttaatatcaactttagtttggttccaagacaaaacatttttctttggattttagaaactgctttctcttttttcacaggtaatgttgttgccccagaagataaggctgaaattattataaccccactggctcaatatgacaacttcatttccgctgttgtttccaagttagggatgaacgatgccagaaagttcaattatttcttgtcattgtgtaaaaccaccgactctccaaacttaccagaaagttttgtttacatgagtgaaactaatgaatttcaagaaaaaatcactacacctgaattgagaagcagtttgacattacaaagtgccaactatatcaagtatatcgctttgactgatcaatcagttgaaaaaccagagtcattgagagaattgatgccaaaaagaagaattgtcattagtgtcaaggccattacttcccaaaatgacttgaaacagttgagtgctgttttggatgcagtttttaatttggttgataaattggctgatggcgctattactttcaaaccagaagcccttaagaaagtagtcaagacaagagaagccgagatcgataaattgaaaaaaattcaagaagaaatcaaaaaggaagaattagctgaagaacaatccaaattaaagagacaagaacgtgacagattaagaaacatgtccagagaagaacaactcaaagcagagaaaaaagctgctgaaagaagacaaaagaaaatgcaaaagaaacaaagaattaagatgtaa

SEQ ID NO: 1153 - DNA, 921 bp, Candida albicans
aaaaagaaacaggcaaattgctccatttatacaatgaagtcactattatctattctgtcacatgttgtacatggatatgtgggaaacagggccacagttttccccttgcagtatgctgggtgggatgtcgatgccatcaacactaccaatttttctaatcatcctggatatggatcattgagtgggaccgcatcaccaccagaggccatacaagatataattttgggactaaaacagatccttgatttcaataatgtgtacgatataatccttacaggatatacacccaatgctgaagttctacagatactaaagagtgaaattgaacaagccattaccaactcccgcaacaaacctcattggatagttgatcctgtattaggagataatggtaaactatacgtcaaagaaaacttgataccggtttatcgtgacatatttgccagtggattagtggagcttaccacgcctaatcaattcgaatttgaaacattaagtggtgtgaaaattgttgattggtcaactgctaaagatgcaatttatgagtttcgtaaactctataaggttaagaatattgtgatatcctcagtatcaattgatgaccatttgtattgtgttgggtcttccaatgacagaattttttatatttctattgaacaaattggatgcagtttcaatggttgtggggatttatttactgcattacttgcagacgaattttacaatggggagtatgtgttaagtccacagatgttatcgaaagtactttacaaattacacaagatcttagagtttagctacgatgatatttttaaacgtatcggacaaattccaacagtggtgaaggatataagagttgtggcagctaaagaatttcttacatctgattataagctagacactgatgtaatatatttatag

SEQ ID NO: 1154 - DNA, 1047 bp, Candida albicans
  unsure (982),(983),(989),(998),(1001),(1009),(1010),(1012),(1022),(1026),(1032): Identity of nucleotide sequences at the above locations are unknown.
ctaagaggcgaatactttctttttgattatatctctttgaatattttgataatggatgaaattcctgaactagttacagaactccctgaaaatggtgttattaaaactgaaaaagtcccagctgccccctttgttccttcttccctgacaccaacagcattggccaaaaaaataccaattactattgttactggatacttgggttctggaaagtcgactttattgcaaaatatcgggaaaactgcaaacaagcgactagcaataattcttaatgaatttggagattcctcggttatagaaaagtcggtgacaattcaagatcaagatgatagtgttcaggaatggttggacattggcaatggctgtctttgttgcactgtgaaagataatggtgttactgcgattgaaaacttgattgaaaattctaaggataaaatagattatattttattggagaccacaggtgtagcggatcctgccccaattgccaaaatgttttggttggatgaagggttggcatcaaatatatacatagacggagttgtaacagtggttgatgccgaacatataaccaaatgtttggacgatgtgggagggcattggcataaagagagtttaggggaggacgttgagtttgaggacggaataactacggcacacttgcaacttgccttggcggatgttatattattaaacaaaattgataaagtgtctgacacccagcccatgacccaaagaatcagacagataaatcaaacctcccctatacatacaactagttttggagatattgaaatttctaagattttggatcttcatgcatttgacgttgacgcaaaattgactacttctgaaacatcatttcacgatgacaggataagtacagttaccataacttttccatttttggaaaatgaagaagggttttccaaagtggaaaactttttgcagcatgttttaagagataatttaatttatggcnnaaaganccaagttgngcngcctttcnntnagtgtactcncatngcaacnatatcccccattatg

SEQ ID NO: 1155 - DNA, 798 bp, Candida albicans
aagaaaaggtttgattggtttctggtattagactcttttattgttccaattccatttgctttactattcctcccgttctttgcccacactttattgccttaccattggtccaattttctctttatcaaaattattccaaggcgatttatcgggttttacatggttagcattttacatgttttggtttttcgattagaagtaggattgtttggattaatcatcgcaattgtgtcgtcgttgggttttggccaatctaacatttttggtaacattatttacttggccatgggtactttactaggtggatttaccagtttttgtattgactcctatttttggggcagacctttgattcctgaaatagactcctttatttttaatattgttcaaggaaaatctaccgaatggggaacagagccatgggatacatatttcaaaaagtacttgtttcaattattcaggccaccagttatattgatgttggctattccaggattaattaatgatccagccaatgatggtaccaaatttggagataagaaatctgtcccccaccctgcaaggtattcattgcgtattttgttcatctcctctattttgtttattgctgcaatgtctttccaacctcacaaagaatggagattcattgtttatactattccaattttcacattacaagctgcaaatggagtaacaaacatttgtcaaaaatgggggttaagcgttctcaacaaggtattgatttttattattggggcaaatgttattattagttctttattgtggtcgcacatggcc

SEQ ID NO: 1156 - DNA, 489 bp, Candida albicans
atttccgatttttttttttcaaaacacattaccaggttttctcttcatcatggcaataaagaactcattatgtatcgctacaacaaagttctagatgcaacactcattgcattagtctcctttcatttagttatatccccattcaccaaagtggaagagtcgttcaatatccaagcaattcatgatatcttgaaatttggtattttcccatttgagacaattgacaattatgaccacaaacaatttcctggtgtcgttccaagaacatttcttggaagtcttgttgtggctggattagcaaaaccaatattattgttaagttctgcatttgggtttgaaattgagggttacgagttgcaaaaattggtacgtgccgttttgggactcgttaatgtacttatgttgattcgcttgagagatagcataaataagataacctttagcgacaagaaaagtgaaagaaaaggtttgattggtttctggtattag

SEQ ID NO: 1157 - DNA, 639 bp, Candida albicans
caaagtatgaatttttttaattggggcaaagtaattatattttcgaaatgttggggaaacttgggaaaatttttgattttcattaccccgggcgggaaggttataaattcaacaacaattattattttggaaaactacaaaaatgaaaccgtgtctgttcacatggatgttccagcgtgtatgactggaattactagatttggagaattggatggtaaatttgctagttatgataagagcgaacaagattttgatatcactaactacgatattataattactcacaacgaagtcccaaactgggagttattacattcatcaagagtgtttgatggaatttctctcagaatgtttatacaaatctttatggctcaaagaaaagacagactgacaatctttaacattacaaaattaatattaagtgaatttgctcaaggagaatttggaacagttcatgatatgttgaggtcaaccatcacaacggtcgagtatttaaacgtttacaaaaatgtgaataaaaacccacatatggtacaaggtgtgccagaaacagagattatcgaccaagagattgatcctgaggaaattcgacaagatgtaaacgagcagatagacaagtttgaaagtgctgtattataa

SEQ ID NO: 1158 - DNA, 186 bp, Candida albicans
ggtccttccagccccgtggtgaagatcaaatgctcaaaagcttatatgcattcaagaatgagatttagagttaaagaatatttgaaaatattgaatcgtgctaaaccagaaaatcttgatgatgaaggtaaagttattgaaaatagaaaaaccgctagtggtagaagatttgatattagagcgtaa

SEQ ID NO: 1159 - DNA, 378 bp, Candida albicans
caactcatatcaattgatcttttatcccctactaccatgttacatattgaacaaaataatttattaattgagaaaactttaacggaaagattatttcctaatccatctgaaagttcattgaaatccttagatagaattgtgtctgattttgatttcactacatttcatttactgacattacccggggagaaacatttattattaatatctctttcattaagatgttggccagatttagttaaacatgatgttgtcaaatatcttaatgataaatatcaaccattcaatgaagtattgacaatattatctactaatgatgttgaacaaggttatgattattcattagttttagatacttcaactgctacaacttcttcg

SEQ ID NO: 1160 - DNA, 1281 bp, Candida albicans
  unsure (141),(203): Identity of nucleotide sequences at the above locations are unknown.
accggattttccccggaggaggatatcaaggaggaagaacccggagaagaagttgaagataccaacaaagttgagaacaacatgggaattaatctgcagccagaagtagacccagattatattcacaaacatcaaacaatnttcaacaaattcagacagtccacagaatcagaagcaattgaacaagagaaagaagaagtcgnagaagaggacgcaaatattgagcaacatagtcttgtcccattaccacaaccagcattgccaagagatcgaaaactatcatctgtgtcaactcatacaaagaacctagattggttaactaaaccgcaatatgcttcaccactggataaaaaggctttcacagattttaaattatcgtcatttatgataaaaaatttggaaaaaatgggatttactgaagcattttccgtacaaataagtgttcttaatatgatgctcccagagatcgaagcacaaaaactaaaaccagatcgtgttggtgatattcttgttaatgcatctactgggtcaggtaaaactttagcatatctgattcccataattgaaagtctataccgaagagtagttccaagagtgagggtgattatattggttccgacaaaacctttaatcaatcaagtcaaatcaacattattacaactctcgagtggaaccaatttacaaattgcagcattgaaaaatgatgtatctataaatgacgaaaaagatctgttaaccaaatctgttcctgacattatagttagtacgccaggtagacttgtggagcatttgcttaatgattctatcaatttatcaagcttgcaatatttgataattgatgaagctgatagattattgaaccaaagtttccaaaattggtcgaatgtgttattagataaaatagattcacaaatcaacattgcagaagtttggaaattatcagtgcagaaattggtgttttcggctacattaacaacagatgccgggaaattatcaagtttgaaattttataatccaaggttgataattgttaatgattccaaacaattggttaatgaaatattcactgttcccgtgacattatctgaattcaaaattcatttgggtgtggcaaagaattcattgaaaccattaattttaaccaaatttttaatatcaacaaacaagttgtctaatgtgctcatattcaccaaatctaacgaatcatcaatcagattaactgaattgttaatcagcttattttcacaaactttctatcaatttaaagattgcctttattaa

SEQ ID NO: 1161 - DNA, 2070 bp, Candida albicans
ttatattcaatgacagataagcatcttctgccttcaccggcattgaatgaagcttttgaaacagaaagtgcagtttcagatacaagtgataccccaatgacgaataattttgaaattccacaaatacagataccacaagattctcaaattaatcctatgtcaccgtctattcacattgaggaagcttttgtccccaatgacacgtcatcggctagtaattttggaatgttgtcaagtgcaaatttttcgaccgattctttaaacgacacaacagagccatttgtcgattactataataatagcaacagtaacaatggttcacctagacgatattcaaattcatcgctaaccaactcaccaagaattggtcgagcaaattcaaatagtgctacttcacgttctcgtccattatctgcatttctaatggattccagcaatgcgatttcagaagatggtcaaccaattcaaccagttttcaacaataccccaagatcaagaaattcgttgactttcggaataaaaacaccggtttcttcaacattcgcaaataattatactccacctccattggctgcaccaactggtccttatagatcttcatctccaacaaggcagtcatcaccactgagaataaacaaacattatcgatcaacatcgccagtaagaagagggtcctcaccaacaaaggccaacaataacaacaacaacagtaatccattcaattttcaatcacaagacttgatgtatcaaactaatcttaacgtcagtaatggctcaaatctaagtttgccagttaaaccggctcatcgtaaaggtcacaagtataaacattcttcgatttctatgaaacttttcgaacaagctccgccagttgatattggaatgacacagctttcagctatacctgatctgtatccaataccaaatttcaatgaaacattgaattcaattactcctaatcagaaattacgattcatgtggtcaggtttccatgtgggattatctttaattattttcactattggcttcaaattcaaattgccgtctttatcaacattggctcatttagtattttatgattcattaggttcattacttatagtgtttgttgacaccatgtctaattttgatgtttggaataaatcgtctcttgcttatccgtttggattaggaagaattgaagttttagttggatttgcattgagtacttcgctagtaatggttgggtttgacttgtttagtcatttcattgaagagtttataatattgtgggtttctcccgataatcatgacgatcatgaacatctgtcacataatgttcatgccgagcctgggaacaatggtaactcaaattggtttatttatattgtggttttaattgtcaccatggctgtgtcgttgttttcatcaaactatattttgacatatgataggatcacggaaatgataaacggtcaggatgacactgatttgaaaggtaatttcccaactaagcgcaacatcagtaatggaagtttgataaacgaggctaatacgatcgataacaacactactggtgagaaactaaagaaaatcgttagtgcttggaaaaagaatcctacccacttgatcacattgagttatacattatttttattagtgggaccattaatacctcaaagtttaacatctgatttggcaattgatattaatgaagctgctactattacggtggcacttttgttatgttataatggatggaaactagtgaaaactcttggtgggatattattatgttcattcccttattcagattacgattatcatgtgctcaaatcaagaattattgatcaaatattatctaaagattttttcaaacaaacctatagaatagaaaaatttttcattacaaaattcaattatcgactttttgttattgggatgaaaattaatatgaaaggagctaattctgatgaagaagtaagaatgagatttgaaataaatcgaataatttgtaatgaacttgaaaaattggataattctagtaaattagtgaaaccagagattactattgatatagaccgtttttaa

SEQ ID NO: 1162 - DNA, 537 bp, Candida albicans
tgtgtttcttcattttttttttccaacatcaaactatcagaaagaagtctcatctcattacaaagagagagaaaaaaatatcatatcaatacgatccagacttttcgatcatcttcttataatcttgtcaaaccaaaaagaaaaatgaaattcctaactactaattttgtcaaatgtgccgtgaaaagttgtcaatcatcattagattctttcccattaaaatatgaagaatgtcaattagttcaagaagaacaagattataatccagaatttattgttcatatgttagatagattagattggaatgctataatacaagttgccaaagatttaggaaatgaatcattaccaccaactaagccagaagatttagatccaattatggaagataatcaagctatattaaaagatttacatactttattggtagaaacacaaatcattgaagggaaaatgatttgtaaaaattgtcaacatatttattacattaaaaattctatacctaatttccttttaccacctcatttagccaattag

SEQ ID NO: 1163 - DNA, 1899 bp, Candida albicans
tttgttttcccccattcccacgtttcaatgactactgctactactaagactacaactataactactaatgctaatgttaatgctaatcagccacaaccagctgataaatcaagtgccacaccaagcacaacaccaagtgcaacaggaacccccaaaccttctgccactcaagttcaattatcccaagatcgtgcatccaatattgggtggttctttattaaatcttattatgatttcttcatttccaaattagatgaaatccataagatctaccatccacatgcctcgatcaatcatgatgcattccctggaaccaaaaatgataaatctgactctggtgcctcaaatgataatgtcaaagatgtcctccctattgcttataaggcaaaaggtaccgatgccattaaggaaactttttctaaacatttatcattgaggaaaaacaatcgaattgtcattactagtgcatgttttgaagtttctttagaaaaaaatattattattgttgtctttggagaatggagttctaatgatgaaccttataaacaattcactcaaacatttgtcttggtgccaggtaaaactgacaatacttatgatgttgctaatgatattttgaaatttgttagtgttaatggttataaggaaaagcacgagcaaaaaagggaacaagaagttaaagcctcttctcaaactgccgttaatggcaatggcagcagcaccaccacgaacaacaacaacaacaacaacaacagtaatacctctgttactaagaaaccaactgttacaacaactggatctgagcctgtcactaaagttacaactgaatctactccaaaaactagtggattgaaacctgaatcatcaaagaaagatgttgccactaatggagaagttaagaaagaagattttgaaaaaactcaaccaattaaatcagatgttaaagttgaaaaccaagaggaaaaacaagagaaaatatcaaacactgacaaagaattgacaaaagacgattcagttaataagcaactgaatgaatccagtgttactactactacttctaccactcaaaattcaaaaccagttgttactaaaaatgaagaatccaaagaagaaaaagctccatctaccaaagaagaaacaaaacaacctacagttaaaaaacctcaaccagaacctacgaagcctaatgcagcagcagcagcaccacaacaacaacaacaacaaccattgacatgggcagcattagctcaacaagctgttcctattaaacaaactaccaaatcaactggatcttcatcggctgttgctaaaccagtatctgctggtagtagtagtggagccaccccaactgtcaaaaagctggttacctcctttagttcaatcaacaattctactacatcacctggtcaacatggatctaatggtggtggtggtggtggtaaatttagaaaagaagattggtatccaatatatattagaggtatacgtctgttggatgaaaaagaattaaaagatcatttgagtaaaaaatttggtgaattgaaattttttaaagtcaatcaaaatattgcattagttgattttgttcatcaagaagctcaacgtaaagcattagatgcaaaggaaacaactttggatggtgtcacatttgcattagaaccaagagaatctaaaaccggtaataatttccataataattccggtaacaataacaatagtaacaatggtggttatagaaagtttagtggcagtggcagtggcagtggtggtggtggtggccaatctaaagaaggtagtggcagtggtggtagtgccaaaaataaagacaaatttgataataaaaagattaatgggagtggtaataagaagaatctcaataaagccccttctttcaaataa

SEQ ID NO: 1164 - DNA, 1032 bp, Candida albicans
aaggagaaacagagaaaaaaaattcctacacgatctcatctctcttcacattttcaatactctttttctttctttttcctttttattgttatacttaaacatatacacttaagatacatatctaattatactcacatcatgggaactcaaaagaaagaaaagcaaagaagggtaagggagaatgataccagagacggtaatcttcgagttaaaggagaaaacttttaccgtgatgctaaaaaagtgaaacatttgaatatgtataaacaaggaagagctattcgtaataagaagggagaaataataaaagctgctgatttacaaagtacagatataccaaatgcaagagttgatccaaatagaaaatggttcggtaacacaagagtgattgctcaagatgctttaacccatttcagagaagttatgggtgaaaaatccaaagattcatatcaagtattattgaaaagaaataaattaccaatgtcattattggatgaaaaagatacaactgaatcaccaactgctaaaattgttgaaaccgaatcgtattcctcgacatttggtcctaaacaacaacgtaagaaacctagagtcgctgcttctagtttggaagatttaatgaatgctgctgaagctgattcaacccaattccaagaaaagcaagaattggattcaactcttggattaatgggtggttctatcttggataaagatgatttcacacaagaagctaaagaggctattttccataaaggtcaatccaaacgtatttggaatgagttgtataaagttattgactcttctgatgtggttatacatgtgttggatgccagagatccaattggtaccagatgtgaatctgttgagaaatacataaaggatgaatgtcctcataaacatttaatttatgttttaaacaaatgtgatttagttccaacttgggtagcggtatgttttgaaaacgtgaatttttggacaaatgtttttccttttttttttttactactaacttttgcaattccagggaattga

SEQ ID NO: 1165 - DNA, 396 bp, Candida albicans
actaagcgcggattgtcactccgggtcaagagagagaactatgaaatcaaaggttggagtaaatttgaggcagatgaaagtctattggaaagagctagtacagaatttatagaattaattgctaggaaacaaggtagattgttgaaaggtggtgaaccagatgaaagtggtgtttctaaacaaatattaaatgatttcaaccgtggtaaaatcccttggttcgtacctccaccaaaggatgaggaaaaagatgaagacaaaactggtgaagataagaaaattggctacaagagaaagagacaagaaagagaagctgctgagaaagagctacaagagaaagaagaaaatcaagatgaagatgataaagaagttaagaaagctaaattagaagagtaa

SEQ ID NO: 1166 - DNA, 222 bp, Candida albicans
tctcaacaacagaaactcaacaaatcgtttgtcagtaacgtggaaaaatcaaaaatgatagctaatatccagaagaaaagaaagactacagatgatgacaatattagaagggattttaaacaaagaaaagttacaacgaccagaagtgacgctaaggatgatttaaaatcaaagtccaaaccaacggacaaattaaatgatattttatcaaaagtattttaa

SEQ ID NO: 1167 - DNA, 915 bp, Candida albicans
ctgtgcgatgtctctactaagaagtttgagaagagtgagtattttttttttgtcaggtcatcatcatttcttctgaataaaactaacacaacaattagcaaccagaagatagaaaatatgagtgcaacatcagatagggaaagtgattttgaatctgaggatgaaagcaactttcaggacaaagtcttcaacgtaaagtcgaaaaccagttctttttttcacgcaaatacgcctgataacgaagattttctggaagacgaagaggataaagatgagcaagatgaaggtgatacaaagacaaaaccaaaagatggaaagcataattttgaagatatagcatatgatgaagagagtgaggaaaacattggtgacgatgaagatggaaatgcagacctcagtctagatggtggaagcaaagtcaataaaaagttgaagaagttgactagtaaagagttggcaaaagagcagaaaagaataaagcgtactggggtttgctatttatctagggttccaccgtatatgaagccagcaaagttgcgttccgttttgtcgagatttggcgaaattgacagattgtttttgaagcccgaagatccatcagtttatcacaagagagtgaagtatggtgggaacaagaagaagaattttacagaaggttggatcgagtttgtaaataagtcggatgcccagctttgtgatgcgacgttgaatggaaacaagttaggtggtaaaaagacatcatactactacgatgacataattaacataaaatatttgccaggtttcaaatgggtagatttgacccaacatatagccaaagaaaatgaagtaagacaagcaaaacttgcgatggagatatatcaacaacatccactctacgatctttatattgccctcgaagtgcacttccggtag

SEQ ID NO: 1168 - DNA, 1065 bp, Candida albicans
gtctcctactactactactactaccaccaaaccaaacaaaatgaagaaaagtctattgctgatacaaagtctttcactcacaaagccctccccagctccaatggtgctgtgactttgaagacaactagtgtgaaaactgcactaactaccacttcaacagtatttagtgctacatctttaccgtcaacgacttatacaccctccacttccgtttccttagtctctacaacaaagaaaaatccagtgagctcacagtcagttgttagcacaactaaaactatttccattaacacatcattaatcacagatgcagttacaattacaaaggaagcaacaactttgccaaattctaaacactcttccacttttaccaatgggtctatttcctttatatcgactagtgctaataaggttaaaagcactgtcacatccgatatatcaaataattcacagaatagatctagcttgagtcttacttcaactatagatcaattagcttccattacaaactcaactcttacaacaattaccaagcctacttcgttggtgccagatttcagctacacaaactcatcgcgggtgtcaagtactatgagaaattcttcagaagaatcctctatggtacttgaaaaatcgagttccaaattgttatctagcacttcatttttaaattcctcatcaatcgcatctactacagagtcttctgaattagtatctgcaacaacatctgatagctcacttagccacagttcttccagttctgttgaacttagctccagtttaagctcggaagccgactccagttcaagttcagaaagtgttgaaacagggtctagtgacgaaactgctagcaattactcaggtgacttgttcaaagcaatagataccaacgctccaccaacagttttcgcaagaagtgaaattcctttaacaattcctgctggtgtcgacaacaacggtaaaccaattggaaccaacaaattctataccaatttattacttggtaatcaagaattcatggtgtatccattgccaatccgactttatgggagtaaaacaaattaa

SEQ ID NO: 1169 - DNA, 426 bp, Candida albicans
caattcctgctggtgtcgacaacaacggtaaaccaattggaaccaacaaattctataccaatttattacttggtaatcaagaattcatggtgtatccattgccaatccgactttatgggagtaaaacaaattaattatggaattgctgttcaacataataatgtatccgacagagtttttggatcaataaacactaataataacggagttgcttcttattactttaacccaactaacaatgctgaattgatattttctgctacatcgttttctaaagattcaatgcatatgaaaatgttccaaatggctgaattgtctgccttggttacattgtcaagttcttccaatgaagaattcaaatattgggatatccctttatttcaaagtatggggttttgttaccgggtattaaaacggggaacttga

SEQ ID NO: 1170 - DNA, 2985 bp, Candida albicans
gaagacagaaaatctattgctgatacaaagtctttcactcacaaagccctccccagctccaatggtgctgtgactttaaagacaactagtgtgaaaactgcactaactaccacctcaacagtatttagtgctacatctttaccgtcaacgacttatacaccctccacttccgtttccttagtctccacaacaaagaaaaatccagtgagctcacagtcagttgttagcacaactaaaactatttccattaacacatcattaatcacagatgcagttacaattacaaaggaagcaacaactttgccaaattctaaacactcttccatttttaccaatgggtctatttcctttatatcgactagtgctaataaggttaaaagcactgtcacatccgatatatcaaataattcacagaatggatctagcttgagtcttacttcaactataaatcaattagcttccattacgaactcaactcttacaacaattaccaagcctacttcgttggtgccagatttcagctacacaaactcatcgcgggtgtcaagtactatgagaaattcttcagaagaatcctctatggtgcttgaaaaatcgagttccaaattgttatctagcacttcatttttaaattcctcatcaatcgcatctactacagagtcttctgaattagcatctgcaacaacatctgatagctcacttaaccacagttcttccagttctgttgaacttagctccagtttaagctcggaagccgactccagttcaagttcagaaagtgttgaaacagggtctagtgacgaaactgctagcaattactcaggtgacttgttcaaagcaatagataccaacgctccaccaacagttttcgcaagaagtgaaattcctttaacaattcctgctggtgtcgacaacaacggtaaaccaattggaaccaacaaattctataccaatttattacttggcaatcaagatttcatggtgtatccattgccatacggactttattggagtaaaacaagttattatggatttgctgttcaacataataatgtatccgacagagtttttggatcaataaacactaataataagggagttgcttcttattactttaacccaactaacaatgctgaattgatattttctgctacatcgttttctaaagattcaatgcatatgaaagtgtctcaaatggctgaattgtctgccttggttacattgtcaagttcttccaatgatgagtctaattatttggatattcctttagttcaaggtatgggttttgttaccggtatttataacgggaatttgactcccttgttgaattcgttgttcggagttaaagatttatctcttgagacttctgatgctttattatccaatgttttgaaatatcgtgctacattattgaacaatgttcaatggttgatttacgttacattaccagataaagatactgactttaaattagaggtcgaagatttctacaacttaaagggatccaaaccagttgatggattaattattcaagtcgcaattgctcctgaagataatgataatgataagtactatgatgccgctgctggtatgtacgttaccggtgccactgttctgggaagtgtatcccagggcacagctgctagttataagttcagctacaccactgccggtaaatcttcatccaataacccaattgtctttgctttaccacatcatatggattcattaaccggttctgctcttgatgcattgactggtattacagttacatctactactaaaggtgaaatgaccgggtttttaacaaatgaattggaatttagtgaaacaattaatcaagacgtggaattcttgccatggacagaaaatatgacaggtagtttgacctacactaaggatcaattagaattattagctagtgctgctaacaaagaattggcagcaaatattgctgcaacagtgaagaatatgaactctaattatttttcaggaaaagttcttgacaagtatgctcaaatattattggtggttagtgaaatcatacaggatgaagaagttaccaaagatgccttaaacgcaatgaaggatgcctttaaagttttcacgcagaacaaacaatactatccattgatgtatgatactaaatttggtggagtaacgtcaacatctgctcaagacggcgatccaaacgctgattttggctctgcatattataacgaccacgatttccattatggttactttattcacgctgcagccatagttggttacgtcgataagaaattaggtggtacttgggctcaaagtaataaagactgggtgaactctttagtgagagatgcttcgaatccttctgccgatgatacttatttccctgtttcaagaatgtttgactggttctctggccattcatgggcaactggtttgttcgtcacttacaagaacattgaatcaagttccgaatcattacattttgctgctgctataaaattatggggtaaagtagtcggtgatcaatcgatggaagcaagaggtggtttgatgatttccattatggcgcgttcttttaacatgtatttctactataaatcagataatactgtggaaccaaaacaaattttaccaaacaaagtcagtggtatatttttcgagaataaagttgattacactacattctttggaacaccagctgatcatccagaatatgtccatggtatccatatgcttccaattacaccttcctcatcgttggttagaaagacttcttacgttcaagaagaatggaaagatcaaattgctggttttattgataatgttgatagtggctggactggtattttgagattaaaccaagctttatttgatcctaaatcatcatatgaattttttgcatcaaataactgggatgacaagtggttagataatggtcaaagtagaacttggagtttggcttttgctgctggtgctctcaatgctagttag

SEQ ID NO: 1171 - DNA, 282 bp, Candida albicans
  unsure (200): Identity of nucleotide sequences at the above locations are unknown.
acaactacttcttcaatgtcagtcatattagcttctgcagggtatgaccataccatacgattttgggatgccttgactggagtgtgttcaagaaccattcaacatccagaatcacaagtgaaccgattagaaataacatcagataaacgatttttggcagcagcagggaatctatacgttaaattatatgatataagacnaacggggaaattcgggaaatggggcaaacggtacaacaaatacttcagcttcaacaagttcatcaaatcaaaacaattctaa

SEQ ID NO: 1172 - DNA, 498 bp, Candida albicans
agaaaattccaagctgataataaatggatggttacttcactggaagatggaacagtgaaagtatgggatgtgcggtcaccatcagtgcaaagaaattataaacatcaatgtcctgttaatgaagttgtcatccatccaaatcaaggtgaattaattagttgtgatcaagatggtaatattcgagtgtgggatttaggagaaaacctgtgcactcatcatttaattcccgaagatgatgtacccataaactcattatcagtggccagtgatggatcgatgttagttgcaggaaacaataaagggaattgttatgtctggaaaatgcaaaatcaaagagatgcaactgttttaacaccagtaacgaaatttagatcgcacctgaaatatataacgagagtattattactgacagatatgaaacatttggcaacttgttctgctgatcatacagccaggatttggtcaacagaacagaatttcaattttgaaattacttaa

SEQ ID NO: 1173 - DNA, 585 bp, Candida albicans
acaatgtcaacttcattaccaccagcaattgtgttttccgactgggacggaactatcactttacaagattctaacgattaccttactgataacattggtatgggatatgataaccgtatgatcatcaacgataaaattttggaagggaaacaatcctttagagatggattcaaagaaatgctagcatcaattaataaaccattcaatgaatgtattgaaatcttattacaaaatgtacaattggatcctggttttaaagatttttaccagtattgtcaatcaaagaatatccccattattgtcattagttctggtatgaaaccaattatctatgccttgttagaaaaattgattggtcaagaagcaatcaaaactatcgacattattagtaatgatgttcgtgttgatggtgataattgggaaattttattcaaagatcctgaatcaggttttggtcatgacaaggcaaaatcaattaaagaatatttgactagtcatggatatgaaagtgatgcagacacaccaagacccactttattttctaatggtgatgtggtcttcaccaggcggctggaaggaaccacg

SEQ ID NO: 1174 - DNA, 819 bp, Candida albicans
atggcgcgaataatgggtgcttcttgccggctgcgtgaagaaccaccgccaatccaggaccccagaccacctactccatcagaggtaacccacaaaagtgattactttgatcacgcacatatgcctgctatggaaaaactacatttgaatgtcccaataaatgaagtagaattaagcaagagatcaagcataggttcttttgtttcttctggttcagatagtgatgaagaggaagcagggaatgtaccacagtacacccaccctgaattgaaaaaatcacagctacatttttcaaaactggacaatatcgaaccgttgctatctccaatcaaaaggatattctacgtatcaccctatggtgaagaaatatgtccaactgcccacggaaaagtagcatctacaattgccaatacagatgcattaatctattcaattggttctttaatgaccagcattgttccaattataattttaaaaggtattggtaaggctattctacaaaatgaatgtaaacgcaagattttgcttttaaatgggtgtcttgatagagaaacttttggcatgactgcatcagattttataagagttattgttctgctggctgagtattcaataaacagtcatgctaatggacttgctgctaaatatgaatggaatagattcatcacacatttggtatacatggaggattccagcattgacgtcgatgttgattatcttacttcaaagggtgtcacttgtgttaaggttgcaaaagttgaaggcacaaactattttgatttgaaaagtttagaaaatgtattagatgaaattatataa

SEQ ID NO: 1175 - DNA, 1410 bp, Candida albicans
  unsure (21),(41): Identity of nucleotide sequences at the above locations are unknown.
cggcggggcataaaagtgaanatgtttatgcatccgataangataatacaaccagtaatttccgaatttgacccagatttaattattgttagttctggatttgatgctgctgatggagatgtgattggtgcctgtcatgtaacaccagccggatatggatatatgacccatacgttaaaggggatcgccagaggaaaattggctgttattttagagggtggctataatttagactctattagcaagagtgcgttggcagtagccaaagtattggtcggcgaaccaccggaaaatacaatcactttacgcccgcaagcggaggctatcgaagttgttgacgaagtgatcaagatacaatccaaatactttaaatctttgagaaacggaattccaaatggtatatttgaagatgtttatgatttagcggatgtagaaaaatcaaactacaaattggtaaatattgctgatccaatcagaagtcatcaagtggaaaagttattcaacgaaaaagaatttatcaatattccaatcatcagttctccatctaatggtgaaaaacccccattcacaacggatttaccggaccaactagaagatttgattgttgcaagtcccgatatttataattgtaccacgataatactaacaatacacgacccaccagaaatatgggccaatataaatccaacaaatggagtcattgaaaccaattctaccatggttttggaacatcctttagtacaaataatggacaaaatacaaaaggaaaaggatccagagaatcaagaaaaatttgggtatttagatatcaatatcccatcattccaacttccgatcccagggacaacatctgaatcgtctacttataatccaattatttttgctcaagaagttttgctttatatttgggataactacatagcgtatttccaacaattgaagaaccttgttatggttggttttggcgacagttatcaatcaattgtgaatttgtatggcaagagaccatcaaacgaaataaaagatttgatcaaggggacagtggcgtttctaaaccgaacgacattgaaaccattgatcccagtgatggatgaatcaatggtggattggtattatcaaaattcaattattttcacaagtaactttaacacatgctggactggcggcagtggtgctggtaatggcaatggaaatggaaatggtaataatggaaatagttcgaacggtggaggtaacaagtcagcagactcaaatggacatgatgattttagcaaacgtccaagaaaaaaatttggcagagtaatcaaagcaaaaacagatggattatgtgatgtcatacaagaaaaattcgatgaaggagtagatttcatattagattcaattgaagactactcctcttctgaagattga

SEQ ID NO: 1176 - DNA, 1158 bp, Candida albicans
gcggacgcggatctcttcccgtggcgaagactttataagaatgtcgactggtcaagaagaaatctagattctaagctagaaaatcaaatctcagaggaagagaatcaaagtcaaaatcaaaattttccaactgcaattgaagattctatacaagccagtattgaaaaattggatgaagtagatgacgaaatcaatcctattgaagtaaaagatgagtttcctactactattggtactacttatgatatcttacatccacgagaaccatctcccaagagaataaaattagaggaaaccgaatctgagccagattctaatggtattgccgacaatgatcaaactatggttgtagttccacccaaaaaaccacaattattttataccccattgaaaacaggattagtttatgatgtgagaatgagatatcatgctaaagtattcacatcctatagtgaatacattgacccacatccagaagatcctcgtcgaatatacagaatttataaaaaattggttgaagctggtatagttctcgatccttctttagcaggaattaatgaaattggaccgtttatgttaaaaattcctattcgagaagcaacatccgaagaaattttacaagttcattctgaagatcatttaaaatttattcaatctactgaagatatgtcaagagatcaattgctcaaggaaacagagaccggagattctatttacgttaacaatgactcctatttgtcagcgaaattatcctgtggtggtactattgaagcatgtaaagcagttattgaggggagagtgaaaaattctttagcaatagtgagaccaccaggtcatcatgctgagcccaatacaccagcaggattttgtttatttagtaatgtcgcagtggcagcaaaaaatatgttgaaaaattatcctgaatcagttcgaagaattgttattgtggattgggatatccatcatggaaacggaacccaaaaagcattttataatgatccaagagttttatatatttctttgcatagatttgagaatggaaaattttatccagggacaaaatatggtgatttaaatcaagttggggagggcccaggggaagggttcaccatcaatattccttgttttcaacacgccgatgggcatcatagtgggaag

SEQ ID NO: 1177 - DNA, 1065 bp, Candida albicans
cattcctttttttttggtggtagggttcatttgaaggtgatgatcatcaaagaccgaactgaaaaaaaaaacacatacaaaaaaaaatatccaatcatattctttggcctcatctcatctcatttcctctatatcacatatacaccaatgaagttatattttgaagcagaaaagtttttgaaaccaaacaaaggaactaacgggagtctacaatctcgtatattcaacgataaaagattaaccaattccccaaaacacatatttgccttggtctattctacattaaagtacaaagaatacatcgatgtgattgtgaaaaaatcaaaaatccaacatgatcttcaaattaaaaaagtgaagatgagcaatgaattattatgcttattggttcatgatttattgttttcttcaaaagggagaatccagagtgggaaacatcctatgaaagacgcatttttgctgaacaagacaagattacaagcagaattcaccaaattgaaattgaaatataaagtgaagtcagttgaccaattaccaacgaaggaagctgacgatgatgaaactccaatacggtggtttagaattaataccattaaaattgacatagatagattttacaccaagcatccattcttcaagcaactacaaccagtgagctcaattgacgaaatcacagaaacagggataatttattctgatgattatattcctaatttatttggggttcatccaagagagaaaatcacatcgactgaagcttatagattaggggaaataattatccaggatcgtgcatcttgtttcccaagtcacatacttaatgcagatcctgaagatgttcatacccaagttatagatgcgtgcgcagcacctggaaacaaaacgacccatgcagcagcacatctaccaaactcagattcagtcgtgtatgcatttgaaagagattcaaaaagagtgaagatattgaagaccatgtgtgagaaagccacaggtaaaacgaaaaagaaacttatccaagtgactcacgctgatttcacaaccacaaaacccgaagattttccctga

SEQ ID NO: 1178 - DNA, 213 bp, Candida albicans
  unsure (201): Identity of nucleotide sequences at the above locations are unknown.
ctcacgctgatttcacaaccacaaaacccgaagattttccctgatgttactggattagttattgatccatcgtgtagtggatcaggtatttttggaagggcattagaagattcacataatgaagaagaaattgaaaatgttaacacagagaggcttaacaacttagctggatttctatttgcagcgaaccaccacgggatngatgtcggtgta

SEQ ID NO: 1179 - DNA, 846 bp, Candida albicans
aaaactgttatggaatctgatgttgaactgcatgatcggggactgaagttggaagaaagcaccagctccaatgataagtctgaaactaacgtaaatgaatttgaaaaaccacgacattaccaccaccaccaagaagttgcagataaagttgtatactctgatgagctcgatgattatcatgaagatgaagtcgatgatgatgaagttgactatgacgatgacgacgaccttaaagtggtggttgatgaatcacttggaaccacaattcttagagaaattcaagatggtacatacgtttgtcttgtatgcactggtgaaataaacaaagattcccaaatttggacatgtcatcaatgtttccgggtttatgatctcgactgtattcaagattgggctgttagaggttcctcgactaataaaacaagcaaggaatggagatgtcctagttgtaatcatgccactaaggttatccccaaagttttcacttgctggtgtggcaagctgatcaatccagaacacaatgtattgatgccttttagttgtggcagtatgtgcaactacaaatacgcaagctgcgtgcacagttgtacatacatatgccaccccggtcagcaccctatttgtggtgcaacggggccgatgatgaaatgccattgtggcaaggaatcacggcaactaccttgcttaatcacgccatatgatgagggttggaggtgtgcacaggattgtgacactatattgtgtgacttgggccacaaatgtctcaagggctgtcattcaggattttgccaggtatgttccactatgatccaggtcagttgctactgtggggacgagcaaaaataa

SEQ ID NO: 1180 - DNA, 1725 bp, Candida albicans
atccagtgtcacgaaaaggtattgatgaattgtggtggtggtagagttggtggctactcttgtggtaagactaaacgtttttattatgattgtcagaagcactttgagataaaatcatgtcaaccacctcctacctccttgatgaaatgtaaatattctccagaaattatcactacatgttactgtggcaaaacaaaagctgatttacataatcgtacaaaatgtactgatccagtccctgagtgcagtaatatttgtgacaaattgttggcatgcggtcatcgctgcaaattcaaatgccatgaaggagactgcgattgtatctcagtgagtgaaataaaatgttcttgtggacatgaatcttatttagctccatgcaagtttattcaatctggtattaagccgaaatgtaatcataaatgttcggttttattgaattgcagaaagcattatcatcgtttggaatgttgtcctgatgaacaaattggtcttgctagagaacgtgaccgcaaaaaagctatcagaaataatattagatccaattttagacaagatgtgatgtcaattgaagcttctcatatctgtactagaacatgtaatagattgaaatcttgtggtaaacacatgtgtcaagctttatgtcataatggtccttgtgaagtttgtttagaatcaactaatgaagatttagtttgtccttgtgggaaaacggttattccagcaccaattagatgtggtaccaagttggtatgtcatgaacagtgtatccgtgttcctctctgtggtcatcgtcctgagcctcatgaatgtcacgatgattctattaattgtcctaaatgtactgctttagtggttcgagaatgcgattgtggtgcaactctggatattcctggaattttatgttttcaagaaagagtttcatgtgggaaaatgtgtaaagttgccaaagactgtggacatccttgtttcagaacttgttcatctcaatgtacaaaagagaatattcacaacagctcccgtgattgtcaatcgtattgcaaaaaaatcagaaatagctgtcctcatttatgtaaattgaaatgtcattttaataaagttggcaaaagctcaaattgtgatgttgttacttgtacttcagaagtaactgttcgttgtgaatgtggacgtttggagaaaaaaatcaaatgtggtgcaagtgttggcgagccttcgagtattggaactgttttggaatgtgattctgtttgtgttgctgcgaaaagagatgctgcattgcgtgctgcattcatggggactcctgaaccggaaaccactgccactgaaggatctttgtataatgcattaatcatccaagatttgtttttcgggttagtgaaagatgatttagatcgagaattgaaacctttatatcaagaccagttggagaattatgaaattcaatggttgaaaggttcatcatttatattttattctccggaaaagtctaagaacatggatgttgaagaagaaaataaattgtatttgttgttaaagagtttcagaagagttttgagagagaaatcattggcgtttgattgtaaattgtgtcttattgatgatagtgcctcatttgtattgaaaattgataataatagtactccacaatctcaatcaaacttgattcaagatgtttccaaaaccaaaaagagtcaaaatggatttgatgttttacaaactgatgattaa

SEQ ID NO: 1181 - DNA, 708 bp, Candida albicans
ggacgcggattttctagcccgtgggggaagagatctcaatttaaatcatcaatttcttataatttgaattatgatacaagagataataaacatttaccaactaaaggaaaattttttcaaattggtttagaatataatgatccatcaattttattcttcaaattgaaaaatcaatatccatttatcaaaaccgtgactcaatctcaatttattcatcgatttccatttattaattcaaatttaatcatcaccaataaatttggattattatatcctttgacaaaagacaagaattcatcattgttagatagattttatattggaggaccaaatgatgtacgatcatttttacttaatggattaggtccaaaagattataattcatgtattggtggtgatttatttttaaatggtgggatatcattaattactgatataccaaaatataatgaatcaaattttaaaattcataattttattaattttggaagattagtagggtttaataaagatattagtctatttaataatttacaaaatttgaatttaactttaactagtcaatattcaataagttatggatttggtatattatttaatcatcctatggctagatttgaattgaattttgtgttgccattggttactcatgaaagagattcacttcgtaaaggtatacaatatggtattggtgtatcatttttgtaa

SEQ ID NO: 1182 - DNA, 1134 bp, Candida albicans
gaatataacattacactaaagaagatatataaaaagaataaacaaaatcaaattagagatcgagacaattcaagtgtggaaagttttagcttattatcgaatactcaacttcttccattgactagcttttttttactttatactattttcaacaacgatctttccgatcctttgacagttttttttttggttcccttttatcaacattttgggacttggcatagcattagtgaaacttattttcaactcctcacactctccccccttcctccgccttcacaactaagaatgtccgattatatggatgatccatttcaaatggatgaagaaataccttctaagaaagatcctataccgtccaaggagagatctttaccaattcccgaaaatgccacaatagaccgggacataactccgctgtatccaacaccaccaaatattcactacgacaacaataaaataatacgatcgaaattggatcaactaaagctagaagaaaacactggtggaaccaatactactacggaagaagaaggagagaaatatgaagaagatattgatgataaattggatatgtcattacaagcaaaattaagattagaatatgagaattgtttagattatgataaaccattaactccacctgagaattttgcacccgtgataaataaaatctatagatcttcattcccacaaccaaataattttgcctttttaaagaaattgaaattgaaatctatattatgtcttatcccagaagattatcctcatttacaacaagaatttattaaaaatgagaacattaaattatttcaacttggaatgtcgggtaataaagaaccatttgtgaaaatatcggccgatttgatcactgaagccgtgaaaatagtactaaatccagaaaatcaaccaattttgattcattgtaatcgtggcaaacatagaactggttgtcttgttggagtgattagaaaattacaaaattggtcattgacacttatatttgatgaatatagaaaatttgcatgtcccaaagaacgtcccatggatcaacaatttattgaattatatgatgatacagaaattttagagtattgttatgagtatgatttgttgccattgaaatgggattaa

SEQ ID NO: 1183 - DNA, 1092 bp, Candida albicans
tactataagattattcaattatcagagaaagaatttattgcatcaaccagtaatggctctttgattggatattcaatttcaaacttgtcctctacccctactatcaagatcgagaaagcacatgagtctagtattaacgatatcgtgaagatcgataatgactcaattgcatcatgttcaagtgatggtattaaaatatggaacttaagaagcaaatcggcaattgtcaccttgacaaatgcaaaaaagtccaatttcttgtcactagcatacaagaataatttattggcagcaggtactgaattagtaggtgtcgacgccgagttgcatatatgggatattagaaacacagataatgttgttcggtcttttgttgattcacaccatgatgatatcactgcattggaattccaccctacattgacaaattatttgatgtcaggctcaaccgacgggtacgttaatatctacaacttgattgagaccgaggaagatgaagccttgcatcaagtcataaactttgcctcggtgcactcatgccattttatcacagaatctagaatttcgatcttgacacacatggagactcttatgatacatgatttaaatgacaccaattacgaggaattggttgaaccgaaattcaaggattttggtgatcttagaaaagaatggccactgaacgagtacgtgatagatatctcacctaccggatttgctgcctatggatctaattctgaaagctctttatcattattgccattcgatcctgaaagtgagagctttgacctttcaaaattgatttcatttcccaaagcacacggagaggaagttgtacgagatttcgttttgataccgaactcgaaaatggcattaagctgtggggaggatggaagaatcaagttatgggaactacctttccaattaaagtcatttgtattgggctcggaagaaaaagaaactgatatcaccatgacagaaggtgacgtccaactggagaagaaatctaaaaaggacaaaaaagataaaaagaaggacaaaaagaaagataaaaagaaacataagaaagacgttagatttaaaccatattaa

SEQ ID NO: 1184 - DNA, 1206 bp, Candida albicans
aagatacaattttattccccgaaggtggtggtcaaccactatgctaagggaaccatcacattattacccgataacacaaaaatcattgaagttaaatcagttttaagagataaattaaaagccattcatttagtcgatgaattaattgaaccggggactcaagtgagattaaatgttgattggggaagaagattagatattatgcaacaacatactggtcaacatttattatcagcagtatttgatacttataaattagaaactttaagttggtcaatgggtgaaacaaaagatgatattaattatattgaattacctcgaaaaattgataatgatttagttgttgaagttcaaaataaagttaatcaattgattgttgattcgattcctattacagttgttacatctgatcaacatggacatggacatggacaagagcatgaacatgaacatgaacatgctgatgttgatatttctcatatccctgatgattatgatttatcacaaggtgggataattagaattgttaaaattggtgaattagatgctaatccatgttgtggaactcatttaacatcaacagcacaaattcaatcaattgcattattacatcaatctccaattagaggaggtcattctcgattacatttcatttgtggtggtcgagtagctaatcatttacgtaaagaacatgaaattttgaaaaatgtatctacaaatcaattatcttgttcaattgatgctgttgaagaaaaaattgaattattaagtttaaattataaaaaaaccaattctacattaaataatttattaaaagaattagcatcaattgaagctaataaaattttccaaaattttaaaacccatgataataacaacagtaaattagcttatgtatatcgtgctgatcttccagaatatttaacttgggttcaaaaagaattaacaactttgattaatcaagataaaactggtgatgttgatttatcaaataaacaaacccttgttttattaagtggcgctgctcctaatggtggaaccattaaaatattgggtccaaaagcagaagaattacaaaaagaattaaaatcaaaattatcaaatttaaaaggtggtggtaaaggatcatcatttcaaggtaaaattactaaatttgaaaaaggtgaattagaagcagtattgaaatatttagactccatgctataa

SEQ ID NO: 1185 - DNA, 2358 bp, Candida albicans
cttgcctttctttttataacaacagctacatcaagaatggattttatagactttgatacatttaccaaagatgcatctggttctgataacgatgtttttcctcaaccacaacctccattatcgttaccgatagcttcgaatttagaccaattcagcaagaaattgtcaaatcttgtattacctggaaacattttaaataacgataacactaaaccgtcaaacgaaatatctgaggtagataatgtaatggaaaagtatgctaaaatgtcaattgatttaattaaacgagaaactggagacgttcaactagaaaatgaggaggattctaaagagtccagtgttcgtacttcattgtcaacaagattgtctcgagtgcttaatgattcgttaagtgatgccactattcgtgaaatttttagcaatttgcaagaaagatttgacaaggaatctaacggatatgttgtcgatttaatagaactgggaattgttggatcaatgtcaagaaaaaaatttaaaggcagaatcgagagtgaacttattcgaaatcaactgaatatacttaaacaatatcagcctattgtcaaacagttgaaacaaattgaggtcaaactcaacaaattaaatgaacttagtgtgcaaacaaatgacaaaatcaataagaattttgatttttccaataaattaaatcttgaaattaaagacttgaacgataataaaagattaatcggattgaaaaaaaattcgttaataagcttcaaagaaaaatttacgttaaatgaatatgaagagtttgtattaaattcaggtgacttgaataatgagtttttcactactttggctcgtgctgaacgtataaatgaaaattgttcaatattattgtctttagacaatcctcaattgggattgaaaataattgccaaaagtaatcaaatgattaacagatctattgacagaattgtgagctatactaataaaactttgggaaacatgtattcattgagttcaaaatcaagattggcaactttacaccaatgcttcaaatacttacagaataaattgaattatttcaactctatcgtgaatacattcagtgaatcgagatcaaaagtattggtagatgaattcaatagacaagtacaaggtgattttgaggttaatggacagggaagatcaagctcaatatccagcgattcaagaccaatttatatgtcagcacacgatccagtgcgatttgttggagatctattggcttatgttcattcagtatctgtgaatgaatccgaaacaataacaagtatatttaccatgggtgatgataatgataaggaatttgagaatattatacaagatgtaactgacaaaatattgcaatcattatctcgtccaataaaagctcgtgtcgaacagattgttactactgagactaaattatctacacttgtacaaatattcaaccttgttgaattatataatattatgtttactaaacagttggggaaagcgggaaatattgttgaaactgttaagcaattgataaaagtgtgtcagggtcggatatttatgattatatcgaatagattggcaactattaaaaacaaaaatctgaccaaattggatttgaatttagatttacaaccaccggaatggattatcgaattttattctgacatattacctattgttgaccagataacgacggaaacaatactaaacttgtctcctgaagaaaacgaaaagtttttaaacttgattgtcaacgaaccaattcaagtatttaacgaacatgttgatcataacaaagtattttctgaaaagaaagatgttttgattattaaatcgaatttccttgatttgatattatctaaaaccataccagtttccctactttcagaaaaagtattagaagtaaatgagatgatagacaagttgacagaagaaataactcaattagaactaaataatatgttaggccaatgtggtctttacgactactttaacattatcaacatgatatgtccattttcagacgatttttttgaagtgtctatttacgaaccaattaaagaaaacaagttgtacacaaaagatagttttgtccaagttgatgaaaaagtacaagagtttttccctagtgctatgattgaaatgcaacaatcccttttgaaattgaattcaccaattgttgtgaatcaaattatagataattcattcatgcaatttgtaaaattctattgcaagttggatttgatcaacaaagagtatttggacttttcctttacatggtctgacatggagattgcaactttagttggtattgaagatgtatattcgatcttcaccacgggtagaagaccgcgt

SEQ ID NO: 1186 - DNA, 660 bp, Candida albicans
caggatgaatcgattcctcagcatacaaatacaccctcattatcagcatacaagtttcctcaaaaacagattgaggatcaaggattattagcattactaggacccaatgtcacgtcatttccattctctgaagaaacatttctgaatgcattaaaattacgagcggagcaagaacgtacgaagcaagagtactacagagtagaaactgcaaataaaaatcttgccattcttcaaacagcattacgggctcaaatgcctgttaatatgatacccctattgtgtgttggaaatgctcctgagttgactgaagaacaaatgaaaatgttgatacaacaagcaacatttggcactccctctgttttgcatccgcaacaacaagtgcaacaagtacaacagcatcaacaaccgttgcatttccccacttcccaacagcaacagcaaccacagcagcagcagcaacaacaaccttttgttggaattcaaccaggacttctgcaggaacaacaaattcaaattatacaagcaaatcaaaagcgaatgcaacaagaattgcaacaaaaaggtggatcattctcccaggggaagtccatttcagaaatcacatacacgcggaggaagtggtggtggtgtaggttcccaacaggacacattcaatgttaa

SEQ ID NO: 1187 - DNA, 597 bp, Candida albicans
caccaaatacatcatcacggtcacctgtcactgatagcttcatcagcattgaaaagcgaaaccaaagcaaaacctgataaactttcaagtcctattaccaaagtatcttctaacaaaattataatagacaaaactatctcaaacatgttagggctttctgaagaaacaattgaagagaaatcaatttggccatacaagatggaaacattaaatggaatcattagtcttaaaattgaagaagaaaaaactaaacaagaaaacataaagaaggatttggcaaacactgcaattgagttgcttacgttggcaaaatcattaaatgttcctggagaactaatttcatacttattcatatccgattcggtgacaagcaatagtttaaatgccactatttctaaaatccgcaatgaaacccaccagctgtttctcaaagatctatcggaaaaatcgaaaatggattcaattattggcatcaaaagaaagcatactagtactagcataaagagcagcggcagtgcacttgtgttccccttgaggtcaccaaaaaagcttccactggaagaatgcacatcgtcgggtcgtttcggatggaagtga

SEQ ID NO: 1188 - DNA, 282 bp, Candida albicans
aaacaaactgatttgtctgagttttctctcgaggaatctgaattcaactacagagtccgtcaaattattggcaaaatcagagaacaaaacgattcaattatttggaagaatctctatgttgttgttggtgcatcatcaaatgaaccaattgaaatttcacaacaacgtgatttgatggctttgagaatgtgggcttcaagctgcttggtggaagataaaaccggcagcgaaccatcgtatagagatttcttgacttctttgaaatccaaagtttctcaataa

SEQ ID NO: 1189 - DNA, 348 bp, Candida albicans
catataattagaacaaacaggtctttattatacaacctggaatcagactatgattctgatacgtcagattatgttgtaccaaaactagaatttgaacttaaggaagttgaggaaaacgataatgaagataataaaggaggaatacaagaatcaaatggttcagatgccgaatttgactttcctttgtttgctgccagtgacaccgttgttgaagatcgaggtcgaagtaaagaggctaaaccatcaataatgaaagtttcacttcgggaacaatctgaagaaagagtcatcaacgaaagacccgaatccttttattttgccaaatacacagataaacaaagagagtaa

SEQ ID NO: 1190 - DNA, 474 bp, Candida albicans
  unsure (462): Identity of nucleotide sequences at the above locations are unknown.
atgacaagccaaactacagagtatccaacgaatgaactagaagattttgaggcttttttggagacaaactttgatcctcaacagtttgcgaacgaattgcttctagctactaatggacaagaaaatccacatttagacttggtaacaccaataaaaaaattgaagtttgacatccaagaatgtgataaaagaatcgaaaagatttcctcttcaaattattcatcattgatatcaaattttcagaaaattgccgagtatcaaaagattttgactacacagataaaccccaaccttgaaagaatcaatgcaccttttaagagaattaagcaagaggttgtcgagccatttgacgaggcaatgaaactaaataaagcattgaagagaatccatttaacattagagttgttgcgaggcacaagttttttgatctttattattcaattttcgacagaccgggacgcnggacaattgtac

SEQ ID NO: 1191 - DNA, 1137 bp, Candida albicans
  unsure (68): Identity of nucleotide sequences at the above locations are unknown.
aagattttgaggtttttttgggagacaaacttgaatcatcaacagtttgcgaaagatttgcttctagntactaatggacaagaaaatccacatttagacttggtaacaccaataaaaaaattgaagtttgacatccaagaatgtgataaaagaatcgaaaagatttcctcttcaaattattcatcattgatatcaaattttcagaaaattgccgagtatcaaaagattttgactacacagataaaccccaaccttgaaagaatcaatgcaccttttaagagaattaagcaagaggttgtcgagccatttgacgaggcaatgaaactaaataaagcattgaagagaatccatttaacattagagttgttgcgaggcacaagttttttcatttttattattcaacaaatagaagaattgacaagtgttctgaacgagagggatttagtaaggttggccaaattacatatccaaatcaatcaaatgtatcaagatgcaaccagtgaaaaaggtgctgaggtaagcgtattgtcagtgaaattgattcgagattatcagtccattgccatatcaaagagatcaaattttctttcccagtgtattaatgttgtaagtggtgacttcaaccacccttcgactcttgaacgcaaaaatcagaaattacattcccatttatctgcattgtatatattggatagtagtgaatttttcaatgtttttgatcgctcaactattaccagaaaagttcaatctgcgtcagctcagctatcacgagcattacaatcaccaagaaattttacagcaatccttacagaagttaaagaagaatcgagtgaatattttaccaagttgagtgacattttgagtgattggaagtctgaaagtgacgatgataaattaacttttttagaaatagtcttgaaatattacaaactggaatcattgacagaattgttttggacaaaattaaatcaaaaatttaagaaaagtatagtggcagcaatggctagaggtgggccaattgcaaagaatttgaaaatttactcccagggtcttaaaacatcagtgctggagacattcaagtcagaagaagagaggaacatgttactagattcattgtccatgatagattacaagtaa

SEQ ID NO: 1192 - DNA, 2094 bp, Candida albicans
aacaacaataacagcaccaataacattatcaatttagataatgctagtgttaacggaagtatgattgcttcatccaatgcaatggtgactggtcctcccggaacatcgatagcgttaggatcgggctttcgatcgccatccatactagagggggaacagcttcaatattttcatgacccagtgaggcaacaacagttcaaacttccttctaccaaggctccgtcaatttccaactccatcagcagttcaaataatatagattcaatacttaaacgacctgtacatctacgtgaggcatcaacgtattcagtgaatgataatgaccaccgaaatcttgtgctaccaaactcaactgaaaggtttactgcttcaccttcgaacaatattggtaatgaaaatatacctcaataccagaaaactagtagtgttgcccactcaatcaatgaaggatacaatgatgatacattttcatataatgaagttgaggataatttaattgatgaagattccacggacgatggggatttgacaaaaaataccattactaataacaacaatccaccaaccacgtcgagccaacagcaaccacaaccgcaaccacagccgcaaccacagcaaccacaactacatactctgtctcctctaaatcagatacaagcagcgacatcagcaacaccttctgtgtccactaaaaacgcgtctaaaagaaattacaaaacctcatccacttcctcaaaattaagatcaactacatcaaaacttttcgataaaaaagggtcacaaccaagaagatacagtaccattcctgatgatattgacattgaagatttcgatgatgagcttatatactatgacaacacagctaggttcccagcgaacgaatcaacttcattactaaatcaaaaccaaagaatcccccattatagatcacttaatttgaatttccctcaggtgaagcgccaaagcaagcgttatttgtcaactggccaacctttagagagttctgatcgtggctctaacaaagatggtactgataatggaaacaacagtgatcacaatattaattctcctttgactgctaataataataataataacgtcaatcacaacgatcatggtgataacaaaaagagtaataccaacaacaacaacattgctaataatagagcatttccatttccttatcaagatcaacaacatcattattactacgactacgatgattttgaccaagaatcacaaatcaatggacccaattttgatttgccagacctccctataaacagatcagcttcacggaattttaacaacaacaataaccccaaaagatttggcgacagtcatttttttctaccaagaaagacagatcagtatagtcaaagaacaagctttctaaagtcatgcattcatacctttgtttgtatattaattgtgcttaccatagggtttgtgttggggtttgttttggccacaacaaaagatttaactgatgtaggtatcacatccattgagaaccccattgttagtaaagatgagttagttttcaatgttgttattgaagcatttaatccagggtggttttccgttgacatcaatgaagtagagttggatttatttgcaagaagtggctatctacctgatacagataatctgaaaatatctaacatgggagggtcacaaaaagtagagacggttaaattaggaacgattttgaattttgaatcggttctcaatttcaaaggtgggtttctctctcgagaaccgacaattcaaaagggaggaatccgattattatatcctggcaaaaatgttactgccgaggctaaattggttgtaaatatggctgatattaaaatagctgcttccaatagcattgctaaagaaagcactactagtaatgacaccaacgataatgacaactccaagaagtgggaaatcatatcaagcaatccatttgatttgattataactggagtattgaagtatgatttaccattttcaagaacctcaagatcagtcgtggttagaaaaactgggtatattgatcctaccttattcgtaataccacaaggagagaataatatttcaatttag

SEQ ID NO: 1193 - DNA, 783 bp, Candida albicans
ccaaatacgcacgtgacatttaaaaatgttacaaaaaaaaaagtaaaaattcttaccagtcagaattttctggctaaattggaggtaacccacaagaggttttccccagcaaatacaccagaagacttggccatgcgacaggaaactaacgacacacaatatgtatcaaataataaacactcagaggaatctagtcgaaaaatactgaggctggttgttaaattggtgccgccattgaatttctcactagtagaaaatggaatctatcgatcagggttcccaatgcctataaattacccattcttaaagcaattgagactaaaaactataatatatttgggtgatctcggtaatcagacctcaaagaaaggcaagaaaaaagataagcatggtacagcagaaataatgaacaattatctagattggatcaagaatgataccgaaatccggttctacaacttattatttgaatcgtcacaagagccattcaataaaccggacgatatccaacaagccacccagagcttgacttttgcattgcagttgattctaaataaagaaaatattcccattttgattcactcaaataaaggcacacatcgtactggtgtcttgattggaataatgagaaaggttttacagggttggtgtctaagtggaatttttgaagaatacgagaaattcgccatggggaaatcagaatacgatttggaattaattgaactatggcagccagaattgtacatagacgatgctaacaagcctgattttgttaggatatag

SEQ ID NO: 1194 - DNA, 345 bp, Candida albicans
tttcccctcaaagagcatcatatctttagtctttttctctttatgtcacgaataagtgcaaaacttatacgggacgctagaagaatctcaccatttctaccacgattactaccagcaaatagaacaattgagcaggcatctttagaactaaaatggatcaagcaggaattacctaaagaagattggaatgatgcagttaatcaacgatatcaactagttccattgcagtatattctcggaagccaaccgtttggaggattgaatattaaatgtaagcagggtgttttgataccaagatgggcgaccgaggatgttttcaccacgggcctggaaggaccgagattg

SEQ ID NO: 1195 - DNA, 744 bp, Candida albicans
caagtggaaaatcattatcaaaggagcttgccgaagatgaaaaattacaacgtgattttatttacgatgaaagtgaacaaattagaaattgatgacgaatacagtcggttgtcgggaatatctgatccaaaagttgttattaccacatcccgtgatccatctgtcaagttgctacaattcctgaaagaaatcaagttaatgtttccaaatagcttgaagttgaatcgaggaaactatataatctcagatttggtaagtacctgtaatagagtgcaagtttccgatatgattttattgcacgagcatcgtggtgtcccatcaagtttaactgtaagccactttcctcatggcccaactgcgattttcacgttacataatgtcaaactaagacacgatttgccaaacttgggaaacgtctcagagtcctatcctcacttaatatttgagaatttccaatccgacttgggtaagcgtgtggttaaaatattgcaacatttgtttcctccaggtgtcaagaaagatagctccagagtaataacatttgtcaataacgatgactacatatcggtgagacaccatgtttacgtcaaaactaaggattcagtggagttgagtgagattggcccacgtttcgaaatgagattgtatgaaatcagactaggattacctgacaacaaagatgctgatgttgagtggcagatgagaagattcataagaacagctaatagaaagaattacttgtaa

SEQ ID NO: 1196 - DNA, 1428 bp, Candida albicans
actccttcatatacatgtatacaaataattatggtgtttataagtacattgctttcgtcgtcactagggtcgcgattttcaaatactttagagtcacaccaaatcgatgatgactattcgggacaatacgattttgatacggtggaactgtcatcgtcatcgtcatcgttaccacagtctcaacgacaagtatcaagcacaaacttaagttcagggttactgtcatatcccgacaggagggtcatcacagaaactacagcggcaactgcgactataaatgcaagtaatttctcatccccgccttcgcctccacgacaatccttagcatcaacacctactcagccatcaaattgtgtagccgttgcagacattgacacaagatttccaccaagttctgctgtcataaaccagtatgacccatatgaggaagtcccatcttatgaagcatcgcaacgtatgcataatcaatccgccaatagtaacagcaacaacattgcccataataatgataattatatcacagaagatgtttcgcatattgctcccacgacgcatatatacactcccattccgtcattgccaatacctattacatcaagcacaacggggatatcttatggcaattcttacgatgcacttattaacaataacaacaacaatggcaatactagtaatagaaacaacgataaccgtaatgggaacaacagcagtaatggtaatgcatctaattctacattacgaggtgggaatatcaaacggtcatccattaaacagctaggtttaaagtttttgaatgcacgacaacattttttactagcttcttgtcgtgatgtatcgttaattcctcctttgattggactaatacgttcctggagaatgatctatagcaatgataccaacaattacagccaggttcttaatggggatggagtaacactaattcgaggatcagaacatttcttgactggactttggtgtattgttgctggttatttatcatattctatattggactcgttgttggttcgatggataatgacatacctgacgtcagcagcaattgtgagagtactttcaatgctgacaataatcatcaccatagaactatacttgatcaatactacaagtgctattaccgactatggattgcatatatggatattcattagttgcgtgctcacattcacatacattgtgcagaattttgtcacatcaaatctagagttgatcaattactataagcggacgacgatccacaagcgagccaggttttttgatttctataatattgttgtgtttgctgttgtccccgtgggtttggctagttttgtcactatggtgggactattgcgatctttgctattattaagaatcgaaattgatagcaacaataatggcaatggtatgattaatcttgatggtgtctaa

SEQ ID NO: 1197 - DNA, 534 bp, Candida albicans
  unsure (499),(500): Identity of nucleotide sequences at the above locations are unknown.
caactattcattatacccccctccccccttcaagcacatactagcatactctatcaaatggcatctgagactctttcaacaacagatatcaatgataatagtgctaacaatgatgttgaacaagacatcacatctaccaccaccaccaacaataacagcgtgaacataccggctaaaccaaacgactatgaggcattgttcaaaaaacttgacattgaaaaaactggtgaaatcacatttttagattttaaacgagctttgaaaaaattcaatcatccaataaacgaaagtcctgaattgttattaaaagttttcaactcattcgactccaatcacgataaaaagattgatttcaaagatttcaaagaatacttgaaaaccacagatgatcaaattttaaagggattcaatcaactcgatcaagataacgatggaagattaaacaagtctgattttattcgttatttaaaggaaagtttacatgtgaaaccaagtgttnngccaattcatttttttcgcccatttgttatttaa

SEQ ID NO: 1198 - DNA, 987 bp, Candida albicans
  unsure (12),(13): Identity of nucleotide sequences at the above locations are unknown.
aaccaagtgttnngccaattcatttttttcgcccatttgttatttaaacagcttgattctaatgaagatgggtatatcaattacgacgaattcagagaatttcttttgttagtacctcgtttacaagggtcaagaatcaaaacagcatttacatttttatttgaagaatatgatatcaattctgacggggatgtgactttgatcaatcaatttttggatggattcaaatttttcttggccggaggattggctggtgtggtatcgaaaacttgtacggcaccttttgatcgaatcaaagtgtttttgattgctcgtaccgatttatcatcaacaattttacattctaaacaagaaattgctcgtcaaatagcactgggggctgaaactcatgtaattgaagcattgagaaaaaaattagcacatgcagaaatggaacaggcagcagaactactagcagaagaagccaaaaccaccaagagcgccgctgcagcaagaacagcagcatctggtgtaacaactgcatcagctcaaaatgcaaagaccattagatcacccatagttcaagcagtaagaacactttggagacaaggaggaattaaagcattttacgttggtaatggattaaatgtaatgaaagtgtttcctgaatcagcaatgaaatttggctcttttgaagctgccaaacgattttttgctcgaattgaaggtgttaatgacaccaccaaaatctccaaaatctctacatatttagccgggggattcggtggggtggttgctcaattgacagtttatcccatcgatactttaaagttcagattgcaatgctccaacctagatcatcctctaaatgctattctgacagccaaagaaatgttgaaagatggtggagtcaaaatattttatcgagggattggtgttggtcttgctgggatgttcccttatgcagcattggatcttggaccttttccactatcaaaaaattattag

SEQ ID NO: 1199 - DNA, 567 bp, Candida albicans
  unsure (221): Identity of nucleotide sequences at the above locations are unknown.
ccaagtgaaacattagagccaccaaagcaggttgaaataaaatatcaaccacttttgaaaaaagaccacgccgcaacagattcttcagacattggtcaattcaatgaaagcaaccacaaggcttcaaaatctacaacttcattgtcatcactttcaagaagcagcagtcaagcgtcacttttaacaccaagtgaagattttgatatgtctaatgtcaagantaaaccacctccaagacaaccagttgaccctacctatagaggttggaaggaagttggtgggtttgaagaagaggatgtattgactgctgaagatgaaactgtagatttgttatcaagaggatcactttttgaccaatatttacctgcagcaatctatggagactggtatcataatgctgggtatttgatcgttgcgggattattatcctggattattggttggtttagattttcagttgcacccttattttttgtcatggtggtgttttctttgttgtatcgtgcttccgttaaaaagtacagaggtgtcttgagagagcaagcacaacgtgaattttctagttaa

SEQ ID NO: 1200 - DNA, 1185 bp, Candida albicans
cacaggaaaacattcgagacgcaaatgagccaaaatgccgatgaatatgaagctttaacggccactttactgtcgttttacaattttttcaggcaccaattcgagcacattatcaaaccaagactaataaaatttcgagccatgaccgagaaagaaagagctttgcttccatggtacgaagcgcacacaggggagttgaaacagtgtatcgaagtaaatcgtggatttacggaattactatctacaagcattgcaaatgactggggtgttgctggaacatctctagattggcacccagctggccctcgagagtttgagataacctccacgacgttattgcaattgatgagagagtggagtgacgaggcccaagctgaaagagacgttgcattcactcgaatcataagcgagttggaagagctttatcctgatgagccgtcgcgacaatcaatcagaatattaaaccctggctgtggcttgggtcgattggttatggagttggtgataagaggattttggacacaaggaaacgagatcagctaccacatgctattggcatcaaattttatattgaatcacagccagtttcctcacagccattcgatatttccgtttttatcgagatcgtcgcatttggtaaagcgaaagtatcaaacaaggggcatcacaatccccgatgtggcaccgtttgcggtcctctcagaattgaaggagaaaactcccagtattgcatacgaagaattgatgtcaataactgccggctcgtttcttgaattatacggtccaaataaaccgagcgacactttgaatgacccggctgccattgagttgaagaattcgagcaaagatagctttgacgtcgttgttacgaatttttttttagacacagcaagcaatatcatcgagtatgtgagagcaatccaccacgttttgaaaaatggtggcagatggataaatttcggtccattgttgtggcattttgagggtgattacaatgtcagctacattaatagagaagattatgtctctataccagatatcaaaaaagggttagagttatctcgcgaagacttgcttgagttaatcaagaatatgggctttgactttgtgaaacatgagtctgacatagaaagcacatattgcaaggacataaatctggtcttcaccacagggctggaaggacac

SEQ ID NO: 1201 - DNA, 573 bp, Candida albicans
agcaattgtacaagaatgtcactacaccatcgtctcttttcattaattatatcaatagccattgcaatggctccaccactcaaagcattgtttgtcaactcaaatttctatatgccaaatgctcctgatgaactccccccattatcatttattattgactttaccagttatgttggtgctgcatctgttcccttagggttgatattattaggtacaacattggccagattgcaagtgaaaaaaatgcctccaggcttttggaaaactgcattgctaatcactattgccagattaattatcatcccaatatttggtgtcggcgtcacaactgggttctataaaggtggttggtatggtagtgatattttggtgagatttgttagtgttttagaatttggattaccaaatgctacttctttggtatattttactgcattctacacagacccattaagtgaggaacatttacaaatggattgtttggcaatttgtttgatttgtcaatatgccatcttatggattacattaccctttttaacaacttttacattgaaagtgtcaatgggattgtag

SEQ ID NO: 1202 - DNA, 792 bp, Candida albicans
acgcggtccttccagccttgtggcgaatatggcaataatcatggtggtaataatagtgtacaaagtcaacgtagtgaaagtagaagagaagctttggctgctagaaaagccaacaaggaagatgatagagagaataatactgctactggtggtaatggtcgtaaaaagaaaaaggaacaaaataataataataatagtacagcaagtggtgctgatggcaacaatggtagtaatggaaagaaaagaaacagagatgataaatccaacaatactggaagtggaaatgatttgaagaagaaaaagaaactgaataataatgatcaatcagataatagaagaagaggtgaagatgaaaatggtaaaggtgatggtgaaacaagtttcaatagtggtaatgccaagaatgatcctcatggtaaactaaagacaacaactacaggaaatcttgttggtggtagttcaactacagcaacagtgtcatcatcgtcaacaacttcttcttcagcaaccacaacaacaacgagttcaaccacaaccacgaaaaatagtgggtcaactggagctagtaccgctactgctactggtgctagcggagctaaaggatcttcttcatcttcctcaggtaataatgaaccaacgtattgttattgtaatcaagtttcatttggggaaatggtgggatgtgatggtgatgattgtaaacgagaatggtttcatttaccatgtattgggtttaaaaacccaccaaaaggtaaatggtattgtgatgattgtctcaagaaattgaaataa

SEQ ID NO: 1203 - DNA, 657 bp, Candida albicans
ttcttaacaatgagaacaaagcaacaacaacaacagcaacaacaatctaattcatcgtcaggtgtagctaataaccaaaagagttatggttatactaccagaaccaaaagtaatagtagtgttactaacggcggcaacgttggtgctactcttactgaaagtagaatcattaccaatattaatgaattattaccaggtttaaatgatataagtgatgcatttgaagcattacccattgatttaattagatattttacactattaaaagaaattgatgctaaatgtattaacaccatcccacaaattaatcatttaatcaatcaatatattacaaatcttcatcaagataagaatgttaccaccaccaccacaacaacaacaacaaatgatgataataccattgatttgaataaaaaattagaaactagacgattaaatttaattaagaataaaatcaatgaagtgattccctgtttagaagaaaaaatgcatgttacttcagttgctagtgatttattaaagaaacatatgtatagaatcaatcaagattataaattgattttattaaataatgaaatccctcaaagtattagaattggtccattaaatcatccagcattttcaccacggcgtagaaggatccgcaattgcggatag

SEQ ID NO: 1204 - DNA, 198 bp, Candida albicans
aaggttcaaaatactacaataatggcttcaattacaagtaatcctcaaatacttatcaataatgattcctcaaccaataaagctcctaccaccaatgaacgactattacgaagaatcaatcatccaccaaatttaagaattgttccaccattaaatttttgtcccgttgaaaatcaattatatagatcaggtcaacca

SEQ ID NO: 1205 - DNA, 600 bp, Candida albicans
ggacgcggatcttccagccccgtggtgaagattatcatcagaagaacaaccgatgaatttttagaatattgtaatgattcatctataaatattgaatatttaggaatgattaatgaatttaatagtgagccagccactgcaacaacaacagacaaacagtcacagtcacaatcacaatctgaagaacaaaaatcacaatcacaatcacaatcccaagaaaatcaacatcatcaatttgaacaatcagataataatttattacaagatccaagtcatcttatatcttcaactattgctaaaatcaataataataatccatgggattcattaaatgaaaacaccattaaacatgctttagatttaattgttgataaaaccaattatccgattttgatttgttgtggtatggggagacatcgtactggtacggtaattggttgtttaagaagattacaacattggaatttaaatagtgtaagtgaagaatatcgacgatttactggaagtagaggtggaagaatattagtggaattattaattgaaagttttaatattgatttggttaatattaattgggaattggcccccgattggttgaaa

SEQ ID NO: 1206 - DNA, 564 bp, Candida albicans
tcgatgaagatacttggcccaagagatcacttaaatgttatacctatattgaaaggagaagattatgatgaaatctacgatcgtgccaaattgttttggaaaaagtttattcctgaatttgaaaagaaattccccgaaattaaaaatgtgttgatagttacacatgcagcaacgaaaattgctttaggatcagctttattacagttaaaatcagttactgatgttatagatgataatcaaactgtgttacgtgctggtgcatgttcattatccaaatttgttagagatggcgaagataaaaccaatcatactattcaatggaaaattgtcatgaatggtaattgtgaattcttgacacagggtgaagaaatgaactgggatttccgtcgtggtgttgaagccgggtcagctgaagatatagcgcaaagaaaggcagcagcagaagcagaagcaaaagcattgaagaaaaatgaacaaaccaaatccgatggtcccatcactgaatctgccactggggcagaaatagatgggaatgaagatgaatttgaagtacgtaaaacttga

SEQ ID NO: 1207 - DNA, 252 bp, Candida albicans
  unsure (2): Identity of nucleotide sequences at the above locations are unknown.
anatcatacaaggagagtatggacgcagatataaatgacttgaatgtaggagtcatatcatcggatttcatgattaaaaagctgttaaactggggcaagtggcaaaatgaaatcagtaaactaagtagaaaaacaagcgagtgggtaattgctgaaaatagtgatcactttatctggaatagtccaaaaggtagaaaggagttacaacagttgttattaagattaataggtgaacaagagtatcttaagtag

SEQ ID NO: 1208 - DNA, 837 bp, Candida albicans
cgtttattgtattggccattcggaacaaagtttggggtagttagatttatcgttaaattgccctgggggggcctcaattcttggtttaattcttggatggttaattgggttgaagaaggtaaacattatcaggagattcgattaactggaagaatcgaaaaacgcaaaaccataagtgaattagttatcatcttttttaaggtgttgggcgagattattatactatggatagtctggtgtattagttggacattgtggataaactgttttgacacccacgaaaagccatggggtaaattagttccggttaacaataaccaattcagagtacacgtagcatgttttggagatgttcacggcaaatctgatcagccaattgtgcttgttgaaggtgggcaatcaacgtcaagcgaagctttccaagaatggattgaagagttgcaccacttgaacaaagtcgaacggtactgtatctgggatcgaccaggctatggattttccgattcggcacctccgccagaatctttagggattgtcactgaatacttgatggaagcattgagaaaagaaaagatcgaggggccattttcggtggttggatttgatattggcggattgtatgcgagaatgtttgccagcagaaatcgagccaagatccagtctatcctatttgttgatagctggtcgcctgatttgttaaagaaatggccatttagcggcagtggcagaaaaaatgagagcacaaaagtgtttaagaaatccttagaggtgatggataatataacagggtttcaattattttcacctacgggaacctgggccggatccgcaaaatga

SEQ ID NO: 1209 - DNA, 1140 bp, Candida albicans
aaattactgatgccagaaagctcatcaaatatgataggcagggaagctgcaccgtcaaatcgaagaacattgtcgtccaagtccaacaactcaacaccacctataaactcgtcagggtcgagccgtccttcttcaccattagagccaccaccaccacaactgcaacaacaacaatcatctagaagaccatcgtttggtttaaactttttaaataatttcaccatgcgttcgcattcatctgaaacagcatcacaaccgttaatgtcaaatagccctacattgggaaacgtgcattcgcacacgcatgatgatgtttcaggcaacagtcaatcattcaatgaagttgctgaagagtctccattagaagaggaagaagaaccccaaaatcctgcaccagaagaaataccacaaccaccagactccacctacgtcgacgaagacgcaaagggcgggttagacaaggatgggttcttttcagtaagattgacgccattaatagaccattcatccacatcgtcaggactatatttctcgccaataattcgtcggctttcaccaaaaacatccatcaacatcgggagatacactgaaaagaacaaagcggcagcacacgcaccccagggatcttcagcaccgattgtcttcaaaagtaaagttgtttcacgtacacatgcattatttttctgtaatgaagatggtcagtggtttctaaaagatacaaagagttcatcaggtacatttctcaatcatattagactttcgcccgcgtcacaagagagctcgttgatgccgatcatagatggagatataattcagttggggatggactatagaggcggcacagaagaagtgtaccggctggtgaaaatgaggtgccactttaacaatagctggcaacgcaaaatgaacccttacaatattgaaatgttcaagaaattgcaaatcggggataagcaagccaccgaatgttcaatttgtttaaatgcaatacagcctggccatcctctatttataagtacttgtggccattggtggcattatagatgtatacacccattgctacagaaaagttatcccctgttctcatgtcccaattgtcgatatgtttgtgatttggaatatttttcagagtcagaatag

SEQ ID NO: 1210 - DNA, 561 bp, Candida albicans
agaaaaaaaaaaaatagaaaagaaacttattcatctacatcatctactcatcagataatgccagaagccatagtatacttaactgaaaccgaaatttgtcagaaatgcaaaactgaaaatgctgtagttcatgcaagagttgaaaagctttgctcaaattgctatatacgttttattcgaggtaaacttagaaagcaaatgcacgatgagaggtataaagtcaaatttggaagagcagttgagcaatacgggactcaaagaatacttctagctttatcaggtggcgagtcatctttagtgctattagatatttttggctctttgttacaagaacaaaatgacctacataagggcaaacaaggatttgaattagtggttgttaacttagatgaatacgaattagacagcttgaacaacaggatccagaaagtctttccagagctcttagcaaagtaccaaccggtgaaaataagcttaaatgtattatctttggattcttatgttgatgaggaaagtttacacagaattttattaactccagcttttagagctatgctgaaa

SEQ ID NO: 1211 - DNA, 327 bp, Candida albicans
ccgtgtggtgaagaaaagcgattggttgaaaagattactgttactgatcctgctgctataactactgatgaagaaaaagagtattatgaaatgttcagagccagtttgtctccagacaacgaagacaaaaataacagtgatagcccaatagatatttgctttggatgtactgtaactcttggtggagttaaaggagatactggatttatctggccattacagggcagcctggaattaaagtacgagtatcgcaacgataaccaagagaaacagaaggttttggatgagtttgttttgactgatgatgaaggtgatatagaagtgtag

SEQ ID NO: 1212 - DNA, 321 bp, Candida albicans
caatttctcttgatctttacaataggtgaaagggactgttcacagaatatcaatgtttttaatatcatacagagtacaagcaggatattgatggggaaaccatccagtgttaatttgcttgttcaaactagaaccaaaatgaaatcccataaggcagctgccaacagatttataaaaagagctagtggactcaaaagaaagcaagctggtgtcaatcatggtaatggtagatttagttattctgctttgaaaggcttaagagggtttgtggaagtttcaaacaaaggaggtcatttgaaaaagttcatcaatcgtgtgtaa

SEQ ID NO: 1213 - DNA, 801 bp, Candida albicans
  unsure (788): Identity of nucleotide sequences at the above locations are unknown.
gtgacgcttgactttccacccggcggccaatacttgtcatatcaaattgcgacatgttacggtttacccgttaaaggagtgtttgtgaacggaggtacaggatctttcgagttctcaccacaagatacacttggttggatgattgagtctgttgatgacgagcgagtggaagacttggatgagtttgtagaggttatgaagaaaattcctgattgttcaagggttccagtgacttatcgtcatgtatctgatatgcattcagaatacgttagaagtatttatattgacagacattggcacacttctttcaaaatggcaactcgaaatgatagcacgggtttgtgggattttgaaactcttcaaaaagaggcattgccccctgttcctcttgagcctcaaaatgcaaagtatattgacatccccttcggtgatgacagtaaaaaaggttgtgctgatttggtgagatcatttgttcaggtacgaacactttgtccaagtcctattgactcacatccttttagaaaagatatatgttatgctgttgtgattgacgccacccatgggtatgttcttgtttcacgaaaatatgttccacattatttatgtgacatttttattgtttttgctgaatcaattgaagtccctggaaaagttgtgtttttacacccccatctcaactatgctatagtcaaatacgacccaggcttagtgttggctgatgtcaaaacacccgtttttggaacttcaccattacaaagaggagataagtcgtttttgaataggattcnattatccttttga

SEQ ID NO: 1214 - DNA, 639 bp, Candida albicans
agcgcgggtctatctagcccagtggtggaagacgaagataacatcaaatttttagccgttgaacgaattgctgcacctagtttgggtaatcaagttacaaatccattgaaaattggggacgtggttctttgtgttgatggtaagcctgcaaagagtttgagagatttgaattccatgtatactaaagacattttagaatttaagattatcagacaaaagaaagaaatgacattgagagtcccaaccactgaaacaagagaactcgacacgtctcatgttgttttctggtctggtgcattacttcaaactccacattatggtgtaagacagttgatgaaaagtattccatctgaagtatatgtagttggaaaatcgtctggttgcccagcagaccagtactatattgtaccgaattgtttcatcacccatgtcaacgacaaggaaaccaaaaatcttgagagttttgttgacgtagtaaaggatttgcccgacaaaacatatgtgaagctaagagtagtttcatttgacaatataccaatggctatatctttgaagacagactaccattattttcctactattgacgttagaaaggaaatcgatacaaatacttggatggagaaaaaatacaatgaatag

SEQ ID NO: 1215 - DNA, 846 bp, Candida albicans
  unsure (214),(819),(835): Identity of nucleotide sequences at the above locations are unknown.
catgagtcggttgatgtcaaaccgattttcagagatcttatacacgattttggtattctaaaattcaatcctcaggacgtcaagtacttgaagttaactcaactagagttggcaccagatttggcaaaagttggtactgaaataagggtggttggtaatgatgcaggtgaaaaattgtctatattatctgggtttatttcaagattggacaganacgctccggattatggtagtttgacgtacaatgatttcaacaccgaatatatacaagcagccgcagctgcttcaggtgggtcttctggttccccagtagtgaacgaggacggtaaatgtgttgcattacaggccggaggacacacagaagctgcaactgactactttctcccagtttatagaccattgagagccttgcgttgtattcaaaataatgaaccaatcacaagaggagatattcaagtagaatgggagttgaagccctttaatgaatgtgttagattgggattgacagcagaagcagagcaaaatgcaagaagattgtttcccgataaggttggattgttggttgcagagcttgtattacctgatggtcccgcagataaattaataaaagaaggcgatacccttatttccattaacaatgagccaatcgcaacatctgttcgagttgatgaaattttagacgaaaatgttggcaaagagttggaatttgtattgcaaagaggtggtcgtgaaatcagacaaaagattactattggtgatcttcatagtattactccaaacaggtttgtggttgtagcagtgctcctgttcaacgacttnttcaccgcagggacgngaatatcctat

SEQ ID NO: 1216 - DNA, 1857 bp, Candida albicans
ttgctgaaagcaaacgcgatgatcatcatctctggaaaagaaaaaaataaaacacaaaatagggatttgataaaacaacaattattgtatagtgattgttcattcctgaaaatgtctgagtcaaccaaccaacaagaaactgctttgagggagatcgtagaagatactaccaacgccaacgaaccaactgctattgataagaccactcttccgaatgagacttcacatgagagagaaacaaccacaacggagaatgcctcttcagagattgaaaatatcgaaccacaggttgctactcacaattcagacctagataagagtattcctacagataccaatattatttcagacgtatcccaggcaccgcacgtatgtcctgataacgaaaacaccgttcaaacaagtgaagatctccaacaatccaatgtggaaaaacaaaaaatggaatttcataatgggttggaacagctgaaagaaatggccactgaaacagaaattgaaaaatttgatgacatacagagggaaatttcagatccgattgacgatgaatcattaaaaagcacacaaaaaccagagtcctcagaaactgaaaaagtagaagcagacgccagtcacaaaggtctagctgatgaagcagaacaattgtctgacgaagaaatcaacgttgatgatatttctagcgatgacaatagtgaaagctcaagttcagaagaaagtctgggtgatagttcttcagatgaatcgagtgatgagaatgagacttctaatattgattataacgatgttgaggatgaagacgaggattcaaatgaaggacctgtcaaatccgtccacgaaataattgatgaaaaggcaccttctttacccgataactatgaaatatcgcctaatacacctattgaggaaattggtgaaattacaggattggtcgaaaatactatgataatcaaggcaagaacgtctggagagtttagaattctacaagaaaaatcaatattttgttttgaggatagaactgtgataggccccttgtttgaaatatttggtagggtacaacaaccagtttacagtgtcaaattcaactcggaagaacagtttctgaaattcaaggaaagcaaaggaaaaactgtgtattatgttgtacctgactcacagttcttgtacaccgattcaattaagcacataaaaggaactgatgcaagtaattgtcatgatgaagagctcccagaggaggaacaggaatattcagacgatgaaaaagaactggcagcaaaactggccaaaaagaaaaagaaaaataaaaagactaaagacaaacagacacacacttcggggccatcattaccaaacaaaagacagaaagtttcggcatattctcctataacaacttactctcagaacgctgtccataatagaggaagacaaatcctgcctcaacacaatactatttacagcaattatggtcaacaacaaccacctcaacaacaacaacaacaatcgcctccagttgctcagtatggacagccttattatccacaaacagattcttacaatagcttgatgggtcaaactccacagtatccacagccaacttttggccaaagccaacatttctatcaaaatgcatacaaccaaccagtgcaaccccaatatgagccagcataccaaccacctcaacaatacaaccagtatcaacaacaaccccaagaacaacaacaacaacaacagttcaaccctaatatgccaaatgcacaaacgcaacaacaggttgaccctgcacaattagagcacttacaaagattacttttacagcatctacaaaacaatcagaatcaataccaacatccacctcaataa

SEQ ID NO: 1217 - DNA, 2040 bp, Candida albicans
caagaaatttgtgaatggttttcaatagatgattttaaatcacttggtgggttaaataatcttattctaaattatactaatgaccttaacaacaacaacaacaaagcaagtataactgaattgatacaaaatttacacgccaaccacaaaattgatgatctatctactaatacattacaaacaatattatattatagttttggtgaatatggtgataaaaaatctaaatcagatcaacttgatagtattaaacgaaataatttacaactcataaatgataaactatatcaaccattaattaatataattcaaaatttctttaatgatagaatatctcatgataaagctacaaccaatcacccagaatcatccacattatcaataagacaacaagaaccaatttattttattatacttacattaatgtattttatgattaatgttagtttatcaattgatcatgataacaatactattattagaagtgagtttaagaaatatttgaaagaaacagattttttaacttcattattaacatttattgaacattggaaatggcatcctaataattgttatcgtataagatatttaatattaatggttaataaactcatttttttagaattgggtgattcaaatcatatgaaacaatgtgatgaatttttagtcaaattacatcacgttaaaaataaaccaacaaaagaatcactggaatcaaatttaacttgttcaccattagattattttgttttccgacaagatttaattgataaatatccactttatgatgaaactgaattaaaaccttatgatttccgtaatttaaaaaagtcgttggataatgatgatgatactacaagtgacacatcaagtattcatagtcattctagtactattgaaggaaagtataaatattttatggcattacacaattcatccaattctctttctaatttaattgaaactcccaagactaataaatcacatactattttcggtcaattacctactcaaacagtacatttagctactccagtaccttcaccaactttggcagcatcagattatatgtctggtggagaaaaaattcgtaaatcatatcaagttaatcaagccatgcccatgatttatcctattactaacaattataacggtgatggcgttataccattagcaatgagagaagccgatgaaatattgagaaaatctatttatgaaagttattctattaaaagattatggaatgaacgagattattttatgaaacaagtacggggatatgcagatgggtatgataaaactaccaaaaatgatgatgatgatgatgatgatgataatgatgaatttgattataattttaatgaattgagacaaaatattcttgaaaaaactctggtgattgatactttagaaagaattgacactttatattcacaatatttatgtcgattgaatactatagttgaagtttttattgaaaccattaaagtgaatcgattagattataatttaaattttgcagaattggaattatattcaaaaaccaagtctggtcatcgtgatgaaacaattcaaaaaaaaattgaaatggtattaatactgcaattggaagttaataatgccaaagaattaacgttaaaagccacttcaagtttaattttaaatttattaaaatggtttaaaataagtcatatattgaaatcatattatttttcatcattattatttgatcaacaattttttgcaatttctttagaatatcttagtagatgttttaataatgctaatttacaaagtatgattactactactaattctagacaaaaaaaggatgaattaactgaatatgaaatatttattaatcaaaataaattaatgaatcccaaaatatcattaccaaatgggaattttttcgataattgtttatgtttatcattaacccatcaagaagttaaatacaacgattttaattttattaataaaattttcatactgtcattacttgataaatttgattctaataatattgttttcatccat

SEQ ID NO: 1218 - DNA, 459 bp, Candida albicans
tcccgtggtgaagatattttgagtgatatattaaatattactaacaaaatattaattaaaaatcaatcacaacgaatatttacatttaatgatttaaaaccttcagaattatataaaatgatattaattaattatgattgtcaatcatttaataaaccaatattgaaaactttgaaaaaattaataccttatcaaggtcgaaaatggaaatcttctaatatggatttaattagtcaaatttatttaaatttaaaattatcaatgaaagataattggttgagtggtaaagatttagaaagtgatttcaataattcttatgatcaagaaattgctcttagaggtttattacaattttataatatgagaaattatcctttacaaatgaataaaattggttatagaattaatcatgatataatgaatattcctcaattggatttaaatgatatgaatatatat

SEQ ID NO: 1219 - DNA, 804 bp, Candida albicans
actccacctttcttcaatatctcattgctttttgttttagttttccctcctcccccccccccccctttttctaaaatgactactactggtagtgaaaaacaggtcattttagtggcccttggtggtgcgtcatcttctggtaaaactactgttgcaaaagcactcaagctattaattcctagctctgttctaatacatttggatgacttttactttacagattccgatatccccattgatccagagaccggatatcaaaattgggattgcccggaagccatagactttgatagatttagagaatgtcttcagaatataagaaagggtgtatttacaagtatcaattcaatagagccaagtgaagcagatttgaagttactgaagcaagaagaaactcattttgcaaaagagattgaagataagagtcacaagtttggcaaaaagagaatagtttttgtggatgggtttatgttattccatgatcccagtattattaagttatttgatataaaattgttctttcatgcgcctttcgatactttgaagtccagaagagaagccagaaaaggttatactactgcagagggattttgggttgatcctcctaattacttttcgaaaattgtgtggccagcgtatgtcaagagtcacgcatatttgtatcagggggagaaggtagacagcaatgaattggaacagtcaattgttgaaaagtatgatctagttgatgtggataataatgacagcactagtctttatgcacttgtagagacgtcattatcatcaattattaatcacttatag

SEQ ID NO: 1220 - DNA, 1263 bp, Candida albicans
tttgcctcattgtcaggtgcaagagttgttagaatcgctacaaaccccgaatactctggtatgggttatgggtctagagcaatggaattattgagggactattactccggtaagtttaccgatatcagtgaatccaccgaattgaatgatcacacaattacaagagtcactgatagcgaattggccaacgcatcactaaaagatgaaattaagttgagagacgttaagacattacctccgttgttattgaaattatcagaaaaagccccttactacttgcactacttgggtgtctcttatggtttcacgtctcaattacacaaattctggaagaaagcagggttcactccagtttatttgagacaaacacctaatgaattaactggggaacatacttcggttgttataagtgttttaccaggaagagaagataaatggttacatgaattctcgaaagatttccacaaaagatttttgagtttgttatcatatgaattcaaaaaattccaggcttcccaagctttaagcattattgaagctgcagagcaaggcgaaggtgatgaaactactagtcaaaaattaaccaaagaacaattagatctgttgttgtctccatttgatttaaagagattggactcgtatgccaataatttattggattatcatgtaattgttgatatgttaccactaatctcccaattgtttttttcaaaaaaaactgggcaagatatcagtttatcatcagttcaatctgccattttattggctattgggttgcagcataaagacatggaccagatagcaaaagagttgaacttaccaacgaaccaagccatggcaatgtttgctaaaattattcgtaaattctcaacctatttcagaaaagttctcagtaaagcaattgaagaaagtatgccagatttagaagatgagaatgtcgacgccatgaatggtaaggaaacggaacaaatcgattataaagccattgagcagaaattgcaagatgacttggaagaggctggtgatgaggcaataaaagaaatgagagaaaaacaacgtgaattgattaatgctcttaatttagataaatatgctattgcagaagatgctgaatgggatgaaaaatcaatggataaagctactaagggaaaaggtaatgttgttagtattaagagtgggaaaaggaaatctaaagaaaatgctaatgatatttatgagaaagaaatgaaagcagttaagaaatcaaagaaatcaaaaaaataa

SEQ ID NO: 1221 - DNA, 1869 bp, Candida albicans
atcatgggtaaaaaagcaattgatgcacgtattcctgccttgatacgtaatggcgttcaagaaaagcaaagatcttttttcatcattgtgggtgataaagctcgtaatcaattaccaaacttgcattatttgatgatgagtgctgatttgaagatgaataagtcagtattatgggcatacaagaaaaaattattaggcttcacctcccacagacagaagcgtgaagcaaaaattaagaaagacataaagcgtggaattagagaagtcaacgaacaagatccttttgaagcatttatatctaatcaacatatcagatatgtttactacaaagaaactgaaaaaatcttgggtaacacttacggaatgtgtattctacaagattttgaagccatcacccctaatttgttggctagaacaattgaaacagtcgaaggtggtggattagttgttatcttgctcaagaatatgacatcattgaagcagttatatactatgtccatggatatacattcaagatacagaactgaagcacatgatgatgttgttgccagattcaatgaaagattcttactttctttagggtcttgcgaaaattgtttagttgttgatgatgaattgaatgtcttacctatttcagggggcaaacatgttaaaccattgccacctaaagacgacgacgaattgactcctaatgccaaggaattaaaggagttgaaagagagtcttgctgacgtacaacctgctgggtcattagtggccttgtccaaaactataaatcaagcacaagcaattttgacttttattgatgtcatctcagaaaagacattgagaaatacagtcacattaactgcaggaagaggtcgtggtaaatctgctgctttaggtattgctattgctgcagctatttcccatggatattccaatatttttgttacttcaccatcacctgaaaacttgaagacattgtttgaatttattttcaaaggttttgatgcattaggatataccgaacatatggattatgacattattcagtctactaatccatctttcaacaaagctattgtcagagttgatgttaaaagagaacacagacaaacgattcagtacatttctccaaatgatagtcatgttttaggacaagcagaattattgattatcgatgaagcagcagccataccacttccaatcgtgaaaaaattgatggggccctatttgatttttatggcttctaccattaatgggtatgaaggtactggaagatcattatcattgaaattgattcaacaattgagaactcagtccaataatgcaacaccttcagaaactaccgtggtatccagagataagaaatccaatgaaattactggagctttgactagaacattgaaagaagttgtattggatgagcctattagatatgcaccaggcgaccctattgaaaaatggttaaataaattgctttgtcttgatgtttcattatctaaaaatgccaagtttgcaacaaagggcactccacatccatctcagtgtcaacttttctatgtaaatagagatactttgttctcctatcaccctgtctctgaagcattcttacaaaagatgatggcattgtatgttgcttctcattacaaaaattcacctaatgatttacaattgatgagtgatgctccagcacatcagttattcgtgttgttacctccaatagaggcaggtgataatagagtacctgacccattgtgtgttattcaattagcattggagggtgaaatatccaaagaaagtgtaagaaaatctttatctcgtggacaaagagccggaggggatttgataccttggttaatctcacaacaattccaagacgaataa

SEQ ID NO: 1222 - DNA, 396 bp, Candida albicans
gaagacaaattgtcttttttttttttcatatttttccacaaaacttcaacttgcttttcttttttaaatcctcagttgtacattaatcagattgttcacatgggtaaaaaagcaattgatgcacgtattcctgccttgatacgtaatggcgttcaagaaaagcaaagatcttttttcatcattgtgggtgataaagctcgtaatcaattaccaaacttgcattatttgatgatgagtgctgatttgaagatgaataagtcagtattatgggcatacaagaaaaaattattaggcttcacctcccacagacagaagcgtgaagcaaaaattaagaaagacataaagcgtggaattagagaatccaagttcttcacctcggcgtggcgatccacctaa

SEQ ID NO: 1223 - DNA, 621 bp, Candida albicans
catattgtcccaattttagcttttttttcttctttttttactacctatccaccaacaatgaaagctgctgttgtatcaaatcctgtcgaacctactaaattgacagaagtcaaagaaattcccaaacctaaaattcaagataatgaaattttaatcaaagcaaaggcatatgccatcaatccgacagactggaaacacattgtctttaaaatgagcaagcctggtgatgttgccggtagtgatgcaagtggcattgttgaggaagttggatctcaagttacaaacttcaaaaaaggtgacaatgtcagctctcttgtgattggtaatgtctctcctgataatggggcatttgctgaatactttgttgccaaacctcaagcaacaatcaagtatgatcacgatttggtatcctcactggaatctaaatcttctacaattgattcttttgaaggggctgcaagtgttaccgttggtttggttaccgttggaatttcatttgctcattccttgaacattgccaaaaataaggagaagggtgattcgattttgatctggggtggtgctactgctactggtattttggccatccaagttgccaaattggtttacattcttcaccac

SEQ ID NO: 1224 - DNA, 1161 bp, Candida albicans
attggttcatattttccaagatatatatatcagcgtcaatttcttcacattcttggatacttgtttgaacaggcactaactatcatgaaggccgctgttgttccaatttccattaaggataactatttaactgaaattaaagatatcccaaaaccggaaatcaaagatgatcaaatcttaatcaaagctaaagcttgtgccatcaatccaattgattggaaacatatcgtttaccaaatgagtaaaccaggtgatgtacctggaagtgatgttagtggaattgttgaacaagttggggccaatgtgacaaattttaaaaagggggatttggtaagttcatttgtaatggggaatatgtcaccaatgagtggtgcatttgccgaatatgttgctgcatttcctcaagccactattaagtatgatcacgatttagataacccaccaaaggcaaaagcttccatgattgattcatttgaaggtgcagcgagtattactatgggattgacaactgttgctcaatcattttcacattctttgaatataccaaaacataagaaaccaggtgattccattttgatttggagtggtgctactgcaactggtattgtagcaatccaagttgcaaaattagtttataatttaaaggttatcactactgcctcaccaagaaatcatgaatatttgaaagagttaggggctgatttcacattggattataaagatcctaaaattgttgacaaattgaaactgcttggacacatcaaatttgggttggatacaattgctactccacagacatttcaaaaactttatgatgccacacaaggtactcctgaagtttatttggattccttattaggaatggatggtaattctatcaagacggatcccgcaagagaaactactgttcattgggggcatactatgggttatctttgtgttcttaaaacgaaaactttaggctcaactacatatgtccaatcaacagagttgttgaatgattataataaatggtgggaaaatgtcatgccaacgattattgataaaataaaacatgcaaatttaaagattttacccaatggattggaatcagccaatgaagggttacaaatgtcaagagagagtaaagtttctggagagaagattgtttttaaaatttaa

SEQ ID NO: 1225 - DNA, 1128 bp, Candida albicans
catattgtcccaattttagcttttttttcttctttttttactacctatccaccaacaatgaaagctgctgttgtatcaaatcctgtcgaacctactaaattgacagaagtcaaagaaattcccaaacctaaaattcaagacaatgaaattttagtcaaagcaaaggcatatgccatcaatccgacagactggaaacacattgtctttaaaatgagccagcctggtgatgttgccggtagtgatgcaagtggcattgttgaagaagttggatctcaagttacaaacttcaaaaaaggtgacaatgtcagctctcttgtgattggtaatgtctctcctgataatggggcatttgctgaatactttgttgccaaacctcaagcaacaatcaagtatgatcacgatttggtatcctcactggaatctaaatcttctacaattgattcttttgaaggggctgcaagtgttaccgttggtttggttaccgttggaatttcatttgctcattccttgaacattgccaaaaataaggagaagggtgattcgattttgatctggggtggtgctactgctactggtattttggccatccaagttgccaaattggtttacaacttgaatgttatcgtcaccgcctctcctaagaatcatgagtatttgaaagacttgggtgctgaccatactttagattataatgacgccgatgtggttctgaaattacaactgcttggacatataaagtttggtttggacacaattagtaataaagatacctttcagaaactctatgatgcaactgcaggcacaccagaagttttcttggactcattgttgcttctcgatggcaagtcgatcaaaactgaccctgcaagaaatgttcattggggctacactttagggtaccttgttgttcaaaaggaaaaagtcttggggacccaaaagttggtacaaacaccagaattggtcaatgactttaatgcttggtgggaaaatgtcttgcctacaattatcaacaaagtcaagcatgccaatttgaagattttagatgaaggcttggcttctgctaatgaaggattgcaattgtcaagagacaacaaagtttctgggcagaagattgtgtttcgagcttaa

SEQ ID NO: 1226 - DNA, 1005 bp, Candida albicans
  unsure (85): Identity of nucleotide sequences at the above locations are unknown.
gaatatgaaatattaatcaaagcagtagcttttgctataaacccaactgattggaaacacattgtttatcaattgggcagcccangtgatgttgttggttgcgatgttagtgggaacattgaagaagtgggttctcaagtaactgggttgccaaaaggtgacactgtaaatgcttttataactggtaatagatcacctcccactggagcttttgcagaatatgtagctgttgatcctgctactttgataagtaacaataggaattttgaacatgtgactaatttacaagtatctgaaatccactcatttgaaggggcagcaagtattaatttaggtttggttaccgttgggctttcattttctcattacttacaaattgacaacaaaaagcaacctggggatagtattttgatttggggaggagcaactgcaactggagttctagccattcaggttgccaaactagtgtataacctcaaagtgatcaccacagcatcacccaaaaaccacaccctcttgaaacaattaggggcagattatgttttcgattatggagacgctgatgttgtcaataaaattaagaatattggccaaattaaatttgctcttgatacgattgcaacaccagaaacgtttcaaaaagtttacgactcaacagaggggtctcaagaagtatttattgattccttagcaggtttagactatcgatcaatcgctgccaatgattccagaggagatcaagtacattgggggcacactattgcttgtttggcatctttaaaagagaaaactgtgtttaatgaaaattatgttcaaacacctgaattgttagatgattttactcagtggtggcaaaaggtggtccctcaaataattgatcgtattaaacatacaaatttaaagttattaaatgaaggattagactccgtaagtgaagggttagaattgtctagaaataataaactctctgctgaaaaggttgtatttagagttctgggtctgtga

SEQ ID NO: 1227 - DNA, 1110 bp, Candida albicans
tttttgttgttgttgttcagcaatatctactttatttattggtttttatgtttatatgatactaacttgtctttgtttgctttagtcatgaactccgatataccacctccaccaccacctccagaatatacccagtcccatgaagatttaccagagtacacttcgtcgttgaactattatggattatcattgattaaaacagaattcataaccccatatcaatacaatagcggtaaccgttcctggaaaccagtattgcttgaattgaactctactcaattgaaaatatacaacttgaacattgataagaaactacaagatttgctaatatgtttatattttgaattaaattgtttagatcaattaactaaagacatcaattctcattataaaaagagtaaaggttttgactttagtgaattatcgtctaatgatgccgacgatgtcggcgatttgttttccggtgatgcatatggtggtactgatagctccaagttatctttaaatgattccaagtttggcaaattgaaaaacaaattgagaaatcaaaaatctaataaaaccttgcaatcaataaaagctcattacgatgaattaaaagataacaaatttttctttgaaccaacatcctcaacaaaggaatataaccaattcgctaaaaagtatagaggtaatttgttgcactgttattctttggcaaacttgcagattggggaagcaccttcgttgaaccaaataatttcagcaatctacaaggaagagcataatggcaacaccaacaattcatcactcgtcaaatacaaaaacacattgcgtcttcgaattgaatataaacaaatcttacttcaattttggtctttctacggtatgatcagttggtttaggaatttcaccattggaagagatttgagtgtacccgtcgaagcaagacatgtatcgaaactcaaatctataccctcaagaaacactagtcaaaacaatgcattattggccgctactgccgcagctgcaaactatggaagaaacagagccaatactccagttgacggtgtcgaagaagacatatccatgtttcggtccaactatttgatacttttcaacagacagtag

SEQ ID NO: 1228 - DNA, 606 bp, Candida albicans
tttttgttgttgttgttcagcaatatctactttatttattggtttttatgtttatatgatactaacttgtctttgtttgctttagtcatgaactccgatatcccacctccaccaccacctccagaatattcccagtcccatgaagatttaccagcatacacttcgtcgttgaactattatggattatcattgattaaaacagaattcataaccccatatcaatacaatagcggtaaccgttcctggaaaccagtattgcttgaattgaactctactcaattgaaaatatacaacttgaacattgataagaaactacaagatttgctaatatgtttatattttgaattaaattgtttagatcaattaactaaagacatcaattctcattataaaaagagtaaaggttttgactttagtgaattatcgtctaatgatgccgacgatgtcggcgaattgttttccggtgatgcatatggtggtactgatagctccaagttatctttaaatgattccaagtttggcaaattgaaaaacaaattgaaaaattcaaaatctaataaaaccttggaatcaataaaagctcattacgatgaatttaaaagataa

SEQ ID NO: 1229 - DNA, 231 bp, Candida albicans
gaaagaagatcaagacaacaacaacaatacagaagaagaactaacaattctaatgcaccaaaacaggaaggtccaaaaagagaagctattttggatttaaataaatataaagatcaaaaaataagggtgaaatttattggaggaagagaagtagttggaattttaaaaggatttgatcaattgatgaatttggtattggagaatgtaacagaaacacttagaggtatgtaa

SEQ ID NO: 1230 - DNA, 873 bp, Candida albicans
tttttattttccttccacctttatacatttgttttcttgttttttttttttcaaataaaaaatagcattagacgacttaatatcatgtatcctagtttaaatggttccaatattggaagtataagtaatgaagatgataatgatcacactgccacagctgatggaactttagttgttatggtaatacgagctaaacatttacccaatcggcgtaaattagataaacaatcaccatatgttgttgcaagaattggaactgttgctaaaaagactctggcagcatttcgagcgggacaaaccccagaatggactcatgaaatgagatttgaattatcacgagagaggaaaccaattttaaaaattgatgtattggatgaaacgaaaaatgatcctacaccgattggaaatgttgaaattgatgcatcaataatatttactaatccggaaaataatgaaaatgggaaatatatttatgataaatggtatgatttgacattgaatggtagaagagccggaatgatttatttggaaatgacattttatccaacggcaccggttttacctccaaaaatccctattgatcaccctgaagaaatggtggttgttaatgaacaagatcaatatgataccgtttcggcaatgggacaaagtatgagatcaatgaattcatccaaatataaagatttacctagtcctccgcttaaccaacaacagcagcaatcatatttatcaaaactggaaggaaatcatagtgttgctgatgatgttttcgttaatctggaaaattcaaatactagtaagacatcatcgatatttctgaaaaagttctccaaatatagtggtggtgttacttcaacaaatagtactaatata

SEQ ID NO: 1231 - DNA, 423 bp, Candida albicans
tttccatccaacaacaaccttaccacaatcatggagttgctaccatcaggacaagccaacacttccacagaggttacatatgaatatcaattaaaaatcaataagttttccacgttgatatcccagaaagatgaacaaacccagcaactatccacattgaaaacagaaaaggaataccttgatgatttatccattgaattagagttgatcgatgatgatgaaaaaatacaatataaagtcggtgattgttttgtattcttacctaaggatcaagtgttggagaaaatagaatcagatactgatagtttggaggaaaagataaatagtattgaagaattgattgatgggtttgatgaagaattgaaggacttgaaagctcaattatatgacaagtttggtgacaatataaatttggaacgataa

SEQ ID NO: 1232 - DNA, 963 bp, Candida albicans
caacagacaacagacagacgacacccgaatttcaatatgtcatcaggggtaaccaatttatttattgataaatctcaacgaccaaatcaagatgaacaaggattaatagatattggtaaaaattgtcaatattgtaatcaattagattttttaccatttatatgtgaattttgtaaaaaaacattttgttcacaacatcgaaccattgaacaacatcaatgtattgccaaaaataaatttttcaatcaacataaatcaagatcatctagtcctgatgaatcagataatggtggtggtggtggtactattatttcttcgaaaagtttatttccggatcgaaatgctgataaacggaaattagaagcaaaattgaattctatcaatccaataagaccaacaacaattaaagaaactcaatttagagttggagatgtatctattagtggatcttccaatgcatttaagaaatttcaaaaatttctaaccaaccaaaagaagaacaagaagagtggtactaccaatgggggtaattcaattacatcaaaattatttggtggtaaatcaagtaagaccagtagtaataataaattcattgatattgctaatttgaaaaagaatgctaaaggtgataataaaatcattatgaatgatagaatctatatttggtgtatatatgtggaaaatcctgatttacaaatatctattgataaagataaaaaaccggtatttatatcgaaaaattgggttgtcggaagatcacttgattcaattgctgataatttacatattcaaaataaaaataatgttactaatgaatcactggagaaattaaatatttttaaattggaagataataatggtagtagtggtgttgatggagaaccaaaattaatatcaacatctttaaaatcaactgtttttaaaactggtgatacaatatatttagttagaggaacaatataa

SEQ ID NO: 1233 - DNA, 1023 bp, Candida albicans
aatttatttattaaaatggctgaattaagaaaaattgcactttcaaattcaaatcttaaaaatatggcatcaccttcgtcatcaacacctggttcttctggagcttcaagtcctcaaggtaatggcatggccaaaacagattcattggtaaatttgactcaaccagaattatatggaatttttcgtaatgattcaaatactagtcttagtaaagaatttgaagaagattcagcagaaattgaattcaaagttaattcaagattaaataaatcaactgctactactactacttcttcttcttcttcctcagaagctaaatattccaaaaatgaagactttgagaagtatttaccattgccactaaaaattgttgttttaactttagcatcatttatttataatgaagttactagtcaaatcaatttcaatcacactcaatcaaattaccccttgacaattaaacatttatttaaaattagttcttatattcatttggatgaatatctcgcgtttgttggtcaaagtaaatatggtcatttaattgatgaaacatttgccttgatgatccaaggattagtaatggcaagtttccatccaattttagattattatttacctaaatctttaacgaaaagattattatcatctaatccaaacccaagttcgtcaacaagttattcgactttaatcaatgatttgattcgttcatcagtggcattcttgggtgtcagttatgccattcgtaacattgaatggtcatcatttttacaagttgccatcatttattcattggttagtcctggattgtggttattactcgatggaactatttctggtcttattggatcattagtagtgtcaattgcagcttgtagtgttgtttattatcagaattatcaatatttaaacggtgttggtgatgcttccccagtggaattggttgcaatttggttatggattggtagttttgtttttggtggtcttatagtttttggtaaactcggtagatttttatttcaataa

SEQ ID NO: 1234 - DNA, 411 bp, Candida albicans
cataaaggagtaaattcaatcatgtcatatagtgaagaagatcctttgagtgaaccaaagaacactcaacaattggatttgtctaaattatcaccacaggaattaagaatctataaaatgtacgggaaattacccactacccaacagatcttatcatccaaattccaagataagaaatattttgacagtggagattatgctatgcagaagcaaatgggaggtggtttaaagagtggcatacctggtggaatgtctatgaagcatccaaatgccgaaagaatgaaagaaatgtcagttcgaaattcaattagcgcaacaaacgcccaagtgcttttgaatggaaaatcgggattattaaatgaaagaactgttggaaaagatgacaatggagaggagcagaataaacaatag

SEQ ID NO: 1235 - DNA, 1110 bp, Candida albicans
aacaaccttatcaatacaatgccagagactgaagttataaacaattctaccacaaataaccttgatgaaaacaacgccagctcaagtataactccagaaaataaaattacaaatccaacggactcttcaataattgaggattctaataataataacaacaacaacacaagtaaattatcattaccatcgccttcgatttcttcaatttcctctcttgacagtaacaattccacggaaaaacttataaacagtctagccaatagcagtttaaatgaaaccaagaccaacgaaaaagtcagtgaagattcaactaacaagtcaacattgattatcacacaattagatcctgaaacattaagtgaatccgagaagagacagttacaaagacaaaacagaataccccagtcatttcactccaaaaccaagttttatgatgagttatcacaagcttcagtggatgtggtgccaaccactacacaagaatcagttgcagtatccgtgcaacgaccaccagaacaaaaaccaatagatgggtcagaaccaggaacaacagagagtaataccttcatagcattaccaaagaaaatcaaaaaattcactgtgcgtaaaatatcgaaccccgaagcaataacttctccaacttcatcacttaatccaagcaaagagccactaagacaaccaaagttttcaccaacaaatacgaaatttaatgttactcctcatgtatctcctatagtttcctacctggagaataaatcccaaggtcaatcacaatcaaggaaaagtagtgttaatagtaatggtgatagccaaaaacataaacaccaacaagaattgcataagttgcgaaaaattgaagagaaatacgatcaatatgaacttcgaattgaaaaaattgataaggaaattgcttatttgaaaaaattactaccaccttataatgttcaaattgattataatactagagttaaaatcaataaagcaattgaaaaattgagtatgaaaaaagatgaaattgacaagaaaaaatatgatttggggattacgataagtcgattatggagaaatttgggagatgggaaagaaatctgggttcggaaatttgattaa

SEQ ID NO: 1236 - DNA, 879 bp, Candida albicans
acaatgaataagttttcgataataactagacctttgtttagatctagtcgtcacataggagtttttgttccaatacagagatttctttcaaccacatctcctagactttctaatttacttggtgaagtgacaaagatcgattccgaaccaccaatcacaaccaccagcaaatccaccaccacatcatcatcagaagataataaagatatttccaaaatcactccagaaaatgatgaagaattaattgaatatcatgcgaaaaatgctgaatccaaacaattcaaaattgaaaaatatattcatccattgaaattacaattatataatgaaaatatatctcaatttggatttttcaaaaatggacaaatcatgaatcataatggtaaaaaattacgtttcacattaacaccacaagaaattgatattttggaaccatctatttatttaaccagttatcgtattaaatcatctatgaaaaaagccactattgttaatcgtatggttcgtaaattcaatgttaaattagccatcaatcaattacatttcaaccataagaagatatctacagaattagaacaattattgaaaagagggttagaacaagctaaacaattagaattgaatgaagatgaattatatattgatagaatttggattggtagtgatggtaaatggaggaaaagattagatccaaaaggtagaggtagaatggggatcattgctcatagatatgttcatttgaaatgtattttgaaaactaatcaaaccaaattaagattggattgggagaagcaacaaaaggaattgaaaagtaaaccaagaatgtttttgaatgatgaacctttaaatcttaaagttagaccttggtataagtggtaa

SEQ ID NO: 1237 - DNA, 1512 bp, Candida albicans
gacaatgaaaggacaagaagaacaaaaaggcaaccaatttgtgaacaaattcccacctccaatacagcatttttcttcactcttgatataccaattatgccagtgaattttttaactagtgttgtgtttgatgggccagaggtgattccatattgggaccaaatcaaagaatatggacctaccgttcttcccattctattaactcttgctggggccaagtattatttccatggtgccaccaatacgtgggagcgagacatgcatgggaaagtgtttatgattactggtgcgaccagtggtattggagctcaaatagcatatgaattgggacaacgaggagcacaactaatactacttactagaagaaccaatgatcaatgggtggctgagtatattgaagatttacgtgataaaactaataatggtttgatatatgccgaagaatgtgatttgagttcactttattcaatcagaaagtttgccacaagatggcttgataaccaaccaccaagaagattagatggagtcatttgttgtgctgctgaatgtatcccacgaggaaaatccagacaaataactatggatggagttgaacgacaaatcggtattaattatttggctcatttccatttgttgactttattgggtccatcactaagggttcaacctcctgatagaaatgtacgggtgttgattgcaacatgttcgtcgcaaaatttgggagatgttgatttaaacgatttattgtggagtaacaagaggtatccagcaactcagccatggaaggtatatggaacatcgaaattacttttagggttatttgccaaagagtatcaaagacagttgatgggatatgagcgtaaagataaggccccttgtaatgttcgtatcaatttaatcaaccctggtattgttagaacaccgtcaacaagaagatttttgtctttgggcactgtatggggattgattatctatttgatcttattcccgatctggtggttgtttttcaaaagtgctgagcaaggtactcaatcattttactttgcgttatttgctcctattttcatgaaaatcgaaggtggtaacgtggtacaagaatgtaaaataatgactaaagttagaaaagaatatactgatgatgacttgcaacaaaaagttttccacaacactgaagaattaatcaaacaaattgaaacaaaatcagctattgaacgtaaaaaacatgaaaacgctaaaaagactccagaacaaaaagccaaggaaaggcaagaggaattgaatagaaagagggatttgcatattaaaccagaaactccggaggaactagaactgaaattaaatctgttgagaaatcaaattggtatggggactggtattctgtctaatgaaatgccattgttccccgatgacgaaactctcaagaaggtgatcagttccaagaagaatgctagtagtaataatagtggtggtctgaaatcaaataagagtcaaaagaaatctaaaaaagtatag

SEQ ID NO: 1238 - DNA, 1698 bp, Candida albicans
agaaaaatgctgtattggaggtgggaatttgttcacaaattggttgcctttttgttcttcttgtcctttcattgtctcagtgctaacatactttgggatgtatgtattgaaaaaaaaaaaaatatagtacaatttctagtccttgttgtcccactcatctcatcgctctcttataaattcacaaacatggatgaagtagtattttacatagctcaaggtgatccagctgataaacacagtcaagaatcatatggatatgttacatcaatccattcttccaaacaatatgcatcttatcgacaagcagattcgcatataaacggtactacggtaactggtattggtccgggagaaagaattttcactgctgttcctaacaaagcattaatcaatgtatattcatggggaaaagaaagtgttgatcaacgtataccgataccagaagcattgacttgtatcacgttgataaaccatccaaatggcagcaacagtgacaatgatgacaaccagttatacaaattaccaaattaccgagttccttggttgttagcaggtggatcaaagagtgggaaattgtacatttgggaattaagttcaggcaatttattatgtgtcagagatgcccattatcaggggattactaccatcaagggttcaagctgtggaacatttttaattaccggaggagaggatgccagatgtcttgtatggaatttagcagaattaattagtatttatgacaaatcagaccatcaagtgaaaccatattggcaaatcactgataacacattaccactcactgatctttgtttaaatgatactcataacattaatgatctaaaattatatacaacttcaaaagacagcacggtcaggatttatgatatagtcacaaagagtttgttaaccacatttattttacccagttccgctgaatgtatcaccaaggatccagctaatagagcgttatatgtcgggttgaataacggtcttgtaagatcaattcctttatattctataaatagccatacatcagtgttggaaagtattggcggcatgaataagataatcacggttgatgctgatcaaaatttaaaagagacatttgttgcacatcaacaaaagacgaaaacaggagacgataagcctgttgttgttacgaaattgacaatttcttttgatggtacaagtataatatctggtgattctgaaggcagagtgtttgtgtctgacattgtaacgaaacaagttgtgaaatcattcacaccttgtaactctccaatagcttatattgctgttgaaactatccctgatgactttgtcaataacttagctactagtactaccactaataaagctgacaagaaacatagaatgatacctcaatttaaacgagtactagcaagcaccaattctgaagaacatcagatattcttggacattcctggtaaaaccaccgcaaccaccaacgcaaccggcaatattgactttgcaacttggttacaaagcaaacaatctgaagaattacaattcaaaaacctttctggaataaactctattgtcaaacaagttggcaacgagaatgtatcggatctcgaagagagattacaaagagtttctcaagcatacactgaattaagaaacaaacatgaagaattaattaaagaacatgccaaattattagataaattagaatag

SEQ ID NO: 1239 - DNA, 351 bp, Candida albicans
ctggccgttaagggtggtgaaaaagatcacggtaaagcttatactgtcaccaaatatgtcactgaaactacccacagatacggtcgttttgacaaaaccagtagatctaaaaagccaaaggaaactggtactcacagatacggtaaattcaacaagactccacgtccagttaccacaactgtcttggtcaaagaaagcgaccttccaaagaaaagagatgctgttgttgctagagattctaaaaacgcttcttccaactataccacctctagtggtaacaatggtgtcgccactggtgtcagcttgggtcttgctggtgtcttagctgttggtgctgctttggtcatctaa

SEQ ID NO: 1240 - DNA, 537 bp, Candida albicans
  unsure (21),(54),(67): Identity of nucleotide sequences at the above locations are unknown.
ctttccccgggaggtactttngtattgtcggtagaccctgtgaggagtgctgtngggacatattcanaaatccgtcatccttgtatatttaaagccataactccagcatggaacaatgtcaatttgaataatttagccgaatgtactgaatctagtcttgtatttgctcatgtaagagcatctacgcaaggtgtattagcagaaactaattgtcaccccttttcatatgggaaaatcatgtttatgcataatggaggtgtatcagcttttaatttaattaaaaagaaattgatcaatcatttagaagataaatttttcctacatattcaaggatcaaccgattcagaatgttgtccagcattatttgttgatacattatataaaatgggttatgatccagaagatttatcagttaaattttcccattcaattcttcgtaaggcattattgacaacgatagatttgattaaaacgtggcaatgtcaagtcaccaatgatccttccttgttgaattttgcagcaactgatggggaatcg

SEQ ID NO: 1241 - DNA, 1074 bp, Candida albicans
agacacttactaaacagtcagatggaagaactagagagatttgtaaatgatctacaaaatattgataccaataatttcagtggtggtgatatatacattggaaatggctcgagtggcagtgataaaacaaaacaggaagagcttacaagtgaggaagttgtccagccaacagacttgtttgaaactgtattgtcgtcatacaagttgattcaatcagtttatgagaatgcttcgtcaaatgatttgatacagacagttagtcaatcagttgcccctttgttacagataaatgataatgtggccaatgagttgatcataaagtacagcgaatcttcacatgtcaacagcatgataagcaatataacgttgaaggatgtaaatgagttgaagttggttaaattgaatcttctagcattggcagagacggatatatttagactgttggatatatggaaaaatgataatgaaatacctgaaacattaccagaaaagttcatggtggcatctgatagtgtacaagcattattggatagaaacgacataaatttattgacggtaaattcccaaggtacagaatctgataaagatacattctggaagattctcacttttcagaataacatgttgaaaagagcccaagagttgttgaatgagctgatgcaattacaaaaaaagagtaatttgcaactggaagatttgggtagtttaatagttcaagtgagtgaagtcattattgctagagctgatatagagttgcaaagaagtctgatcaacaactattcttcgtcagtggataatcatctggtattaatgaccaactgcaaaaatttattgaagaatgctattaacattgccagcttaaatggtggattgagggagagaatgatggtaaaaataaatcgcgagcaatgcaaattagaagctgtcttcagattatgcatcttggaaaataggaccagtattgaagagctagataaagtcatgacgagaaacaaatgggtcaatgaattgccaaatttgaaaaaactgggactttacgatgactttggattaaataagataattgtaccttga

SEQ ID NO: 1242 - DNA, 600 bp, Candida albicans
aatctggcttttcccttcatcagatggtggttgcataggaaataccataaacagaatttcaacatgagatttcgcagattacccaaaaaatcagaaattaaaaaagtgtatttaccatctactgctacggaatatttagagcagggatcaattgatgaagagtctggtgaaagatggttgggttcggatgtgagcaaatgtttgaggttttttaataaagcatactcgaactatatccaagccataaagttagatcccaagttattggatgcccattataattccgtgagattgttgttgcatacataccaaactttcaagagaataccgtcaggtcatgacattgcaattgaaaatgcatcattggaagtggtacaaaatatatcagacatacgaattgcttacgagaatagtttggaacgtgttcaacagttgggccaagtaccgaatgacttactatataactatgcgattgtttatctcgagtggctagagtcgcagcaagaagaacaagatgacgaaagtagcttgctggtgagttttgaacaggtagtagaggtatatgatagagtctcaccacggggctggaagttccgcgtc

SEQ ID NO: 1243 - DNA, 471 bp, Candida albicans
cgacgcggttttctacccgtggtgaagattaaacaattacaagatttaaatgttcctgaattaacaactttaactgaagtcaaacatttattagatctgagagattcaaaaattaaaatcatcattgattcaatttttggattttcatttaaaccaccaattcgtgaaccatttaaagatttaattaattatcttggacaaaatcatgatcatttaccaccgattgtttctgttgatattccttctggttgggatgttgatgaaggtccaggaaccgaaattgatattcaagcatcttgtttaattagtcttacagctccaaaaccatgtgctaaactttttgtaaatagtggtcctgataagattcattatttgggtggaagattcattaatcctcgtatagctaaagaatatggtattgaagatattgtcaataaataccaaggtgatgaattaattgtcaaattataa

SEQ ID NO: 1244 - DNA, 1347 bp, Candida albicans
acagaggaacgagaatgcaccaataaagaaaaacaaaaaaagaagaaaaaaaaaaattgtaaagacatctcttactctctctctcacctatcctcatcactggaacacacaccaattatgaagcttgacacttctcatatgaggtatttaacctcagacgattttagagttctacaagctatagaactaggatctcgtaatcatgagttagtgccaactcaaatgattcactccatcggagggttaaagtctccatcagcaacaaatcgagctataggtgatattgccaaattgaagttgatttcacgattgcgtaatgccaaatatgatgggtttcgtttaagttacaacgggtatgactatcttgcattaaaaagtatgctaaacagaaatacattatactcggttggtaccactattggggttggtaaggagtccgatatatactctgtcagtgacccagagggtgtacagaaggtgttaaagatccatcgtttgggtagaacgtctttcaaaacagtaaagaataaccgtgattatttgaaaaataaacaaacttcgaattggatgtatctttcccgtttggcggctgccaaggagtaccagtttatggaggttttgtataataatgggttcaatgtaccgcaaccatttgattactcgagacattgtgttatgatggaatggatcaaaggcatacccatgaaacatttgagacaacataagaattataaaaaattgtattctgatttgatggggttcattgttagattggctaaagctgggttgatacattgtgattttcacgagtttaatattcttattagggacgacaccgacggccatgagttagattttgttgttattgatttcccacaatgtgtttctatcgaacaccctgacgccaaagaatattttgatcgtgatgtgcaaggtatccgagactttttcagtaaaaaatttagatacaatccacagcatgacccaacaatgtttgacactgatggttacggagatgggtataaatacgcatatcctaatttcaagcgtgacgttattagagaaaagagtttggatgtggaagtgcaagcatcaggatatgcaaaaaagaagactggaaaccgcgaagataaggatttggaaaaggccgttttgggaatgcgaatcaaggttgacgaagatgatgatctttctgaaattgatgatgatgaagacgttgccaccgaagatgaagaggaagacgaagaagaagaagaagacgaagaagaagacgaagaagaagaagaagaattgtttgaagatgaggaagagttcgatgaacaggcagaggcagaagagaacgaatag

SEQ ID NO: 1245 - DNA, 525 bp, Candida albicans
ccaagcgtggttccttccagcccggtggtgaagacgattattgggattgatgtgtcgaaggatggtaggtggttacttgccacatgcaagacgtacttgttgttaattgataacaagatcagtgatggtcaaaagaatgctggcaagttggggtttacgaattatttcgacaaggacaagaagcccacgccaagacgacttgcgttaaagcccgagcacgaagcgtatatggtgagagagaatggagggaaacagttgctgtttacgcctgcgtatttcaatactggccgtgactctaaagaaactacaatcgtcacctcgttgggcaagtatgttgttacgtggtcgatgggcaaagtgttgttggacaaggagaacccgtatttggtgaagaggtacacgcaaaacgttattgctgataatttcaagtttgggtcgaacaacgaagtgattatggcgttacaggatgatgtttctatggtaagtagacgtagtttagctaacccaaagaatgtatttaagtaa

SEQ ID NO: 1246 - DNA, 1269 bp, Candida albicans
aagcgagtaaatttttttgcctccctgtttgcttctgtattctttttactggtagcaatgaattttatcaagaagtttattgggacgactactaccgatgaggttgcgctgattccgtcaggaaagctttatctcacacgttcaaaacaatccccaaagggggcaattgagtgtctctacaatgatgcgtttgcgtcaatcaaaaagacgaccagcccatactactatcaattgtgtatcaccaaagtttaccaagagggcgaagctgatttcaatagatttgatgattcagaagaggagtatgatggggaggagctggcacctacaaacgataccagacgccaatctaaagacgagtggattttccccattgccgatgaattgaagattcatgtttgtgagaaggaagatgggtcgagagctattgcatggaaggatgtgaatggcgatttgggcgataagtttgagtttgttattgatgaggaggtgaggggtagtgaagttgaagcatttgggatgaccatctacaagtgtttatttgaaaacaagtaccaaacaagctatgcaaaggtgaatgaccccaatcaattgaaggagtttatctataatcccaagggcgagttgttgacgtttgatgaactaaaggatttgaatgatttagaggagtatgagacagatgagtatgaggattgtgagacctcgccaattgacgcgccaaaaggagaaaccaagtatgctagcactgacgttgacttgcatttgtacgataccaggacaggaacatttattttacaccttgccaagccagattttgagttgaagttgatagatttgggcaattgggaatatacactttacatccatggcgagactacacggatcaacactacgttgagcaagaatatgaaccccacctttaattaccaacacttgtcgtttattttcaatgactatacggttgacgaaggcgggatcaatgcgtgttcgtggttggtcaagtttcctgattataatgacatgtcaaagtttcaaacggtgtttcttgggttgatgtatgagacgttgaatagacggaaatggggagaaacagaggagcacgattattttgttgatgcattttctcgggttagtattggtgatgccaaggatttggagagtgaggaagaagaagaaagtgaagaggaaaacgaaggcgatggtcctgtgaaatgggaaactgagaaaaacgaaaagaatagcagtttgactgtcgggtacgccacggacagt

SEQ ID NO: 1247 - DNA, 498 bp, Candida albicans
tttccaaaaatgataaaacaactattgatatcaccaagttgtaagatactaccaacaactagatttatatataattggtattcatgttattctacaaataaacctcgaaaatcaatagaaagtaatcaaaagaaatcaaccaccaccaccaccttcacaccaacacccacatccacttccacttcttcatcacaatctcaatctcctactactgatcaaatattatttgaacaatttcaaaaatcggttattaaaaatgatataaaacataatcccaataatcaaccattttggatgaaacgaaatcgaaccattaaatcaaagcatagtcattggaatccaactaaaaaattatcacgactggaaatgaataaattacgagaattgaaacaatatttcccacattttacaactgcagatttagggaaaattttccatatttctccagaatcagtacgaagaattttgaaaagtaaatatatccctgatgatgattga

SEQ ID NO: 1248 - DNA, 834 bp, Candida albicans
  unsure (184): Identity of nucleotide sequences at the above locations are unknown.
aaagttagtgaagaagaagaagacgaagatacagattctccacaaccagtatcgaaaccaataaaaaaatcaataaaattcacgatcaaaccacctaaaaaaccaaacaattactcaacttttagtggtagttcaaaaaccactaacgtctctcctgatcaatcaacacaaagagtaacgaganaaagacaagttagttattatcaagatgaagaagatgaatttgacgaagaagaagaagaagaagaagaagatgatgatgatgatgaagaagatgaagaaggatttgatcaagaagtgaaagtgattaaatccaataaattgaaaagattgaaacaaccatccaatgacaaaagaacttctgatcgtagacaaacatcatctacatcaagaactcgtaaagatcaaagacaaacattagatccagaattacttttaactgatgaagaagatgaatatgatccttctacatataatgatttatcaaaaatgacagaacgacaaagagctagatatgatggtgttggtggtgatgacaaaaataataataataaaaaaaaaactgaacaatttattgaattagatgatagtggtaaaaaggcaaaatcaaaacttgatcatgatcaacaacaacaagaagaagaaactgaagaagaaatagctttaagaagagctgaaaatgctcgaaaaagacaagattataaaaaaaaagtattagaagaagaaaaacgggataccttaaataaattattgaaacgaagagcaactaaatcacgagaaattattaatgaagcagataataaagatatcagccagccgctgcaaatcatcctc

SEQ ID NO: 1249 - DNA, 1002 bp, Candida albicans
tcacttatacacttgagcgggcgaccggccagccccgtggtgaagaccgaagatttggaagaagataattataaattgaaagctagtgaagaagaagaagacgaagatacagaatctccacaaccagtatcgaaaccaataaaaaaatcaataaaaatcacgatcaaaccacctaaaaaaccaaacaattactcaacttctagtggtagttcaaaaagcactaacgtctctcctgatcaatcaacacaaagagtaacgagaaaaagacaagttagttattatcaagatgaagatgaatttgacgaagaagaagaagatgatgatgatggtgaagaagatgaagaaggatttgatcaagaagtgaaagtgattaaatccaataaattgaaaagattgaaaaaaccatccaatgacaaaagaacttctgatcgtagacaaacatcatctacatcaagaactcgtaaagatcaaagacaaacattagatccagaattacttttaactgatgaagaagatgaatatgatccttctacatataatgatttatcaaaaatgacagaacgacaaagagctagatatgatggtgttggtgttggtggtgatgacaaaaataataataaaaaaaaaaaaactgaacaatttattgaattagatgatagtggtaaaaaggcaaaatcaaaacttgatcatgatcaacaacaacaagaagaagaaactgaagaagaaatagctttaagaagagctgaaaatgctcgaaaaaggcaagattataaaaaaaaagtattagaagaagaaaaacgggataccttaaataaattattgaaacgaagagcaactaaatcacgagaaattattaatgaagaagataataaagatggatctgatatgggaaataatgttctttataaaaaaaaaagaccaatgttggaacatccagcattcataagatatgttaataatacaacttcattaaatgggaattcagtattatcttataattga

SEQ ID NO: 1250 - DNA, 2040 bp, Candida albicans
ataatgactcaaagcaaagaagaacaatgtccaatatgctctaaatcatttcctgtgtcccaactttacaagcacgtaaattcatgtttagacaaccaggaaagtaaaaaatcacccagtgaagaggcatcagaagacacaagcgggaaagcagagaccccagcactgaagaaacgaaacacgcttagtgctttgggattgaaagcagacacctcctcgctgtcacagaaaaaggccaagaaaactgagactaaaaaaccaagtttgacgagtaaacttctcgagcagaaacgattacaagctgaaatcagaaagagagacaaggaaattccattggaagagcaattcaaagccatagcagaggatgccatgactcagagtagaactcaagagaagccacttgcgaatgacatcgaggagacaaaactgcagaaggaatcaaaattcctacagaaagcaaaagagattaaggaactaaaacggcaagcatctatcccattagcccataggcttcggccaaaatctctagacgatttttttggtcaagagaaattagtcggggaaaatggcgcgttaaggaacatcatccaagctgatataatcccatcgtttttgctttggggtgttcctggaatagggaaaacctcactagctagaataattgctaaaacaacaagctgtaaatttgttgaattatcaggaattgatagtaatgcaaaaaggttgaaggaggttttcgttcaagcagaaaatcataaaaacttgagtggacaaagaacgattttgttccttgacgaaatacaccgattcaacaaggcagtacaggatttattattaccggttatagaaaaggggacattaacagtaattggagcgacgacagaaaatccgtcatttaatttgaacaatgcattgttgtcaagaatgcacacgtttgtcatggaaccattgactgttgactcgttaatcaagattctaacaagagctctttttgaagtcaatagagtaaggaaaaatttgtacggactacattatatttcactacaaaaggatgcttatcattacattgctgagttgtgtatgggggactcgcgtgttgcattgaacatacttgaaactataaatgcctatttatcagctgacaaattcaagagtactgttaatgccgatgatgagcagacgaagaaacagggtgttataaaggtgtctgctgatctcttgaaaccgttgatgaagtcaagagatttccatcagttttacgaccgaaatggtgattcgcattacgacataataagtgcattccataaatcagttcgcggatcagatcctaatgcagcgatgttctatttagtaaagatgttatcagggggagaagatccattgttcataatgagaagaatgatagtgattgcaagcgaggacataggacttcgcgatagttcctgtttgccatttgctattgctgcaaaagaagctttggaattcgtaggtatgcctgaaggagagatcattttagcccattgcgccaacaagctagcgttggccccaaaatctacaaagtcttatcgtgctttaagaaccgctcagaatataattaaagaaaacccagatctaacaaaactacctgttcctttacacttgcgaaatgctccgaccaaattaatgaaagatctaggctttggcgacaagtacaagtacaatccaaattatgaaaacggtaaagttcgtcaaggatatttccctgatggcatggacccgataaagttattggaggacacccatttaggtaaagaaagagatctttcagtgccagatgatgaatacgagagagctcaattggcagtggaggattatagaaaatttaaaaagtcttacaggaaagaattctttattgataatgccactgatctggatgaaaatgacagtacccattatggagagtactcggataattttggaaagtcgtttgatgaaaatctaccacccgaccttcaaaaggagtattttggcgacgatgaatcaaatatacaagatctatga

SEQ ID NO: 1251 - DNA, 735 bp, Candida albicans
ttatacaccacaataaacttaaagaatatgaatcaaccaaacccgaacaaacaaccaattgtccaatcaacactagaacagacatccaatgaagaggttgatactgttttaggtcgattcactctatttgtgaaagacttatctaatggattaaacggtagtcaagaagtcccgccatcacaagaaagtgttagcgaagaagcagaagttatcagtagaaagattattgtattgggtcaaacatttgataattttgataatgccaatgattatattgaatcaaaactttggctatcatatcgttgtggatttgaaccaatacctaaatcaatagacggtcctcaaccaattcaatttttcccatcaattattttcaatagaagtactatttattccaattttgctaatttgaagagtttattcgataaagaaaatttcacctctgatgccggttggggttgtatgatcagaacctcacagaatttgttggcaaacactctattgaaattgtatcctacgaatgaaccagaaattgttaaattatttcgagatgacactagtgctccattttcaatccataatttagttcgagttgccagtgtactgccattgcatgtaaaacctggggaatggtttggtcccaacgccacatcattatcgataaaacgtctagctagtgaactactacaagatcaagaaatcgatggtatcaaaatcccccggagtgtttattag

SEQ ID NO: 1252 - DNA, 696 bp, Candida albicans
ctagtgaactactacaagatcaagaaatcgatggtatcaaaatcccccggagtgtttattagcgaaaattctgatttatttgatgttgaaataagagatgtgtttgccaaagagaaaaatgctagtgttttgattttgtttccaataagattaggtattgataaagttaattcttactattacaatagtattttccatttattagcttcaaaatatagttgtggaatcgctggaggcaaaccatcttcaagtttttactttttaggttatgaagatactgatttgatctattttgatcctcatttaccccaagtggtagagacgccaatcaatatggattcatatcatacaactaattataacagactaaatattagcttattagatccttctatgatgatcggtatattagtgacaaatattgacgaatacattgattttaaaactagttgtcttgatattaacaataaaattgtccatttccacccacatacattaccggtgcaacaagattcaataatcaatcagtcatgggaagaagttcaggatgaggaagaagagtttattaatttaaatgtaagtaagattgaaaatgaacagcaacaggaacaaggacaactgacggatgctccagatgagtttattgatatcggaaatcaactgctgctggtggtactggtgccttccaatgtgtga

SEQ ID NO: 1253 - DNA, 1353 bp, Candida albicans
ttgggggtagacatcaggccgctggatcgtccccatgccccagtggtggaagacgggggaggaagattacataatgagataaccacaaaactagaagcattagaagaagcgatgaataatgtttccagtgatacagaactggaacaatctgtgagccatatagaagaggaagatgaaaaagttgaaagtcatatcccagaacccgatctatctgcagaggttgatgaacctttacaggaaattgacgaatctgaaaatgaaaaccaaatggagtccgaagttggcacaaacactaacactcaagatattgaaacattagatattataatagacctcccgagtaataaagtcgaactgcatatgtcgcattcattaccacaaaaattcaaaactccttcaagccccgatgatgacaatgatgacaacaacaacaatagcactcccgaatcagaaccagaatatggatatttagaagaagattatgaatttgatgtttctaaaattgaagtttccaatgttagatttggtattgaaaatcaatatcatattaaatgtatggaattgacgggactgattgatgaatatatatggattgatgaaaatgatgtgattgaatatgttttagataatggagttaaagaacatcgattgaataaatttttatcatttattaccaagggaatgattgatgaacaagaaccagaaccagaaccagaagtttatatttctgatagcaatagtgaggaagaagaggaagaagaagacgactataattcagaacaagatgattatccatatgatctggatgataatttagaagatttaattgcatattccaaaaccagtacacagggactcataccatttgaagatcgtgatttctccaataatattcctagcaaaaaaagacaaacatttgatcatttagattttgatgatgatggtgaattacaagattcattaatacgtcaactaaacaattataaagccaataaaaaacttaaaaaacatcaatgggaacaacaaaaattagaagaatcaatattacatcatgatatgttaatcaaataccctgttagtttacatattaaagatataaaatctgaatttgatcaattattaaaagatgaatcaagacaatcaatgagtttcccaacattagatactcatggtcataaaacaattaaaaatttagctgattgttatcatatgagtgttataaaatcggggaaacaaggtataaggaaatatttaaaaattgttaaaaataaagcgacatttaaatattatcctaattatgcaagaattaatagaatattaatattcaccacgccctggaaggaccgcacttgc

SEQ ID NO: 1254 - DNA, 1008 bp, Candida albicans
  unsure (428): Identity of nucleotide sequences at the above locations are unknown.
cagacgtattctaatatgacagatatgtcaaacactactactgatggtaatgtgtctagtattgttgttccaggacaatatattagtcctacttataaattagaaaatagcaacaacgattcatctataccagtgaaatatattcctggatcggggacaataatatcaaatatcaatatcccatcgccaaacacctcaacaaactcagttaaatcaatgccaattatagtatcgacaatattagggaatgtatccatctcacctattgatcaaaccccaacatcaaaaccatccaacaatgatgatatggttatcgataatgagcaaactaaactggatgaagataaagataaagataaatatgttaaaagttatttagtttctgtgataccaaaatctaccaaacatcaatccaccacctccaccantaatagtaatcaatcaggctccaaggcaatttcagcaattgcattacctaaagaaaatgatattgtattagttcgtattactaaaatcactaaaatccaagcatattgtgaaatcatatcattagataccaccaccaacattttaccagattcaggtcttggtaataatgggaatggatcacatgtatcaatgtcaattaccggaagtaattctcaacataatttcaatcaaaattcaattgcttctagtcaatcaactaatcaatcagtacaaatttatgaattgggagaaaattttaaagggataattagaattaatgatattagattgactgaaagagataaattaaaattaattgattgttttaaacccggtgatattgttaaagctcaagttatatcattaggtgatggatctaattattatttaacaacggcaaaaaatgagttgggggttgttttcgctaaaagtgaaaatggtgctggtgatttaatgtatcctattgattggcaaaatatgattgatattaatagtggggttatagaaaaacgtaaaaatgctaatccatttttacaataa

SEQ ID NO: 1255 - DNA, 2961 bp, Candida albicans
atgcggtccttccaggccgtggtgaaaatcatggctaaaaatgaatctaaaaataatttattttgtggtgttagcgatggtggtgtcgatgttggtagtgctggcggtggtgcgcaatacaacaagaataaatttaacgcaaatttctccaacaaacaaattaaagagaattttcattcttcttcccaacaactgtttcaacaacaagaacatcatcatcaaccatcatttcatcagtcaccattaaattcaactgatcaacagatgtctcctaaaagttctgaaccattacatccacctagacatgtaaaacatcctacggacactactactaatactacgactaacaataataatcccttttataatactacttcgcattccaatcaaaataatttatttaataaaaacgtgtcgataccattaaatcaaccagcatatccaggaaataatactactaccaccaccaatactaacaaccatcatcataacaaaagtaatagttataataataattataatattattcgtactgttagtaataattcaaattctaatatgtcccttgattccaatttttcgtctcattcacccctgaataataattcttcacgtccaaaaattgtttgtaaatccaaaagtatgtggacggttttaactaatgataatgattcaatgagttcatcacatacacctccaccaagatccccattaccacctcaaccaactaatgattctgtatcattggggtcacctcataaacgaccatctcaaccaagatcaaattcatcttattcaattatgaagggtaaattcaatcgtaaaaatagtaacactacaacatcaactgattttcatccagaaaataaaacccttctgcataaacgaagtaatacattgaatgatttcagcaagttgaataaggaacaacaaccttcttcaggggttttaccatctactgcaagtactaatctgaaatcaagtaatgggaagaagaaatttagtttcaaatcattatttaaatcaaaatcaaagagtcattcattaaatgaatccaattcatcaatactgctggaacccaaaaaaatgacttcaaaatcgtattctactccgaatatgcaaatgttatcagaacaaccaaaatcaattgatgatgtcgaagatactactaataatgaacaaagcacaaaactggaatctaaagcaccgttgccaactaaaacaaatacttcatttatgaatagatttaaaaagaataaatcgtctgatagtttgaataaacttggatcgtcacatcaacaatctggtttgaaaaaaggggtatctaattcgaatccttcactttcttcattgaatgggaataaaccggttgtcaattcaactaacaataacaacttaatacaaccaaatgaagaacattctaaatttggattactggcaccaccagttaatagaaattcatttaattttattagagaagttagtgaagatagtgtttatattggagatcaaaatgatgatattgaagatgaacattcgggtgaagaagatattaaaccatcgaaaaagagacaaggctataaagatgttggtaatattcataataatagtgatgatgaagaagatgatgataatgttgatcgattatcaaatttcaaatcaattgaacgagggcaagaacgtggtgcttcagacgatgatgatgatgatgatgaccaagaaaaggaaaaagattttgactattatgatgctcaaaatttaactgaagatccacctaaaaaattatcttcagggaataaatatggtgaagaaatttctttaataccaccattaattgattctaatcaatttggatcaccatttaaagtcaattatcaaagttcacctaaatcaattgatttgaaacgggaagcacaacacactaatactaatgatgatgatgacaatagtagcccacttcaaagaactatcaaacgattttccggtccaccaacatcatcttcattaattcctatcaaaccaccactgccaataagataccctcaacaacagactaacaataatgttcatgtaacagaagataagcctaatactcaattattgggtgaagcattatttcctaaatcattgaatgctcatgaagtggaaagtattgtatcattagaacggtcaagatcaatgaaatcagtgaaatctaataagcgtagttcatttgttaattatgatggtagtgatgataatattgttcattatgttggacctatatcaaaaccaactactggtaacaatggtaataatggtattaccagatcaaattctattttgaaaaattcaactagtcgaaaaagtaatttgaatgaagaattaaagatgaattcaattgatggtaccgtttcaggaacaaccaacaacaatatcaacaatattgatactagtggtaatttcaaggtgattaatgataccaccacaaccaataatgatacttttactacaatcactgatattggtcctagtggtggtgcaattggtcaaaatattcttggatcaaataatgggtttggagataatagtggtattgatactggtgatgatgatttaatggaatttagtgaatttattgatgttgaaaatatgaatttccttgattcacctattcgaggatctccaattaacaacaatggtaaatttatgcaatcgtcaacaactccttcgtctccattagctaattatcattttgataatgattctattaataaattacaacagcaagaagaggagctgcaactgcagggaaagattgttgatcaatcgactcctgaaccaccagttattgttattaataaagataatttagatgataagccaacaactatggagtctaaactcaactcaattccagtaattactataccagataaagaaactattgatattagtaataaagattcgattgaattctaa

SEQ ID NO: 1256 - DNA, 630 bp, Candida albicans
ttcccaccaccacatactaattctccaccaaatataatagctcaaccacaatcaccggcaccatcaaataaatcatcagtattttcacctaaacaatcgaatgatatcaataaaaaaccactcaatcaacccccgccgcgtccatcatcatcgccaccacagactcaacaacatttcagtttacaaccattgaaaaaattcactcataataaaattccatctatttctgaccaatcatcaattaattcagaatcatcaccaagatcattcacttcaatgattagtaaaaaatggggcaacagaaagaataacaactacaatccttctaattctctaaattcaaattcaagtccaaaattcaattcaatacctccaagaccaggtccaccaccaccaccgccgccaccaccacaagttggaaaattgcaaatcactaatggggttaggtttagttcaagaattatattatatgatacctataatgaagatgaatatgatagacatcctgatactgctacatgtaatcaattgactccattattagctcaacaaattaaaaatgaattgaatagtttcaaaagtgaaatggaaattcatgttgaatcaaaatgttatacacattttttttag

SEQ ID NO: 1257 - DNA, 849 bp, Candida albicans
tcgaagaagatcattaaaagaaaatcgtctcgtaatgttaatggtattggaagcacaaatactaatactatgacgagacttgattctaccactattgcatcatcattattttgtcgacaattatatttcaatttattaagtaaagatccaacattagaaaaaatgtttccatcgattaaacatcaagcagctaatatggccgggatactttcattaacgatatcacaattggaaaatttatcaattttagatgaatatttagctaaattgggtaaattacattcaagagttttaaatattgaagaagctcattttaaattgatgggggaagcatttgttcaaacttttcaagaaagatttggatcaaaatttactaaagaattggaaaatttatggatcaaattatatttatatattgctaatactttattacaaactgggattgatccagtattaaaattgactcgttatgaactgaatggcagttttacaacttcaactaatattgatttgactaatggtgatagtatacttcttgatgatactgatactgataatgataatgtcagtgttagtaatattctagatccaaaacatcaacaacaacaatacggtggttcttcatttaatcaagatgataatgataacaacaacgatggtggtgttcatccatctacaaatactgttgtgctcacaaaatcaaatatactgatcattgaaagtgtagcaccacatcatcaacaacaaaagaatagttctggttcctctgctgccactcctacagctccttcaaagaagagtaaattcagtattagaaaaaagaaaaaggaaaattgtgtggttatgtag

SEQ ID NO: 1258 - DNA, 1791 bp, Candida albicans
gtgtatattcaacctggggaagctggtataaacccattagcatcatcatcaaccaataccaccaccaccaataataatgactcatataatgaaaatggagaagtagaaattcaaatagattcacaaggaaatccattagaaatgtcaaaaattgatgatagacaatttcaaagtgataaattaacaccagcacaaatatcattagctgattgtcttgcttgttcaggttgtataacatcagctgaagaagtattagtagcacaacattctcatcaagaattaattaaagcccttcaatcacaaaaggaaaccaataaagtgtttgttgttagtatatctcatcaatcaagggcatcattagcaatggcatataatgtatcgattgaaaatatggataaatgtttgattgatttatttattagacaaatgggatttacttatattgttgggacatcattaggaagaaaattatcattaattaatgaagccaaagagataatcaacagaaaaaccaaaggcagtggtactggtggtattgactcagattcctcctcaggacctatattatcatcaatttgtcctggttgggtcttatacgctgaaaagactcatccttatataattccaaaaatgtcaaccgtaaaatcaccacaacaaatcacgggatgtttattaaaaaatttaacttcaaattcattaaatattgaaaaatcaaaaatttatcatttatcaatcatgccttgttttgataaaaaattagaaagtgctcgaccggaagtatatgaagaagaagaagaagaagaagaagaaaaagacaaggccttagtgctggttcctgatgttgattgtgttattactgctaaagaattaattacattattagaagaatgtcctcaatatcaattaatcccaccaacactaccacaagaagaacttattggtggtggttgtttatcaatgacggaaatttataaacaatatgcaccaccaaattggccatttatagaaatatcatggtcaaatgattcaggttcagcatcaggaggatatgcatataattatttaaccatttatcgaaatgatttaatattaaaaggttatgatggtaataaattcaccataaatttaattaatggacgtaatccagatatttatgaaatgagattaatgtataatggtgaaaataaagaaaaattggctagtgctgctgttgtcaatggatttagaaatattcaaaatttagtaaggaaattgaaaccaaacacaggaaagacaacaaacaccaccaccaccaccacaaagagtaaagttaatccattggcagctagaagaagagcaagaatggccaacaatcgaggtaaaccagaaacaaaatcaacatcagaagtgaattcccaagaaatggaaattgttgctgatgcttcaaaagttgattatgttgaaataatggcatgtcctaatggttgtattaatggaggtggtcaaatcagtgctccaaataccaccaccaccaccagtatcacgttaccacaaaaggagattgaaaaacaatggattaatgcagtattagagaaatataatagtattccaatgtttgatttaagttcacaatcatcatcatcatcaccaaatgaaattattaaatttattgaatggagtaaaaaatttgaaaatcaatttaatattagtgataatcgattatttaaaactcattttaatcccgtggagaaaaatatcatcatgtcagttgatgatcctgctactgctttattagttggatctaagtggtaa

SEQ ID NO: 1259 - DNA, 1167 bp, Candida albicans
agacgatcagcaaagcacaagcttttatttgatttgaaaagtattgaggttggtgtcaatgtttattcaacaagagatcctagacgtgataaaaccgatgagaatatgaaatatgaattattgaattttatcgagttaagagtgggaacagttgatatttatgataatgtgtctacgtcaacatggaacaagtttttaagttatatgaatatacttggtgatcgagaaattggaaccagtatggtgaaggtttcaattttgaatgttagacctgatcctgcaatggtttctggcgaagcaataatgaatgtatcggtattacccttgcgattgcatatagatcaagatgcccttgattttttggttaggttctttgaatttaaagatgaaagatttgaattgccaccagatgaaatggtttatatacaaaaatttgaaataagttcaatcaagttgaaattagattataaacccaagaaagttgattatgctgggttgagatctggtaaagcaggagaatttgccaattttttcactttggatgggtccactttaactttacctaaagtcaaactatttggaataccgggtgcacccaaaattggtattgggctaggcagggcttggttacctgtgtttcaactgacacaggttattggtattatatcgggtgtgtctccattgaggtctgtggttaacattggtggtggctttaaagatttggttgcaattccaatatcagaatacaaaaaagatggtcgattatggagaagtatacaaaagggtactgtttcatttgccaagactacggggtatgaaatattgaatttaggagttaagttggcttccgggacacaagtattattagaacaaggggaagaaatgttaggtggggaaggctctagtgtaagaagtccaaatttaggtggactggataatcgacgcaattccaatgcttcagatgagttacctgttgaagttgcaaaacccaaatcccaaaataatctacttgttagttcacaaattttgaataaagcatcaacaaagattgaaactcatagctacgataccaaaaaactatattccaatattgaattagatgatgaagatatggacgataataggattaatggaattaataaatcttcaccacgcggctggaaggat

SEQ ID NO: 1260 - DNA, 684 bp, Candida albicans
atgattcctcaatggatacctcaaaatatacagaaaagactacttctatatgtgttgcaacaactatcattgttttccgaaatagatttgccaaatcttgaagaggtgtcattaaataacatcatcttaaaagatgttgcacttgatccagaaaaagtgggtaaactacctggatgtaatttaagatatggtcaaatcggatcgttggaactaacgacgatatcaggtataagtggtgtgaacattgatgtcaatgatgccgaaattgtgatatcgcctgactttgatattgacgagaatatgactaatcaagtagcattcctgttggcccagagtactgccaatttagctaatactataatgttgaataccaacgatggatctgatatgaacgaaacgtctgatccggccctggaggatgatgatgaagatgatatagatgacaaaattactaaaccaataccaccgaaaaggcgaacaagctctgttactggtaataaaactactgcattaggtggggtaatgcaaaaagcagttgaaattgcattactgagattactgataaaagtcaattcattaaagataaaaatcgtgtccgatctaacagatcttcaaatggaagttaattcggttagtataaagagcacaactggagtctttcataagcaccgcccgatcagtgta

SEQ ID NO: 1261 - DNA, 2769 bp, Candida albicans
agatattctgaggatcctccaattatattttacatggatgattgtacaattgaatttgatggattgtccacaatttcgaacttagaaatagaggttgggaacataaatttagctttcactccattaactcctaccttggtttcaatatttcaaggagttgcaaaaagtttgaaaatcaagtattatcaacaaaagaagaaaacaaagagtatgctggctcagaggaacgaaaagtttccacagtatacaaatgacaatgatgaaattcctgaagatcaatctgaatcagacgatgcctcacatgaaccttttttcaataggtttaaagttaatagttttgtcataagtgcaacgtcagcattatctgagaatggtttatttgcaatcaagaacggtatcaatataattttttttaatattaatattaaacagaaaaatgaattactactatatggaggtgttgagaccttcaaaattatacgatttgaagatgataatacatatgagatttttcattttgataaaccccaaagtgctccatcatctgcgccatcatattccggttctaatgatgtggctggcacgtcatcgtcattatcttcatcaacaggtagtgccacttcgaaagctgacattcgttttgaagttttcaagaaatctgaagagtctgatgatttagaagtaactgttttgatggctaaaagtgcacattttaattttgatctccaaagtttattgatattatctaattttgctaaagctgttagctctatatatgatgaatacggacttctcaaatctgtgattgataagttggatacaagagataagaaatggagtggtggcaccaataattctaaaatgctgtcaaaaagtgaatttatcttacaaacggcaacaatttttgtgaattttataatatcagacgattgtcagctccagcttatagtatttcccatcaagtttaatcttcttcaggagcaattgacaatatcaaaaatattacttaactgtactaatggcgatactcaagtagagggtgtaatcattttaacagacgttagcttaattactaaaaaccaagagttcagagcttattttcaatcgactaatactactacatctgctaatacacatccattacctagaaaaaccactatgaattccaaacttagtgtaattgttcaaaagttctccctgaatgtgtctatggataaattgaaattcattggagaaaaacttaagaatttttctaatgagtttatcgaaagatcaccaacacagtctaactccttggaaaattctttcttaaatgagcccgtagaaaggcaacgattagaaagctcactccatatgaactcttcgttgttttctacacgaagaccaggaagacggctcggtttgggatttaataattctcctagtgtttttttggggtcaactcgagttaccatggcaagttttcaagtttgttttaaagaagcaacatttaatatcaccggtgtatttcccaaatttggaaattttagtgtacaaatgctggatatttctttttacaagttgaaaaatgatattttagggcatatactttctgtcctggtacaaagaaagaaaggtgatttggtagagaatttaatacatcaatatcaagatttatcacccaacagtctcgaattcccattgctactgatcaaatgtaagcttggagacaaaacgactaaaatcgaaatcactgctagaaatcttgtgcttgaatactatacaaattggttattactaatggataaagaggaatctattattgacgcagttgaagaagaaattattgaaaaagtgactccttcacaacattcttcatcccagaataaattagatatcagatattcgatgtatgactgtatggttggtttaacaccaggaaggttgagctgtaaaagctatttgattattggtaagggagactctgacatttcctttggtgttaatcaattttatgtcaaatgttcctttagaaacatatccatggttttaattgatgatacgaagaacattctaccatttagtgagcccagtacctcatcatcatcgtcttcgtcatctgctactcgccaaacaccttatgtttatattcagccattagactattattccaagttgggttatattcatcttggtttgattaatgttgcccatgttggaattacatttaataccgatatagaagcattaaaggacagaaacgagaaacttggaattaaagacagtttgacatttgtggatctaaaaacaaatttagatgaatgtcagttcaacttatgtgctgatactgcaaacacattgattcagttggttaacgatttgaaattaccattgaattttagagatgaagataaaatgaaagtggattttgctgatggtattaatgttatgcagggtattgatcagaatatatttaaagggttgacagaaacattaacggaattaaatctcaatggcacagaaaatgggtctacaagtgaaagcagttctcaagaagcgtcatcattaatgtttgaggaggggcactttgatagggggaatcgatcactatatgataattcacatgttgatcctcttcatataaacatcaacttgtcgaaagtcaaaatatacttacatgatggatatgattggaaagatactcgaaaggcaatccgtggagccgtcaagaattttgaaacagcacaaacagcaaaaacagtggctaaaggagaaagagaaaaagcgtaa

SEQ ID NO: 1262 - DNA, 471 bp, Candida albicans
tcaactatggcaggtgatctaaatctaaaaaagtcttggaatccagcattagttaagaaccagcaaaaagtttgggaagaagaacaacaaaagttagatgaacttaaacgaataaaagagagaaatcaggagtataaacaagaacaagaatacttggaattactaaagctacagcatggagatcaatttcaaattaaagacttgaacaaacagcagaagctcaaaatatccaaactaaattggatgtatgatgatgtaccatttgaaggcaatgagaaagtggaagagaattcaagtgggtttattgaatcaaatgtagagtttacagatggcaaatccaaagttgagaatttattaaaaggaaatcatgttgtgggcaagaagagagatggtagtggaaccagtgatagaataaataagataattggggtggggatgaccaaatcaagtaaagtcagctattcaagatga

SEQ ID NO: 1263 - DNA, 501 bp, Candida albicans
tatattccagaacaagaaataacgaaaaagttcaaaatcgtaatacaagaggacggagacgaacgcatagtgtcagaatcagttgaagtcaaatggccccatgagttgagcaaaattaatccgtccgtaattaaagaaaaatataagggcaaagataagaaggacatgtctgcaaaggacaagaaaaactataggttaggaatgaaatcattcttctcgtggttcaattggactggagaaaaaccaggtaaagagttcagaaatggagaagatttggccactttattatcagaggacttgtatttgaatgcattaaagtattatattatagcattgtcaccggatgaagatgatgatgcaaatgatgaagaagacacaactgaaggtgaagaattggacttgagtgacgatgatgtagaggaatcagagcttcctaacaaaagaactttggaagaagaagaagaagaagaaaatgaacatgcgacaaaaaaatccaaataa

SEQ ID NO: 1264 - DNA, 1197 bp, Candida albicans
aataaagcaatgaaagaaaaagattatggaagcttggtgaaaaataatggaagatcaaaggagaatgtaactaagatatcacttcctcgaacatctagttctctttctgctacatcttctatcccttcatctcccattcatgatatgtttagtccaacaaagttatcacctcgggcatcaaagacttataaaaagcgtcctaagggtaaaatactagttcatgacaatgctttagaaaccagtaaagtgaaaaaacttggagagtatcaagaaataattgccaaaccaagaaaatcattagatccatttgatctaatagatattaatcatatagagaaaagcacaccgagtccagtgaaaatggcaaaaaaacgtaaaactgaaactggtatcaaagtggaaggattacttgaaataagcgatgatgatgataacgataacgataaactgaaagagaaggacaaatctcagccaaagacattaaatgaaaagtttgattcaaataacattcttcattcacttgatcaacagaatcggagtaaatatgatgatgttttgaagaaatacaaaaagaagaaaatcccaaaaccaattgtatcaaggaaagaattattggcaagagcaaacaaatatatggatttgataccaaagattttaggtgggaaattaaacacttcggtatattatgagtatgctaaagctgaacaaatgaaatcggatcgtgaaacaatgccagcactggataaatggcgtatcaaatgggagaaatattatggtggatattatggtttccaaagacaatcaataataggagcatatattttagacaggtatgaaaagaaattgacaaaattttgtaaagataataaaactgctaggtattggaacatgtcacaattttcgacatatgttttggccaatgaaatcatcattagaatgattatggaagatatgaatcttgattttgataaagcagaaaaattttgtctagaaactgttgattatggtattgttgtggcagattctattgaagttgattatgataatggtcttagtcaagagaaaactactaccaaaaagagtatatcttcaaccaaactgaaacttctacccattctgttaaatgcagatgatagtagtagtgatgaggaaagtatattccgagttgaaaaaagtggcaaaactagaacaaaataa

SEQ ID NO: 1265 - DNA, 666 bp, Candida albicans
gatttaaattatttgtcttccaagttaacttccctccatggcgatgataatgatgatgatgctcaaaaactaatccaatttgtcaattgtaattggaatcaagtactcattaaattttatctggaattgaaaattgtattatcgtcattaaatttagaaaatgatgaaccgttaagtaattctgatgaattagatgattataatttaaatcaattaagtttaatttataaatggtttaatattttatttgaagaaaaacaattaaaatcaactaatcgaccaaaatttattttattagtgattgatttagttgaatttataaataattggttaattcaaatgatttttaatcttgatgatataagtgaatttcaatgtactaaaataactcatattattgataatattaataatgtcaccataccatatattcaagaattgggtattaacaaaagttcatcatcaattgaatcatatgataaattaaataatgttaaatttataattaataatcatttaaaagatattatggaaagattttatcaaggagaattatttaatttagaaactcaagaattagtaaatatgataaaatctattttcattcaaagtgaattaagagataattatatacaagaaataattgaatttcgaaacatgagctaa

SEQ ID NO: 1266 - DNA, 726 bp, Candida albicans
actacattatacaccatttccaatatgtcctgtgaagacgaacatcacaaccacaatcatggtcataaccataatcacaatcatgttgctcctattcctacaacagctggacaatcattaaataataaaattgatacatctaaagtgacagctctcaacatggccaactctgctgacgatctagcaaaagttttcaaagattcgactaaaaaatatcaaatcaaaccaattatcaaatcagacagtgatgaacaaatgattatcaacattccatttcttaatggcagtgtcaaattgtattcgataattctacgtaccaatggggatttgtattgtcccaaaacaataaaattattcaaaaatgacacatcaattgattttgataatgtggaatcgaagaaaccaatacaggtgttaaatcatcctcaagttggagttgcttataatgatagtgatgatcttccagagtttttggaatcaaataacgatgacgattttgtcgaacattatgtgtctcgacataaattcactggggtaaatcaattgacaatatttattgaagatatttatgatgaaggagaagaagagtgtcatttacattcaattgaattgagaggggaattcactgaattaaacaaagaccctgtcattacattatatgaactggctgctaatcctgctgatcataagaatttaacgattgttgaaaatcaaaatctagcataa

SEQ ID NO: 1267 - DNA, 1035 bp, Candida albicans
tttggcccactatctcacaccaagagtatgactgatttcgaccaatccaccaattttctattggaatatttccccaagttaccagatgatataattttactaataacagaacaattgcccctagaatatgtaatcgactggttaatcaaaatcccgattgtacaagatattgtgattggcactttatacaaccataatgacctccaattcttgatatctcccactaaacgaccatatatgaatcatatatcagctttaaaatcaaagttaacaacgtttaaaggatattatcagattagtacttttatcaaagaaaactcttctcgatttattcccaaaaaagtattactcatgagtggtggtgattggagtgctgtggaagaattaattacaaattttaagtcttggttagttcaagttgaatctattgaaatcgcattggaaagtaatgaaatcaccccttctgatctcaagttattactagagttcaataatttgaccaagatccatttttcggcagtttctttaaccaagtgcatactgtttttgcagaacaatagtttattaattgatcatccaagtttgaataatattatatttttgaaacacggtattgtgaattggactggaataaagtttcctcgtaaacttgaatcattggatttgtcgtgggaatcaaaagttgatattactactgtcgaggttcctgcctccttgaatgagttatactttaatttggcaaatgtatcacaacttgaaaatatcaagtcacaaattagtagcatcaatctaaccactttaatgttgactcatgatggactcacggagattagtttgaaggctttgccttccactttaacaactttagacgtctcagaaaacccaatttcgaaaataagtgatattgaatttggatggccacaaaacttgactaccttgttattagacacaaacaatttaacgaatgcttcggtagctgctatcactgaatggccaaaaaacttgaaaacattaaggttaaaatcaagcaagtga

SEQ ID NO: 1268 - DNA, 1200 bp, Candida albicans
  unsure (958): Identity of nucleotide sequences at the above locations are unknown.
cgtccggcttatagaaaacataataaagtgagatccattaatgatgccattgatgaaattgggtttactccttatcatttgaaattatttttcttgaatggtatgggttattgtactgattgtatgttgacttatcttgaaagtagtgtccgtacatttattaattatcaatttggttataaattccccgttagtaatgaatgttatgccggtgggatgattttaggagcattagtatgggggtttggagctgatttaattggtacacgattagctttcaatttatcattattattaagtgctattttcacaatcatgacggggatgatgggcaatatggcatcttattgtttatttgtattattaagttcatttgctgctggtgggaatttagttttggatacttgtgtctttttggaatatttacctcataaagatcaatggttattaacttttttcgcattcttttgggggattggtcaaactattgctgttgcattagcttatgcatttttaccaaataatagttgtgaatcagctgattattgtccatctcatatcaatcgtggttggagatatgtgttttatactaatggatcaattgttttggccatggccatactaagactcacagtggtgagattgaaagaaactcctaaattcttggtggctaataatcgtgatgctgaagcagttgaagtattacaagaaattgcccacaaatacaatcgtaaatgttcactaacgttggaacaattgttagaatgtggtgaaattgaaagtaatgatgactataggaaacatttcagttttggtgggacattgtcattaatgtttcaacatttgaaaattttgtttgcaaccaaaaaatcagcttggtcaacttccttgttgtttttctcatgggcttgtttaggtattgcttatccattatattcagcgtttttaccaaaatatntagctactcgtggtgccaatatctctgctgataccactagtggagtatatcgagatttagtcatttctaatgtgagttcagttggtggtcccattattgctgggttattattatatttattaccagttttaggtacaaaaggggtattgtttattggtggagtcactaccatggcattattatttggttatactgccgtgagaaccagagctcaaaatgttggattaacatccgcattttat

SEQ ID NO: 1269 - DNA, 183 bp, Candida albicans
gaagcaaattttatatcttcaattgattatgcaactcatggtggtagtattcctttaaggttaattaattttgatgggattattggtgctttgacaattagtggattatcacaagaagaatatcatttatttgccattgaagttgttaaacaatttcttgaaactttaaacttgaaacaataa

SEQ ID NO: 1270 - DNA, 747 bp, Candida albicans
acaaaaccatttcaatctatttcgtactctcaaccaatgaacaaggaaatatcagaagaaccgtcaattgaacctcaagttcaaggcaacgagtccattgaagagactcgactggaacataattattcaacaaggtcgaaagaaaggaaacgggaagaagaactccaaaagaaatcccaattaaaacaaaaacaacataatgtagtaatacatcctagattgaaaccagtcccctttaaaaatctggatttgaatcctgcttcattgcctgaaccaaatgcagcaacaacgataaatgaaattgaattttttcaaactgaagatttaccattaaataaacgcggtttcaaatataaacattgtcgaccaaacccagagttcccctctaatttgtattcaacaactgatgttccaccatatcatgtatgtgcaagtttatttgatagatcctcaggtattttattcagtaatgacttgaaatcaataacaacagcacagggatggagatcatcaagaacaaatgtttgcatacgtgaagggtcatattactttgaatttaagatattgaattcgaatgagaaaagtcatgttaggataggagttggaagaaaagaagctagtttggaagcaccagtggggtttgatggttatagttatgggttgagagatgttgatggacagtttatgacaattagtcgaagacaaaagttgtgcattgagaatgggtttaaaacaggggatgtaatt

SEQ ID NO: 1271 - DNA, 912 bp, Candida albicans
caagttggatctccacccgtggtgaagaccgatcaattttcaagcttgttatcatcatcgttgccagtgacatcaacatcaagttcaaccatctcttctttttctccaatcacaacaattttgtctacatcaattactagtcatgatacaaattgtgaagcaacaatcaccaacatttcaacaaatacactaattgaaacaattactgtcaatgggaatacaacaatatacactgaaactcaattatcgacatatttaacatcaaatacaagtatcaattgtcccaacacaaatagtgccactactacaacaacacaggttattcctaccgctacaactgaacaaattcatactactacactaaatggatcaattattgtttctactgaaactgcaacattaaaaactacagtgattattactcattgtcctgaatgtacaatcctgtcatcaattaatgaatatagttcatctttaaaagctgaatctagtcaacaagtgacatctattggatcaagttcagtggaattatcagtgtcatctaccttgtcactagtagaatccaccgccagtagtgattgtctggagtcaacaacatttacgtctattgtttctacaactactgaatcaatttatactataacttctaatgaatcaacttttgaaatgacaacaacggtaactaatatcgatccaattgtgataactacatgtccaactatcactcctgttagctcatcatattcaagtagtgaaagtttatcatcaagtgtttcaacatcattattgactgaatcaaattcaactattctgcaatcaactgtttcaactgataagtcaagtttaacaaatgataaccaaatatcaacagtctcaacagaaaacaccattaacgtcaattacaattattga

SEQ ID NO: 1272 - DNA, 933 bp, Candida albicans
ctaagatttgaaatctataacaagggatatttttcagtatttaaatcgactaacagaatgaaaagacaacataatgatacaatttcttcaaacaattctgaattcaccaaaaccaaattaaggaaaactactaatatgacaagttatccttctccaacatattcattcgaagaaagtagtgattattatcgagttccaattggtagaccaactactccagttgataaaattatcaattcacttgaaacaatgccgatatctccaattaagaataacaagggagaattaacttttactccaacaacttggacaacttctatggatctttacaaagtaagaccgaaaataagcccaagaccaagtccaaccccaagtcctgttggaaccccacctcctgttcgtagtccaactccaactccaagttcctatcccagtcccagtccacgtcaacgtcaacgtcaacaacaacattgccaaacaaatcaaagattgttgtcacataatgatttaaactcagtttcaatcctcccagaaatggagatctattcggaaaatgaaccagaaggtaaactccaaaaattagaaactactattacaacaaagaataatttacaaattactaattgtttcaatccatttgtatgcttaaatttcaacccctttgcaccatttactaattctccatatccatttagttacagtcaacaacaaaaaactaatgctaatactaagaatgccattgtttgtccaactcttttaccaccaccgatatttttgtcagaaaaaaatagtacaaataaaattacaaatgaaaatttcccatttcttttcatcactggtggttcaagaactgataatgttgtttgtactaatccaaaatgtccatgtgatgccaaaccatcatattttgttgaaaaatttttcaattattga

SEQ ID NO: 1273 - DNA, 192 bp, Candida albicans
aaaatggctttacaaacacctaaacaaagagcagctaatgctagatttgaaaaaaagaatactaatcaatgggggaaaccaaaaaaggaaaataccaaaactgaatatcctgtatccaaatctaggttatttgtattattattcttagtatgtggtggagcaattttagaattaataagattgatcttttaa

SEQ ID NO: 1274 - DNA, 576 bp, Candida albicans
gatatcatggactcatcgactgtattatttattggagcagttgcagttgcatttatttttttgaaatggatggtgtccccaataccacaacaaaatgagtttaacatagatcatttgtcacaagaccaatccacaggatcgaccacgtcatccaacgcacaccaaaatagagacacacattctatatctacacagtcacaccgaaacagtagaagagcagtgtcagaatctatgatcgaagttgtacagtctattgcccctatgttgacggtcgaacagataagatacgacttggaaactaccggaaatgtggaagctacagtaaaccgattcatggagttgggtgatttaccattccccccaggatacgtgcgtccacaacaaccaccaacaccaagcgaagaaccaaagaaacaagaagtgattgggaaacgatcagtgaatttattggaaaagtacaacattgatgcgaagaacccgaagagcgatcacaacagtttattgcaccaaagaagacaagaaatgattcttggtgctagaaagagattggctgcccagttaagcaacgaattataa

SEQ ID NO: 1275 - DNA, 1380 bp, Candida albicans
caaggtgggggcgcagttgctactttgaatcaacaaatgcttattcttgctggatcaactttcggaggtggtaccacagttaactggtctgcctgtatcaaaaccccattcaaggttcgaaaagaatggtatgacgatttcggagtcgagtttgctgcaactgactcttatgataaggatcaagactatgttttcaaacaaatgagcgcatctactgacggaatcacgcattcgttagccaacgaagttattatggaaggtggtaaaaagttaggttatgcaagcgaagaaatcaaccagaacagtggtggacacccacaccacccttgcggattttgccatttgggatgcaagtatggtatcaaacaaggttccgttgtcaattggtttagagacgcagctgccaatgggtctaagtttatggaacaagtcagagtggtaaaaattcttaacaaaaatggtattgcatacggtgttttgtgtcaggatgttgctactggtgtaaactttaccattactggtcctaaaaagtatgttgtttctgctggttccttgaatactccaacagtattggccaattctggatttaagcacaaaaatatcggtagaaacttgacgttgcatccagtaactactgtttttggtgatttcgggcgagaagtacaagctgaccatttccacaactctattatgacagcagtatgtacccaagttgatgatttggatggcagggcccacggagcaaagatcgagaccattttgaacgccccatttttgcaagctgctttcttaccatggagaggaagcaatgagttcagaagagatttattgcgttacaacaatatggttgccatgttacttatcactcgtgatagcactagtggtaccgtcaagggcgatccatacagaccggatgcattatatgtcgattacactatcaacaaatttgaccgtaatgcacttttgcaagctttgttgattactgctgatatgttgtatatcgagggtgccaagagaattctcagtccacaatcatgggtgccaatatttgaatcaaatgttcccaaagaccaaagaagtattgatgacaaggattatgttgaatggaggaaaaaagttgctggtattccatttgatcagtatggtgctgcatacggatcggctcatcaaatgtcatcctgtcgtatgagtggtaagggtccaggctacggtgctgttgacactaatggtaaattgtttgaatgttctaatgtttatgtagccgatgccagtgtgttaccaactgcatctggtgcaaacccaatgatttcaacaatgacagttgccagacacattggtttgggcttggctaaagatttgaaaaccaaagcaaaattgtag

SEQ ID NO: 1276 - DNA, 696 bp, Candida albicans
cattccagaattgaatttattaacaacaacaacatattcatcgttatgtctgtcattacattaacaaaagagtctcacaagaatccagaaaagtttagaattaaacatcaggatgaggtggagatattaggtccacatcgtaaagaccgttttgccatcaatgaagacttgccaaccataaccaccacttctaaaattgccattctcggagccggttttggaggtatggcaagtgcaatcaagacaatgcaaaaatacaatgagcaagatattaaaatttttgaaagacatgacaactttggtggtacttggtatgccaacacttacccaggatgtgccagtgatattcccgctttatggtattcattttcgtttgcattgacatccaactggagtagagttcaaccaccacagtatgagatggaagaatacattttacgagttgccgaacaattcaaattaagagagaaaactagatttcaaactgaaatcaacaagtttgagtgggatgatgtgaatggtgagtggaccttgtatgcacatgatgttaaaactggtcaaagaatcctccacaaaagtaagcttttacttgcctgtcaaggtgggttagttcatcctttgcaattacaagccgaagggattggaaaacttcaaaggggcatacatgcactcggctctttgggatcattctgttga

SEQ ID NO: 1277 - DNA, 1929 bp, Candida albicans
gagcgatgtccttccagcggtgtgtgtgaaaacaggcgccttatggatgatataataagtagtttcaatcaaaatcgtgatgaattgaaaaatttttggacagatcatgaaaaattcaatgaccctttccaatctaaaaccattgaatttaggaaacaattttatgtgaattatccattagataagatagattcaatcccaaattccaattccctttcccatgcagggttcatatactcaccaagatcaattgaagatgaccgtgtgcgatgtatgtattgtcagtgtgcattagattattgggaagaagatgacgatcctattcaggaacatatacgaaatgagtccacttattgttattttcttgatttatataataatgaacaagatggagacaaagatagtttagaattggaaaacccaataacaaagagcataaatgacattgatcatgaggaggggaatattgataacaaaattgataataataatgattataataataatgataatgatgatgacgaggaaattatcgaactagcgagctttcatgcttctgaaaatgacaatgacaacaaaaccaaagatgatgtaatcagtatatctgatgattccaccactagtctaccccaggaaatcactaataaacacaaacatgacacttctgttaataagatgaatgatagtttttccaccccagtcaaagatatatcccaagatttatcaataatagaacaagatgaacgaccgacgtatagaagatcgaaaagaattaaaagattatatggagaaaaggatagaaatgttgattattgggataaattacccgatgaagatttattacaagaatttattgaagtatcacaaaaatcaagtcaacacaataattccaaaaggaaatcttcaattattaacaaaaacctaatagaaaattcattattatataatgaatcaacagatgataatgggattgatgatataggggatataaaaattcacaatgatagtgatattgaagaagtaattgataatgatgaaataccgatggatgaaattgaaattgaaatggaagatgtatatgtagaggaaaataaatcgaatgatttgtcacaacaaaaacaacaagcaaaagacacgacggctaatggcaagggggagtaccagttacaatcagacaatgtcctggataaggataaatcaacagaaccaagatcacagaaacaattaagttttgcaaatggggatgacaatgaggataaagatttagatatagaaaaaggagaacaggcgaaggtggatttactgaaagatataaatggatttagtccagttattcaagaagattcagattccaattctgattcaaattccaattcagacggaacagataacaaaaacagagaagatgtaaattcgaattcagagaaagaagaatttgatttagaagattcagacgacgaatcagaatatcacagtgatgaaaatagtgaatcgtatgcagactcatcagatgaactgtttaaaatatctggaaattttgatgataccactcaagaactagagaacccaaaaacgaaacaaagaaaatcaacttctaaaacgccagcaaaagagacagaaacttccaaacaaaataattccaaagccaaagtcaaaggcaaagacatatctaaatccgaacccaaaaaacccaaacgtgttgttatcagtaagaaagaaaagtctacaacacctttagaaaatttatttgataacacagacgacaatttagaatatgacgaaaaacatatagaaaagattgaaaatgagccatcaactcatttacttgaacccaaaaaattgaaaaagaagaatactatttcaaagaaaacaaaatcaaaaacttccgaacaaaagcaaattgaaaccaaacaacttgcaccaacgtaa

SEQ ID NO: 1278 - DNA, 204 bp, Candida albicans
tggaattctttggagactctatttggtgaagatgacatttctattactgcggaggatttggatcatgctctatcttccattagacccagtgttagtgacagagataggatgcgttatgaaaagctagacaaaaagttgggctggaatataatctctgataaagagcctgatgatgctggtagtacatctgataaaaacgattaa

SEQ ID NO: 1279 - DNA, 399 bp, Candida albicans
aataattttatcttttataataattatcatttcattatttacaattcatattatttatttcttgcattatatatatttaaagtcatcaatttacaacttcaacaacaacaacctcccaaacaattttattcttctacctatttatttaattgtttgtgccaaatttttataactactatatccactcccacccacacacatttatatcaagtatctactacttctagcaacaattatgcaaacatgttagaacctctgcaaagaatccggaacgccataatagaggggaatctacccattgtcaaacgaatattatcccggttttccgaactatggttaaacatagatccgaagaaacaagggtggagcaatcttcactatgcatcttattatggtcat

SEQ ID NO: 1280 - DNA, 1302 bp, Candida albicans
accacggtgttgcatctttgtatggagaagaaacacgctcaaacattgcattatttattacaagaattcccaggaaaaatctggttgaattcacttggtggaagttcaagacaaacaccattgcattacagttgcattcacgattttaaagaagggacaaagttactattggagtttggggctcaatggagtattcaggatgcccatggcgatacatgtctacatctttgctttcagtttggaagtgtcggatgcttgtatgaattgctcaaatatattatcattcattcgaaaacaaaggaagatgcatctgagaaaattgaggagttggagaatgttaaaaacaaacagaattgggtggctaaagattattcatcaagtttcgatttaattacccaatatgaggaaatgaaaagagatctactatctcaggactacactggtgcagtttctgaaataaagttctcagccgagtcaacaacactgccaaatcctgaagtggcatcaattgacactttaggtaacaaagtattagcaagtccaattgtactgatgacactgcaacagtcagtggctaataatgacaagaattttgaaggacgtcaacattcacaatcattaccatctgcgttcaaggcgcagccacagccacagccactagtcagacaaaggtcaaacacaacatatgtttataaaccacctgccgctttaaccattgcaactgaaggcttaacaggtaggtcaccctcttccaattcatctccattatcaccaatgacacctcaaccaacaacgtcaaacagagcaccgtcattaaaatcagtcacaatatcgccttcagttcgtactaacggaactacaaactataatgctggcacggatgatgaaccaatttccccacagtcagcaatatctactacttcgtcatttaatgcgtcaccaaactataaattagggtcaagaaaaaagagtttttcgttttcaaaatcagttccattaccatcaataaactctgaaaatgttctatggccctcagtaaatgaagagggagtgacagagtctccacctcaacaaatatcacctataaaacgatcagcagcagattacaaactaagaaagaactcgtcggcctcatctattgctgcaaaacttgctttcaattctagccattcatcaccaaatcataatgaaattttaagaaaacgagctgcatccaaatccaatagtgtgcacagtaacagctcgaacagtgcctcgtcagttagacagctgcatcaagtgcccaccaaaggggtgggatga

SEQ ID NO: 1281 - DNA, 939 bp, Candida albicans
caccagatttatatggcaaaaaatccaagaattcagatttaccagtgtatgtttaactttttatttttttttttcacgttgttgttgttgttttgttgttcaatactaacaaaattgaattttttttttttcatatttagatttaataagtttactcctaaaaagcattcagatcgtgtgttgataaagcgagtcttgtatactttggtatttttattggtaacgtatacgatatattcaagagtgttaacaggtgatagcaggataccgcaatcgcaggatcgacaacaatcaccgaccaacgacaataatcatgaagtgtataaagttacaaaagatggagtatataagcaggaagttactggtgttgttgaagaagtagaagaggaagaactaaaggaggttactacagaagatctctacaagtcgaatgttgacatttttgatttaaatgattatcaagggtctcaaaaaggtgctaaaaatggcgatattctattatttcttatgcctttgagaaatgccgaacacgttttaccaatggcattctataatcttatgaacctcacttacgatcatcgtttgattgatattgcatttttggtttcggattgttcaccagatgacaccacgttggaaactgtttttgaatattcagtggctttacaaaatggaactttggttgacaagttgaaacatgaagaagagttgaagaattcaggtaatgtcaggggcactagtgatttatatcaatcgtatatggagccatcttatattgaaagcgtaaagaaagcctatagtaatcctgagtcgcatcatccaaactataggaccccatttagatcggtcactattttcaaaaaagattttggtcaagtcattgggcaaaggttcagtgatagacatgctgttaaagtgcaagggattcgtagaaagtga

SEQ ID NO: 1282 - DNA, 552 bp, Candida albicans
  unsure (496): Identity of nucleotide sequences at the above locations are unknown.
tatcatagaatgtttaaatttagaattccacaacaaatattgaaacaaaactcaacaagttccaaatctataatcatgccagttttgaagaaaccattctcaacatctaacccaaaaggtgatttgttcaagtatcaatcacaattaccaaaattgccagttccatctttggaagaaactgctactaaatatttgaaaacagttgaaccatttttaaataaagaacaattggccgctacaaagcaaaaagttgaaaatttcatccaacctggtggtgctggtgaagctttacaagctagattaaatgatttcgctagtgacaaggataactggttagctgaattctgggatgattatgcttatatgtcatacagagatccagttgttccatatgtgtcttactttttctcccaaaaagatgttcacaatgttattgggtacgatcaattgttaaaaagcaatttgattgcttactacaccattgaattcaaagatnaaatgttagacgaaagtttagatccagaagtcatcaaagtaatccatactgtatga

SEQ ID NO: 1283 - DNA, 933 bp, Candida albicans
  unsure (11): Identity of nucleotide sequences at the above locations are unknown.
attcaaagatnaaatgttagacgaaagtttagatccagaagtcatcaaagtaatccatactgtatgaatgcgttcaaatacatgttcaacaactcaagagttccagctgaaggttctgatatcactcaacattacgatggtgaagctaacagattctttattgttatttacaaaaacaacttttacaaagttccaactcacaatgaaagtggtcaaagattatccaagggtgaactttacagttacttgcaacaagttaaaaacgatgccactcctaaaggtcttggattgggtgcattgacctctttgaacagagatgaatggttgggtgcttacaacaacttgttgaaatcaccaatcaatcaagcctctttggaatccatttttgcttctgcctttgttatttgtttggactcgcacaacccagtcaccattgaagaaaaatccaaaaattgctggcacggtgatggtcaaaacagattttttgacaaaccattggaatttttcgtcagtgctaacggtaactctggtttccttggtgaacattcaagaatggacgccacaccaactgttcaattaaacaacactgtttacaagaaaatcactgaagaaagcccagaagatttaattgttgaaattggtggttctgcaccaaagattggtcctgccgaaattttgccttttgatattaacccaactactaaagccaatattgctgatgccattgctaaatttgatgctactattgctgcccacgatgaagaaatcttccaacattacggttacggtaaaggattaatcaagaaattcaaggtttccccaaatgcttacgttcaaatgttgatgcaattagcttacttcaaatacactggtaaaatcagaccaacttatgaatctgctgccaccagtaaaattcttgaaaggtataactga

SEQ ID NO: 1284 - DNA, 243 bp, Candida albicans
tacatttcatcatctcaagtgccatcagaatacttccaatcctggggttggtcacaagttattgatgatggtttcggtttagcttatttgatcaacaacgactggattcatgtccatatttcttgtaagagaggtaacggtttgaaatctgatcatttgaaatggtacttggttgaaagtgctaacgaaatgaaagacattttgaccaagggcttgttatctgaaccaaaggccaaattgtaa

SEQ ID NO: 1285 - DNA, 708 bp, Candida albicans
ataaatctaaactttcatagttacccatacactacagaaaaagggagtgggaaccacctaacaaaaagaacaattccccgtctcaatatgatgccaccagggggacgaaagtccaaaattagaccaccaagaaaatcactaatcagctcgtcatcgtcatcggaaaactcaaccaccgatccagtaatagatttcgataaaaattggtcagttttatctagtgccatctcccaaatccaaaacaaaaatgtatcaaacttatcatatgagcaattgtatagaaaagcctatgtgttggttttacgaaagttcggaggaaaattgtatgataatgtggcaaacgttattaaaacccatttgctaactagaagagaaaaattattgagcgtgtctgccaatcatgatttgttcatgcaatcgatacttcaagaatggagcgaacatttacaagcaatgaagtttataagtgatgttctcatgtatttaaataaagtttatgttgctgaacacaaaaaattgctaatctatgacttgggcattcaactattcaaagattatgtgataaaatataacaatgatgaagttgggtctaaaattgtcaatatggtgattgatgaaattgccaagagtagaactggggttgttatcacgtcaagcatgtatatcacgaaaattatcaattcttcaccacggctggagatcccactt

SEQ ID NO: 1286 - DNA, 729 bp, Candida albicans
gggatgttggttgggtacttggctaccgaacaggaagagaaagggttgttaaggaataaaaacaacacgccagttgaagttaagttggtcaataaggatgataaggattttgatatgtatgagttccacgaccatttaccagcagaagaaaagttatccattcaaactgatttcgaggaagattccaagaaacatcgctttttggatttgaacaaaccattattaatgcaattgttgactagcaatttctccaaagagttttatttggaccaagtccatcgtccaagacattatgggaaaggatctgcacctttgtttggaaacttcttggagccaatctcgttaaccccatggtgggttatacctttagtttggttgcctcctaacttttatcttttctatgttggatttgtcaatcagagccccattactgcgttgagtgtatgggtgatgggattatttatttggacattagtggaatactgtttacatcgtttcttattccacttggactactttttgcctgaccatccttatgcatttgctctcccactttcttttgcacgggatccaccactatttgcccatggatggctacaggttggtcttaccaccaactttgtttttggttttggcctacccattctacaagttgattttctcaatatttcctttctatatggcttgttcaggatttgctggtggtaccttaggttatatcatgtatga

SEQ ID NO: 1287 - DNA, 429 bp, Candida albicans
tggaatactgtttacatcgtttcttattccacttggactactttttgcctgaccatccttatgcatttgctctcccactttcttttgcacgggatccaccactatttgcccatggatggctacaggttggtcttaccaccaactttgtttttggttttggcctacccattctacaagttgattttctcaatatttcctttctatatggcttgttcaggatttgctggtggtaccttaggttatatcatgtatgatattactcattacgtgttacatcacaccaagttgcctaaatactttcaaactgtgaaaagattacatttggaacatcattacaaaaactacgagttgggctttggtgtgacatctcccttctgggatgttgtattcggcactgagcttaccaatacttttgaaaagagaagatag

SEQ ID NO: 1288 - DNA, 1527 bp, Candida albicans
accgttaaagtggtcttacaattactacaagatcgcctaatgtcaatttcccattctgatcgtcaacaattattagaacaaaaacggcagagattacaggaattgaaacagagacgtttgttacaacaactgtctcggctgcccacacctgaagaaccgcatgcgttgttatttaaaaagcgtgttgatgcaacaacgcaaacacaatacgatgaaatatcatcaaataaagcaaaccccatcaaccaggtaacaaagaaggaaattgataaatacgacaaatctgttcaaactacaacaccgatccaaattgaaacaccatctgtacctgctgagaaaaaagtcaaccttcttgacaagcaagccatttgtgaaaatgatttgaatgaagctttgacaacttccatcaaaacggtgaataaaattcaaattaccaagacaatccaactagaccaatcagcaaaacgtgcttcggatgtgaatttgctttcgggatttaacatcacagcaactcataatttcaaacagacaattcggtgtatggatgtgttgtccaagtcgttagcacttgcgtttacagataatgaagccgtggtatatgatttccaggaatcacagtttttccctgagttttacttgaagtcactctcaggaattgaaatcatgcaatttgataaatataacaaccaccgaatagtagggggcttgagtaatggtggaatctgtatatgggagttgggaaatagtagtatttctttgatgccagttttgtctactccgttgtactcgtctatccttcgaacatcagcattgctgcatttagataaaattgtttatttgactcagtttcttttagatggtaatccttgtatcttatctgtgtcacgagatggtgtcgttaatgtttggtctgccaacttattggtggagccaaagttgtcttttaaaatatttgggtctacaagaaaagctgacgatctgcaagtcatgaatggattgtatttgggaccagatgagattgttggtacaaattttattctcgatttaattgttgctacaaacgatgggagaatatataaaggtaatggcgaacttgtacatgaggactgtctatctattattggttcattaatcaaacttgataaccttataatatcgagtcattctgaatggaacttcaaaatttggaaacagcaacaagttcagccgttcaaggacattccaacaccatatattgtccgtcagatgataatcagacctcaaagaaaattgcaattggtaactgttgggtatccaaatttggcgaatagtcgttatgttgtggatatctgggatttgagcaagaagatatattctcctatcaccaccataatggaatctgtcgataaaattgatgatattgcctttaatgaaactggtgacactttcattgttgttgtaaaaggtaatatgactgtttactccattgatgattcaaagttttccagatttgaaaaagatgattcccattttgataaaggtatataa

SEQ ID NO: 1289 - DNA, 261 bp, Candida albicans
tctatagctatattgaaagcatctgatttggccgaagaaattcaaactaaaatatttgaattatcgtcccaggcaatagccacttataaaattgaaaaagatattgctgcatttttgaaaaaagaattggatcaactttatggtcctacatggcatgtaattgttggtaaatcatttggaagttatgttacacatgaacaaggttatttcatatatttctatattggtgatatggcatttttaattttcaaaagtggttaa

SEQ ID NO: 1290 - DNA, 939 bp, Candida albicans
  unsure (905): Identity of nucleotide sequences at the above locations are unknown.
agaatggcttctaccagatcgaatgctcgtttgattagatttgggatctttgcccttgttttaataggatgtggctatatccttacaagaggctcatcattccaacctccaaattatcaacaaacacaatcacccgccgctcatgaaaaacagaccggtaatgttgctgctggaggtggtgctggttcaggttccgcaggagctcaagttccattaggcaaaaatagaggtccaataccaaaagcaattatgggagctggtgaaggtggtagtgatgctccggttcctcaacaagatattcctgatagttataccctcaatgacaaaattaaggctacatttgtcactttggcccgtaactctgatttatattctttagctgaatcaattagacacgttgaagatcgtttcaataagaaattccattatgattgggttttcctcaatgatgaagaattcaatgatgaatttaaagaaactgttggtagtttagttagtggtaacactaaatttggtttgattccaaaggaacattggtcatatcctccatggattgatcaagaaaaagctgctttagtccgtgaacaaatgagagaaaagaagattatttatggtcattctgaatcttatcgtcacatgtgtagatttgaaagtgggtttttctggaggcaagaaattttaaacgattatgattactattggagagttgaaccagatatcaaattatattgtgatattgattatgatatctttaaatggatgaaagataataataaagattatgcattcactatttccttaccagaatataaagaaaccattcctactttatgggacactactaaagaatttattgaaaaaaacccacaatatttggctcaaaataacttgatcgattgggtttngttttcaccacgagccgccagatcagaatatagt

SEQ ID NO: 1291 - DNA, 2538 bp, Candida albicans
accattcttaatatagtcagatataaccttaacttattaattatcatggctaggaatagtattaaaaaatctcctgtggtgaagaaaaaggatactccaatagttagaaaaagaaagccaatccaacaagaagcagaagaagattccaatgatgaagaatctgaagatgagttaaatgttgaaggattgatagatgcaagtgatgatgaagatgaagaagaagaacaagaacaagaagaacaaccccaagaagaggaaaataacagtgatgatgatgatgatgacgatgatgatgacgatgacaacaactcagaagcagattctgaagaagaattaaatcaattattaggtgaagaagaagaagaagatcctagtgattataattctgatgaattttctgatgaaccaaaagatgatgatttatcaaggatcaacatcgtatcattatcagtttctgatccttcaattcaaaaaaattcaatttcaaaattttctgatggttcaataagaattttaaaaccagaaattgaacctaaatatgatagtgatgatagtgatgctgaaaatttcaacactattggtaatattcctatttctgcttatgatgaaatgccacatattggatatgatattaatggtaaaagaatcatgagaccagctaaagggtccgctttagatcaattattagaatctattgatttacctgaaggttggaccggtttattggatcaaaatactggtacttcattgaaattaactgatgaagaattagaattaattagaaagattcaacaacaagaaaatactgatgaaaatattaatccatatgaacctttaattgattggtttactaaagatgaagaaatcatgccggtaactgctgtcccggaaccgaaacgaagatttgttccttctaaacatgaagctaaacgagttatgaaaatagttaaagccattagagaaggtagaattatcccaccaaataaagttaaacaacaattaactgaagaagaagaagaagatcaatttaattttgatctttggcaagatgaaattgaaatatctgatcatattatgaatttaagagctcctaaattaccaccaccaactaatgaagaaagttataatccaccagaagaatatcttttaactgaagaagaaaaatctaaatggttacaagaatctcctattgatagagaaagaaatttcttaccacaaaaatataattcattaagacaagttcctggttatcaagattccgttagagaaagatttgaaagatctttagatttatatttagctccaagagtacgtcataataaattgaatattgatcctgatagtttgattcctgatttaccttcaccaaaagatttaagacctttccctattcgttgttctactatatatgaaggtcatactggtaaaattagaactatttctattgatcctcaaggtctttggttagctactggttcagatgatggtagtgttagaatatgggaaattttaactggtagacaagtttacaaaattcaattaattaataaagaaatcaataatgaagatcatattgaatgtttagaatggaatcccgattctagttgtggaattttagcagtttgtgttggtgaaaatatttatttaattgtcccaccaatttttggatttgatattgaaaattctggtaaattaagaattgaaagtggttggggttatgatacttttggtaataaaaagaaagatcttaaaatttcctcccaaaaagaggaagacaataaagaatcagacaacgaagacgaagacgaagaagaagataatgatgatgatgatgatgatgatgaaccagaaactagctcaactgttgaaccaaagaaagaagttgctaaatggtatccaccaaatactgaacaagcttctatgggtatatcagcaattattcaatgtcgtaaaacaattaaaaaattatcatggcatagaaaaggtgattatttcgtcacggtttctcccgatagtaaaaacactgcggtattaattcatcaaatttctaaacatttatcccaatcaccatttaaaaaatctaaagggattataatggatgctaaatttcatccatttaaaccacaattatttgttgcttcacaacgtcaaattaaaatttatgatttagctcaacaagtattattaaaaaaattaatgcccggggttcgattattatcaactattgatattcatcctcgtggtgataatttaattgctggttcttatgataaacgtgtattatggcatgatttagatttaagtgctaccccatacaagacattaagatatcatgaaaaagccgttagatcaataaaatttcataaaggaaatttaccattatttgcaagtgcttctgatgatggtaatattcatattttccatgggactgtatatgatgatttaatgaacaatcctttattggtaccattgaaaaaattaaatggtcataaaattatcaatcaaattggtataatggatttaatttgggcatcctaa

SEQ ID NO: 1292 - DNA, 1584 bp, Candida albicans
cgattacagacgacaacaacaacaataaagatgtcaaaaagatcagctgaagatgatttaagtggcaatagatccaccagtcatactgccattaaaactaataaagattctcttccaactactacaaatggaaaggaagaagaaccagacaatatggatattggggaatttgaagatccatacggtgatgaatttgaaagtgatgaagaaattatagaattagacgataacaatgatgaagaagatgatgaaatgattgatgaaaattcaacacaagccaaaattgaagaattagaagccaaagaacaagaacaagaacaacaatcatcaatatatttacctcataaatcaaaaccattaggaccagatgaagtcttagaagccgatccaacagtctatgaaatgttgcataatatcaatttaccatggccatgtttgactgttgatattttaccagattctttaggtaatgaaagaagatcatatccagcaacagtttatttagctactgcgactcaagctgctaaagccaaagataatgaattgttagctatgaaagcatcttcattggccaaaacattagttaaagatgaaaatgaagaagatgaggaagatgaagacgatgacgatgatgttgatagtgatccaatattagattcagaatctattccattaagacatactacaaatagaataagagtaagccctcatgctcaacaaactggggaatacttaactgcttcaatgtcagaaaatggtgaagtttatatatttgatttactggcacaatataaggcatttgacacaccaggttatatgattcctaaatcatcgaaaagaccaattcatactattcgtgcccatgggaatgttgaaggttatggattagattggtctccattagtaaatacaggggctttattatctggagatatgtcagggagaatttatttaactaatagaacgacatcaagttggaccactgataaaactccattttttgcatcacaatcttcaattgaagatattcaatggtcaactggtgaaactacagtgtttgccacgggtggatgtgatggatatatttgtatttgggatacaagatcgaaaaaacataaacctgcattatcagtaattgcttctaaatctgatgttaatgtgatatcttggagttctaaaatcaatcatttattggcatcaggacatgatgatggtagttggggtgtatgggatttgagaaatttcacaaacaataccaccagtaatccttcacctgtggctaattatgatttccataaatcgccaatcacatcaatttcattcaatccattagatgaatcaatcattgctgtttcatcagaagataatactgttacattatgggatcttgctgttgaagctgatgatgaagaaatttctcaacaaagaaaagaagctcaagaattacatgatattccaccacaattattatttgtccattggcaaagagatgttaaagatgttagatggcatccacaaattcctggttgtttggtatctactggtggtgatggattaaacatttggaaaactatatctgtgtaa

SEQ ID NO: 1293 - DNA, 864 bp, Candida albicans
aaaaattacaatagtgtggcagttgctactatatacccagtgcttgcttcatgtagagcatttgaagattataccagagtcactaattcccttgcatctcaaaatttgaaaattggtggattcaccgtgcctttgaattatctttataatagaaatttaggaggcacaccaaactccgaccctaatgataaatcatcatcttcaacttctacaaatattagtattaatgatgaaagagcattacaaattcatttaatttctattcaaaaatggtttatatattggattgtcattgctataatttctttattagaaaatatattatttttaaaatatgttataccgggttattcaatttttagattaacgtttaatatttggttaatcatccccatgatatcaattaaacaagaagttgatgccaattctacatttgataatactattgaatggaaaaaattcacatctaatggagcaggattattatattttagttatattaaaccatttattgaacaacatattgattgcattaggaaattttctattaatccattgaattttatcctggttgagaaattgagaaatttgtacaataagagtaatcaggtgtcatctaacgacacaaacaatggtaatacaagtaccggtagtagtaataataataatgattattcaaatgttttggattcttttgtgatggttatgaatatgaagaataaattcactggaggtgcaaatagtacgagagatattaatgaacttgataataagaatactagtgccgacaatgaatttgatgttgttaatattactcctgaaactgatagtcaagtgaataagaggaaaggtttcttttggtaa

SEQ ID NO: 1294 - DNA, 1584 bp, Candida albicans
aacttacaacacaacaacaaaaaaacccattctaaatcactattctccattatgaaaattttcagattattttcactactaatcgtacaatttatcataaataccactgttgcagtatcacctgtgtcagcagttttaccaaaactgagtttcagtccatttgattcaccagaattttgttcacagatcataactcccacttgtaatacaactttcacctacattgatgaattgaataaagatattcgtccctacttgtcggaattagtcaagaccctgtatttccgttattttaaagtcaatttagataaacaatgtcgtttttggaatgctcaacatttttgtgctagtgaaaactgtgctgttgaaatattggaagatttcaattggagtcaagtcaccaatgaaagtttgaaaccttcaggattaggtaagatttcattacctgacaaatcatcaattgataattccattgaaaccgaagaagttcaaacttgtgaagatttagattatagtgaaatagatgatgaccatcattgtgtttatgtcaacttggtaaataacccagaaagatttactgggtatggtggtaatcaaagttttgatgtttggaaggctatttacctggaaaattgtttccctaatactaatccaatgtcagtgacaaatgatgccgacaatggtggtgaacaatgtatcgaaaagaacttgttttatcgtgttgttagtggtatgcatgcttcaattgcagtacatttatcaagagaatatttgaattctgaaactggtgaattttatcctaatttaaaggtgtttatggaaagagtaggtatgcataatgacagattatctaatatttatttcaattatgccttagtgtcccaagctatagttaaattgagtgaaattttaccattgagagagttcattcaactggggtatgatgacattactccagctcaaaagcaacatttattggctaataatgatgtcgaatcagtcgaagtttatgatcgtttgttgttagatgacattattcctagtttggaagcaaatgttgtgtttaatacttccaacttgtttgataatagcaatttgagagatgaatttagatcaagatttagaaacatttctgccattatggattgtgttggttgtgatagatgcagaatgtgggggaaaatccaaaccattggttatggtaccgctctcaagattttatttgaagatgacaactatgataatcacaatttgaaatttagaagaattgaaattgttgccttgattaatacttttgatcgtttatctaaatctattgaaagtattaatatgtttaaagaaatgtatttgcaacaccttaaagatattgctgaaggattaacccaacctggtgtttacgacaaaatacaaaacaacaaaccaggtaacggatttgccttcccatttgttagtccattacctcagaaaaaacctgaccaaaccaacacccccaaaaatcaacaacaaaaacaacctcaagaaactgacaaaaaaagacttacattgcccaccaggcgtgatagtcgatcttggttagagggagga

SEQ ID NO: 1295 - DNA, 669 bp, Candida albicans
agaacatttaatatgtatttcccaatcattgtatggttatatgtatctatcacttttgtggttgccaattatggttttgatcaatggacaaatgatgatttaaaacaatttttaaaagaacgtaaagtggcattcaatgatgccttggagaatccaaaattaattagtttggctaatgaagaagctaagaaattagaaaaaggttacaagaaagttactgaagaattaaataacaatttgaatcctccagatgattcattaaatgattatttgaattttgattacttatttgggaaaagaaaagaaaattattcaattaaagaatggatttttgaaagttggccagtaaccagtttgcaaacttttttaactcaaaataatatccaatatagtgcaaaggataccaaagatgatttaatcaataaggttaaagatcaatttgattctatttctaagaaaaatcatgggtctagtttttatcctggcaattggttatatgaatcttggtcagaaaatgatttgaaagattggttgaaatcttatggcattgaatttaatcctagttcaacaaaggatcaattggttgaaaaattaaaagaatttagttatcaagccactcattcaattagagattccaaagatgtcttcaccacgcggctggaaaatcca

SEQ ID NO: 1296 - DNA, 636 bp, Candida albicans
  unsure (596),(614),(629): Identity of nucleotide sequences at the above locations are unknown.
attcatacttggttggcaaacactgaaaagaagtctcaaccttggatcacaaagggagaacaaaagtctcagaaaaagaagggtagtaatttgattaatgatacattctttgttggtattaataattggtccaaggataaattgcgtgaattcttggatgtcagaaaagttccttactcaatatttaccaccaaacatcaattaatcaagttggtgcaaaagcacaagtttgatccagttcacgttgacacatatgcttggattgttgatgatgtctctactgattctatcaagcaatggttaattgaacaaggtgaaaatgtagaaggtacaagaaaagatattgtgtctgccttccaaaaacaatttgagtctttgaaaaaaggatttaaggatgctttcaacaatgttgatctgcaaattcgtttatttgcaccagatattaatggctataaaaggtacttgcagaagaaattgagtgaagctgaatataaaaagttgactgaagaccaaatttcacaaggttttaaagttgttcaagaatattataatatggctggtgatgctgcgaagtgggcatttacgccgacaattanttacagtttgctaaaacnggcaaaaagtatccnccactaa

SEQ ID NO: 1297 - DNA, 1944 bp, Candida albicans
ttcactaataaagaaacctacaacacaaaataccttaccatgccttcattagtaccagttagctccagctccagaacgactctctcattgagtggggccaccggaaataactcatacaacaatcaatacggtgtttatgggaatggttatgtacaaagcttgggccataatcaccgtggtatcgaggatatgaaaagaattgagatgtccttaaaatcaggtattgattcagagattgcatgggctttgagtctgttaacccatatgtctatacaaccattaatagatcttgaacagagtccttttctcggtaatgagttaatcaaatatttcgtgaaaccatatcaattaattcaagaaaaaaaatttgacttgttaactcaagatatattaacatttagtttggattcagtgttgactttaagaaatttgtcacaggacttgccaaatcaacaatggttatcacaaattccttcatttaagaaaaacttgattgaactgataaaattcttaacaaattggttttaccaaccaggtggtaaccaaattcctcagtttgagaaatataacaatcaatttgccgaatctttgaattatattgtggacttattggaaccattgacatgttactatattgataacagtaaaaatgatacattgtttaatatattgttaaacacattaatgattaccacggatagaaatttatttatcaatattttgaaatgtatttctcacttgttgattatttgggataagggtgccaaagcaaaggccgaggaagatgggaacggcgatgacgaagatgaagatttggcacaagaagaagaaggggaagaagaggtgaaattaacaaacaactgcatagacagtatttctgattctcaactagagactatcatcaacactcttcttattgccgatagcgagatgaacaatgctgttttggattttctcaaaatgtatttgttttccgaagccttgcatgaaaagtattccagttccattaaagattctcagagacatagattgagaaagttgttacagttaaacacttctaaggccacattcaacactttaatgaaacagttacccttgttgttagtatctgacttgcctttgaatgaaccgattgaagaacaacctgtcccctccttaaacttgacaaagagatcccaatactcaggggtgcccacatctgcaccagaattaactgaagaattatacaaaataattgtggcttttcctgaaccactaagagcttcaacctggttgcattgctgttatgaggcaacaatgactgaacaggcagaagtgacacaaatttctatttggaaagcttatgaaacacaattccaagagatctggaaaccaaataccgagggaactctcaatcataactataaaccacttttgcctgctgtggagtttattaaaaatgttacgaaagcatttccttatgctgaagctaaagttgtagcattacctcaagctccaggtgaagaaaaccaagctcctaagaaaaagtttattatcaaaggaattcagcccagacaatttccagtgagtatagatgttggtaattatgatgcattgaaaccaatgggagaagccactgttaccgaaggtgatgaaagtttaccaattggtcatatggatgtcaaaaaatttcatcatctgttgacttctggtgtggataacattttgtttgcggactctgccaataaaatcgccaaagaatcattgaatctgattaacgaatccagtcacgatatattagaatacattatactggaagttttggaagttgcagggattgaatcgaaagaatctagcatattccgtctttacaataaatactggattcctgaattagtatacgccaacccttctttgttagaaaaaggtattatagaaaccacttggttgaaatatttgctataa

SEQ ID NO: 1298 - DNA, 1104 bp, Candida albicans
ctttatccagaaatgactagagaaactgatccattattgaaaaatagacaacaaccccaacctcaaccattggtaaaaccattgtttaagaaattgttaacaattatcattccattatcattaatcattatatctagttattacatcatgacacaccaccaccatcaccaccaccaaaacgacccaaacaacactgatggacctattttaactttaagattatatactaataatattcgatttgataataaaaattaccccgataaatatgaacaaccatgggaaatcagaaaattccaaagtattaattcaatgcaattcaatacatttcaaggtaatggcaatattatttgtttacaagaagtattacataatcaattaatagatatattacaaggattaaatgatattcaagaatggaattattatggagttggtagaactgatggtgaaaaatctggtgaatttgctccaattttatataaagatcaagattttaaaattattgaaaattcaacattttggcttagtcctacacctcatgtgcctagtaaaggatgggatgcagcattagaaagaatagtcacgatggttacttttcaaagtcgattaaacccggaaataaaatttaatatatttaatactcattatgatcatcgtggtgttgaagcaagaagaaaatcatcacaattaatcgttgataaaatgaaaaattataatgattatccatcatttttatgtggtgattttaatactgaaccaaatgatgaaccatatcatattttgactaaagctgggtttaaagatgggaaaatattaattgataagaaatcagcttatggatttgaaactacattcacagggtttgatattaataatgaaccaatttccagaattgattatatttggtctccaagtttcactcgtattttatcaaattcaaataatgatactaaccaagactcagatgatgataatgataatgatgaatcttatgaagtgactttgaaacaatttggaatattgagtaattggtttaatggacatcatttctctgatcatcgccccgttgtatcaacttatgaattaagaaagaagaaataa

SEQ ID NO: 1299 - DNA, 1539 bp, Candida albicans
  unsure (753): Identity of nucleotide sequences at the above locations are unknown.
cctggacctgatccacaagcttttggcaacagatcaatatatttagggaatttgcatccaagtactactatagaagaaatcgccaataacgttagagccggcggcttagttgagtcaattaattaccgaccagagaaacgagtttgtttcattacttttattgacccaaatatagcttacaagttctttatgagtcaccaggtattacatcaattagttattcatggctatgaagtcactgttggatgggcaaatcaacctagtggaccattaccacgtgacattggagtcgctgtcagttcaggtgcaacaagaaatgtatatattgggatcaaaactgctaatagtagtgctcttgattcgtctgagaaagtaacaaaaattccattaccatcagaaaaagaattgcgggaagattttggcaagtttggtcctttggaacaaatcaatttcattcacaatagggaaagtgggtttatgaattttttgcgtattgcagatgcaatcaaagttgtttccatttttgaacatggtgttgccattagcatgaaacgattaaaaagagtttttaaactggaagaggaagctgaaaagttctataataggtacaaaacttataaagttagttttgctaaagatagatgtggtaatccgccaaagttttcatttaagaaacgaagtaccgatcatccaaacatgtaccaacagtatgaccatcattcaacttctagtctcagacatctgcgaagtaancaagagtctcattccagcgaacaaaatagtacaaatgaatataacaaggaagtgattgcacaagaagcagcaatggtttttggtattgtgagcaaaactaatgcagatagccagggaaatacatctactgaattgtcagatgtaccagaaactaaagaagaagatggtgaagtacatgagtatgcagcaccaaaaagtaccaatactcaaaatggagaaaacaccgataaaggtaataaactggaggatatcaaagaacaaaaaacagaacggaatggtgatcataacaaagatagagaagaagaaaataatgacgaggaggaagatgatgaagatgaagatgacgacgacgattatgacgatgtatctataatcattggatctgatgacactgcatcatttaacaatagtttcaataaggaaacaaaaggagaacataaatcatcaaggtcaagaccacgataccaaaaaatatatcataatagttattctgagccaacattcagaagaagttcttcaaatttgtcaataaatggttctatgaattacagccaaggaccatatatgcagccacaacctgtttattttttgccacatcttagtcgtaacaattcttcatctagctttatgtctagtaacatgtacggtccaccaggtaatgccccaccacctcatccgtactttgtttcacctccccaatttataccccaaccccaagtttgttatcctccaatgatgcaggtcccaagtggacaggctcttcaccacgggatggaaatccgcgtc

SEQ ID NO: 1300 - DNA, 1245 bp, Candida albicans
aatgtttctttcaattctcttcaccaaaacattatggatacggtacttgaaaggatagtgggaaccttgcttgagacaagaaactatacttttacggagcaatttcttgaccaactaacagaactcacattacaatttgtcaatgaactttcagcggatctttcaaagtatacacggatacagagaaggcaacagccatctttatctgatatcaaactattgttaaaactaaaacatatttcaataaatgagctaataagggaaattgaactaagcaagaagtttacgtaccgaaagcaactagcctcattgttagaccagttggtcgaagaaccaatcaaagaacaatcacgtccattctttgaccaatcgtcaatcacagagctagtacccagattaaatgtcaaaccagactatatcccgtcttatttacccgatctacctccagactatacctaccaatcgaccccggagtacatggaaacactaacagatttaaagaaattgcgaatgaaattagttgaagaatcaagaatgacagaaaactctttatacaaattgattgaatatgatgatattgaatggagacagaaattcgagcaagaattggtagagttgagtcctgactcatcagccaacgaaaccacagaagtaccaataccgactaccaatgggaagagtgaagatttcaaatttgatattgttgaatatgcaagaatgagaaaacgacttttgattaaaagagacagagatttagagaataggcggaaagcaagagaggagaacatgttcatgaaagcagaaatgtactattcaccatactccacactcaagccaacagcagaagtcaaacaatatttttccgatgccttatcggacggattcaagagtgtgattgtgtcggtacgaaatgcagaaaaactcaaagagcaaaacatcaaacgtcaaatggaagaaaacgccagacgtgaacaagaattgcagaaacaaaacgagtctatatcatttagctttcctacaataaaccaattggaaagtgaaagcgagagtgacaatgacttcgagcaagaagtaaaagacaatatagaattaaactttgatggtagtgaccacgagagggatagccggaatttggttgtcgtacaaaactcggacgagaaagccttacagcaagatcccccaccctctaagtttgccgaagacgtatctgacatgtcgtcggatgatatggacactattgcgtga

SEQ ID NO: 1301 - DNA, 276 bp, Candida albicans
aaatctattctttccacaatcctaaaagaacagggaacaatgtctgcagccgaacctaccaatatagatttaaattcattacctcctcagcaattgattgagtttcgtaaatcgatagatgaggaaatcacccatttcacacaatccttgcaagccttgtctgcagcccagtcaaagttgaaagattgtatttccagtataaataacttggaacaatccaaagaaaatgatttattagttccattaacaagctccttatatataccaggccaatga

SEQ ID NO: 1302 - DNA, 1746 bp, Candida albicans
agacaaatcagtaaatggaaagattctgttcaagctttgagacaagctgaagttttaaaatttccaatgatcaatcaagagcaagatactattcgggattcagcccttacttttagatcagataatgtgccgactactgaacttgaaaaaagaatcaataatgtgttaacagaatcttcgcttgttgacgacaagaaagaggcaacatttgaagaaattgctgtggctaagttgagtcccgaagagatgaaaaagagaaccaacgaattgagattgatgcgtgaattgatgttccgagatgaaaaaagagccaagagaatcaagaaaatcaaatccaaacagtatcataaaattcaaaagcgtgaacgattaaagaatcaagaaatggttgaaggtgaagattttgacatggaagatgaagaccacgatactaaaagagcaactgaaagaatgagtttgaaacacaagacacaatcacaatgggctaaatcgatgataaaaagcggattatcaaaagatgcctccaatagagctgaattggaagaaatgttaagacaaggtgaaaagttgcgtaccaaacaaatgggttttgaagacggagaccaaagcgatgaaaatgctgatgatattataaatgaatacgatcaagatgatatagacgatgaaaataacttgagaagcaaattgggtaaaggtgttatgaatatggatttcatgaaaaaagctgaagctcggaaaagagaagagaatttgaaagaattggaaatgttgagaaaattagagaatggcgaaggtgatttggaaattttcgaagaagacaatagcgcagttaatgtcactaagaatcaaggaagaagaatatatacaccagcagcagcatcccaaataaatgacaataccaatgagcaagcattagaagacattgaaaatgacaacgctaaatctttagataaaaaattagccaaaaaatacaaagtcattgataaccaagaaacaaaaacatcagctaaatcagaatctaaccctgaagttttgcctgtcgatgaatcaaatccatggttgtcatctaatactagtgctaataacgacaccacaaaaaagaactctgccaaaataactacagttgataaagagtcttcaaaattggctaaagcagctgccaaattagccaaatcaaaattgaaaaaacacaaatctagtgatgataataccttaattgatgtgaatgagacattggctgttaatgatatttaccaagatggttccgaggatgaagatgaatcggttccaacaatgtttaaacaaaaggatttgattaaacaagcttttgcaggtgatgatgttgttagtgagtttgagaatgaaaagaaacgtgtcatcgaagaagaagacgacaaagaagaggatttgacattacctggatggggtgattgggctggaggtgattcaaaacccaagaagagaaaagtggtgcgtaagattgacggggtaatggcaaaagatcgtcgtaaagataaaaacatgaagaatgtaatcataaacgaaaaagtcaataagaagaatttgaaatatcaaagtagtcacgttccatatccatttgaaactagagaacaatatgaaagatcattgagaatgccagtgggtcaagaatggacatcaaaagaaacccatcagaaattgactatgccaagagttattgtcaaacaaggtacagttatcgatccattaaaagcacctttcaaataa

SEQ ID NO: 1303 - DNA, 1434 bp, Candida albicans
tcaatgacaagtatagaagaggaagaagatcatacccaagattcacttggtaatacaataatcaacccatctcaaaaaattgaatcaactaatcaaataatcaaccatcctaaattatccattaatgatctaccttcagaattactcattcaaattttcactcatttagatcctatatatcttaattcattaagacttgtttgtaaacattggaattatataattaatgataaagaattatggatgaaatctttccaattaagattcaatatccccattacatcatctagtttcccatcattatcacaatcactgaattggatgaatgaatatttcatgagattacaagtcaataaaaattggaaacgagggatatcaatacataaaacttatcaaatcattaataatgaacatagatttaatgatttgactatggttgattttggtatgaataaaattttaacgtatgataaacgatataataatatctcgattgggaaattgtctgatgggaaaaatcaagggtttatacctgggggtaatattaatggatttctgactgatgtattatgttttgatattaattggaattatttggtgatagggacgaaaaatggggaaataatacttaagaatttgtatacttcaacatcatcagtttcccaaagatcaagtgtgacaaaatttgatacaatagatgaagaaagtcccattatggatattattatgaataaagatgtaataattagtgggtcctttgaagggatcataaagtgttgggatttacaaggcaaaattgtcaaaaaaattaacttagaggaggaagtgatatataatatatcaagtgattttaaaaaacatataatcgtcaatactgatcgtcatatatttgtcattaattatcaaactgaagagattatatcaaaaattgatttagggtttataatcaatgaaaatgaatcaatagaatatgatttgttaataagactgaaaaataaattagatgttgattatggaactcaaaaaattattatatgttacaaatcatttattcgagtgttttattttgataaccacaattatagccatcgtgaattgaaattagaaaaagatattgaagttatagattcacattttcaaattgctccccccaacaagtttttcaacagaaatacatatgtagtaggacaagatggattattgtatggtaatttattatctgatggcagtgtaattatttggaatgtaagagaagattcattattaatcactcctattatacaaatttatcctcaattaaatcataaaaaatattcttatggacttaatcatgccataacaagacataatttattagaaatcacatcatttgccatgaatgggaccatgatagcaattggaggtatcttgacccacgcggctggaatatccgag

SEQ ID NO: 1304 - DNA, 546 bp, Candida albicans
agtctttttcaaactgaacaatccacgaaaaaaaaaaaccaagggagatcacctacagtttcaaaactgtttacttcttccaaacctctcacccttcatcgtcattgcatcctattctttcaattcccagcttgcaatttaccttcagtcttttatataccaaaatttcaaaccgatttctttcctttgctatcatatagacgccctatgacaatttactcattttttatatttgatcgtcactgcaattgcatttacaacagagagtacacacacactgcctcatccaacgacactttgtcaggacaaataaataaaagcaatgattctaatagctcgaaattattatttggaattttgtattcggtgaaaacaatatctaataaattggccaatgacaaggatactgagatgaatgaattgaaatcgttcacattggttcgtttaaagtccatttttgggagtcattatcacggtttaaatttgttattgtcaccaatggagaagtcagtcaattatctgatgttttatttgaattatatctga

SEQ ID NO: 1305 - DNA, 744 bp, Candida albicans
gctagacttggaggtggtattttatcacttggattggtgttattgtttactaattcagtttatcgctcggagatgagaagattcaaccgtaacatcagagatgatttgactagagtaaaagctgacaatcgtttggtaaacgaattggaaactatggaatggatgaactcttttttggacaaattttgggttatttatatgccagctttgtctgaaactgttatgtttcaagctaacgaaatattgaaggatcaggcaccaggttttggtattgatgctttatcgttggacgagttcaccttggggtccaaagctccaagagttgattttattaagtcatacagtaagactggccaggatttgattgaaatggattgggctttttcatttgctcccaatgatactgatgatatgaccaaaaacgaaatcaaaagaaaaattgacccaaaggttgctcttggtgtgactgttggtaaagcctttgtttcgaaaactttgcctattttagtggaagatatgtcgttcactggtagaatgaaagtaagaatgagactttccgcaaacttcccacatgtcaagatggtttctgtccagtttttagaagccccagaaattgattatgccttaaaaccagtcggtggtgacaccttcggtattgatatcatgtcgtttattcctggtttgtccaagtttgtgaacactatcattgacgtagtcttcacctcgggacgtgacaatacggca

SEQ ID NO: 1306 - DNA, 1512 bp, Candida albicans
caagatctaaaatcaaataattgttttactttcatattatgggtcaatccaataaccaatatgggtggaggtttaacaagtttaacaagctttgcatcttttagtagtttagcaatgcacgactccaaacggtatagaaatcttgttgtcaaaaaaaaaaaaacagagccaacatcaacacatacaccaataattcatactattcgccatcaattgttcatcacaatgagtctgttacttttagaaactttacaagaaggactagaggatgaatatgttcaattgttaaatctggattcaagtttcgctcaagatgcagaaaaatatttacaggaattattagttaatgacgatttgttatccactgatccatataccactgcttctggagattcatcatatcataaaaagacattaactgaagaaatagcagagttggatatgtctcaacatgaaatcaacaataaacttagtacaatcacaaattctaatcgagatttaattattgatataagtaatgatttacaatttattaatcatcaaataactaaagaatacaatcaaaataccgaaaatttagtgaaaagtataactagtgattttagaatagattcatcaacatcaaattattttaatttaaagactaatattagtataaataatactattttgaataatattgattcagtattggatattttggaattaccaacattatgtaaattatgtatattacaagggaattatcaagaaagtttagaaatatcaacttatattcaaagtttaatgattagatatcccaaaatcacattatttaaaactataaatgaacaaattgattatggattaaaagtgatgattagaggtttaattaaattattaaacactaatttaaaacaaaatcatattttgaagatattccaaatattacataaattatttgataataataataataataataataataatgataacaattatgagaactgggatattgataatgaatcaattttaataacaatctttttaaattcaagatttaaatttattattaatgaaatttccagtttgaaaccattaataaaattcaataaattaacatatttgaaaagatatattgaaatatatcgtgaatttatgtttaattcattatctatttataatataatttttaaaaacaaaacccacaaccaaaaccaacaacaacagaaacaaatcattataataaatcaatttattcaaagtttagtaaaacttttatgtcaagaatttaaacattatttacctgatataaaatctaaaaaaattgatgattcaattgaatcagaatttgaattgaaaagttcaatagatggattgatattacaattgatatatttatgtcgatcattgactggatttggattagattttgaacccataatattgttagaattggtaaatgatgatcttatacctgaatcagattggttaagaaatttatccaaagtaaagattaaaaatagataa

SEQ ID NO: 1307 - DNA, 1521 bp, Candida albicans
ggcccctttctcctctatttatcaaaacaggacaatagttattttattggtattttacagatactatttcaaatgaattcaggaaacctacgcaccactgacgatcttgatgagtttcccgatgatataagggtgcaaaaattgcagtcatgtaaatatatctatcccgattgtgaaatagacctttcgtctttatctggcacggttaatatcaaagtgaaaagcgataacgacattacaatacgactaatagaaagaacttccaaaggaaccaggattattgcgactaataagatttccaacttgccaccgattgtgttaaactttcagctaagtgcagattatccctttgtggcaccgcctgagatcaaagtgacttgtgtttggttagccacctcaaaaactgatttattaacgaaggacctttatgatatttggaaagaatatagagaccaagtgcttttcaatttaatagatcatttgcaggatcaagtccaaaaccatttggacgtcttgatacctgccccatttgacatttttgacattgatgagtattacaaagttgttgatttcaatattgatgctgaaatagaagagttcaactcacaaacatatacatgtgacatatgccagaaaactttaaagggtttgcattgtacgaaatttgattcctgtgggcacgtattttgcaataactgtctagcggaatatttcgagtcttgcatcgaatctggtgatatcgataaggtacattgtcctgactttgagtgtaccaaaaagtatgttgacaaaaagaaaaagtttatggaattagaaacatgggtgcataatgataaaaaggtaaaagacatgttaaatcaattattgataccgtcgatccccttggctatgttgacgaaaattttgaaaagcccaagtttagtagatcgatattacaatttgttcaaaaaaagtcaatatgaatggattggtaatcttttacccaatagattagtgaaatgcccaagagttggatgtgatgaggttatattcagagaggacattgacgaaaaattggttgtatgtcctaaatgtaagtatgcattttgtaatgattgcaggaaatcttaccacgcaagattcaagctttgtctgaaaatcaatgaaaatgacaagtatctgggtattcctattgaggatttggaagcgtatccattgttacccccagattcttatgataaaaaaataatgaacgcaaaatatggaaggaagagaattgatagagcaatcgaagagtatcagatggaccagttgttccagcagatgatgagggaaagaaaaactgttgtgcaatgtcctggttgttcagttgctactgagaaaagtgaaggttgcaataaaatgaaatgtagtttatgcaaaacagacttttgttttaattgtggttctaaaataggaaacaaccacgatcattttgttgatccaagttctccatgctacaaacttttattttttggcatgcctggtactgaagatatatag

SEQ ID NO: 1308 - DNA, 285 bp, Candida albicans
  unsure (83): Identity of nucleotide sequences at the above locations are unknown.
actgagattcagcatgtattcaaagttgatcattctacccataggccagatgggatcccgggaatatatttcttgtatgattntgaaccaataaagcttgtcattcgtgaggagagaattccattctttcagtttattgctaagttggctacaattgttggtggtctattgattgctgctggttatttattcagattatatgaaaaattgcttttcattttttatggtcaaaaggcagtgcaacaaaatagagaacaaaaaactggtgggttgttagatatttag

SEQ ID NO: 1309 - DNA, 594 bp, Candida albicans
ctcaggagaaccaattgtttctacttcagtcagtcaatggattcgtttgcccaaaaagttaaaacatttgatgcctttccgaaagtagatccacaacatcaagtgagatcacagagaggtggactttctactttgttgacatacttttgtggattgttaatactatggatagaaattggtgggtatattggtggatacgttgatcgtcagttcacagtcgacgatcaaatccgttctgctttgactatcaacgttgatatgatagtggctatgccctgccaatttattcataccaatgttgaagatatcactcacgacacgtatttggcaggagagacattgaattttgaagggatccattttttcgttcctgattcattcaaaattaacaaccctaatgatttccatgaaacaccagatttagatgaagtcatgcaggagagtttgagagctgaatttagaagtgagggcgcccgagtcaacgaaggagctcccgcttgtcatatttttggttctattccagtaaatcaagtgcgtggagatttcagacctactgtaagtcttctccacaggcgcccgatccgcgtactattt

SEQ ID NO: 1310 - DNA, 927 bp, Candida albicans
agaccacaaatgaataacgaagagatttacacaatccgccccactcgttctaagttattgatagtttggtcgatattagaactatgcactgtgtcgctcctatttgcaatgagctttttctttctttttgcaaattcaaaactaattcaaagaggtccacctgcatttcaattgaggattcagtcagattcaatatttgccaaaaatacattccaacttgtccaacaaggactaaaatttgcaacatatttgtcgaatgacttgaacatttacattaatgagactatcccagaaacatatctccaacaaattgactctaattatgacaataatttgtaccagtttaatgtttttggtttttgtcggaagacccaatttgataaaatattgaattgttacaatggacaaggaataaacattgctgcgtgttttcttcaagatataggaacacagctaggaaatttgacaaaccaggctgatccaagcaatgtttcagccaaattagtttctttttactacaatctagtggaccagatttgcagtgactctgacaagaaattgtgtgctttgcaaacatacaatacaatgtcaagaatagttcaatatcttgggatctcatctttgatttgcttagctgtgactaccgctacctctttttttgaaatgataggttactgtgtttttgcaaaatctttggctagagtctttttcattgtcaacgtcatatctatgttggttttcgtcttcacaatatgtatactatactgcataatcatggttatgaaaaactttttaaccgatttaatcacccaatttcaaattggaaccctagagttcccctccatcaaatggattacttggggtgttttaacattaatgtgtctaattattgttgtgaaacgttatcttatataccaatctatttag

SEQ ID NO: 1311 - DNA, 603 bp, Candida albicans
tctatcctgttggaagtagaatttgatattgttaatgttttgcttggtgtttgtttttttcgaattttgtgtttggtgatgatgatgagagatggaaatatctcgggaccaaaaaaaaaaaaatttaccaccaagtgtagaccattttctttctacaaaaacagacatattataatgttgataaatgatgaatcagtatacttgtataatttaactttgaagccgccttcatattatatatcctcgatagtggggcagttttacaaacaagacaattccaccaagaatgcgcaacaattagttcttgtctcatctactacattacaattattcgaaataaatgaagaagcagggaaacttgaacttcaatcttctcaaaacctacttggaataatcaatagcattgaaaagatttgtctttctgaagttgacggggtagtcattaccagtgattcaggaaatctctcaattttacaatatgacaataaaactaaaaaatttatctcaaagattcaagagccaatgacaaaaaatggatgggggagaaattatgttggtgaaaatttggccattgaccctgagaatcgatgtatatttacttaa

SEQ ID NO: 1312 - DNA, 495 bp, Candida albicans
  unsure (466): Identity of nucleotide sequences at the above locations are unknown.
ttatacacatacaaacaactctttatcatgcaaccagtaacatcagaagaatcatcgggtgtatcaactagagaatcatttgaaattgaagatgattctcttcaatctgattcaaacctaaaccctttaggtgtatcactttatggttctaaaacaatagaatctattgtttatatactaggttggtattttttttcattatcaatctccatttataataaatggatgtttggatcaggattagattttaaatttcctattattatcacatcattccatcaattatgtctatgtatattaagttgtgtggtattatatttaaaacccaatttacgtccacttcatactactaatgtttcaacacctacttcaactaatggtatatctggtcaaacaattggtaaatttttacaaagtttattaatggatttcccaatatatattagacaaatatttcccttgttcnaattgctagcgctggtgatattggattaa

SEQ ID NO: 1313 - DNA, 726 bp, Candida albicans
gccctgccaaaaacaaagactcaaaaaaaaaatttcaatcccattcaactaaagacactatcaaagtcttaccaaatacactgttggactatcatcatcttattatccttagccatgacgtctgaagttataaaattccctcaattcccagaatttacaatccatatttcattattcatcaatgtttcctctgaaaatataactaccatcaaatcaaatttaatatcagccaccgataatgatcacaacaaatacgattattgcttccttaatactaaatatatcatatctaaagaacatttatttcaaagtatatataaatcattattgaattatactagtaaattaggattatctactcggaatttgaaatcagaaataatttataatttatcaccaattaataatgttggtgatgcattgaaacgatttggtatttctgaagattgtcccaattgtatagtcattaagattattaataacaataataaagaaaattccgaagaaacaaaaattctggagaaagttactactgatttaaaggaaattatagatggagaattaattgaattaaatgatcagtatattttcgaaaatttcattgatttggcaaaattcagaaaattatataaattaaacgatgttgttgatttgaataaagaagataatttacaaggaagattaactagattggctataggtgcatgtataataagaggttattaa

SEQ ID NO: 1314 - DNA, 402 bp, Candida albicans
ttagatactaattttaaaccagaatgtataaattgtcttttacatgccagatgttacgccaatttggaaattggatgtttcgaagatttcatggaatataaaccttggtttgattttattgtaccagggcataaaaagtgtattcccgacactaaaaaggctgagaaattagagattatgattgatgttgcgttggatttgttaagaagcaaaaatgctgccattcaatgtggacaaaaccctaatgatgaagaaagtggaatcaaattgaatgatttacatgatttgcttttatcgatgaaagcaccatatattactattgatgaatttgaagaattatgggatcgatcggtgattgaattagaaaaagaacccgatattatagtaaggcaagtacgataa

SEQ ID NO: 1315 - DNA, 429 bp, Candida albicans
agaaaccaaaggaaaaagagtaccaaaatactaactgctagaaaacgtccttcgaatgtttcgactccatctactaaaggcaaatcaaccaaaaagatatctccattggttactaaatctgcattgacacctaaaccaagattgatttccttacgttcacaaaaatatgagtctgacgacgaatcagacgaagaagatgtttctgaaataagaaagccagtaacagcaaccaaagatgttgattcagcgggcacttcgaccaaaccgtttgcattaccattttcaatacgaagaattttgttatcgatgttcttatgggtgtttgtatgtaacggtggtctttttgggttatggtactatgaacagaaatatgctgttggatactgtggacaagaaattgatcaaccaaccgttcaccaattaagataa

SEQ ID NO: 1316 - DNA, 282 bp, Candida albicans
ccatatcaattatatctggtgaaaattgatattctttacgaggaagttttgaaaaaattgaaaactcaatccaatatgaccaaggaaaacccagaagtaaatccatatattggagctagtcaattaagagatttgatcttgagtaatgaagataacttacatcaacgtatcaccatgtggaaagatgtgagtgttaaagttgaacataattccaacattagtagccaaattgtagaaaataatggtgaaatcatgaaagtttgggaatatataggtatataa

SEQ ID NO: 1317 - DNA, 447 bp, Candida albicans
cacatcctctttttttcaactagagagccagatgttcttcaaaaaatgtgggataaatccaaacaacaaccatttgtaccattagggtccttattaactgctggagccgtattattagctgccagatctatgaaacgaggagaaaagttgaaaacacaaagatatttccgttatcgtataggtttccaattggctacattagtggcattagttggaggtgggttttattatggtacggaaacgtcacaacataaacaaactagagaagataaattaagagaaaaggctaaacaaagagaaaaattatggattgaagaattggaaagaagagatgctatcatacaggcaagaaaacaaagattagaagaaagtaagaaagaattacgtgaattggccaaacaaggatttattgaagaaaaagaatccaatgataaaaaagaagattaa

SEQ ID NO: 1318 - DNA, 801 bp, Candida albicans
ttaatgagctattccagtatcaaaatactaaaagtaagttatccatacaacttaataaatgcaatggataatttgattgaaaataatgttaaaattgttttcagtggggtgattaacgatccatttattcccttgtattcgtcgttggcaatacaatttagccaccctaacataacaagaaatgtttattataatgacaacaataataatatttacaatataagcaattgtgaagtgattccattcgtttctcaattgttgaagattatttgtttgatgaagaatttaggttatgatcaagattatgatttggttagagatttaagtgataaattcgaatccttgacgagtacagcaatgggatatagtattagtggagcttcaactaatacgacaacagcttttactggttttgaaaattctactgaaacaacaaataatactacaacgaagtacaacagtaccatattcaatgatgacaagctttacttagaagcaatcaggttttcattagaaacaactaatctaatcggtaaacaacgagaattggtaattacagattataacacaatggagagtatacctagtgatggcgattttaacttctataatatgttgccatggaatatgagaagcttattgcacgactttattcaaatcaaacatgtcaagagctatcagttaattgaacaattaatcaatcagttcaacaatgagtgggatcctagtagtaaaacctggaaggatatcaaatattgtttaggcggtctagaagattttcatgctgatgaattgatctaa

SEQ ID NO: 1319 - DNA, 804 bp, Candida albicans
aatggtcccttttacggggtagacaagtcttttttcatgaaagcatattctgctatagaaaatgagtcattgcttgaattgtttgaattgaacaaatttgacagccaacaatcaatcgcttataaagattcgatccaaaccattattaatgccaatgttaaaatctgttttattgcgtcgataaatgatcaattggtacccttattttcagcacttgcctcacacattttccatcccaatatataccgtgcttgctacattgactacacttcacatacaccccaatttgtgggaaaattagtttccttgtgtacacatctattgaatattggttattttgacaataatgttataaaagaattgagtacctctttggctggaccatttagtgggaacgggcattccaagatttataatgatgggaaagtttacgatttgggtatcaaatttgttcttgatactgatgatattgtcattccttttgatggcgaatcaaatttgctggaagaaataactaagagtgaattgccaatttcaaatcaaatatatatcaaagagtacaacattgccaaaataggtacaaatccatatatattaccatggtgtttgcgggggttgttattcaatattgagaagaattggcccaataagagagctggtcgaatcgaagacaaagaaacagtgaaaaatgggtatgaagaaattcatgatttgtatgaaagttttgaaaactggaaacctgaaacaaaagtttataaagacctcaaatttaggttgaatggattgagggcaagtaagctctaa

SEQ ID NO: 1320 - DNA, 375 bp, Candida albicans
ctcttggagcgaaattcttcgatccggtctgtaataaaatgtgggtaccagtgcactattcaaaactccgtgccatttgtcgccaagagcaataatggtgatattgtgttgatcagtgggggtcagtattatcaatttggaattgaaactttccttgtcggtgccaattatgccctgttggcaggtgcgttgttattactaacctacattggatgttataaagttacggagagaagtttcattaccagtgaagacattagagtattattggtcttgttagttactatcttgatttatttattgtacagttgtttaacaagcattgtgcttagaaaagatcagggatatccttacagctttatcaaattgttttaa

SEQ ID NO: 1321 - DNA, 1278 bp, Candida albicans
caccacagttttacaagaaggtttcttcctttacttacttgtgtgatcacatacattgattcaatgtcaacaaccgacaacataaaactcacaattctaaggtatatacgtgcattttttattccagatagcacgctacattcccgacaaaaatggatactaggtttgattaatcttgccgcagtggttatattttgggtgctgtccagtttcttggtcaatgcagttgttgaggatgacacttatagaaaaccatttttcatcacttatattaacacgagctgtttctgtttttacttgataccctatttgcgacttgaaaaattatctgtacgggaatttatcgataagttcactcaagaataccgctatagtaaagtaagtcataaactggagcaagatttaattcaagattacggatctagagataacttagcagtattggaggagcaaacattacgtgttattgattccaacgagttagcagaaggcggagacgaagaccaagatatcaatatttacgaaacagccaagttatctttacagtttatcgtattatggttttcggccaacttggttattaatgcttccttgtcgtatacttcggtggcatcacaaactatattgtcgtcaacatcgtctttctttactttaatcattggatacttggtatcaattgaaaagattaaccaaaataagatattgggtatattattgagttttgctggtgttttgattgttacaaaagcagatgcaacagaggataaccccaatactgataattcagctctacttatactatggggcaatatacttgcattgttgggtgcattaatttatggaatctacacgatcttgctaaaattcaagattaccatacctcactccaaaagagaaaagaatttaaacacacatttgttttttggatttgttggaatcttttgtttagtattcttatggcccatgttggtgatgttgaattattttagagttgagaaatttgaactaccaccaacatcaagtgtggcgacgattatagctgcgaatgcagtcatcacttttgtgagtgatttctgttggtgtaatgctgtattattgacaagccccttgacagtcacagtaggattgtcgatgacaattcctttggctatggtgggtgattgggtatttaaacaattcaaattgaatctattgtatgtatttggagccacaattgtcactactggctttctaatcataaataaagacgaggaagaagattttgttgaaagtgattga

SEQ ID NO: 1322 - DNA, 1779 bp, Candida albicans
aatatggattctttgtcttcagaccacaaagagaaagtcgacgaatttaaatcgataactggaagttctacagactcagaaaatgacgataaaataattgaatttttgacagtacatgattttgatttgaataatgcaatatccacatattttgattctgggttcgattccattgggaatagctcagcaattaatcaacatgatgagattgacaaccaagtgacccatcgacactcacatcaccaccaaaatgaaacgcctgatgtcagtttggaccaaagtggaccggtaaatttacagcatcaaatgttcttcgatagcttattgccaaaattacctaaagccccagttatttcaaatggttggcaattggaagttgggatacacacatcaatattagatgaaaaaataaggcaagaaagagagaaaactgaaactacaaaagaagatgtttatgaaaccacggaatccattcattctgaaattgaagacaccaagaaatccccattgagctcgttatggataatactattgataataccaaaaacattattacatgttattttatcagcccttaaatttgtgtttggttggcgtgtatttaaaggtcccgaagaaagacttccccaactattcaattacgagaagtttatccctaattataagtttttaccagaattgaaacccagcaaggaagaaacaaataatgatgtgaatctcatcaataaattcaacttccgggaagaccaattcaacgaaacgcatctgttttgtcaaaaagagtatcgttggctcttggttgttttggtcaatgattctagcacaactaaaaactttatcgagtcattggtgaaccataaacactttgacaaactatttaacaaatctaatggattgttcaaggaaacagagatatttgtcaataatatcgaaagatcccctgaagcatttgaaattgcccaaacttacaaagtgaaaagactcccctatgttatgctagttggcaatgtgtctgccagtcctgatataatgccttcaatgtcaatagtgtataaatctaatattgctaaaccatttatcactgaagaggaacttcctaataccaccaacaaaatcttgaagaatattggcaaattattggagcgattcaatcctcagttagtatcagccagatttgataaacaagaaatggaaattagcagacagataagacaagaacaagacgacgcatatctcagatctttgcaacaagacaagataaagaaagaaatgagattacaagaagagaatgctcaaaagttggctgaacaaaagtctcaattgagacaatattatttgctaaaattgatatcgacaaagtacattgaacagaatgtccttgatcaagatgttgatgccaaatgcaagatagctttgaagttacccaacggtaagagaatagtagagttattcaatggagaaatcacattattagaattttacatgtttatcgaattgaaacttttcatcgaacaagaggagttagacacagaccaagttgatgacttgattgaaaagctagatattgacgataatgtgaaaaattcaattcaagatctttctgattatcataactcttatccatttaagtttgaagtcattcaaccttatcctaagaaagttattcatttggatgttgacatggatcaaagtataaaagacattagcgagtttagcaaaggggcaaactttttaattgagtttatagatgatgacgaagaagaagaagaggaagaataa

SEQ ID NO: 1323 - DNA, 1146 bp, Candida albicans
caaaattggagtggaatccccttccccattatcaccggattaatcctgaaacttatggaacaagaagatgatggagatttaaacactaaaaataaactacccacattaacattagcatcgataatcacagattattgccacgcaaacaatttagaaaacttagagatccttaaacgatggtatatttacccaccaatgatactattcaattccacaggctcaacatcggagtcaaacggacaccccacctcagatacaatattcaacccacaacaccaaaagttatgggaaaacgtattatctaatcagaaatcaatatttggaacttcagaaattactcatatagcgttgaataaacctataattgaatccgatataatgagacgtccccataatttaatccccattataggcgattttggacccgatatatcaatagacaataaaccaccttctcctacagaatcagattttaatcgagcattttggtgtcatgttatacaaaatggaatttatcaaacttgggcacctaaatataccatgttttctcgaggtaatattaaagaaaaaaaacgagttttggattggtttaaaaatcttgatcaaacgattgtttttgatttttattgtgggattggatatttttctttatcttatcttaaaaatggaggtaaattattatgttgggaattgaatccttggtcaattgaaggatttagaagaagtttagaaaaaatgaaaatcaattataaaatatatactagtggtgataaatttagtattaatgatttgaatcaatttgatgcatgtttatttttggaaagtaatgaacaaataactacaagggtgattgatcaagttaaagataatagtttaccaattagtcatattaatttagggttattacccagttctaaacaatcatggacattagcaaataatttaattgataaatcaaccatcaatactaatgtccatatacatgaaaatgttcatatcgatgattttgaaaaaattaaaactgatgttaaaaaagtttttacaaatgggaaagttttgcatttggagaaggtgaaaacttttgctcccgatatttggcatatagtaattgttcttcaaccacaggggctggaaggtcccgcgctt

SEQ ID NO: 1324 - DNA, 264 bp, Candida albicans
gaaataatgacatctactaataaatcaatttcccacctaccgattttgcataatccattccttaattgtctttttaacaatccacaatacttcaaatcgccactcaaaggtgtcgtggatgaattgcaatccaatcacacaaactttaccatattagtacctccagcccatgtattaaatgaatattatgacccaaccacagaaagctcaaattcaaagacacttttaaaggaactatgttataacaatgaaagatttcattag

SEQ ID NO: 1325 - DNA, 1890 bp, Candida albicans
aggaactatgttataacaatgaaagatttcattagatcacatatcataaatacagcatcacccgtttcttccactattactcctatttcaaaggagcaactggttatttataacactttgaacaataaacaaattcttattaaaaatagaatcatatacactggcaaaggatttaggcgaagcttgaaattgaaaactttatcgatacaatactttagttccttctgcgactatttccccaagagaagcaagtttatgatcatctatatcgaaagtactttgtttggaggcattccaccaagaaagatgttacctccgcttccagaagtaagagaaacaaataaaaccgacaaggacattgattcagtaacatttgaaaaattattgagaagtttcccattgttgtctaaagctgtaagtgacaagttttatcgattatttcaccataacaattatcaatttcgggtgctaaggtacaagaatcgtaagaaattgtctcatattaaacttgaatttcagaaaatattgcaggaagcctttagtattatactggacagtgtcaatgtggataacccaaacagcgaacaaacctataatttaataaatcatataatcagcatgtacccagggatagatttaaataaattggtgcatgaatatgttgaactcaacttgtatgatgtactatggtcacaattgattttccagtttaattgccccaatgatgataaagaagcttacgatccagaagcgattcttattctcaccaaggaaaaatatgaaaaattatcgtgtttgtccttaaatcaattggatattcctgtaaataagccgtggcttatgaatgaattacatgaacgtatttccttaggtgtccaagagtttgagaagttggcagattcatctatcatgaacctggccgccaaaactcaagttgtttacagcacatttcgaatacttacacagaggaaaaatggtaacatcgatccagtaataaatgcagacactttgattggacttttgataatggttatgatacattccaaaattgaaaatattgaagcccacatttactacattaagcatttcaattccattgataatactaacgatggccagttcaactatatcatgagtaatttggatgcagtattatttcatttttcgaaaaaggaatctgggtatttagatttgattgagaattctaaaaaaaactatgagatatggaatgccattaaaaataatgatttggagaaagtagaatcaattatagaattggttaataatgagtatccagaaactgaattacctgagaatcattttcttaaaagcaaaaatatcaatggtgaaagttgtttaatgtttgcaataaagacaaagagatatgaaatctatgattgtttgattaatctgaatcccaactggatacccatagatagtattctatttgaaaaaaatgttatgaccaaccaaaacttgttgatgtgtgcattaatagaagaaactgactacaagattattgatgatttagtcgacattattttgaataatgctacattggaagaacaaacaatgtacttcaatatgactgacatttccggaagaagtgttggccattatttgtttcacaactacaagcttatatcaaaaattggccatttgattgattgggaaaaaaatgacaataactcacatacacctttgtttagcctttgtagatgttacgaccatcctgagtacgttgaattaattagagctgggtttaattgtgtctacaaaaaatatggtgaaacaggtgtggactatgaacaacatgttgataaatcaggaaacaccctattgcatgttctcctcaaggggttattttccccccacgctaaaaaaaaattt

SEQ ID NO: 1326 - DNA, 504 bp, Candida albicans
ataatcccatttgttaatcaactttatagtatacaacaatatttaaccatgcgtagacatagtagatcagctccagctcctagacaacatactagatcagctcatactgctgctgctccagctcaccatgctccaccacaatcttacccatatgcccatccagctcaaccagtacagactcaatctagccaaccagatttatttggacaaatggcttctaccgatgttggtgtagctgttggttccaatattggtcatactttgggtgatggtattactgggttgtttggtggttctttttcatatgctccagttgaagttgctcctcaacaacaacaagttgccgcttaccaactacaacaaactcaagaacaagctatacattgtgatgccgatgctagaaattttactagatgtttagaagacaatggtggtaacatgcaaatttgtgattactatttacaacatttgaaagcttgtcaagaagcttcaagacaatattaa

SEQ ID NO: 1327 - DNA, 543 bp, Candida albicans
aagaaaatggtcgaattttattttcatgataacaaagatacacttgaaaattttactgaagatcacaattcaggagaaccagttagttttgatcaactagctgaaattggtgttatttacaagtacattactacccaggaagaattagacgcattggctactgaaagagaatacaagaatagagatgttgttactttaaacttaccagccttcaataatgatattgatgcttataatgccaaaatgcaacagttttacaaagaacattatcatgaagatgaggaaattagatatattgctgaaggtgaaggttattttgatgttagagataaacaagatcgttggattagagctaaattatcaccttacgatttgttgattttaccagcaggaatttatcatcgttttacattgactaatgctgcaaaacacgtcaaggcagttagattatttaaagatgaacctaaatgggaagctatcaatagagacacaggaaaaaataccgaagctcgtgaactctatgctaagactattgcagtatag

SEQ ID NO: 1328 - DNA, 291 bp, Candida albicans
agacccgagaatattctgatcattttcattgttgccggattatttcaaatgagtttagatatttatattgcattccaatatttgcaattcaaatatttcactactactaataaaaatttgaacgatggtgctagtttacatagaagaaatcaactgattgatgatgttgtaaatgatttggtgtcggtgtcgtcagaaatcgaattggatgtattagaaaaaggacagaaggatatctccaacaatcaaacttcgtcatggtcaagatcaagatcatctactcttgcataa

SEQ ID NO: 1329 - DNA, 969 bp, Candida albicans
  unsure (906): Identity of nucleotide sequences at the above locations are unknown.
aattctggctcaaaatcagacttagaatcattcattaaaataactcatggagacgttataaatttagtttctaaagaagttttctcaagatttagatataaattatcatcaaattggattaatattattcaattaccacaattgtttagagaaattgcatttccatatggtattcaatggagatctcaaaattatccatccaccaaagaggaatttgcacttcaaaataaccaaaacaaggatattccaactcaaattcaaataattgaaactaaatcttcaaagaaatcgaaaaagaaaactcaaactcaagtcatcactgaaaaatctattcgacgttcatcaattttcattgctgatgatattattggattcataccaattattaaagattcaagttataaaagtactattgttgaagaaatttatagtaatgctcgttctcatttagttcaaggcaacaaggaaatgggtatggctttatttaatgaattacttgcaattaatgaatccatttatggtaaagttaatcccgaaactgccaaattttataatttagtggctcaagtttatcaagaattaggttatgatattgaagcagctttaattggtcgtaaagcagtaatattatgtgaaagatcttgtggatttgattcttatgataccatcacggcatatatgaattcagcttattatgaatcttcaaatgaacaatatttgaattcattaaaattatataaggaagctatgaatacttggtcattggtttatgggaaagatcatcctactttgattaatacattgactaatttatcagaatcattacttaaaattaaagcttatgatagtgcccttgaattattacaagaagcattagaaattacaaaaaaattaaatggggaaatntctgaaattactggattcatttattatagaattgctaatattgtggttactttgaataaattt

SEQ ID NO: 1330 - DNA, 972 bp, Candida albicans
aacccttcgagtttttatatcactttttgtcaaaacgataaggcagtgaataattttgtcgccaatttatggaataataagaatgtaaagaagatattggatgaaattgagtggtcatctagagttgttcgtggaaatttgacaagacaagaaaaggactctagaattaaagctactggtagtaaggtggatttgaaggacaatgaaagtagtgatgagggagcagaagacgatagtgaagatgcacacaaatctttagatttggaagatgcttatgacaagttagcaatttatgacaaggtagacaatggatcaggaggtgaggaacaacaaccagaattagatcctaatgtaaactataatgaggtaacagacgaagagccttcagaagaggagtcaagcgaagactcatcggatgactttttcgaggatgaaccaccaaaaaagaaacaaaaacagagccaagatagtgggaaatcattcaatcttcctcaacttgcctctggttatttttcagggggttctgatgacgaagcagacgatgcagataacgataaagtagtaaaggaaataactacacagagaaagaatcgaaggggtcaaagagcaagacaaaagatatgggccaagaaatatggtaaagaagcaaaacatgtcaagaagaatcaagaaatacttgccagcgaaagagaacgtagacaaatggagtttgaagaaagacaacgtaaacgtgagttaaaggcaaaattattagctgagaaacaacaaactggtgctaactcattaccacttggtgagagaaaacctactaccagcaacactgccagtaccataccgcagctgctgctggtctctactaactctgttgcaacagaggaaaaatccatccatccatcctgggaggcaaagagattggaaaaggaaaaactcaagaatgttaaattccaaggtaaaaaagttgtttttgattag

SEQ ID NO: 1331 - DNA, 1329 bp, Candida albicans
  unsure (1258): Identity of nucleotide sequences at the above locations are unknown.
ttcgcggatccttccagccccgtggtgaaagataaacgttggccaaccattattgatggagcaattgaagatgtccaacaaactattgagaatcaccaagaggaagcatcaattggtcacaaaataattcaacaattattaaacaccaaagaagattttgttaatgatgctattgttagaccattcactgatgaagaaataacaatcaatcctcatttgaaacattataatgaatcattggaaaatttaaacaaaatcaaaccagttacttggcaaactggaccatggttatatttagaatgttacttgtatcaatatatcaataattttttcattgtaaataccaatgaattttggaatcattatgatgttttccaaaatttaaaagataaaacttttaaacaatcggaattgggggttttagaattatgtaaacgttatgaaacattatccaaacaattggatcaagctaatgatgaagttttacatttattatttaaagaatttattgatatttctttatggggtaatgcaactgatttgtctttattggcaggaaatgttactttagaagatattaaatcggttcaaggagcagaagtacgtaaaaagaatgaagaaaaaatattagtcaatgatttatcgcaagcttggaaacaattacacaatgatggtaatgactccggaaccaaacgagtggatattgtattagataattctggatttgaattatttgctgatttgattttgacattgtttttattggattctaaacttgttcaagaagttcatttacattgtaaagagattccatggtttgttagtgatactatgcctaaagatttccaagatttactcaatcaattggttgaccctgaattttatccacaaatacattcagatgaacctagttctatcaaattagttcatgataagattcaacattattatgacaaacatgcccttattattaatcatgatccattttggacattggactataattattggtatattcctaaatttgactcattatattcagaacttcaacattccaatttgattatatttaaaggtgatttgaattatcgtaaattaactggtgatttacaatggcctaaaactactccttttaaaactgccatacaggaattatcaacttcaaatttacccgttttatccttgcgtacttgtaaagctgatgttgttgtgggattacctgaaggagtaaatgaaaaattgattaaagaatatgaanatatgggtaatgaaaatggtcaactttggagtagttccggtaaatgggcagttatttcattcaacaaatag

SEQ ID NO: 1332 - DNA, 1779 bp, Candida albicans
cccccctacaatccaatcattcgatctcaatattatttaatagatgattcattaataatgccaccattcaaattgagaagtagaagcaacagtagcagtagttcaaatccgcaaactcaatggtataataataaaaaccagaaccaaccctcaatgtcagaaccgacttatacgttaccaggcgttataaactatctaacatctgaattcaccaagttggaacaatttaaaattgtaaacaatttagagcgaagtgagatgaaattcaaaattaaggaattggaaggggaaattaaaagtttaacattcacaaataaattacaaaagaagacaattgaaagattgcagacagaaaacaaaaagctaagactgagactaaacgaagaagaagtcgaagaagtcattatgactccatcacccgaagaactagcaaaaatgtccaagattgatttacagacgattaagagaacaagagagcggttggctaattcgatgaaggaaattgtaacattattaaaaccacctactttagaaccaagtatttcattggcaaaaactagtaaaaatacgaatgatctagaatctttattggataaacctgagatcaacaaggcagacgactttaatttcaatgttaaaccatatagttttgaaagcaaggattatgaatcaccagttagaaacccaagttccctaatttcccagtatttcaacagtaataccgaccttaaggagatttctaaagaaaagaaaaaggctgaaatggaaaacgacagtatcgttgatgatgacgagatcttagacgcagaattagaagatgttttggaaaaagccatttcagaaacaagtgattcggcaacaattgtactcaatgatgacgatgatcctcttgctgatttgaatgatgatgatttttcacttgatgatagcccacaagagagaagtcaaatcaataataacaacaataataataatgatgatgatgatcttgattttgaagataagctatcgtcattcccactgttagtatctccactgttagtacttccactgttagtacctcctccgttaaaatccccacagttacaacccccacagttagaacccccagtgttagagccccaagtttcaagctcaatctcaagttcaagtaagaaaaataaagaggaagaaggtggctatgaccatttagacgtgtactatcatgatccaaacacaatttatttgaggtccatgaaagatacaaccaaaaaggaagttaaattggacatgcttttggatggcaaacttgcttcgacgcaaaaatttgaaatggaaacatcagcgcaagatattgctgatatactccctatagatgtacctgatacacttttaatagttaaaaagaatggtgatgtcaaaagtatggtatttgaactaggtaatggcaaagaacacaccataatgtctgtcaagtcagacttcaaggacattgaatcatgtggattaactgagttcacagtaaagatggatgatacatacaaatattatggattgtgtatttcagggaatacttcctcgaatcgaaaattcctactgaagatatatgagttaagttatgatttgtcgaatcgagcagtcacatctaaggaaataggcagttacaataaaaagtttttaacaaagggcaaaccagcagatgaagtacactttgctggatggatcaataatgctaaagttgactctttggtggacattcttgaagctgataaagatccaaaaagcagcatatggcgtgat

SEQ ID NO: 1333 - DNA, 1242 bp, Candida albicans
tatagcatgtcgttggaaacatttcgagaatctaaagcatacaaatggacctctaaggtcatatcatttcttataggacaatggtttttcatttttcttggggtttttattgctctagcccattcatatcctgaatttgccaaacaaggaggaacaattcgagccgagtattctattggttacggggctgttgcagtgattttccttatcagtggattatccatgtccaccaaacaattattggtcaatgttgcaaactggagagcccattttactgtattatcgatgtcattcttggtaactagtgccattatttatggaattgctctgggtataaaagctagccataatgggcaaattgacgactggttattgataggtttgattgtcacccatgcgtgtccaacaactgtgtcttcaaatgtggttatgacgaaacaggcacatggtaatgatattttgacgttgtgtgaagtttttatagggaacgttttgggtgcattcatcacaccggcattgttacaaatgtacatgagaggtacttgggaaataggtaatccaagtcatcaaacccagggggattccacagtgcaagagttatacgcccacacaatgaaacagttgggattatcggtttttgtgccgttgtttgtcggacaagttgtccaaaatattttcccaaaacaaaccaaatggtgcttgacaactttcaagttgaacaaagtcgggtcctttatgttgttgttaattatgttccaatcgttttccactgcttttgcccaacatgcgttcaccagtgtcagtcatgcctccatcattttcctagtgtttttcaatatagggatttatttatttttcactgtcttgacattcttttattcccgtcccttttggatattaagagtattcaaagaagagccaaatgagtcgtcaagtaagctttatcgatatagctatgcattcttccgtccattttattacaacagaaaagacactgttgctgtcatgttgtgtggtccagcaaaaacagcagctttaggggtatccttggtttcttcgcagtatggatcacataatccaaaattgggtataattttagtgccgttggttctttatcaagcagaacaagttatgacagctaatgttttggtcagctttatgagaaaatggatacatgccgaggataaagtgcccgaagatgaagaaacttcggtaggatctgacaacgatccaaagaaatag

SEQ ID NO: 1334 - DNA, 243 bp, Candida albicans
gaattacatttactcaaaagtgaagggcttattagaaattttgggatttcaggctacccggtgaaatttttatatgagattgctcttagatgtaaaaatgaaattgctccattggatgcagtgttgtcatactgtaatggatgtatccaaaatacattattatttgagtaccacgacaagttcttacaacactgtggtgttcagacagttttgaatggatcgattctttccatgtcgatgtag

SEQ ID NO: 1335 - DNA, 867 bp, Candida albicans
tttttccccaatatcatatatacgtgtcaattagtgatctgtcttattcttactttttttttttttgactcgatgccaccaaaaaagtcagtttcggctaaattagcattccaacctcgacaacgagtatttgcaaaaatgccaggattttctgcttggccagcatttgttgttccccaagaagatataccagacgatgtactagaagcaaagaaaagaaataataaaactccttattgtgttatatttattcctgatggtgattattattggatgtctgaaaaaggattaactgaattgacagaagagaaattatctaaagcattaaaagatgtcccactagatattaagaaaaaaatgaagaatttaaaggggaaaattcctgggaaacaaagtagttataaacaagctatagctgccactgatggattggattatgatacctttagagatttcttgattgaaattaatggtgttgaagaagaagatgatgatgacaaggaagaagaagaagaagtggaagaagagccagaagaagagctagaggaaccagaagaaccagaatcaaaaccgaaaccaataaaaaaggagaaaataattgttagatccaaaagtaacaaacgtgaatacgacgatgaagcagaagatggggatgttgaagaaagttatgaagatgaggattcagtacaactaaagaagcaatcacgaaatgggggtagaagaagtcgatcatcaagtgtttcaacgaaaaacactttaacaacagctactaatggtagaaaaaagagaagattgactggtgataatagtagcaacaccaaaaccagtgaaaaatccacagattcaaacatgataccaaatccctaa

SEQ ID NO: 1336 - DNA, 1434 bp, Candida albicans
  unsure (1398),(1425),(1428): Identity of nucleotide sequences at the above locations are unknown.
tctgttttattcttactttttttttttgactcgatggcaccaaaaaagtcagtttcggctaaattagcattccaacctcgacaacgagtatttgcaaaaatgccaggattttctgcttggccagcatttgttgttccccaagaagatataccagacgatgtactagaagcaaagaaaagaaataataaaactccttattgtgttatatttattcctgatggtgattattattggatgtctgaaaaaggattaactgaattgacagaagagaaattatctaaagcattaaaagatgtcccactagatattaagaaaaaaatgaagaatttaaaggggaaaattcctgggaaacaaagtagttataaacaagctatagctgccactgatggattggattatgatacctttagagatttcttgattgaaattaatggtgttgaagaagaagatgatgatgacaaggaagaagaagaagaagtggaagaagagcaagaagaagagccagaagaagagctagaggaaccagaagaaccagaatcaaaaccgaaaccaataaaaaaggagaaaataattgttagatccaaaagtaacaaacgtgaatacgacgatgaagcagaagatggggatgttgaagaaagttatgaagatgaggattcagtacaactaaagaagcaatcacgaaatgggggtagaagaagtcgatcatcaagtgtttcaacgaaaaacactttaacaacagctactaatggtagaaaaaagagaagattgactggtgataatagtagcaacaccaaaaccagtgaaaaatccacagattcaaacattataccaatccctagcattaagaaaattaaaagtgaaaccagcgatgacgataatcaatctcataaatcatcaatagcttcagttgcatccaacaatcataacaataaaccaacagtttctgataaggaaaagaatcatcaattatggctatgtcgagtgaaactacaaaagaccttgattcaaagaaatcaagccactactcccaaagatactacaggactaaaaccaccaactgcagatgaattactgacagcaagattaatattgcatcgattacaagatttccctataactgctgaattattaagaaaatcgaaattacataaagtattaagatgcattataaaggatccaacattaaaatatcctgaaagctttaaattacacgatagatgtcaagaagtattagatgtatggaaagaacctattgaacaattgaaacttgaaaaacaattggaatatgaagataataaacataatccttctcatcatagtcatggtcatggccacggtcttgatgctgctaatcgcaaggcaattcataatcaagatgattctgaagtttctggattngaagccactattcccgacatggcaggnacngggtaa

SEQ ID NO: 1337 - DNA, 525 bp, Candida albicans
aaaatctcatataggaaaaaaaaaaagtcagtcaacaaacctaaactattttttttttttcacaacaatataatcctattaccactgtatctatcaatgtcggaataccaaccaacatctattgtgcttgcaaaagtcaaaggttatccagcatggccagcaatggtattagatgaaagtttattacctgaacatatttccaataaaaaaccaaaatcgaaaaccaatcctccaacatcaatttcatctcccactccacaatctccatcgaaaaagaaaccttcaataattgttccagtaagatttttcagtgacgatacttatatatggataaacactaatgatttgaaaccattaactaaacaaatgattcaagattatttttcaacatcaagtataaaaagaaaaatagataatttattacaaacagcatatgaattggctaatgatccaccagaaatgggattatttattgaatatggatctaaaggaagcacaccaacaccaccaccaatggtaagatga

SEQ ID NO: 1338 - DNA, 921 bp, Candida albicans
ggaataaatatagataatacacaacatgatttagaacttgatagagactcctcgacccaacagcctgcacagacacacgaagatgatggtgatttgcttgggttggacaaaccaatcaaactaaaaacgcgtgccaaaatagctaaagttgataatcagagaattttcaaccacaatggtatacccttacttgtgaaaacacattccaaattgttaagaacacttaagaagaatgataaaaacttctattcagaaccaagaagctcaatatcaaaaagccagaaatttgagcacgagtatgagaacttgagttcagtattgcaattctatcaattgtggtgtcatggcttgtttccaaaggcaacttttaaagattgtatccacttaattcgagcactcggtgctaggtcaccacaactcagattgtatagaagagaattaatagcagccgaattgcataaattaaaggttgccaagggaataatagctgatgaaaatcaagacgcaccaagtatcccagaggaagagaatacaacggatcctagtaatgaggaatggaattctatgcatatgtcagctttagtaccaggttcttcaaacaaaaacggtctctttgtggattctaacagtaatgaagactttgaaacaacaaatgaggtgaatgctgctgctagtttagcggacaaggacgctttatccaccgatgataaggctgaacaaacaaatgctatcacttccgacacacacaacaatgatgtcgactccgatgacccttttagtgacgatgatgatataaatatagatgctcatactgaaaatttgcatccagcttccggtacacaacatcaagaccgtcccaaggaaacaaccgaagaaaatgaggacttggaattagaactaatgagagagtacggcgcataa

SEQ ID NO: 1339 - DNA, 522 bp, Candida albicans
atggcgcttgcagatttagcattgagtaatatttggggtggtctttccagtgatttcaagaagaagaatttctctctttatggtcaatggataagtatacttacaatttttttatgtttggctcttggggtagctaatattttccatttgggaccaatcattgtattttctataatatgtatagtccagggattgattgtattgtttgttgaggttccatttttgttaaaaatctgtccattgacagatacatttgttaattttgtcagaaaatttgatggtaatttacctcgttgtggattttatttattaaatgcagtcatccaatatttgtcattgacattacaagcaactagtttattggtggtggctatattatttactatttctagtgcctgctatgcattagctgcattgaagcaccaagagtatttgaaatcatcacttgatgtcactgggacaggttcaggtggtgcattagaagctcaagttggagaacatgtcgttagaaacgtgttgtag

SEQ ID NO: 1340 - DNA, 1110 bp, Candida albicans
acattctatatgggctctagagttggtaatcggggtagtatcaagctatcattgagtacaagaaatatgtcaaacggtggtgctggaaataatggtggtcggtctggtgataatcaaaacaaacaatcaactggtgatgaagtcaagagcaagagaaaatcggcacgtatagcccaactagaagctgaatcgataccaaaactttcagctagtccggagatcaaagaaggacgtaaatccagtaaacctggatctgtttctggcaacgggaacacagtatttgttgaaccggagctagcagcacctacaccaagctatactggattgccattagaagagtttcctagcaacaaaatcaaaaaggaatctttatggcctgcgaaatacaggcgaactaaaagcagcgatagttcaagagaaagcacagctacaccaggggacgaaatagataccaataaagttgaagcagattatcaacacaatctaaaaacgagtttgagtgaggatctagctaaagaaagcgaattgagacaatcgctattaaatgagaaaacatcttcaaaaccaaaaagaacaacacgattgaaacttactttacgaacacccacacaagaaacaggaaaacaacaacaacaaaaaagatcattagatggctccgccaatgcgaagcagcgtccattgaaaaaaataaaagtcacgtcacccacaaaatcacctagaaccaaattgttcgatgccaaaaccagtaatggcagtattgtaaagcaagaaaaagacaagcaccacgaagaagaagaggaggaggtaaaagaaaacgacgatttctgttttgcttgtggtatgcctggaatattcatctgttgtgagaagtgccctaaatcttttcattttacttgttgtgatcctcctatagaggaggcacccgaagacgaatggtactgtcgtgaatgctataccaaagttcacccggaatcgatccaggattggcgtgatatgggggtctttggacaattgttgaaccaattggaaaccagaaatccaaaagtatttcaattacctcttgaattacgtgaaaagacatctgtcggggtaaccaccgaaagcaatggc

SEQ ID NO: 1341 - DNA, 711 bp, Candida albicans
gagcaagatttcttaatagtttgcaggcaaagttgggcagatgaattgatatccgaaaaatttttggcaattgtgtttttcagtgctttggaaccaaattttgcacttataaatgatgcaactatgtggatttcgacaatgtttacacgtctggagtctaaaaagaacattaaatttgagaaatcattggttagactaatacatgttctagcccaccatgagcagtttttgctgttgctaaaagacgggagtgatgaagataaattggcttcatacaactatgcttccaggttattgattttgtatgttcagttgattgctactcaggaaaacatttctttattgtattattttgctagtcgtgttaaacaacatcgtgacgccactatagccacagtggattatgaagccgaaaacccaactgagcagattttgaatttgtacaggatggctgagttagcacaattagtgattaagacgtatgctgatggcaagaattggccaatgcaaacatggcccggcaaactcaagttgccactggagatctatgctccgatggcatcgtcgaaagaagcacaagccgttgttactgagatctatatacctgaaaaacttcaggttgaattacttgctatgatcaataaaaaattgcgtactggaattattgtcaagaaggttgccaccacatcggttgatcttagagctcgttga

SEQ ID NO: 1342 - DNA, 2259 bp, Candida albicans
taccaatcacatcgaagaagagtgactgaagatgataaaagtaaactgaactccaaatttgacaccaaattttcacaggccatggatattctaaagaaagtccaccatttgtcaatccaattgtggaagtttattcctagcgtgttatcgtcggttatggcacttatagatgatgaattaaatgctgacgacgaaaaagtgagaattttggcaacagtcacaatagggcaaatgttgggctcgccagtatatctgtcagcttcaaccaacgttaacttttttgccactcataaacaaacatggaataattggttgaagaaaacttcagacgtgtcttccaacgtgagaagcaagtgggtgcaacaaatacctaatataatttgctcaaacaactatacaacgacagagattaatcaaatgttatcggcttgtgtacacaaatgtcttgttgatacagaagaaaaagtaagagaagctgcttgtgtatgtttaagtgaaattccttaccaacatttcataaacaagatagctacaacagagttgataaacacgttgtttcaattgacaagagaaaagcacgcttctattcggaagatttcaatcaaaactttaggttcttattatgctagttatatgaaagttgaaaagaatacactgtctgaaattggcactgaattaaaagattcaattttgagtattccaaaccaaatattatcattggtatatatcaataataaagaaatcactacgttggtagatttagctgtctttgaagacatgttgccaatattagatttgaatcccgaaaaccgtgttgaaagattggttcagttttatcgtgttttagatgctaaggggaaagaggcgtttgttgcaattaataagagacagcaacaaatatcaaaagtattgtctacatatattgaactatccgaggcatataacaagagtaatacattggaaaataaagataacagtggtaccgatgatagcaatgagataattttaaagttagataaaattattgagtggttatatgtatcatttcctgaaggatggaacacttcatactgctttgaaaggttttatagattgaatcgagctcggtttttccatttggttaaagtttgtatttcatcagaatctgatctcgccacggttaaaaactcaatgaaggaattactcaacaaattagctgattcgaaaaatatcagaatcgaaaacgaaagaagcatggtaaccactactgaaatggctgaaaactttaaacttttattgttgaaagcttcacctattttttacaatctttccattgtcgaagggttaattaaatattcaaaggaaggcgaaaatgactactattcctccgcaaacgaaatattggaacagatctcatccattattcccgatgtctacaaatcacatttgagagcattatcgaatttgataattgataaaggagagcaaacaacaagcaaatccaatgccttgaaaacggtgtatcattttgtgaaaaagtatccagatttattcccaaaagaattttcattcattgaagctttaaaaaatttggcaataaatggtacaccagaagaagcaaaatattcaattaaaataattggattaaacgataaaaaagaggtctactgtgcgggtattatggattctatttatccattagatttggaaagcacaaagctttccacaaacctaagctcaatggcggaaatatttgttgttgacaggttggcaattctggacaaggaaaatgaattgacaccacttgttattaaagaattctttttgaaaaatagaaacctcgataatcacaatgtaactgacaatacatggattaccactactgagttgaacagccatcctactttatatgaaaagttgatagccatcagattgttggttaataatttaaagagtcttgataaggcagatttgtctgaaagcgcaaaagaagaagcaaaacagaaagccttaccagtgatcaaactattgatgtcatttattggaaataatggtgaaataatcaacaagaatgatccctcttggcccactccagactcgtataaactgagattaagattggctgctggtttatacatgttgaagttagctaaaataccaatttatagtgaaactatgctcctggcaagtataaggcgattaacttttttgttgattgatgaagattataacgtgagagcaagatttcttaatagtttgcaggcaaagttgggcagatga

SEQ ID NO: 1343 - DNA, 798 bp, Candida albicans
caaagggtgataaatttaatgatggtaacgaaaagcagagtttcaagaagtgaagataccatgtctttgaaattcgacaaatcaattttgccaacagttaaatcgcaaatttccaataaagaattgataaatagattgattgctttgcatgatgaattatctaatatcgatgactcaagtgtgaatttgtcgaattacacaactgacttggtcaacaagaaattgcttagccatacaagtatgggggttcaggcttacttatgttgttgtctttctgatattcttcgtatatacgctccaaatgcaccttattccgaccagcaattgtcagacgtgtttaaactttttttcaagcagttttcaagattatctgctaaaaaagatgacccattttaccagcaacatgtttatcttttaaaaagattagcagaagctaaatcgaccattattataactgatttacctgatctggaatcactaattgtcagcatattcaccacattttataatttggcagcaaaagggttcccggtggagcttgagaccataataacagatattttgtctgaggttttgtccgaagccgaagttgttcctcatcaaatattgcaattgatcttgcaaaaatttgctaatcacgaccctagtaaattattgctgaatagtggtataacaagtcctgaattcaatttttcattggcaatttgtgaaaacaatattgacagaatgtcgcgtttagtggctcagtatttttcagaaatactttatgataataccaatcacatcgaagaagagtga

SEQ ID NO: 1344 - DNA, 579 bp, Candida albicans
attagtcaaagagttctatcagccatgtcatctactaaacaggatcttccacaagctagggctccaactttaccatccaaaacaacacctgaacaaagatattggagaagttatataactcctcaattaattaaagaaaatcatccgataaccagtattgaattcaatcctacaacacctaatgattttgctattgcctcagcaactaaaattcaagttttttcatctaaaaccagacaagtaataaaaactttctcacgatttaaagatgtagtatattctggtaattatagatatgatgggaaattattagttgctagtgatgcatcaggattagtatcaatatatgatagttatcaaccacgaaatttattagttagcttaactccttcttcccatcctactcatgtggcaaaatttcaccccactattgggaatcaattaatcacggggtcagatgatagaatgttacgagtttatgatatttctcaaacttctaatgggcccattatacaatttgataatattgatcacgaagattacataagaagtgttaatgtgccccaccacggcggctga

SEQ ID NO: 1345 - DNA, 240 bp, Candida albicans
gaagattatataagaagtgttaatttcatcccgggagattccaatttaatagttactgggtgttatgatggaaatgtaagaatattagatgtaagggatcctcatcgtgttgttgccaaatttgatcaagaaaaccctgttgaagatatattagctgtatcttcaaatactttagttagtgctggtggaccttatgttaaaatttgggatttaaatagaatgagtcaattcatcaattaa

SEQ ID NO: 1346 - DNA, 555 bp, Candida albicans
  unsure (37),(39): Identity of nucleotide sequences at the above locations are unknown.
aatgagtcaattcatcaattaaaccgaaaggaggtgntnttaataaattcaactacatgcttatcaaatactcataccaatggattaatggtagggtcattagattctaccattaaagtatttgattatacttcaactaattggcaagttcaatttggttggaaatttggtagtggagttttatcatgtggtgtatcaccaattaatcaaaagcattttgttgctggattaacatcaggattaatttctataagaactaaaaaaactgaacctaaagttaaacaaggaattaaaaatgatgtatctggtggttatgctagaatgatgaaaggtagagattatactggtgaagaagaagatcatataattgaaagttcaaaaataataactaataaaactaataaaagtgttaatgaattaatgctgagttataagaaatatcttggtgctagtggttcaattgatgatattaaaccaaatgatttgaaacaagaaattagtcaatgcttaaaagctaaagaaatttgtggtatgttagaacttttaggtgtataa

SEQ ID NO: 1347 - DNA, 1257 bp, Candida albicans
ttttttttatttttttcatttttcaagattccttcctcttgttattactttcatataaatcagttagcttttcatccctatttttttggaattcctatttattatctcattatgacattcgttccaagaaaaacatttcctaactataacatacctttgaataacttcaagggtcatcaccaaaaagcactttcaaaatttgggcatcttgcacctcagttagatatgatattggaagtaagggattcccgtgccccaatttctactaccaatgtcttattcgataaagtattaccaagcaagaagaaacttattctctatagcaaaaaagatttgtcaatattgaaacccaggctactagaaaagtggcacaagctgaagaacgagcaatacatgtttgtggattgtcgaagtaagcgtgacggtaagaagatcattaacgaaatcaagaaattatacgatagtatggagacaccacctccattgggattgagaaccatgataattgggatgcctaacgtagggaagtcgtcattggtgaatacattgcgatatgtagggttaagcgatggagaaaatgcagtttctacaaaaataaggaaagttgctagaactggtggtcaaccgggcgtgacaagaagtactagtgaaattattcgtctttcacgtgatcctgagattatggtatacgatactccaggggtgtttttaccgactacaaaaaatgcagaaacaatgcttagtcttgcattggttgggtgcattaacgaatcattcattgatcctgttattttagcagattatttgttgtacgtcttgaatctacaagatccaacaggaaagttgtacacagattatatcgatcacccaactaacaatgtgtatgagctcttggaaagcatcgaccaaaaaagaaatgttttgcaaatagataaacgttttgatgaatgtggattggcaaaccattggattagcaaatggaagcaaggtaaatcactgaagtatcgtgggttattagatgttgcagccattcacgaaatcaacgcaaaggactttggtaacttaactaatgcagaaagagagagaattggtttatcaaacgtgcagcaaagacttcaagaaagattcggcgatgatggtacatctacttctacacacagaaaaagaactgccaaagacagagagtttgacatgaaaaatagactatctcaacttcgtcttcccacggagcctgaccggagccaagcttattgtgta

SEQ ID NO: 1348 - DNA, 873 bp, Candida albicans
  unsure (724): Identity of nucleotide sequences at the above locations are unknown.
cttggtcgagttttttttttccaacaatcaatcaaagaagtaaactatataaaccaaaaagtgttttccaggaaaatgatagtaagaggaaaatgcttgggtcgactggtttcaaaagcagtttcactttttagcagacccatttctgttattctggccaaatcttttgccacaactacaaatctacttcaaaattccaaggatgattcaacagaagcgactattccatggtatatgagagaagagaacagttcacctgtggaagtgttgaataaaattgaggttcctgaattacctgaaaattcacctcagagcttgcaagagtttgtcactttgctaacagctgagtacggtttaaccgatcttgagatttttgatttgtcgcaattaccagaagatcatccaaaaagtttagaggaacaaaatgaagagaattatgttattcttgcttctgggaaatctgaaaagcatatttacaaagcagcttatgaattgagattatacatcaaacatacttacaaacatttgccaattatcgaaggaatgtcttcaaactcaattagcaaagtaacgagaagaagattggccaaaagagtgagaagaggcccaccagcaactgcaagtacatttgggattggtgctaattcctgggtaagctgtggcactggtgttgatgggatagtaatccatttgttaagtcgtgagagaatggaatcattgaatntggaacaactttattccgatgaacaagaaaatgaggaatctcattcgacaccagagattgaccaagatcgactttttttcggcgatagaagaagattccatacttctacccgccatttccattttgaatactttaagccatatttatga

SEQ ID NO: 1349 - DNA, 915 bp, Candida albicans
agcaacaatctttttccaatattttaccatcgattctccaccaaagcaaattatccaattatgccagttgaagagcttgaagaccgtgttatcattactgatccaaatgactcaactaacagagccaccattttgaaatttggtgctactgttgtttcttggaaaaacaataatcaagaaaaattgtggttatcagaaggtgctcatttagatggaagtaaagccgttagaggtggtatcccattagttttcccagttttcggtaaacaaaaagattcaaatcatccaactttcaaattacctcaacatggatttgctcgtaattcaacttgggaattcttgggacaaactcaagaaagtccaattacggttcaatttggattaggtccagaaaatgttgatccagaaactttgaaattatggaattatgatttcactttgattttaactgttagtttgactaaagataaattggttacttcaattgacgtggaaaacactggtaaagaagcatttgaatttaattggttgttccatacatattatagaatccatgacatcaccgatacattagttaccaatttaattgaccaacaatgttacgatcaattgattggtgaatcatatatcgaaaaggcaccagttatcagtttccatgaagaatttgatagaatttattcaaaagtcagtttggaaaaatccattcaagtcgttgataaaggtcaagttcttttcaatcttcatagaaaaaacttgcctgattccgttgtatggaatccatggactaagaaagctgaaggtatggctgatttccaaccaaaatcagggtttcatcaaatggtctgtgttgagccaggtcatgttaactcaatggtctctttaccagctggtgggaaatggtcaggtggtcaataa

SEQ ID NO: 1350 - DNA, 1989 bp, Candida albicans
atatccaatactaccttctttactagataccattatcaagaacaattaatcccactttgtttcatgcgtgattccaactatagggcaatatctagtaataaagcagcggtaacaatcacagctagtctctacgataggagagctttggatgtgacgtcagataagcctttagtcaattctttaaattttttgacttatttggtgagttcactggcaaaagtgagggaaacgttgtcactcgatggtggaattgagcgtttaattgaaatattacacgaatgtcatcaaactaattctagcaatgatcttttgtttgccgatcaagagaagaaacttttagcagcatggaaatggacattggcttttcaatcgttagtacttattggtactagaggaacagaagaaattagacagaaagttgtcaaagcaggcattctaccaatcatagccacagttttggataattatctatcactacacgagaacacattccatcaggcctcattgaggtcaacggcgaatactggaaatacgacaacaacaacaacaacaacaacatcgactaccgcaactccaaacataccaacagcttcagtggtagatactacttattaccaaacaactcctccagataacccagtggaaaacagtgttaccacagaaaccacgacaccagccacagagaacttatttcgtcactttcaacatccaaatcaaacacaacggcctgatgcggttggtgtgcgagatggtgaaaatactgatcgtactattttacaagaagattatcagaatcctatccaaatagcaacagctgcaatagaagcaacatcgatttctaacgttcatcccagagaagccaactttaatgttgattttaatttgacaaacgatgattacgatgactggacagtagaacaattacttaaattgatagcaacgaattggatggggaataacgagacggatagagtaaataatactattaccagtgatattagaagaagatacgcgatagtgacgatattaaacaagttgagggaagagaaacaaatggagactttacatgatgaatttattaacgaatgtgacattgacatggatagcaatttacaatttctctccgatatgtatgcaagagattttgaaatcaacaaaacttgttataatctgaaagtttttgtcaggtctttcaccgatagtgggatcgttatccctcgagacgatgacattgtctggtcattgcagttactagcttacatatcaaaatatccttatttaaaagactgtttacaaaactcacatttggtcttggatatgagtatcagagataaacaattgaaactatatctagagagacaaatgaaattgaagatgaaaaaaatgttagcagtgagattgcgccctactatagttccaaaatctaggaaacaaaagtcttcgtacttggaaacctttcattctagtccatctaactcacctcaaatggtcagtgatttaaatgatgatacgtttatcatggggaatgacaaatttggattgtgccagactaacgacttgactgaaactgcagagctgggtgaagaagatgacgaggaagaagtagcagaaaaagggaaaaatggagaagaagttgaatacgacgatgattacgacgacgatgaggaaccagaggcatgcgatgatgatagtgaagattcaatctctctgaaggatttgcttgatatactgatagatcagtttgagtatttaccaaagttatatgaaagcatggttgagtgtgagtctattctggatgacagtgaacgtgaagttgcactatttcaaatctacaataaaatgaacaaatgcatagaagttgaaagtcgaaagttaaaggataccattattggtgcacgattgaagactaagcgataccttgagaaaaaatggaattatgaagaatataaatatttgtcttcgaccacggcggctagaaagacaacgctc

SEQ ID NO: 1351 - DNA, 582 bp, Candida albicans
tcaacgataggtaatcatcccaacaatccctacagactcataccccccccaataaactcaaataacatattacaaatgtcatcattagataacgacaaaactgaaaatttcattcaagaaagattagattcattacatgaaatagattgtaaagtagtaactttacttgatcaattttcttcaattttccaatcattttatactaaaagtaaagaagatttttctcaacaaacttccgatatatattctactttgagtaaagtagctattgatttacgtaaagaaattaaaattatggatgataatattggggcatatgataaaaatgatgataatgtgatgatattacctattagtaatgttgatcaaaaaaatacaaaattaggtagaaaacgattggatttagaattggcagagttgaaaagactaatatcggatgagaaacaagttgaaactttagaaaatgaatctaataatgaaatacaacctaaaactgaaagtgataccaaccaagtagaaactaatgaaaatggaaacgacataaacaataaagaaagtgaggacattgaaatgaaagaataa

SEQ ID NO: 1352 - DNA, 1674 bp, Candida albicans
aacttctatatgaactcacgatatttattacgaacccatagtagggtattgtttagaccacgaaatactacaacaatatcagcaacttgtgccaactttatatctcgtcggcatgtctcacaatataattataatcaaacttatgctgcttacaaccaaccaaaaacaccattttggaagaaacttgtatatgcaacattggggctaggtattatttctgggtatgtttattatatgtggtggcctaaacatacttttccaagttcaattgccaaatttttacgtaagggattatgggcagaaagtgatcgtggggaatttgattatcaattagcattgaaatattatttacaagcattagagcatgcgaatgaaattggattagatccattaagtgatgaatatactgggatacaattaaaaattggagaaatgtttgaacgattgaatatgttaactgatgcagcatatatttataatgaaattgctacattatacttgacagttttaactgctcctcgtgattctccagagggacaaagaattaaagatcgtaaacatcgtcgtcatttaattcaaaaagatttaagaattgccattaaattggtgtcattaaatcctacaaatcctagtttagctaaagctatacttattacccatttgataattgcccaagatgaagttaataaattgatgggatcgtcattatcttcgtcaaataaattaaatttggttaataagattgatcccaatgacaaactgtcatcaaccaacacttcgaacggagcttacactgccgttttagataatgataccattgtgattaccaataataaaactggggaagaaaatcgaattaaaaagacccctgaagtttgggaacctttcactgatgaatttttcaatgccatggatttattaagtgctgtttgtattacatctggtgatttagccatggctactaaagtgaaaattgccatgaatgaatcaatgttattagctgatattgaaccttccaaaatgttattatcacaatgtaatttaggatctttactttatatgcaagctgaagaattagaagctcaagaaatatccatgacaaggaagttttccgaactttctggtattgaatatgatcaattgttagaatcacatcaaaaacaaatgcatttacaacattcggaaactaaccctgaagataaaacagattcgaattcaaatccaaattccaaattgattatggaaaaattgagagaaactgtaccgatcctggatcaagaagcatttgccacagtgactagatcaagatcagtttgtttacaattggcaatcaagtcatatgaatcagtattacaatttgcaaaatctttcccacaagattttgttaaacaacataatgaaatcaatgaaactgtagcattagcaacatatggtttaggagttattaatttacatttaagtcattatgaaaaagctgaacgattattacgtgaatcaagagttagagcaaaatcatgtgattatggaacattgttaccaatgattgaaaaagaattggaaaaattatttaatgaaaaaaaatcgttaaccaaagatgaaaatgataattcaaagttaaagaaaaagaaacattctttacatgatattgaaatggatataactttaaataagtaa

SEQ ID NO: 1353 - DNA, 1041 bp, Candida albicans
tgtttctacacatttaattacagttcaattcaattcatgcttagaaatttcttactttctccacgtacatttgtacgaatgagttcaactaaatcacaattgatttctcaaccattcaaaatggaaaacacacaaatgattcgagaaacagcaagaaagttcccacgaccgaatttcatttcctttgatttgttcggtactctatatgtccccaagaagccagttccccaacagtattatgaaattgcttatcatgagtttggtattaataaatctatacaatctattgaagaggaattcccaatagtttatgatgaaatgttacaatcgtatcctaattacggaaagggtcaccccaaatttgataattgtgattcctggtggaaagaattaatcatcagattatttcaattagatagacacgatgatcaggcattagcattgtgtcatcggttgattcaccattttacaagtgaagaagcatattctgtgtatgatgatgttgtgcctacattgcaagcattgcagaaacagggtgtcaaactaattgtggccagcaactctgatccaagagcattgaccatacttgagagcttgaaaattaaacaatactttcattgtagtgagcatttccattgtagtggggtttttttatcctacgattcagattattccaaaccaaccaaggcattttttgatgaaattgctttagtcgagtatagagctcatgttgatgcaaattatcgaagcaagaattatcctccaggtgacttcctttctgactgttggcatgttggcgatagttacaacaacgattacattggagcagtgagggctggctggaacggggttttgttggatagaaatcatactagtgaatttttcaaaaatgtaaggaaaccccagaatgacgggtgttttttaaatgaaaatccggaaaccaaaagagatgggcaaactggcaatgaaatgttgatattggcaaacaatagagtggtcataactaaacttacacaacttttggatattttcaaactttga

SEQ ID NO: 1354 - DNA, 1743 bp, Candida albicans
acaacattcgatacgcaagtgctcgcccttaaaatcatgctgacactcccgtttatcaataatggaaacaaatcaaataccggatgttcccatctaccgggcagattaacagcattaattgtttcaatattggttgctcttgcgtcaggcacaccatatttgtatggggtctattccccacagtttgtaaaacaagtgggattgactacttctgattcagcaacaatatctttggcaacaaatttgggctcgggagtaggtggactaccaggagggttaataattgaccattttggtccacaaaagagtatattattggggtcagtttgtatatttattggttattttgccatgcacaaaatctatgaagccaaatatgacaatttattgatcatttgccttgcaatggtccttgcaggatttggatcaatcacttcctattttgccacattgaaagcttcacaatcaaatttccccaaacatcgaggtgcagctggtgcgttccctgttagtgcgtatgggtttgctgcgactatattttcaattatttcagcaacttatttcaaaggaaactctggaggattattggaatttctatcaatcttttgtggtagcatgacatttttagggtcttttttcattcacatttatttggaccatcatgatgatcgtgagatggaccctgaaatgtcaagtccagaatttgtgtcatctccttcaccaaactattacaatattgaatctgcttcatcgagaagtcctagaatagaagaagagatttcgttactaagtgaaggaaactctgtaattgaaccaccagccacaacaatgagtagacaagattcattacaaggatctatttcattttggggtattggtcaaagaacacctagagaatctatcagtttgcaggaatcggaagctaataacattgtcgagagtcttcgaaatgaaaatgtacctaaacaacagcaggaagagcaactgaaggattccaacaaactgtggctcaacctcatttcagtacccgaatttctccaaaaggaaaacggaagaatatttgctatccattactatattgtctcattagccagtggtattggtcaaatgtacatttatagtgtaggattcattgtcacagcacaatattattatggcaagaacaagatagaaaatttaacaaccgaaaaccatagatttagccgtaatgatattcatcatgatccaaatgttgatgatacagtacaaacattacaagcccttcaagtctcagtaatttcgattgcatcatttctgggcagattgttttctggattcttgagtgattacatctataaaaaatggcatattcaacgattatggatcgtcccagtaacccttgtatttctagcgttagggcaatatttaactatccaaaatgtaaatgacttacatcttgtcacccttgcttctgcccttattggaggaagttatggtcttatatttggaacatatcccgcagtgattgccgatcgatttggcactcgtctgttttctacatcttgggggttggtgtgtacagggcctttaattacattatggattttgaataaatcttttggcaaactatatgacgccaattctgatagtgataccggaatttgttatttggggaatggttgttatcaaggtgcctttgaactaagtctagtcctttgtggtatgacatctgtggtgacattacttttgatatatatacagaga

SEQ ID NO: 1355 - DNA, 663 bp, Candida albicans
ctatatgaactacctataatgatctcacgaaacgtgcaaagagtttttgttttattgtcatgtacctttttgggtttaatttgtggaacactttatctttattcatcatacagtccccaactagcaaatcaattgcactacagtgcatctgactcgtcaataatagccctttgcggaactataggtgtggcaatagctggaccaatatctggggccgttgtggatagaaaggggtataccgtgtcactactaataggtggtattttgattatatcgtcgtatattggattgaaacgacaatttgactatgcttggagcaatgtgcaattttccagcttcactatcttcttggttggggtaggatcaacgttcattaactctgcatgtttgaaatgttgtgctgtgagttttcccagtattagaggtgtcgctacaagtttaccactagcattatatggattaagtgctctattttattcagttatagcatctgtgttttatcctggtgatacatccaattttttggggtttttggtaatgtcaattattttcatctatttgatttgtttccccagtgtctatattgctgattgtgaacacaaactaaaaagtgcttcaaccttccacaaaccttcagttactgtcaattccacacatcaccat

SEQ ID NO: 1356 - DNA, 894 bp, Candida albicans
accctttctacaatcatgtttgctagattagtacctagattgcaaccacaattgttgtctaaacgagtattgacagcaagatatccaatgttgactacaacaccaatttatcatcaaaccccgatgcaaattatcaaaagaaattatgttattgttcatagagaaagaaaaaaagaaccagtaataaggtatcttttctatatgcttgttgcatcatgggtggcaatctactttgttgctaatcgtgttgataagaaaaagccaccgcaacaaagtttcactgaacgtgaatttcaactgtatgaagaggaaacaggattgaagagaagaaataaattaattagtcataccatgaattcaaaatataaattttacgttattccatatgttcatgatgaagaagaattgaaaaaagtggctaatttcttacaacacaaggatgaaaacgcaacggtgaagatcattgatcccgcacaattgattgaggaacaaaggaaagatgaaggtatgaagtatcattacttgcttgaagatttagatgaacaaggtagaccatatcttccaggattgatcactgcagttataaagcaggagatttataagattttgaataatagagaaggaacatttgataccaattttataattaaaaattaccctcaaactaccaatgaagcaatcaaatttgaaaatgacatttctgatattcaaaagtgtttgattttgcattatgacatgttgaatgagttgccaaaaaacaaaaccgatgaagaacaacgtgccatcaagaatgttgatgggtattttgactcggtgggtaaatcgaaaacattggtagaaaaattcgatccaatggataaggaattcgaagagattatgttagaagacatttaa

SEQ ID NO: 1357 - DNA, 183 bp, Candida albicans
acaaagatatatacatatatattcataatgtcgttagtgctgttgtccaagttttgtgctcatgtgaagaattgtttgaatgttactttgagcaaaacctcagttccatacaatagaagtaacttgcaagtagccatggcattatatcaacaagttttatcagttctattccaaaaagaataa

SEQ ID NO: 1358 - DNA, 372 bp, Candida albicans
  unsure (103),(109): Identity of nucleotide sequences at the above locations are unknown.
cttgcaagtagccatggcattatatcaacaagttttatcagttctattccaaaaagaataacctgggggccaaatttaaagccaacagaagtgactccagatnatatanattcaagaagactatggattgatttgaagtatagaaataatcaatcagtgataagacaattggaattgatttccaaaccaagtaaaaaaattgatttaacaactgaagaaattaaagcgttggcatcgggattaaaagttagaaacattccagctttacaaccagctggatgtattttcattaagcatgataaagatatattagaagttcaagaggcggctaaaaagggtatttcaggtcaagcattattcagagtaagatga

SEQ ID NO: 1359 - DNA, 1608 bp, Candida albicans
acaaacaaacaaacaggcatttatagtttatattcaaatatgtttctatcagtattatttatggctccattcactagggcccatccaactatctttacgcaatacaatggaggactcgatgaccaacaaccagttatcaagccaccatttagacattcaaatggacaagaaacctcagacgatgatttagtcacatttttaatcatatcttccataacgtttgcgtcattagtggtggttatactattatcattagtaatcttttgggttgtaaagcgatcacgacagctatctcaggacgaacttgacagggaggaggaaaaccaagcgtatttggaattgaattctgatgaacaagaactatattttcaatccaaagagtttttaacaaatagtccgtacttggtgggtgatttaaccttgagtcaagaattatcgatacaggaaaaaggtataacggcatttgaattccaaaaagatgtggttttgacaaataacgatttgatgattctcaacaaatatgagttgaatttttttcaaaactttgaatgttcaactcaaacgaatttaccgattccaatgaaaaatgaggtgtattatttcgaatctaaaatatactcgttacctaaccctgatgaaacaataatatctattggtttaagtatcaagccatacccatggttcagattacctggaagacacccacactctatttgttacgactcgaatggctatcgaagacataatcaaccattcccattcactaacgacccgccatttcccaaattggtcgaaggcgatgtaatcggggttggttatagaacccgttcgggaacagtgtttttcacacgtaatggtaagaagataagtgaatccaaattgggtgggcatgtcaagaatttcaaaatttccaacaagggtcaactctttcccaccataggtgccaacaatgtttgttctgtacatgttaatttgggacaaatgggatttgtatttattgaagggaacgtcaaacattggggttatgcaccactagagggaaatggaccagctcctcctgtctacaataaatacaattctgatattttgctagaaagatcagagatagacgatgatgatttgagtgaaagagaaaatgatttcccaccagatttttgggctattaatggaagcgaaaatgaagctgctcgtactgtgtctcctcatgctttagatcaagataaattcagttacaatgcatattcagaggtcaactcgaacgatgagagaatcacattggctagtttggttcctcctgtcaagccaccatcctataatgaagagttggaagaaggtaactcgagcagtacaattaatcctatgttacctgaagaacaaaagcaaaccgaagaagataaaaagagtaatgacaggcatagttctgagggtgttgccgatgctgaagacaaccaaaatatagatgcagaggttgtggaaaatgatgaagttataaacgacgctacccaagcagaaccatttgatataacagctgagaattctaacactgtggaggcagacagtataaatatcaatcaaactgcagatgtagataatgacactcctgagtaa

SEQ ID NO: 1360 - DNA, 1221 bp, Candida albicans
  unsure (1187): Identity of nucleotide sequences at the above locations are unknown.
cactgcctgctagcgactctgtttctttcgaaaaacgaagtcccatgtttctctttaacaccagagcagacaaaagaccccatagcattcattgagagtgtaatggacgttggtaaagaatatggtgctgtgaaagtaaaactacctcaagacgatgttgagttatttcaaaccacaaatcaaataaactccgacttgttttggtttcaaacgaataaattactaaataatcctcctgaagatgaagtatacatgcgattgaagtttcatcatgatttgctcgaatttcttcaaagtgaggacctggtaaaatatgaagaccaagaaaacaaaagaggtagtaatgcttctgcttcttctgcttctcagcaaaccaataaaatgcccatgattgataaacgtccattagatttgtacaaattatttcaatcagtgatgatccgtggtgggttcgtcgaggtgataaacaaaaaactttgggctcaaattggtagagaactaggttataaagggaaaattatgacaagtttgagtagttccttaaagtcctcgtatcaaaaaattctttatccgtatgaattatatcttcgagagaaacagtctattttagaagcaaaagaggaagaactaaaacatgtacaagtgaaaaaggaaaataaaatcgattttttggttaatcatgatgactctaacgaggattcacaaaagaatttgaatgggaaaagggggttagatgaagatttttcaaccaacaaaaggattaaaactgagggttacactgcaccgttaattataggttcagctaaagattttagaagatcggtcaaatcaaaactaagaaaaggatatcttttaaattccccattatcaatcgatgttaaacaacccaatgtctttaccataaaacaagatgagaaaaaacgaaggagacaaaatgaaaaagtggacattagtatactgcctcaaacacagttggattctgcaattcgctacatagcaaatagtcaagatgattcgagagttaaagcggcacccaaaatagcttctatttatacattgcgacaattcatggaaaaggatataaaattccaagagtttttggttcagaacaacctgatccagtttaacaacgtcaatgttaccgatcggaacttgatatctcccccaatgtctagagaaattatttnttcagccacggggcctggaaggatccgcgattgg

SEQ ID NO: 1361 - DNA, 939 bp, Candida albicans
ttcccttttagggttatggttacacttgaaacccgtggtgccatttcgtggggagtgttattatattatgtgggggtatttccgttggatggtcgtcattattacaaatttttgagagttgtcttgccaactcatctttatgaaattgcctcacatattcaaatgggtcacgatcattctcatggtcatgggcatggtcctgtctctgtccaaccagacacccactctcattctcatggtcaaattgatccatcgaatataactacccatcgtgaaattcctaacataaatgctgcctggttggcaggtggatcaattattgccaaagaacttttgtatcgtaaaacaatgcaaattgccgtacaaaccaactcaaaagtgttagtggcaaatgcatggcatcatagagttgattctttgactgctgttgttgctttgtttactgttgctggtggggttttatttaatgttgcttggttggattcaattggtggtattggtgtttcaatattgattattaaagctggttgggattcattaaaagaagcttggaatgaattgattgatcgtggtgaaaaaccgggatctgaattatacaacaaaattgaagggatcattaataatgaattacaaatgaataatgaattgaaacaatttaaattaaatcaattatcagtgttgtcttctggtgctaatactaatattcatatgaatctttcaactacaaataaaaatttaaatttacaaacattgaatcaatacgaaaaaagattatcagatttaattagacaagatgatagatttgttagaaacatttttgttaaatttgaccaagttgaagaagaaccagagaaagttgaagccaaaaaagaagaagatgatgatgatgatgaaaaggaagtaaatggttccaatgatgtacatagtcacaaacattaa

SEQ ID NO: 1362 - DNA, 606 bp, Candida albicans
gaatacatttgcttttctgtcaattatatgggtgtgagtcgtcgttatttatatcacacattatcaagaatgactcagttaacagccacaaccattaaaaataaacctattagaaatgctggatgtttaattattggtgatgaaatcttaaatgggaaaattttggatacaaattcttataattttgctcgattttgttttaataatttatcgattccattgaaaagaacaattgtatgtggtgatgatgaacaagatataatcaattcattaaatattttattaaaacaagataaattagatcttataataacttcgggtggattaggaagtactcatgatgatataacttataaagtaattagtgattatttccaattagattatcaattagatcaagaagtagtcgatagaatgaaatcaattcgtggtgattatcttgataaattgaatcctgaacaattgaatgcattttatcgaatggctactctaccggtgtcacctcaaccatcatctcttgcccaaaattcaactacaaccacacctgcaactacggttgagaaatattttattgatgttttcaccacgggcgtggaaggaccgcac

SEQ ID NO: 1363 - DNA, 366 bp, Candida albicans
  unsure (4),(11),(32): Identity of nucleotide sequences at the above locations are unknown.
cctncaagcgncattataacgggtctctcaanaggtcaccaattaatgaacgatatggaaccaatgttaaaaccacgagtaatatcatcggatttaattagaagatatgttgttactaaatctggtgaaactcaattagcaccgtatttaaccaatttacaagaaaaatgtgataaaaaatatggtaaaggggtattaaaattaggtagttatcctcatatgaatttacatattaataccattagtataattggacaaaaattaactagtcaagatttggattggatagtaaaagcattaattgaaaatattggtggtgatgctaaagaaatcactcaagctcaagaagatgaatatagtaaatag

SEQ ID NO: 1364 - DNA, 2700 bp, Candida albicans
gtgtgggatttagagtatgatcagttgactatcgatgtcttgtaccaacgtttgttcaatgatacacaagagtttgatttttttacgaaaagatatgaagttattgagcaattgctagattatttgattgatatacagaaattgtcaatgaactggattcaaaacgacgataaaaatcttattgccatttcattacatgacctcaagacatttagtaagttacttaatgtcatcatcatacacggcgtgtatccgcctttgaatatactccgcataggtatacagtttgaaaaaaggcaattaaagaatttttcaaacaacaagaacttgattaagattgacaagttgcctcagactgattttgcatatattgaaaagcttttgactttgatttatacaaagctattgcgggttttactgataaaatctgatgttgctagtttattattaaagggaaccggctacaccgactttttggttgtggctattacattgattgtcatccctcagtttaattccagtgatatcgactttgctaaaattgaaagcatagcatcgacgtttgagttataccagacatattctttgttgttaaccacaccatctccagctattttcaaaaagtttgtaatgtcacatttggggtcactccactattcaagaccaaatggtatactcacactaattgagtttgttcttgggttgcgagaccaagaggaaataaacatcgaaaagtttgataatgtggcaaatgttgttttgcacaaacccgccaacgtcgacaccaagagttattttatgtcagttgggaatcaaatgtatgacttgttgattaatatcaaccgaccaaatgttacttcatgtgtggcatatgttttggaaaaattatggcagagaaacaaactagttgtaacggattttgttttgcaaagaatatggaacaacttcaatcctccaccaaaagacgaaggtatcttagtgactgaagcccaattgaataacaatattaatgtgatattatctttaaccaaaaaggggttggaacccgatttataccaagctgttattcaacctgtgttactaccactttgggggtattacacctttctaaaacaaaacggtaaagaaggtggggtcgccttgaacattttgactagctattttacattaatgaagggtatcgacgatctgggattgccaactatagctaaaaatttactttacaaacatggagaaaactggaaatatgaatttggcgacaacaacttgacccaaattgtgacagaaaaacccgaatttgtatctcagagcaaagagtccaaaatcaataaattcttgaacgatttggactttgcttgcgaattgtttgtcaaggtattggaggaattggatgatagtctaattcaacagctatttgtaaaaatcttgaacaactggttaaacaatgacacacaaattttaggaggcgaagaaagagatccatttctaatgcttcttgatttacgtttattagaaaaaataggggagaagtttagagagaatttagcaacgaacccaattgatatgttagaattggtacagagttttctcagttcctacaagccaaacagcaaagagaatgaacacagcgccgaagattcagacgacgaaatggatgacgatgagctggagtttaatctggatcaaactataactgttctcctccagttattgtcagcaattatttccgaaaacgatattattcttgacaacaagggttccgagttgttgtcgagtatcaaaaaaattctatcgacgaattcacagtttcaagctagctcacttaagggttcagcagatgcattatgcacaagaattgaaagtttactatctaacaataatgagatacttcctgccaacgaatctgaagcccagaaacaaattttgcagcgggccataaccaatttaaacgaccccttagtacccattcgagcccatggattatatttgttgagacaattgattgaaatgaaaagctcagtaattacattggattttgcaataaatttacatctcgtacaattgaaagacccagaaccatttatatatctcaacgtgatcaaaggacttgaaactttaattgagtggaacgagccactagttttggatagcttgtgcaagttatatttacaagatgatgttgagttggacgaaaaactaagaattggagaggtgattcttcggtatattcaaagagcagggcaaacatttaccgggaattctgctaaattgattgtagaaacaacattggcggtgattcgaagagcaggcaacaatagaaaagatgacagattaagaatgtcgagcatgtcgttgttgggtacatgttgcaaggtcaatccgttggggatgattgataatttgaactatgcgttggatgcaagtattggtattttggaattagaaacagacaaggatcaagctataatgagacgtgcagccattatgttgatatatgatttgatactaggaacatcagagactgacaaagtcgagtttcctcagcagtacaaaagcaaggttataactgtattgagatatgttgctgaaacagataacgatttattggtcagagaacaggcacaaaaagtgttcgcaaccgtggaagagttgattgaattagccatggaattatacaaagaggaaaatcaagtacaatga

SEQ ID NO: 1365 - DNA, 2337 bp, Candida albicans
tatctaacaatgactatggatggatcaactcctgaagaaaaaagattaaaggatatcaaatttagacaatggggttcatatattggtgaaagacaatgggccacagttagagaggattattccgatgatggtgatgcttggtccgctttaacttttgatgactctagaagtcgtgcttatagatggggtgaagatgggttagcaggtgtatctgatagaaaacaatttgtcaacgttaccatggctttatggaatgggaaagatcctattcttaaggaaaaattgtttggtgtaaccaattcccaggggaaccatggtgaagatgtcaaagaacagtattactaccttgacaacactcctacccattcctatatgaagtatttgtacaagtacccacaaaatgagtatccctacaagcaattggtggaagaaaaccaaaaaagatcaagattagaaaaagaatttgaaattaccgatactgacatattcaaaaacaatgaatattttgatgttgttatggaatctgcaaaaggtgatgctcctgatgaattgtattttagaattactgcttacaatagaagtgataaagctgcttccttgcatatcttgcctcattgtacattgagaaacatttggtcttggggtgccgacgagtaccaagaagtgaaaaaaccacacgttaagcaaattgatgaatacactgttgaagttgaaacacaaaagtttggtaaacgttatttggtatttgctccatcgccagggtttaaagagtctgatcctgatgttgaaccgcagttaattttcacagaaaatgaaaccaacacgaagaaattgtacaatcaagatgataaaagcaagtatgttaaagacgctttccatggatatgtcgttgatgggaaacaagaagtagtcaacccagaaaaacaaggaacaaaagccgctgcttggtttacatttaaagatatcccagctggggagtatgttactatccgttacaaatttaccaatgacaaatcagaagttgatgaatttgagttggacaatattatcagtaaacgtcaagctgaggctgatgaattttattggcacgttacaccatatccaattagtgacgagttgagactaattcatagacaaggttttgctgggttgctttggacaaaacagttttattattttgtccacaattattgggcaaatggtgatccagataccattaagccgccaatgaatcgtgccaacggtagaaacaaggaatggaaacatttgtatactgatgaaattttgtccttacccgataaatgggagtacccctttttcgctgcttgggattctgccttccattgtattccatttgctatgattgatccacgttttgcatggatgcaattagatcatttggtgcgtgaatggtatatgcaccccaatggacaaattcctgcctatgaatggaattttagtgacgtgaacccacctgtccatgcatgggctgcgtacagagtatttaaaattgaaagaaaaatgtatggggttgaaagtcttgattacttggaatctatcttccaaaaattgttgatcaattttacttggtgggtcaatagaaaagatgctgaagggaaaaatgttttcgaaggtgggtttttagggttggataatattggtgttttcaatagatcagaagagttaccaactggagggagcttagaacaagctgattcaactggttggatggcattctattctttgcaaatgttgaatattgcccttgagttggctaagactataccagtttacgaaaatattgcctccaaatttttcgaacatttcattattattgccgacgccatgacttttagaggtggtgatggagatgaaagcactaaagatgctttgtgggacgacaaggataaattctattatgatgctattagatacagtgaccaccacgttgaatcattacatgtcagatcattggttggtttaattccgttgtatgcttcgttgaccattgaacctgatcttttaaacagatacccatcattcacaaaacgtctcaattggtttctagttcaccaaaagaaaatgtcagaaagaaacattgcctcaatggaaaccataggggttggtgaaagaatgttattatcattagtctccaaagacagattgttggccattttggacagaatgttgaatgaagatgaattcttatctgaatatggtattagatctttatcaaagtatcataaggaccatccttatgttaaggaagtcaacggaagaaaaattcaccgttgcttatttgtcaggagaatcagattcaggaatgtttggtggtaa

SEQ ID NO: 1366 - DNA, 963 bp, Candida albicans
atgaagatgaattcttatctgaatatggtattagatctttatcaaagtatcataaggaccatccttatgttaaggaagtcaacggaagaaaaattcaccgttgcttatttgtcaggagaatcagattcaggaatgtttggtggtaattcgaattggagaggaccaatttggttcccaactaatttcttattagtcgaagcattacaaagattctatttgtattatggacctgatcttaaagtggagtgtcctaaagggtccggtgattacttgaatttggctcaatgtgctcaagaaatccagcatcgtttgattcgtatctttttgcccgatgaagaaagtgatcgtgcctgtaatggtggtgtggacattttgaaccgagacccactttttaaagactatgttccattttatgaatattttgatggtgatagtggtcgaggattaggtgcatcgcatcaaactgggtggacttctttggtgaccaaatggattcatgataatgctgctagtaatagagttccaaggactccacaaactccaaagaatagaagaagacaatcagttttcttgcatgccagtgaagaggccaacgatgacgatgaggaagaattacagaaatatgttcctaaatgtggtccaatgcctggtactttggctagaagaaagtcaggtaaatcattgttaaatttaactgtcaatgccttggatttgggggacgaagaaggaagtgcaactacaaaagctgctgtgtgtggtcaagtcggtgaagggaaatcaatcagtgaagaagagttagaaaaattacacaaggtccaatcgggggcttctattgattccaacgaagcagctcaacttgatagtgatctattgggtcaagttagagctgctttcaagaaatttaagtcaagaactgacgaagatgaatttgaaggtgatgaatttgaaactagatgttcataa

SEQ ID NO: 1367 - DNA, 633 bp, Candida albicans
  unsure (4): Identity of nucleotide sequences at the above locations are unknown.
catnttctactattcttttgccatgtttattggttagggatcctgctaataagggtaatgtacaccaaccttataccaagcattttatacattgctttgacaatcgcatcatccgagttattgaattccatacagggaacatggcaaagtcaaagtgaacgagtaattactggaccaactttttttgatccccagaaggaattgctagaagaacctaagctaccaggtatatcatattcatttaaaaatggatactgggaactggcacaatatattgtcatggggaataatagaaaccaccaatgtcctcaagcaatgttaatttggcaacatgggaaatataatttaaaacgaggaaaacttgtgcttattcccaatagaaatgacggtcgacaattaatcagcgatccttgtttggataatggtaaatctgaatataaaaggtttcataacggagaaacattagaagttgatattagatttgatggatattttggtaattggaagttggttttggtagattatcttacaggtaaaaagaagcaaccaatgtggttgacactgagaaatgccacaatgttgcccacaggaaccataacctctacaaagaggaaatatgttaaaaaagagtag

SEQ ID NO: 1368 - DNA, 1017 bp, Candida albicans
  unsure (236),(248): Identity of nucleotide sequences at the above locations are unknown.
accaaaccaaacgcaacttcacagaaatttattggttatacccaagggaagattaaacgccataaacaaagtaccaggaacaagagccggcatttcaacagacgtaatgaatatctgcaaaagtcaccagaatcttccatattggcagatgatgattttacagaccaccaagaacagcaacaaactacagacagagacaatagcacaaatcttaatatgacaactgtgacgacgangacgccgccgcntccacgtccacgtccacctccacaacatgctcaggaagccaatgtgtacaaatcgccgcgaaaggaggctattatgcgatacaaacagaatcatgataacacctttaatcaactattcgacattaaagaaaacttgaaatcaaaagaaaatgatgataaacagtcccaattgcaacaggctactggtggaaatcaagtgaatagcaaccacaacaatggtaatcacaatatatctttggatttggatgaaaaagttactctatttaaatacaaatcgctgaaaattttggaattggtaaaccaaaacaatgccaatggctctttgctagcacatgggatatttgagattttccagctacatcaaggcgatgtgacttatttgtcctgcggtaataactttatttacccattattgcccaaaatcaaggttttcagaataaattcaaatcaattcttgctaccattagtcaatccggaacgatactggaaaatatttataaacagcgaagaattgaatgtaattaacaatctaatcaacgttttccaaagaaatgttcaatttataagtttacatgaatcagaaaataaaaatgctccagagcctaagctgcaatttgagttcacagatagtatcaacacaaaaccaaaggaattggaatctcctccaagaaatatttatatttctaacgaaatccctgattcccctccatccgctcctatatctccaggccacattcaaactaccttccacctatcgccacaagggaga

SEQ ID NO: 1369 - DNA, 624 bp, Candida albicans
cccacgcatttgctaaatgggattttggtgctgtgcattcgattgaatattcccgggttgatgaatgcttttgttgatgtcaactataccaaatcagacaaaaattatacattgtaccggtatgttcatacttgttctgatttttacagcaccgaatctcaattgagaacttttgaatttaaacctctaggtgaaatcccagaaacgttgcatatacataatcaagattttagacatttcaaaatccccaatagagattcatataagaacattgtggtggtaaccgcatttttcattgacacggctgagaatttgttggattatttggatgttataaagaatttgacattaccatcaggtaacatagaacgtggttattggataaatgttggtccattgaaatacggtactgcagctcaagtggaattaaacgctgatgaattgaaagaccttcgcaagaatttaggatggaaagattataactcagtgtacacaatttacgacaaattgtcggcaggtgacaagaccggacttgttgggtatttgacagataaagaaagtatgtggcaaggttactatggacttaacatgtttgccagtggtagagaggaaaataagttttaa

SEQ ID NO: 1370 - DNA, 1716 bp, Candida albicans
gattatcaactttatcgtaatggactgatttgtaataatacagtcactcacttgtataacacccaagaatcgttgatatcttatacaccatcttcaaaacccaatcatgatttacaagtatttctaactagattcaaatctacatcagttagttattcaccaagagcattaatttatgatttaagaaatggattaggggcattgaataaatatgagtatcatgaaacattacctgttgatttgaacttttcactattatcgacaaacacaacggcacctgcgggagcagaaacaggagcaggcagttctttagaatcggggtataacttgaaaaaatcaagggttgaaaaaaatgaatatcaacagaaattggatcagggggttactgatggctcgtcattaaatgttaacaataccaaatattggactgattacaataaactaatatataatcccaaatcattaaccacagtcaataattttgttcacaatgaaaataaccatgagtcgggatatcattataattttaatagtttgaaatacgactcgttcaatattggacaagaggaatttaaggcatgtaacaatggaaatggtggttatggttatgacgataatgataataataaatcgatagagaatttccgatattttttagaaaaaactgatagattacaaggattacaattgttaaccaatcttaatgatgcatggggagggtttactagtgagatgctaatagatttgattgatgaatttttcaacaatacaagtagtgacaaacaaaatttatggatttatggaataatgaacagtacaaaactatcagaaaagacacagtcaatcagaacaaaattatcgtttattaaaacattgattgaattgactaaacaactgagcttgattttcccaatgaatttaaataattcaaaagatgaaagttggcacaataattactccatgttgaccgataaatataattcaggttcaaattggcaccaatctagtttatatgctacatttattaattcgatatggggattgaataatcaactcaagaatcaaatcagcatgactcatttacaaaatgatatcgtgaaactcaatcctaatcaaaaaataattaatcaaattaaaataaaacaagagaaaagtggtaatggtgacaaacaaaatcaattatttggttcagatttaaatcaatttaacttgaaggacatagttaatttgaaagaccttagcaatcttgggaaaagctctgacacaagtgctactcaaagagaaataaacttaggaatatcaaagaatgcaagtactaatactggtaatgatgcctatcataattttgttcaaaatagaatatcttcttcaacttcacaaaatgaaaaaatgatgaaagacaaagagcaagaacaaaatgggattattaacaactatctaaacccttatattgacaatatatttcaagtggaaactttccctgttgatattttaaagtcatcgtcaaatgctattaatatatcgactgagtttaatgttaatgatggattgaaatcttacttgaaaccatatataaaactagtgtcaaatattagaaatcaacatcgtgaatatctagatatcattgaatataaagaacaattgttggaagatttgaataatataagtcaagaatattcttatggttacgaatcagatgatgaagattatgagtga

SEQ ID NO: 1371 - DNA, 1185 bp, Candida albicans
  unsure (1126): Identity of nucleotide sequences at the above locations are unknown.
tttctctatctccacgttgaaggagctgggaagaggttgtcacgtgctcatctgcaaaaatcccatagcaaaattgcccaacaaattgatgatgatttcaccaatgattctttaaccttgacagatatcactgaaaaggcattttcgtcgatgaaatcttttttcaataccaatgctgccagtctaatctctgaagtgacaagagctgttgtccaacacaatattctcaatggaaccgatttggagtggggagtctcattcttggaattatgtattacttggattccagttcaattacgttttgtcagtttgtccaccttgttggccactttaggtagaattaatattgaaggtaacaccaaatccaattacaacatgcaattccagtatgctcgttacttgttaggattactttcatctcgtgtgaacatgattgggttatcagtttcagatattattcaacagttgttatcgttgcaagctgatttgattttgaaggcaagtgacttggacaaaagtgaaatttcaattttaacagacatttattctgactgtatttgtagtttgactacacatatatattactttgatcaagtcccggactcgattcaagaaatcttaatcaagattgattacattttagaaagcagttttgtggaagataataacattacgtccactggagaacaaattcaagatttgattatccaattgttggataacatttcgaagatttttttaattttgaagaataaatcaagctcgattaatcgtaaccatgtgaatttggaacattgggatatcagtttaggattattggctccacaaggcgaccatgacgataacagaaaaatgattatttctacgccacaacttatcaatatccaagccaagtacttgaaagtatttgatgagtttttgaataatgaattggcggttggcaattctaaaaagagctatgatcttcttagcaaacagtctcgtttggatcctggaagtacagctgttgaaggagtgaacaagtctgacgatctggacaatggtaaggactttaaaaaacctgatgccaatcaatacattaccaatcaacaaaacttcatatcccatttccttatgtatatcgacnaatttttcgaaaattacgattcccccaacacacaatcagtgttacttttggggactgtt

SEQ ID NO: 1372 - DNA, 261 bp, Candida albicans
tttcttcaacttccagatccaagaatgaatttgtttcaacataaacatcaaaaattaatattacaatgttatcctgctgggaaagcagtggaacaaaaacccacttcgtctgagttaagtaaattaataataccatgcctcccctccgtaagttcaattagaaaaagtgataattttttgaaagatcaaactctccctgaagtttgtacaaaccttctggtaatttccaattcccttagcccttatccgggatttttctaa

SEQ ID NO: 1373 - DNA, 3180 bp, Candida albicans
caacattccattgagatggccaatccagttaagattggatactatgatccatttggcatatatccattgattaaagatgaactcaacaaaatatctcctatactgagtttacacataaggtttcatccttcacaacctttgaaaacaattcatgatttgtcacttgaattcacagaagagattcccaaaaagtcggagtcctctactctggagaattacaatgtttacaccagactaatgcttattaagatagaatcattggacaagtatcgtagccaagtgagaccgttaatcaaagaatggttgaagaatcttgtttttaatgaaaaagtgaatggctcttcaccatcatggatgattctactatatgtaccctccgatgccaaggataaacagtcaacgattattaaaatgtctcactatgacaaactattgaaggattttagtaatgaaggaggtaaggaattggcagctctatttgccgaatctacttcgcctactgcatctgtcggtgctcagaacagcaaatcaactgggtactgttttaaattcaaacagcatgaatttgaattgaacgaatttcttgttcaaattaaaaacctattggggtttacatttaaccaaaagtatcatttgaatctggatttgataacgacaagtggcgatcacgaaaacaattcgttgacgaaatatgtggcaacttataacttagccgaattgttctatgatatgaagctatttaatgattgtatcaactttttcaatcggttatcagagcaattaaacaccttggttgagaataatccaaatttatttatatataaagttgacttaccagccaaagttttctcgaataaatttgatttcaaaaagttttataacaataaatgccaacatatgcatgacgtcaactcgtttaccaatgtgaatttatttgaattgaaatgctttatatttttcagacaagcatccacgcttgaaatgttagttaacaaaaacttgaacaattccatctcattagcagaattacaaatttccaagcttttacgaaatttggtactatttttaaatgacttgttacaggtatttcaaaacgagcaagctttaatagaatttgagtactcgataatcgagtatttcttgaatttagatatagtcaataaacttatcgagcaagctacaaaactttatgaagctgaaccagcaaataacaacaattcatatcaactaaaaagattgtttgagtcaagaggagaactcaagttactgcagagatctagtttgatcaaattggcacgtgaaaatagcatcgaaattaaaggtttggatcaggtttttgaggatgtctctcttgacgaagaggaaggaccaaaacaatctaaagattctacagaacaagtcaaactagatttaaagcacccaaaactattacaggcaatacaaagtaaggattcattcgttgatgagtttactaaactaactgaaggaatacttgaagattttatgggctgtgatagatcaaaaactatagatgtattatccatagatttagccatattaaactacgagaaaggtgattatagtgaatgtttacaaatcttacacgactcatacgatttctttattcagaatggatggaactatttaggtggcatattattagaaatctattatggatgtatggagaaaactcaatctaccaattttgaagaaatattgagtacttgcttaaaattattgtcatgtttagttgctaatcatactgatatcaattctttcagattgattaataacaagttacaaattaaaaaattgtttgacagaattgaagtctatgcaaataagttagatcccaccaagaaattcgaaagatcgttgaaccagtttttcaaaaccgacatacttccgtatataagtgccgatgaatccacatcgagggataaatatttgatccgattgaaacttaagaaccccttctccttgggatttgtcttcaaacatgttgaattgattatggtggacgaagaaggatcagaaatagtctttcatgctgagaatgttgagatttcagacaagatagacaacacaattcaattatcaaccaataattttatattggggtcgttctcaccatatcgtttgacaattcagttctataatagtttatttttggtattagactatggagagaaggaattacaaatgaatcatgcttcttttttaagtgatacagtgattgaacataacggtaataataatgacgtgtttgtttatgatggtttgactccaatgtctgtatttaaaccaagacacgagaaaacacttttggcgtatcagaatatcaataaattgactgcccagttttgttgtgccaatgacttgaaattgggttccacagaagtagttttaaagatcaaaaatggaagcaatcctatccacgatgttagaataaatttgttttccaccacagagggactaacagtagtcgacccggatttgaaagtcagcaaacttgattcacatgaaagtcaaacttttttaatcccttacaattttgtcaggtcagttaataaaatcattaatatgagagcaaagattgaatacaaagttgataatgaggagcaatacagtttccaagtttcctataacatagacactgcattaactatatcagttactgtccaagacatattcaaacgggattttatatattcaaagtttcaagtgggcacatccaatcccaagtaccccattagaatcatcaacaatgatctaaccactgagtcaaactatgaaataatcaaaccaagtaaattcccttcgtatgatattatcgcatttggcgaacaacccagtaatttcttttacaaaatcaagcccaaaagcaacaaagtgtatctcaacgatactttaagcttgaaagttgactacaccaatttgcaagaagagtgtgaagagtatgtttctcaagagataatacaccaattggaacgcatcaaattggtcaagtattggtatttgattaaggatgtcattgtcagtaaattaacatttgatctaaatggttttgcagtatacaagacgattagattcttgaatggattagaattgaatttactagcagagagaattattttgcgacatgtcaaagctctgtcttcagcgcgacctagcaaacag

SEQ ID NO: 1374 - DNA, 729 bp, Candida albicans
ccacgtggtgaagatgaagaggctgattctaaattaattcattcatctggtggagtatttggtgttttacatggttattcaattactgaacaattgaattctggttggtttatattaatgacgttatttaccacgattcaaatgttaagaattaattattttgttgccacaattaaatcacaagaactttatttatatcatggtaatgaatcattagcaaccaccataaatcattttttcgatttagcattacctttaggtgggattttttcaattccattcattggattaattttagataatttgactacattaactgcattatatatcttgacgggactttcattattcattggggttgctggattagtatcttggttacctgccacttatgctgggattatagttcttgtggtttatagaccattttattatactgccgtgagtgatttttgtgctaaagtatttgggtatgataattttggtaccgtttatggaaccattattgccttttccggggtatgtaatattttacaacaagttatggataaagctactcatgaatttttcaatatgaatccaggtcctataaatacattgttagtagtattgacggcagtgtttggttttgctttaataatatttgttaaatcaaaagaagctcatattaaaagaaaaaatttagaaatggaagctcaagatgcttcaaataggccagtaccagtataa

SEQ ID NO: 1375 - DNA, 1059 bp, Candida albicans
  unsure (832),(896),(931),(952),(985): Identity of nucleotide sequences at the above locations are unknown.
ctcaaactcttcttctttcatttatttttttcaagaaactttaaatcttctcaactcattatgttaccatctgaagtttcgtattcaaaacggttaattcaatgcacgtgtgccatcttctggtgtctattatctggaggtccaatatttggatttgctgcgttgaaaccaattttaattaaagagcacgtttatgaatacttgtgtgatgttcataccccaatatttactagtttcaattccaataacgacaacaacgacattatagccaaatgtaccgaacaagatttgaagttgaatatgatgttcacagtcgctgcgatgttgaccaatgtttccgctttagccattggtagaatcttggatgtatatggacctaaagtgtgtggattgattggagctttctttttgtatttggcctgttttgttttcatatattcgaaatatttggctgggtcaatcatagatccatacttgttagggtattcatttttagccttgggtggtccatttgcatttatttcatcatttcaattgtcaaactcgttccccaaaagtagtggtacgatattggcattgatcactggtgcctttgatgcctcaagtgcagtgtttttattgtatcgtattggttataatgccagtttgggcagttttacattggagaagtatttcacgttatacttgtctgttccaacttttattgccgtggtgcaaatttttattatgaactcagactctgatcaaactgaaggaacttctaaactttgtgtcaatgacgaagaaaaccatggacatgttgcatctcctgtatcttccaatgatcaggaanacacaccattactcagtgagccggccactagaactaggagagaatccatgggtgtatgcatcanacacccatacgaaattgagggaaaaaaattttggntgaagcatcaattggaatgtntggtggtatgcacggatactcggcacaaagacnaatcaaaaaatgggtggtttggtgttgacaacatggctcagtattataatgaatgtggcgaaataaaactattc

SEQ ID NO: 1376 - DNA, 537 bp, Candida albicans
  unsure (30),(31),(35),(43): Identity of nucleotide sequences at the above locations are unknown.
tattacgcatctgctcgtgaggaacacttnnaaangactccangagcattaagtttaaaatttgcttcacatattgaaaagattcaaatatttgatggttatttgataggttatacattattagcccttgctggaccatttgtatttatatcatgttttcaattagctaattgtttcccgcaaaatctgggattgattttagctttattaactggagcatttgattcttcatcagcattatttttattttatcgattatattatacgaatgtttcaccaatttcaattgataaatttttcacattatattcaattgttccaatttctatattcttatgtcaaatgtttatcatgcctaaggattcttataaaaccgttggtactttggcgaatattgctgaaacggggattgatgaaactggtaaaccattacatagtaatttattaacacctgaagatcaacaacaacaacaactacaacagcgtgataattctgcaacagcggctatagttgatgttacagaatattatcaacca

SEQ ID NO: 1377 - DNA, 507 bp, Candida albicans
aaacaaatcaatgaagtgatattacaacgataccatgatttagttgaaagacgagaaaatgatgaaaaacgcaaacaagaaatcgataggaaagaaatggagagacaagatgctcttttggcagctaagttactgagagaagaaatgggtaggtttgggaaacgaactattcgtaaggcaacacaaacagcatcaaaaataaaatcatcgaaatcaaaatccaatacaaaacgtctggcccctaataatgcttttaatagagaaatggcattatctccagaattaaccaatgtgattggtgttgataaatgttcaaggccacaggtggtaaaacttttatgggcatatattaaagatcacaatttacaaaatccccaagataaacgacaaattgaatgtgatgaaaaattgcaaaaattatttaaaaaaagtatgttacattacaatgttattcatatatatatcacaagatctattgtggacaaaaattttactaaccaaaaatga

SEQ ID NO: 1378 - DNA, 1509 bp, Candida albicans
ttcttcgcgtttgtagttttactttattttattttcaaattctatttttatattttttttcttctctattcgactgcggttgatttcccaacatcacaacatagagattatcaactacagactaagaacctcgacaacacattatattcacccatggtctcactacaacaactaacaatatcaatattactactttttacggcatctgtgcaatcattggacatcaatgttgatgataaagattcgatatgttctgcagctaagtatgttgtccaaggtatttggaactattacgaaggtctcaagtatgggggtacagtaggaatgtttgctccacccaactattggtggaatgccggagaagcctttggcggtttagtcgatttttacacttactgtcaatctgacaattctacattggaaaaattgatctataatggtatgtaccatcaagccggtgaaaactataattatattccatccaatcaatcgatgacagaaggtaatgatgatcaaggtgtttggggtatggctattatggaagctgtggaaagaaatttcactgagccggaatcacacagttggttagaaatggtccaagccgtattcaataccatgaatgcaagatgggatgccgataattgcggtggtgggttaagatggcaaatttttacctggaattctggttatgattataagaattcaatttccaatggttgtcttttccatttagcggcaaggttggcaagatatactgggaacagttctgtttatgtggacactgctgaaaaagtttggaaatggatggaagatgtaggatttttaactgaagaggacaatggtgatgttagaatctacgatggtgctaagattactaataactgtagttctgtgactgacttgagatggtcttacacatatggtgtatttatggctggttgtgcttatttgtacaactttacaggtgatgatgtatggttgactagaacaaacgagattgtccaagcatctttgtcatacttctttgccaacaagattatgcaagaaacaacttgtcagcctcaaaacaaatgtaataacgatcaaagatctttccgttgcttattttcacgttgtcttggtttaactacacagttggcaccagaaaccaaagatagaattagagaagttttggaagcaagtgctgaaggtgctgccaagtcatgttctggtgggtccgatggagtcacatgtggtgaaaattgggcaatagacaagtgggatggtgtttatggtttgggtgaacagactagtgctttggaggttatgatggcattgatcgttgagccaccactttctgtcaagacaggtggtactaacagaactgactattctgctggtaccaactcggaagataatgccaataagaatgaattgaccattacaggaaaggacaaagcgggtgctggtgtattgacagcaatagtgttggctgtcattttgggtggagctatatggatgatcttttaa

SEQ ID NO: 1379 - DNA, 909 bp, Candida albicans
aatatgtctaaacaaattgaaaagaaaccaatcagctttgctaatattgctcttggggcaggtttaaaccttgctgaagtgactactttgggtcaaccattagaggtcattaaaaccaccatggctgccaatcgttctttgaccatgccacaagctgctaaatttgtttggtctcgtggcgggattttaggattctatcaaggtttgatcccatgggcttggattgaagccagtactaaaggtgctgtgttattgtttgtttctgctgaagctgaataccaattcaagaaattgggtatgaacaactttgtcagtggaatgggtggtggtatcactggtgggttagcacaagcttatttgactatgggattctgtacatgtatgaaaactgtggaaatcactcgttccaaacaagccaatactccaggtgtaccacaacaaacttcattccaagtattcaaagaaatttaccgtaaagaagggattagaggtataaataaaggtgtcaatgctgttgccattagacaaatgaccaattggggttcaagattcgggttcagtagattggctgaagaatcaatcagaagtttgaccgggaaatcagaatcacaaaagttgctggcctgggaaaagattgccagtagtgttattggtggtgggttgagtgcttggaaccagccaattgaagttattagagttgaaatgcaaagtaaaacaaatgatccgaaccgtccaaagaacttgagtgttgctggggctttcaaatacatttaccaacaaaatggtatcaagggtttatatagaggtgtcactccaagaattgggttaggtgtttggcaaacagtgtttatggtcgcctttggtgatatctttaaaagaatgttgaataccgatggtgctggtcattaa

SEQ ID NO: 1380 - DNA, 1455 bp, Candida albicans
tatgacaatgaatttattgatttgcgagtacttatttcccgctttttgggttttataattcaaaatcaaacaaatattcctgataattattatgaattggccaataaagtgttggaaaacaattttgaaatcatccaacttgaaccaaacagattagatttgaattattatactttgaaattttatattctggttatggataaaagggtatctaaatttgatgaggaattaattgatattttcattaattttaatgctacttgccgtaatcaagcaactatattggtagaacaaacaattgcaagggtattaagagaatcaccaattgaaatgaaaatcgttcagtctaaaaaggattcaattttcaaattattcacagatagtaaatcgatatcggttcaaagaatttgtacatggtatttaagacagattattttattagagcaacaagattttgttgttgaatatcaattatcaaagaatgacgaagaaatgcaagcaagaatacctgaagaattaattaaaattgttaatcatactttaggtcatcaagagtatgaagttttccaatatatgtggtcatggatattgatattgtcatatatggaagatatcactttgaagatgaagaatgaatatatcggacaacttttacaaaataaagagcttccaatattgtttgattttgttttcgaatatttacacattgaagatgagagtttgtatatcattgatagtggtaaaccacaagacattgaaaacaatgttatccccaattatgatttaattgaaactggaaaatcagaaagctctactcatgaacttaagttgctagcaacatacctttatttcaaatgtgctcaactttgtgggtcacaagtgcaactttggtttcaagaaattagagataaacaattcaaaaacattgtggagaaattcactgttaaatttatttcaccaatacttgttaaagatattaaacaaaatgttggtaaagaaattggtaaacttcaacagaatgaagtcaatataaagattggtaccaatcaaatcaaagccaatatcccagtggaagaagaaaatatatcgatgcgttggtctatccctgcgaattatcctttgagtaatgttgctgttgaaggaccactttgtgttggggttaaggacaatcaatggaaggcatggttattggcttcacaaaaaataatttctttaaccaatggatcaattgctaaatcaattgaattattttgtaaaaatgtcaatttacatttttcagggtttgaagattgtgccatttgttattcgattcttcatcaagattcttcattaccttcgaaaacttgtacaacatgttcaaacaaattccatgcagcttgtttatataaatggttcaagagttcgggtagttcaacttgtccactttgtcgatcaacattcaatttcagaaggtag

SEQ ID NO: 1381 - DNA, 372 bp, Candida albicans
atgttgattcatagtaaagaaagcggccgaaggaaaaacttgcaaaaaaaaaaatggaatgaaaaaaaaaattctctttgccttacgataactttgatattcttcttggtatacaacaccatggctaaacaatacgagattacaggagatttagggtataatggattccccgtatctttaaattatatcacccacttgccagatatatctactttatacaaccccgaagtagttgtgattttcaaatcgttaatgaaaagagaccccaaaaccaaggagaaagcgttaaatgatttattaacagtatcagctattgacgactccacaattattgcatggcttccaaatgtatccaaaacttgccttggataa

SEQ ID NO: 1382 - DNA, 1089 bp, Candida albicans
  unsure (842): Identity of nucleotide sequences at the above locations are unknown.
cagtatcagctattgacgactccacaattattgcatggcttccaaatgtatccaaaacttgccttggataattctagaagtgttcgtttattgtctcatcaaattcaagccaatttcctaaaaattgttggtggaaagacatatagcaaatatttgaaaagttcaatgcctatatggttaatggggatgtttgatacagataaatctgtatcctcaattgcatataaaacattattacaatcatttcaaggagatagttccaaattgaataagacttggagtatttttgaagaacagattatcaatttgattgggaccattgtcagtatagaaacattggaaactttatcagacagaagatacactagtgaatcggaaatggtgtcaaaatatgatcgagcattagtttgtggcatcaatatgttgagtaaattgccagatgaaaccattgtccccatattagaagaagagtcgttatgggatcatttgagcacctgtctcaaagaagataatatggatttggtgttattcaaaaacttgttattgcttataaccaatttatcagatgaaaacttacaattggtctacaaactagtttcaaagaagtttatcaagattaaattcaagtccaataaaatatccggaagtataatttattccaatgtgatcataccattctggcaggctatagtacgattaactgaatttggcattaataataatttgaagaagaatttctgggatctagcaggtagtaaaagttctactaggttttacgaatacttgaaacttggtccatgcaatctggatccaacttactactcattgattatcaaagtatntcaagatttacagcagaagttagatgttgttgattttaacagccaggaagaatatgattatgtgattaatttactactgaagcagtattcgacaactatgggatcactccaagcaggtgcattaaatggtgcattaaagaacccggatttatttaccgtggaatcaactgtattgattgatgaacttatcttgccagtattgagaaacttagtcactattaagggttcaccgttgataaaatgctaa

SEQ ID NO: 1383 - DNA, 1197 bp, Candida albicans
  unsure (1131): Identity of nucleotide sequences at the above locations are unknown.
ttatggcggggttggttgtgtttaggaccattgaggaatatcaattgggaattgatcgggaacatcaaacagatacacgtattaggggattattctgtttttagcgattcaattattgaagagttacagaatttggcggatttacttggtgatttggatactttttatattggcgataacaaattcagacaactcattgatttgacacggttgaaactaagatctgtcgttgttgaggagatccccattgaagccacccccaaaatcgaagagttacttattggaggaaatacacacttaccaaactttcacaagttcaacctcacttcgttgattttgcccaacaacacccaaaagtattggtcatggataatggaaaatgtgttcaccctcaaaaaccatgttttgcaattgacgaaattcaaatttgtctttagcttagatatggcgttgaatgccaagttggtgcgattgatagactgggagaaaattacccaattagaattgatactcgcctataccccacggaacgatgacgattacgtgattgattgttttaacttaatccccccaacacctaatctcaagaaactttctatagtgcaaggcgacacctacccaactcatcgagagaatgaactttttgatttgaatgttttcaatttccttacaaatttattgactatatgtgatttaaagtacttatccatcaaacacagtatccccaacattggcaacttagaggatgggagcgaaggcaactactaccgtcgttgggagatgtttatgctgaccttgccgaaaattataaactcccacaacatagtgcttattctccccaacttgtttcaatcgtttgctggctatgaacaatatatgaacacagtgttattcaatgggtgcaaatgcaaacactgccaaatataccttggagatttggacgagtttatgatgtaccacaagtactatgacgcatccaccaatgcaaaacgatacaaagacatgaatgctctgcatttattaagtgaggtcggacaacagttgaattatcgaatggtacaggacgagttattgacacaattaaaccatttatcgtttcccttggtaaacaccctttgggattttcatacnaataccaacaacaaaccatttaaatgctatgacatacaaactgttgatcaggggagagtacgatga

SEQ ID NO: 1384 - DNA, 2568 bp, Candida albicans
tcaccacccatgctgctagtcccaaccgaactcaaatcggtgaaaaagtcactcattgagaccaaaccacctattgaaaatgatgtccaacaaagtttacgctatttgctttcccatttaaacctgaaggaagaaaacgacaaggatagagttcttttcaacgatgcattatccatttgcttattaaggtatgaccaatttaacaacaccctcgaaagctcgaacaccctttttgattacatcctcacccatgtaaatagaaactatgcaccattgcagaactcgttgaactcggttcttgaaaagttggtaatgttccaaaatgccgacattccattgtggatcgacatgctaatgcagcagccactaacaaaaaacctttttgtattattggaaaaactactcagaaaactccccgacagactgtttttcattctaaagtatcccgactaccccatgcaagcaatgagtatgttcaccgacaacgtcgccaatgccatcagcaaaacccttattgccatatacgaaaattgtgagaacacagagtcatggtacaagtcctggagcagcataattgatttgcagaatgataatgtcagaaccaatgttattactcatttattaccgggattattacgtgtcaacccacaagctttcccctttttgctagcagattgcaagaccaacttgaaagcactagtcagtattttgagtatgggccaaaaactaaaactcatcaagtccttagaagttatcgatcaaaaatcattattggaatgtctcgtacatgcagatagcgccattcgtatggacgctctacaagttctcattggcgataaaaaagaacctcttacaaaatacattttccaaaccatcgagtcaaaccacttgatggaaatcaatttgaacgaagcaaaccaccaagacaagttcattagtgctatgcaccagtttatatctggaaaactcagcgactgcttgaatgggaagtttggcgaaacagtgcaaaccgaaaccagacagtactttaccagattcaaaacattgttagtcagccatttggagacacaaaacaactttcaacaaaaaatgggagccatcacaatcctcagtcaaattcattcaaaactcgaaaacattttcaaccccaatgtcgtcaaattgttgattgagaaccttttttcaaattataaactagtacgggagtcgagtctagacttgctcttacaatgcaacaatgtttcagagtactttagcaaccacaaagctttggctagtaaagcgtttgctattttgccaagattggctggaagagaaagcgaaggtgcggcgttggccataacattcttagcacaccatgcccaggacttggactctttaatggaaagactatacagcggtcttggtaaagaatcgggtgagcatggctatctccaggctcttgctaccatcaacaacaaattggggatatgtggagactatcgtcttcaacttgaagcagccaagcaagctactaaacgaatgaccgacattctatcaaccgaacgaattgcttattccaatgaacaagagtttgtcacatcaaaagaagttgtaaactattcgtggaaagtgttacagaatgccaatgacctatttcttctgttgctaaaacaaagacgcgaggctgacgatgtcgtcgagtgtttctcccttgtggtcgagcagctacacaatatcaagtttagagccgctatttcctcactgtatccgaccatgattgccatagcacgattgctcgatggaaaggtgacggaatacataaaacaggaaatccaatatatccccacagagagcaagcagttggttactagaaggtctggcggactattatacgttatcccagctttgctaatcgcttcagaaagaaataaagaggtcgttgattacgtatttgatagtttatttcaaattgccagcttgccatacgagtcagagtccaaacaagatttaccacaagtccatgcgttcaacactttgggccaactattcaaagaaagccaattgacaagcgacagctcaccatttaccgaaagagccctcttactttccttaaagcactttaacgcaaccaactggtcggtcagaaactgcgcattgatgttgtttggtcatttggaaaagaaaatattttctggtgcaaaagtcaactcaaagaggttttttgcccgtttcaaaaacatcgaggacgtgtttattgattatttactgtgtggacaagaccaggtcgtgtttcctatactaatcatgttggagaaattggaatttgccaacacctcctcaaagttgaagaaggcagtgacaaatttgttgtcgagagcttcctggaaagtacgtgaattgagtgccaaaatcactgctgccatgctagaagccgacgaatttagagagtttgtcaccacatccctaaacaccaacacaagcatgaatgctttgcatggggtagtacttgtattgaaacatcgacccatcaccatccacatggatttgggcgtttggaaactttttcgttgccaaagagtatattga

SEQ ID NO: 1385 - DNA, 234 bp, Candida albicans
agagaattttgccagatactttataacgttgagccaaagatagtagacaacaagcatgcttatgacgcccctgccatttcagctaaatgtccaggggtttggtttccagcggacccaatgggattgagtgagattgaaatcgagcaattgtcaccaattgttgatatcagtaccaaaaatgccactttcaatgaaaagggaaagattgtattcctcgggaaaccaccaaattag

SEQ ID NO: 1386 - DNA, 2226 bp, Candida albicans
aataaactcaatcaaaaaatggctgtagctcctagtagtgtttccacatctacaatcatttcaaccctacttgccaatttggcattgtttggtgtttttgtcggttgtttcattgtcttaagattaaagttcaagcgtatctatagtcctaaatcctcgtttgatttggttcccgaagagaagaaacccgagccattacctaaagacccattcagatggatatttatcttacttactaagcctgattccttctttttacaacaagctgggctcgatgggcttgtgtttctcagatatataaagacttttggcacattgttcttgtgcgcattacttatgtatatcattttattgcctgttaatgccaccaatgtaattcacaataaaggatttgatcaactttcaattgccaatgtcaaacaccctagacgttattatgcccatgtgttaatgggacttgtgttcaatggtattgttatctttgttatttatcgagaattatttttctacaactcccttaaaaatgccgtgttgtcatcaccgaaatatgctaaaaagctttcatgtagaacagtacttttccaaggtgttccagattcattattggatgaaaaacaagcattcaaaatattcaatggagttaaaagagtatacgttgccagaacagcaagagaattggagtataaagttgagaaacgagctgcaatggttaccaagttggaaaatgcagaaaacaaattgatgaaaatggcggtcaagagtaaacttaaagctgataaaaagggaattatattagaaccagttgatgagatcagttcatatgttagtgagaaaaaaagaccaaaaatgaaagtaggtggatttttctcttccaaagtggatacaattagacattgtcaagaacaaattccaattttggataaagaagtgaaaaagcttcaaaaaaaattcagacattcaatgccactaaactcaatctttgttgaatttgaaaaccaatactatgctcagttggcttaccaatccactgttcatcataacccaatgagaatgtctccaagatttattggtcttgaacctaaagatataatacattcaaatttgagaatgttttggtgggagagaataactagacgattcttggcatttgctgccattgtagccttggtcgttttctgggcgatccctgttgctgcagttggtactatttccaatataacttttctcactaacaaattgccttggttaagatggattttgaagatgccacacgccttgttaggtttggttaccggtttgttgccaactatattactttcattgttgatgtttttgttgccaatcattattagagtgtttgcacgtatttctggagaaatttctgctgttggtgttgaaaaatggactcaaaatgcttattttgcctttttgatggttaacgggtttttggtgactgcattggcttcgtctgccaccgccactattactgagattattgataaaccaacttcagctatgagtattttagccaacaaattgccattatcttccaacttttatatctcatacttggttcttcaaggattttccatcgctggtgggtcattattccaagtagttgggttatttttgtattacattttgggaaccctttttgataatactgttagaaagaaatggaatagatttagtggattaggtaccgttgcttggggtacggttttcccaatttttacccaattggcttccattacattggcttattcgatcatttcacctttgatccttgtgtttgcttttgcttctttctttttagtttatgttgcatatgctcataacattacctattgctttgttgagggcccagatgcttttggaagtcattatccacgtgctcttttccaaaccttctgtggtatatatttgggtgaaattgtacttttgggtattgtggttgttggtaaaggttggggacctattgttatccaagtcattgttttgttggcaacaatttttgcccatgttcatctcaatttatcatttgatcatttgcttgatgttgttccgcttgatgcaaggaggccatttgatggtttttcaagtacaacttcatatactggaacatcagagtatgaatcaaaagtgttaaataaaaagaaacgtcgtgctaattttgaaaaagagttgttgaaagcacaaggggaagattcaaaattaaaggggtga

SEQ ID NO: 1387 - DNA, 594 bp, Candida albicans
  unsure (580): Identity of nucleotide sequences at the above locations are unknown.
tggaaagtttttagtggaaatgggaaagacaataacaaagaccaaatggtttgtaagagacatttatcaaatacacaacatcgcgcatcttctgaaaaaaaaatttggattcgtactcaaactcatctcgatcagtttatagataaaaccattacaactagtctaaacattatgaatgccagcatatatttacaatcatttggatggaaagaaggagaggcattaaagaagggagggttaaaaaaaccaattttagtaaagcataagaaagacaccaaaggattgggccatgataccaatgactcagatatgtggtgggaaaaactatttgacggtcagttaaagaacttggaagtcaacaacaataataagaatggaggagtttcattcgaaacaaatgaagaaaaagtggttgatgcgtttcaaaaatcaatatctcctttgtataaaatgtttgtgaaaggtgaagggttagcaggcactgtggggaaaacagaccatacaaaggagagtcatagagaaatatcttcatccaaagcattagaagacatggaaaaacttacaaataaagatactttcnctggaaaacattaa

SEQ ID NO: 1388 - DNA, 705 bp, Candida albicans
  unsure (9): Identity of nucleotide sequences at the above locations are unknown.
gaattaatntggatttctgccgatatcgtgatatgtggcagacattttggtttgaaagttttcaatgaagtgtacccagaagttactcacgttgtttgccgcgatgttagtgaaggtgctggaccaacattcaagaccagagttgcaagaaaactatatcctgacactatcaaaattgtcaatccagattggctatttgcatgtttgagtaactggacaaaagttgatgaaaaagattatttgatttcaactgatgatacaaagctttggaccgtgaaagagaatgagattaccaagtaccagaaagctttggaagacagaagtgctttggcaaatgctactcatattgattctattgagtcatttgatgagtacgatttggatgaagctaatcaagaagttgatgatttcttggcagggttaagtgatgatgatgaggaagaagaggaggaagaagaagatgaagagatcgagaatccagaatcaaataatgatgatgaagaaatctatgagcaatcaaccaatggacatgattcatttatcaaggatgcttatagtaagaagagaaatagagatgaagaggaggtacaacttgttaaaaagcaaaaaatagaaaatggagaaaatggagaaaatgaaaatgaaaatgatttagacgatttggaaaaagaactacttgacggttttgacgacttggaagaataa

SEQ ID NO: 1389 - DNA, 1101 bp, Candida albicans
ggtgaccacatgtcggacctaactccaattaaacttccttcgtccgctccatttccggttgtcatatcatctgtattatgcaaacctggagatacaatttccaagcacaagactatattcaagtacaaatactgggactaccaagatgatccaacttcaaaggaggacccacctaagaaaatacgagtagaacggttaggtacatttgagagtcccatagaaggcgaaattgaccagattaacatcaagccattgcaagaagtgatgcatagtgatgtggatttgttatttgttaaagaagcatgtcctcatactgtgcaatacagtgggttatgtgcattatgtggcaaatccttagaagaagaaaaggattattcaggatacaattacgaagacagggccacaattgaaatgtcccatgacaacactggcttgaaaattagttttgatgaagcagctaaaatcgaacacaacacaactgaccgattaattgatgaaagaaagttgattcttgttgttgacttggatcaaactgttatacatgccaccgtggacccaactgttggagagtggcaactggacccagccaatcccaactatgctgctgtcaaagacgttaagacattttgtttagaagaagaggcaattgttcctcctggatggacaggtccgaaattggctccaacaaaatgcacatattatgtcaaactccgtccagggttgctggagtttttggagaaaatggctgagaaatatgaaatgcatatttacacaatggccacaagaaactatgcgttatcgattgctaaaatcattgatccagatgggaaatattttggtgatagaatacttagtcgtgatgaaagtggttctttgactcataaaaacttgaagagattgttccccgtggaccaatcgatggtagttattattgatgataggggagatgtgtggcaatgggaaagcaatttaattaaggtggttccctatgatttctttgttggtattggagacatcaattcgagtttcttaccgaagaaaaatggtcaattaacaggaccaaccaaaaagattttcaccacggcccggaagatccgaatg

SEQ ID NO: 1390 - DNA, 960 bp, Candida albicans
cgcgagtatatcattgtttcttgggtgttttgtatttctaaagtcgtaataaaccccaaacacagaatgccaacgagtttaaacagtgaactagtacgagagattcatagagattatattgcaaagaatttcccaagtggtcataacaacaccatcaaccctcaagatttggaaatcctttcgacaattcgatatgatccaaatctttcttccgtttccccattgacttatgatgatatcacacctcaaaatttcttcttactcccggagcatactagtagattgcaattctcgatgaatttttttcatttgttattcgggacaactcttgatttcgaaataacagaatcttttttatataaacaactagttcaagcaatgagaaagttgaagaaatcggtattgtgctcgtataaggttcggggtctattcaaattggatggatcggtcacttttgagttatatgaagttcctggtagacacaatttgttaagtggtatttttcctgatttgggaacatttcctgaagagcttgaatttttgagtcatcctgatgacgaggatggagaagatgtgaattggaaggtgtatattagtgatagtcccactttgatctcaccatttacgtctttcaaaactacaaagagagaagtatataacgaggcaaggaaattattacctggtactaacccaggtcaggaagaagttgttctttttaatactcaaaacaatgtcatggagggaagcatcacaaatatagccgttaagagggagtcagacgggaaatgggtgactcctctattaagttcgggttgtctctgtggagtaacaagacactttttgctacggaagaattttatagaggaagataatgtaacactagaacaattaaagccaggtacaaaagttttgttaatgaatgctattatgggggtgtttggtggcactattgttgggtga

SEQ ID NO: 1391 - DNA, 396 bp, Candida albicans
tcgcaaaattttcatgatttaaaagatatttttggtcaacctattaatcaaacagatatgtcaaatcctactcgatcaagaaatgaacgtcctttagatactattagaggatttgaatatgctattactggtgatgtaagtttccgagatcaattggaaactaatcgattaggttggggttttcatgaagattttccctattataatttgaatggacaaaataacaacaacaacaacaatgcccaagaaggtgttggaaactcttttagtagaccagtgattaattttgatgaacaacctgtatatcaagcaggtaattatagtgctagtagtttacaagctgatcaaaataatactaaaaagaaaaagagaggtttatttggtagaaagaaataa

SEQ ID NO: 1392 - DNA, 342 bp, Candida albicans
ttagttagtttattcatttatttatttatttttacttactccttttcttcccccacacacatttcacatacttcctcctcgtccttccccgtcctcctcctctgtcctcctgcccccttagacatggctatatttagatcaaaatcatcagctaataaaaaacctcaatcagctaatgatatagatataaagatttcatcacatgatgccgaacattataaaatgcatacggctaatgttcatgatccaattttatctgcggttcaagaagctcaacaatttgaacaagcaattaaacgtgttgatgatgataacccttcaggaggaagaccatcatattaa

SEQ ID NO: 1393 - DNA, 1230 bp, Candida albicans
aaccaaagttatattctatcagtctttccttacaatcctttagaagtaactttattcgttcttttttatataaacataatacccaacttaataatgttattcaagtctttcgttacttttactgtcttagccaatgctttggctgctccattagctcatcaacatcatcaacataaagaagaaaaaagagctgttcatgttgttaccaccaccaatgttgttgttgtcactattggtaatggtgatcaaactaccacttttgctgctccatctgtagctgctgaatctagtgttagtgtttctgtcaacactgaaccacctcaaaatcatccaactactactcaagatgttgcttctgcttctacttatccatcttccactgatggttctgccgcttcttcttctgctgccgcttcttcgtcttctcaagctggttctgaaccttctggtggtgttggatctggtggtgctaaaggtattacttattctccatacagtgacaatggtggatgtaaatcagaatctcaaattgccagtgaaattgctcaattatctggatttgatgttattcgtttatacggggttgattgtagtcaagttgaagctgttttaaaagctaaaacttcatctcaaaaaattttcgctggtattttcgatgtttctagtattacatctggtattgaaagtttagctgaagccgttaaaagttgcggtagttgggatgatatttacactgtctctattggtaatgaattggttaatgctggttctgccactccaagtcaaattaaagcttatgttgaagaaggtagaaaagctttaaaagctgctggttacactggtccagttgtttctgttgatacttttattgctgttattaacaacccagatttatgtgattactctgattacatggctgttaatgctcatgctttctttgatggtcacgttgttgctgaaaactctggtgcttgggtcttgcaacaaatccaaagagtttggactgcttgtggtggtaaaaagaatgttttaattactgaaactggttggccatctagaggtgattctaatggtgtcgccgttccatctaagagtaaccaacaagctgctatcagttctattaaatcttcttgtggtgcctctgctttattattcactgctttcaatgacctttggaaggccgatggtccatacaatgctgaaaaatactggggtatttactctaactaa

SEQ ID NO: 1394 - DNA, 1128 bp, Candida albicans
ctcattagcaccatggccaaaagaaaagcaacagaatcggaacctttaccgactaagaagccaacaaaatctgtttctgaaacgacaatctcaatatgtataccttcaacagtaatttccctgaagaatgcttataatttacaacaaataaccaatatcatatatcaaattgctaaagcctgtaccatttataaagttgccgaaatcattgtatttgatgtgccacaatcaaacaatgataaagaagacgataaactgactgttgtcgttggaagcaaggttaaatttgttgaggatgaacccgaaaagactcttgctaatccgagtaaaaaatccaatgttaatggtgataaagtatctccttcattattagttgccagtttattgcaatttttcatcacccctccatacttcgtgaagacaatgttttccagtcatttaaattccaaattcaaaaacatccttcccaaattcacgtatgcttttaaattaccaaaaataactactttaccattcatgcaaaataatcaagtatataaggatttcaaagaaggtatgataatacccagagaaacaccattgatgaaaaagaaaaacaaaaagaccaagtccgaccacaaaatcactgttagtaaatatgtcaatattggagagaaagaagcattgaaattaaacattaaacgagaaatccccatatattctcgtgtaacagttgacttgaaaaacaaaacagtcgtctccccattacaagcctatggggttgttggtcataaagctgcttttggttatcatgtaagaatggccagtgaatttaacaaaatattcactcaatcaccaatatctgatggttattcaagtaccatctatgtaaactgtgatgattattttggcaacaacaataaaatatcggagttagataatctactgacattcaaagaggccacagggaatgtattgatggtgttggggaactataaagatttacaagcaggatttaaagctgacacttcaaacgtatttgaaaatattgacagtgttgcccatttatttgattctaagttgaatatcccagatggtggtagaatagaagatgccatattaattagtttagctaaagttatagagtag

SEQ ID NO: 1395 - DNA, 1131 bp, Candida albicans
tacaacaacttcaagtatcaccaatccttatataatcaaaatatgtctcaaccaattaacttagctattgtcggtacaggtatttttgccacagataaccacttgccaactatccaaaagattccgggattgaaaccatatgctgcttacaacagaaccaaatcaaaggctgaaacttttgcgcaaaaagccaacattgctctggataaagtttatgattcattggaagaaatttttgaagataaagacgtcgaatttgtcgatgccttgttaccagtgcaatttaatgtcgacgcagttaaactcgctgtgaaaaacaataaaccaatttgctttgaaaagccaattgctgccaatttagaccaagctaaagagattgttaaattaagcgagtccaccgatttgccaatcttggttttggaaaactgggcttatttgaaggccattgatattttgaagaatgaaatattaccaaaaattggtgatgttgttgcctttacatacaatgccactggcccatttaatgacgctaataaatacttggctactggatggagattaaaaccagaacatattggtggatttttgagtgatggtggtgttcatcagttggcattgttgactgaggtattgggagatgttgaatctgtcagtgggttgactcaacaattgaaagaacaaagtggaactgatgacgtattgttctctacattgaaaactgctaaaggtgccattggtacttttacttatggttctgcatttggtgctactgacaagtctacgtttttcaaaatctttggtacaaacggtagtgcaacatatgattggtctccaagtttgccaaaaccacaaattacttatgctacaggtgccacctcaggtcaagcttctagcaaaactactattgaaatagatgaagtcaacaccatagaagaagaattcaagaatttcaaagatgcaggtcttcaccacggggctggaaggatccccgcttcacgcccaatcccccgaccacggaaccccaccgatcaccaaagaccccccacaccaaatgcggagacaacccggcggacccccggcacacacggacacagcgcaacaaggtccagcgcgacaccgcgaaagagggga

SEQ ID NO: 1396 - DNA, 1146 bp, Candida albicans
ttgtttgcattattaattgaatcacctattaccaatccatatgatatgtcacaagttttcactagttccacaataccgttaacgtttgaatcacgtgaacataaagaacatcatagtattcgaaataaacctccgctgtctcctccagaaagcacagacaatgaaacattacaacaaccaatctggcaatgtatgttggcaggaggatttggaggagttgtgggcgatagtgcaatgcactcattggatacagtgaaaacgaggcagcaaggattcccatataaagtaaaatataaacacatgattccagcttattcgacaatcttaaaagaagaaggattttttcgaggattatatgggggatatacgccagcagcattaggatctttcccttcaacagcggcatttttcggaacttatgaatattcaaaacgggtaatgataaaccaatggcatgttaatgaaacattagcatatttcattgcaggtatattgggagatttggcatcaagtatattttatgtaccttctgaagtgttaaagactcgtttacaattacaaggtaaatacaataatccttataccaaagaatgtggttacaattatcgtggattagggaatgcaattgtgacgattgctaaaactgagggcccaaaaacttttgtgtttggttataaagagacattgtttcgtgatttaccattcagtgccctacaattttcattttacgagactttccgtcaatgggccatttattcaaacaatgggtcggatgatttgtccatatcaatggaattgttgactggagcagccgctggtggtttggctggaaccttgacaactcccctagatgtgataaagactcgtattcaaacagctacaaacacttcagagttgagtagttcaatttccaccaagcaaaccattacaaacccaataatcagattattaaacagaaatgcaactttaaaagcattggtatcgatatataaacacgaaggtatactaggggcattttcaggagttggtcctagatttatatggacaggtatacagagttctattatgcttctattgtaccaagtggctttaaagcaattggatgtgttatctgatgacaaagacagagacaaattagagtcttga

SEQ ID NO: 1397 - DNA, 1197 bp, Candida albicans
ggaactaatccaaaagttaataatttaacacaagggttcgttcaagccaaatatgatattttgtgggtgaaggatattaatgtttgggccaatcccaatattttgaaaaattccgtaatttcattgaatggtaatttaaatatgtcgagaaaaatgggacaatctagaccagtgaaactagttcatcatgtaccattagcgttaagtatcaataatacaaccagaagtgatgatttcattggtggtcaagatttagaaattacagctatgacccctgttccttcatctgaatcccttaattcacaattagtgaaacgcaaactgtcaccgaaatctaacaattctttgaatgtccatccaggttttacatattcaaagttttcaaagaaattgggggctgaacttgatgaaatgtttttacacacctcccattccaaattttatgtgctgttgaataatttagcagtggcaccatgtgttaatggaaaatctaacatttatcgccgttcagatttggatcaatcagttagattaattcctcataaggactctccattttttaaagaccctaaagtgagacaagatgcagggtattatacttctttaggcgttggacatgcaattaattttttcgcaagatacattggagtagacaatatgattgggattgcactttgggaaaatactcaaggaagaaccggattaactggagatgtggttgtgcaaccgtatagtgggtcagaaaataatgccgttaaagattatattcaaagaagagtaagatggcttagagtcagaaaatatatggttttgttagcaacgttgattgaaccaactactgagtcgattatctgtggcatctatggtacttatgccatttcaactgtttttttcggtacttggttcaataagtactggtttgttatgcatatgcttatatggatgttgacagattatgtacagtatcacacattgataaaccatacattggatgttaaaaatatcacttacttacctaattggttaaatgagtccatcccacctaaacaaagaaactgtttgcaatggggatacatttggatactaagagaattgttggcattacctatttggataattgcgatgataggacatgaaatcgattggaggggaagaccgtttaggattaagaaagatttaactgctgaagaaatgtga

SEQ ID NO: 1398 - DNA, 504 bp, Candida albicans
ggtacatttgatcttgtttcttttatcaacactgtgaaatatcgtaatcttttgttcttctttctaatggttcaagaagaattatccttatttaggattaccacggggtatttttttctactatggtatataattatccttgtggcagcttacagtggatttttcgaaattttgttcaattttagaaatcggccaatattacatacaaaacaacaagctaatcaccaaaatgaccctgagagtgatgatgaggaaatatatgaaggagtaacaattatacgaccaatcaaaggtatagatccagagttgacatcgtgtttagaatcttcattctgtcaaaattatccaagaagtaaattacagatttcgttttgtgtcgatgatccgaatgatccttcaattcctataattcaaaaattgatagcaaaatacccaacagttgatgcccaaattttaacaagtgaaagttataactctcagacgaaaaacagtgatgaacattaa

SEQ ID NO: 1399 - DNA, 2352 bp, Candida albicans
tttatctcggtagtgggaacgttgaaaaaaaaaagccaattaaaaaaagaaagaaaaaaaatacttccgttccaagagaaactatataataattcaccagtcatcctgttaactatggcaactgaaagagatcaagaaataattgactttatagaccaaggtaactatacctatgcacagtctttaataactaaaaaacttgccaaatctcctcaaaagttgttttatcatgttctacagaatgaaatacatctcaaaagcggtcaacgagaattggcaataaaaaagaatttggaattgttgaacagataccctaatgaccctttgactattgaaaaattgagtgattttttcagtaaaatggagatggaaaaagagtccagtttggtgtatgagaatgcaatcaaaaagtaccctgtatctacggaaactctatgtttgagttggtttgacaactcgattgaaaagtatgatttcaaagtatttaaccgtattttcatgtatttgaataaaaatggaaagtcaaggttacatacattatggtatgcatttagtttccatttgttattgcaagaaggtgagactgacaaagcaagtttgtataattctttgggtaagaaactaatggagggtttacaaccatttgaaaacacacaagaaatctacgtatacacattgtttttgagttctaaagaaattgagcaagtgttgagtggagtcactttaccgttggatcttgagttgaagcttttgtatatgaaagcgatgaaagaaaatgctagttttgaagcattgcatgcatatacagagaaattgcttttcaaagaaaagtttgacgattttgatacttggaaattatggattttgtcaggtaaagagattggcaaatcgttcgaggaattggatcaaaaattgaccctgccaacaagaaatatatcgttgttgaaaatcgagttggatatattgtactctaggaatatcgaaaccagtgtcgagaactactacctcaaattcaacactaaattgtgttgctatgctgatctttctcagtatgaactaccaactagttttattggtagtcttaagaattcaacttcggaggaaaacttaattaccgtagtcaacaacagaaagtttgtgaatcaaacagataactgggatgtttatgaaaggttttcaacaaaagaaggagctgagtatgatagtaatccagttaatgaattgacattacgaacaattgtctcagatttggactcttctcctcaaaacacaatcaagaatattgtccttctcaagcatttactagaacaagacaagtacaactataaattgaaattatggttaatgaaactttactcccaattaaatacaaacgatttgattttccccatttacaacggactaaagatcaggatgacccagcatgagacattgaattactatttgacaaccactaacccttcaaaaatcaaccttgatgcatgggttgatatctacagattttatcttacatcgaaacaagaaatcaaggagagcattattcaagggtttgacaacggggtgtttaataaacttgaagggtttattaatttctccaagcgcatgcaaaattctatttctttaaattttacagtggctaaaattctccaaatatcgacaatcctcggtactgatggctacttgaattatttcattcattatcttaaaactaacgaagctttgatagtttctgactacactgacaatcgtgactttaagtcggaatggaatgggttagaaaaaatagattgcattgatgttcccgtgaacgatgtcgccacaaaattaaaactcttggtttactctatagtattcgaagatcaagacgcaagcagattattgaaggttttcaacaaaattacttccaacgcaaagttctctgtgttcgacaatttgttatataaattatactttaatttgttgaagattacaaaaactaaattgaatccacaagagacacaatcattgtacaattatttacagaaaaatttgaaaactgataaattgaaaatattgataccagaaaatttattatcgggggaattgactcaaaatttaaccaatcttgtcgaatttataaaaatcgttaagcttcttgctaaaaggcatccttcgtcatatatgaaccagttggttaacctagtgaaaccttttggcaaagaattcaaaaatctaaaactagtacaaaggcaacacgagattattgattcaatggattttgaaccaccaatttctgtggatatttctcaaaccaagcttgaaattaaaagttctattgaagattgtgttgtcgccttacttaatagcctatag

SEQ ID NO: 1400 - DNA, 1233 bp, Candida albicans
tgccagtccatcatgagttcagttaagtatgatgctattattattggtgcaggggttattggtcccaccattgcaactgcttttgccagacaagggagaaaggttttgattgtggaaagagactggtccaagccagatagaattgttggagagttgatgcaaccggctggtatcaaggcattaagagagttggggatgatcaaagctattaataatattagggctgttgattgtactgggtactatatcaaatattatgacgagaccattactatcccttatccattgaaaaaagatgcctgtatcactaatccagtgaagccagttcctgatgccgttgatggtgtaaatgataaattggatagtgattccacattgaatgttgatgactgggattttgatgaaagagtacgtggggctgcatttcaccatggggatttccttatgaatttaagacaaatttgtcgtgatgaaccaaatgttaccgcagttgaagcaacagtaacaaagattttgcgtgatcctctggatcctaacacagttattggtgtgcaaacaaaacaacccagtggcactgttgattaccatgcaaagttgacaatcagttgtgatggtatttactccaaattcagaaaggaattaagtcctactaatgttccaaccattggctcttactttattgggttgtatttgaagaatgctgaattaccagctaagggcaaaggtcatgtgttattgggaggacatgcaccagcattgatatattcagtgtccccaactgaaacacgtgtattgtgtgtttatgtttcatcaaaacctccttctgctgctaacgatgcagtttacaagtatttgagagataacattttgccagcaattcctaaagagactgttcctgcttttaaggaagcccttgaagaaagaaagtttagaatcatgccaaaccagtatctttctgctatgaaacaaggtagtgaaaaccataaagggtttatattgttaggtgattctttaaatatgagacatccattaactgggggtggtatgacagttggtttaaatgatagtgtgttattagcaaaattgttgcatccaaaatttgttgaagattttgatgatcaccaattgattgctaaaagattaaagacattccacagaaaaagaaagaatttggacgctgttatcaacacattatctattcttcaccaggcggtggacggtccgaacttgcaa

SEQ ID NO: 1401 - DNA, 444 bp, Candida albicans
attcatgtcctggtaaaactgtcatggcaggagtatcagggtttgccttgggtgggtttttcggattatttatggcatctatggcttatgatacacctattgggaactgatgctgtgaaacatatatcggaattaccatttaaacaacaaatgaaattacaatttaccgatatggcaaaacgatcatattcatcagcgaaaaattttgggtttattggtatggtttactctggagtcgaatgtaccattgaaagtttacgagcaaaacatgatatatataatggtgttagtgctggatgtattactggggcaggattagctattaaagctggtcctcaagcagcattagttggttgtgctgggtttgctgcattcagtttggcaattgatatgtatttgaacagtgatgcagcaccaccaccaaagaacgattatgatatataa

SEQ ID NO: 1402 - DNA, 735 bp, Candida albicans
  unsure (12): Identity of nucleotide sequences at the above locations are unknown.
ttgtctgagatntgtaaaaattgtatttatataactgattctaggaatgaacaagaaattaaagatctcaagaaaagtgtggaattacaagaaagaaaccataaattaaggaaaagaaaacccaaactgaaaaactccactgaatcgacaaaacttgccacaccagatcacactcatttatctgattcgatatcccccgtgcttcgtaagaaagcaaaaagatcaaataagattgatgtcgaggccaatacaagagtcgaagactctctggatccctttaaagcattttcatataactcgactttacaaactgccacgaatccatcttcaccagggcctacaataccacccaactcaccagcaatacaaaatctaatacatccagcaggctccctggaagaacaagagttctcaccactgaaacctcaaccacatccagagaatacaacacaagaaacaaaatcagtggaagagataatccgtgaaaatggtactgaactggaagtaaactcgccatcaacattcttgacttttcttcgagatgttaattcactgcataatcataatcaccatcatcaagttggttttttagaggacagtggccataatcatgtaagaggtggtcatgaaattgaaacagataacgacgaagataaaattcaaaccttagatgttgatttagacaatcctgaactacgagaaattctaacatcaccagatttccatgcgcattag

SEQ ID NO: 1403 - DNA, 270 bp, Candida albicans
  unsure (134): Identity of nucleotide sequences at the above locations are unknown.
ggtgctggtattggagtattaaagaaaactgataaatctcaattagaaaaaccaagtatattattacaagaagcaaaaggtgaaacccctcaaattaattcaaatacaggtactagcagtaatgcaccacctgntactttagccgatgcaccacctgttactttagccgatgcaccacttgctactttagccgatgcattagcttctgctttgaataagaggaaagaaaaagttgctcaaagtgatgatgaagaagatgatgattggtaa

SEQ ID NO: 1404 - DNA, 1998 bp, Candida albicans
gtgagtcggtggataatagttaatagaagaaaaaatgctatgcttgcgcacactacctttctctctttctttctttctctttttcattttaatcaatcatcaacaacaacactctctttaatttctatattgctcaaccttcaatactttatattatttcgtaaacaacaattacaacaacaacaacaacaacaacaacaacaacaacgccctacgccctattctcctttaaaaactactacaatggggatattaactactcaagataaagaaaaagttaaacgggctattccaaaagccaacaataaaataatcgatgcaacggtggctcgattatatattgcttatcctgatcctactaaatgggcttatacaggattggtaggagcaattgcattagttgatgatttagtaggtcatactttttttttaaaattagtcgatattattggtcatagaggggttgtatgggatcaagaattatatgtgaattttgaatataatcaagatcggaaatatttccatacttttgaaattgaagaatgttttgtgggattattatttgaagatactaatgatgctactcatttttataaacgagtaactactcgacaaaaatatggatctagtgccactgtgaaaaataaaagtgctattgccttgaaagaaagaattggatcaaataaatcttatgaaattcctggtcccagaggagaatttatggatgtgaatactgctcaacgacaaagaagggctaaaggagtattatattatgatgatgtcccaccaccagaatggagatcattatatgctgaattggaagcagcaggtattactgaagatatgattgctgacaatcgacaatttattaaagattatatttctcaacaaggtggtcctttagttggattagaacctccaattccaagaaaatttcaaagaaaacatgaaattgaacattcgatggctattgctgaacctttaacagtatcaatatcttcatcatcgtcaaacacaacttcaaaacacaaaaaagcaccaccaccacctccgccaccgccaccgtcaggaccaacatcccatcaacaacaactacaacgacaacaatcaactacagttgatcatcattatccactgaatgaatcaaaagaaccttcttattcaccatcaccatcacctacatctacatctacatctacacctgaaccggaatctcatgaaataacaccagcaaaaccaagatttagattacctccatcgacagctattgctcccccagtaagaaatacttcactaccacctaatggacttcaatttattgacaaaccattacctaaagtaccattaccattatcaccagtatctccacaagcaccaaatcatgcctacccaacaacaacaaatacaaatacaaatacaaatacaccattcaaccattatgtccatcaagttccacctcctccaccagcaagggcaacaccaccagcaccacctccacgagcaagaactaatcaacttggattaccacccagaaatactcttggattaccaccaagaactaataatacacaaccaccacctgcaccaccaccgagagcttcaagaggtgcagttccaccaccaccaccaccaccacctagagctactagagctccaatgcaattacaacttcaaagttcaccacaaagctcacccatatcaccaccagcacaacagcaacagcaacaacaatatccatcaattccaccaagagagaataccagtgctattatatcatcaccaccaccagcacctccattacctcaacaacctagacctactattgcaacacctcaacaacaacaacaacaattacctcaagcaacaaccagttcagtagcctcaccagcacctccactaccacctcaaatgaatcagaccacccaagagacaccagcgactactactacaacaacaacaacaacaacgccatctataccagcgcctccacctccacca

SEQ ID NO: 1405 - DNA, 1410 bp, Candida albicans
tcaccttacaatacactaacaattctttcctttattttaaaaagtacacacgcatataacacaatgagtgagaaaattgttcaatcttccaatggcgaagcagctacactaactgctgttgattatattcaaaatcaagaggaattggagaaagaggcgagagaattaatgccttacgatccaaatgaatgcacctacgaaatgggagaattacgtcagccattatttgcttgtttgacatgttcagctgagaatgaaaatcaaccaataggagtatgttactcgtgctctatacagtgtcatctgcagcatgagttggttgaattgtttactaaaaggtcatttgtatgtgattgtggaactacaagaatgaagaacacaaaggacggtgcttgcaaattacgaagacacgggaaaaaggagtcaagtggtcggaaactttcaaattcttctgccacacattcaacatatttggaactagccgctgaagacattcccagtagttctaatacttacaatcagaattatcatgggaggttttgtggctgtaaacaagtttataaccctttagaagaaacgggtcatatgattcaatgttactttggatttacctgtggcgaagattggtatcatgatagatgcgtaatgggtattacattcgcagatgagaaagcaaatcagaaacacgggaactcacaagaagaatctgtgccagatggtacaaacatcaagacagacatttcaaaagcacaactggaatcagctgatattgatctgattgagaaacttcagtattttccaaaactagagactttcgatgagtttatatgttggcggtgtgttaccctgtttaaagatgtattcgaagacttggacaaacattttcctggagtgatattgtcaaaattgccacgattttcaaacactagcacggttgaggactggtatgctaagagggaaaaactacttgaaccatgctttaaaaaaattaaaatagaagaaagttctggtaaattgggagaatttcataatcaagaatactcattgtttttgagtaacgatttccgatttaaattgatagataactacgagagtcttgatcacgagtcgaaattgtacaaattcttgcttaataactcgtttcttttcaaagatgatcctatattcaagccacctgaagatgattcggaagaagattgttactcatcgtcaaacgctggcactggacgtgctttggagacattacctcgtgacaaagcaattgaaagtatccaggcatacgataagatcaaatctaaattgaaagatttttttaaaccatttgccgaacaaggtaaggttgttactgaagaggaggtaagaaacttttttggtcacattgatgataaaaacaacgactcgggacaataa

SEQ ID NO: 1406 - DNA, 1023 bp, Candida albicans
cggaattgggaaaatgtggttaaaaaaggaattaggtcctgggaggaaagaagtaaaaatgttcatttaagtcatcaaaacccaaaagctgtttatttcccaatggaaagatcgggatcatttagaactacagtaaaggatgcaactaagcgacaaagaattgcttacaccaagagaaacaaatgtgcttatcgtttggtggccaatttgtatcctaatgaaaaggatcagaaaagaaaaaataaacccgatgaacctggtcataatgaagagaattctcgtatttccgaaatgtgggttttgaggatgatcaaccctcaacataatcatgcacctgatccaataaacaaaaagaagagacaaaagacatcaagaactttggttgaaaagccaataaacaaacctcatcaccaccatcttcttcaacaagaacagcagcaacagcagcaacagcaacaacagcaacaacagcaacaacagcaacaacagcaacaacaacacaatgccaacagccaagcacaacagcaagctgctcagttgcagcaacaaatgcaacagcaattgcaagccagtgggttgccaacaacaccaaactattctgaattgttaggtcaattaggtcagttgtctcaacaacaatcacagcaacagcagcttcatcatatacctcaacaacgtcaacgaacccagagtcaacaactgcaacagcaaccgcaacaaactccacatggattggatcaaccagatgctgcagttattgctgcaattgaagctagtgcagcagcagctgttgcgtctcaaggatcacctaatgtcactgcagctgctgtagccgcattacaacacacacagggtaatgagcacgatgctcaacaacaacaagatcgtggtggtaataacggtggtgctattgattcaaatgtcgatccaagtcttgacccaaacgttgatcctaatgttcaagcccatgatcattctcatggattaagaaattcgtatgggaaaagaagtgggtttttgtaa

SEQ ID NO: 1407 - DNA, 1743 bp, Candida albicans
  unsure (1734): Identity of nucleotide sequences at the above locations are unknown.
tcaagttctccccatttgtttttcaaaggttgcaaaacattcccaaaaatgtctaatcacgaagatgattattcccaaaacatcgacgaacagttgttacaaaacgtcgatgattcttcaacaggcaatgtcagagtaaaattagaacaaattgctcatgctgctgcattatcgaaatcacaacaacaacagcaacaacaacagcaactacaacaacaacaatcaagttcaggtactccttcatcatcttcttcttccactggtagaagacaaaagactcgtagagggatttctactaatgattcatcggtagttgatgcagattcagttgctgaagctgctgctgctgctgaacaatacaaacaacaatatcaacaattacaacaacaactacatcacgctcaacaacaacatttggcaggtttacctcaacaacaacaacaacaacaattaggaagacttgctcaacaactacgacaacaacatcttggtcatgtaaattcacattctcaattccctcctgaattgactggaggtccaactgctgatgaattatctgaatataacattcaaatccctgatccaattattgattccaaactgaaaatttatccagtcacagaaaatactatcactgctgaaggtaatttgattactcgtccttatccagaacaagttttcaatagtcgtgatgaattgaatgaatttattgctgaatttgctcgtgataatgggtttggggttgttattgctcattctaataaaaaggccatttattatacttgtgaattgggtggacgttatcgtcataaaaaaaacaaaaaaatcgatgtgaccaaacaaattgatgttggtgatggttatatgttggatcccgataccaaaaccaagaaattaaagtgtccatttgctatgacagcttcatataaaaaatctgctaatgcatggactttaagaacaacttgtaatgaacataatcatcctcaattagatccattaagtaatcatccaatgttacgcaaacgttcagatgaattgaatgtgatgattttagaaatgtacaaacttggtactaaaccatcacatattgaaagtaaaattaaagaggaatatcctgatgttttaattaaaagagaagatatatataatgaaatcagaggttataaacgtaaattaaagaaacaaaatagtcgttttggtttccataatccttcaagaatttctgctgctcaatatagaaagaaagctgctgctcaagctgctgctgctcaagctgctcaagcagtggcacaagtgggtacggatggtcctaatactgccgatgtcgatgctgttgccgcagtagctgctgctgctagtgctaatgcctttttacaaggagctgctggtgatcaaacagctactgcggttggttatgaccaattccaacaacaacagcaacaacaacaacaacaacaacatcaacatcaacaacatcatcaacaactgtcacaacaacaacaacagcaacagcaacaagaagaattccaacgtcaatttgttgctgctactcaagctcaagctgctgctgctgctcaacaacaactagacgaatctcaatatcaacattatcaacaacaattacaagaacatggattaaatgatactgatggtactgctgctgctgccattgctgcagtcgccaatgctagtcgtcaacatcatcattatcatactgataatggtgatttatcntatggataa

SEQ ID NO: 1408 - DNA, 537 bp, Candida albicans
  unsure (491),(529): Identity of nucleotide sequences at the above locations are unknown.
acagtaaaggatgcaactaagcgacaaagaattgcttacaccaagagaaacaaatgtgcttatcgtttggtggccaatttgtatcctaatgaaaaggatcagaaaagaaaaaataaacccgatgaacctggtcataatgaagagaattctcgtatttccgaaatgtgggttttgaggatgatcaaccctcaacataatcatgcacctgatccaataaacaaaaagaagagacaaaaaacatcaagaactttggttgaaaagccaataaacaaacctcatcaccaccatcttcttcaacaagaacagcagcaacagcagcaacagcaacaacagcaacaacagcaacaacaacaacaacaacacaatgccaacagccaagcacaacagcaagctgctcagttgcagcaacaaatgcaacagcaattgcaagccagtgggttgccaacaacaccaaactattcggaattgttaggtcaattaggtcggccgtntcaacgacctccacagcgaccttttcacacgaggtgcnggtattgt

SEQ ID NO: 1409 - DNA, 1209 bp, Candida albicans
  unsure (1197),(1198),(1202): Identity of nucleotide sequences at the above locations are unknown.
cactttaacctactcaacgtacctcaaatgccttctgatactcccaaagaagctaaattacaaatacaatctaaaaaagatgaagagccacctcgatccatcttgactaagggaccatcatcgccaccaccaactcttaatcaggattcaaatattgtacatccacaaccaaaacattctccaaataccacatcttcacaagttcagccgcagacacaatcatcatcaacaccttccaatcaaccagcaactatcaagttatcaccacaattatcaatctcactggaaaatcgtgagactgtgatggcgggtggtgcattgttgaaagaaaaacaggaaccttcagataaatctaaacctattatcaccacaaccaacaccaacactaccaacaccacagccgctagtcctttgttagacaaagacaagaatgattcgtttgctaatattaactatactttgaacccaccaaaagaaagtcagcaccacaaagctccatctgttcatgctcatttttatgtagaggaaacgttacggcccgtcagaaaccgttcaagaagtgggtctgcttcaaataatgcaaccagtttgtcaccagcagctagtcctcagcatgtcgataatccagtgtttcacaaagacgcaatcaagagtcaagaaagcataagagctacatctgtttcttctgtgggaagcacccaaagtactccacactcagccgctgccagtgccaacgccccttcaagtggcactacaggaacagtagcaacagcaacagcagcagcgccgccaccaacaacaacaacagctactggtactggtgaacaaaatgctaacactgatccacgtttacctcaagatgacggcaaattccatgttttattaggagtttgtggtgcattatcggtggcgaaagttaaattaatagttaacaaattgtttgaaatttacactccagaaaagatttctatacaagtgatcttaactaaggcgagtgaaaattttattttaccagaaacattgagcattttagagaatattaaaaaagtaagaatttggacagatatcgatgaatggactacttggaaaataagactggatcccgtgttacatattgaattgaggcgttgggcagatattttggttgtttgtccaatgactgccaacaccttgtcgttttctaccgagccgggtcgnnggancaatgaa

SEQ ID NO: 1410 - DNA, 1536 bp, Candida albicans
  unsure (1435),(1454),(1510),(1520),(1522): Identity of nucleotide sequences at the above locations are unknown.
ttatcaatttttttttttgagtggacacgagaaataaataaactcttgggattcaaattagccaaccaaatctttttattcaataatatacaaaacctcacttccactatggataatgatgaattgacagcatctgtttgggatgatgcagtgtctcctagcaacaatgacgactttggctcaaatggacttgacaattctagattacacaattcagtagttgctccgttatcgaatcaattcagctcactagctatggatgacccctttgccaatccattaggatttggtaatgacgatcaaaaaggttttcaaaaatatgcaaaagatgaagatgaagatgaagaagacgaagatgataatgattacaacaaacaatcgtcgtactacaatgcagtcgatgaacaaacccatgaattgaaaaaagaggaaagaaaagaacattcaaatgaaatattatctaaattaactcatggtgccgaagatagtgatatattagaatcttcaattgttaaatcgcctgggaagatatcttcatctggggcgttgtttcatgataaaggatctccattaaaagttatttctgcagatgcagagacaaccaaatcaccaactcgtttgaccaaaatcaaaactaccaagttcaaggcaaccagaccaagaaaattcagttctaaaataaatgtgcaacatatgaatgaaagcagtacaaatccattgggtccactaagtgtagatgataataaagaaaatgaaaattcagaatcgaacccacaagcagatttcaatggggaatcaatagccaaggaagccgaagcgcctctttatgatataaataatggacctgactcaccacaaaaaccactgctgatcaaaagcaaaagaccacaagcaaacgaatcggatccacaatccaataaattagaaataactgtaggggaccctactaaagttggtgatttaactacagctcatgttgtatacacaattaaaacggtgaacaagaatttagattcaaagtttttcccagcagtcgaactggtgcaagtttctagaagatatagagattttcgatggatatatcaccaattacagaataaccatcccgggagaataattccacctccaccttccaaacaaacttttattggaagatttaatgaaaattttattgaaaatcgaaggttatcattagaaaaaatgttgagtaaaatcaatcatcaccctttgttgtgcaacgacccagatattgttatgtctttaacaagtcaagattttgtccatgaatctaaggaaagagaaagattatcaggatcgggagcatcactacgaaacagggaatatttggatggcaataaagatgtggtaatgtcctccaatgttgcagctgcagcagctactgctgctggcacttcaggtggatgtatgagttctntgtggtcaatgttcactanaataaacagagccagattcatatttgatgacccaagaatcaatatttttgacgatntggagtatantntaaaacaattttaa

SEQ ID NO: 1411 - DNA, 486 bp, Candida albicans
gaattgtttcttacattttccagtattaacttcattaataacaacattatcaacctattcaacaacatgagattcacacctattttaagacagattccaaaattgaaattaagtgaggtattagttaaagctggagatggagtacctactggtttagcaggtatttacaaacacccaaatccaagacctgctttggttactttatacaatgaaactttgaaaacattaaaagaaaacttccccgcagattcagtttatagacaatctacagaagctttaactcaaaatagattgatgattgttgaaagtgaagagatagtcgagaacatagagaaccaaattggtggtggtttgattgaagaaatcgttattcaagcagcagatgagttaagtttggcatcacaattgggcggattaaaagtttgggaagagttagaagagaagccattagatgaccaatgggtttactttggtaaaaaaatttaa

SEQ ID NO: 1412 - DNA, 1230 bp, Candida albicans
ttaattttctttttaacaaaattacaagaatcacaactttctatttcaaaaacaacaaccggaatggcgacactctcacaaccacaaatcgcactacctaaaacaaagatagcgactacttttggcttatccaaggatttgaagtccccgatatcagttaaagtttgctatttggaatgcacaataaataatgtctctttagtcccattatcaacaaaatttgaagatccaattgtattcaagaagctatctcaaatatataagaactcggatctatttgttgaaattagagtttacgatggtaagaataacaatctaatcagtacaccggtgcggacgtcttacaaggcatttaacaacaagggaagaacctggaatcaacagttgaaattgaatatagattataatcaaatatcaattgatgcatacttaaagttttctatttgtgaaatcattgataccaagccatcagtatttggagtttcatatttatcgcttttcagccatgattcatcaacactacgaagtggatcacataaaattcccgtgtttatggaagacgacccacaatatagtaaaaatattcagtatggaactctaactggtttaacagacttggaaaaaagattaattgattatgaaaatggcatgtatcctaggttgaattggttagataaaatggttcttcctaaagttgatgccacttttttgaaaacaaacaataaagaccacgattattatttgtacattgaattaccccaatttgaatttccaattgtatattctgatattatttaccaaatcccaacaattgaacccataactgaaactacttctaaaatccccccagatgatacattgaatagtaacattataattaattcgatagatattccaatggccacatcacacgatccaaacataatgaaagtgtacgatccagatttccatttaacagcaaataatcatctaaatccaaatgctactacttttgatccagttgagttaaaataccgtaagttagaaagagacattgataataatacaatcttggacaaagaattgaagccaactccacaattgagagatgaattactaagaattatgatcaaaccttcaaatgcagaactaacagataatgagaaaaatatgatttggaaatttcgttattattttagtaagaacaaggccgggaatgatccaagtaacaaatcagtaaagtcattttga

SEQ ID NO: 1413 - DNA, 213 bp, Candida albicans
cccaaatttttaaggtcaataaactgggaaaatgattatgagctagatcacacgtttaaagaaataattccattttactggagtgttgataagttgcaaattggggatgctttggaattgttaggtgattatttcaatccgtacacattgggtaaaccgggaaatcaggatgatccaggacgtcgaaaagtcaaaaagataagcgaagaataa

SEQ ID NO: 1414 - DNA, 1602 bp, Candida albicans
  unsure (555): Identity of nucleotide sequences at the above locations are unknown.
agaattttattgtatttacttcaattagttcaagcattgaaatacgaggcattgatatatgaaaaaagtccaccattctgtgaaagatctgatcagattgaagataatacatcgtcgactttaaagtcaccattggctgatttcttaattgaaagagcagtagaaaatgaaaacttgggtaatttcttttactggtatgttaaagttgaaaatgaagaccaactcaataatcctcatgtcgatggtccaatcaaaatctacatggatattcttaatcgctatattgaattgctaaaagcacattgtcatgaaaatagacttccttactataagcatttaaaacatcaaatatggttcatcaagaaattaacttctttggtagagttattacgtgcttcatttaagaaaaacgaggcaacagcaaagaaagttgaatatttgcgggaatatctagctaattctgggaatgaattgttaaaattccctgaacctttcccattaccacttgatccatctgttatgatatgtggatgttatcctgaggaatcatcagtnttcaaatcttcattggcaccattaaaaattactttaaaaaccattgaaaagaaaaaacacggacatgccacttcgcagttatttggaaaacgatctagatatgggaaatacccgttaatgtttaaaataggtgatgatttaagacaggatcaattggtaattcaaatcatagacttgatggatcaacttttaaagaatgaaaatcttgatttgaaacttacaccatataaaatattggctactagtccaatttccgggttgattcaatttgttccaaatgaaactttggactctattttgtccaagacatatccaacatcggtcacatattctggtggtggtgaaacttctgatgtaccaccgtcagtatcaaacaatggtattttaaattatcttcgtcttcatagtcaagaacaacaatccgaggaacctatatccaaaagtattttaagtacaaataccagtcagtccaataccgagataccagttttaccacgtcaacctaaaccaacaataacttcagatttgggtgtatcaccgattcttatggataattacgtcaagtcatgtgctggttattgtgtaattacctatattttgggtgttggagatagacacttggacaatttattactttcacccaatgggaagttttggcatgccgactttggatatatactcggccgtgaccctaaacctttccctccattaatgaaattgcctatacaagtaatcgatgggatgggagggttacatcacgagaattataatgttttcaagagctattgttttatcacatacacaacattgcgtaaaaatagtaacttgattttgaacttgttccaattgatgttggatgccaatatcccagatattcaatttgatccactgagagtgattgaaaaggtacaagacaagttttgtttacaaatgactgaagaagaagcaattttacatgtccaaaatctgattaatgatagtgtgaatgcgtttttgcctgttgttatagatagattacatagtttagcacagtattggagagcttaa

SEQ ID NO: 1415 - DNA, 1059 bp, Candida albicans
  unsure (674): Identity of nucleotide sequences at the above locations are unknown.
ataccaattcaacaaatagttcatctttcactagatccgttgggggttggcataaattcaaatctgtctcctaaaaatgggaaaaagcggaaaagtggaagtaaagtccgaggtgtgttttcgtcaatgtttgggaaaaacaagtcaacgtcatcatcgtcgtcttcaaactcaggtctgaatagccactcacaggaagtcaatattaagatcagtactccattcaatgccaagcaccttgcccatgtgggcattgatgataatggttcatacaccggtttgccaatagagtgggaaagattattatctgctactggtattaccaagaaggaacaacaacagcacccacaagcagtgatggatatagtggcgttttatcaagatacaagtgaaaaccctgatgacgctgcatttaaaaagtttcattttgataataataaaagcagttcgagtggttggtctaatgaaaatactccaccagcaacaccaggtggaagtaacagtggcagtggtggtggtggcggtggcgctccttcaagtccccatcgtacaccaccttcatcgatcattgaaaaaaacaacgttgagcaaaaagtgattaccccatctcagtcaatgccaacaaagacagagagtaaacagctggaaaaccagcacccacatgaagataatgntactcagtatacaccaagaacaccaacatcccatgtacaagagggtcaatttattccaagtagaccagctccgaaaccaccatcaacaccgctttcttccatgagtgtgtcacataaaacaccttcttcgcaatcattaccaaggagtgattcacaatccgatattcgttcttcaacccctaaatcacatcaagatatttcgccaagcaagatcaaaattcgttcaatttcgtcaaaatcattaaagtcaatgcggtctagaaaaagtggggataagtttactcatattgcacctgctcctccaccaccatcattaccttcaattcctaaatcaaagtcgccttcggtcctcaccacgggactgcccaaccgccgtaaaggtggg

SEQ ID NO: 1416 - DNA, 1074 bp, Candida albicans
  unsure (130): Identity of nucleotide sequences at the above locations are unknown.
gtttcccattgcaggaggaaatcaaacaatttgatcgagacgagtgaacacggggaaattattgatgggacgatggaatctggatttagtgatattgatgattcacaacaatcacatgacaataacaacnacaacaacaacaacgagagcaatccagaatcaagtgaagccgatgatgaaaaaacccaaggaatgcctcctcgaatgccagggacattcaatgtgaaaggtttgcaccaaggggatgatagtgacaatgaaaaacagtacaccgagctaactaaatcaatcaataaacgtaccagtaaagattcatattctcctggcacacttgaaagtcccggtactcttaatgcattggaaacaaataatgtctcaccagcagttatagaggaagaacaacatacactgtctttggaagatttgtcattgtccttacaacaccaaaatgaaaatgcaagattatctgcaccccgcagtgcaccgccacaggttctgacttcaaagacatcatcatttcacgatatgagtctggttatatcttcatcaacttctgtgcataagataccatcaaatccaacttcaactcgaggttctcatttatcaagttacaaatctacattggaccctgggaaacctgcacaagcagcagcaccaccaccaccagaaatagacattgacaatttattaaccaaaagtgaattggatctggaaacagacacattgagtagtgccacaaattctccaaaccttttaagaaatgatactttacaaggaattccaacacgagatgacgaaaatattgatgacctgccccgtcaactatcacaaaatactagtgcgacgtcaagaaatacttctggaacatcgacttctacagtggtgaaaaattcaagatctggtacgtcaaaattaacctcaacctcaactgctcataaccaaacagcagcaattactcctataatcccgagtcacaacaagtgtcatcaacaagtgataaataccaattcaacaaatagttcatctttcactagatccgttgggggttggcataaattcaaatctgtctcctaa

SEQ ID NO: 1417 - DNA, 642 bp, Candida albicans
agtgagtacaactcgattgtgcacaaggacaatttatatattattgatgtttcgcaatcagtggagccagaacatccaatggcacttgattttttgagaatggatatcaaaaatgttaatgattttttcagcagaagcaaaataaatgtgtaccctgagcgtttgatattccgatttattacatcagaggggcatcttttgggaattgccgataatagcgaccaagaattggaaaaatatcttgagacattgccgttaaagacagaagatgatcaggaagtggaggatgaaatttttagatcattacatttagttagatctttgaataatttagatgagagggactttcagaaattctctgaagggaaggttgatacaatgaaagatcttgttgccatgaaagaaggcgaggttgcatctcctggtttgcaaactgctaatggcaacgaggtagatagttctgaagatgaagataatgaaggcgtatccgaggaagaggaagaatcctcatctgaagatgatgatgatgaagaagaagaagtggatggtatatccgaaaaggaatgggttgaacgtgaacaaaatgctccaaggggtaagaaacacgaacataaagatcttcaccgcacgggcccagaatag

SEQ ID NO: 1418 - DNA, 1035 bp, Candida albicans
cccttacaaatttttggtgttgctcgtgaattgatgcaattccattcccaaacttgtggtatagttattggtggggccgatagaagacaagaagccacaaaattagccaagggtgtgaacttattagtcgctaccccagggagattattggatcatttgaaaaatactcaatttgtgtttagtaatctaaaagctttggtgattgatgaagccgatagaattttggaaattgggttcgaagatgaaatgaaacaaatcattaaagttttacctaatgaaaacagacaatcaatgttgttttctgccacccaaactacaaaggtggaagatttagctagaatttcattaagacctggtccattatacataaatgttgtgcccgaaaaagatgtttcaactgctgatgggttagaacaagggtatgttgtttgtgattccgacaagagatttttactattattttcattcttaaaacgaaacgtcaagaaaaaaatcattgtgtttttgtcatcttgtaatagtgtcaaattttacagtgaattattgaactatattgacttaccagtgttggatttacatggtaaacaaaagcaacaaaagcgtacaaacacttttttcgaattttgtaatgccaaacagggaatattagtatgtacagatgttgctgctagaggattggatattccagccgtcgattggattgtccaatttgatccaccagatgatccgagagattatatccatcgtgttgggagaacagccagaggaactcaaggtaaaggtaaatcattgatgtttttgaccccatctgaattgggattcttaagatacttgaaagctgctaaagtacctttgaatgaatatgagttcccagctaacaagattgctaacatccaatctcaattaactaaattgatcaaaaccaattatttgttgaatcaatcagccaaagatggatacagagcatatttgcaagcatatgcttcacatggactgaaaatcttactctcggaaagaacgtataccacacgcatt

SEQ ID NO: 1419 - DNA, 3813 bp, Candida albicans
accgtatataaaaacttggagatgggaaaatatagaaagaggtttaatgagaaagcaagggcaggtatgcttgccaagcaagctgcattgaagaaagcaagaaataagcaattttatagacaagacgatgaggaagagaccgaaacgactccagataccaccgaaatattcaatacccaagattcaaactctgaaatacttgcacccgtcactgaagaagaacggttagctagaaagagggcattagagcaaaatttgtattctgaaaattccaaaaaggagaaaatgtctcgagcaaagaagaaacgtttggataaatacattgatcatcaattgaaaagagaggaaaagaaaattttgcttgaaaagttggcagagaccaagatggatactagtaactttgccgctcttaaggaattgggaaaaggtaaacaaaccaaaaaagaggaaatgattgaggcgttggaattggaacgtcagggtagagctgatgagaatacacgggaagttttatatgaagaacgagatgtaaaagattatgatgattcagatgaagatggcagtatatttaaaagcttcgacgacgacagacatttgcaagacgaggagggggaacagcgatcaacatttgtggataacaggcccaaaaagtttggcggtcaaggttcgggttttggttttgcaaacatacctgtaattaaaaaagatactacggaaattcctaagaaaaaatacagttggaggaaaagggtggaagaagaagaaaaaaagagattaaagaaagaagatgatgatgattttgcttcgtcttcagaggatgaggaggagctggataatagtaatgctgacgatatgaacacttctgaagaaactgtggaagcagatgagttacgtgatctggatgtggcggaagattctgattccaatgaagaagaatctgaacatgaaattaatcctgaagctggtgagtctgctgaaagtgagggtgatctgtcaagtgaagtagaagaagaagaggacgacgacgacgacgatgatgatgaggaagaagaagaagaggaatcaaagttgatgaaaagcaaaccgcgccactctactactgcagctagtttcaaagaatgggcagaacagcaggttcgtattatggaggggagagacaagaatgttctcacaccagaagtttctgaagagatcaagaaaaagtactcgaaacagactgtcagagatgaagacgtcgatcactcgtcagatgaagaaggatacatccctataaacaaagaaatgcaacgtcgagcatttgttgtagaagtgaacagaacggattctattcaacaacaaagagttttacttcctgtttttgctgaagagcataggataatggaggctgtttatcaccacgattgtataattctttgtggtgaaactgggtcagggaaaacaacacaagttcctcaattcttgtacgaggccgggtttggtaatttattgcacgacttgtatcccggaatgattggtgtgactcaaccaagaagagtggcagctgtgtcaatggcagaaagagtaggtagcgaattgggagatcatggtcaccgtgtgggttatcaaatacgatttgacactactatcaaaaatgaaggtaaggaaaacggtacggcattgaaatttatgaccgatggtgttttgttgagagagatgatgaccgattttttgttagccaaatattcagcaataattattgatgaagcccatgagagaaatattaatactgacatattaattggaatgttgacaagagttgtaaaattaagaagaaaatatcacaaggagaatcctcaattgtataagcctttgaaacttattataatgtcggctacgttgagagtctctgatttttcggaaaaccctgcattattcaaaacaccaccacctattatcaatgttcaggcaagacagtatccggtgtcaatccattttaataaaaaaactaactatgattatttggaggaagcgtttaaaaagacatgtaaaatacatcgtaaactacccgaaggtggtatattaatattcttaacggggcaaaatgaaattaccactttggtgaaaaaattacgacaagaattcccgtttgaaaagaagtcaaccattcagtatgatgaaaacattgatgttaagttgtcagaaaatgttcaacaagaggttgaagatgtggattttagtgttcaatctggagatgctggtatacttgatgattatgaagaaggagaagaaaatgaggaagaagaggagggttttgaagagtctatcgatagcaaggagtcagaggtggggccgttatatgtattgccgttgtattctttattacctacaaaacaacaaatgaaggtgtttgaggatccaccaccgggaagcagaatttgtatagttgccactaatgttgccgaaacatcgttgacaataccaggcatcagatacgtggtggattgtggtcgttccaaggaaagaaaatacaaccaagaaaatggagtgcaatcatttgaagttgattgggtttccaaagcatctgctaatcaacgtgctggtagagctggtagaaccggaccaggacattgctacagactatattcttctgcagtttttgaagactttttccctcaattcagtgtacctgagattttacgtatgccatttgaaagtattgtattaagtatgaagagtatgggaattgatcaaattgctaattttcctttccctactcctcctgatagattttcattaaagaaagccgaagagttgttagtcatattgggtgcattagataaagaacaaaagcagattactgatttagggaaaaaaatgtctttgttccccttgagtccacgatttgcaaaaattctaattattggaaaccaacaagaatgtctttcttatatcattgctattgtttctgcattatcggtcggagatccatttataggtgagaacgaattagtcgggaacatgaatgacgaagcacgtagagagtttagaacaaaattctatcactcacgtgcattattctcaaagttggatgcgtctagtaattgtatgatgttattgtctgcagtttgtgcatatgaccatgttccaaaagaagagcaaaatgggtttttacaaaagcattatcttagacataagatgatggaggaaatacaaaagttgagaaaacaagttggaaatatagtagaaaatatgattatgtctgctgatggattacagttggaacaaaaagtgaaattgcccattccaaacaaaaagcaagtgagtgcaatgaaacagatgattgcgtctgggtttatcgaccaagttgcaattcgaggagatctcatttcatctgaggtaaaggttgcaaacaagacaagtattataaatatcccatactgtcccgtgatgcccatagaagatggaccatttgtatatttacatcctaactctcttatagctgaaagtgggcaaattccaagctcgtatcttgtctatcaatcattgagtacaaagggaaacatcagtgaagatgaaaccaagaaggttaggatgaatccgttagttgatataagtggtaagcagttggctaatattgctaaaaactcggtgctactcacatattccaaaccgttaggacatccttatgctccaaaaaacttgacaccaacgaaaagagaatgttatgtggttccacgttttggagcagccattggaagtggtggtgttggttgggatttgcctgccattaatgtaattcaagaaaaacgtaaaggtgtttgggtaaacttatag

SEQ ID NO: 1420 - DNA, 2232 bp, Candida albicans
taccagaaagagggcaacaaaaaaaaaattcaaatccaattcgatgagattaaacgatatctttttcattacttcacaatcccaagtatgacagtatcaacagcaattaataataggaaacgattatctagtggattaagtgttacttcaaaagtatttgtccgttcaagaaatggtggagcattaaaaattgttcgtgaacattatttaagaaatgatattccatgttattccaccatttgtcaatcatgtcaagatataattaaacctgatgctcaaggtgaattaccaaaatttatcttatcactgaatccaacgaaaactgctaaaggtgaaccacattatttggtgttagataccaatattatcttacatgccattgatttattagaaaataatcaatgtttttatgatgtaattatcccacaaacagttttagaagaagtgaaaaatcgttcatttcctatataccaaagattaagaaatttggttaaatcagaagataaacgttttattgtttttcataatgaatataatgaacaaacatatattaatagaaataaaaatgaaactattaatgatagaaatgatcgagccattagaaaagtagcacaatggtatcaaactcatttaccatccaaaattaaaacttttttcatttgtaatgataaagataatagaaataaagccattaaagaaggtattgatgcaagatcattagttgaatatattgaaagtttaccaaatgctgatgatttaagtgatttaatccctcaagatgattctacatttgaaaatgataaaaatagtactaccgctacagctggtctggatgatgaagaaacttcattcccggaatattattcaaatgcaagaataatggcaggtattaaaaatggtactttatatcaaggtattttgaatgtttcatcttataattatttacaaggtgaagttctggttcccgcatttaaaaaacctttattaattcaaggatcgaaaaatttgaatcgtgcattcaattccgattcagttattgttgaattattaccaaaagataaatggaaagaaccatcaactaccattatcgaagaaggagctattggtgccaatgataatgccgcagatggtgatgatgaagaaggtggcggtggtgatgttattgaaggtaccaagagtgtgatttcagataaagaacgtatattattagctcaagaagctataaaagttattggttcaaaaaatgaggataaaagattacaaccaacagctaaaattgttggagtaatgagaagatcatggagatattatgttggacaaattgctccatcatcagtgaatcttgatgataagactggacatgcttcaagaagttgttttgttattttaatggatcctaaattacctaaaattagaattagaactaggaaagctagagaatatttaggacaacgaattgttgttgtggttgattcttggccaattaattcaagataccctaatggacattttgttagagctttaggtgaaattgaaagcgctgaagcagaaactgaagcattattattggaacatgatgttgaatatagaccatttctgaaaaatgtattggattgtttaccaaaggaaggtgataattgggtagtcccagatatcactaataatactgaagatcctcaattacagaaaagagttgatttgagagataaattagtttgttcaattgatccaccaaattgtgtggatattgatgatgccttacatgctaaacaattacctaatgggaattatgaagttggagtccatatagccgatgtcactcattttgttaaaccaaacactccattagatcaagaaggtgcctctagaggaacttcggtatatttggttgataaaagaattgatatgttgcctcaacttttaggaacaaatttatgttctttaaaaccatttgttgatagattcgcttttagtgttatttgggaagttgatgaagatgccaatattgtcaatgtcaattatatgaaatcaattattaaatcaagacaagcattttcttatgaacaagctcaattacgtattgatgatccatcacaacaagatgatttaactaaatcgatgagaattttattaaaattatcgaaaaaattaaaaccaaaaagattagatgccggggcattgaatttagcatcacctgaagttaaagtacatatggatagtgaaaatttctga

SEQ ID NO: 1421 - DNA, 915 bp, Candida albicans
catcacctgaagttaaagtacatatggatagtgaaaatttctgatccacaagaagttgaaattaaaaaattattagaaacaaattctatagtagaagaatttatgttgtttgccaatatttctgtcgcaagaaagatttatgatgcttatccacagacggctatgattagacgtcatgcagcacctccagcaactaattttgaaactttaaacgacatgttaaatgttcgtaaaaatggtatgtcgatttcattagaatcgtcaaaggcattggcagattctttggatagatgtattgatcctaatgataaatatttcaatacgttggttcgtattatgtcgactcgttgtatgatggcagcagaatacttccctagtggatcttatggataccccgaatttagacattatgggttagccgttgatatatatactcatttcacttcccccatcagaagatattgtgatgttgttgctcataggcaattggccggtgctataggttatgaaaatttagatttaagtcatcgtgataaatctaaaatggaaatgattgttagaaatatcaataaacgtcatagaaatgctcaatttgctggaagatcaagtatagaatattatgtgggccaagtcatgagaaataatgaatctgaacatgaaggttatattattaagattttcaataatggtattgtggttttagtgccgaaatttggtgttgaaggattaattaaattagaaaatatgggtgatgtcaattcagcaaattataatgaagataaatatgaattgacatttaccgattttaaaggtaatgaaagaacaattgctgttttcgataaagttaaagttgatgttaaatcagtgaaagatgaaattagtggtaaaagaaaagctcaacttatgttaaaataa

SEQ ID NO: 1422 - DNA, 1578 bp, Candida albicans
cccttaattcttttgattttattggttgtgcttctggttgagtataatttttattattgtacaatcttgtccatctggtctgatttattccaatcattctttacaagcataatgtcagggttttttgtctcaagagtagaaagtcatttctcaaaaaatcctatcaaatataaaccacgttcaaactcatctcatgaagctaataacaacacaacttcaaatttgattaacaaattcaaaccaaagaaaacttccaagggcacggataatgaattacccaactctatacctgaaatgattcaaactgctatccctgagttcagccccaaatattccttttttgtgaacccattactttcttctggtcatacacaaacagcatataccgctttaaacaagtttgagaatcaacacgaggttcactataaaagagaaatcataacaattgaaaataaaccttacactttacccaatggagatcaattgtattacgaccagtggaaaggtgagagtaccattgctttagattatgctgtaaacctgtcacttggtccagatttgaaccacgagcagtacaagcctgaatctcaaacaagaccacttccacctcgtactgaattcaagaaccctaacgaagatttgatcagtgatgacgagaagcctttattgattattttgcatgggttgtcgggaggatcatatgaagcgtatttgcgagcagttattgacaaaattattgaaccaccatttgaattcgatgccatggtgattaattcacgtggctgtgccaaccacaccattacgtctcctcaattgtataacggcttgtggacgaatgatgtgagatatgtgatcaatgagattgtctcaaaaaggtggccccaaaaaagagttttcttgatgggtttttcattgggagctgctatacttgcaaattatttagggcaagaaggagcacatgcaagcccacaaatcaaagggtcagtagcaattggatgtccctgggactttgtggatggaagtttccaattgcgtgaatctgtgattggtcattacatttactcccccaccatggctaacaatttattgaaattgttgaatagtcatcatattttattggctaatgatttggtcaaacaatataaagaagaccccactcgaaacgaaattaaattcttaaagcaattcgacaacgagtttactgcaaaaatgtttgggttaaattcagcagatgaatactacagaaaggctagtcccattcaaagattattaaatgtgagagtgcccatggtcattttgagttctttggatgatccagttgttgggtctaggtctttgccatattcagaagtgaatttgaatccatatgtcagcttaattacaaccagtgtgggtggccacttgggttggtttgctatcaatggtgatagatggtacgtcgagcctgtttgtaaattattgacggtgttaaatcaatatgacgcagacaaggaaagtatagttgagttgccagttgatatttcagaaacaagttggaagtatgatagattagtcaatggtatgttggttgatcagtag

SEQ ID NO: 1423 - DNA, 468 bp, Candida albicans
gatggtggttatttggacaacttgcctgtgaatgagatgaaaaaaagaggtgtcaagcatattattgctgtcgatgttggttctgatgatgatcgtacaccattgaactatgggcacactcttctgggattttgggttttgctcaatcgatggaaccccttttccagtcaccctaacattccaacaatgatggatattcaaatgagattgacttatgtttctagtgtcaatgcattagaggaggccaagagaacccctggtgtttactatttgcgaccacctattgatccttatgcaactttagattttggaaagtttgacgagatttacaaagttggactcaagtatgcagatgacttgtttgccgattggaaaagcaaaggtaaatttccaagaattgcaggattggttgagaagaaaaaggatggtgaagaaaagaaaatactttatcgaagaaactctatctag

SEQ ID NO: 1424 - DNA, 444 bp, Candida albicans
gaaaatcaattattgatatttccgtttttatttttttttttcagattgtctttttttgagcgagtgagtggtggtggtcaacatattgaaagagttttcgataatacaaatcataaacaccaagccataattaatcacacaagcatgagcaatccaaacgaaagtgaaccacacacccaaccagagatcaacaatgcaagtcacattgttaaacctgaaggatctcaaactgttaatactggtttcatttgtcgatggagtgattgtactgaaaacacatacaacaatttgacatcattagtcaatcatttgaacagtaaacatattgcacaacttccaccgggatcaaatacgaaatacatatgttattgggagaattgtgctagatatggactagatcaacccagtagatctcacccggaactgccggaccgatatattgta

SEQ ID NO: 1425 - DNA, 321 bp, Candida albicans
ggaggtttctccgttagtaaccctactatacaacggttctttgcattgcatttcttattacctttcatacttgctgcattagtatgtatgcacttgatggccttacatgtacatggttcatctaaccctgtaggtattactggtaatattgatagattgccaatgcatccttacttcatatttaaagacttaattactgtctttgtattcttattaatatttagtttattcgtattctattcacctaatacattaggacatcctgataactatataccaggtaaccctatggtaacacctccttcaattgtaccagaatga

SEQ ID NO: 1426 - DNA, 693 bp, Candida albicans
tctttcatttttttttgtaatttttcatatttcacttctttcaactttcaaaccaaacaacctctttccaaaatggctatgcttactaaatctatacatgatgaagatcatgttggaaaaaaggatcctgacaccaatccaaaaacggttcaaaatgttgtttcatcgagatcacccccaaacccagctaaggacattactgaagaaagaaatcgtaccaactgggatctcaaggaaatgcatgagtttttagaaggtggtgaagctaaatctgaacaagttttacgtttgtatcaatcaattgaacgtgacccaatcttgcaaaccagacctgaacaatttgatattactcaaaaggaagaaagagagttggttgccaccagaatcaaccaaatgaccaaatatatggaaattgaatcagctgcaaaattcagaagaagattgcaattgatgacaattatcgacccatcaatgggtattagaatgttagtcaacattggattgttcatcaactgtattaaaggtaacggtactcaaaagcaatatgatttctgggctaaatctaaagaaggtgctattatcaaacaaattcacggttcctttggtatgactgaattaggtcatggttccaatgttgcagcttgtgaaaccactttttcaccactgcctagaggacccgcaatctgcggggaa

SEQ ID NO: 1427 - DNA, 561 bp, Candida albicans
actggttctaacagctcaaaggttgtgttggacaatgttgctgatttggatgatatcgacaaggttatcaaagccattgaagttgctattatcagattaggtcaagaagctgcctttactgtcagaaaggaatctttagatttcgttggtgctgaattggttcaactttctaaattgaaggctcatcactacctgttgagtgaatacgttagaagagttaacgaatttgaccaaaaagaattggttccatacttgctcaccattgctaaattatacggtgccacagttgttttggacaaatttgctggtattttcttgactatcaatgttgcttctactaaagctatcactgacttggcttttattcaaattccaaaattgtgtgctgaagttagaccaaacgttgttgctaacactgattccttccaacaatccgatatgattgtcaacgctgctattggtaaatacgatggtgatatctatggaaattactttgacttggtcaaggcccaaaacccaccatcaaagactaaagctccatactctgtcttcacctatcgc

SEQ ID NO: 1428 - DNA, 1998 bp, Candida albicans
tacaatatgtctactgaacttcaaaaagaaagagaacaaattaaattcaatcctaaagaagtcaactatttcttggaaggatctaaagaaagatcagatattgtcagcaatcttgttgaacaaatggaaaaagatccagtattaaaggtggatgcgtcatactataacttgactaaagaagaacaaagagaggatactgctaagaaaattgacagaatttcaagatattttgaaaatgaattcccagatcaacaagcacaaagattatctattcttggtgttttcgatcctcaagttttcactagaattggtgtcaatttgggtttatttgtttcttgtattcgtggtagtggtaccaactcccaatttttctactggactattaacaaaggtgttgataaactccgtggtatctatggttgtttcggtatgactgaattggcccatggttcaaatgttcaaggtattgaaactactgctacttttgacaaagaaactgacgaatttgtcattaatactcctcacattagtgctactaaatggtggattggtggtgctgctcattctgctacccattgtaccgtttatgctagattgaaggttaacggtaaagattacggtgtcaagacatttgttgtcccattgagagactccaatcacgatcttatgccaggtgtcactgttggtgatattggtgccaagatgggtagagatggtattgataatggttggattcaattctccaatgtcagaatcccaagatttaacatgttgcaaaaatatgctaaagtttctcgtgaaggtgaagtcactatgcctccatccgagcaattaggttattctgcattgattggtggtagagttaccatgatgatggactcttatagaatgaccagtagatttgttactattgccttgagatatgccattttcagaagacaattcaagaataagatttctggtggcgaccaagaaactaaattaatagattacccattgcatcaaaagagattattcccatatttggctgctgcttatttattctcacaaggtgctttgtacttggaacaaactatgaatgaaaccaacgaaagattagatgatgccgtttctgaaggtgacaagaaaaaaatcgatgaagctattgttgcttccaagaaattgtttgttgcctctggttgtttgaaatctacttgtacttggttaactgctgatgccattgatcaagctcgtcaagcttgtggtggtcatggttactcttcgtacaatgggtttggtaaagcttattcagattgggttgtccaatgtacttgggaaggtgacaataacatgttagccattaatgttgccaaaccaatggttaaagaaatcttacaagaaccagaacaaaaaggtttggttattgctaatgtttccgatttgaatgacccagctaaattggacaaagcttttgaacatgctctttctggtttggctagagatattggtgccgttgccaaagaccaaggttatgatgtcactggtccaagtttggttttggtttccaaattgaatgctcataaattcttgattgatggattcttcaaacgtattactccagaatttgctccaatcttgaaaccattgggattcttgtacgctgattggatcattgaaactttcagttctgtgtttttatcttatggtgttatcgctccggaagtgattaaaaagatatcctcagaacatttcccagtattagctaaacaaatcagaccaaatgtcgctggtttgactgatgctttcaacttgtctgatatgttgactaatgctgctattggtagagccgatggtaatgtatacgatcactactttgaaactgttaaaaaattgaacccacctgaaaacactaaagcaccatattcacaagcattacaagatatgttgaaccgtccatcagttgaagaaagacaaagaggtgaaagatctgaagaagctgctgaaattttatctagttag

SEQ ID NO: 1429 - DNA, 237 bp, Candida albicans
tatagctttcaattgaaaaatttgaaagtgaaaaacaaatcaaatatggtggagaaaagaattgctattgttggaggcggtccatctgggataataaccttaagatctctcttagacgaaggatttacttcagtcacattatttgaacgaaagaataagttaggtggatgttggaatttaaccccaccagaacagaccaatttcgacgttttcaacgagccggagcagaatcatgat

SEQ ID NO: 1430 - DNA, 918 bp, Candida albicans
agatctatgaaacaatcagcaaagaacaccattataccgccaatggctccaccatttgctttgcagtcaaaatcatctccactttccactcctccgagattacacagtccatggggtgtagacagaggtttacctatatcaatgtctcctatacaatcatcgctcaatcaaaagttcaacaatatagcactacaaacacctttgaactcttcattcctgataaataatgatgaggcaacaaatttcaacaacaaaaataacaaaaacaataataacaatagtactgccactaccactatcactaatactatcttatcaacaccacaaaacgtgagatacaattccaagaaatttcaccctcctgaagaattacaagaactgacatcaataaatgcatatccaaatgggccaaaaaatgtgttgaacaatttaatttatttgtattcagatccagttcaagggaaaatagatatcaataagtttgatttggtgatccatgtggccaaagaatgtgacaacatgtctctacagtatatgaatcaagttcccaatcaaagggaatatgtgtacattccatggtcacataattcgaacatctcaaaggatttgtttcaaataaccaacaagattgatcaatttttcactaatggacgtaaaatattgattcattgtcaatgtggagtatcgcgatcagcatgtgttgttgtagcattttatatgaagaaattccaattgggagttaatgaagcttatgaattattaaagaatggtgatcaaacatatattgatgcctgtgatagaatatgtcctaatatgaatttaattttcgaattgatggaatttggtgataaattgaataacaatgaaataagcacccaacaactattaatgaatagtccacctactattaatttatag

SEQ ID NO: 1431 - DNA, 912 bp, Candida albicans
acaagtaaagaacaacgggggaaatatttctcaatgaccgataatggattatgccgaaaattccttggaattaacgtctatcaacaagcaaatgaaataagattaagtttgaatgattatataaggagaatgattgaggagttaaaattatctgtctcagaaacaaacccagtatctataccatctgatgtcaattatgaaatatttaaagttaacgaaaatgatgatgagaaaccatgtgatcaaaccaaataccgaagtttgataggcaagctcttgtttgccagtaatactataaggtttgacatcgcctattctgtcaactccctatccaggtttatcaacgatcccaaagaaaaacattggattgcagctgtcaaggtggtaaaatatctcagtggtactcaacggtatggtatttgttataacggtaacggtgacttgaatatttacgctgatagtgattgggcttccactccatctgatcgaaagtctattacggggtacattgttacctatgctggagcgccgataagttggcgttccaagaagcagaacgtgatagccttgagtacgacagaagcggagtttatggctctcacagagtccataaaggaagccctttggctaatatacatttttcgagatattaatgtgatattgaaattaccaattgtgatatatgaagacaacctactgtgtcagaaattacttgaaaatcctcgattccataataggacaaaacacattgacttgaaatataaatttaccaaagaccatatagaagctggtacaatcaaagtggaatcaactaattcagcagataacttagccgacatgctaactaaacctttaccaaaaattaaatttaaacatttaagatggctagcaggattaagacctttagattga

SEQ ID NO: 1432 - DNA, 1014 bp, Candida albicans
  unsure (990): Identity of nucleotide sequences at the above locations are unknown.
ccaaatggcaatcctcaacaaatagtaatcggtaacccatctagtatggttgagaaaaaagataatggtatcgattacaaccgaaatacttttcaaatagaagatctggttgtgaattttgtcggtagggataccgtaaaccgtatcattggcttgacgaatttgaaagatatccagaaggtagtagaaaatatcaataataggaaaattgtcattgatagtaacgttgaggcggatcgaaataggaaaagaatgattttgcaaaaatttgatttcgacacgaaaagcttaatatctgatttaatgaaaaatggtgggtctaattatgagaaaagtaagttgattaatactagaaggggagaaaagagtcgtttagctacacattgggatgataaattggaaaagaatctactgaaatataatgctgaattacaaaaattagataaaactcttatgcttttgagaaaacaggctgaactgatagaggctagagacgcacaaattggtggtcaaagtttgaatagcactcctgttgacaatgcaaattctcgtggcacgcccagtagtgaaacggatacagctgcgggccaaagtccaaaaaaaaatcacttggtgaatatccctccacagacaaatcaactggcttcccaaaatgagactttgcaattgtcctcaatagtgacaccatcaaatcgagattcttcaaacaagattcgttccggtccacctcttcagacatcacaggttcctacctcaaaacgtcaaagggttataggtatgttaggtattgaattgaacgaggacgcgttgaaaatcagtgatagaaagcatggtttacagaatagtgttacgcctatcaacaataaaatcaagaacataagtttgggtgcactgaacacaaacaattgtaaagatcggttaggagatttgcaaactcagttcagtttaaaccaaaacataaccagtggcacaatgcatgatccaattgtnttagatttgagtgatgaagaataa

SEQ ID NO: 1433 - DNA, 462 bp, Candida albicans
caatgtgaatacttgaaagctgttatcaacgagagtttgagattgtacccatcagtgccacacaattttagaactgctactagaaataccactttaccaagaggtggtggtccagacggtatgtcacctatagttgttaaaaagggtcaatcagttatgtacacagttttggtaacacacagagataccaaaacttatggagctgacgctaacgaatttagaccagaaagatggtttgaaccagaaactagaaaattgggatgggcttatgtcccattcaacggtggtccaagaatttgtttaggtcaacagtttgctttgactgaagcttcttacgttactgttagattacttcaagagtttgagcatttgactatggatgcagaaactcgctaccctcataaattaatgaatagtttgactctttccctcttagatggggcaaatgttgaaatgtattaa

SEQ ID NO: 1434 - DNA, 1647 bp, Candida albicans
tatcccaccttccatcaatatgaaaagttgcaatatcaaattcaaattcagaatagcaatccatatttatttattatcatgagtgtttcagacattgtccaagaatatatcaccaaatggtatgtcgttatacctactttgtttgttgtctatcaggttgttgatttcttctatgttagaagcttaagaagtcgtcttggtgccaaagctcctacaaacaacgaatccgatggttattgggggttccatttaccattcttgttggtttccaaaaaagctgaaggtacaattattgatttcgctggtgaacgtttcaaaagtattgcccacccagaagtcccaacttttcagttcccaattttcactgtcaaagttatttccaccgttgatccagaaaacattaaagctgtattggccacccagttcaatgacttttcattaggtactagacacaatcaatttgctccattgttgggtgatggtattttcacattagacggtgctggttggaaacatagtagatctatgttgagaccacaatttgccagagaacaagttgctcacgtcaaggcattagagcctcacatgcaagtattattcaaacatatcagaaagagtggtggtagaacttttgatctccaagaattgtttttcagatttactgttgattctgctactgagtttttatttggtgaatccgtcgagtctttgagagacgaaagtattggtatggctttagaagcagtcgattttgatggaaaaaaggaatttgctgaagccttcaacttttctcaaaactatttggcctcccgtgctgttatgcaacaaatgtactggttattgaacagcagtgagttcaaaagttgtaactccaaggtccacaaatttgctgaatactatgtcaacaaggcattggagttgtctcatgaagaattggaaaagcaacaaggttatgtctttttgtatgaattggcaaaacaaactagagacaccaaagtgttgagagaccaattgttgaacattttggttgctggtagagataccactgctggattattgtcgtttgtgtttttcgaattagctagaaatccaagagtgtttgccaaattgagagaagaggttgaagaaaagtttggtgttggtgaagatgctcgtgttgaagaaattagttttgaatcattgaaactgtgtgagtacttgaaggctgttcttaatgaatgtttaagattgtacccatcggtcccacaaaactttagagttgctacaaagaatactaccttgccaagaggtggtggttctgatggtatgtctccaattttggtcagaaaaggtcaaactgttatgtacagtgtttacgttacccacagagacactaaggtttacggtaaggatgctgacgaattcagaccagagagatggtttgaaccagaaaccagaaaattgggttggtcgtttgttccattcaacggtggtccaagaatctgtttgggtcaacaattcgccttaactgaagcttcttatgttactgtcagattacttcaagaatttggtcatttgactatggacccaaatactgattatccaccaaaaaagatgtcacatttgaccatgtctctttacgatggtactaatgttgaaatgtattaa

SEQ ID NO: 1435 - DNA, 672 bp, Candida albicans
acgatttgggtgaaccaaactcgtgatccacaagtattacgcgatcaagctttaaatattttgttggctggtagagacaccactgcaggattactttcctttgccgtttttgaattagctagaaaccctcaagtttggaaaaagttgagagaagaaattattgagagatatgccgatggcgtaactgagatttcgtttgaaacattaaagcaatgtgaatatctcaaagcagtaattaatgaaactttgaggttgtatccctcagttccacgtaatggtcgatttgctaataaaaatacaactttgccaagaggtggtggtcctgatggcatgtctccaatcttgatcaaacaaggacaagctgtgatgtacagtatttattctacacaacgtgatcctaagtattatggaaaagatgctgatgttttccgtcctgaaagatggtttgaaccagaaactagaaaattgggatgggcattcttgccattcaatggtggcccaagaatatgtttaggacaacaatttgccttgacagaagcatcttatgttttggtcaggttggctcaatgttgtgaaaatttgcaattgacagaaggtatagaatatcctccagctaagttgactcatttaacaatgtgtatgtttgatggtgttcctattaaagttgattag

SEQ ID NO: 1436 - DNA, 948 bp, Candida albicans
ttattcaaacttatcaaatttgactccataaattcaacaatcgcaatgttagaagaaatctcttttgagtcttggtacctctatttaattatttgtggagtattgtacttttgtacaaactatctttatattcagtatttgaataagaaattgggagcaaaactgcctggcagttgcaaatcggatggttgttttggatttagaagtggctttgaaatgctcaaggctaaaaaaattggtcgacaagttgatttattacatgaaagattcaatgatttatctaacccagaagtgaatgatacttttacgtcatataattttggattccccatgattatcaccaaagatcctgaaaatatcaaagcattattggcaactcaatttaatgatttctcgttaggtagaagatatgatttctttaaaccgttattgggaaaggggattttcacattggatggtgaaggatggaaacatagtagatcaatgttaagaccacaatttgcacgtgaacaaattgctcatgttaaagcattagaaccacattttcaattattgaagaaacatatcactaaaaacaagggccaatttttcgatattcaagaattatttttccggttcacggttgattctgctactgaatttttgtttggtgaatccgtgtcatcattgaaagatgaatccattggatataatcaagacgaatttgattttgctggccgtaaagatttccctgaagcatttaataagtcacaaatttatttatctacgagatcattattgcaaaacttatactggttggttaacccaaaggatttccagaattgtaatgctattgttcataagtttagtgattattacgtcaataaagctcttaatgcaacaccagaagaattggaaaagaacagcggatatgtgtttttaaacgatttgggtgaaccaaactcgtga

SEQ ID NO: 1437 - DNA, 1524 bp, Candida albicans
atgttaattttattacctattgctgttatagcagccagcatttattatattgctgaatattggaaaagagaatcaataaaacgtaaatatgattgtcaaccagtaaaacaagcaccattagttacatggtatgatatatttgggattaaagcccttgttgataatagtaatctaaccaaaagtggatatttttatcaagatattcaacggaaacttgataatcttgatacaacaacaatgaaaactactgctttagggaaaaatcaaatcattactattgaaccagaaaatttccggaccatgtgtagtagtgctgatttgaataattggaccattggtactagaccaattgctttaaaaccattattaggtaatgggattttttcaagtgaaggagaaagttggaaacatagtcgaattatgttgagaccaatttttgctaaagaacatattaaacaaatcacggctatggaatcatatattcaactgttaattaaagtgattaaacttcaacaacaaggagaaggagaatttgatttacaacatttattccattgttttactattgattatgctacagattttttatttggagaaagttgtgattgtttaaaactgattcttggtgaaacatcaatttctaccatgagtgaagaagaaaaatcaaaatttgcacctaattttgatgttatgcaatatcatatgacgaaaagattagtatttggttatttttcctttttggtgaatccaccagaatttaaaaatgcggtcaaacatttacatgaatttgtattccattttgttgatcgagcaattaatttcactgatgaagaattaaatgatccaagtaaaaattatgttttcctttatcaattggctaaacaaacaaaagatcgtaaagtgattttagatgaattattaagtgtgttattagccggtagaaatactactgctagtttattatcatttatgtttttcgaattggctcaaaataaacccgtatggaataaattgaaaaaagaaatcactgaacatttccctgatgttgaatcaatcacttttgaaaccattcataattgtgaatatttacgttggtgtattcatgaatctttaagaattaatcctccagtacccattaatactagaactgctaatagagataccgtgctaccaaaaggtggtggaaagggaaataattatccaatttttgttagaaaaggtgaacaagttattttcccattattttcaagtaatcgtcaagaaagatttttcggacctgaaccagaaaaatatattcctgaaagatgggctaatttacctagaaatggtggagttgcctttggaccatttggaactggaccaagattatgtttaggtcaacaacttgctttagttgaagcaagttatgttactattagacttttacaaactttttctcaattggattcaaaccatacagaatgtagaagactggttggtgctaccatgagattaatggatggatgtcaagtcactttaaagtga

SEQ ID NO: 1438 - DNA, 1710 bp, Candida albicans
  unsure (1055): Identity of nucleotide sequences at the above locations are unknown.
gtgaacacaagtggtggtaaagaaactgttgtttatcaaatttggccggcatcatacaaggattccaatggtgatggtgttggtgatattccaggaattatttcgacgttagactatattgcgagtttgggagtgacaaccgtatggttgagtcctatgtatgactcgccccaagatgacatggggtacgatgtttctgattacgaaaatgtctacagcaaatacgggaccttgcaggatatggacagattaattgctggttgtcatgacagagggttgaagttgatacttgacttggttatcaaccacacttcggttgagcacaagtggtttaaagagtcgagactgtcgaaggacaacccgaaaagagactggtacatttggaaaccacctagaatcgatagcaatggtaacaaacacccgccaaataattgggggtcatatttttctgggtcggcatggaagtatgatgagttgactggtgagtactacttgcacttgtttgctgaatcacaacctgatttgaattgggaaaacaaggagtgcagagaagctatttataactcggccatcaagttctggttggacaagggtgttgatgggtttagaattgacactgcaggaatgtactccaagtaccagcatttcaaagatgtgcctgttgcttttcctgatactgaattccagccttgtgaaatctaccacaagaatggtccaagaattcatgagttccacaaggagatggccaaggtaatggagccatacgatacgatgactgttggagaggttggccattcgactagagagcaggcgttaaagtatgttagtgctgctgaaaaagaaatgaatatgatgtttttatttgacgttgttgagttgggctcggacccacgtgacagattccgttacaatgggtttgacttggttgatttaaagaaggctatcaaatcacaaggtgagtttgctgagggaaccgatgcttggtctactgtatttattgaaaaccatgatcaggcaagagccattagcagatttggtaatgactcgccagagtntagggtgttgtcaggtaaggctattgccatgttgcagtgttgtctcactgggactttgtttatttatcagggtcaggagattggtatgaccaatgtgcccagatcatggccaattgaagaatacaaggatatcaacaccatcaattattaccgtgcctttaaggaaaagtatggcaaagatgctgattataaacagaaggaagaaaagttggttgatgttattaaccgtttggctagagataatgctagaacgccggttcagtggagccaccaacaatatgctgggttttcagaggttgagccgtggatgagagtgaatgacaactataaggagattaatgttgaggaccaggacggtgacgaccattcattgcttaacttttatagaaagttgttgaagttgaggggagagtacaaggatctttttgtttatggggagatgaagtttttagattttgatgacaagaagcttttcacgtttgccaaggaagcgcctggctctcctgttgcatacattgtgatcaactttagtggtgaggatgtcaagtttgagccgttgattaagggtaattacaagttggtacttacaaatgtcgacaaagacagtaaagacgctttgtctccatacgaggctagaatgtatgtagttgattaa

SEQ ID NO: 1439 - DNA, 270 bp, Candida albicans
tatatggcttttaatataatcaatatatatctatttaatatgcaattagctttagctgctaaatacattggtgctagtatcgccacattaggattaggaggtgccgctatcggtatcgctttagttttcgtagccttaatcaatggtacatcacgtaacccatcattacgtagtacattattccctcaggctatcttaggtttcgctttaagtgaggcttgtggattattctgtttaatgatctcattcttattattatacgcagtgtag

SEQ ID NO: 1440 - DNA, 348 bp, Candida albicans
tcttccacatccatactaaatcttactacagcagcaatggggaaaacggtttctaaattatcaaaagatgatttgaggcagcttcgacaggccacgtattttgataaacgtgagttgcaacaatggtacaaagggtttataagagattgtccactgggccaattgtcagaagaagaatttgtgaaagtttacaagcaatttttcccatttggtgacccgactgattattgtcattatttgtttcgagtttttgatttggataattcaaaatacattgattttaaagagtttataattgcattgagtataaccagtagtattcaccacgggtggacaggtccgcgtcac

SEQ ID NO: 1441 - DNA, 915 bp, Candida albicans
tacttttcccaatttatacataaaatgttaccttttgcctggccatatccccctgaacagaaagatggatattggggcatccccacttctactatcgattggtgtgaagagaactacgtcatatctacatatatcgcagaggcattgaatactaccactaactcagtatttattgctttggcaacatttgcgatatatcatgcgttccataataaattagagccacgtttcatatttactgcctttgggtttcttttggttggtgttggctcgtggttgttccatatgactttgaggtaccatttccaattattagatgaattgccaatgatctatgccacgtgtatcccattttggtctgtgtttagtgaattcaagacaccgagacagtcaattctcgttgccgtgggtatttttactgcggcaaacttgcttactgtaatatatttgtactttagaaacccaacaattcatcaagctgcatacggtatattgaatggttttattattcttagatcaattcagttgaatgtaaagtatgtccacgataaaaccgcaagagctcaactacacaagactagtatttttggagtcgggatatttttattaggatactttttatggaatcttgacattcatttttgtgattttgctcgtgctaccagacgagaatggggtattccatatgggtttgtcttggaaggacacggatggtggcacatattcactgggattggtgtctactattctttggtgtatgaagagtatttgcgctgtttcttgactggtactgagaaatattttcagtttacatggatatgggggttgcctgttgtttactgtatagacaaacagggcttggaaagatacagatctgttcaaaaattggcagaagaagataagaaacacatttaa

SEQ ID NO: 1442 - DNA, 471 bp, Candida albicans
acaatggggagcaaattaaaaagtgttggtgttctccgagattcgcgcaacaaattccattttttttcttcaatgtcaaggctagagaaattgaaagagaagaggagagaggggcaaaaaccccaacaagagagaaagagtttcaagacaacaccaagtgagccacgctcgcatatggactatactattgaggaaactgaaaactggcacaagaaacagcgagttgatggttctgagaatgtggataaactagctgagctgacttattacaaggatattctggcgataaaggtcgacttacaagcgtatagggaaggcaaagctgccgaccccactgaactaaccacgatccttgctgccaacactgagcgaaaaacgaaacgtaaacgccacgccaaagatgctgatgctgatagctatatcaatgagaagaataaacagtttaatatgaagttaaatagacaaaaatag

SEQ ID NO: 1443 - DNA, 894 bp, Candida albicans
tcggatattggtccaggaagggttatcgttaaagataatgtattcaccaacaaaaacttcattgaaaaaattgaagggtcttggatcaaagattggagtcaattacggcaactcattcaccgtacggttaaaacaaataactttaaaaaagtaaaaccaactgaatcatcagattcaaccaccaccaatacaacaacatttgacgacttaaatgtatgctttgacgggaataaacagcccaagaaaatccattcactatccctagttgatgagaaaggggaagttgctgataccacagaagctatgttgaatgctgcatctaactatatgtctggattgtacaataaggataccaaagttagacattatatagaaaactatctagccaagttcccaaaaagacttggcgatgatgataggtcgctcctagctaaacccattacgctagaagaactcacttgtgagttagatgaagccctgggagataaaactcctggggaggatggtatttccatgaaatgtttaaagaacctttggggtgtgtgtggtccagcattggttaaggaagctaataaaatccggaaaactggtaatctacccaaggactttcaaaggaatcataatcacattaataccaaaacatgtataaaggaaatcaacaatgtccgtcccattttactcatcaattgtgcattacgtcttataagcagtgtggtaaatagacgtatccaaaaggcaatgataaattcaaaaatatggcacaacaatcaacatggttttattcccagggagaactatacaagatgtccctcaaaaattagcccccacaatcgatgccatcaaggcgtcataccaatagccaccatgccgttatttttaatcgatttcccgtaa

SEQ ID NO: 1444 - DNA, 2715 bp, Candida albicans
ctccatctcaggatgttgagcaacttgacgaaatcaacaccccctcatggcttgctagtcaagctatgttaccaatccctgaagctccctcacaagaggttgagctcaatgaaggaccagacaaacttttgttcgatgaaaatgagtacattgagactcatgactactttgaaccttcggatttctacaagtccggagacgatgatgactacatggatgaggactcagaagaagagaactcagaagaagaggactcagaagacgacgacgaaatgtcaattgatgcggtttcggaaaatgaaatcgatgaccttcaaaaagagaatgagaatgatcaatactaatcaactaaaaatcacgtctctcaactgtgagagaacaacaaacatcaatggtttaaaacaacttattgaaaacaatgacattacacttcttcaggatctcggaaaaactaccagatctttgcttgatatcatacaactaccactaacaatcatttattcgaaattgacagcaattgtcattcaccacaaaattgatgatttaatcaaagtcaccaaccaacacacctttgaattagacccagtcgcatttccacgagttagtgatgctgtcatcagggtaaacaacaagagaaaataccacatcatcaacgtatactaccccccaaacaaattcgacgaacagcggcaacttataagaatgatataccgccaactcaagaacaaaaatacgcctatcatcatgggaggagattttaatcatatcctcaacccagaaatagaccgacagtttcaagtaaggcacaactattcagaaacaagaacaacagaagaatctttattaagaaatacacagctaaaattgatagatgcctaccgatgttttgaaccccaggcaataaacttcacaaaccataatcaattgaacaatagaagaatcgatcggtttcacctctcagagaggcttgaaaaacaactcctttctaaggatgacgctattagatcaacccatgaacgaatcaccatcgttcttaaatttaccaacaaaccagtcattgacatggggaaaaaacgcttcatgatcaaagactaccacattgaaaacccaacatttatctcaaatgtattaaattccaaccctcgcgattgggcacatttgcgacaaataataaaacgactcaccaaaaaaaaacgattccccaaagtaccaaggtcaacaacactcacagcagacacgtttgacgatttacgtatccgctataacgggaaatcaaaaccaaaaaagcacatcttccaaacaataagagatgtccatggtagaaaggcctcgaacacgaaggaaatactcgacattgcacatggctacctaagcaacctatttaacaaatcaccacataataggcaacaaattacaagctacctagaagatttcacacctaacatttcccctgaacaaatagccacacttgatcaacctattactttggatgaattgacaaaagagcttaaggctaaatccaacttatccgccccaggcgaagacgggtacggctttcgctttatcaaatcaatttgggaaacatgtgggccacttttagtcaacatgggcaaccatattagatcaacaggaaatttaccacctgattttaaattaatattaatcacactcattccaaagacgacaaaatccgattacatctccgatactagacctatatcagtcataaatgttggtttgcgtttaatcagcgcagtcatgaataacaaactacaacaaatcatggaatcacattgggaccatgatcaacatgcctttattaaaaaccgatcaatccaagacatagtggaaaaatttgccatcacttgggaaagagtcaaaagatggactacttactcatttgctatggtgttgcttgatttctcaaaagcttttgacagcctcaaccactcatacattaatgcggtacttatgaaatacaagttccctcaatcattcatcaacttctgtatggccattacaagcggccacataggaaacattcgtatcaacgacaaatcatcagaacccttgcgattattggcaggagttagacaaggaaatcctttgtcacccaccatcttcattctttgtctagaaccattcctagcaaagctaaaacactcaattgtgggtataccacttgaagctaacatttttgtgaaagtacttgcctacgcagacgatgttacagtttgcttaaacaacccaaaagaacaacacattctatcaaatgccctcaaccaatttgctaaggcatcgggtttggaggtgaataagaataaaacaattttactatcccgaaaaataggcctgtacaaattaccattccaaaagcatcatgctgacaaaccagaaatcaaatacatgggagttccactctcaccgaaactcaaactcacgtttcttaaaaactggacaaagaatcttcacacagcggtaaacctcgacctaccattacagcaacgagcccttggtatcaatacatacttaattagcaaacttcactatcaggatactctcgcatccttcaaacaaagtgagatcaacaaaatcgcccttcaaatgaaccaatgctttagaggcgtgggggaagaaaacctcttggcactaccaaaccaaggtggttttggactcatggatatcagaacacagacaacttataacagatgctag

SEQ ID NO: 1445 - DNA, 462 bp, Candida albicans
aaacgtgcgttctgtactacaatctgtgttgattgtattcacatgcccactcctgggttaaatgacaaatatatcatcattgctcgtgacgaatttagttcctggccagaagctatatcagtgcccaatatttctggagcaatcgtcgcaaaattcctttatgagtcatttatcactcgttatggttatttcactacattgaaaactgatggtggacctgaattttgcaatcaagtcatagctaccttggttgaaacatacggcataaaacacatccttggtacgcctcattatcctcaatcccatggatttatcgagcgtcaacacgaaggcatcatcaattttctcaaaaaattaccaagcaccaacccttggtatcaccacctatccaccgccctttgggtagatcgcacacaagtcagatccaggactggactcacaccacagtatctagttcatggt

SEQ ID NO: 1446 - DNA, 411 bp, Candida albicans
ttagtagggttaacggatggaatagggaccttcaatatagatataaccccacacgggatcgaagatcccgtgcgggtacctaaagttagatttagttataccataaatgtacctagacataatatacaattattatataaaattaaaagtatattaggagctggtaatatcattaaagatacatttaaatgtaagtatattatatctaataaaaaacatctgattaatattatattaccattatttgataaatatcctttattaacatataagtataatagatataaggtatttagagagagtataataaggtatatggatgagaccaaatctataggagacaggatatcaagtatccagattatgtgtaaggcctcctcagctaatgctgaggaggcctctcctgtttga

SEQ ID NO: 1447 - DNA, 636 bp, Candida albicans
gcgcggagcggcctcctccgaggtgaagacgtgtggaacaaccaagaagaatccccgccagtgacatcaacaaagtctcaacaaagtgtgcagccgaaacaacaaccaaagcaacagccgaatactagtataaagacaaattacaaaccaaaagttgacccaaagttgttacttcaacgaaagaaacttcttgaagagatgtgttataaactaaatggatctgtcaggccactcaaagaagaggtttatcgagccactattccagtacttcctaatactgctccggaactttggaagttgaacggggatatcgatcttatgctcacggttccacaaacttatcctatggacaagataagtgtttcattgaggaacaacttcaatgaaaacctagtggtaaagcattgccaagaggaccagtttgagaaggtaaagattattaaacaatacaaaaagtatgagaaaaatatgaacattaatgtaaggagttatgactttggaactgaaaacttgactgtaatactaaattatttgacgaataacattgataaatttgttcttgacgcagaaagtttcaaaaagtataatgatactgtgaaaatttttaaagccgagatggttagtacagaatgctga

SEQ ID NO: 1448 - DNA, 903 bp, Candida albicans
ttaaatccagcaatggctactacaaagcatcgtcagtcaagcatatcaacacaagaggatgataccaatttatactctgacgtggatgaaatatttaccaaactagatatttcacaaatccatcaattgaataaaaagtacagaaatataatagatgacaccaaatcaaatttacatgatcttgttggcagcaaatatcgtgacttaatcaaaatagctgaagacataggagatatatatcaacattcaagcgacatagacttgaaagttcaacaattgtcatataaaccgaccaagtttatctcaatatatctggacaattatggtaaatttgacagttatatgagaaaacagaatgcgttacaatcgcaaaaggattcacgttcaattattgttagaaatgtgataaacaaaaaattgaggaaattggatcaaaaaatcaaactggggaaatcacctttagttcatacttctaatttcatttactatgccaaagtatatcacaccatagaaaaagctttcctggatattatcgaaaaggacaacaacataaatgaaaaatactatgagttgaaaagaaactttaaaaattatttggaatatgaaatatctgcatacaatttgccagagtctattcttcatgccaacgacaaattcaaatttaaccaacgcttgaatagtaaggaactcatcatgaacaacccacaggttttattgcaagatgacctagatttggaatttgaagaagaggacattgaagcagaagaagaacaagacgatactgacgaagctcgaaattctgagaatgcatttgaagttgatgaagtcgtcaattctaaactcgattcatatgatagaaacaccctttcttcacctacggacctgctgatccgagttatttaa

SEQ ID NO: 1449 - DNA, 1143 bp, Candida albicans
ttatttgaaagcatgatgctatttttttttgctttctttctttcgttgctatttgtgtttgttttggtttttttaggttcgttggcgcattgggtcgtgtacatcattccagatatacgagcgctcataagagaagaacaatcaagaaatcaagaactcaattcacgtttattccaagctcccttatatataatgactgaaacatcaatattatcatataaaaaaccgacttcaaataagaattcttttccggtgccgggatctgcaccatcgacaccaatattgtctcattctggatcaccagctcctccaacaatacaactgccagtatctatcgactctccacgatcatcaaccctgacaacaacaaatgtgggcgcatctactagaaaagtatccgcaagaagaaaagctctacaagatttttaccatctaaatagtaatctggacaatgccacaacagatggcaacgacaccacccacgaaggaatttcaaaaatatcgaatctaaacgacattgacaacttgattaaaactgcaccaattgaagaaattttgaaaataagaaacgatttgagtgccaaattaaattcatccaatcaaactaaaaagtcgataatttatgacaactattatgaattgatcaaactaagcaacactttatcggatttgtccacatcaaaaccaagaaagaaatccgtctcaacggggttaaaaatatttgctgacgatgaagacaatggagaggattctggggacaaaaatttgactgaattgacaaaagagggatatgttgatcaagttcttaaagaattatctgaatttgcttctaaagaggccccagttttcaacggaacatttaacgatgtacttggaaaactaaaagagcaagacgaatcggataattccggcatgattgtattgaatgatgataaaccaacagagaaagaagaatcttccgaagatatagaaaaacagataagtcatattaattatatattgaatttgccattaaagacgaacatcaatgacacagaacgagaacaagcaattgaatatatcgataaagttatcttagataatcctgataatgaaattttatcattacagttaggtaaaataaaacacgacatcactacataa

SEQ ID NO: 1450 - DNA, 570 bp, Candida albicans
tttgttagcaaaaattgcatcaagatactcacctcagctccatttacaaaaaaaaaccttccacaactaggaaaaccgcgaaagcattggaaaaaaaaaattccactttttgattccatctattttaacatctcatcgctttctttcctacatcaactaataatgaagacgaacaattatatgtggaaacttgatttgttagaatccaagtttaataaatctacacccagatttcctcataccaaaaaattattaattgcaagtaatcacaatcacaaattattaaaaaaaattcctaaatcaccagaggatgcccaagtagaaattgaaaaaataaaatcagatatctttcaaaagaaatatcattcggcatattcaaaattagccaaggaagtggagaaaaagactatcccggtggacgataaagaatttgtatcaaaattgataacttcaaagctaataaaaataattcaaagtgcatgtttaaactccaaagaattgaaaacgaatcctccaacatatattggacagcatcttcgagaaattgtaattgacaaatcaaaggaatga

SEQ ID NO: 1451 - DNA, 198 bp, Candida albicans
cctggagcatcaatgacggtaacgtggtattttggagtttcgaatttccacaaagcgatatcaatggtgatacctctttctctttcagccttcaatttgtccaagacccaagcgtatttgaaagaacctttacccaattcagcagcttctttttcgaacttttcaatggttcttttatcaataccaccacacttgtaa

SEQ ID NO: 1452 - DNA, 552 bp, Candida albicans
ctcttatcaaagtctacctccgggctggtcaaaaactctgtcatctggctctttatagcatcaaatcgatgttcatcccagttctccttatccatcttgttaacagcaacacatatcttctctagtccaaaattcttggctaaaattgtatgctccttggtctggccatctaacgcaaaccccgcctcaaactcgcccgaaatcgaatcatcaaccaacaacgcaaaatcagcttgcgataccccactaatcatttgcggaacaaaatccttgtgtccaggagcatcaatggcagtgaatttggtggtgtcagtttcaaaatcagtggcacatatatcaacagtaacaccatgcgacctctcttcttcagtctggtccatcacccaagcaagtgcaaacgatcccttgccggcgttttatgcttccttaactagtttgttaactgtcttggcatcaataattccaaaatcatacaaaagtcttcccattaatgtggatttccctgcatcgacatgcccaataacaacaaaagacttgcgtggtttagcataa

SEQ ID NO: 1453 - DNA, 198 bp, Candida albicans
cctggagcatcaatgacggtaacgtggtattttggagtttcgaatttccacaaagcaatatcaatggtgatacctctttctctttcagccttcaatttgtccaagacccaagcgtatttgaaagaacctttacccaattcagcagcttctttttcaaatttttcaatggttcttttatcaataccaccacacttgtaa

SEQ ID NO: 1454 - DNA, 630 bp, Candida albicans
gccgtctcggccaacatagtggacagcaactttgagactggatccatcaattgcttagacattctcttttgtgtcaattcaagcaataaccataataaatcaggaacaccttcaccagtaacagcagaggtaggaacaatagaaacgtatttggacatgtttttgttttggaaatacaattccgagttcaaaccttgttctgcaagagctaatttgatttgttcatatctgttttcaaattcagcttgcactgatttggtttgcttagcaaatgaatctctaaaagagttatttggtatttctttccaatcgtataaacgatcaatcttgtttaaagcaacaacgaatggagcctttctatctctcaacaatcgtatagactctaaagtttgttgttccaaaccatgcataatatcaataaccaaaatagcaatgttacataatgaagaaccacgagatcttaagttggtaaaggactcgtgcccaggggtatcaataatcaacaaaccaggaacatcaaatgtttgcttttcgtatttggccatgacagcggtcttttgtttaatagcatcaactgggaagtatgttgcaccaatttgttgtgtaataccaccagcttcacctccttga

SEQ ID NO: 1455 - DNA, 336 bp, Candida albicans
ccttgtgcttgtttggctcttaactgcgataacactttgattggattacccccacagttttggattaaagttcttggtatgacttcaaaggcatctgcaacagcttggtatgggtattgttcaattccttcaatggtctttgccttttcagccaatctgacactacaagccatctcggtggccccaccccctggagacaatgaaggttcaaacatgacgtttctggtgacagccatagcatcatgtaagtttctttcaatttcattaaggatatctttggaggcacctcttaacaacacagtacaggcttgtgggttttcacatttgaccaaataa

SEQ ID NO: 1456 - DNA, 1011 bp, Candida albicans
acaaataaaatgtcatatcctactataccatggcccacatttgctgacttgaagcaaatgcttcacggattttgggcatctaaaccaacctacactgagtctcagtatccagatttacaggacaaggttgttattgtgactggaggtaatactggacttggttatgagacagttaaatctttagccggatctaccaaggctagaatttacgtgttctccagaaataaagagaagacactcgctgcaatcaaacaaatacaattagaaattgctgaagaatataatgttagtaacagtgacattcgttttattcaagtggacttgagtgatttgacaaccatcaaaccagctgtcgaagagtttttgaagcaggagcagagaatagatattattattcataatgctggtatcatggggccaccagttggatctaaatccaagcaaggctatgaattacaatggggtactaatgttgttggcccacatttattgcaaaggttattggatccattgttcatcaaaacaagtgaaactaatcctcctgggttcagcagaattgtttgggtatcatctacagctcacttgtttgcacctcaaggcggagtcttttgggataatgttaattatgagaatttgaaacttagtcaaactcaagtgagaaccaccctttatgcacaaagcaaagctggtaatttgattcaagcaagaacttggtccagaaaacacaattatcccaatgttatcagctcgtcgctttgtcctggttatttatacaccgacttgatacgtaatttgaacagttttgaacagtgctttgtcaaacgcttgatttacccaagaagatatggagcttataccgaattatatgcggcattctctccagacgtcaaagatggtgcacataccattgggtttggtgttccatctcatgcaagaacagacttgactagtgaagccgtaggtgacaaaacatgggcttatcttgataaagaaaccgatgcttatttgtag

SEQ ID NO: 1457 - DNA, 1596 bp, Candida albicans
tctatggcgactacaactaaaacgaaaaagaagaaattagtttatagacaagatcccgatggggtatttcgattaaagaaaatagacgacaacaattctataaaatcagttgatttggccaataagaaaaaagaggtggataattatttaaatgaattaattgattgttcttatagtattgttgatgatattcccgataaggaaattgcacgagaagaagaagaagaaaagattatccacgaaatcccaaaccctccttctacacaaccagaaccagaaccaaaaccaacaacaattaaaaaagttaaaccaactactgtaaatacttcttcgaaaaatcttacgatcaagccagcatccactccgcctcaacctgctgttgttattactgaaaaaatagcggagtctaaaacatctccacctacaccacctaccacacttccagaagcacaaccaccacaagaagaaaataaaacccaggagcaagaaacaccaataacgaaaattccatcccctacagattttgttacacacgaagaaactgaagagaatatagtagaagaagtaatcatacctgcaaaaccatcaataatgtctacaatacatgaatttttacgttttcatattcctagttttgtttttggaataatagctacagttataggaactcgatataaagatgaaattatttatggtgcaattggattgactgtacttgctactggtttagcaatagtgggtgttttaggattatgtctttgtttacatcttggtttggtaaaacaatctgatttgaaagtacttgatcgatatattgatattttaaaatttagagcaacagaagaaagaccccaagaaaagattgtcattaatgaagaagttgtggctgaaccggaaccggaaccagaaccagaatctcaaccagtggaaacttctgaagaagttgaaatggaagaattagctccagctccagcaccacaagcagaacctgaacctgaacaatatgttgttcatgacactgaggttatacgtgaaattcctattgaaccacaacctaagctttatcagccaaaactcaaacgaaacctgcattcaaaaaccactcctattcttgtaaaggatccacaagaaactggatatcaaccattagaggaaccacaaccacctaaacccaggaggaaatcatcaacaataagagtcactccatatgtatatgaacctagagaacctcgaaaatacagtgtaatacctactagtaacacaattccattaccaggagattcaccaacgaaaaccactaaacataaacttgtccatcctaaaccaatgttacaaagaatacaaacagaacccattaaagaagtttcaagaagaaattctaaaagaagtactgggtcagcatcaccaacatcaacaagaagtgatccatattacttattacaaaatgccccacaacatcatcaacatcaacaacaacatatttttaaagaacgaactcatgaaataccaccacaagttttcaaaactaaagatttacctaatttaccacatcaagctgaagaattaccatttattaatcgaagtaagattagttga

SEQ ID NO: 1458 - DNA, 801 bp, Candida albicans
gaactccagcacttgaataaggtaaagttcagactttatggcgacactactgatgccaatcctgctgtggtagtaagtaaccatgcatctttagcagactgttttgttattcactatttatcacgtatgtctatattaggggacgattattcgccgatgcgacaatgtgaacagttttcgcttccaataattaatttcttctcgtggtttctagtatggagagttcctacagtcaaaattttgcttcatatgttaaaatccgatgaaaactgggaactagaactgaagtcgttatcatttgttttttcacgattattaagaagcaaattttcagaatgggttgtgttgttccccgaagtaaacatttggacccccaatggagccgccttacagggccaagtaagcaataagtactttttgccaaaattcaatcacttgttgtatcctcgattctctgcgtttttcaatatcatatccatacttaaccaatcaaagccacatgcttatttaaacatgtacgacatcaccatcttatacacccgcaacggtcacggtacaatttcaaatcaatataaaccaccgactttgctagacatatttgccagtgctgaacctataacggtgattgtttatgtaaaaatccgttcagtgtcaagaatccctacaaaaagaaaaaagctagaaaagtatctagaacatttatggatacacaaagagaaagtgatctctcaattaaaggcagaaaatgatacccacatccaattacgtatatcgaaagataatttttctgtagctccgtag

SEQ ID NO: 1459 - DNA, 753 bp, Candida albicans
tacttaataatgaaaagttcaataaatttacattctcatacaattgatttatgtacattggaagaattaagagacccaaacttgataagtagatatccaccattatttcaacggaaacagaacttaattgccttggataattcaaccaaatcaatcaagaggtccaaaactgtttcaactccaattacaacaaataatagagccaccaacttaacacccatagtttcagcacctacttcaaattattatcaagtgcaatccacacatactttaaatagaagaccttgtgtggaatcaaaagaatcaatttccaacaagagacatcggtttgttaaattttggaaaaatatttcagcaaaatccaataaaatgtcacgacatgaatgtttaatacaatcaattagtaaaccggtggattattattgtcagcaacagcaacaacatcagccagctcttagtcctgatacatgtggttccatatttttgaatagtctatatccgtcaaaatcaagaaacacaattaatataaagccagatgatcacatgtcatatgaagatggaagaggttatgatatgaacaacagtactagcaataacaatgacggtgtggacaatttgaattatcatgatagtgaatttgatttatctcgaagaaatacatatatatcacaaatgaaatttcaaccaatgtctccaccacaagaattatctgctgttaattctattgttattcctccctgtgggtggaagtaa

SEQ ID NO: 1460 - DNA, 468 bp, Candida albicans
tctatttattttttcatttggtacgatgtaccaccaaaaaaaaaaatgttaatcatttcagaattcaatcctcaattaatgcattcggacgattccgaagacgattatgatcatcaatccagccacagaaactcttctaatggcactactactttcaatcaaataatcacttacaagggacagattttttcgcttaatgatgctttattaattattgaggcatgcaggctacagaaattacccatggtgacaagaaggttgaccgggattgaaagaaataaatttattaaacccaacaccgtgtttgtatggaacgaaacccaatgtggtatgaaacgatggactgatggcagattatggtcggcctcgaaagtctacaatggaaatttcttggtctataaacaatggaataaaaagactaaacgggaaccaagaagaagaggaatcaggtggccaagcattagttaa

SEQ ID NO: 1461 - DNA, 987 bp, Candida albicans
atggattaccaagatctactacataaaataataaaggagttccactcactcaaagagttcaaaccatgggatagcagtgttttgtatgagacgttactacgatcagtattaactactttgatcgaacttttgggcatagacaatccacccagttatctacacctcaccaccaacaatgatagtataggtgatttgaaaataaaatactatggaaatgcattaagcaagtcaatcaacggtcatagcatgttgcaatatcttgaatcaaagcatgtatcgatattacaggccgtggttgagattattaatacgcgatcatatagaatcaaagagtcttattctgctgttttcaaagacgtttctcatttatttgaaaaactactaaaggaaagatatgaagctgaatctaatctagaggattatatattgcagtgcttgatgtacgagacccaattttaccaaggaattgttgataatgttttaactgccgatgacaccgaaaaattggctagttttttggggacacgactatctgaagaagattcgatgtttagctatagggatatagattatccactagagttaaacattaataatgaatctcttgaaaagatatataaaattttcttaggagtcattggcaccaaaagattcgatatcaaggaggttgcgtctgctgttgttggtgtgtataaacgacaccagagaatagatcattttgaaaagttggattcagatgagattttgggaaagtttttcagaaatatattgccacaactgttccagagtgtgacaaataaggttttccgggaatttcacaaagaggtagatgacccaccattggacgtgctagaccagctagataatattgttgatgactttattgcggttggaattgaaggggtagatttgggctttccggctttgttcagacactacataaaattcatgaacgaaatttttccccactgtggtcgaggatgctga

SEQ ID NO: 1462 - DNA, 762 bp, Candida albicans
gaaaacataacccttaccctgacaataaaattctggattttggaagattttgtgaccccacgattcaaacacttggtagagcttatctcagtaaagtataatgtcgaatatgagtttattagttacaaatggcccagtttcttgagaaaacagaagaccaaagaaagaatgatttgggggtataagattttgtttttggacgttttgttcccacaagatctcaacaagattatattcattgacgccgatcaaatatgtagggcagatttgacagaattggttaacatggatcttgaaggtgctccatatggatttactccaatgtgtgattctcgggaagaaatggaaggtttcagattttggaaagaaggatactggtccgatgttttgaaggatgatttgaaatatcatattagtgcattatttgttgttgatttgcaaaagttcagatctataaaagctggagacagattgagagcacactatcaaaagctttctagtgatccaaattcgttgagcaatttagatcaagatttgcccaataatatgcaaagactgataaaaattttcagtttgcctcaaaattggctctggtgtgaaacgtggtgctcagataaaagcttggaagatgcaaaaatgattgatctttgcaacaatccattaactagagaaaataaattagatgctgctaagagattgatcccagaatggattgaatacgagcaagcaattgaaccattggtatccattagtacagaataa

SEQ ID NO: 1463 - DNA, 2550 bp, Candida albicans
acacatatttggtctcctttgccagtcatgtcatcagcaaattacatatcagatgaggtgccaccagatatggtttccccgcatgatcatacaccttcaaaagatgaacctttgaaacatttagataccgttattgcactatacgatttccctggaacccagtcgtctcatttaccactaaacttgggcgacactattcatgtcttgtcaaagtcagcaaccggatggtgggatggggtagtaatgggtaatagcggggagcttcaacgaggctggtttcctcataactatgtacgatcggtgaactatgtgcaaccggtgttgaaaaaactaaaagataataaagatctcgattcgataacagcggctaatacagctgctaatgtggtgatgccatcattgactaacttgattcaaaaaagtttacaagaatcagaacgcaatagtcctgcaaactcaacaagaaaaaactcggtggtgagttttgctagctctgagacaagcatgcccagcgactcaaaatatacacaacaacagacaaacacaaatcaaaactcacctgaatatcaactgatctcattaccatctactcgagatcacagcacggtggagatgcaaccaccttcgcagcagtcttcgatttcacacactttaactggatttggaattggtgacgacgaaatcattcctatggaagtcgaggaagcagagaaattggtggaagagtacagactcaagtataacaaaacagttacctggattccacgaacatcaaccaagggagatataatcttttactgtgaacaacttgatgtgtattgtgaatctctacctttgattttgtttgatggagaggcgtcgctgccaaatttggaatacccggggagcgatgtaatcatggatcccaccccaatttcagttcaaggttctcaatcgatggaaaatgtcttggatactcgagaaggatcagctgcaggctcgtttgattctaccaagcgtgattctaatgtgtcgatgagcactcaaagctccgggtcatcgtatcatcgtttcagtcgaccttttttttctgtggacaatctattctacaagcattcgtcggacataggtacgtggaatgaactaaaggaacaatgcaattatattttggatttgatgttgaaggccattaaagatcaaaataggcagtttttcagcacccatttttctcgcttgaatacacttgtggtggctttgtgtgccgcagtcagattgaatcaagaagactatattgatactaagtatgagaacactacaagaagaaagttaaaacgtgtgtgtgcctcatttgcccaaatttacataaacggtattttacatctaagtgtgttgcattactctcttgaagggtttaatgaaggtcgtttgtttggctacgacatgggaaaattgaacagatccagctccagcagtgcattccaatcgccagcatcatcactatcaacaatacgacagggttcagatgatagcactcgttttgctcaaaaattgagccaggacaggaatagtgaaggaaatggtgatatgaattacattaaccagttggtttacgaaattgataatttgcgtgagaatgtcaattccattgtgaaaatatttcttaagcttagcgctaataaaaaaattaagaattcggactatgattcgtcggatgcatcagatgatgaaggtgaagatcggtttgatattttgccccaagtatatcctcgttttttggttgacgaatttaatggtggcaactggtgtaacccatttttctccacgaagaataccgttttgaatgtcagtggagacgacttgaagaatcgctaccatacaaaaattataattgatcattccgcttacgattcactttcccagtatgtcgacaagatagttgatgcatgtgaaaacattttggaagctcttgatcccaaagttcaaaatactttttattataatgagatgctaagaaatgaaaggaatacgcaaattttgcggttaacttataagtcgctttaccactgcagtgccatggttgacttgatagaatcgtttgacttcactgtattctgtagtgtcaaaagacatactggtaatgcaattgatacggaggatgaaagttatgaaaatccaagtgtttggggggatcactatgattataatttatcgtttgaatacccagtcgttttagagtttttctgtttgaaacatgaattgcatgatttggttgcaaagatcatcatggcaacccaatcgttgactttggaagatcctgaagtctttaaaggtttgaaagaagaagatcctttattctataatcgtgaaatatcgaaaatacctaaggaaaaggcagcgctattgttatcctctattttgaaagaacaacttagctttaaagatggaggagatatatcactaaacccagacacattgttgtcagggtatttagtagagatagcgaagactaccaaaaccgtactcttgataacgcaacaattaattgaagaacgagaaacaatattcaattag

SEQ ID NO: 1464 - DNA, 1206 bp, Candida albicans
gtgaagattggggaattgatatctttactaattgctaggttcaatattgaacctccagaagggttgagctacgaggaatacaacctatgggtctcgaaaaaaaggaaccctattcgcttgagggtgataaatattatgaaacttttacttgaaaaaaattggtccatgtcgtattacaatgaacctgtacttcgcaggtggttgacgtttgctcactccgaccaagttcagacttattcattgggaaatttgcttgttaattatttagaaaggctacttcgtggtgagagaatttatgtcgaaagagatcctgtcattccaaataccaagcctcctgccccattgaccaaaggctcgtctttgctgaaaaagccaagggtaatggacattgattatgttgagttggcacgtcaattgacattacgtgagttcaaattatattgcaagatcacaaaatttgcatgtctagcgaaagtatggggtaagaagtcagggttcagtgagagcattgatagtatcactcagtttataaaggcttccaatcaattgactaactttgttggatacatgattttgagaaaggcggatccgaagaaaagagtccaaatcattcgttactttattcaagtagccgataaatgtcgacaatacaacaacttttcgtcgatgacagcaatcatttccgctttgtattcttcaccaatccatcgtttaaagaaaacgtgggagtatatgaatgctgatgcattgtccaatttaaagaatatgaataaattgatgaattcatcgcgaaacttcaacgagtatcgagatgttttgaaatttattggatcggagccatgtgtgccattttttggtgtgtacttatctgatttgacatttgtttaccatggtaaccctgactatttgtataacagaacaaggcaagtgaattttgctaagcgtgctaaaacctcagagattgtttcgggaatagaccgtttcaaaactacagggtataatttccaagaggtccctgaaattcagaagtttcttgatgcatggtttgaaaagtgtccaacgatcgatgaacaataccagatatcgttgaacttggaaccaagagaacaagcagttggtgccagtaacagtaatagtactacaaacgccaccaccaatatcaacagtttcaaaccggtgctcaccagccgtagcgatcatgtcgcg

SEQ ID NO: 1465 - DNA, 747 bp, Candida albicans
caaattgttatttctaatatagttgatcattctaccacaggagaaattgttccacaaaatataaaaatcattaaaaaagtgttaaatggttatgttgggtttgccaatttaccaaaacaatggcatagaaaatctattagaagaggattcagtttgaacattatggccattggtgaaagtggattgggtaaagccacattgattaatactttgtttaaccgtgatattataaccctgcaacacgattccgatgaatttgacgaaggtgaagaagaagatgtttctgtcaagatcaaatcaactcaagcagaaattgaagaagatggtgtcaagttgaaagtaagtgttattactgctcctggatttggtgaatcaatcaataatgtcgaggcttggaaaccaattgttgatgaaatcaatagtagatttgattcttatttagaagcagaatcaagaattaacagaactgctgttgttgacaatagagttcatgcttttctttatttcattgaaccaactggtcattcattgagagctttagatattgcattgatgaagcaagttcatgaaaaagtcaatttgattccagttattgctaaatctgatactttgactgatgaagaaattttagagttcaaacacaggatattagctgatattagtcatcaaggaatcaaaatttttaaaccaactgattttgaatatgatgaagaagaatctgctaacactagactgataaatagatag

SEQ ID NO: 1466 - DNA, 363 bp, Candida albicans
acccatcctgatcaagcttggcaatattatcaaccaatgttgcagaaactctccattaatgatgagccgattcctgatccaatcaacacaatagtcaccgattggacaacgaaaccatatatccgtggctcttattcaacaatgtacaccaacgatgatccaagtgatttaataattagtttatcaggtgactttgaagatttggggatcctggaaccttacattaagtttgctggagagcacacaacttcagaaggtactggatgtgtacatggtgcctatatgagtggtatttatgctgctgattgtattttagaaaacatctttcgtaacgatgttactggttataccattatcggttaa

SEQ ID NO: 1467 - DNA, 1521 bp, Candida albicans
ttcacatttatactcactgtttgtcattttcatctcatagtaatgccacaagtcactaaaactaataatgaaaatgagtttagacttactagatcaaaagtacagcatcaagagtcgataagtaccatcaaaaataccaccatatccaattctcagcataaacaacaaacacaacaacaaatttcatcaccacctcaagtctctgtaacatcatctgaaggagtttcacatgtcaatacacgtcaatatttgggtgatgtttcaaatcaatacataacaaatgccaaaccaacaaataaaagaaaaccattgggtggagacaatgcccctctacaaaaacaacagcatagaccatctagaccaatacccattgccagtgataacaacaataatggtagtaccagtagcagtagtaacagtagcaacaacaataacaacgacgcaaatagactagcatctttggcagttccatctcgattaccccaaaaacgacaagctactgaatcgtcgacaaatttagtagagaaattaagagtaccacaaccagaagtaggggaaagaagtcagtcataccataagaaatcacgtttaattgattatgaatggcaggatttggatgaagaagatagtgacgaccaattaatggttagtgaatatgttaacgaaatattttcgtactattacgaattagaaacacgaatgttacctgatccgcaatatcttttcaaacaaacattgttaaaaccaagaatgagatcgatattggttgattggcttgttgaaatgcatttaaaattcaagttattacctgaatcactttttttggcagtcaatgtaatggatagattcatgtctgttgaagtggttcaaatagataaattacaattattggctacagcagctttatttactgctgccaaatatgaagaagtattttctcccctggttaaaaattatgcatatttcactgatggttcatatactccagaagaagtggtacaagcagaaaaatacatgcttaccattcttaactttgatttgaattaccccaatccaatgaatttcttgaggagaatttctaaagctgatgattatgatgtccaatcaagaacgctaggaaaatatcttttggaaatcactatagttgattacaaatttattggtatgagaccatctttatgttgtgccctggccatgtatttagcaagactaatattgggcaaattgccagtttggaatgggaatttgattcattatagtggaggttatagaatcagtgatatgagagaatgtatcgaattaatgtttcaatatcttattgctccaatagaacatgatgaatttttcaaaaaatatgccatgagaaaatttatgagagcaagtactctttgtcgaaattgggctaaaaaattccaagcatcaggaagagatttgtttgatgaacgattatcgacccataggctaacattagaagatgatgacgaagaagaagaaatagtggtagcagaagcagaagagtaa

SEQ ID NO: 1468 - DNA, 1407 bp, Candida albicans
ttattaatcatgtttcctaattcacctgatgctttccatcaagttaggatgatgcaatccctgatcaaagcaagtaatttcaagttacaatcaatggaatttagatgtcattcaaataatgtatgtgaatatcaaatggaaatgttgcatcacttgttatcagttgaagctaaaacattgcctagtttatcattaattgaacagcaaccagaaatcaaattaggtatgagaccattgttgttggatttcttaatggaagttatcactattctcagcttgtctagatctacattccctttgactgtcaatttgattgaccgttattgttcaaccagaattgtcaagaaacaacattaccagttgttgggattgactagtctttggatcagttgtaagaacttggattcaaagttcaaagttcctacattgaatgatttgagaaaaatttgtgttgacagttattacaaagaattgtttgtggaaatggagaaacatattttaaaatcattagaatgggtcgtcaatgctccgacatttgatgcctttattgatttgtattcaaacttgttgatttctaacagcagtaactttgaggttgcaaacattataaaaaaatcatctcataaaataaaattgttttctaattatattggtgaattgttccagttttatccaaacatttattacgattacacatcgtcacaaattgctttgattgctattttaatcacggtcttgacgttgaagattcctgttgatttaattagtttgttgaacttttacaatggattggttaaaactgaaatgtttaaatccaatgttgaacaaggtgctgaagaccagtttgaggaaattctttcagttgactctttcaaatcattattcaataagagtttcttcaagaacttgatcaagataattgataatcctccaagcagtctcaagattaagtactttgctgagaatggtaaatattcggtattgatgaaacagttggtcactactgcttccaacaccttgaagtgtatattggatcctgttccaacaacaccaaaggctaatagttttgtcaaacatcaacaacaacaacaccattatcacccaagaccgccaatgagtatcaatacctcaatgattccattgacacctgtttccaatagcactagccctaatagatttagtcctgatcagatattttcggaaaatgagtctacacctggtattgcctttggtaccatgacacctgattcccaatcaacatcacctggggaaaaacgaagttatgaatgcattgatgagttagagattggcacatcaaccattgctggttacacactcaaaaatcatgatacattgaaaagatcgaagagtgctaattatggtacacttttctatcttcaacaataa

SEQ ID NO: 1469 - DNA, 651 bp, Candida albicans
atcatgactattgaatcaactaattcatttgttgtcccatcagatactgaattaattgatgttactccattaggttcaacaaaattatttcaaccaattaaagtcggtaacaatgttttacctcaacgtattgcttatgtcccaaccaccagatttagagcttctaaagatcatattccaagtgatttacaattaaattattataatgctcgttctcaatatccaggtacattgattattactgaagcaacatttgcatctgaaagaggtggtattgatttacatgttccaggtatttataatgacgctcaagctaaaagttggaagaaaatcaatgaagcaattcatggcaatggaagtttcagttcagttcaattatggtatttaggtagagttgctaatgctaaagatttgaaagattctggattacctcttattgcgccatcagcagtttattgggatgagaatagtgaaaaattggccaaagaagctggaaatgaattgagagcattaactgaagaagaaattgatcatattgttgaagttgaatatcctaatgctgctaaacatgcacttgaaacacgatttgaatatgttgaaatcccaggtggtcatgggtacttgttgggaatagtttttaaaatcctgccc

SEQ ID NO: 1470 - DNA, 1245 bp, Candida albicans
agctttaattattacgtacaaatcatgactgtcgaatcaactaactcatttgttgtcccggccggtactaaacaaattgaaattgcccccttaggatcaacgaaattattccaaccgattaaagttggtaaaaatattttaccccatcgtgttgctcatgccccaaccaccagattcagagctgccaaaaatcatactccaagtgatttacaattagaatattataaaactcattctcaatatccaggtactttgatcatcactgaggcaactttcacttctgaacaaggtggtatggatttacatgttcctggaatttataatgatgctcaaaccaaagcttggaagaaaatcaatgatgaaattcatgctaatggaagtttcagttcaatgcaattatggtatttgggtagagttgcaaaccccaaagatttgaaagatgctggattaccccttattggtccatcagcagtttattgggatgaagaaagtgagaaattggccaaatctgttggtaatgaattgagggaattgacagaaaaggaaatcgatcatattgttgaagttgaatatccgaatgctgctaaacgtgccattgaagcaggatttgattatattgaagttcatagtgccccgggttatttcttagatcaatttttgaacccagcttccaataagagaaccgataaatatggtggtagtattgaaaatcgtgcacgtttattattaagaattattgataaattgattggtatagttggtgctgaaaaattggctgttcgtttagcaccatggtcatcatttttaggtatggagattgaaggtgaagaaatccattcatatattttacaacaattacaacaacgtgctgataatggtcaacaattggcttatgtttcacttattgaacctcgtgttattgggatttttgatgcttcgttagaagatcaaaaaggtcgtagtaatgaatttgcttataaatattggaaaggaaattttgttcgtgctggtaattatacttatgatgccccagaatttaaaactttacttcatgatttagataatgatcgtactattgtggggtttgcaagatttttcacttccaatcctgatttagtggaaaaattgaaattgggtaaaccattgaatcattatgatcgtgaagaattttataagtactacaactatggttataattcttatgatgaatctgaaaaacaagtcattggtaaaccattggtctag

SEQ ID NO: 1471 - DNA, 924 bp, Candida albicans
cgccccgtggtgaggacaaacactggttatccggtacaacaaacggcgcaacagagaagcggcgataaactacagcaggttcattcccaacaacaacaacaacaacaacaaccattgtaccagcaatatccgccacaatctgtaggttacctagcgggtgatgtgtacaatccccaacaccaagaatatgtgcaaatgaatcaattgcccaatcagcattacaatttgcaacaaagacaacaggcacaaggacaacaactcaaactgcaactaaacgagcaaaatgccatgatgtctgcctcgactcaacaatatcctgtccaggattttacaaatccttaccccaatgcacagaatcccgcagaacaacagcaacagcaacaacctcttcgaacccagtcacaacaatgggacggctaccaatctcaacctttgtattctgctgctggtaatactataccatcctcaatccagcagcaaataccaccacagaatttgtctccatcagagcagcaacaagtcaagcaacaacagccactgccgccagaacaaggaacaaagaaaaaacctggtagaaaaccaaaattaagaaaattatcggaactgagttctgaaacaccacaagttccaaaaacagcatccagttcttcgagctcaccaactgcagtcaattctggtaaaccaattacaaaaagatcgcgtatgggatgtcttacatgccgtcaaagaaagaaacgttgttgtgaaacaagaccaaggtgtaccgagtgcactagacttcgtttgaactgtacatggcccaaacctggtacagaacacaaaaacaaacctaaggatcaaaaggatgacgaaaatacaattgaacatgccgagtttggtagaatcaaagttttgagaggtattgttgaatacagaagtaaataa

SEQ ID NO: 1472 - DNA, 2082 bp, Candida albicans
ctacaacaacaacgacgacaaagagtcagatatggtcctccacatcatgttagacgtcgaccataccatccaatacttgaatcattggaatttcaaaccaatcgacatttaattcaagaatattctttagatattgtcaatactttatctcaattggaatcacttacattagttaatcctgccatgattgatttacaaccagaaattcaatggtttatgcgtccatttttattagattttttaattgaattgcattcttcatttaaattacaaccaacaacattatttttatgtcttaatattattgatagatattgtgctaaaagaattgttttcaaacgtcattatcaattagttggttgtacagcattatggattgctagtaaatatgaagataaaaaactgcgtgtacccacattaaaagaattaacaataatgtgtcgtaatgcttatgatgaagaaatgtttgttcaaatggaaatgcatatattaagtactttagattggtcaattggtcatccaactttagaagattgtctacaattagccattgatctgaataatttatctaacaacaccaccaatgatattgaaaacaaaagtgtacgtcctaatcggaaatcaagtatatcatcagctgtaactgctgttgctaggtttctttgtgaattatctttatatgataaatattttttatcagtcccaccatcattaattgctattacagctaatttattaagttgttcaatgttacaaattcctcatgcttcaataactttgaaaaatttaattgaacaagaaattatgaatcctcaacaaaagaaacaaaagaaagctttctcctctaattcatcgaaaacaactactgccagttatactcatcaaaatcaactggatgtaaggcattccagttttgatgaagatatagatttagatagtggggatgaaggggacgatgatgaagattatattgatgaattttatgaaactaataattatgatgatactaatgcaactacttttgatgaaagtataaataaatccactaccattaatgatgagaaccaaccaccacaaattcatactccatttttaagtggattagatgaagattcaatattatcaattaaaaaaatatgtttaatgttgatcattcaattaagtaaagttactgaagtattatcaaagaaatatgaaaatttaggtgtgattcaagttattaataatttccattctaattacaaatttataattcaatcaatttatgaaaatcaagaattattactcaatacaataaatgattccactaacaacaatgaaattgattataaattgattcaatcgagtgaaatattattacaatttcctaaatttgatgaatatcttactgaagatgaagatgaaaatgtttccactgatgatgaagcaaatagccaacctcaaggttatgatggtagtggcagtgatgggaataatcaattatttactcccaaatcacctaatgccttttcatcaaattcgtcattaacattaaataatcatcctcaatcaatggttccggtaaccccaccttcagcaacttcacaatattcattattttgtaataaaaataatcgaactcatgaatctactagtggattaaattctacttgtaatactcctactcatatatcaataagttcatttgctccacctcaaccaccaccaggctcaatattaaaaccaaaactaacatcgattaacagtactaacagtttgaagattaataaattaactagcaatagtaattctagtaatatcaatatccatcatggtcatcacaacactacacaagaaaaaagatatagtcatattagtattggtagtaatagtagtagcaaatatgatgggttttctccaattaagtcaatatcaactaatggatcattaattactaataatggatcattaattactaataatggatcatttacaaacattgttaataataccaattcttcatccccattaatgaatcaacaacaacaacaacaagtgacccaatcatcattatatcaacatcatcatcaatatcatcaataa

SEQ ID NO: 1473 - DNA, 1305 bp, Candida albicans
taccagtattcaatcatgggttgtggcgctagtgttccagttgatgatgatgaaattgatctatttcttcaagataaacgtataaatgatgctattgaacaaagtttacaattgcgtcaacaaaactcgaaaaagggagtcaagttgttgttgttgggtgctggtgaaagtggtaaatcaacagttttaaaacaattgaaattattacataaaggtgggtttacccaacaggagagaagacaatattctcatgtcatttggtgtgacgttattcaatcaatgaaagttttaatcattcaagcaagaaagttgaaaatcaaattagattgtgatcagcctaataattcattaattccttataagcagattatattacgaagcgatcctttaaaacaaatagatgctgatgttgctggtggtacagatttcctaaatgattttgttgtcaagtatagtgaagaaaacaagaacaagagacggttgaagagtactgggacaacagatatatggggtaaagatgacgattccaatatcaattcagatgcaattaatcaagctttggaactgtctttgaataaagattctgaacagtttactcgtctttccatagctgaagcaatccataaattatggaagttggactcgggtattaaaaagtgttttgacaggtcaaatgaattccaattggaaggtagtgctgattattatttcgataatgtcttcaactttgctgatacaaattatttatctactgatttggatattttaaaagggagaattaaaactactggtatcactgagacagattttttaattaaatcgtttcaatttaaagtgttagatgctggtggacaacggtcagaacgtaaaaaatggatccattgttttgaagacatcactgctgttttatttgttttggctatctctgaatacgatcaaaacctatttgaagatgaacgggtaaatagaatgcatgagtatattgtcttgtttgattcattgtgcaactccaaatggtttgcaaacaccccattcatattatttttgaacaaaatcgatattttcgaaaacaagatcaaaaagaatccgctaaagaattatttcccagactatgatggcaaaccagacgatactaatgaagcaatcaagttttttgagacaaattttttgaaaataaatcaaaccaataaacctatctatgttcatcgaacgtgtgctacagattcaaaatcaatgaaatttgtcttgagtgctgttaccgacatgattgtacaacaaaacttgaaaaagagtggtattatgtag

SEQ ID NO: 1474 - DNA, 948 bp, Candida albicans
attttgaaaattggggattttcatttcacaaatagggggaaaatttttggggttcttcgggttcaggttaaaaatacagctattcttaagcaaggggagggattaattaaggttgaatgtgtgcttattcaaattcaaaaagcggctggtaatattgcttttggtactgcttatcaaaccatcactaataatggccaaatttgtttgcgtcatcaagactttgttccagctacaaaaatcaaaggtaccggttgtgttactgctgatgaagacacatggattaaacttggtaatactattttatcagttgaacctactcataatttttacttgaaagatagtaaatcgtctttgattgttcatgctgtttcaagcaaccaaacatttactgtccatggttttggtaatggtaataaacttggtttgactcttccattaactggaaatagagatcatttccgttttgaatactaccctgacactggtattttacaattaagagctgctgcccttccacaatattttaaaattggtaaaggttatgattctaagttgtttagaattgttaatctgcgtggtctcaaaaatgctgttacttatgatggtcctgttcctaacaatgaaatcccagctgtttgtttgataccatgtaccaatggaccatctgcaccagaaagtgaatctgatttgaatactcctactacatcatcaattgaaacaagctcatacagttctgctgcaactgaatctagtgttgttagtgaatctagttctgcagttgatagcttgacttcatcctccttatcatcaaaatctgaatctagcgatgttgtttctagtaccaccaacattgaatcatcttccactgctattgaaactactatgaactcagaaagttctactgatgctggttcaagttctattaggtcttcaccaccgggatggaag

SEQ ID NO: 1475 - DNA, 1986 bp, Candida albicans
gtgactagatggacgggacttctcccgaataaacgtttcttctttatattgacttgtttcaggagtgtcaaaaaagaaatttttcggggcagatcccccttacacactcttctagaacatcaagagaaagaaaaccaaacccatttttgcaactggtttactatatcttcattacagaaacaaattctaatctatacacctcagaaaactataaattcatccaatatcctctcccgtttttcacaatttcaattctttttcatcactacaaaccaatcttcaatcttccacatgcaactattccagaatattcttgtttccattgctttgctcacacagatagtttttgctattgagatcaccgaaaacaaggtcgatcgaggcacagtcaccttgaacttgagcgacattaccatttaccctggggcttcctggtctattatcgacaatgcttacaccagcttcgttggtaagttagacgtcagggatggtgcggggttgtatatctccctgacctctcatcttttggcccttcaagtcagtttaacaacattgctccactccatcaccaacaacggagtcgtctcctttgactcgcgtatttccagaacctcgtcctcctatgacttgcaaggcgtctccttcaccaacaacggggaaatgtactttgctgcttccggtgagttctccagctccaccgcactcacttctgccctgtggaccaacaccgggttattgctgttttaccaaaatcaaagaacctccggcaccgtaagtcttggtatgcccttgggatccatcaccaacaacggtcagatctgtttgaataaccaggtctacgaacaaacaacccaaattaagggttcgggttgtttcactgccaacggcgactccaccatttacatctccaacgttttgttagctgtttcccccaaacagaacttttacttgaccgacaagggttcctccatgattgtccaagccgtatctaccacacaaacattcaacgtctatggttttggggaaggtaacaaaattgggttgactattccattgatgggaaatctctggaactcagcatacgcttatgacaccacttctggtatcttgaccttgagaaatcttttgcttgaacaaaaatttaacatcggtacagggtacgatccatcaaaattccaagtggtcactgattcaggttctggtatcccatccacaattttagggtctgttgcatattacgggcgtgttccagaaagaaccttaccaaagtcttgccagattccttgcaagccaataccagaggctccaggaaccacaccaacacaatacattactaccatcacaaaaaccaacactgccggtaacaccgtcaccgaaagcggtgttgttaacgttctgacagataaaggcggctcatggttcaccaccacctcaatgttcccagcatggtccactgccccatccactgcaactgttttctctagtgacaccattatgtcaacagttgaacctgataccacagaattggcctcactcacagatatccctatcgaaacatcatcagttgaagagttgttaagtgttatgtctaattgggaaccatcttctgctccaactttatccattgaaacacctgtttcaagtcaccactattatatgcaacattcatcctttgaatcttctgctgatatcaataccgtattttccagcgagtctgcatttgaaacagccagtggctatattgtttccatgccttcactgatttcacattcaaccatggtacctcaatcgtctgtttctgccttgtccgttgttagtgagtcgctcgcttctgctgagccatcatttgtcgtcccaagtgaatcattcatattcagtgcatcttctgctgccccccaaccatctagcagtacttattcagtctcattcaccacacaatttgaaaccccatcttctgctggttcctcattggttacttgctgttga

SEQ ID NO: 1476 - DNA, 2934 bp, Candida albicans
atagaaaaccaccaaaaagaaaccaactctaatctatatgaattgaaaaactataaattcaaccaatatccattcctgttttccacaaaaaatttttctagattaagtctttcccatcattacaaaccaatcatcatccgcaatatgaaattgttccagaatatccttatttcaatcgctttactcactcaattaatttttgctatcgaaattgctgaaaataaagttgatcgtggctccatcactttaaatttaggtgatatcattatttatactggtgctacttggtctatcattgacaatgcttataccaattttgttggtaaattagatgtcagagctgatgctgggttatatattaccctgacttctcatcttttggcacttcaagtcagtttaacaactatacttcattccatcaccaataatggtattatctcctttgattcacgtatttcaagaacatcatcttcttatgacttgagaggtatttccttcactaacaatggggaaatgtattttggttcttctggagaatcatcaagttccacttcacttacttctgctctgtggtctaatactgggttattgctgtttttccaaaatcaaagaacttccggtactgtaaatcttggggtttcaatgggatctattactaatgatggacaaatctgtttaaataatcaagtttatgaacaaacaactcaaattaagggttcgggttgtttcactgctaaaggggattccactatttatattgccaatgttgtattagccgtttcctccaaacaaaatttttatttaactgataaaggttcatcaatgattgttcaagctgtatcaaccacacaaacatttaatgtttatggtttcggtgatggtaacaaaattggtttgactcttcccttagttggaactattttcaattcagctttcacttatgatactgcttctggtattttgactttaagaaatactttgcttgaacaaaaattcaacattggtacagggtacgagccatctaaattccaagtggttactgattctggatcaggtactccatccacagttttagggtcagttgcttattatggccatgttccaacaagaactttacctaaatcttgtcaaattccatgtaaaccaattccaaaagcaccaggtactcaaccaacagaatacactaccaccatcacaaaaacaaatactgctggtaacactgtaactgaaactggtgttgttaatattctgaccgataaagctggatcttggttcaccaccacatcaattttcccaaccttgacaactgctattgctgcacccacctcaactgctatgtccactgatttatcttctagtgtcaatattcctgttgaaacttcatcaaatgaaagctcatcaattactttggcaagttctgaatcatcagctgttcaaacttcatccattgaaatcccagtttccagtcatatttctgctaatcaagagtcatcttctattggcgaatcctctgttaatggcagtactatgatttccagtgaatctgctcttgaatctgctagtgaatttaccattgctcaatcttctgatgttgaatcatattcttcgagtgaacattctattactcacgaatcttctgctatcacctcatcatctactaccattgagacacatgttactgaatcatccgttgttgtggactcgttcacttctgattcattgtttgttagtgaaacacaagatcccaaagcatcttctttttcgattgtcacaccaagtgattctataattgtcaatgaatcatctatccctgaattatctaccagtgttggtgcagtctcaacctcaacttcatcttctgaaatatcatctaattcatatttccctagtgaaacacatatctcaaaagtatcttcttctgctgaaccaacatttgttaccccaagtgaatcaataattatcaacatttctgaaccagcagttagcactgattctgtccaaccatctactgaaccacaacctgatatgtcatctgtgattgctgaatctttaatttcatcaactgtcagtgctctggaaatagaattatcatctactatggaattatcccattctgaatcattgttagccaaacaatcagaaactattaatcaatctgaatcaaattacattagtgaaacttcagctgttccaactgcaaaatctactatttctgacagtaaattaacttccacttgggaatcttctagtttagtcaatttggagtcaacatattctgttgtcatgagtgaatctgaaataactccaattcctgttcatacttctgaatcagctaccgaatcagctgctgaatctagtgatatccagacacaatttacttcaacttggaccaccacaaaatcagatggttcttttgtaactgagtctggtgttatcagtcaatctggtacttcttttaccactattgccacattcccaccattatacacatcatcagacattaccactgagtttatttccacttggaccgccactaactctgatggttctgttaccactgagattggagttgttagtcaatccggaacatcgttaaccaccattgctaccttcccaccatcatcgactgaatcaggaattaccagtgaattcatttctacctggactaccaccagctcagatggatcggttgcaacaagatctggtgttgttatccaatccggtacttccttaactaccatagccacatttccgccaatgtctacttcatctgacatcatcactgaatttacttcaacttggaccactacccattctgatggatcgataactactgagtctggcattgtaagtcaatctgggacttcattcactactttgacaatttttgaaccctgtcacttcattagctgtgccgtcatatactgtgattga

SEQ ID NO: 1477 - DNA, 882 bp, Candida albicans
aaaagcatgtttctgtactcacaagctataagatttatcattttcttgttacctatatgtttgactttcaaaattacggagaataggattgatcgtggtaaattaaattttgagatacaagatattactataaaatctggtgccttttggtccatcgttgacaattctatctgcactttttttggtagcttgatggttgagccccaagctagtctttatgtttccctgacttcccctattttggcacttcaagtggcctttgtttccattcttggtgtatttcacaaccaggggaatatcacattcgactccagtgcttcattaacatcagctacttacaggattattaccctgacatttcgaaatactggcagaatgtttttttcagcatctgggaagtttccaaatacgatggatattgttgcatcagattggacaaataatgggcttttgagttttcatcaggatcaaagaactagtggtgtggtctcacttggttcagctttggggaccataactaacaatggtcaaattaagttgagcaatcaagtgtaccaacaaagaactcaaattagcggttccggttgctttgttgccataaataactctactatttatatatccaattcgttattgccggttcagataacacaaagtttttatttggctgatagcacgtcttccattatagtggattctttttcggccactcaaacattcaatgtttatggatttggtaacgggaacatgattggattgacactcccgcttgttggtaattactggtattcctcatatacctatgatgctacaactggtatacttataatgagaaacgtatttttggaacagatcttcaccccgcggctggaaaatccaacg

SEQ ID NO: 1478 - DNA, 294 bp, Candida albicans
  unsure (16),(18),(20),(24),(27),(114): Identity of nucleotide sequences at the above locations are unknown.
ttgattcgacgggaanananaggnaanagggaaatttcacacaccaaatttttttgtatgggcgggtgtgcgtgcgtgcgtgggtattacgtgtcatttgaaatgtcccctganacaattcaacacagtaattctacccaccaccaccaaacactaacaacaacagtaataattttacaaatcaagtttgcagaagctacacgtcaaacagctaatgacatcacgtgggcagcagtagtaatagtagagagagatcaaatcaaatattgtatgggtaaaattagttttagctga

SEQ ID NO: 1479 - DNA, 594 bp, Candida albicans
tcatatcctcaaatgttttcatctttccaccacattttttttttttttagtcttcctcgatccattagttttcatcctaagtatatcaaatacttactactcactgctactacagacgtactagtatttatcttgacgaaattggtaatagttgattggccgaattgttttaataattggtcggaagtaatcacaagaatgagtgtcgatccaactactagtaacaatcaaactaacaatcaagagctctccaatctcagtttacaaattgacgaaaccagctcctctaatgttgaaaggaagaaaagaccacttaatcttatcccttcactgccaccggagctgcccaatgcaagagattcaacaagtgacaatatgatttatataggagaagaatttacagaacatcttgaacaactggaagaaatggaagattgttttcagctgattaatgagatatttgaaattattcaacaacgggaagtatacgataacccagagttcgaagtcgttgccaaaagacttactttacttagaatagagattgagaatttggtttatagtgagagaaactcaactaatcctagtcagtaa

SEQ ID NO: 1480 - DNA, 393 bp, Candida albicans
gacgaaatcggtagtagttatgaccctcaatttgatgattatgttaatgatccagatggttttgaaagtcgattgcaagaagcaatggcaatgagcagttctccaattattagtgatgaggaaaatgaaaatcaagagatttccaattccaattttcaaaatggggaaaattttttttcacgagaagaaggaagatcaattgagctgctcccttcgctgccacctccatcgcacaatacatcagtttcaacaagtcgtgatacactgaatacaacaagtcgtaatacgcagaatacgacagcaaatactacagaatacgatccagaaatcgacgagcccatccgtgaaagccttgatatttaccatctgctcctttctattaaaagaagatga

SEQ ID NO: 1481 - DNA, 237 bp, Candida albicans
atattagtactgaacaatggaaaagcacattggaaaaattacaacaaaatggtcaaaaataatgaagcttcattggatttccttcatcggtttacctcagggcactttacacattacaaatccaacaacaaagtttgcgacctatgcaaacaaccctacactacaacatctttggaacatagatacgaaaaatgtccatttgctaaactattgtggcagaagttcgccccccactaa

SEQ ID NO: 1482 - DNA, 345 bp, Candida albicans
atattagtactgaacaatggaaaagcacattggaaaaattacaacaaaatggtcaaaaataatgaagcttcattggaattccttcatcggtttaccttagggcactttacacattacaaatccaacaacgaagtttgcgacctatgcaaacaaccctacactacaacatctttggaacatagatacgaaaaatgtccatttgctaaactattgtggcagaagttcgcccccactaacatgcgcaatcactttaggtactacatagcaaatctactactaacattatcacaatcacaacaactttcaaaattcattgctgccatagctgctatggaacagaaatga

SEQ ID NO: 1483 - DNA, 1215 bp, Candida albicans
caatttttgattttccccaatttcaaacatagaggattgatgattgattcagttcggaactttttaacagtggactcaatacttgaacaaatagatattatggccttgtcaaaaatgaactccttacattggcatttggcggattcacaaagttggcctgtggcattagaaagttacccacacatgataaaagacgcatacagtaatgatgaagtttattccaagaacgacttgaagtatattgttgattatgctcgtgcaagaggtgtgcgcgtgattccagaaattgacatgcctggtcatgctagagctggatggaaacaagtcgacccaacaatagttgaatgtgctgatgcattttggacagatgccgctgttgaaccaccaccaggacaattgaacatcgagtcagagaaaacctatgaggtaatttctaatgtctacaatgagttgtcggatattttcattgatgatgttttccacgttggaaatgatgaattacaagaaaaatgctattcggctcaacttctgccaaataacacagttacagacttgttaaagcgatacttaaagaaagctttgccaatttttaataaggtcaatcaccggaaactaaccatgtgggacgatgttttactatctgacgtatcagcagacaagatccctagcaacatcactttgcaagtttggcatgagattagtggagtcaaaaacttgacttccaggggatatgatgttgtagtgtcgctgtctgactttttgtaccttgattgtggtaacgctggatgggttacaaacgatcctcgatatgttgaaaccccagaaaacgttgactttaacacaggtcaaggaggaagttggtgtggaccttataagtcttatcaacgaatttacaactttgatttcactgctaatttgacagaaacagaaaaaaaccatgttttaggtgctgaagctgctttatggtcggagcaagttgattctactgtcttgactacaaagatatggccacgtactgcagcacttgctgaattgacttggagcgggaacaaggattccaacggacaccacagagggtatgaattcactcaaagaatattaaacttcagggagtatttagtcaaattaggatacggggtttctcctttggtgccaaaatactgtttgctcaatccacacgcttgtgatttgtacaaaaatccaccagtttattga

SEQ ID NO: 1484 - DNA, 999 bp, Candida albicans
aaacaaatgtccaaaggtaaaagagcaccttatacacggccctgcgattcttgcagttttcgaaaagtcaagtgtgatatgaaaaccccatgttccagatgtgtccttaataacttgaaatgtacgaataatcgaatacgaaaaaaatgtggtcctaagaagatccgtgatagaactcgagaagcaattaataatctaagtaataaagaagatcccaaaacaaattcatttatcccgcatttccagttggacaagttacagccctgtttggagacatatcaaacttggtattatggaatttggccggtcttgtcgatctcagatttgaatatgaaaattactaaacgagatgtgtcagcttatgcacttgcctgtgcattaagtgcagcaatactcaatcaaatagattttattagtaacaatgggacctattgtatccccgaagacgttaagaaattggactttattggtgaatgtattcgagctcgcacgtttatgaattatcaaatgactcccacccttgagacaatattgacatcattttttttacatgtggctgaagtgaataaaggtagcaaaccagcggcaattatttatttgagagaagctatcacaatggctcagataattggactacataatgaatcgacatataagctgaaaccagttgctgaagcacatcgaatgagaaaaatatattttatgttaatggtcacagaaaggtttatgtgtattgacgatttgatccctgttgttcttgaaaactcgatcaaagagttttcgttggatgatgaacaatattcagtattaattgatggattcaaagagttggtcaaggttttctccatccctctgaaagccattttcgacagatttatacaaatgaatgattcaatatccatgcctccagagaccgctgggttactcaacaaaatacaactagaactagagtctatttgtatatcaccagtggcaccagatatccaaaaggcatatata

SEQ ID NO: 1485 - DNA, 2577 bp, Candida albicans
gatcagtgtaattccaatatgtcgacgtcacagccgtcacaacaacaaaacccagaacaagttgtcaatgatattaggcaaaaaatagaaaaagaacggaaaatcattcaaggtttcaatgatgtcaaaagaaataccaacaatccagaggtgattcagaaatgtaaatcgaaaatcattgaatcacaatcaatgattgattactaccaagaaactatgaacaaattaactcgacagatgctgcgtttaaatactaattccagttcacggacagctagtaggagctcggtcatttctgagtacaagccatcgtactccaattttgatttgattaaatacgaatgtccctcacttggtaataagattcaatttatgttgcaatatttggaattcaaactccaagtcgaaaataagtattccgaggccaataaaaaattgtctcatctttatcttatggatggtgacaaatcttccagtaatgctgctgaaggtggtagagctgagagtgatcaaagaattcaattgttggaaaaagctttgaagaaatatcaagtgtttagtatcaatgaccatgaatttgaccgtgattacgaaataatggacagtacaaaacattcgagaaagttgttaactggtagattgactgtttccatcacatgcattagagatgttgatcacatagctactgcattagctaagaagcgtgagacagttgtggtaattaaagttgatgatctcgagaaagctcgaacaaaaccatcgaaaaatgataattggaacgaagaaatggtgattgatgttgataaaagtcacgaaatagagcttgctgtgatggataaacaaaatggaatttatgtccccgttgctgtaaactggttttcactttttgatttagcagaagagatacgtaaaaagaaagttgctaaagatcagggctccagtgggtggttgcctgcagccaatttacctcaaactggtggttctggtgctggtactggctcaagtatgactggtggggctagttatggagcaacctcgcctctcccagcccataatgacttgagaccttcagtatctccttcaagtgatgctaaagaaaacaaagttctggtcagtacttggttgagcttagaaccaggtggtcaaatgttgattaatttgaattttgaaaaatcaataaccaatggaaagcaatttagaggaccattaggacgtcatggggccatccgtcaaaagaaggaagaggtatttgaaaagcatggacaccagtttgttcaaaaacaattttataatatcatgtcctgtgccctttgtggagagtttttacgttacacgggttatcaatgtcaagattgtaaatttttatgccacaagaaatgttatcaaaaggttgttaccaagtgtatttccaagtcaggctccgattatgatgctgctcagttgaaccaccgtattccgcataggtttgagccaatcacaaaccatggtaccaagtggtgttgtcattgtggttatattttgccatggggtaagaagaatgttagaaagtgtactgagtgtggtgttatgtgccatgcccaatgtacacatttggttccagacttctgtggtatgtcattgcaaatggctaatgagattcttgcaacgattgagtcaactaaagtttcaccaaagaaggcacaacatcagcaatcacatgccaagccgttaccacctaaaccaccgattgaaagcaagccatctatggattcagaagaaactttgcacaatgagccttcgtataaatctttgcgaccagcgtcagtggttcatcaagacactaactttgtttcaaaattgcctactacagttcaaaataaatatcaggaaccagtagagttaccaccacaacaacagaatcaggtcgttccttctactagacgtcggggtcatggactgactgaccttagttttgaaactggttacggtcaacaacagcaccagcatcatcgtgatgtgccacagattgttgttgaagaccaccaacattacaattcaaatgataatagagatgtcgaaatggaagaatctaaggatgaatttgacaactttgactataataacaagtacaccgagaatgaaattctcactgatgttcaacaagaccaggtccgtagtccctttgctgatcaaatacaaggtgttcctgaaacttctcatgcaaaacagcagaatcaacaagtacaacaagtacaacaacaagaagaacttggccatcaacgtactcattcttcaggaaaatttggcaagtctaagcgtcgcaaaagaaaggttggattagatgatttccaattcttggctgttttgggtaaagggaattttggtaaagttatgttggctgagtcgaggcatactctgaaattatgtgccatcaaagtgttgaagaaagatttcattgttgcaaatgatgaggccagaagtgttaagtctgaaaaacgagtattcttaacggctaataaagagatgcatccatttttgttgaatttgcattgttgtttccaaacagagaatagaatctactttgttatggagtcttaa

SEQ ID NO: 1486 - DNA, 273 bp, Candida albicans
  unsure (17),(33),(41),(125): Identity of nucleotide sequences at the above locations are unknown.
ctaattggtaaagaatntgattcatcaagaaanagaggtanaccatttacttgtactgttggtgttgttcaagttattaaaggttgggatatttctttaactaacaattatggtaaaggtggtgntaatttacctaaaatttcaaagggaactaaagcaattttaactattccaccaaatttggcttatggtccaagaggtatcccaccaattattggtcctaatgaaactcttgttttcgaagttgaattacttggtgttaatggtcaataa

SEQ ID NO: 1487 - DNA, 381 bp, Candida albicans
attacaatgtctgaagaacttccacaaattgaaattgttcaagaaggtgataacaccacatttgctaagccaggtgatactgtaaccattcattatgatggtaaattaactaatggtaaagaatttgattcatcaagaaaaagaggtaaaccatttacttgtactgttggtgttggtcaagttattaaaggttgggatatttctttaactaacaattatggtaaaggtggtgctaatttacctaaaatttcaaagggaactaaagcaattttaactattccaccaaatttggcttatggtccaagaggtatcccaccaattattggtcctaatgaaactcttgttttcgaagttgaattacttggtgttaatggtcaataa

SEQ ID NO: 1488 - DNA, 1401 bp, Candida albicans
acttttattacttttttccccaattcagcaactaacttactgaaaaactttatgatcatggaaaagctcggatttcataaagtatcgaatagtccatcatcaccaagtcaacctaaaatcactcataatcgaccaatccctcatcctcaatcaccaccattaccacaacgaccattgagtgaaccattaaagaagcaattattggtcgacaattctcctgggaacgatgttgtcattgccaattgtgttgctgtcaatgctcaagattttcaaaatatccctgatagagctccagttattttagatggagtctttgtttattctattgccaaagatgatcgagttcgtcctggaactattggattagccggtaatatgagaacatggggtaatggttcattagttcaaccagtgaatgttgaaaattataatattttccataatggacaacaacaacaatatcttggggccattgatttactgattgattttagagctaaagctagagctaatctgaatccaattaatcatgatgaattggtggctttatttttgaaaaattatgaaaatcaaattttacaacctactcaagtcatttatatggaatatacagggatttattttcaaattagagtaaacaatgttcaaattattgatgttaatactaaagatcaattaccaagtttcaaagattccgacgatataaataccaaagggatcttgatcaaatctactgatgttgggttttatccatatgaaggatcaattattaatttgactaaaccgaaaactttaaaacaaagaatgtttggtggatcaactcctcatcgtactagtcgtagaaaacaaattattaaccctgattttaaattagaagatttaggtattggtgggttagatgctgaatttcaagatattttccgtcgtgccttcaattcaagaattttaccaccagaattagcagaaaaattggattataaacattgtaaagggttattattatacggacctccaggtactggtaaaacgttgattgctcgtaaattatcgaaaatgcttaatggtaaagaacctaaaattgtcaatggtccagaaatgttgagtaaatatgttggtgcatcagaagaaaatattcgtaatttgtttaaagatgctgaagcagaatataaattaaaaggtgaagattcagatttacatgttattattttcgatgaattggattcggtatttaaacaaagaggatcagggaaatccgatggtactggtgttggtgataatgttgtcaatcaattattatcgaaaatggatggtgttgatcaattgaataatattttggtgattggtatgactaatcgtttggatttgatcgatacagctttattaagaacctggtacatttga

SEQ ID NO: 1489 - DNA, 1041 bp, Candida albicans
acgttgtccttccaccgtctggtgaagatgtctgctcatgcatactccacctcaacaatgacaagaacaactcgtatagatacacaagaagctacaaagcataaggatttaccaccagtgccttcaccattatcattatcatcgaatccaaatccagaatgcctaatggaatccaaaagtctaggtaggaagaacttcaaaaagctttcactagatgcatctccagtcaaatcaacaagcggtagcctaaggagttctgatatgatgctgataaaggagccgacttctttacgacaaaagagacaacgcccgccacctatacttcatttacccactgcatcttcatctgctacgtccactccaacatccaatataacagggtcttcatcagcttcttctatacaatttgcacagaaatcccctgggtcaggtgtaattgtgagtcaaacattgagccgaccttcaagtgccggaggcattccatcttcaggttactcttcattgaacgtcaatcaaagcaataggaatgttgatccaggtaatgtggtttccaccgatatgatattaaaccaaatatccaatttagatttaacaagtatgaaccatcatcgccagcattatcaaaatagccatcaccatcttccaacaaccaatcgtagacgtcaaactgtcatttcctcaatatcaccaacaaaatcatcagcagcatcatctccgttggaaccacaaattcaactgttgccagcttcatcgcagtctcctattgccactaccagtgcattaaagttaaacaataaagatttgttgacgttaaaacagttgggatcaggaaactcaggatcggtgctgaaaatcttacacatccccacccaaaaaacaatggcgaagaaaatcattcatattgatctgaaaagtgtgatacaaactcaaatcatccgtgaattgagaatactacatgaaatggccatctcccttatttcattgaagtgttatgggagcttgtttgtaaccataacacccccattgtttttggtttggaat

SEQ ID NO: 1490 - DNA, 459 bp, Candida albicans
caagttaaacttgaagaagaaaaagaagcaaagaaattcattgaacatggagagaaatttggcaaaattataactcaattgggtgatttgaaaaaggtggataagttgactcatgagattaccagcaatatagaggaggaccataccaaactaattgaagagattaatcaaataaaagaaaaatacaacataaaatcatggccaactaccgagtctacagttgatcttggcttgaatgaacctatattttccgacgagaaagaaaagagattatactttatacaatacatcttgaatgagttgatgaacaatgccaagtatgaagaaataagaaagtctattgttgaaagcaagttgaaaaagtcaatggaagaagttagcaaatctatacaaaagaatgttgttagaagatacttgttagacactagaaatgaatgtccggttccattacctcaataa

SEQ ID NO: 1491 - DNA, 390 bp, Candida albicans
actacaatgtcagtcgaagttgatggatttaacgcttccgctttattcaaagaattgaacgaaggtttacaagacaaatcaaaggctcaagaagctatcaaaggtgtcaatgccgttattgtcattactttaaagaacaaagaaggtaaagatcaaagttgggttttagacttgaaaaaagaaggtactttgactaaagttgaaggttcagttccaaaaggtgatgttcaattacttttaaaagatgctgatttcgttaaattggctaatggtaaagctaacggtcaaaaattattcatgaacggtaaattgaaggttaaaggtaacatgatgaaagctactgccattgaatccgttttcaagaaattggacccaagaccaaaattgtaa

SEQ ID NO: 1492 - DNA, 486 bp, Candida albicans
gcaattttcttcacagcgatattgttgttgctatcattacctgtattaactgcgggagttactttattattaatggaccgtaacttcaacactggattctacgaagtagcagctggtggtgatcctatcttatacgagcacttattttatgtaattacattagggatcccatgctgctactttataagtatgtatttacatactaacctccttaatgtagacattaaagaggaaggatttatatttactaagttttaccaactatatagtaaatattatcctaataacccattaccttcagaggaattccttacttggtttatagggttctttgaaggtgatgggacattcgttataggtaaacatgagaaatacttaaccataatacaacctgctataaataaacatgtcttaacatatatatgttctaacttaggtatcggtaatatagatgttcattctaaaggtaacaacacattaagttga

SEQ ID NO: 1493 - DNA, 186 bp, Candida albicans
ttagccacattatatggtggtgaattacgtctagctgttccaatgttattcgcattaggtttcctattcttattcactatcggtggtttaactggtgttatgttaagtaacgctagtatagatgtagccttccatgataaaagtaaatatcatttacgatataaaaagtatataatactatattga

SEQ ID NO: 1494 - DNA, 846 bp, Candida albicans
gtcttatggttgggcgatcatttgctaccttctattcccgaggctatttcattgttaagatccaaaaatacacaggttatatttgttaccaataattcaacaaaatcccgtaacgattatttgaaaaaatttgagaaattggggattccggatataagtaaacaagagatatttggatcgtcatatgcatcagccattttcattgataaaatcttaaaattacccaaagataagaaagtatgggtcttaggagaaaaaggaattgaacaggaattgcacgagttgggatacaccactgttggtgggtctgatcctgatttgatttcttctggagttgatttcgattccaatgatcctagattaaataaactagacaacgatgttggctgtgttttgtgtgggttagtgttcaatttgaattacttgaagttatcattaacgttgcagtatttgttgaaagataaaaagacaatcccatttattgccactaacatcgattccaccttccctgctaatggaaagttgcttattggtgctggttcaatcattgagacagtgagctttgccagtggtagacaaccagaagctatctgtggaaagcctaatcaatcaatgatgaacagtataaaagctgattttcctgacttggggaagactccaaaaagagggttaatgattggagataggttaaatactgacatgaagtttggtagagatggtggtttggacacattgctagttttgacaggtattgaaactgaagaaaatgtcaaactgttgaatgaaaacgaaacacctacctactacatcaacaaattaggtgatttccatgagcttaacaattag

SEQ ID NO: 1495 - DNA, 567 bp, Candida albicans
acacaaactatggtcaaatcttataatcgttatgatcaagaaaaatgttttggtgtaattacatcccaagcaaacattgtttggttaccaccatcagaaacccaatcatcaacatcaatgggacgagccttgacttcgggattagaagaaattttaatttgggacatcaagactggagaaattatgaatcgaatgagtgatggattaactcctggtagctctaatgcatctactaccgttccaccttcaccagtgagctatttgacatatcaccaagaaacaaatatcattgctgctgggtataccgatggatcaatcaaaatttgggacattagttcaaattcggtgattattaactttgagggacacaactcatcaatcacccaattaaaatttgataaaaacggtacgagattagtatctgggtctagtgactcttcaataattatgtgggatttaattggagaagtggggatgttcaaattaaagggccataagggtcccattactggtcttgaattattatcagaacagcataaatacacagcaagttggcgacaatgttga

SEQ ID NO: 1496 - DNA, 1464 bp, Candida albicans
gaattgaaatctcaacaatgtatagaaactcatttggctcattttaatgaatgttgggcaatgggtataaatccaacaaaagatatgttgataacaagtggcaataaagatcaagttaaagtttggtccttggatctttctcttgaggatggattgaaaatcggcgaacgtggatctttcgaaaagacaagtaaatcaagaagcaatgaaattgcctttaaatctttgaaatattcttcatcttcagcttcattgattcagttattttctattcagaatgctgatcgaacaatggagatattcagaatcaggtcggaagatgaaatcaaacgtggtatcactaaaagaaccaaacgtttgaaagacaaaggattggatgaacaagaaatattagagtctttgcaaagttcagaaataagtatgttgattacaccatttaccacaatgaggaccatggccaagataaaatctgcttgctggaccaataacattaagaaattggatatattgatgtcattaaccaataatagtattgaataccataccataccagttccagagacccctaaaaaggctcaatcagcagatttatattctgtaaaacagcatacaattgatttattgggtcacaggttcgatattagagccatggatatttccccacaagacaacaaattattggctactgcatctaacggagaattgaaaatttggaacaccagatcatataatgtgattagaacatttgttttagaaggtggttatgctttatgttgtaagtttctaccaggtgggacattaattgttgttggtttcaaaaatggggatttagaattgtatgatttagctacgtcatcgttagtggatagagtagaaaaagctcatagcgcaataactgttggtggtgctgctccttctaatgacgactcggccgccatttggtcgcttgatataactccagacgggaaaactttggttacaggtggtaatgacaaatgtgttaaattttggaatttcaaagttgagcaagatattataccaggaaccaacaccacggtttctcatttgaaatttgttcatactcaaacattggaattaaatgaggatgttctttgtgtcagaatatctccagatgctaaatatttagctatttcattattaaataataacgttcaagttgtgtttttagacactttaaaattattcctcacattatatggacataggttaccggtgttgtcaatcgatatatcacatgattccaaacttataattacttcatctgctgataaaaacatcaagatttgggggttagactttggtgattgtcataaatcaatttttgctcatcacgattcaattatgaacgttaggtttattggtgatacccataatttcttttccactgggaaagatcgcttgatcaagtattgggatggggaacaatttgattgttttccaaga

SEQ ID NO: 1497 - DNA, 705 bp, Candida albicans
ccaaccaacctgttggttaacatgcatattactgatcacggtagtgattggttatgggctgcattctccgtgtttcttttgttaaccatcattcatttattgcttttcttgtacggcaatttcagaaaacctggtgttaaaaactcattgttggttattccattatttaccaatgctgttttttctgtcttttactttacttacgcatcaaacttgggttacgcttggcaagcagttgagttccaacatgctggtactggtttaagacaaatcttctatgccaagtttgttgcttggttcgttggttggcctgctgttttggcactttttgaaattgtcactagtaccgttttagacagaattgaagaaaatccaaacattttcaaaaaattctttttgattttccaaacttggttagtaaaatttatttttgttgaaatctacgtgttaggtttgttgattggttccattatcttctctacttacaagtttggttactttacctttgctgtctttttccaattgttgcttatggtatgggtaggtagagatcttcacagatctttcaaatcaccatcccattctaacattgctaatttcttccttatcttcttctatcttgtttggattttatacccacttgcttggggtttgagtgaaggtggtaacgttattcaaccagattcagaagctgttttctacggt

SEQ ID NO: 1498 - DNA, 1263 bp, Candida albicans
  unsure (17): Identity of nucleotide sequences at the above locations are unknown.
acgaagcagtttatttnacaaccatattccttcccactcatgtcatctagacggaataaacgaccttataaaggtttgattttaaagcccaaaccaataaaaccaggatctgggtttggaacaggaacaagatcaggtttaggaacagtttcagttacggcctccccgttggctctgacatctactacagccacaactataattagttttcaaaatggtcatactacttataacgtaccaaattcaggaaacgtgtcgccttcaacatcatcaacttctacaaattcattagtaacgaaaaaacatattaaaaaaagtctacagaatgatttcaagttaaagtctgccgtcaatactaataataatgataatgaagacaacataccttccaataacggaaacaatatcttcggtgtagtgggtgacttatatgatatatttgatgctaataatttcaatgaatttgaattcttatattcaatttacgtccctaataaatacttgattaaaaataacagaaaatcaattaaacatttactaattcatttacccaaaatttatcatgattccactgccaatagctcgagctccactaccaacacagccaacaataatcaatcaactaatatcaatttgtcaattcatttattcctaagcacgatcatggttaaatttgttaattcttggtatttgacgaaattaaacacagcaaatctacagtttttaaaattagtatatcaattaatggttgtttttattaaagacgttatagcaagaatagaatcggtagatatactattgatgattgatcaatttggtgatattttgaacactcatttgaagcaaaccgtccccaccaaatattcagataataacaaatacccatataaatttcttgaagattatttttccaatcaaaaaccaaagttgaacacttttgattttgataaactgacattacaagtaaccaatgattatttgaaatcaaatcatataatttttgaaaatttcaattcttcttccaaaaatcacgacccaagtaatgagatgttgtactatagactacttgtcaagaatgtgttattggcatcatttaaagacagagaattaagtccttctacatcaaaaataactaatgatttaatagttcatattttaagtgatattgttattgtcaaattaattgagaaattatcgtcccaggattttatttttgacaaattaaatgaaatattagatgggttgttattgttatcatcctag

SEQ ID NO: 1499 - DNA, 546 bp, Candida albicans
ataatgttgaaatctactgtcaataatactcgtatcaagtgtggacacattgatcaaagaagaaattatttgttcacaacattggctggtacagttttgggctcattcttatggtccaaaaacaatgtattagcttcaaaaatggaaaatggtgaattacactatcatgatcctaaccttaaattcaataagaaattgttcaatggtaaaccaccatttgaaagacgtactccagattatcctggtcatgtaccattatataatttcgagaaagttttgatgtttttaggatccagtatgggggcatttttccatccagaagaaaataaatatattgtggctcttggtgaaagtactgccatcacacctattttacagaatttacgccacaagatgctatcagatcctgtgggtagaaccatattaagagagaagccacggatgacgttcgattcattgaatttgaacctattgcgatcattaactgataatacgattggggaaaaatatgtcaattgggttagacaaggagcatgtcagtcctga

SEQ ID NO: 1500 - DNA, 492 bp, Candida albicans
ctgataatacgattggggaaaaatatgtcaattgggttagacaaggagcatgtcagtcctgatactagggttgcagttagatatattgacaatgaagaattggcttatatatatcgacgatatcgtgaatgtcatgatttttatcatgcaataactgggttaccaattattattgagggggaaattgctgttaaggtattcgaatttgctaatattggtatccctatgagtgggttaggagctttatttgctcccttgcgattgaaatcaagtcaacgtcaacgattaagggaaatatattatccgtgggcaatcaaaaatggattgtttagtaagccattgatcaatgtttactgggaaaaaattctcgagaaggatgttgatgaattcagacaagagatggggattcaacaacctcctgatttaagaaatatgagaaaagagtattttgctaggaaaaaattggaaaagcagttgcaaggtggaaagtaa

SEQ ID NO: 1501 - DNA, 1107 bp, Candida albicans
agacctagtgccataattgtccctaatttagttaattgttccgccagatttacatcaccaactgttttagatagatatgccgggttagaagggttggattttatccctgtaaccacatatagacgtggatcttatcaacagatcaatttatcagcaagggaaattatatctttatcgaaaccagatttaagtaagttgacggacttatcacgagactggtcagttctcagtgtttatggtactgaagatgaaatcattcccaaatatgatagtgccaattttgccaatgcgttaaatagaggtccattatcacatacattgaaattgattcctgatgctgatcataatttttatggccacaaggaaataaaggccgatgatgaattacatgaacttaatccatataatttacctttgaaaaatggcaaacgagtaaactataattatttggtcactgattatataatagactctttaactccagaaatggaattacaaagatttattgccaccagtagagatattggtagagttgctagatggaaaaatgttgatggagtcagtaattttagagatgttggtggctggagagttcatgctcccactttcaaattagatacaatcaaagggtccgccaacaaaaaccagaatcaagatcatttggtatattatgttaaaccacattttgcattcagatgtgctaatattgctgggttgactgaaactggactccaaactttacaaaatttaggtatcaaggcaatatttgatttacgttccgatggagaagttaaaaatgatggatatccagataatttatcgaaatatggtattgaaagaatccattctccagttttctctaatgatgattattcaccacaaaccatagctatcagatatacaaatcttatgacttgttggtcaacttatgtcaacgtttatgaagacatgttagaatttggaattaatgcctacaagacaatatttgagtatatcagggacgtaaaccaaccatttgtattccattgtactgctggtaaagatcgtactggtatgctaggaatgttgatcttattacttgcaggtgttgatagaaacactatcgca

SEQ ID NO: 1502 - DNA, 2529 bp, Candida albicans
accatggccaattctcatagaaacacattaaagcatgaccataagccattcaaatcaaagcatgccaccaaaggtcaaatcaaggccagaataaagggtaaagttgaaaaatcatccaatagtctgggtggcagtaaactgctgaaagttgtatcaaaattggaaaggaaaaacttatcaaaacaacaaagggacaataagatcttagaaacgaaattaactaaaaaattgtttgaaggtaattcaggggcagaaaagattgttaccataattacattaactaatgatttatctgctgttgacattgccaatagattatttaatgaacaagaagataccagtaatgagtcaataacaagattcgattttggttatccttcggtcacaaacataaatattgcaaaattcaaaaccaatttgaaagtgataattcccaaacaaaataatatgattagtattcttgatgcggcccaagtgtctgattttgttctcttggggatatctgcaactgaagaaattggagaaaactcatttggtgaaaccgtcttacgtgcattgattgctcaaggtatatcaacaacaattggggtgttgccgaatattgtcctggcttatccaaaacgtaatttacaattagatgtcaagcagtcgttacaatcattttatcatcattttttcccatcgcgagatggatcatcgaatcgaggcagtggcactgatagtggtgggaataaattatacctgttggaattagattctgataactcgaattgtttgcggataatatgtcaaaaattccctcaactgataacttggagagattctcgtgggtggttagttgccgataaagttgaaatttttaacccaaatggcatgcctgtggagaatcaacaacaaatgatggtggtagaaggtatggtgagaggagttggattcaatgttaatcggttagttcatttgcctggattgggcgatttccaattacacaagttggagaaattggcaagaaaagcacgtgggaacagctcacgtaatcatcgtggcggtatggatatagacactggtaatgatggtgatgctgaggaaacgtttttgcctaatgaacagcaagagctgttggatgaattgaatcctgacgaagggatcgatatgggaactatggaagatgacgatgatttcttaaataacgataactttggtgtcagatcagagggaaaaatatatttcgataacggcaacagcaacggtacgagctcttccagcacgggcaaaaaactagttccaagaggtacttcagaatatcaaggaagatggtttgttgatgatgtattggatgaagatgcatctgatttagaagaacaacgagaaggagaaggagaagaagaagaagacgccaatatagttgacgatgatatgatggtagaagataatatggaggcagatgacattaccgatagtatccatgattcagaaatgatgcacgttgacttgtcaccagaagaagaaagtcgtcaacttgaagaataccgatcattagctaaagatgatttggaattccctgatgaaattgagttgcatcctaatgaatcggctatagagcgattgaaagggtttaggggcgtcaagtctttaggtaattgtgattgggattatgatgagtacgatcctgaagcaccatcgatattgaagaggttgttccaggtgtcgaattataaagccacgaaaaacaaagtcaataaacaattcatcaaacaaacagaaatcaccgcaggtaatcgagtcagattatatattatcattcctcctggcgcttccaacaatgtaagcagcgttattggcagttgctcgagtgttccattccctgtatacgagttattagaacacgaacacaagttgggtgtttgtaatttctcatttgaagcatggcaagattacgagaaaccaattattaacaaagagcaaatcattgtgcaatatggaccaagaagacaaattatccagccgttatataatcaagccaacaataatccaaacaacgttcataagttggagaattttgtccatcataaccaaggtggtggcggtgcaattatcgctactgctataaccccagtattgtttactaactcgccaacattatttttcaaaattcatcccgacgctgacgatagtagcaactctaatggtggatcagttgagtttgttggtaagggtacttatttgggcagtgatgctaaacgtatcatggtacaaagagttgttttaactggtcatccaataaaaattcataaacgtgtggtcactatccgttacatgtttttcaatcgtgaagatatcaactactttaaggcagtctcgttgtttacgaaaaacctgggacgagtcggatttattaaagaaagtcttggtactcatggttatttcaaagccaatttcgatggtaaattgacatccccagatgtggtggctatgaatttatatcaaccaatctggcctgaaattttcactgcctggaaaaaatttaattaa

SEQ ID NO: 1503 - DNA, 690 bp, Candida albicans
attaacttggaaccaataaatcaaatcattaaagaacttttccctcaaagacattttttgggtacattaatttataatccaacaacaacatgggaaacattacaaactgccgaattatatggattaaaacctgaattacaaaatcgattcaatgaaattaaacaagaatttatagtccggaaaaaatatcagccatttggaggaattcgatacatacctacattaccaccattaccatcagaatatattaataatataattgaaattaaaatcccctttagacatattattttgtttaaacaagatatagctaatgaattaattactcgagaactttggggaggtgctagtgggatatatactgatgattcggatatcttacaagtattaatgcatttaggattatttaacaataccattgatttatcaatttggaataagaaatggaccacaaaagatttaatcaaaccattacaatcacaattagacaacaacgatgatggaactaatttaggaattgataaagatgtttatggagatttatcagtagaaatacttttattacctaatttacctaaatattatggattttatcaaaatggtataaattcacgatcttggttgactagttatcattcaggattaagttttgctgtatataatgttaaatgggagactagaaaaacatga

SEQ ID NO: 1504 - DNA, 384 bp, Candida albicans
gtactactaaaaatattaatcgaagaatcctttcatgatgtgaaaaccgcagatggtacaactatgcgtatttacgtttaccatcctaaaattcctaattatccaaaagtgaaattcccaggggtcctcgtatacagtgaaatatatcaagttactggacctgtttctagattcgccaaggatattgctggccaaggctttattgttgcatgcccatccagttatcataattttgttggccctgagccattggcttacgatgttgaaggtaccgatattggtaaccaatacaagattgaaaaagagttgaagtcatatgacgaagataccaatttgacaatagagtacttattgagcttaccaacttgcaatggtaaattgggt

SEQ ID NO: 1505 - DNA, 456 bp, Candida albicans
tttttctttacagagcaacaacaaaaacatccatcatcaataatcatggcagaggaacaaagaagacaaatagaacagttgatgggaaaagaaaacggatcgctgatacggcgaagagatcctgaaatgacttcatctcgtgtatgtcgggcttttttagtcggcacctgtcctcatgatttatttgtaggaacaaagcaagatcttggaagatgtcctaatctacatttacaaaaacataaactagaatacgagcatcgaacgaaaaaattgggcgaaaagtttcctgacatagagtatgattattacaaattgttgtctaaatatgtctctgatttggaccgaaatatccacaatgcccaattacgtttgcagcacacgccagaggaaaaagcaaaaattgcccgcgttacaaaggaattttcacaacgagcctggcaggatccgcaatggaat

SEQ ID NO: 1506 - DNA, 504 bp, Candida albicans
ttgacgaaaatcatgttgaatttaattgatgatgttaataatattttaaataataaaattgttattagatataaatctaaagatattgatgctatgaattcaattgctatggcttattcaaatagatcacttaaagaatttgaaaattctttattgacttatgctaatgaattaaaatctgatgcaattataaaaaatcattttaatgcattatatgataatttattagaacaaaatttattgaaaattattgaaagttatagttgtgtggaattatctcatatttctaaagttattggattaaatttacaacaagtcgaaggtaaattatcacaaatgattttggataaagtgttttatggggttttggatcaaggtaatggttggttaattatttatgatgaaccaagaaaagacgctgcttatgaagcttctttagaattggtgaaaaatttatctaatgttgttgatttattatatgaaaaggcatcttcattaaattaa

SEQ ID NO: 1507 - DNA, 732 bp, Candida albicans
atgtcaggcgaatcagataaaatatctactgatcagtatggtagaagaaaatggaatgtggacttatatgagaaggaggcaaaagatagaaagaatcagtcaactcaacctactttagcaacaacaacaacaactaaccaaattaatgatcattcatcatcactggaatatatagaacatagaaacaaactattaaatgagctgataaatgcagtcaaacaatatagtttaataaatccacaaacttcaacgtcgacaaccacgtttggcaaaaataaaagatttgggtttttctgtccaatatgtgacgtttccttcagagacaatttattattgattgatcatttaaattcacctcaacatgtaagcaaagctagacagatgaatttgggtattgataataatagtgctgagcaagaattattagagaatggaatacgaagagcatcattacaagaagtggtactgacaatggaaaggcttatagcgaaaagcataaatgaaaagagcaattctgaagatgggaaaacaggactaacgttcaatcaacgtgtagaaaagagaagagaatatgaagatagaaagagaagtaaaagggcagagcggaaacaaattcaaaagcaacgtaagaaacaaaaaacgacaagtgatgatgataaagagaaagagactaacatcaatatcaacaatctaatgggatttaatagttttgggtcaacaaagcttagctaa

SEQ ID NO: 1508 - DNA, 1251 bp, Candida albicans
gtcattgtattctttagtgcatcatttgaatcgggtgcgtcgctgctaccagtgcgccttaatggtttggtttggtttggattgctcgttgataaaaaacctctcgctcactctccctatcttcctgcgaagtttcaacacttctttctctttgtttgccccagtatttatttcttgtttacctccctccctctctccccatctcaaacacacactcacgacatgtttaaccaaccaccgaaaattttacgtataaagagaaaaagacatcaagacccattacaagccttgattcttgaggatagaagatcggtaaagcggtctaaaccttcatcaccggtgacatcacctcgattatcacccacaactactactcctgtcaccaccacaccactggaaaaccacaattatgttttcaaactagcccgaacagatgaatctgacaaggtcaatgctcatgatgaatcaattattcaaacaatattatctgaatcacaaactggtattgatgagaataatttatcagaacccaccaaacgaaattttgtcattcccaaacaccaaacagaagaagatattgaaattccaaatgaactttctgatatgcttgattcctttttatcacttgagaaaaataatgacaccaagcgaaggaaaagaggaaggagaaacactagtgaagaatcttcacgtcctacacaattggtcaatgcagagaatgacaatgttgaagaagaagagacccaatacgtttatgatgtctatcatttgactgatagtgaaccaatgacttcagcaaaccatccactgacacaaataggatatattcgattttttgaagatgaaaatgaaaccaatttattaatgaatgatgaagaagatgaaaccaaacccaatgtgttgaccgatgatgaagattctaatgccgagtcattttatcaaaatgattatcctagtgatgaagatgccggagcttttagtgaacaagactcactagaagaagaaaatgaaggttatgttcctcatgatggggttggattcaaaggtgataatgaatattttgattatgaagaattggaaaatcttgatgctgaagacaactattatgaagaagaagaagaagcagattatgaagatgaatctagtgggtttaaacgcaatcagtttttcaagtctgatattgatgatcccatcgcgatacatagagataaagtatttagtaaactagagaatatgataaataacaaataa

SEQ ID NO: 1509 - DNA, 2301 bp, Candida albicans
  unsure (2291): Identity of nucleotide sequences at the above locations are unknown.
acaattacgtcgctacctcggattttacgccaacaaaaaccagcaagagggccaccatggctttttatgaaccagagtttcttgatgaatttgacgagattgctaaagaagaaagcccagttggaaattgaattggagagattaaaacagttggaaaaattatccaaaaaggctgcaatcagaagtcccatccaaaaggatagtgggtcagtcaattcatattccgggactgacgacacctccaagaaaaattcctcaaaagatgacttgagtaagaagctttctaggtatgtcaccgacgaggatgatgctggttacgatttgcaatattcagcaagtggtggtgatgaatccccacctccacctccacctccaaaacacattacaccaaataagacttatggttatgtgagagacgatcattttaataaacctacgccacgtgttccatttgatgctgatgattttagaatatctacaaactcccagggtgtcatagatgaagaggcgtacctcaagttatctttaaaacaagaagaattgaaaaactccattaaatcattacaaagtgatgttttgaatttgtcggaattaagtgctactagtgctggttcatttcttagacataaatacgaaaaagatttacaagctagtcaattgggtctgagtcacatatcagtggaagaacgtcatgaagaagaaccagataaaacttcagatgttatggaaactgttttccaagacaaaaaacccaaacagtctaatatatttaaaaaattgttgaggaaaaaccatgatgatgtccatccaatagaaagaaccattcaaaaacaagaacaaattgattgggctacgttcaaatcggatatcaataggatgaactcactaacgtcgcatgacaaacaaagtaggactaaaagagtagtaagacaagatggatctataattgttaagccattggattttatatctgagattaacactaatgagactgtgggtcctgaagatgatgatattgacttggaaaacgtgcaatatagtaaaatcgaaacatttatgctgaattacgatttgagctacgatttgaatgaattgatttctgacatttcaatcaaatttcattcttcagtgatcaatcaagtccgatgcattttggtgcatttatgcaagtttgacattattgaagaaacatcgaaaattctgcaacaaaagccaaaattatctgaagttcaacatagtggcaaggcaactatttttcaaatcaattacattttcaagaaaatattagatgcattaaaaattccgtgtgaggttgttttagggttttggaaaaaaccaaatgaattttatcataatgaacaatacgtaataaaccattgttggctttctgttttggtcgataacaattttagaataatggacatatataattttaaaaatgcatctgtgtgcaatttacgacaagaaaagctcaacgaattctatttccttgctgaaccattaagtttggtgtcaacccatatcccttgtattattgatttacaacatgttgtcccacctatcgatccaaatattgcattctatttgccacgtacctattcaggtttctacaaaaacggattggcattcaaaaatttcaataatgcattgacaagaatcaatgatttggagatttttgaattggaactcgaaatccccaccaccgttgaacttttcactctagtgaagactgcaagggcaaccactaatgaattgagtttgtgtcaaattaaatgggtcaatcacaaacgtgttgctaagatcaaggcagtgttacccgaaaaggaatcagtgggtgttttgcagatatttgctggacctaaggggttacaaaagcattttgacaatattcatgaattggcaattgtaattccattatctcatgaaggtacatctaaaccaacgaagtttgtacaacgattcccaaccgtgcagagtcaaaaaaatgatttgtacataataaagccacaaactagtaaaatcgttgtcaataatatgtataactttgaaatcgaacaatatccatcaaaagggttgaattctggttccggattaatgaatcaagatttcaagttggttattgaatcaccatcaggaaaatactttaaattgaataaggaagataactccaagccatacggattgtactcattaaatatcaagtgtcaagaaatggggttgtatagaggattagttattggagatagtggtactagttggtatgttttcgctcagtgggagtgcataagtancacagttgca

SEQ ID NO: 1510 - DNA, 861 bp, Candida albicans
tcaatgtcactgccacctttatcttctccagttccccaagtcaagacaactcaaaatggtaaatctcccgatgcaaccgttcatcttctagcaggagcaatagccggattagtatctgctgtcacattacaaccgtttgatttattgaaaaccagattacaacaacaacaattaactactaaacaagaagttcgaactactctcaccaaagaattgaaaaaattaactcgagtgaaagatttatggcgtggtacattaccttcaacattaagaacttcaattggagccggattatatttcacaacattatcaaaaatgagaacaagttggggtgaatataaacaatctaaagattcatcaataaatttgaaatcaaattcatcaattttacctaaacttaccgcaatggaaaatttaacaacggggtttatagctcgaggtattgttggatatatcactatgccgataactattattaaaactagatttgaatctaatttatataattataattccatgtatgaaggtattctggggatttatttagatgataaaaaacaacaacaacaaataagaaacccctcgataaataaaggagtagggggaggagggggaggaggttcatggaagaatttggttaaaggatcagtacctactttggctcgtgattgtccttatgctggattatatgtattaacttatgaaacctttaaaaatgacttaattccattaataattccaaattcatctttatctttatcttcatcctcatcctcatctttatcttcatcctcatctttgtttgttttcaatgataataatagatcaagtattataaattctacagcagcagtattggac

SEQ ID NO: 1511 - DNA, 582 bp, Candida albicans
cactgtactaaacatactttccctccttataactgtatactcttagaaatgttcaaaagatttgcattgaattcagctaaatgccttagcaaaccagcttgtactcgacaacttatataccctcaaaccagattcatcaccaagacattgccaactgtggcgtctgctttgagaccaataggctcaattagagcttattcgctcagtactgaaggtgaagctatagatgataaaattgataaacttacagataacgagtatgctaaagtttccaacgagtatttagagaacttgtctgatctgttagaggaattgaatgaagactttgaacaagtggattccgaattgagtcaaggggttttaactttgacgttgccaccaaatggtacttatgtgattaacaaacaaccgccaaataaacaaatttggttgagctctcctattagtggtcctaaaagatacgatttaattggtggtaaatgggtcacattacgtgatggaagttcattgacatcattattagaggaagaaatatcaacagccattggtcaagagtttaaatttgaaactgttgaacagtag

SEQ ID NO: 1512 - DNA, 1992 bp, Candida albicans
ataaataataaacatcatgtaatcggtttttttttttcttctcctaatctttttcctttttcttcaactttattgtattacatactagttctttttcttattctgcaactaattgaaataatgaataccggtattgaaaatgacttcaagtatctacatagtcgtaaccttcaacaacttcccaacaacaacaccaaaaacccttctcaaaatataccctacaattacccgtcatccgatgaagatatagaagatgaatattattctgatgatgaatctcaaaatcagttagattatgagatcaaccaattaataaaccaacaaaacgagaagcaattcaaaaacaagttcaaacaattggaaaaccaaagtctacaacgattcaaatctcaatgggatgctataatcgataaatatagcaaaattgacgactctacacaaagtgatgaaatcgatatcgtcacgggagaactaataaccaacaatggacatttagataaattgaatcaaaatcataatcaaaaaggagacattactaagatggatatttggagacaagattacggtcaacaattggaaaattggagacaacgtgatttccgaatgaaaaaacaagctaaacaacgcaaaaatgaacaacgacaaatattaaagaaattagatctatttaataaaccaatatatggatatccgaaatttgaaaaacttgaagaaaatgattttctcaaacagtctccaacaaagaataaggtaccaagcgggatagagtctgatgaatcacccactaaaaagagaagagttttcactgataaaaaagtggtttctaaaaattcaaattatttagagtttctggatgatgatgacgaggaagttgagaataagtcactatacaccaagactgtaattgcacatggaaaactttacaaaagagagtcagataatgtgctatatgggtcatctgctgatactttttctccctatattgatagacagtcgtttcggccagaatccaatgaactacaaagcgaagactcacaagattatgaatctaatctatcgtccgacatttcagatgatgagtacgacgatgaaacttatcaatctataataattaatgataaaaaatatagtccaaaatttaaagaacattttgatgaatcagaaaccgaatcaatttcagaaacacctcaaccacaaacttcttcagaagaaacacctggactttcatctcaaactgaagaaatctcaccgtcgccacatccagaatccagttttgatgacgaatatctgattattgaggagccttactattttttggatgtgaagtcacttccattgcccactattttcaattgtgcgtttataaaatgccattattgtacgggaaataaaaaactatatgaattacatcttttgcaatcacacagttcgactttggcagaaatgggctatccaattaatttaaatagtcagaatgctgcctacgaaaatagcaacactgatagcgataaagaaaaccataagattgaatttactagagacattactgacgttgatttggataagctatatcaggtatttccaaaaacgtacaaattaccgccacaaaaggaagcattaacttgcggcaaagaattagctaatggacaaacatgtcaaaagttttatttggtgcaagaacagctcgatcaacatcaagaagctggtgatgaatgtagtgataaacgtcaagttttattttgtccaatacttggatgtggatacttaacagatggtgggtataaggaatggagagagcatatgattactgcaaaccattctcaagaagaaacagctgaaaaagagaccaaaaaggaaaacttggaaaagttgatttctcgacctattgcaacgagaaaagtatcagtgaaagtacctaaatttactgaaacagattttaaagtatcttttatagaccaaggatatgaatcaatagatgaattattcaattga

SEQ ID NO: 1513 - DNA, 1590 bp, Candida albicans
ggaagatccaaatgtttctggactatggataggagttgggtagtaggttgtgccataaagggtggttgtttagttagttatggcacatgttgtggtagtttgatttttttttgtggtccacacgactggccaaacatttatcaaaaaatcgagttcaactttttttttttttccagttcgccaccaccaactacttttaccaccactaacaacatgtcaagagaagatccaattaaggctgaaaaagacttttctgctactttagatgaacaattcccattgattgaaaagatctctgactacaagcaagcattagataagtatcttgtcttggagaaacaaactcgtcagtcttccgatttggcttcatcaaaaagagttctcaacaagattgttactgcattggttgataataacgattgggagtatttgaatgacttgataactatcttgtcaaagaaacatggtcagttaaagtcgtcaattcaagcatttatcaaagatgtgattgataatttggataaattggatgaaaacaacaagcaacaattagagttgaagatgaaattgattgaaactattagaacagtcacagacaaaaagatttttgttgaagttgaaagagccattgtttcaagacagttggccaaaatttatttgaacaaattgaatgatttggataaggcagtggaaatcttgtgtgatctacaagtagaaacgtattcgttaatgccattcagtgacaagattgagtatatcttagaacaaattcagttgactttacaaaagggggactatggccaagccaagattttgagtcgaaagattttattaaaatcgttgaagaactttgccaaagctgatgagtttaaggctacttatttgaagtacttgattgatattaacgtgtttgattatgattatatttcaattgttaagaatttgttattgttgattgagattccattgatcaaggaatcggcagagtacaaggagtatttggtgctggttatttactacatcattttgtcaacctacgatcctcaccagaacgatttaatcaacaaaatcaaatcaaaccccattttcaccaagaatgttgatgctaatattgtcaagttgttagatgttttcaccacaaacgagttgattcactggtcaaacatcgagtcgttgtacaagacgtcatttgccaattccaaaatatttgctgatgaaaagaactataaaaacttgcaaaagagaattattgagcataatctccgtgtgatcaacaagttttatcaatctattaggttagatagattagcgcagttgttgcaactatctgtcgatgaagctgaactgtatgttagcgaattggtaaaccaaggaatgattgttgccaagattaatcgaccacaaggacttgtgaaatttgacaaaaccaaacatattgaggggagtgatcctcgtacgagtgataaccatatcaacgcagtgttgaatgactggtgttatgatattgagaaattgttagaagaggttgacgctataggccatttgataaacaaagaagagatgatgtacggaatcaaacagaaaagttaa

SEQ ID NO: 1514 - DNA, 210 bp, Candida albicans
catgggcaaaacaaaccctggaggatgtttttcaaaaatttatcatgcccaaattggattgggggattagatatttataatcaaggtggtcagatattggctcattggaatgaacaagttggtcccgttcttgcagtatgtactcttcatccaagtcagaattgggctgttggtggaagtgccagtgggaaagtctacttatttgagtag

SEQ ID NO: 1515 - DNA, 528 bp, Candida albicans
tatccgcgctttgacccattagatattaaaatatgtcacaatcgtattacttcaatgtctttccacccatcaaccaccaatagaattgttgttggtggtgatactactggaaatgttggtatttggttagttgatgaacaaaacaatgatacgaaggaagaagaagaagatgatgatgatgatgagccatcaatttctatcttacagcttcatggtagaaatgtttcgaaaattatgacgccgactttttcaccagaaaagatttataccagttcatatgatggaagtattcgagttttagatttaaacaagttaaccagcactgaattgttatatttgaatgaacctggtgcaagagaagatattgccctaggggtgtctgatatcaatcaatgccaagattcatcagtaatattcatgaccacacttgatggtgagttttaccaacacgataccagaactcctttcaatactcgtcaacgtcatcatttagcaagtcaagatcgtcacagaagtggaaaatccgcg

SEQ ID NO: 1516 - DNA, 321 bp, Candida albicans
acttccaaattttacatcatgtctaatatattatcagtattcaatccaccaccttctcgtccctacccaccatcaccagacgaattgcgatcagaatgtttaccatgcactgccattcaatcaattgttgccatcggcggtggattatatctaagttcaccgaatcaattcaaagataaaacgacggggaaaatcgacgttacgaaaaaccccctttggtggcaacgattagtgagaggggcagggataattttgtttggattgggtgcttatcgtgctggtgaagtcgttcaaatattatatagaaagagatttggttaa

SEQ ID NO: 1517 - DNA, 282 bp, Candida albicans
atagtagttgctgaattcccaacaaacagaacaaaaaaaaaaagtcttgcaacgagagtgagagaaagaaaacaaaaaaaaattctagaagatttttcttttaataggcaacctcaaattgcacatctcatcactatgacaaccatgtcaagaagatatacaccaaacataattataacaggtacacctgggtgtgggaaatcatctcattccctgagtttagtttctcaactcaatcaaactcttggtaaagagacgacgattcatttcaaagcactttaa

SEQ ID NO: 1518 - DNA, 660 bp, Candida albicans
tttctcaactcaatcaaactcttggtaaagagacgacgattcatttcaaagcactttaatatcagtgaaatagcaaaggaaagagactgcattgaatcttatgatgccaagttagatacttcgattgtagacgaagacaaattgctagactcgttagagcctgatttggaaaaggggggagtggtcgttgattggcattgttgtgatattttcccagaaagattaattgatttggtggttgtattgcgtacagacaattccaatttgtttgatcgattaaagactagaaactacaatgatctaaaattacaagaaaacttggattgtgagatcatggaagtgatattacaagaagcaaaggacagctatattcctgacatagtaattgagttgcgttcagacacagctgaagagatggatgaaaacgttgatagaataagctcttgggtggaaacatggatagaggaccatccagatggggttagcaatgaattgaacaagcaatataacccagatgattcttctgatgaaggtgatgacaacagcgattccgatgaatatgaacttgaagaagacgaacaagaagaagaggaggaaagagaagagtacgatgaagagaccaatgaagagatggagcatacagaagatattgcacaatag

SEQ ID NO: 1519 - DNA, 426 bp, Candida albicans
catatatatcttgatatatctatatatccccttatcatggcatattctacaggtagaggaggtgctggtaacatacattccaataaaaacaaaacatcagaaaataatgttctaactccacaaaaatcaacaacattttccccacaacaatcaaatgatgatggtagtacaccacttcaaaaagtaacgtcacagaataaacgagtatattattccactggtagaggtggtgctggtaatataaaaacatcagatcaattaccttcaccaactttaattcctcaaggttctaatactcctcatttacacacagctaaagtttccactggccgaggtggatatggtaatatggtgaataatgatgatccagaattaacaataatactacatgaatgtcgatggagaaccagcatcatcaaaagatga

SEQ ID NO: 1520 - DNA, 615 bp, Candida albicans
aacagtgaacccaacatgtccggcacgctaccttttatagaagattcaacaggggagaaattcaaaagacaaaaatacaaagagcaaagctttgttgaactgaaagagcgtggtagcagagatacaaaagagcatacacctactacagcattatcatatgatgaggtcaatgacgacctcgatgagttggttgcattgagaggagagggaagatattttggtgttaccgatccagatgacgaatccggaatatcgaggcaatcgttgggcccactatgtgcaaattgttacaaaaggggacacacaagagccaaatgtacagtggtcatttgtcataaatgtggagctatcgatgatcattatgaaagtcaatgtcccactactataatatgtagcaggtgtggtgaaaagggacacattgtgctgcaatgtaaaagcaagatccgaaagagacaatactgtcgaacttgtgactcttttaaacatggtgacgagaactgtccaagcatttggagaagttatataacgaaactgccgagccaaggggaaaatgaggaaagctcagttttaccaagaatttactgttacaactgtgcatcaaatgagcattttggt

SEQ ID NO: 1521 - DNA, 1242 bp, Candida albicans
ggatttgcaatgcccaacaacgtttcaaccgtgccagctcaaggtatgaacaagaaccatactgctatcccatcgtcacttcttacagctctttctaagcaacaggataagctttatatattacatttggagaaagatttgattaaatttatcaagaattctgtattggggaatatcaaacaacccgaatatatcattcaagcccaatacttgaagaatagctactacagattattgagtcatcaattatgtcaatattacaatttacaacattggaacaacacttttaatgaaataattgtcacaccaattccaaattttgattatcaacagtttataaaggctatcgaaagctcagataacaacgaaggaggtgagtttgtcaaaattgtcagtgttgcccataaatataaatcagaaaatacagccaccaccaccaacaacaacacaaacaccgacgccccagaacagccaaacaaaccagcaccaataaagaaactaatggttagaaaaattattaataaacctgtgagtgatccaaccccagggcaagctccaggtacaccagaaagtgaggttagtgatctaacgaaagaattagatgaaagtaaattgatactggaagacacaggtctgagcacaccgatttctgaatcttcagagaacactactaataatatcgagtctcaaagggcgtccaaagaagcactttacatgaaactaagggaagagatatttgaaaacaataacgaagaagaagaggaggaggaggaggaagaggaggacggcgattatggtacaaccgattctcaagaaagtaacaatcgaagttacaaaactcacaacaatttcatcaaaggacgaaatcacggtaattacagtggttacaagactaccccatatcaacaacaacaactacaacaccaaccaccaatgtataacactataccgatgcccgttccatatcaattcagtcctaattcacaagggccaccaattccagggatgatttacagtccatattatcaaccaatgatgtatggatatgcaccaaactatcctggagcccccaccaacaataataatgttgtaccagctcccaaatacgacaaggaaacagagagaagaatattgaacaatccgtacataatattacccaatgatactaaaaatggtaaaaataataattatagtaacaaacatactaagcataaaaaacaatttaccaattctaatatataa

SEQ ID NO: 1522 - DNA, 1113 bp, Candida albicans
tctgcaaaaaaaactattacgctgaggcaacacataacggcgatggactcgaacatgaaaaaaaaaatttcttcacatattacctctaaccaatccatctccaacctaaaccaaaaaccattcctaacagcaaccatgtctgaagccactgataaacaagagcaagtatcagctgaaactcctttagaaagagatctcaagtcaaaacaacaatcaatagcagcaacgaaaagaaaacaatatcgtgatgataaatctcaaatacgaaaacaagctagatttgaggtatcaaccactccagaaccggaacaaagtgactcttcagccacaacagcaaccattactgagttaccgaaaaagagatattatcgtcaaagggctcattcaaatccattttctgatcatagattagaatatcctaagagtcctgaatcaatggattggtcaaatttatatcctaaacaatacgatattagtaaagttgaaattgctgatattggatgtggatatggtggattaatgattaaattaggtccacaattcccgaaatcattgattttggggttggaaattagagttcaggtgactcaatatgtggaggatcgtattattgcattaagaaagaatcaagaaattataaacggcaaaaagaagaaggaaagtggtggtggtactggtgatggtgatgacaatgattatagttatcaaaacattgctgtgttgagaggtaatgccatgaagtttttaccaaatttctttgttaaaggacaattatcaaaaatgtttttttgtttccctgatcctcatttcaaacaacgtaaacataaagcaagaattataacaaatactttactaagtgaatatgcatatgtgttgagagaaggtggagtggtttatactatcactgatgttgaagatttgcataattggatggttaaacatttggatgaacacccattatttgaaagattaagtaaagaatgggaagatcaagataaatgtgttgaaataatgtataatgcaactgaagaaggacaaaaagtgactcgtaataaaggttcaaaatgggtcgcatgctataagagattgccgagccctgatgactgtgaatag

SEQ ID NO: 1523 - DNA, 804 bp, Candida albicans
agaacaaaccagaacaaaaaaaaaagaaaatcaaatcgagagtctgattataatccttcttcttctttttctctccccttttactcatcgcacgaaaaagaaagcattatttttttttacggtcccataaatttagttttcatttctttattaatccctgaaacgattactacgatgtcagatacagccaaattatctaaaaaggaaagaaaagcacttagtttccgtaagtctaaagaggaaagagatgcagaaaaggaggaaaagttagaaaggaaaagaaaagctgaagaggaaaaacaggaagatgtcaaggatacagaacaagattctctagaacaaccaagaaagaaaagaaagaccagaagaggcaaaaaaggtaaaggtgttaatggtgggaaaggacctaggtttattttatttgtgggtaatttgccatatgatatccaacaagctgaattgatttcacattttaaaaatagtaatcctgatagaataagaattcgacctgataaaggaattgcatttttggaatttgataatgatactcaagaaattcaaagtaaaatggaattagctttacgaatgcatcatacagaaatacgtaacagaaaaatcaatgtggaattgaccgttggaggaggaggtaattcggaagcaagaatacagaaattgaaagaaaagaatgaaaaagtgcttgaagaaagaaagaaacgagttgacgaagggaaaaagaagaaaccagcctcgaaacccgtggtgccactgaatgtccatccttcaagagcagctttaatcaattaa

SEQ ID NO: 1524 - DNA, 231 bp, Candida albicans
caatttcaagatttaataatggaattcaagtcaagttttgaagatattgatttgagtgttgatttacacccaccaacaaacattttcattgatgttagagtattgaaagatggaggtgaggtcaccactgaatatggttcttttaacttgatcaaagattctcaattctttgtcagaaaatctgatgtggaaagattaatacaacaaggatatttagaagagataatataa

SEQ ID NO: 1525 - DNA, 525 bp, Candida albicans
acttatgtaaagttgaaaaaaaatttttttttagaaccacttttgatttttgttcttgtaggaggatctcaatcccaatccctgcaacagcgtcgctgtaaaacaaacaactcggaaaaaaaaaacggccaaaattatcaactatcaacaacaacaacaacaacaatttcaatccatcaaatacttccatatcttaatattcttgagatcatccaaaaaaaaaaaatgtcaaattcttcatctaatccatctaaaaatgaatatttcataaaacaacgagatttactaatacaagaaatatcaaataatttatctatagtacaaacaaatttagaaactttgaatcgatcattacatgaactgaaacaaattggtaaagaatttgatgatgttgctagattatggtcgacattttatgatggaatgaatgggatgaatcatcaaacaagagaaaatacccgtgacgaaaataataaaataagttcctctgatacagaagatgaaaacaacaacaacaagatatag

SEQ ID NO: 1526 - DNA, 345 bp, Candida albicans
actattcattactctcaagaacttaccatggatcagactaaacctggatttctagatcagtttttattagaagacatttctcgtcattgccctcatcaatttttatctttccatcaatgtatgacattaccgcaaccagatccaaatcaatgtttccaacaacaagttgatttgacaaaatgtattaaaacttctgtcccatcatttgctaagatccaaaatgaatgttttggaaaaatgcaagcttatgaagcatgtctaaaaatgaataagagtaatacaaagagttgcagtcatgaattacaaaatttgagaaattgtgcttttggaactatagataaataa

SEQ ID NO: 1527 - DNA, 525 bp, Candida albicans
ttctatcggataccacatggagaaagtgcagccgatgtttacgatcgagtagccagttttatggagtcgttattccgccagtttagaagtgatgatttccccaatatcttagtgttggtcagtcatggaatctggtctcgagttttcattatgaagtggttcaagtggagttacgaagagtttgaaagtttaaaaaatgtgcctcattgcaaatatttggtgatgaaaaaagacgatgaaacacaaaaataccatttgaaaacaaggttgttgacttgggacgatgttgaagatgatgatttggatgtcgggcaatgtctgttagatgatgacgaagtgtacaagctcattcaagatcaaaaagatactgtcaattcaacaagaaataaagataaaataattgaagaaatgtaccgaaaagcacaaggaccagaatcaaaatacaccgattataaagagaaagtggtatcaagattcaaagtggacaatcagagtgttgttaatagtaccgagagtttccattag

SEQ ID NO: 1528 - DNA, 798 bp, Candida albicans
gaccccacaattagcacaacaatgaattggacttcacttgtatatctatggttcattttcaaaagcatatttgctgacttaacatcacaccaactcaagagcaaagtggtattcctagatactactatcctggatgaagtggcccgaagctatttgggatcagaggacggaaatgttacacatggtaattatgaaatattgtcaattgcaaatggcgccaatgacggaaacatcacatcatatttatgccagttgccaagaaccaaaaaaatggcaccaacaaaacccaagcccaccatgtcagttcatgaattgaaatcgcgagctattgacttgatatcggaatcctttgtcgaaggtaccagttgcgtattttctttcaacttgcatgcaaattattggactataggctattgccatggaatcaacgttattcaattccatgagaatttggatgattttataagcggaattcataaaccccattctccaaatcatgtatatacattaggcaatttcctgaagcaaacactgccattagaattcgagtttgatactaaagaacgcacaataagtcaaagattgttaggagaagtttgtgatttgacaggagaaccacgtaccattgacaccatttatagatgtgaccatatacttgaaattgttgaattaacagagataagaacatgtcaatatgagttacacataaacgttcctaagttgtgcctgttgccggaatttaaaaggactaaccttgaagaaggtgtctcagaaatactctgtacaagaattgaataa

SEQ ID NO: 1529 - DNA, 372 bp, Candida albicans
agttcaagctgttatatgtatgtattaaaacaatgcctacaattttgcgattgtttaattttgaatactaacatgtcaatgttagacacgattgacaaaaagagtcatgaaatcaaacaagaagatgaaattatagattccatagaagaattggttgaggaattacccgacacctctcctagatacgtcatcctatcatatcccttcaaactggatgatgggcgattgaaaacaccattagttatgttatactggatcccaccaacaagtggacaagaaagtagaatgctctatgctggtgcagttgagcaatttagagataaagctggagtctcaaagtacgtattacaggtaattctgccttttagctga

SEQ ID NO: 1530 - DNA, 612 bp, Candida albicans
ttagccaacacaaataaattacctactcgaaacaaacaacaagaactgcaccactcttattcatacatgacagaactattatccaatcaatttactaggaacttgactatccaagatttcgatgaatgtattattctagaaagtaaaggtttcccaccagaacaaagatgttcaccagaaaattgtcaatatcgattatctgttgcatcaaaattctgtttaggattatttgaaacaactccacttggtgattccaaattaattgggcatatattggcaaccaaaatttctactgaaagaatcactgaagctggaatgggtaagaaaatcgaaggtgttgagaattctggtcactttgaaaattcaaggaatataggtattcattcggttgtgattgaccctgaatatagaggtgttcatcttggtcatattttcctaactaaatatatcgagtatattcgtcaatttaaattgacagataaaatattaatcattaataaagaatctttgataccattttatctgaaggtgggatttgaaaatttaggacttactgattgtcgttttgctggtttaattgactacgatatggtttacaaattgtcctcatag

SEQ ID NO: 1531 - DNA, 570 bp, Candida albicans
ttaaaaattccagtgtcagagactgtcaaagagcaatctaacgaaacggtaccagaacccaaaccggccaaagaacagaaacgtgaatttcctgaattgactacagaggaaattgataatttgtatattaaatcaataaagtcagtgaataatattgaattacccacacctgcatctacatttatgtcatatgttaacaaaaatgtaccatctagtattactatgaagaaaacgtcttggaaaaaggcttccaaatttttaaaggaaatggccaaacttaactatattaaagtcaaaggtaaggacgaagaattatccataattcaactaaataccactactagtgagtcgaatgcaaccccgaaaacaaaatctaaacctacatctaatgcatccccgaacatcctaaaggttattccactttacaagccaacgaaaaatcttcgtttatttttcaataaattggatgctgaatatgatgagtattttactgcagccgctgcaaaatcgttattagagtcttatatcaagaaattttcattggttgctgatgatcccaaacttattaaa

SEQ ID NO: 1532 - DNA, 486 bp, Candida albicans
aaacacattcctgtcatgtttaaaaaaccagcccaaatcaaaccatcttcaaatatcaaaacttctgaaagaaaaaggctattgtcatgtattgcagatgcgtattctttgcctcttgaagaactaactaaggaggaaactgaaaaaatacttccatcgacaatcaaaaaggccagttttgtatcctttgaaaaagtttccgggtcaatttattttgatgagaatgaagtccctgtttggttccatacccgagactcggatatatatcctactatattcacgttaatgaagtatccaactattttgccaacaattgccacacatccacatgttctcggagtattagctaagggagccgacctcatgttaccaggaacagttcctccatttgataagcgagcagtcaagggtgcgattgtggggattgtaagtcacgacaatccccataaagtattcaccaggcgctggaaggaccgaacttgcgtt

SEQ ID NO: 1533 - DNA, 900 bp, Candida albicans
  unsure (8),(11): Identity of nucleotide sequences at the above locations are unknown.
cccgccanagnacagaaacatgaacttcctgaattgactacagaggaaattgataatttgtttattaaatcaataaagtcagtgaataatattgaattacccacacctgcatctacatttatgtcatatgttaacaaaaatgtaccatctagtattattatgaagaaaacgtcttggaaaaaggcttccaaatttttaaaggaaatggccaaacttaactatattaaagtgaaaggtaaggacgaagaattatccataattcaactaaatatcactactagtgagtcgaatgcaaccccgaaaacaaaatctaaacctacatctacatctaatgcatccccgaacaccctaaaggttattccactttacaagccaacgaaaaatcttcgtttatttttcaataaattggatgctgaatatgatgagtattttactgcagccgctgcaaaatcgttgttagagtcttatatcaagaaattttcattggttgctgatgatcccaaacttattaaaccagatgcagaattgggtacaaaaactgaaatgcctcgtgatcagttgttgaaacactttcttaccaaattttctccatattatcaaattaacaactctgtggtttataaggggacaccaccaaagattgaaattgttacagaactaaagattggaagaaaagtcgttactagagtttccaattatgaaaaatttgaaatcaagaccgaaactttagctaaagaattgagaaataaatgttccggttcatctacaattgttgataatgatgttcaagtacaaggtcctcatggtaaattgattatagacatattaaaagagaaaggagttcctgtgtcgtatattaattttgaggataaaacgaaaaagaagaaaaataaaaaatag

SEQ ID NO: 1534 - DNA, 330 bp, Candida albicans
gaatatacaatgccaccaaaaggttggagaaaaaatgctgatggacagtatccacaaccaagcagtaaagaaaatgagttgatatcaattgatgatattttgtttcccagaactaccattcaaaaactagccaagaatataatatctgacgacgaaaataatgctggtcaaatgacgatagccaaagattctcttcttgccttacaacgatcagctacagtattcgtttctcacttgttgtttcaagctaagcacatatccaaaggaagcaaatctgaaaattgtctcggcacaagacatgttggcagcattagaaagagcagaatttag

SEQ ID NO: 1535 - DNA, 1341 bp, Candida albicans
ctgaaaggtaattgttgtttagtgctactcgtaaatgctcaatatattataatgggttatccggaagagcttgagaaaatcaaggagttgcttgaggaggcaagtgctacatgtaacttcaagtacatgctcattacacaaggaatctcaccgacaacagatgtggcatttacttattcaaagcattttactcatgaagaagtaaacgactatagagttgtttttgggagatcattcacgagcattcgaccagtattgaatcgtacatacacgttgaagttgagtcgctcatccgacaattgggatgctatcacgagacaacttcatgatttattcaattctttaaatcaaggtgtatgcaaagaaattgctaaattgtggattcgaatattggctcctaataaacaaaaacatttcccctattcaaaaaaggatgttgttcccaattggtggccacgagacgttgtccatacagaaccagaccatttgaggaaagaagatcgaatcaaagttctaattaatgtggtgaccaataaaaatttcaaattccgtgacgttgatactaagtctattaaaaccaaagtagagcatactgaggctattattcatgaaatcatctatattgcctatcttgctggattattttattttggtcatgatcgagacaatgaaacttatgatattttatcttctaatgatagaaagttgttagaacaagacgaaattgagttcgaggtaagtgattttcggtactttggtaatgaaggtatttcacaaagtaaaataaaggatgaatatcttaatgaaaacttattcagattgaaaggtggtaacactgaaccgacaaaacaatccaccaaacagtctaataaagtaaagaagcctcgaaagttatctaaaaagtctagtactaaagcccttgctaaagtgaaattggatttgttagatcctcaggagaattttgatttgcgtattacgccagaggcacagcctcggtcacagctgccattacagttgccccagtcaacaccaaaagatcctgctcctgaatttgagtttccgttccaagacactgcatctaaaagtgatttgatgatgcacactcaaggtgatgaaatgtccttggatccaacatttgatccaaatactggatatcatattgttccaaacactgctcctgactacatgcaaaattatttcaatatgaataatgataactatgttgatccagcggccgcatacatcccagatccatctgaaacttctcaatatattagtcaaggtgtgaaaaagaaatgggaagataagcttgatagcttatttgaggaagattttggataa

SEQ ID NO: 1536 - DNA, 453 bp, Candida albicans
acaaacttattgacaaacatggtggcgctcaagcaattttcaacagcaacaacgatttggtttatggtagtgaagaaagagctcacacttataattgaatatctctataattccatcaccagcggaactaatagtgacatttacagcaggtatttattaacaactgcaacaacaagcaaatggccgttgtatgacaaattctaccaggcagtgaaagaggaccctgcaaaattaaagttcaaatttcatataatgtacggacaatttgattttatgaattctgaagctggtgaaaaattggtaaagttgttgaacgagaataaagtgggtgccaagtattacgaaatcagtgaaggtggtcacaatctttacattgataatccgtttgacactaatcaaaaaatatttgagattgttctgcaagatgctaccaaagctaacaacaatgactag

SEQ ID NO: 1537 - DNA, 1176 bp, Candida albicans
aatttagctatgggcgtatttggaagaggagcagtcagtaggatatccatccgatcaattcatttgagaaacacgaccaattttgttgttcctgaaaattataagccaaataggtcattgctcaagcagttaccatggaaagcaggacttgatatctggtggaagtccttgtctccaaatagactctctgatttgcagaaagatttagtggaatttatgctaccctctcatttgcaagaaaaccagagaataatcaaagagttcaaaaaaacaactatcgacgacaagggcaattatatcaatgaggtagggttcaagattataaacaacaaagataaaccaacaaagcatcttgttttcattcatggttatggtgcttctttaggctgttttgcaaggaattttcaaataatcaacaagttcaaagatactgactacaactatcatgtccatttcttagacaatttgacgtttggcttgtcatcaaatcccagagtgaataacgataccataaattactggcgtatccctgctacagccattgtgaagttatttgataaaactccaactgactccaaaaagttgtaccggaagtattacaaactaattgagggataccaattagatccagaaaatttcgaaaagtatagatcctattttactccaattttaaaagatcttgaaaacttttactgctccgcgatcgagaagtggagattgaacaatgacattgaaagtattgattatttggttggtcattcatttggtgggtactggtgtggcagttatgcattgaaataccctgagaatgttaacaatttagttttgttgtctcctgttggaatcgaaagacatgttcaagcagtcacaaatacagacccaatttctgatagaattgaggtgcctacacttgaccctacttcttacaaatttttaagccggttgcctatactatccaaaaaacacattctcagttggtattataaactcccacatttacccagattgttaccatttctcggaccttggggagctcaattgtactttaaaatgtggatgggaaagttgtacaaaataaacaaacttattgacaaacatggtggcgctcaagcaattttcaacagcaacaacgatttggtttatggtagtgaagaaagagctcacacttataattga

SEQ ID NO: 1538 - DNA, 444 bp, Candida albicans
  unsure (50),(92): Identity of nucleotide sequences at the above locations are unknown.
aacatgtggcgcttaagccattttaaaccagcaacaagaatttggtttantgttagtgaggaagggctcacaacttatgaatggaaatatgnaagaatccattcaccagggggaattaatagtgacattaaacagcagttatttattaacaaattccaacaacaagccaaatggcgttggtatgacaaattctaccaggcagtgaaagaggaccgtgcaaaattaaagttcaaatttcatataatgtacggacaatttgattttatgaattatgaagttggtgaaaaattggtaaagttgttgaacgagaataaagtgggcgccaagtattacgaaatcagtgaagttggtcacaatctttacattgataatccgtttgacactaatcaaaaaatatttgagattgttctgcaagatgctaccaaagctaacaacaatgactag

SEQ ID NO: 1539 - DNA, 2679 bp, Candida albicans
cacttgattgggaagtggccgaagtttcatggtcaacatcttcattttgtaaaaccttcttggtgtatttatacgtggtatcaaaaggcactattatgggatttaaagagaccgtcaagtaacgcaattgcaagtatactacattcgcataatagggccttatctgacatcaatttccacccatttgatcctgaaattttagctacatgtgcagttgatagtttcataatgagtggggatatgagagttccaagaaaaccagttgcaaagtgggcagaatggagagctggtgcaagtcaagtcaaatggaatcacgaaaaccccaacgagattgcgctgtgtcacgatagttcattttacatttgggacactagaaaaggtgctttacttgttgttaaaatcgaaaaagctcatgagaaaaagataaatgggattgattttactcaaggattgaaaaacattgtaacctgctccaatgacaataaagtgaaattttggaatttgcaaagcgacgaggcttccaattacatctcaaatttcaattattttgatagcgcacaaaacagtccgattcgtcccagtgtagttatagaaaccgatttcccaatagctagagccagaaatctaccttttggatctgacaaagcatgcggaataatgcctttggcaggagggaataactcaattcatatagtaaactacgatgatgcttaccgtgattatttacaagaaaaaaccacacaaatattaagtagccagcccgtttattcatttaaaggacatcgaggccctataaaagattttctttggagaacaagacacgaatgttacgagggctttgattctagaaagaaatggaaagactatcaattggtgacatggtcttcaaaagactacgatttaaaattgtggcagcacgatgataggatttacaagggtgtgaactatgaccctactttttttaatgttttcaaggacgaactggactcagaaacctcccggccagaaacaccacgagcagaacatgtttataaatatgataccttttgctgtgaaccacgaataacgatagatgatataacaaaaacaaatggtggcgatttgctttctgcaatgacactttcattaattgcggagaaacataaattagccaatacggagtttacacagttgaatcatctcaactggatttcaggtgttcgaatgggacataatgactctgctgagcggaagaacagttcctcaagttttgaagatgatggaccaaccaacttgggtgaggaggttagtatcgttggccacaagtttcctaaaataagatttgaaaaaatatccgtttccactggggaattggttatcagtttacgtgggccgctacctacactagaaagtactagtatggaccgcaaagattcggttgaatcaaatgaaaacaataatgcagagtcggcagtatcattacgtgataagagtattatcagtgaaggcgataaggataccgaaaaaatgagccacaaagaaagagagaacttgcatactgaatctaatattgagaaatccaaagaagagtttacaactgatcaaaaattggtgtttatacgtcttgaaattggttttcctaaggcatatccattcttggagcaagtcagttcagagcaattcaaatcagctaaaaagttttccaagctacaaaaacagaaccagattaagttcaatattgaagagacccatgagttatcaacctctaccaagaacataatgcaggagaatttggacaatattgcacaattctatactaataagtatcagcgattttgtctagaaccttgtttaagatatttgatgggagagaaagtggagcttgatgacgatttaatgattgagggcaatcaaaatggaaccgacagtggcgatagtgagttcatccaagaagtaggtgatgaagcatgggttgacgatttaatcaaccaacaacccgatattccgacatattcgtccggcgaagaagaggaaggagaaactggattggccgatttgatccctgcacatgacagaactctataccaaacaactgattccgaaattaaggacgatgaaacacatttgggccgagttaatgggaaagtacctactgttgatagtacacctttaccaaatgggtgtggtgctatttggtctcccaccggccaattggtttgcttttttataccaaagtcaaaagcagatggggatgcacaggaagacaacgagagtaaggcattccagaaatttaatatttttaaatttacagacggtgggtttagtctgccacaccatcaaaaatccgagtctataggatccgagtctgggactcaagacgactgtgattcagataattcttctgaagatgacaatgacaatcgatcagtttcttcttcttcatccgatggcagctttgccaaagattgggatgaaatgttactgaatgacgcaccgagagtaagagttcagggattgttcaaaactactcttggcttgggtaattatcttgatcacgaaagcagtctcaaatcatcattgaatagattgacaagcaatgggggtacagcttccaactacaaatcttcccttaaaggtgaccgacagaattttactgatgccattcagctgagtaatattaaatattgtgcgtatatttga

SEQ ID NO: 1540 - DNA, 1131 bp, Candida albicans
aaatcacgattttattggaatacacacccctttggaagttcttggcttattaaagagattttcgattattttgaaaggaaattgaatgtacaaatgttggcgatgatggcatgcatattgtatgagaatcctaaaaacttgaaagtggccagtgaattaatgaatgtccctgttcacacaccttatcaagctttgccaccacctcctatagtatcattgagtgcttgtaacagtaccatatttgggctttcttatgggaaaactacagttagcgaagataccgggtacgatcatagaaattcagctttgctgggcactataaaggagtccctggccccgcctgccactgcttacgccagatccataacttcgtcggttggagcagagagtattgctaatggatcgccagataaatttagagttttgaaaaaaaactttgcattaaaatcgcattcgttgggaccttccaacaactcgcattcttccttgaatgactctttacttgaatctaatgtctctacaccggaacggaatatgagaataccgtcactggaaaagaaaagtaagggtattgttttacgaaaaccatatcctttgaagaaattccgaccaaagcctacccctacagtatctattgagatgcaaaatattgaagagttggatgtctacgaagatattaactcaagatctttattgagttcgatagacaaagacaagttggtcaagtatagagagatttatgctgaaatgttgtataattggcaattgcctgtggggcgtatcaaacttttgaaattcaattatcctgagctggaaaaaacggaattgactactaaagatattcacaagtgttcaattggattcaaaaagagatcgcaacagcatccgcatcaaaatttgttgaacccaataacgacaatttattcaaagttcccaaactcatggaatacaagcaaaagacaattattaaaatattgcaatttgtgtcaattggcagtaactaaaaacttcactttatgcacagtgtgtgaacatataatgcacacggcatgtgccagagaatggtggactacagataatagtgaatgtgcaagtggttgtggttgtagatgtttagaacgtagcttttga

SEQ ID NO: 1541 - DNA, 1359 bp, Candida albicans
tccgggaatttccacccattttaccccattgaaaaaaatatattcatttcaaatgggttattagattatatcgatttaagcgaattttcatattcatcggatgttccatctatttcaccaaaatttttccaacaacctgaaaatgaagaaaaagtattatttttcgatcgtgatcctcaaatatttgaaaaaatttataatcatttacaaggttatctgattcatattgaaaatgatcatatatttatgaatttatggttagattgtttttattttggattaaaaaatttacaaaaaaatttaaataaacatgattattttgccataattggtaatgaacgattcagaattcctaaatcattaatcaatatgccagggaataatcctaattttttcacaatcaattttgatcgtttattaattgataatattaatataattgaaagaaataatatgttacgtccacctccacaaactttccctccagtaagtaatcgttcaagtaaattatttgctgatttattggaatttttccgaggtaatcatttggttataatgaatgatgaacatcgacaattgttaattaaagaggccagatattatcggtttttggaattggaacaacgattaattaaattcaaaatcacgtttcgtaatgaaattgtcattaatttaaatgatatatctcgtaaaggtttacaaaatccgtcaacaagttacaatattgaattaccattgacgtattatcgaccttatattaaagatgaaatgacaagagatttaatatttgaattaaatgctaaagattttgattgtcaatcagaaatcaaattgattttgaataaatcaactaaattgccaacgttaaaagtgactaacaaagcatgtcataaattacatcaagtatttaaagattattttagtcaagttcttaaagatgataagggtttactttttttcgttggattcactaattcaaaaacatttattaatggaaaagaaatgaattcaaattgggtaaatgatatattaggtatcgaagaagaggaagaagaagaagataaggaaggagaagaagaagaagataaacaacaggaagcaaaaaacaaagacggttcaaataaagaagttaataaaaagagaaaagtttccaaagaggataagagtgacaaaactatgacgaccaataaatctctggaaacaaatgatcctccttctcttagtcctggtgatatcattgaaatttgtttatcacgatcattatggaaagttatgatgagaggtccattagcaagattgcatgctgtaacattagaaggatttactagatccaacgacaccctaatagactttttataa

SEQ ID NO: 1542 - DNA, 723 bp, Candida albicans
aacattttttttttttgcttttctgtatgccttttccgaaatggttcgatgcatgatatgttgcctactccaacagtaaagaatatcgactacgacgaagtatatgaaccctctgaagattcatttttattattagattgctttgagaaagaaaaggattacctacaaagtaaattcaaaactgttgtacctttggttacagaaatcggaacaggttcaggaatagtcactacattcgttgctaaacatatagtcccaaatggcatatttttaacaacagacattaatccacatgcatgcgaaacagttttacaaacagtgaagcacaataatgatattggcagttcaaattgcctactagattcaacacagatggatctcacctctgccatcaaagagcgagaagttgatttacttatatttaatccaccatatgtcccatcctcagagattccagagattccgagaactaacaacgatcctgtatggttagatttagcgttggtcggaggtgaggatggcatggttatcacctggaaggttttaaataacttgactaatgttctcagtaaaagtggtgttgcttatatactattttgtgcaaggaataaaccagaaacagttacctcgataatgcagctgaaaggctggaatgttgaagtagtgataaatagaaaagctgggtgggaggtattgagcgtgttaaaatttactagaatatag

SEQ ID NO: 1543 - DNA, 588 bp, Candida albicans
agacatagtttgaatttaattgttaaatatcctcctacttatcctgaagtaattcctcaattatctataaaattaggtgaatctccagaagataaagacaactatgataacggtgacagtgatgaaggtgacagtgatgacgatgacgatgacgatgaaaatgcagatttaaaattagcattaaatatggccgaaaccattgaatttgatcctaaaactgatcttaatgatacattaatgaataaattattagaagaaagtgaattaaatttaggtataccaatgattttcaatttaatcaccattttaaaagaagaactggaaaatttattcaatgaaaaattaaacattaaacaatgtgaatttgatgaacaacaaaaaattaaagaattaaatgaacaaaaaaaatttcatggtactaaagttactaaacaactgtggttaaattggagaaataatttccgaaaagaaatgaaatatgaattatatgataaacaaagatttgaaaatatgcataaagggaaattaactgggaaacaaatatttgaaaaaggtttagctaatcaaaatgatgatgatgaacaataa

SEQ ID NO: 1544 - DNA, 330 bp, Candida albicans
tattatcatttcataagcaacatgtcaacaaatcatagaccacaattagaaagtaaacgaggtaaagttattaaaattaaagataccattcaacatgctagaggattaccacaacaaacatcaataaaatatcgacaagatatcaagaatgagaaaacgattaacaagtttgatgatttgcagaaacatgataataataagattactagtcttgaaagtataagtccacctactaagaaacttaaaatcgaatccacaaaagaaataacgaccgaaccattaaatcaagaaattgataagcattcaatcttcacacgggtggaagtccgc

SEQ ID NO: 1545 - DNA, 942 bp, Candida albicans
tcaagaacgatgagcatctactcaagatccgtgtcactagtcaggtgctactcttcggctcagacagcgatgaagaaacccttccaaggtccactctttcttaatccacatgcttggaaaggattaccagctgatcaagtgtttgaattacataaaatcagaaaggaatatatgggagatgcatacaatccaactgatgaagaaagaacagcaattttgtctacaatatcgtctttggttcctaataaacctcccttagattatgctttcgagattgaaaatttcaaagaacgattaatgaataacactcctatgcaagacagaggaaaaccacaaaagttgagcaatcagtatgtgatcaattctggtgcggttcctcatcaaagaagaagaatagaacaattaacgagaaaaattgcttatgaggcaccattgttagcaaaatatagacaaccatacacaccacgaccaagaacagaagcaccgattagattgacttacaattctgactttacagatgatacttcaagcgcacataacagaaaagtggcattaaaagtgagtttgcgtgatttaaacttgaatccaaagcaacagcataaatttaaagtgttggcaggtgacaagtttaatcatgatgaagatacatttcagttgaaaagtgaaagatatccagaggctgcacaaaatgtcaattggttggttgacactttcaataagttactcacagaagccaaagatttgtccaaggatgactacagcgatataccattgtcaaagagtcatatgaaaatcttggcaaagaaagctgttccatccttcccagaacactggaagaaaccagaggatgcaccaattaaaagacatgacattgtaaagaaattagttgctgctactgagaaggcaaaggataacgaatatattcgaaaaatttccccatga

SEQ ID NO: 1546 - DNA, 690 bp, Candida albicans
actacaattgccgatacgaccccaaaggaggatccattacctgatactacctacgatattttttaccgccgaatgaataagaatgagaagcagatgtcgaatgaggagagaatcaagaacttatgggagttggatacgttacagtctcagttggagaggttgacgcagtatgattggattaggagtttaccggatattactgtgattaaggatatgaaggattatgatgagttggagaggaagaaggagttgacgattaaagagattgaacggttattgcagaagcacgaaaactggagaaaacggaaggaagtgcacagccaagagatgaaggagtggtatggtggttctgattctgagtatgatgtgccgatagaggagttgagagagagaaggaaattggaaaaaagacagcggtatgggccagtgataagactaaatttggggaacgactattgtttggtgattgacccgcttgccacccccaaaattgaaaaatgtgaagaaccgccaaagccaaagggcaagcccataaccaagctagaggatgtggaggatatttcgcaaattgatattcaaacaaaagacaatatactttttggtactaatttcgaagatatacctacataccgcaacgggttccagctcccactacatatgaggagaatgatgcacaaacaagctaaatga

SEQ ID NO: 1547 - DNA, 420 bp, Candida albicans
agtgaacaatttatgatgagtttgaaatttaacattgagcttgactttgatatagaggaggagattaggaaaatcatgacattgtcgccaatgtcgactcccacttcaactttttcacccactgattctatttccacagtcgccacagagccagatactaagcccaacctagatacaataagctatgtcaagtcactaatgattgatagctccaaacttcttgggttgtactcgacgctaaagaacacgtacttaaagttatgcaaagagtataattatttattgacaaagtttaatgataatgagaaagccaagttgcaattgattcaagaaaatgaggaattgaaacaagctatggcggagttgttacaggatcgcagcagtaaaaagagaagaaagtcaagaaaagcattggcttag

SEQ ID NO: 1548 - DNA, 918 bp, Candida albicans
acaatggtgcaaataacagaagtaaaagaaaaccaatcatccagagaaagcagaactgctgctcatactcacattaaaggattaggtcttaatgaacaaggcattgccaagccaatagaaggaggatttgttggacagaatgaagcccgtgaagcctgtgggataattgttgatttaatcaaatcgaaaaaaatgtctggtaaagctgtgttaatagcaggtccaccagcaactggtaaaaccgctttggccttagctatatcccaagaattaggtcctaaagttccattttgccccattgttggatcagaattatattccgcagaagtcaagaaaaccctggcattaatggaaaatttcagaagagcaataggtttgagaatcaaagaaaccaaagaagtttatgaaggggaagttattgaattgactcctgaagaggcagaaaacccattaggtggatatggcaaaactatcagccatgtgattgttggattaaaatcagcaaaggggaccaaaactcttagattagatcctgtcatttacgaaagtattcagaaagaaagagtaacaattggggatgtgatctacattgaagcaaacaccggtgctgtcaagcgcgttggtcgatcagatgcgtatgctacagaattcgatttagaagcagaggaatatgttcctttaccaaaaggggaagttcataaaaagaaagagattgtccaagacgttactttacacgatttagatgtagccaatgccagaccacaaggaggacaagatgtcttgtcgatgatgggacaattattgatacctaaaaaaactgaaatcactgataaattaagaactgaagtgaacaaagttgtttccaaatacattgaacaaggtgttgctgaattggtgcctggtgtttttgtttattga

SEQ ID NO: 1549 - DNA, 531 bp, Candida albicans
acaaagttgtttccaaatacattgaacaaggtgttgctgaattggtgcctggtgtttttgtttattgatgaagttaatatgttggatatggaaattttcacatatttgaaccgtgcattggaaagctcaatagatccaattgttgttttggcatcaaacagagggttaactacagtaagaggatctgatgatggagtcaaagctcctcacggatgcccacctgatttaattgatagattgttaattgtcagaacattgccttacaatcaagaagaaatcaaaactattattggtaaaagagcaagcttagaaggattgacattgactgatgacgctttagagaaattgtcaaaacaaggtttgaccacatcattacgatatgcagtacaattattgaccccagctggtgttttaagtacaactgcaggccgttctgaaatcactgttcaagatatcgaagagtgtgagttcttatttttggattctcgtcgttcaacaaaagtcttgcaagaaaccaaaaccttcctttaa

SEQ ID NO: 1550 - DNA, 1164 bp, Candida albicans
gagttcgtttgtctactactattatcaaccagtaaatataacacacaacgaaaaacaaacagatattattggaaccacaaattgtatacccccattatgacagcaaatatcttggataataaaacatttatagatactgtattatcaatacaatcaactcaaaatgataaagaattacattggtatattataaatataattttacccgatttacctcaaatcatagagactttacagatttgttcaaatttgttgatgtacaattcaccacaagaacctgattccaaacaatgtattgaaaaaggtccatctatcaagctacctttgtctttaaccaatcaacaagattctgtcaatgggataataacccgagatggaccatatatcacagatcttaatttgacggttaagaatcattatttcaacaagcatttccataagttgcgcttaataaagccaatggttttagaacaacttgttaatgtgctaaatttgattaaggattcgattggcatactacagaatttacaatcaatagataaagagttgacattattgtcagagaaagaagaaaacgaacatactatcaaacacgatcaattgatatgtgatttcaagaaacttttggttaatatccatgattcaaagacaaatttgcaacttccatcagatcccaacttggttttccccttgcaggtaaccgatggagagaattttgaaccccagttactggatcgtatagcagtggacttttatcttagtcaaaaccaagtttgtattgatttgaaaagtcttcacagaataacagaaaaaccatggtgtgaaattgatgctaatggtaaatcgtttgtcgacaaattgaaggaagaaatgaaaaacaagagactgtcaattggtgataaatctacgtccgacgcaatcaatcaaaataacaacaccaatatattttctaacatgatgagtcaccttctgttgagacacaagtatgatacaatggattatataacccggtgtatcacctataataatatggttgtggtagtcaataagaagtttgaagtatctacagaagatccaatcttgattagttgttttacaaagttagattctttggaaagtattatcaatggatacatttctagcttgaatagtttttcaatgtaa

SEQ ID NO: 1551 - DNA, 1053 bp, Candida albicans
aacaacatagcaatggtggtaaacaatccaaataactggcattgggtcgataaaaactgtcttccttggtctgtcgactattttaaagacaaattaattaatttaaaagtaactgatggaaccaacaatgtacatatttctgaagtttcctcagttgaaggtgacgtagacgtgtcacagagaaaaggtaaagttatttcattgtttgatatcaaaattgttttaactttcaaaggtaatactgccaaagatgataatgtgagtgggtcaatcacaattccggaattgacttatgatagtgaagtagatggtttacaatttgacatatctatttataacgaaactgccgaaaattcaggtatcacagatttgatcaagaaacagttgatacctcaattaagaacagcattgatgaaatttggtcctgatttgattgaaattaatagtaaagatatccaattatcacaagataaggtcacctcgacatacacaaaggctaatcaatcatccactattgctgccactgctgatcacccaaagagtgaactgaaaccggttgaaaagaaaacagaaacccattcaacttcaaatattgcaagaaaagtagtttcagaaaaggattcatctactgttcctaaatacaacactacaactttgcatttagagccatctttcaacacttctgcagaacaaatttaccttactttattagatgaggctagaattggtgcatggactcgttcagctccagttattgaaaagttcccacctaaagaaggatccgaatttaaattttttggcggctcagtatctggaaaatttttgaaattagttcctaatgaacaaattgttgaattatggagattagatgattggaaagctggccattttgcccaactagatatgaagttagttcaaagcagtggtgaaactaaattggtggtcaaattcagtggaatcccaattggtgaagaggaaagagtgaaaaataactttgaagaaagatatatcagatctataaagatcacttttggatttggagcagttttatag

SEQ ID NO: 1552 - DNA, 1215 bp, Candida albicans
aagcgccatacacccagacacacagctattgtcatgtcactaataaataagcaatggtcgagtatatcgacagaactagtccaggacccgcaaaattttgaactctggcagagcttgatcgaagcagctgaatggaatgaaaaacgaggcattaacaaatcaactagcgaggaagaattgaacgtcttaagaacatcttataattcatttttagagaaatttccattccaattcaaatattggattcgatatgctgagtgggaatttaaattgggaaacacatctactgcagaacagatttacttacgagggttgaatacccaattaagccattgtattgagttatggatttcctatttgaacttcaaaatcaacaccataaacgataacatttcagaaattttacagaaatttgaagctgcacgagatttgattgggttccatttctttgggtttgaattttatgaattgtatttatcgtttttggacaattataaaaatgataacaatgaatttgagaagaaatactacattctattaagaatcatacttgaaatacctatttaccactatggaattttctacaagaaatggtttgatctaatagataatttgtcgaaagacgaaaaactagctaaacaaattgcaccatatattgcccccgccaacgaaattgctacccttgcatcgaaaaagaacacctcgatcttcaacgaattgaaaaaacgattcaccgatgcttacatagcaacacaatatcatagtttcgagttatacgaatttgaaaaaaaattgatacccaagaacaataagaatccacaacaagataatgatttgagatcacgacaggaacttgatgcctggatgagctatattgattatcttgagataaaacaatacccgattaaatttatcgaattggtatattacaggtttttatataatgccagaaactatccacaaacctggagtaaatttgctgattactatatatatcatgcaaaatttaacaaggcaagaaaaattttgaccgatggagtaaaatatgttgatgattataagttattgataaaattggttgatctagaaatctttttgaaaaactatcaacgagctataaacttattgataagttacattcaatacaattctaatgttccaattccaatacgtgataaagttcatcaagttaaacaattaatagatcaaaaatga

SEQ ID NO: 1553 - DNA, 882 bp, Candida albicans
  unsure (848),(850): Identity of nucleotide sequences at the above locations are unknown.
acgatgtcaactactcaagattcgaaaaaaacaaccggcacttacaaacgttcaagagtcagtagaggaggtaaacaacaaaacactgcatttcgtggcagtggaggagcagaaccaaggaaaggatataagaaaaattccaactttgatgaaaattcaccatccatcaccaccaccaccaccatcaaacaacaaattgaagaaattcctgaagatgaacaatgtataatatgtgccgaacggatcaaatatgctgcattaacaccatgtaatcatacaacgtgtcataaatgtacattcagacaacgtagtttatatgaaagaaacacatgtctaatatgtcgaagtgaaaatgataaaattatcatcactgaattgatcgataaagattatgatgaaattagtgccgaccaaatcactggatttgatgaaaaatatagaattgaattcactcaagattatgttcaaaaagatacattagcattattagagaatacttgttctatatgtcgtcaacaacaaactttcccagaatttaaacaattaatagatcatgctaaagaaattcatggcaaatattattgtataatttgttctaaattcaaaaaagctttcattccagaattaccattatacagttataaacaattacaaagacatcaaagtgaaggtgatggaaatggaactggaactggaactggaaatgacacagaaacagggttcaaaggtcatccagaatgtaaacattgtcatggtaaaaggttttattcagaagatgaattaaatgttcatattagagatcgtcatgaacgttgtcatatatgtgatcaatctaatcccattaaaangntaaaccccggccacgggaaaattttattataa

SEQ ID NO: 1554 - DNA, 669 bp, Candida albicans
tggatatgggaaactgatccggaaactttagaagaatttgaatgtgtggcagtattgaatgatcattcacaagatgtgaaaaatgtttcttggcatccatcaatgaatatattggccagttcttcttatgatgatactattagaatctatcaacaagacattgctggggatgaatggtcatgtgttggtattttaaatggacatgaaggtactgtttggtgttctaaatttgaaagtcttaaaagtccaattgctgattcaagtgttttaagattagtttctgctagtgatgatttgtcagtaagaatatgggtagcaaaaagagagcaagaagacgaagaacaagctaagttggaacttccaagttcgattagacacacaaacgaaatggtatgggaagtagaatctgttttgccttctgttcacaagtatccggtttattctgtggcgtggtctgcattaactggtaaaattgctagtgctggctccgatgggaagattgttgtgtattcagaaactgaaaaagggaaatgggtgattgattctattcatgaaggtgcacatggagttcatgaaataaactgtgttatctgggcacaactagatgatgaaaatgaaatattagtgagtgccggagacgatggatatgtgaatttatggaaaatatag

SEQ ID NO: 1555 - DNA, 219 bp, Candida albicans
acatcaataccaagaagtttttacaattcaatcccacatacaccattaattatgaattctgaaaagattattgaagttatcattgctattttcttaccaccagtagctgtgtttatgaaatgtggtgccactaccccattatggattaacttggtattatgtatctttatttggttccctgctatcttacatgccttatacgttgttttgaaagattaa

SEQ ID NO: 1556 - DNA, 681 bp, Candida albicans
caatttttaccattattacaagatgattgtattgaaaataagtttgatgcttttgaaagtgaagaaattgattggatagaattaaaacaacaattaccccaagatccattaaatcaaggtacatcatatttacatggagaaatcatggttatacaaggtccaactatggaaaaaagattattagatatggccgcatttgccgttggtttatctcgatcaacaagattatcaattttagaaactcaattggaagattatctacatttaactaagaaaaattcggaaatattagctaatgggaaacaaatcaccaccactgaacatgaatttttaaaaatcacgggtcaattatttttattaagagggaaattaaatctttatagtgaattaattgataccccagatttatattggagtgaaccaacattagaaaaaatttattatagtatatcgaaaattttagatattaattctcgaatatcaatcttgaatagaaaattagattatgctactgaagaacaacgagcatttttaagtgtattgaatgaaaaaaaggggacaagattagaatggattattatttggttgattttaattgaagtttgttttgaaatattccatttttatgaaaaatatgaagaaaaacaaaataagagactaaatgtgaaagaagatagatag

SEQ ID NO: 1557 - DNA, 732 bp, Candida albicans
aggataggacttttcacttccttgtgcgaacatgaacgactcaccaatatacaattaggtctttatagtactgttatccctttatctgtaattatcattgttgccctaatttccacttgtcctcctaaatataaattatataatacttgggtttcaagcattggattattattaagtgtattaattacttcatttgttacaaatattgtgaaaaattggtttggtagattacgtcctgattttttggatcgttgtcaaccagcaaatgatactcccaaagataaattagtttcaattgaagtttgtacaacggataatttagatcgattagctgatggatttagaacaactccttcgggtcattcatcaattagttttgctgggttattttatttgacattatttttattgggtcaatcacaagctaataatggtaaaacaagtagttggagaactatgattagttttattccttggttaatggcttgttatattgcccttagtagaactcaagattatagacatcatttcattgatgtttttgtcgggagttgtttaggtttaatcattgccatttggcaatatttccgattattcccttggtttggtggtaatcaagcaaatgattcatttaataatagaattatgattgaagaaattaaaaggaaagaagaaattaaacaagatgaaaacaattatagaagaatatcagacatttccactaatgtgtga

SEQ ID NO: 1558 - DNA, 891 bp, Candida albicans
acttttgacataaacaacaggtaccacttgtctgccatgacattcctcaacccatcctcaatagtaaaatacacacagagtaaccaatttcacgattttatccctgactggatagttgcaactgtaacggtattgtttttttttctggttgcagagacagcactcccatttcaacggcagttttcccttgatgatttgacaatttcccacccatttgcaattaaggaacgagtttcgggaatcttgtgtatagaaattgctgcatttgttccattatttgtaattttaacatcattattggtaaagtatcaacagggggcattttcttcacatcaacaagctttgcattgcttgcaaattagtgttttaggtttgataatatcattgagtttaaatggagtcatcactgatatacttaagatttggatagctagaccaagacccgatttcttggaacgttgtgggccagcaccgggaacaccattgcatgagttggtagacgtgaatgtttgtactgcacctttgggcaaagccttgttgattgatggtatgaaatcgacaccttctggtcattcttctattagttttggtgggttgttttatttaacattatggttattggggcaatttaagttattccagaatagagaatctccgcaatacgtttacaagtatttccttgcattttcaccattgtcattggccacatacattgcgttgagtagaacacaagattacagacaccattttactgatatagtgttaggaggagcaataggtatcagcttcgcttggtggtcgtatcatcattatttcaacaaacttgtttcagaggagtcacacaaacctatagattccgaaaccttaactgaactgttgttaccacattag

SEQ ID NO: 1559 - DNA, 387 bp, Candida albicans
acttttaatcatttacctcgcaccactggaaatagaatgattcatacaattaagagacatacaaattgtgcatctatacggaaaaggtttttttcatacagcaccatcaattcccaagtacaattgacatttttcaccaaagacaattgcatgctatgttcgaatgccaaattcatattatatgatgcattgaaatcccccaaacttaaaaatatgcctatcaaattgacaaccatagatattatggaccctaagaaccaagaagcatttgacaaatactgctatgatgtgcccgtgttgcatgttgacagaccaaatcaggccaaaccagttaaatttatgcactacttttacgaggataaattgctagaggagtttacaaaatag

SEQ ID NO: 1560 - DNA, 1137 bp, Candida albicans
tttaatagaaagacgcgtaaccaaacacaaaacaagaaaagaaaaaatatttttgttggcgtttcgttcatctctcaatatcccccattgaaaccattccagaacaatattccaattatgagtctgttgaaacgaaaaattccgcttgatgaaatagaagattttattgctgaagaggaagaagaagaagaacaaaatgatgatggttcatacgaggaagataatgaatttgttggaccaagtggaacggctacacctcttgatgagagtgaaattcagcatgttgtaaaccaagtggttagattgtttctttcgagagaattaaatggccgaaccacaagaccagatgttattagaaaacatattaagcataatttggggagaaaaattaccacggaaaagttaatacaacaagcaaatattatattaacagaagtatatgggttgaagatagaagaagtcccaacaataaaaagagaagacaaaaaatcactgaaatctagaaaagtgacatcagataaaaatccttatattgtcactagttcgttactgagcaaatcaagagccattctaggggaattatggaataaaaatttagccaaaaatgtgaaaaagattgacattgggggtaataaatttttcttaccaaaatattctataacttcggtacccggatcacattatgaattggttaaaacggggattatgcttgttataatctcccatattatattgaatgaaaatcatgtttcagagtctgcattattgaaaacccttcataagtttggtataagcagtaatctcaatgttaaaaacagtaactttaacttgaatagtcaagaattgcttaaagaattagtgaacaaggactatatcttaaaaaatgtcattaagggaagaactgagctggagaacattttcgactattctataggacagagatcattggttgaattttcacctcaaggagtgtttgattatatcaaagttatttatggtaacaaatttgatagcactatagcagagagggcattagtgacgattgaaagagcatatggtgttgcattaaacaatacagaggaaaataatgaacgagagggatctactgaggccaacagccaagaggggtcggagtag

SEQ ID NO: 1561 - DNA, 1086 bp, Candida albicans
aggggatataacaaaaagaaaaaaaaaaacgacgaaaaaaaaaaaataaaaaataaacaaatttcatcctccaaagtaatgtccttttcagctacagcgtttaaattcaaactagacactctactggatactcaagaatccattgtctcgatctcccaatgggttttatttcaccagaaatattacaaggagagtgcaaagatttggctcaactacatcactcaagattcaatcacaccagccaaaagattgtcgttactttatctttgcaatgacgttgtgcaacaagcaagaagaaaaaacaagccggaattcatcaatgagtttaataaagtgttgccagatgctttgagtaaaaactatggaaacttaaacccaaaggttgacaggttgttgaatgtctgggaagaacgaaaaattttcaccgaggatgaaattgccaatatgaaagcatcactagaagccgaacccaaacctttggagtcgattgatattgctccccagctcaaacaaatcaacgacttgttcgtacatcttaataaattaaatgatatcaaccaggaaaatctcacacaaatgggcatacagtcgaaaacatacttgtatccccaagaaccagaaactttacctccggcacccgtatatctttcaaagttatatatgttggaaaagttgggtaatgtttgtataaataatgtagaagaaataaaagagaccagaatgaagataaattcagagcttgatagccttttcaacttgattattgacggcacgaaaactgatgatagcaagatcgctaatattaacgaaaaaatacaaaaagcaaaggagactatacgcgatgtgaatttgactagtatggaagccggtagtgatgacgatgacttccctggctatttatcggattctgaagaggaggaagaaacgaaaaagagaagattgtcacaaacaccatcgggtggatcaacaccttccaagagagtggcattctctgaagacgttgaagtatttgaagatcctgatgagaacaaggaagagtctgtttctgtagatgttatgtctttattatctaaattagtcgactag

SEQ ID NO: 1562 - DNA, 480 bp, Candida albicans
aaggcgtcagaaaatggtagacaaactgctgatacggaattatcaactgagtgtaaatcaccagcaaaagagttttcaacaaggcagagccacagagtaagacctgcaaggttggttttttatgacactaaaggaggaccaagtggaaccggtttatcttacaagtgttttgagtgcatagacgaagtaatcagggccactttcacgcgtgtcaaaaactgtaagtgcgtgtggggttgtcccttatgtgtggtttccagtgcatgcaaggaacaaatgagagtgctgtcacgaccagctgcgttgttgattttggcatcatttctaggaatgaatttatctcagctcaaagatgatttgcctataggtccagaaccggacattccagaattggaaacagagactataatgtatgcgaatgcaactgttcgattttcaccaaatgttcagattttaaatgttctacgtagacgtacttag

SEQ ID NO: 1563 - DNA, 534 bp, Candida albicans
aattgcattatgaatctcattgatatgttatcaaaggatcctccatcctcgttatacaatccagaactcgaggaaaatattcaaaataatgaaatctccaatggtatttctattagcgagagtcaagataacattatacttgataataacagcaacggcaacatcaacaacaacaacaacaacgacatcaacatcaacatcaacaacagcaatcctcctagtataatatatcttccgacaccattgactgaattacagaaatcttttgttgaaatgacgttgcatttgttcagttctgaattgttaaatgaagtgcgttcgaaaagattgaaaaccagtattgataatttattagactcgtctactaccatagaggaaagcgatataatcgtgaaccaaaacaagatatcgttgtgttttgaacaactttcaataatctgtgatcatccgtcattattgattgaacattttatccccaaaaaaatgttattgctggaaacaaatgaacgacaacttaatttgagtggtaaattg

SEQ ID NO: 1564 - DNA, 564 bp, Candida albicans
actattaacaacatggctatgcgtactagagctgagaaaagaatgaggaagttcctcattgagcaattaaaaactcgtcaacaaaacggtgctagaatagcacaaggcaagaaaagcgaacatgaattgatcaagaataacttgggtccacaagtttttgtgtttagaaatcttttcagtggacaagtattgtactcccaagttccagcataccatgaaaaccaaattaatcaacaatttttgagcccaaattggcaaaaccgaaagccttcaagaagacaagatttgtggaaaataatgtgcgtggttaattttaataactacgagtatgctatcgctgcatacaagggtttagttgatttgagaaaaactagagatgttgttcaaaagacagaagccaatgaaatgagaaagaagaacgacgaagggaacatttggtacagtggtcaatttaggccaacatacacacaagaagctgttgccgatttaacgcacgtcattgatgaatttgaattagaagggcataaaatattttgggccaacgaatggcataggggagaatga

SEQ ID NO: 1565 - DNA, 840 bp, Candida albicans
agcccaggaaacattgtaatagttggttggattcatttattcacacttagaaacgaactagacgaaagtacctcagtcaagacccccaaaaaacgatcatttgctaaatattcggaggttacatctgctgcagatgcacaattgaattcccgtcgtaaccaaatattaaccaagtggtcagctaaagttgccaattcatccggtagaaatgccatgaatgctaataaattcaaaactataaaccaatcttttgaacaacaggttaacaacaacttgtctgacatggatagattaatcaaaagaacaaaattgaaccgaagaaacgtaactcccattggttataccaccaaagaggaggatgatcatgaaaatggcaataaaaacaaatctatcgacgaggacgacgacgatattcccgaagatacttctgttcgtaagaaaacccaaggcttggaaaatgattatatatttgatgacgaagatttctatagagtattgttgaatgatttagtcgacaagaaagtgcaaacaagtgatccaacatcaggtataactatcagtttaagagctgctcaaaagtccaataaattgaaaaataatgttgatacaaaagcatctaaaggtaggaaattgagatatcacgtgcaagaaccaattgctaattttgaaacttcaagaggcagctggagatggaatgatgatcaaattgacgagtttttcgcatctttattgggccaaaaggtcaatatgaatgagatagatgatgaacaagaagaagaacaagagaatgatgataatgatattattccagaggataacggaatccagttgtttggttaa

SEQ ID NO: 1566 - DNA, 678 bp, Candida albicans
gggatcatgattttagaagaatctaaagacaatgccatttttcagcatcatgacggtggttctgaaaacgaatctgaagacgaggatactggcttaagaaatgagcattatgttgaatcttcaaaatcaaagttgagacaacagaatgaaggtgtgaacttgggggaaaaatacgtgggcaatgtcacaagcagaagcaaattgtatgacgatgaggatgacaaacaaccaacagaagctagctccggagaggagttagatgctgaatcagcggaagaagaagaggatgaagaatctgaagatgtagcagatgatgatgaagatgaccaagagtcagatcgcagtagctcaagtgatgcagagaatgacgaggacgagaacatttcacacaaaagggaattattaaaacaattaatgagcaaagagagaagtcacatcgttaacagattatcccaatcagcaacaaatgatgcattaaaaggttattcaatacaacagcaaaacaaaacttttgaaaaaatcattgatgtgaggttgaaatttcagaaatcggtaacttcaagtaatatgttacctataaatacaagtacatattcagaaaccaaatctgaagatagcgatgaattagtgactaaagccaagaaacaattgtatatattcacccggggtgagatcaag

SEQ ID NO: 1567 - DNA, 1389 bp, Candida albicans
cagtatttcttcatggctaataaacgacgtccaaagaaaacccgtgcaccttacagaagatatgtttacaaatcaaacaattatttagctgactccgatgaagacgaagagtttgaggacgaaactgagcaactggaaacaacaatacaggcaactaacaatgccaggttcaaaggggcgataaacgtgcagtcaatatatgtcctaagtgatcaaattcgttatcaaggtaaaatgtggccatggagtaaatttgaaaaagttgacattttgcaatgtgctttacagggtcataaccctttatatgctcatactaaagtagaagacgagccaacccaaggattgatgaagtttcctgcagagatatttgtccacatatttgaaatactaaatgcatggggtaaactaaaacctaaatatatgagagtgtgcaaactattttatttattgatattgcccataatatatcggcaaccacaactaaaagccactaattttttcaattttgtggaggcaatttctagcaataagtcattgggtcaatacattcatagtttggacctttcatatattatacaatcaggtaaaaatgcatttgtagctaaactcatgaaacgagcaggtaaaaatttggaaattcttgttgccccacaaacaagttttggattggggccattgattgcattgaagaattgtttaaacctaaaggttttggacttaaggcttgtttctgaaactttaaacttggaggagttattcaagtccataaggaatttgacagaattgacacagttatcatttccaaggtcttcggtagaaattcatgattatcagctgataaattggcctccaaaattaacgttcttgagactttcaggaggtattagtgatgatttcttataccaattggagttccctcctctgattacacaattggagtttgcacattgcccatctataagcgatcttggctttcgacaaattttgtatcggataggggccaacttgaaaacattaaaagttcagtatccaatgccgggattgaagaaaaattcgttggatcaagtgtctgtatattgcccaaacttgagagtattggaaattagtgttgattatgtttcatccatgttttttgacgagcaatatttgggatatatggactatccgagacctttgcgtactttgtatataaatagtagtggtatgttgggaacactgactcgtttggacccgatagatttggcggttgctttgaatgatggtagattgccacatctaaagcatattcaatgtactgccaaattgggttgggatccactgtctgacgccctaggttatattgctgacgaattggatgaaagaaaaggtgggatatatataggttattaa

SEQ ID NO: 1568 - DNA, 807 bp, Candida albicans
attagacgagcattatttaatagtgacattagaagccacactactactattgcatcaagtgtggagactgatcatgaagataataacaatggtgcttttattggtgatgatggtggtggtggtggtgatgatattcatggtgacattcatagcgatggtaataatgatggcggggataataacagtctaactaaacatgtcagtcatcaatatactcgacatttacataattcgactccgtcattaagagctactcataatctgtcatcagattcaaatttatgtcctgtgtgtgccaccaatttattgaaattatatattgctgatattcattcacatgcacaagataaaacttatttacaaaaaatatctaatgaagattatgaaaaatttaaagaatttcatattaatcaatgtttaacaaattttgattttgatactaatcattcaaatagattttctccagataatctgaaaactttaaagaataaaatgttggtttataacataccaccgataccaaaaccaatgtatgaaaatatagaaagtgggagtaattcactacctattgaaaaggccaataaactggaagaaattaaaggtgatgcgtacgatgatgaagatgaagatgatgatgaggaggaggaggaagaggataatgaatgtgttatatgtttggaaagtttgaatccaggtgataaagttggtcgattggaatgtttatgtgttttccattataaatgtattaaagattggtttaataagaaaggttatggtgaatgtccagttcatttcttacataaataa

SEQ ID NO: 1569 - DNA, 678 bp, Candida albicans
gataatgatgaccccaatgaacagattctagggttacgatttgatctttattcaaattatactaaatgtttccagcaacatcattatggtatacttcggaaattaccatttgaaaaaaacgacagcatattttataattggatagtttataagcatacactaccgtcatatatcccagttgatgaatattccaaaatcttgaatgaaaacgataatgaaaacgataatggtaaccaaaataatagcttgtttaaatttgttgaatccattcaatttacattaaccaagacccagtataaattagacaaattcaatcaacttttacgatttaacaaaaatcaatttggtttggataaagatgaagcgatttttataaatttagattgtgatttactgggtcaacgaatattcttgaatttaagtcataactctcaatcccaaataaagaaaactcaaatgatgggagttgaattgatttgttctaatgatttaattgaagttatacatttcaataatttcccagatatcattcactctaatcaattattgatttgtcagactatattacaaaactccaaaattaatgatttgattaaaaactttagaaaagttattcagattttagttaaatacaaagtaatagaatatacagacatagtcttcaccaaggtggaagac

SEQ ID NO: 1570 - DNA, 1470 bp, Candida albicans
atagaaagtttgttgtcatttctatggactatggttcctccaaaaaaagatgcatttgcagatttatttcaatctgcaagtagtggaaatagcactagcagcttgaacttaaagctcaacaatttgtcactatcagaacgtcaaaagttacagcaacaacaacaacaacaacaacaacaacaaagacaacaagcttttcaacaacctacaaaaaacaatctacttcaatctcaatcccagaacaattccgtcaattcaagctggtcaaacattgatattttgacgccaagtaggacagctagtccagtaagcaatagtggaaattccgagctgggtgtttcacttcaccaaacaggtatcttgtcggcccaaccagaagatccatttctgatctttctagaaagcaagtcccaaaacctgtctagtaagtcggacccaacccctgttaatagggacaactcaaaatcagctgagatttctttgttggacgatgatttcaccgattttttccaagaaagtaaatcggcttcgaagtcagttgcatctccttctatactgtcacaaacttccgaagcagagtcccacctgacagttctgcatagcaagagagcttcaaatagagctaatgagcaaaaagattttgttgttgctgaattggttgacattggatttagtgtcgaagatgctaatgaggccattaacaaaagagggttagatttgcagaaatgtgtcaattatattatgagtaagaactcgggcaattcaaacacggacatggtggagaacggtggttctgttctaggtcagcgttccgaaggaataaaattgaatgagttgggcaccgatttagttaagaaagcaaacagtttctacaatttttctaaacgagcggtaatgcaaaatttggaacaattcagcggtcctagaagcaacaatgacaacatcccagcgtggatgaagacgaaagagaagtatgaatcagatgcaatggagaagaaatatggaggcgaggagtatggaacggacgaagaaaacataaatcaaaaagacatagagcgctttatgaaacaacaaagagaacggaacagagatagatccagagctcgctttgaaaattggatagacggcaagccaaaacaatctcatccctcgtctaaagagtcaagtccagaattaccacagagaccgctgaattcaaatcgccatggcattatgagctcgcaaaagagagagccacctagacgcaacgtgcagcagaaagcaagtattgaattgccacaaagaccagcaagaaaaagtcaagttactgcacctccagagaggcccacttccataaatcatcatgcatccgacccagtttcagttgactcttctgtaaacagtactactcccgatgaggatttgcttggattgggaacttcgggcacatcaaatggtagaaatgcccctgcccctggtttcttttcgtga

SEQ ID NO: 1571 - DNA, 957 bp, Candida albicans
attggtaattggcgcaaaggacaaaaaaaaggaaattcgccagaactcttggtgatagtgccaaacagaccaaaaaaaaaaaaattttcaaaacccagaaatcaagcattattcttgaagaaatcagaatccatagcctacacgatgttgagaagaacgatatctcgtcaattccaaagaagccaaagtacctcgacaaagggattttggtccgacttttccaagagatcaccatctttaagaattcaaaatgaaaacattagaaagggattatttgaaggaatcgatgaacaaggaccggcatcaataaagaactcaaatattagagagatttaccattctcctattgctattgatgaaactttttctgaagcctataaaattctagaagctgatgcaagtaagaaatatggcagacttgaaaaattgcaagaagaatatacaaaaatagaagataaatctagcaccaaggctaattccatcaagagagaaatcgaagaattacaaattgagaccgagttgagaaatcctgaagtattatacaatattgaatataattctgctgacgttatcgacaagtcacaaccaatatacagaaagttgttgaaggaaaaatggaaggaacacgatttgttgcttacaatgcaaagattggaacagttgcatgttattccagatactttgccaactttggtaccggaagcagatgttaaggtgaaattcagtcacaatgttgaacatgaatttagagattggattgctccaggatccattttgccaacatttgctgttgaaaaacctcctgtggttcaagtgcaagagtttgataaagttgaaggtaacgaaagattatacactgttttgttggttaatccagatactccagatttagagaaaaactcgttttcaactactttacattatgcctgtcctcaacacggcgaagaaggaccaagt

SEQ ID NO: 1572 - DNA, 615 bp, Candida albicans
gcgcggatgccgccacctcgtggtgaagatgtcaatgatgaaaaacttgttgttattaatgaagaaaacaaaatatttgaatttttcattaatgacaaagatggtcaattattaactccatggtctaaaagaaatagtgaatttttaccaagacaatttatatcattacaagataaacccgaaggaatgtttattcaacagaaacaagagaaattatggatttatggatcaacatggttaagttttttcgatttatcaatgaatattccaatatctaaaatttataagaatacttcgacttccaaaaaaagaaatcatgatggattatcaatgaatgaagaaattggtgaattagaagatgaaactgaagaaattatagaagcctcattaaaacaaagtgaaatagatagattaagacatcagattcaaactgaagataaagacaatcaaaataatgttgataaaactaagaaaccattttggattacagaaaaatatagaccaattatgaaagttgctaattttggtggaaatgatgatattattgttgttgaacgtccatattcttctttacaaacaggtccagcatttgatttaccaaaaattaaagtttaa

SEQ ID NO: 1573 - DNA, 612 bp, Candida albicans
cgacattatttgatttatactatcatcactttacacacactcatatattattattcatcttctgtacgcaaaaaaaaaaaattctttttttcaattcttaaaccgtataataaagagacccaaatcttcaacctatttttatcacaaaccaacaaaaatatctacaccaagaagtttttaattatggatattcatcgttgtagatttgttgattataccccacatacaatcacatcattagcattttctcataaatccttattaacatcattaccaactgccgatgtccgattagccgttggtagaagtaatggtgacattgaaatttggaatccaagacataattggacacacgaattgacattacccggttcaaaaggtagatctattgaagggttatgttggagttataatgaacaagatccattagaaccaccaagattattttccattggtggatcaacatatattactgaatgggatttatccacggggaggccattgataaattatgattgtaatgccgggataatatggtgtatcgatattaatccacaaaatgatcgattaacggttggatgtgtcttcaccacggggctggaaggatccgca

SEQ ID NO: 1574 - DNA, 558 bp, Candida albicans
cgcggatccttcggccccccctgtggggcaagacgatcattggaatatgatttgatttgtcaaagacaagatgccagagtcttgagtgtgaaatgggctaataatgaacatgttattggtggatgtgctgatggtagaattagaagttggagtagtgaaggcgaaaccaagggtagacttgtagctactatgaaagttgataaggctaaaactgaaagtactttggtgtggtctttgacagtattaccaaataagaaacaatttgttagtggagattctaccggatctataaaaatttgggatttgactcgttttacattgttacaaacttttaaaatacatgatgctgatgtgttgtgtttagttcatgatgttaaagaagaaaaaattttcagtgctggtgttgatcgtaagattcatcaatttgatttactcaacagtaaaaatagttctaaatggactcatagttttaatcgtttattacattctaatgatgtcagatctttggctatatttgaaaacaaaaactataatttattagttagtggtggtgttgaa

SEQ ID NO: 1575 - DNA, 366 bp, Candida albicans
gtcatctcaactccatcattggacactccacaagaaccagaaataccaaaagatccatttgaagctataaccccaatcgatcatctggaacccacggaacaaccattcactagaattcaaatcagatttcctaatggtaaacgattagtacgtaaattaaatcctgatgctaaagttaaatcaatatttgaatggttgaaatatgtattacaaaatgatttccaagaatatggtttaaattctcctgatgataggtttattttatccaatagctccaacaaagcatttaaatttatagattctttggataaaactatagaggaggctaatttgaaaaatgctagtattcttttggaacaagattaa

SEQ ID NO: 1576 - DNA, 990 bp, Candida albicans
atcaacaaccaagtattactagaccaaagtgatatttttggtaatagacaccaaggtgttttccaccaacgatttgatttccaacaacgtatgatgcctggatttgacgattataatgatgataataataatgatgatagaattgaagaaattgatgacgatgacaatgatgatattgaatatcacgactcacatgatatacaagtgttagactctgatgacgatgaacaaggacactataatggtgctgtgggaggaataacgggtcgtagaagacaattgagacaaaatcgtcatcaagaactatcatcaacacaaagacgattagcaaatttattccgtccaccatttgatatcatatctgtattaaatcttgatgaagccaaatatcaaggtcgacaattgaaaaaatggattctaataaatattcaagattcactggaatttcaatgtcaagttttaaatagagatttttggtctaatgaaagaatcaaacaaattgtcaaacaaaacttcatatttttacaataccaaactgattctgttaatgggcaatcatacgttaacttttatcatgttgatacgttccctcatattgctattttggatccattaacaggggaaagagtacataaatggactgatggtcaagttcccttggtaaatgaatggattgaacagacatataagtttttagattcattttcattaattcctgggtctaagaatcctttagtacatcatgatgtgaaaattgatcctactagtttaagtgaagaacaacaaattgaattggccatgaaacaatcaattatagataataacgtggacaataataataacactagttataaatcgggaaatactattgatgatgccattgaattggatagtgatagtgatagtgctataccagatgagtcatctcaactccatcattggacactccacaagaaccagaaataccaaaagatccatttgaagctataa

SEQ ID NO: 1577 - DNA, 789 bp, Candida albicans
tgtatctcaaaccaactagctaaacaatataagcatactagtaataaataccattactacattataatcatgaatagactagtcctaagggtactatctaagtacaccaggttttctctaccgagattgcaattccaaaacatacggttttcccattcatttccattgcgagattaccaacagaaagctatagacttgatcctagaatcatccaactcgggagtgaaaagacaagcaatagaaatggctactggaagcggtaaaacagttgtatttagtcacttaatccccttattgaaacagaaaggaaccagagcccttgtattagcacatactcaagaattaatcactcaatcgcgagataagatcaacaaagtgaatcctgatttgaaagttggtattgaaatggggaaagtacggtctaaaccagatgatgacgttgttgtggcgtcagtcatgtcattagcccgatccaatagattagaaagatttaatcccaatgaatttaaaacaattattattgacgaatgtcatcatgctgttgcaccgtcgtatttgaaaatattgaaacatttccatgcagatacaaaagacactgatgttcatgtaattgggtttacggctactctagcacgtaccgataaacagaaactaggaacagtatttgataagattgtctttcaaagatcattacccactatgattgaaaacaaggagttggcagagtttaaaatatcaaatgtgaatatcaaagatttaaatttgaaaaatgtccccaacaaagtcgtg

SEQ ID NO: 1578 - DNA, 1059 bp, Candida albicans
aataaacaacattctatattggtgtatatcctggaacgaaaaagaaatcggcttcaaagtgaaagagttgctaatagccatcctcttattatggttgcaaattgcttcaccccaagggtcttggtgaaatacatgaaatacaagctctcaccaatccaatcttggtacagcaaacgtctcattcactcgtttgccttgagagactatcaacaagaagctatagattccattttggaggcatctgaatcgggagtgaagcgacaagcaatagaaatggctacagggagtggtaaaaccgtggttttcagtcatttgattccattattgaaagggaaaggaacaaagactctagttttagaacatacacaagaattgatagcccaatcttatgacaagatcaccagaatcaacccagatttaagagtaggtatagaaatggcagaatcacgagcaagacttaatgatgatgttattgttgcatcagtacaatctttagctaccaataaaagatttacaaaatttaaccctgatgatttcaaaaccattattatcgatgaatgccatcatgcagttgcaccaacatatcaaaaaattttgaaacatttcaaggctgataccaagaacactaatattaatgtcattggatttactgcaactttggcacgtgctgacaaacaaatgttaaaagcagtatttgatagaattgtatttcaaaggtctctcgctaccatgatctttaataaagaattggcactgtttaaagcatcaaaattatattttaaaagattgaatttgtctaatgttaaaatgaagggtaaagattatgatcctaaagctttatataatgcggtacttaaagcaggtatcaatgaacatcttttattagcttatatggaattggagaaggagtacaagagtacattaattttctgcattaatgttgagcattgtcgtgaggtatgtgccttgcttcagaagcaaggtgtagatgcacgatatgtgattagtgaaacgtcaaactccgaatgtgaatattcgccacggcctagaagatccgca

SEQ ID NO: 1579 - DNA, 1839 bp, Candida albicans
aatttcacaacaatgagttcgagagcattgcggaggttggaaagacagaaattggaaaatgagttgtctatatccccagaacctgaaagaaatggtaatgacgaatctgattttgatgatagtccgatttctaagccaaaagcaaacgcatttgcattattaaatgacggcgacaatgaaacagatgacgaggaaaactctgataatgacaataaagaggatgaatcaacagagcaaactagagcaacacccaagcagcctaatgaaccaccgaagaataagaacaataaaaagaagcaacaacagaagaaggcaacaactaataagaagaaacaacaaaacaaaatagtggatgaatatggtgatgacgaatttgataagatattagaacaaatgagaataaaagatgatcaaacaacaaccctgtcagtaacgaaccaaaaaactttaattaacgtgtacgattttgaggaagaattagatgaaataactacccctactcctgacttcgactccaattttaaggcatttactacaaatcgtttgaaacaatctttgtctttattgtcaattaagtctgtaggtagtttggaccaagataatgagtataagaatttgttcggaaatttatcgatgaataccatcgaagatgccaactcaacaacatcaatgggtatgtctccagaaatgttacaacaattcaagagattggctaaactaactcgtgggtggggtggaaaggaccgtcgaggtattcccggcacaacaagaaaattgattttgtccaaaattgaagatgattggctaccaacaaccttgaagcccttaaatatggaggagattaaaccagatgattatgttaaatttttagattataaagaggacacggcagatttagaagagctccaattaaaaataaacaaagaagtaaatttgggcgtgaagtatttccaattctcgaaaattaacaatatcaaagagcgtgttgcaaatactagattttatgctagtgtggtaatgtctccagacccagagtcattaatgcagcaattgcaacaatacccataccacgtggaaacgttattacaagttgctatggtgttgttaagacaaggtgataacaagtcaacaagtaatgcattggtcgaaagagcactttttgcatttgaccgatcactccataaggggttccatgaattgttgtaccaagcctcaaatggattggcaaggttaccgtatgagcggtttatgaatcgtcaattctacttgtgtttgtttaggtacatcactgcactaggtgaaagatcaacattctacactgcattagcatactgcaaacttttgctaagtttaagtcccgccgaagatccgttgggtgtgagatattttattgacttttatgcattgatgagtgaagagtggaagtacatggtccaatttgcagaatcgcctttggtgaccacctatacaagatggtatacacctggtattgccttttctactgttttagctcatttgaaactaaatcaagaggaaaaagctagaggggcattgaagaaggcttttgaagcgcatccatacacggcatacaaactctataagcaaatagggttatctaatgatctatcactcagtgaaggttcatttaaaatagatactgaggtggaaattgctactgaaacttacttggtcagatgtacgattatgtggaatgatcagtcccatagacaatttttgcatgatgaattagagaaattgtcttcagattggaaattgcagaactcgaataatggtgtcttttcttcaattttgggatcttttggtttcacagataactaa

SEQ ID NO: 1580 - DNA, 276 bp, Candida albicans
cacataaaaatgggtaaagctaaaaagacaagaaagtttgctgctgtgaaaagaacattaaacacaaaaaaagaccaacgtctaactcaaaacaatgccaacaacaacaacactaacaaaaagaagggtggtggtggtgttgttgatgatccagaattaactcgatcgttcccacaagtatcatcagcattatttttcaaatataatgaatctataaaaccaccatatcaagtattaatcgattcttcaccacggcgtggaaaatccgcacttgct

SEQ ID NO: 1581 - DNA, 282 bp, Candida albicans
  unsure (246): Identity of nucleotide sequences at the above locations are unknown.
accaaccaaccaccaatcatgcttaaatgggtacaatcaggactttctgccgttgcagggacagcaaaaccagaatatggacctgatgcaattcagcccatcaccaaaagaatctttgataccaacaatggaaaaatctatcgtgccactgaaacaaaggatctcgaatggctttctccaaattataccaatgttgaaactcaaacattttatttcaacgatttgagccatggggattatggattngcacaaaatattccatcccaaagttcatgggggtga

SEQ ID NO: 1582 - DNA, 480 bp, Candida albicans
accatgtcgtttgatgaaggtagaaataactcactagatcaagttgtgtctcaagataacacaaaagacaaagataatcataatgatctactaccacaaccatctggacaagtctccacatcatctccacaaaaggacaacaccccgccatcaccaacaccatcgaatgatgatccagatccgttggaattgaagaaactatcgctaaattacgactacctaatgtacaaaattaaggactatataaatacactaacggagcaaacgtaccaatcaatactatctaaacagtaccagatcaaccaggaatacttacacgatcaattgaatttatttgataattatgagactatcgatgaaatgttgaaaactataagtcaattggaaatggaatttttaaagttggatcaattggaagtattcattgaagatttcaaacagagattaaatgttttggaacatgaatttgacaaactataa

SEQ ID NO: 1583 - DNA, 765 bp, Candida albicans
agactatacgcataccacgcccagcaatggctagaacaggcacacagagctcaactgacaaccaaacgcagaatctcaccattgggggtgggcccagaatccgtgcaaagaggtaatagaaagttacgctgggcatcaatgtttgatgcaatgagaaaggctatgaagaaacgggagatcgccgctgcaaaagtaaaccaccgcaaatcaacagcagaactacaagccaaccaaaatgtaactgaacccaaacccaacagcgacagaattcctacccctgcagagctttcaagactcaaattcgaaagagacaaaacactacatgaaaaccatatcaaccagcaagctacaagagcacgcatggtgcaggcagtggctaaaccagcaccaccgccaccaccaccaccaaaacccgtgaaaagacctacaacacctaacggcacacccctaaccaacgagcaaatccagcatttactacaaatgcaaaaacatagaagaatgttgcaacaacaacaacaacaacagcagcagcagcaacagcagcaacaacgcagaatccatttcccgccagcccaggtctctaaagtcatcaacgacatccaacagcaaaatccagggttatcaaaagaccaagtaactaaacttgcagctcagtacctcgccagtttgctgcaacaggggtacggcgtaccttcctcgccagtgccaccacaccaaaaaaaccaaactgcatcgcccatgtcagggtcgccaaacaacgcgtaa

SEQ ID NO: 1584 - DNA, 639 bp, Candida albicans
tcatcgcatggtgggtgtgggtggttagtttttttgttcacgaaaaaaaaaaaaaaaaaaaagtgcaccaaaaaatttttgatattgatcaatcacttctttcttcattgtgtaaaaactactagccgacataagatgggtaaaagaagagtagatgaagaatctgattcagatattgatgttagttcaaccgattcagaaactgaattagaaagcacacaacaacaacaacaacaacaagaaggtgctactacaattcaagaaactgttgatgttgattttgatttttttgatttaaatcctcaaattgatttccatgctactaagaattttttaagacaattatttggtgatgataatggagaatttaatttaagtgaaatagccgatttaattttacgagaaaattccgtggggacatcaattaaaactgaaagaatggaaagtgatccatttgcaattttaagtgtaattaatttaactaataatttaaatgtggccgtgattaaacaattgattgaatattttttaaataaaaccaaatctaaaactgaattccatattattttgaaaaaattgttaaccaatccgagcgatcctactaggaatttggacatttacactgggataaataattag

SEQ ID NO: 1585 - DNA, 582 bp, Candida albicans
gcgggatttcagcccgtggtgaagactatggaaattacttttgatcccggtttgaatgacaaactgggcaataatgccgaagaagaagataaggaggagacaacaattgaagcataccgaagaaaggaaaaagagcgtcgtcaaaagagattagccaaatttaaggagtctaaacaaactgaagaagttgcaaattcacaagaaggctcagctgataagagttctaaaaacagaaagaattccaagaaaggtaaatctatgccagatatggacgaaaaatccaaggctgaattagagttgattttgatggacaaccaagagggaaacaacaatgaacatttcagcatgaaagaagtcatcaagtcagaaaaggacaagaaaaataaaaagaacaaaaaaggtaaaaagattgatcaagaaatggtacaggatgggtttgtggcgaaccttgatgatcctcgtttcaaggaagtttttgaaagccatgattatgctattgaccctaccaacagtgagttcaaaaaaaccgaaacaatgaagaagattttgaaggaacgttctgctagaaataaggataagtaa

SEQ ID NO: 1586 - DNA, 1419 bp, Candida albicans
caagtcatctataatcttaaaataatggcgaaaaataataacaataataaggatagtagtaatccacgaaaaccaattacgcaggatgaacgtttcaagtcggttcataatgatcccagattcaaaatgcccaagttaaagaacttgagagttaaagttgacgatagattcagtaaagatgagttgaaaaaattgaatgctggtgcattagggaagaaagttaaaattgacagatatggtagaaagatcaagaaagaatccgatgacttgagtaaattttacgaacatgaagaagatagtaaagaagaacaatcgagtgacgactccagtgaaggtgaagaatcagatgatgatttacaagcactcacagaaaagttgcaacaagaggaacagtttttagacagagcaagaggagaagggttagtgagctcttctgaagatgaagaatcctctttatcatcatcagattctgactctgatgaggagaatgaaggagtagtcgaagacgaagaagaatcagatattgagattgaggaaaccaaacctgaagacacagagccaacatgtgcctttgccgttgtaaatatggactgggacaacatcagagctgttgatttgatggccacttttgtgtcatttgttccgaaaggtggtgctataaaatctgtcacaatatatccttccgaatttggtaaagagcgaatgcagaaggaagagatcgaaggtccaccaagggaattattcaaaagtaagaaaaaaaaggaagaggactctgattctgaagacatagaatcagacgttgatgtgaatgacgctgacaatttggcaaaaataactcggaagttatacgaagaagatgacggaaaagaagattacgatagcaaggcattgcgtcgttatcaattgcaaaggttgagatattattatgcagtggttaagtgtgactcggttgaaactgctagactgatttatcaaaattgtgatggtactgaatacgagtcaacagcaaatatttttgatttgagatatgttccagatgatatggagtttgatgatgacgaagctaaggatacctgctccaagattccctcttcatacagaccagactcaacgtttgtaactgatgcattgcagcattcaaaagttaaattgacttgggatgaaacacctaaagaaagactcactttgtcttctagaccattgtcacagaaagaaatagaggagaatgatttcaaggcatatttggctagtgatagtgacgaaagcgaagtggaaaaggatagttcaataaaagataaataccaaagtttattaggaaataccctcactaaatttggcaaagaagaaaatgatgatgatgtggatatggaaattccttttgatcccgtcttcacacacgacgctgccaggaccattgtg

SEQ ID NO: 1587 - DNA, 603 bp, Candida albicans
cccccagttaccagccccgtgtggcacataggaatcttgtctttattcgccggacatccaattaacttctggcaatggctatataatctgttggctatcattacacttccagtgtatgtatcggcattgattaacttgaagacaaaaccaagaaatttacgtaagatttcattggcaacaattgtttatgttttagataccttcattggcagtctttacactttgtactttatatatttttggtttagtctggaagaaggaagtgttaaatcaacaggagctgatctgagcagtagtactttgtcgtctcaatcagcgtctgctgcaagagagttattcattacacttggaactaccataagtgtcactttcatacgcttgtatttcaccttggtgatattatcatttgccaaggcgttgttaaaacaaaacagaatggaagctagatataatgacgtccaaaacggaacatctagcaggagtttagaacaagaggaagaagacgaagttgctaatgctactggatactttggagaattcagaaaagctatatttgatttggaagtaagatcaaaagagtatttggatgatttatttaattag

SEQ ID NO: 1588 - DNA, 1038 bp, Candida albicans
ttagaaacatccaccatgtcaacaacaggattacaaagacgtcgtggtgccaaacaatcaacacctaaaccaagaaactcagattcattcgatgagagtcgctccccagcatcaccaaataaaccagaccataaaataggatacgatgataaagatatcaaagatccaagtaccttaaaacaaccattattgacattgatggaagaagttttgttgatgggacttaaagataaagaaggatacttatcattttggaacgacaatatttcttatgctttgcgtggatgcatattgttggaattgacattccgtaacaaaattactttggttaatgatccagcaagacgtcgttttgagttgagtgatagattagtggaggttattgatgccgagccaactggagaagttttactagatgaagcgttgaaaatcatgaaaaatgacgaaagcaatttatctgtcaccaattggattgatttattgagtggtgaaacttggaatttgatgaaaatcaattaccaattgaaacaagttagagaaagattggctaaaggtttggttgacaaagggattttaagaactgaacgtaagaatttcttccttttcgacatggcaactcatcctgttgctgataaattatccaaagaatatataaagaatagaattttgagtatgttagtgctgagaaacgttgacttggacacagtttcaaatgaacaatttcctgctgatacatctttcagatacttgaggacagtatcgttggtatgtggtgcatatgctgctaatgtattagaaaatgttttgctatcattaaactacgaaaagagagaccaagcttttgccagagcagatgaattattggctgatttcagtgagttccctttcaatttgtctcatcaaagtcctcttggattaggattaaatttaggtcaagaagttggtgatgaaatagaaaaatcttctgcatctgaattacaattggaattgattgcagctgttttgagtgtatttgccagaatggattcaatactttag

SEQ ID NO: 1589 - DNA, 414 bp, Candida albicans
tgtcaatgcttctttttaattcataacatatggacatctactgaattgggaaacagacgcttggacaaagcatatacggagttatcgaaaaccaataaccctgatgttgacggtaagatctttttgtttttcctggtcaattccctgggtaaattctgtggaattgctgagatgaaaagtgccattgatttcaccacggcactgaatatctggtgtgaacagaccagatggaaaggtatatccccagtcgaatggttattgatcaaagatgtccctaacaaattctcccagcatttgaaaattccagctaacgattataagccagtaacaaattctagagacacccaagagattccattcgacattggtatcagcatgcttaaaattgtcagttcttttaaatccaatgactaa

SEQ ID NO: 1590 - DNA, 1860 bp, Candida albicans
ctcaggtacacaccaatgtctgtcgtgaatgacgattttaaaccactactcatacaatgggttgaagaagaggccataaatgccacgaaaagaggatcaaaaatggtagatctatacaataaaattctatttcaactacgaggatacgaacttcccatatgtgatttgaaaacattgaaactgattaaatacgtaggagataaaacagccaatcaattaagaaagaaaattgctaaacactgtaaagaaaatgaattgacactacctcgagggtttatggatgtggcagaaaagcatcgtttagatttggaagaatccaaccttacactgtcaacttcaaccattaaaactactaacaagcgggccaaaacttccagcaagagcaaaccaaaatatgttcccaaacacagatcaggagggtttgccattttaattgcattgtatctttatgataaagatagaaatggaatgactaaagaacgaataattgcaggagcaaccccatattgtgatcgttcattcagtaataatgcagcttcaaaagagttttattctgcatggagctctgccaaaactttagagaatcataatttgatttcaactactggaaggtcaccgaagatttattttttgaccgacgaaggcgtgtcgttggcacagcaattaaagactgccattgggttatcatctcctcctgaaggtagtaaaaaggacgacagaaatatgataatggaacagtcattcgataatggaattcgactcgacacaagttttgagttatcatcaccagcaggacgtgcaatgttgagtagctcgccaataagaagaataagtaatcctgttcatagtaatagagccattcaaaaaatgttagaaaaggaattacgaaacggtgaaacgccgccatcgctgcagcacgatgctggtaatagaatttatgatggcattaagtatgaagtatggagaaaggaagattatgaagtgattgtctatatggacaaccgtgaaattagatcacgagctgacagggaccattttcaaaccagattacaaacacttggtgtcaagtgtgaagtcaagccattatcttcaggagatgtattatgggttggtagaaatacaagtacgggcactgaggctgtattgaactatctttgtgaaagaaaaagactagatgatttatgtgattcaataaaagatggacggttccaagaacaaaagaatagaatgaaaaaaactggcatcaagcattgttattatcttgttgaagatatggtaagttatcaagacaaagtatacgacttgatggatagtatacagtcctccttaacccaaacaatgaccacagcaagattgtacttgagacgatttaaagacatcgatgaaacgacagcgtttattgcctctaacactaaagttattgaaaatttaaaatcaaacttgattgtgatcaagccccaagatataaaaaaccaacaagattatctaaatatacttttaaaatttagaaacaagtttgagaaaactcaacctcatcaggacaacccagattatgaatgtgttcaattgttttcgcgttttcaagatatgttgggcaacacaaaccagatgactgtaaaggaaatgtttatattgatgttgatgacaattcggggagtatcactagagaaggcagtggtaatacaaaatcgattcccaacaccaaaaagtttacttgaatattaccatacagagcatgctactactgacacgaatattaaaagagacttgatgatgaatgagtttaaggatcaaatcggtaataaaaaaattggtaaagctttactggaaaagatttataatgtttgggggaaaccttga

SEQ ID NO: 1591 - DNA, 2046 bp, Candida albicans
gcatctcgacatctcgattttcaattttttttttttcaagttaatccaatttttttttattctataaggtctttcttaaagaagcttctcttttttttattgtcatttaccataacacaccccttcctaaggataatgtcaggaccaataatttgttcaaagtttgatcagtcggggaactatttggcaaccggtatggttgctcttgattcccatcaagtcaaagttcaatccataacctcatctcaagcatcgttaaatacatcattcaccttggaaaaatcaaacaaattagtaaatttagcatggatcccatcagattcaatacaattgttagctctttgtttatccaagggaagtattttgatatattctcctcaaacaaatgaaattgttctggaattgattagttctgcaaatgtctcaattttggatttccattactcaacaactactagaactgggtggtcttgcgatatagaaggaaacgtgtacgaatgggatttgaattcttatttgttagttgattctttcaaagtcaatgaatacattgaatctgttgattcgataaatagaatatctacagtaatgttcaattctcaaccgcatttattgcttggttcaaacgcagtctaccttttcaatattaaacaaagagaacttgtgaaaactttcccaggtcatattcaaccagtaaactcgataacagctttaaacaacgacatgtttttaacgagtgctaaaggtgaccgatttgtcaatttgtatcaacttgataaaactgccacaaaggcagtctttgtgggtctgtcctcagtatcgagcttatcagtttctataaaagacgacaagtcagttttggtgattattaatgaagaaggtgatattgagattttcaacaatccattagcagacgccaaatctcaagtttccactcctgtaccgaaaaagaaaagaaagcaagttggtgtttcttcaagatcattcaatgcatcaattaaattatctcgtccagaaccagaaatcaaaagcccacaagatacacatttatttatcaatgctgtttccactgaagataacttgatcacattcacttggttggaaaattcaactatcccattctttgacacccttaaatggattgatgaaaccggttctttgcttcttgaatcagccaaagtattgctaaaatctaaaccaaatttaaaagtcactcaacatttgactaacggtcacgatgtggccgcaccaaaactttatactgaagggcacaccattgtgagtgatggcagtaatatcagagatttggaatttcaagaccatcaagaggatgaagaggacactgaggaatctttggctgaaaaattagagcgattggcaatggatcaaacttcacaacaaaaatcaagaagaaggaaactagaagaggcaagaagtggtgtatctttatcgattgtattaacccaatctttgaaaaataatgatcaagctttattagaaaccgtgttatcgaatcgtgatcctatcactattcaaaacacaatcagtagattagacccttattcatgtgtcacatttttggataaattgagtgagaagattcaacgtcaaccaacaagatttgatcaagtgagtttttggctcaaatggatccttgtgattcatggtccaactatggcttctttgccaaacttgagcatcaaactatctagcttacgtgcagtattaaataagaaagctgaagaattgccaagattattagaattacaaggtagattgaaattaatggatgattctgctgcattgagaaatgagtttagtgctgaagaaatagctgaagatcttgaagaacgaagtgatattgaatacaatgaagaaattgatgatgcaaagtatgttggggtgatcagcgacgacgaaagcatggatgatgtggatgactttgatgatcttgacgatgaagaggaagaggaagaggaagaagaggaagatggtattcctgatgctgcaaatttagatgatagagaagattctgatcttgaataa

SEQ ID NO: 1592 - DNA, 657 bp, Candida albicans
attagcatttgcaacatgtctgaatctgagaaaatgtacatttcgtacaataatatacaccagttatgtcaagaaatagcccctaagatcaaagaatttaagcctgacttgatcattgctattggtggcggtggttttattccagctagaatgttgcgttccttcttgaaagaaccaggtcaaccaaacgttagaattatggctatcatattgtctttatacgaagagattgagagtgaaaacggtattgaaaagccaggtacccaagttgtgcgtactcaatggattgattatcatcaatctaaaattgacttggttggtaaaaatgtgttaattattgatgaggttgatgataccagaaccactttgcattacgcagtcagtgaattgaaaaaagatgtggaagagcaatcaaaagccaaaggtgcagaccctaaagataccaagtttggtatttttgtgttgcacgacaagcaaaagcaaaagaaagcagaattgccagatgatattatgaagactggtaattattttgctgctcgttctgtcccagatagctggattgcatacccatgggagtctactgacattgtttatcatcaaatgaaagctgaagaacaaggaaacgatgtgttccttccttcatccactttagagtaa

SEQ ID NO: 1593 - DNA, 1764 bp, Candida albicans
ttctcctctcgaccttacactacctctttttcttcctacctcttctctctcctcattatattcgtactctctctacctcactctcttccccccctcccgtacgacattgacccgttgatgggcccttcccaggtgaacaaacgacaacatcaactacaacacctggtagtacacttagagaaatccaagactcatttaaaacatctaggcagacaacgtaagttgatggggagcttttatctcttggcaggcaagtaccatgatgcatttcaaaattttatagagagtttgacaagtctaaaaaaatctgatgatttcttatggctagcaagcgcacttgagggggttgctgtcagtatagtgttaatgcaattcattggcacagcatatcaattacctaatcaaacaatgaacccagtgctacaggtatcaaagatacgaggaagtatagacacggcgacagttcggaaaacatctatcgattccaatgtttcttctcccaggaattcaattaacggctcaaatgggtttggttttaatgctttaacctcagcaatccctgactttaacaatttaccggtgcaagaacttttgaagattatcacttcgcgggttgtgtactattttagcatgagcacaaatgatattgaaaacatggttcctgatattgtttacgtggaaagcattttacgaagaattaagctattgattggcattcatttttccagtagtatggaagacatagtcaagggaacgattacacctacaccaaacggatcattcccgaaaattgaaatcatcgacgagattgacaaaatattcctgctacaaataactgatttgaatattgtggatcaatgtagaatatattctgccttggcaacaatgtatgctgatttaggattaatgcgaaagaatgcatttattttaagacttttaatatcagcaattttgcctcacttaagttctggagagcttccagcccagtcaattaaagaagtccttgagaatgtatttgtcttgtatgatatctgtgatgaacctgaatcattttctgaagcagcgaggttccatggacaaagcaactggacttccttgcaaatacagcttttgagattggctttgaaagtcgcagaaaatttgaatgaccaagagctattgttaaagttgtgcacattattattgactagatacacacattgtttgccaactgatgaccaaatcaaattgaagaataaggtggatctggctttgaaatcaaatggtggtctaagtattccatattgggatccttttcttgttcgcaaagtcaagtttgtaaattcaaaaccccgtggcaacttaattcctatgaaagagacattgaactccaataattcactgcaaccatttttcgatccatacactaaaaaggaatcagataaagcgtttgttccaacattggtcaaagatgatatttctcaattgaaagtcactttacaaaacccatttgcatttgaagttgagattcatgagataaccattgttagtgaaggtgcacaaatagaaacgatcaaaagtttaattcgacctttggaatcaataacatccaaaccttcttctactatgccgaatggaaatatagttaataataaattacgtggtcatcctggaaaaaaatcgtcttcaacaaccctggtagttcatccaggtgtttcgcacacgacgtctaccaattctgccagtacgtttgttcttgctccaaagtccatggaaaagtgttaa

SEQ ID NO: 1594 - DNA, 597 bp, Candida albicans
  unsure (555): Identity of nucleotide sequences at the above locations are unknown.
tatatgtgggacaaatataattttatcactccagcaaaagttcgagtgttgttggttccaataaatgattgcactccgtccaatttccaacgatatttacatttaatccaaacaaatgtcggagaggtgcgattattggatatcagagagaacaacaaattgcattatttcaactctgtaacttccccgcaaggaagaatcttcccagagtttattaccagctccattgataacgaattgattttccttcatgattttgatccatttagaaaaacattcatagtgctaggggtgggaccatatgggcaagatccttcgacggcattagttgaattgaaaaagaaatataacactgccattgttcacaatgttatactatttgacaccccagaagacaaattgaatgaacaagtacccgaggtgtttttccacaatgggactactagtcatttgacagctctagaaacaatattttgcgatataagtgggaattttttagaaaaactagacgcatatgcttctgcatatgctaatattacattgaggtctcctgtntcgattactgatagccatgtactaaccaaaactatcaatcta

SEQ ID NO: 1595 - DNA, 1173 bp, Candida albicans
  unsure (1151): Identity of nucleotide sequences at the above locations are unknown.
caatgtcccactaataatattcccgttcttcaactcaaccgttatcggctggttagtagaattggggatattcataagaaagcgtaccaacttcatgttgtggtgtgtgtatcatcaaaaagacaactttttttttttggaaattttttttttttttttttctttctttcttcaccactaaccaccatggctaatacaattgttgaaaacatccagagaatacctcccgtgactcgttttttcacgttagcgtcggttatgacgtgtttggcaatcacatcgttcgatgcattgccaggactcttctgcaactaccacaccttatctaacgactttgctggcatctacaaggtctaccaaaagggaaactcgttcaacaccgccaaggctatagctcttcaggtgatcaactcctacaagttcctcacatccacccttatcccctccgacgtcttgtcgagccagcgatggaatgcattaatggatatatactttttctacacattctccaaccatttagaggcatacggtggcaaattcaacggcaacttccccgactatctatggtatgccataacatgcggaaccatggtcaacgtctttgcattgttctacaacgccttcttcgaccccatgccaatcttcccccacgactgcttattggcgtgtttgacatacacctggtcgagagccaacaaaaacgccaagataaacttaatgggaatcgtgcccatcaaagcatactacttgccattgggtaacatcctcatcaaactaatccttcgtgggccttcaggacttgtggataccattattggaattttatcggggtacctctacctctgcatccagctgaacacgttgccggtatacaatttgttgcccgacgcctacggcaaaaacacagaacagcacaccgatgcccgaagagtgggtattctgagatacgtcgataacggcggcagtcaatacgagtatattggcgactcaatctacgataaagggtactggaaagctcctaaattcttctacaacctcttggggtacccatccaaaaactcagtacgaacaactgcatttgatagtacacccagaaacgaagagagtgctacaaccggctattcatggtttggaagtgtagctagactcanccacggggatagagaaccccgc

SEQ ID NO: 1596 - DNA, 819 bp, Candida albicans
acttattccataatggcaggatttaaaaagaatagagaaattttaactggaggtaagaaatatatccaacaaaaacaaaagaaacatttagttgatgaagttgtatttgataaagaatcccgtcatgaatatttaactggtttccataaacgtaaattacaacgacagaaaaaagctcaagaatttcataaagaacaagaacggttagctaaaattgaagaacgtaaacaattaaaacaagaacgtgaacgagatttacaaaatcaattacaacaatttaagaaaactgctcaagaaattgctgccataaataatgatattggatttgatcaatcagatgacaataatgacaatgataatgaaaatgaagaatggagtggattccaagaagatgaagaaggagaaggagaagaagtaactgatgaagatgacgaagataaggaaaaacctttgaaggggattttacatcatactgaaatatataaacaagatccctcattatcaaatattactaataatggtgccataatagatgatgaaacaacagtagtggtagaatcattagataatccaaatgctgttgatactgaagaaaaacttcaacaattggctaaattaaataatgttaatcttgataaatctgatcaaattttagaaaaatctattgaacgagctaaaaattatgctgtgatatgtggagttgctaaacctaatccaatcaaacaaaagaagaagaaattcagatatttaacaaaagcagaacgtagagaaaatgttcgtaaagagaaatcaaaatcaaaatcaaagggcaagaagtaa

SEQ ID NO: 1597 - DNA, 1014 bp, Candida albicans
aatacattttcttgcttttgtaatgaaccgtcattatacgtcatgtccgtgaaacaggaaacacgtcctttaacaatcccattagtgacaaatccagaagtggcaacaacgttatcaaaattcacctttcaaaaccttgacgatttgaatgatcccaaaaaggcatacttactgcccttagccaccattgccctcatcgatttaaatgcatttttcgctcaggttgaacagataaggttgaacttaacaaatcaagatccagttgtgtgtgcccaatggaactcagttattgctgtcagttacgcgtctcgaaaatttggcatcaccagaatggatacaattgcatcttgtaagtcaaaatgtcccaatgtaataattgctcatgctgcagtgtataaaaagggggagtcacattgggcttatgttgagggattgcctgctattaataaacataaggtgtctttagacccgtatcgacgagaaagcagaaagattttacgtgtcattggtaaatcgttcgatttaacagaaaaggcaagtgtcgatgaatgttacatcgatctcggcagagaaatttataaaagattgatagatttgtttccacagttatcaaggggttctcgtgacaatcctgaaaacagctatgctaacttgccattaataccgccaacgttacccttgaatttgaaatgggagggcgaaattatcaacactgaaaaagaaaaatctgaggacaatgatatcgtgtcacctcctgtaatagaagattgggatgatatttgttttattataggatcacagatactattggaagtacgtaaagacatctttgaagaactaggatataccacatctgcagggttagcaagaactaaacaggtggccaaattagcggctggattcaagaaacctgatgcacaaacaataatcagaaattctgctataaatagtttcttaactaatttctcttttattgaagcatcgctgaaattttccccgaataaaactgattga

SEQ ID NO: 1598 - DNA, 1443 bp, Candida albicans
aatgggttcgagatatggggttgtatggaaattagctccaaggcgtttgtagccacgcatatagcagaaattaatgctgtgatgaatatgtcgcgtcgatcaatgcttgccaattctttgtcagaagttgatttggatgaagatgaaattactgtggaagacatggagcaagccgaagaaaaggacgatgattctaaaatcatgcaaatgaatgaagaagaattgaaaaaaatatcgacccatcatgttttgaaatttaccaaatcacagaaaaccacgattgaattattgcaaatcatgtcattaggacatgaatcattatatggatataaagctcaattgggtcaattaacacatcgtcaaacattatcagtgttgaatatattaagtccgttgattaataactggggtcgtaaatacaaagaatttttagtaccttcatcaacaacaacaaataacaagttggttaaattggcacctaatttgccacaacattggttggatcctgaaagtaagatatgtcgtgaaattgccgataccattgaacgagaaacatttataattgagtttaattatgttaaattatatatttattccttagcattaaatcaatcccccaagtctatgcttgaaaaaggtaccaagataaagctagacgagttatcgaaatcagctaaatatattgagcaagcattccatgctgcaaatgaaacattgaatgctgctcataggattcatcgatttaaaatgttacgattcatgcctgttagattattaaccagatttattagagcggcagcatttatagtacgatgtcatttgaccatgacggcacaagagaatatttctttgtctgtttcaaaaatcactattgatgaaattatcaaatcaactcatcgagcagcgatgacattaagagaatgctcaccggatgaattgcatttgctttctcgatattcaactatccttatggtgctatattcagagatgaaatcgaaacggaatcgaaaggaagaagttgatgatgaaaataatgagtctgctgtagttacagaaaccgttatgcaagataattcaagtggtaatgcactggaacctaagcaggtacctggaggctcaacagtgaatgcatcaggaacacattttttgtcagcttcttctggtgcttctaataatggaatacctggcatgggacaatcaacagcaacgcaacaatcgcagccgtcacataccccagttggtttgaccccaggcacttacaacaacagtcataataattctggacccgcagcaattaatactggacaaatggaaatgaatgagaactcatcgtttccttcagtgccaccgcccgttgaagattttgattttgatttcaatattgatgaacttttgggtgacgggtttcaaaatattgttgacttgtggagttttttgaattga

SEQ ID NO: 1599 - DNA, 1578 bp, Candida albicans
ctattccatagagagaattgggctctcatttattggtttgttgcgataaagaaaaagtttatagttgaacttgtattaatgtcaattgtcgaaccagaagttgccgagtccaccggaggtgatgctccccaaacttcagtaaaatcacccgaaccttcatatcaacaactgtcacaggcccaaggaaagtataaacgaaactatcgggcttgtttgaattgtcgtcttcgtaaagtcaagtgtgatttaggaccagttgataacccccacgatgggaaatgtgcacgttgtcttccagaaagaaaggactgtgtatttgttgaaagcaaacgaggggttaaaccaaatgtggtcaatgggaaacgcaaaaggcaacgagcatcgagtagggcgatgagtagactggaaactcaatctccggattctaataatgtttcttcaactacatcaaccatagcgtcacaaaatgataatacaaatgtacctttgattaacatgtcaattaacaatataatgcaaaaattacctggtgtagagagtattctaccgaaagacaataccaaaaatcctccacattctgctttttcaaatccgtcaacttcttctccttcatcatcattatcatcaatgccaatgggacaaccaccacagttaccgccaatatctaataaaccctcgatccagaatcaactgttactggcaaactcaaagtctttatcgaacgaatttgcaacgatggaaagtgctttggtatttttagccaacgctgcaggagagattgctaaagctgatgaaagagataatattgatgctcaatcgaaatatgaccaaatagaagcatcattatctggtgccaatagtcatcgtgttagtatagatgagcccatgaatcatcaacaacagcaggagcaactgcatccacattaccagcagaagctgcaacaaaatcatcatcatcataaaccaccacaacaagaactccatcatctgcaacctttgaatatccctaataatgcacctgaaagtttcactaataatcatcgaattcaaactgaacaatcaaatatcccaccatacatcaaacctacaacttcgcgaagaatgtttgtgccaccagcagaaagtgggaatgctgttagaccaaaaggttcgaataaattgtctagtatagattacattggtcctgcaccgagaggaatattgactgaagatgaagctaagcgattgatcaatttgttttttgccactatgcatccatattttccacatattccaaaattccttcattcacctaaggttttatcaaattaccctattttactatgtgccatattgacgatttcatctaggtatcacccatttgaaacagatatgaccaatcaaactaacggtaatggggcggttcccagacatatagaagttcatgatcgtttatggttatacgttcaaagattaatttctcaaacggtttgggcagaggcaagtacaagatccattgggactgtttttgcatttttgttatttacagaatggaatccccgagccattcattggacggtggtccgattatgcaaataa

SEQ ID NO: 1600 - DNA, 558 bp, Candida albicans
gtccttccagcctcgtggggtgaagacgagataatgtcaaccgataacttatttgaagatattgaacaagataataatccatcattctatggcaatccttctatattgaatgatccatatcgtccgattcaaccaccaccaccacaacaacaacaacaacagcatcaagaaaatgaaagtaaacaatcacatactaaatcacccaaaccgccactccaatcaatacattctggtacttcaaatgcacatccccaactgcaaccacaacataagcataaacataatactctgctcaataatggttatcctaatgaattggtcaacagtactattggattatccaatagaattcttgaattattaaatgattctcaattgcaagtagatataataaattccgaaaaacttgtcaattcatcggtcattgtttatactatagagttatcatcaccaacaacgaaaatagttgtgaaaagacgatatagtgaatttaaatctttgagagacaatttattaaaattattcccgacattaataatcccacccattccagaaaag

SEQ ID NO: 1601 - DNA, 1269 bp, Candida albicans
accacccttaagatcaacaacaatatgtcgccaatggatatagatactgaagtttctacagttttagcaacaattaggctgaaatcagataattctgaattaaataatattatttatcaactagaagatttttatgaacgtaaattatggcatcaattaactcaagttttagatcaaatttattatacattagattctactataatcacatcaaatttaaaaaatcgactttataatttatttattaaacaatttcaattgaaattgaatccaattaaagttgttgattatttattagaatcatttgaaaatgatccaaaagaaactttatcaactttattaacattaaaaaaagattttattaatgatttgaaaagaagtcataattatagagttactgatgatgacaatgatgacaatgaagaagaagaagaagaaaatcaagatgaagaattgaaacaattaattcaagatgatgaagctgttatatatgttaaattacaaattgctcgttattatttgaaattacaccaattaaataaagctgaagatattttaattgatgtagctccaaaatttgaaagtttaaacaataatttaaattctaaaattaattctgcttattatttagaaaaaactgaacatgccaaaattttaaataattataatgattcttattcaaatgggttattatatttatcttcagtgactaatttaactgatgaagaaaaaaataaattacgttatgaattatgtattgctgctttattgggtgataaaatttataattttggtgaattgattttacatgatattttccaagaaatttctcaaccatcatcatcaacaacatcatctcaatataattggttatatcaattaattattaatttaaatgctggtaatgttgacaatttcaatcattggttatcaatagctataaagaaagctccaattttggaacaacatcaaatttttttaaaagaaaaattaaccattatggcattattagaattagtttcagccgataaaaaattatcttttgatatcattagtgaaaaaactaatactcctattgatcaagtcgaattgatcattattaaaactatgtcattacatttgattgaaggttatattaatcaagatcaacaatatgtggtggtatcttggattcaaccaagaattttgaatttagatcaagttaaaaatttgattcaaaacgtggagcatttaagtaagaatatttctttagtttgtaaaaatttttag

SEQ ID NO: 1602 - DNA, 810 bp, Candida albicans
gcaaagatggaagacatatctgaagagcaagagttcaaatatggagaacatagtttacaaaagataaaggtctttaagtacagctcgaccaatgcaagcacatacatatatatccacggaggtgcgtggagagaccccagcaacacattcgatgaaatgagacctgttttaggtatccccaatgctaacttgataggaataaattaccgtttgtctccagagatcaaacatcctgaacacttgattgatatattaagggcattgagatttgtcaagcagaattttgacgtcagccaaattactttattggggcattcggttggagccactatgattcttcagttgttgcattacagacaaattatacgtgatgggttgaagcacacacacaaagatgatttatccagcctagacaacttgtttgcttatgttaatgacaatgtgcttttgctgcaagtgatatttttggatggcatttatgatgtggttgagttattgaaagagtatcctgattatgcatcgtttgtagatgatgcatttgtgtctaacaaacatttcgccgactcaacccaacttagttcggcaaatgaatcgttggacttgcctttttctttggtttcgaaagacacaaagtttttgatttaccagtccttggaagatgatcttctttcgatgaaacaaacacatctattaattgactatttgtcttcaaaaaatcaagggttcacattgcatgtaggcaattggggcaaacacgaagagatatttggcaaatacagagaaatagtgttttctggtaacgtaccttaa

SEQ ID NO: 1603 - DNA, 2718 bp, Candida albicans
  unsure (27),(2649): Identity of nucleotide sequences at the above locations are unknown.
atactggatttgccaggcgtggtgaanattgctaccaccaattcaaaggattttgaaaacctaatggatgtgtatttatcgtcagtgtttgaaccgcaattaaaccataccgatttcttgcaagaaggatggagaatagaaaatcaaaatgttcatgacatatcgtccaagcttgaattcaagggagttgtatataatgaaatgaagggccagtattcgaactctgcatactacttttatatcaagttccttgagagtatatatccatccttgaataattcagggggtgatcccaagaaaattgttgatttgctgtacgagggtttactagagtttcacctgaaaaattatcatccatcaaatgcaaaaacatttacttatggaaaattaccattggaagacagtttaagtaaaataagcaaatactatgaatcattcgaaaaaaaggtgtcttcagttgacgtcaaacaacctatattttctacagataaatcagaaatctttgatgtcaccatcccgggtccagttgatacaatgaatggtaaagagacttcagaacagtactgcacatctatcacctggaacttgggtaatccattggatccaaacatgcagtatgatatttttaaatggaaaatattgagctcattattgtttgatggacacaactctcctttctatcaagagttaattgaaagtggatacggtgacgatttttctgcaaatactgggttggactcaaccaccgcgttgctttcgtttactgttggtctcaactacttaaccaagcaaaaagttgataattttaatgaaaaagttatggaaatcattaataataaaatcattcccgaattaagtaacgaagagtcctcttcatatcatggtagaattgatgctatattgcatcaaatagaaataggattcaaaagacacaagcccgattttggatttggattattgagctctattgttccgtcatgggtgaatggagttgatccaattgacaccttgcaagtggaaaagatattgtcgcattttaaagaagattataaacaaaatggtttaaggatctttaaagaattattagaaaagacattgtgtaaccctcattcgcaaaaatttaaattcaccatggagccaagagaagattttaccaaacaattggtaaaagatgagaatttgatgatcgagaaaagagtaagtgaactcacagaagataacaagaaggcaatctatgagcaaaacttggaattagctaaattacaattggaggatcaaaatacagaagttttacccacattgactattgatgacattccaaagagaggtgatttttatgccattgatttgggccaagtaaataagaaagttgtacatgaaagggtagttgataccaatggcttggtttatgccaacgctttaaaagatatttcctatttacccaccaaactttacaagtaccttccattgtttaacaactgtttgacgaaccttgctggaacagaaaacacacccattacggagttggaaactaaaatacaaatgttaactggcgggataacatttagttctaaaatatcgactgacccctataatattgagcaactaaaattacagtatgtgttaagtggaatggctttgaaagaaaagtcatcctcagtttatgatttatggttggagattttaactactaccaaattcgacaccagtgatgaggtattagaaaagttgtcagttttgattaaaaacatgggacaaaaccaaatcaataatattgctgatcgcggtcattcttatgcggctgctgtgagctcactgaaattgacaccgctgaaatacatcagtgacatcgtttcaggtttgagtcaagttcaatttgtaatggagttgaactccaaattagaatcagaagggaaagagtacttggccaaagagattattccgatattgcaagaaatacaaaagtatgtattgcaaggtgaattcaggtatagactagttggaaatcaagagattattgttgaaaacgaaaagcttattgagaaatttgataaggatatttcttcgaacagaccaactttatcgttaacagtaacagatggtttactggcattgttgaactcattcaattacaatcatacaagtgaaaatgtcttagttaacttaccatttcaagtgggatactcttcattaggtaagattggctcttcgtattcatcaaaggatggtgcttctttacaaatattatctcagttatattcctttaaaaatctacattccaaaataagagaaagcaatggtgcatatggaggtggtttgacatatgatgggttgaacgggacattaaacttttattcgtatcgtgatcctaatcctgttaagtcgattcaaacttttagagattccttactgtatggacttgatgctaattggaacgataaggatttacaagaggctaagttgcgggttttccaaagcgtcgatgctccaattaatatctcttctcagggtgctagtgccttctttgaaaatatagatgattacttgagacaggaaagaagagaaaactttttgggtaccactttaaaggatctcagagatgtgactgaaaagtatcttgttgataaccaaaacaaccttgtcactgtnattggtgacaatgaaattttaaatgtcgataataaatggcaaattaaaaatttcaagtatagatgttaa

SEQ ID NO: 1604 - DNA, 459 bp, Candida albicans
actacattatcaattatgttgaaaactagattaaaacaaagcagggccataagtcgggttgtaagaagatatgcatgctcacaccccatttctcccaatcttgataagtacccagttggtctaaaattgcatggttacgaagttacccaaacatcacctatcccagaattttccctcactgctgtatcattaaaacacacagagagtggtgcaactcacttacatttggattcccctaatgacagtaataatgtatttgtgattgccttcaaaacaaatcctccagataatactggggttccccatattttagaacatacaactttgtgtggtagtaaaaagtttccggtccgtgatccattttttaaaatgaccaacaggtcgttgagtaactttatgaatgcaatgacagaactgcctgttttcaccacgaaactggaaggtacgcgcttgcgtaaa

SEQ ID NO: 1605 - DNA, 1143 bp, Candida albicans
  unsure (1076): Identity of nucleotide sequences at the above locations are unknown.
ttatgtacaatgttatcaccacaagatcgccaggacaagttagtccgtgctactgatttagatgcattgagctgcaagtatagtattaacagaaacttatatttaaatcccccagatgaatttgtgaaagacttggttgagagctatcagcgttacttacagtactgtgttgggtacacaggattatcatcctcccgtgcattaaaaggactctttcaggagaagaaaatgcctataatcaaccgaggctcatacttaaggacaagagcaatagatcaagtagtgaacaagtttataggcgaattcaaggacagatgtcaaattgtgtcattagggagcggctcggacaccagagctttccaaatcttcaagtcacacgcaaatgtgatatatcacgaaattgactttcctgagtctgcaaaggtgaaaaaattggcaattttacagaatcctgtcatccgagagttagtggggactaacgagacgctgcctcttattaataacaaagaacaatttgaaagctattcctcagaattgcatactgagaagtatcatcttcatggtattgatttgagaacactaaagaagccggattctcagattaaaggctttcagccagaagttcccacattggttattagtgaatgtgtattgtgttacttatcccctgatgaatatcaacgcacaatgaactactggacagaaattgcagaccagaattatatgggattcttgatatatgagccaatgtcactaaatgatcagtttggagagacaatgacactcaatttgcaaagcagaggactcaatttgcaaacttttagcaagtacccagaccttatatcgcggaagaagtttcttgaagagtcatgtcacttaaaaaatttgaggcttactgatatgagttacattggtggatataaagtcaggcaagatggtcgtgagtggatagatcataaagagatgggtcgaaataatcagttggagatgatagatgaaatagaagaaattcgtctcttggttgagcactactgtttggatttatggggagtataccgaagagaaaacttggaatntcaaaggcatcgacacctgggagctggatcttactggtatttcattgttgatgtggtcgatggctag

SEQ ID NO: 1606 - DNA, 723 bp, Candida albicans
aagaagattttcggatacgtgggattaataacttttgtaattggtgtgcctgtgttatacgtggttgatttattagaaattgaaaagtttcaattccctccaccaaataatactattttagctagtatttttattaatggtatattttctgtcatttcggattatacttctgtgttggccatgttgttaacttctccattggtggtatctttaactttaacttcagtgattcctatcacaattttcattgattacctcgtgttaatatcgactggaaattctgtgaaaacaaactttgtgtatgttttcggtattgtttgtatattggttgccgttgtgttggtcaatgttaacataacatcagaaaatgatttaatagaagaggtcattgagcatgctcttgaagaagcaattagaaatgatgaagtaatgtcaccagtgttaagtccattattgagtcctagaaataatgctacaaacgttcttggcctgcagttactgcctcatgcttcacccattagcatttcattattttcaccaaaactcaaatctaaacatcctcttagaatatcccactttaatcttaatgaaaatgatgaaaccgaaccaacttttaatgcaaaccatgaaccattgtatggcatcacatcatcaccaccaaatattgttgttgttcaaggcaaaaaccatcaataccaaataaaacgaaatatagatgaatag

SEQ ID NO: 1607 - DNA, 612 bp, Candida albicans
tctcccgcatacactggaaatcaagaaattttatttatgcccaacacacctttacttctgatcagatctcctagatttgacagactctcccctagaatcacaacaacaacagccacaacaactgatcccaatggtattgttgatattatcaaccaacaggaaatacaaaattataaacttggtataattcttcttgtgattgcattggctacttggattattggatcagaattggtcaatgcggtattaaaaggagatgattatgaaaaaccttggttatttgcagtgatcactggttcatgtttctcaataaatttattaccggatataattctacttaaacactgggaagttttcggtcaaactcaaattgaagaagacttaccattacttcaaacgaaatcaaaagaaaagaatgaagatgtttcagaattaactcccaaggaagtgtgtattctggcttttcaaatcgcagttatttattatccatataatgtccttgggatgtccgcgttaaagttcacatcagctctgaatcaaacagtcatgggttcaacaacatcaatgtttactttgattgttgggagtaatactcaagaccggaaactttaa

SEQ ID NO: 1608 - DNA, 438 bp, Candida albicans
gttggtaatgaaaaagttcgggcaagctgtttggattgtgatgttcttattattaataattatttgtttgatggacaattgaatgatgaagttgggaaattgttgtatggattgagaccagggactaagattgttagtttgaggaactttatcagccctcgttatcgagccacttttgatactgtttttgattttttgagtgttgagaaacatgaaatgagtgacattatgtctgttagttggactgccaataaggttccctattatatatcaacagtcgaagaaacaataccacgggagtatttgagcagagaagaaacaaaggaaacaagtggtaaatctaaatcagtcagtcccgttggggaaattgaaaatgtggcagctgccatgatgactccgccgactgactcttcagaatcggagattatcaaaaattaa

SEQ ID NO: 1609 - DNA, 2193 bp, Candida albicans
cacagactgcagacatacccacatatctcaatggcagctcatccttcattatggtatcgagataaagatagtttgagaattgggggtgttgctaggtatactatagaatatacaagattagaccccaccattaaacgtatatatttccgtttgaaaaatatcgaaaaatcgagtatccgagcaatccatctattgagtggtccgttcattttgtattgtcacgtagtgccatgcaattataatccacgtaaaccattccatcctgaaaatgtccagaaaaatacagaagttgtgtttgagaatcaaatcaagccaaaccaagctttcaatgtgtcgcttttgttaaactcaaattccttaaagggaaaggatgataaaggatacgatattttccaatgggaaattgaaattgtttcacaaattgtaatcactaagaaaacagaggttgtctacgatttcatgataggagatgacctacatttcatgaagaaattagggcagagtataatacagcaaactctcaccagtttgggaacaaaaatagatatgaatgaaggaacaaagcccacaattgtggacaaagcgatagatgaaattcataatgattctcataaaatttacaatacacaacttaaagtaagcaaattgactacagatgacatctggtcgaacgaaccaaaagatcccaaaaagcctgttcacttagttatcgttacacacggaattttttcaaacttgactgcagatatgtcgtatatcaaggatcaattggagcttagagtaaaggaaaatattttggttaggggctatagatataacgctggacgtactgaaagaggggtcaaaaaattggggactaacgttgctaattacattacagatttaattgagaattcactctatcagtatgataagatctcgtttattggccattctttaggaagagtggtacagctatatgccatcaagtacattttgatgactaaagggccagattattttgagagaatgagaatcaaaccagttaattttattggaatggcttccccatttttaggaattttgaatgaaatgaattttttgatatcgtgggtgttggatatgggtacccttggcaagactggtcgggatttaaccttactgaaacgattgcctgcatggagtgatataagcattggagagtctaaaaagagagattcattcaaacctgtcttggaaactctaccagaagatcctttgcaaaaatttttggcacagtttgaacaattggttgtgtatgcaaatgctatgaatgatgggatagtaccattgagaacttctgctttgctatatttagattatgaagcattaggagacgtttctgaattgaaaaagagtaagcacatgcatgttcaccctgaactagaagaagctgaccacaaaatacaagtgaaccgtagtcgtgatactgtactggaagtacccgaagaagcaaatcaaatggttcaggacatacaggacgcagcaaagtctacagataattcccagtcaactgaatcatcagagactatgggcaagaaccatgtcatcagcaaatataaagaattcttgaacttgaatttcctggagcataattccaataatcacaaacccaagctaacgaaaagacagagaaaatataaaaattttagcgtaagaggaactgattataatgtgtttaacgatgtcttaccagaagatcactcattccagtcagaggaaactaattcaacccaagattctcaaactatagtcgtcccaccaagagcatctgctatagaatcagcaatcaatacacttatatgccccatcccttccaatgagtttttgataaatcccgagctgagacagcatgttattttccatgacaagtactatcaattcaataaatcatcccaagaagaaggtaacctcaacaaacatctgaaggtagaatggtttgcatcagttttgttgagatatcacagtaaatggaaattagagaagcagaaacagatagctgataaatatcataatgcgtgtggctggagaaaagttttggttaatctacctccagatgcacataataacatcgtagttcggagaaggtttgctaatggatatggttggggtgttgtagatcacttgtgtgatttatttagagtttccgaacacaaatgtaaaaattactggtaa

SEQ ID NO: 1610 - DNA, 666 bp, Candida albicans
gtgaaaattgaacttgtttcaacaacttatcttgacacatcttcaacaactttcttcccgcctcaaaactacatcatggctgaaaagattagatattatttggaacaatcagttccagaattagaggatctcaagattaaaggacttttcgataaaaatgaaatcaccatggttatgagaagacgtaccgatttcgaacatagaatcactggacgtggttgtaaaccaaaagattttttgagatacactgaatttgaaacaaaccttgaaaaattgcgtaaaaagagatataatagattaagcaaagtgggaatgattgaaactaaacccagtataagtgattgggcaggaactcgtcgtattatgtttattttcgatcgagcaacgagaagatatcctggagaaactgagttatggtcccaatacttgaaatttgcaaaatcaaatggtgccatcaaagtgatatataaagtgtattctcgattattacaattacaaccaagaaacattaatgcgtggttatcagctgccaaatatgagtttgagaccaatggtaatgctaaaggtgccagagttttatttcaaagaggattgagattgaatttggaatcacttgagttatggttaaactatgccctttttgaactaacttatttctcaaagtga

SEQ ID NO: 1611 - DNA, 1470 bp, Candida albicans
agaatacctagaactagacaacacattttcaatatgaacaaagagataagtgataagtttgtcacattgacttcagaatccgatggccaacctctcatttatccagtgtctaacaatgatattatgcctcacaatcttatggatacaggaccatctttgcaaaccagagaattattcgaagcttggagaccattcatccctcaagttcaaatgcatacatatttgatgggtgcctactattttcaagaagtgattcctaaccaattggcagtattgtcactcaacacaatgtattggtttgattccaaccctatggtcgatgattgtgacaacaaaggtgatcctggttataaattattcgaatggttagggtatgttttgaaagaaatgagagcccgtaatatgaaagtatggctttgtggtcatgtgcccccaaatgaaaagaattatgacaccacatgtcttcgtaagtacattgcttggacccacgaatatagagatgtcatagtaggaggattatatggtcatatgaatttagatcatttcatcccgttagattcagtacaagcttataaatctatccaaaaagatttcaaagatgaatttaaacagaaaagtgttttcagtgtggaagacgaagatgaccttgcattagaagattcaaacttatacaaggctttagatgaaaatttcagtgacaaattttttagagttacaggtggggttcctaataacaaagtgacatacttggaaacgctcagagaagaattatatgcaccattgaagggaaagaagaaatcaggggaacatttcgaaagatattcaatagctcatgttactgcatcaatcattccaactttcaacccaggtatgagggtatgggagtataacattactgatttggaagataagctacaacaagttaaatttgaaccttgggataagtttttcgctggtgttgaacgaatgatcgaagttcagtccaattatgtcgatgaaaaggacaacgatgaaatgaattggcaagaaatggatgatataactattgaaaggaagaagaaacataagaaaaagaataggaaaaagaagaaggatcatacattccctaaaccaatgccagagaatttaccacttggtcctgcgtatatcgaacaaacatttactccagaaagatatgtacaatactatgccgatttggaatccatcaacaaaggtaaaaaagaatttgattatgaaatagagtatagcactgatgattccttatatggattaaaggcattaacagttgaagaatggatcaagtttggtagaaaattaggtgagccagtaaaagatcttaaaaataatgtcaataaggggaagaaaaagaagaacaatggtaaaaaatataaaaaattacaacaaatttggaacgcttatttgaaacatgcatttattagttctgattatgaacataaaggatacggttaa

SEQ ID NO: 1612 - DNA, 1206 bp, Candida albicans
tttgagaaattcaaactgacaaaggatattttgaaagaaagaaaagctgtagactttgaaaatatatggatgaatattgctcaactgtttccaaagtctattctgttcatttcagattttataatgttggtttcctataaagagttttatgatgaaatgttggattatacaccaaaaatcaaatggccaattgaagacaaagaattgtttgggatcaatttgtacataattgctctcttgcttcaaactggaaagccacatattcatagacgcgatataatgttgaatgctcagactttgattaatcctgatattattagtaccgacacggtcaatgaaaaattcttcccaagtttgttattggtattggaacgaatgatgattctcttggaggagcctgaacatgaaatggcacctgagttaccttttacaatacagaaaaaaaaggaatttgatgttgccactaaggaattcaaagctaaaacatttgatttattggtgaagcttgaagttaaggataatttggaatccgcgtatggtctagcacgtgtccttgtgttgtatgccagagacaaaagttatgctgatagacttgctggatcgcaaattcttaaagatttactcaagttggttagaacaaatgttaagaggaaaactgtcattgaagcattgaggactagtgttatcttgattttccgttactgctttgaaacaagtaggatggcagaaaatatcatgaatattgaagtgactgcattgtttaataatcctatacgtcaaattaaagatcttcacgcttgtttgagagaaagcgcacctttggtatttcgagacattgatatggctgttggagttatttgtaacaatattttgctcgaaggatatacaggcgaagaatcttatctgagcaagattgcaataagaaagagaaagaacgatgagttgctgcaagatgttgaaatgagcgagcctgaagaatcgaagccattggtttctactacgatcataaaccagcttttatcggaattgatgagtgctatcaaaacagattggttgtctgatccatcaaccgttgaagaaaaaaaagataccaaaaaatcaactgtcgatttgtttgctaacgagaagttttcgtatgtatgttttcttcttaaaacaatagcagaattggttggttcatacaaacaagccaagttggatttttga

SEQ ID NO: 1613 - DNA, 1344 bp, Candida albicans
cgtcccatccccatggtgaagacctgcgctcaagatgagtttgaagttgatgatgctggtgaagaagatgtctttgaagatgcagacgacgcgcgaccatcgggttctggacgtagtagtagtgctgctactactcgagctcaaaagaagcctgcaggtaaagtttatttcagtcctttggttgacaaacagggtattgctgccttgatcagacttttgttttcaccattgacaataagccagagagagcacatttatcacgcattgcaatacatgtgttataacaaacagagcaggattgagataatgagtttgatgattgctatattgaatgattgctttactaataaccgccctgctcagaaagtctacacccaagtttgtaacaaagcaggtggaaacaaagacagtaagcagcagtacaagctaccagttggtgctactcaaatttctgttggtatacaaattgtggaagctgttgattatctattggaacgaaataatcatttgaagtactttttgttaactgagcatgaaaacacgtttattctcagaaaggataaaaagagtgcttctaaagaatcaaaattcccgattaactacatgttgaaaattcttgataacaagttggttacagacgatcaaacgcttttggatatattggccagagtattccaagttgccagtagagcgttgcatgcattgaaaaatagtgcaaatgctgatgataaggatgatgacaaggaaaacgaaaaggaaaaggaaaaagacaagccacatgctcctcctccgcctgttattccagattctaattaccgacttattattaaaatacttactggtaatgactgttctaacacgacattcagaagaacaataagtgcaatgcagaacttttctgtattacctaacgctcaaaaactattttctttagaattgtcggataaggcaagtgaattggggcaaaccattataactgatttgaataacttgaccaaagagttggtatctggtggaggctctgatagcaagtcattttccaaattcagtgcacattggtcagaccaagcaaaattgttgcgtatcttaacagctttggattatatgtttgaaaataaggagaagaataaagaaaaaggaaaagaagatgaaattgaagaattgacagacttgtacaaaaagcttgctttaggtagtctttgggatgcattaagtgagaccttgagagtgttggaggagaaaccacagttgcataatatcgcaaatgctttacttccacttattgaggctttaatggtggtttgtaagcacagtaaagtgagagaactcccaatcaaagatatt

SEQ ID NO: 1614 - DNA, 708 bp, Candida albicans
tttttaccatctggtccattactccatatattacccgaagtattaggagccataagaaagaataaagaaggaataaataaagtgaaagacaaaaaactcatacaggttttcttcaagtcattctacaacttgaataatgccaaagagttggttagaacagagctgtcgactaatttaggttgttcccttgatgagttgggaagacattatacatctcttaaacctataattttgcaacgactcctggagctaattgagaatatgagtgaatacgtcaatcaacgcttgccaggtattgagttttatacatcagactcgggctctttgttttcaggtaagggcgatgactcaccagtcaaagttgaaaatggtaaagagatcactagctgggagaatgaggattctgcatatttgcttgataatgtttttaactttcttggtgggttgttacaggatagtggccaatggggtacagatgttattcagaaaattagcttcaaatcatggatcaaattattgacattacgtaacgcaccatgggattattcaatgtcaaatggtattgtttcatttatggggattttgaaatattttgacgacgaaaaaagagaatatggcttacctgttattattgaagaattggacaagacccttaaattggattccgtatattcttatatcttcaccacgcggctggaaggaaccgcg

SEQ ID NO: 1615 - DNA, 786 bp, Candida albicans
agacactcatctttggtttcaagagacgtttactttgctgccataagagctctagagtgcatatctttcaaaaaagtttggggtgcagagttgattcgtacaatgggaggtaatgtgagtcatgggatcctattccaatgcttaagacacatttggaaaatggtcaaagatcagaaagaagactattttgaagaagggtacattcactttttcaacttgataggaaatttgattagcaacaaaagtttggttcctaaattaactgctggtggtattcttgacgatttgatgccatttttgaacttacccactaaatatcgttggagctgttctgctgcagttcatttgattaccatgtacctagcttccgccaaggattctcttgatgaatttgttactaatgatggtttcactttgttgatcggtaacattagacgtgaagttgattttgcattagaaaatcctgaatttggtggcggggcaccaaaagatgctattgtctattattcgatcactttgagacaagcaaactatatccgcaatttgatgaaactagtagcagatcttatacaatcagatctgggtgatagattgagaaatttgtttgactcacccttacttgaaagtttcaataaagtattaacacatccccatgtttttggcccatctattttggcggccacaattgattcggttttctttattattcataatgaaccaacagcattttctattctaaaagaggcgaaagttatagacaccatattggataacaacgagagatag

SEQ ID NO: 1616 - DNA, 972 bp, Candida albicans
  unsure (942): Identity of nucleotide sequences at the above locations are unknown.
attagattcaatatgatagttggaaaaagagatcatcaccagagaatggagatggcaaaacctttgagatcattgattgataaattaactacatgcgatatcaatgagttgccacaatatttacaagagaatttcaaatggcaaagacctagaggtgatttgattcattggataccattattaaatcggtttgacgagatttttgaacagaaaattgaaaaatacgggttagataaagacaatgtaaaattgctgttagtttcacctgaagatgaacgtcttattgtttcctgtcttcaattcacttatatcttgttggatcattgttttgataaacaggtttattcaagtagtgaaagaatctacgcattgatcaactcatcatctttggaaattagattgagagcattggaagtgggtattgtccttgcagaaaaatttgttcaaactacttcgtcaaggttttctgcgcctaaacctgttagaaacaaagttttggaaattgctaaatctttccctccattggttcctattgatagtacattgaaacaattagccgaaaataagaaaaataataaccacagagatactgatgaaaagcctagtattattggtgatcattataactttgtctatacattggatccagagaaaaaatatccaagcaaatggaaaagtataaattaccaatactacaaatcagtacctaatactccaactttaaataaaaatgcatcgaaactgaaatctaatgataaaaagaaggaagatacagtaactgaagggttacacatatttcatttacctgaagaatcagtgagaaaattgactgttcaacaattgttcgaaaaaggtatggaagttttacctccggaatcttggttttgttttggtatacacgctcaaatgattaaatcactgcgactctacatcttcatcacngcccgcccggaccacaatattcccaaagaa

SEQ ID NO: 1617 - DNA, 525 bp, Candida albicans
ggcaggtttaaaaaaaaaaggtcggttggcgttcgccgtgatcaggtatttttagattcttataggtccttgtttttcaagccaaaggatgagtttagaaactcaaaattggagattaatttcaagggagagcaaggtattgatgctggtggtgtaactagagaatggtatcaagttttgagtcgacaaatgtttaatcctgattatgcattgtttacaccagttgtatctgatgaaaccactttccatccaaacaggacttcgtatattaatcctgaacatttatcttttttcaaattcattgggcgtattattggtaaagctatttacgacaactgctttttggactgtcatttttcacgagccgtgtataacaggatattgggtaagcctcaatctttgaaggatatggagactttagatttagagtatttcaaatcattgatgtggatgcttgaaaatgacattactgatgttatcactgaggacttttctgttgaaacagatgactatggtgaacactag

SEQ ID NO: 1618 - DNA, 1227 bp, Candida albicans
tggaaactcatgatttggagcaaagaatatttgaaaaaaaactatatcaaactactagttcccatatgtgttgttcttgtccttgcatatttgaattatgctattaattatgcagttggatataaactagtatatgtacatcattcacatgctgttgcaattatcctttgggtgttattgggcttctttcaattggagttattagtttactgggtattaatattccttgttggaccagggaaatcaccagtattcccacctatcgacctttacggtgaaaataataaaggtttaattcccttacctgatttatttttctgtgatgaaaaaggttttccatattactgttcaaactccaactccataaaactagaaagaagttttttttcaaaagatgttggatacaatgtgatcaagtttgatcattactgtatatggattggacaacctattggacaggataattatctatttttcatgaaatttatgatgggttttcttgcatttttcattattgtgctaatatactgtgcaaggtttaccagagaatctattcaacagggtgaaattgatcataattttattgtattgtttgttatgagtgggttttggatcattatgatagggtgtttattcggtattcacttgcggtacgttagtataaatatgactacattagatgaaattacgataaaccagaggaaacggtataatcgatggaaagatgccagaaagaaccctaatatgcccagctggatgaaaacaaaaaacccacctagaaaagaaacaggaagaagatatgttaatgtcaagcacaaaaccggtagagctatagtcaggtattatattgatgaaagaccctttgatatgggatttagaaggaactggatcaatttggttttcaacggcaacagaaatcacgggaaagacgatgaattttatactttatggagattagctgctgcttttgttgtttttattattccttttattgacataccgttttcttttagaggtaaactacaagtaaaggatgatgtggaacaggaacttcacgaacaagaaaacctactagcaaaatacacagtgtattcaagtgttgttaatgacaaattcatgaacatgatagatgaaaagttgaagaaaaacagttattctgcacctggctatttggtggaaactactcctcagaacaaccaatccacaatagataaagatagcatatag

SEQ ID NO: 1619 - DNA, 1458 bp, Candida albicans
aattttttttttgattcaacaaatccactcatctcatcaaaaccatctttaatctactacccattttccttcttatctttccacccccacacaccccttatcaatatgtctgaattacatgatttatgtaaatttccaactcgaccaatagatcaatcatatattgataaattgactcaatatcttaaagatggaattcccgcaacttacacaatcgaggaagcgtataattatattaataatattgaggaagagccaacaacgacaacaactccattacatttaatatgtagtcatgctccatttgatatcaccaaagaagaacaagaaataatctctacaatggtggagaaattatttgaatatggagcaggatggagttttactgatattaataatcaaacccctggatgtattttaatatcaagaagaagagaaagagaaaataaggaagaggatggaaaatggatgaatgatgtatatcaacaaatcattgatgctggagttagagcggaattattgttgagaaaagtaaatgaatttgaagaaattgaatttattgaagaagatgatgaacaagaagaaaaagaagaagaggatattcctcaattggttaaggatgaacaagaaatcaaagaggaagcaaaacaagaacaaactactactacagacattaagcctgtcgttattgatgatgcacctgatgcaccatcacaaaatcaacaatcatatttaaatacaaaattagaatatattaatgatgcattaattacaaaagacgataaagatggagtaatgatggcatgggaaaatgatattatgaaattagccagtgataccataaccagctcagccagctcagcctctgattcggaactggaacaggaggtgaatattttaaatattggatttggaatggggataattgatgctatgattcaatcaaaacttaaatctcatccaaatgctaaacattatatatgtgaagctcatcctgatgtattacaaaaaatgaaaatagatggatggtacgaaaaacccaatgttataatattagaaggaagatggcaagataaattaaatggcctattatcttcttcttcttcttcagaagcttcggttttttttgatgggatttattatgatacatttctggaacattatcaagatatgttagaattatttgatataatagttggattattaaaacctcatgggattttctcatttttcaatggattaggagctgatagacaaataatttatgaagtttataaaaatttattaattattgatttagaaaattatggattaaattgtcaatttaaagaatttaatgttcctaatgaaaaattttggaataaattacaagataaaagtatttgggatgatgttaaacgatcttattggtcttgtcctatatattatcatccaataatcaaattcatcgattattag

SEQ ID NO: 1620 - DNA, 684 bp, Candida albicans
tggatccatttcaggaagttaaagaagatgcatatgtttctattagaagctttagataatataataaacttagttcttaatggaaaaccaccaagtatggaacaacaacaagattttgaaaatagtttccaagaattacgagaaatatatcgagatttacaacaagcattatccataagtgagtctcaaccatcgaaattcaatttatctgatattgatatatccaatcgaaaatcaattttatctgatttaaatgatcaaattcaacatttagagaaaaaatggaatcaaaagcaatatcgagatgtaacaacaatgtccaatagaatcagtcaagatggtcaagaagacgaagatattgacccatttagtgcagactctgccatgacttcatatcaacaacaggaactaattcaagaacaagatttgcagttagatgatattcatcaaaccatgatgaatttgaaccagcaagcagcaattatgggtgatgaattggaagaacaggggtttatgctagacgaattagattatgaaatggataatgttgataataaattacaaagaggaatgaaaagtataaatatattcctagaaagaaacaaagaaaccgcaagtaattggtgtattgggatattggtggtagtactatgtgttttattggtgttgttattgattgcatag

SEQ ID NO: 1621 - DNA, 450 bp, Candida albicans
ttttcttttcagttaaactggcaacagcatttccgacaacaaaaccagctatcaatcaatataatggagacccccattccaaatcaagatacagctaaagaaaatttagagacacatgccaatgaatcaatagataattcagaccaaaccgagaacaaacccacaaatggttctgttgacgaaaaaccacaaagctcaaacccaatggaaatagatacgaaagaagagtctacaaagtcacagataaatacaccagtcccaaatgagaatagtcagcttcccatgcatgaaatagtaggtggatcttcagttagacgatatctcaaccaacaccttacaaagactttactcgagggattaaaagaagttgcacaaattaaaccagaagatccattgaagtacttaggggagtatctaatctcaaaatctaacaagtcaaagaaagagtag

SEQ ID NO: 1622 - DNA, 240 bp, Candida albicans
aacatgtcttcgtcgcacccagatacacaggtgttgcgaccatactatgatcatgatacattcaatgcgggatactctgtgattttcaagaaaggagttggtataatagaacccaaaaccaacagacccgtgacatccaacatttctgaaaagttgatcaatcaatcaataaatgagaatcaagggataattcgaaatctgtttaaacatggaggaacagtgggggatcaatgctactaa

SEQ ID NO: 1623 - DNA, 1698 bp, Candida albicans
gttcgcggattttgcagcacgatgtcaagatttgatcaattatacaaatatggactgtatcgtataataagaccaatgtttcgaacaatattagtatatgtcagtggtagaattcatacttgggtagcattagattggattcttagtaaatttattgaagatggtgatcatgtcattattattgcttcaattaatccatgtctgttaagtggtactaataaagatcgatccaggagagctacttctataacaataatgtcattatcacctgccaaaataggtagtcaatcatcagtaattcgtggaaatactttatcgccacaaagaagtcgaactgatgaaccacaatcaacacgtcaagattctattgatcctttcataagattaaaagaaaaaagtcgaccagaaaacattgtcaaaatagctcataatttaatggattatgtaatgaaagtaataaatccaaaaattattgccagaattaccgttgaattagtagaaggtgacactaaagaagttttacaagatatgtatcgattgtatgaaccaaatttggtatgtacgggagcaaaaccaaatgctagaatgggggcaccattaagatcctggcaatcatcaaaattaactgatagattaattaaaaatttcccattaccagtaattgctgtaccggcagttaatatgtgtcaatttgaatataatttacaaaataaattgaatggtacaattgatgctaaagaagttgatcaacaaaatcaattaaatgctctgaataatataatggaaactagtgaaatcaataataaagcaggagatgaatcagaatctggtgacgatgatgaaaatgatgccagatcaattacatcatcggtatcaatatcatctgatgaaagttatgattcatttattgaagtggctgatgtatatcttgaacataaacaagatttacggaaaaatttacaacatttacaacaatcacaaccaattaatgaaaattattattctgatatggttaaattaatatcggatgaatcagttgaattatgtgaagaaataattagtattcaaccaaattttattggtaatggtgctaaattagctcgagaaatcacagggtctaattcatttggtaatgttccttataaaactaaatcaatgttagaacctcaacacaatgattcaacatccaatggtaatgataatggtagtggtaataacaataaaccatcattatcatttaaagaacttaaagaacaattgaaattaaataaaataaagactgaactggcagtagatactccagtttcaggatcaacttcatcacttggtactggaacagaaccaacatcatcatcatcaccaccacaaaagccagatcttcaacctccatcaatcaaaattgatgttccatctccatctccaacaacaacaacaacatcttcgggcctaccaccatcatcatcatcagaaacttcattaagatttggaaatttagaaaaaccatcgattgaaagaaggaaaaaaccaagtatgttacacaaatgtttgagtcatagtgatgattctgttgatcgacctaaattggaagcaagaaaatcacatcctgatgtattagaacatattcgtgatgaaattaaaccgtcatcaaaagataagaaaacaaagaagaagaaaaagaagtttttagggatattttaa

SEQ ID NO: 1624 - DNA, 1878 bp, Candida albicans
aataacagcaatttgtttttaaacaaaatggaacaggtgtcgtctattttaagtaacatattatcagtagaagaagggacaacacaatcacacccacaatccaaaacactgctgaatcgtagttcaattgatgagtccctggaaacattatcaaagaaaccacagcgaagatccaaagattttgatttttcttcattttggaaaacaagtgataaagaacaagatacaactaatggcgaagacagaaaaaatgattttgaaactattggagataagacatcaaagaaaacactatccaactccttagagctggaaggcaatgccactactgtaccattaccagccccaagttcgtcttcatcagcacaatatatggcagataagttaatggagaaagtgatttcaatgatgatttcaaatgaagtggttgatgaacaaacaagcaagattcttcaagaccgaatagaaatgcagaaacaacgtccgccattgagtattgccttgatgcagaataacagtaatgagttacaccgacgcaattccgatatgtatattttcattgatcatgtacaaaagtttttcagttggcaggatcctttctatacagtggcatggttgttaattattactcatttaattttgaatccatatttatttactgttttgccattagttcaattgatcacttcaacattggtgccacattatttaatgatttatccaccagatggtgttgccaatcaagaatatttggaggtaaacccaaaaccttcagacaagccattgaatttatacaaggtacctaaacctgttcccttgttttctcgtgaatttttcatgaatttcacagacacccaaaattttatgactttgaatatcaaattgtttgattttacagtatggttaacatcggattatttatatttcaaaaacgaacaaatcacatcgggaatatatgtgatttgcatagctatgatatttgggaacctatatttattgccatatattgttccattcctattgaatcattttataattgtacaactatatttcatttttaatatctgggcaatcacagcaattttacatccttatccacgaggattgttattagaatggatctataaagaagacacgaggttgaacgtacaacattttgttaataaaatagaagataagttgactaagtttattgcgaaaacccccacattggaacaatctataacaaacacagatttgcaacatgcaactaaagatattggatcaagtaacgaaattttggaagataatgatactaaatatgttgagatatatgaactacaaaagttgaatactaagaataaaatgtgggaagctgttggatttacacctaatttttatactacaaacgatgtgattcgaagatataacagtgccatacaagaattagaacagaatgataaatcgcatacacattctaatgaggacccgcaagaacctcacaaattacctttgcttaaacgagatacactctctgagattagtccaccacagaactacaagttcatcccatcagaaaaatggaaaatagattacgatattagtacttgggtagaaaataatttaattcaagatcttgttattatagatgacgatgaaaaatgggcatatgatgtgatcactgaaacaaatcaagaccaaaaacaggaaatagaggggaaacaactcgataaggcaatcaatgaaatgactatgaatgaaattgagaaatttacagatttaacaaaaagtacagagttcttccgaagaagaagatggattcgaaaagtgacaagaatgaattataaagatcttaaagaggaatcggtgccaataagttctattagtgcttgggtataa

SEQ ID NO: 1625 - DNA, 519 bp, Candida albicans
tttttgcaggcatcaagaagattccaagaatgtcaggaccataatttaaaattgggaaaccagaaaatccttatactgtgtgggaaagatcaaaaacaaagcttgtttgaccctgcttcccatataactgaagacgacccaatgttttatgagttaaaaaaattgcccaaattaggagttacacaagatttggtagaaattgtggaagataaggaggaaaccgagtcagcaaatatagtgctaaaaaccgaagcaccaactggattatatctacctaatggcaataaaaaaatctgtatgatatcaggtacagaagtgaaatactttgatccttcaactggtattccgtatagttcagttgaagcatacaaaatactcaaatccatcgaacaaggtcaaattccatggttgagtcttacaaacgagtcgaatgatactggcaatgtcgagctttaccttggatgcagagatgggactgctcgacatgcacaaggtgttccagaaggatttgatggttaa

SEQ ID NO: 1626 - DNA, 378 bp, Candida albicans
tatacccataacaccattcatctgatgtcatctgttttatcagcatatagaaacgcattgagagctacaaaagttgcttttcgtcaagatcttcctatactccaagcagccagagtgcaactcaaacaaggtataagggacaactcgaatttacaagcccaaccagaaatagaggaagcagtacaaaaattgaatgaagttgccaagttcttgatccagaatattgtccaaggagagaaacaacaagatgggaaatattttttgaatttccatgaaaaaacggagttgggtgacaatgaaaccatcaaacaaggacgaaaagagatggggagcttggcaggtaaaaaaggaagttccattaaatcttgtaacgactag

SEQ ID NO: 1627 - DNA, 924 bp, Candida albicans
aggagtcctatgaatacatttaaggaatatagtgaaaaccagttatcaatattaaaaaatgcagtacagacccttgaagatgagaagaaattcttaaacaatgagttgatatctaaaactgctagtaagaagcgaaaaacagagccactgaacaaaatagcaacatccactttagcaaatgaagaaaagtatttgccactacggccgttgaaagaagtaaaaactggtacaaatgattcagttgttgcaacccaaaatgagacccaaggtaaaccgattcaaaaagttatcaaactactgagtgactcatcattacttatagatcaactttggaatcattctatagtgggaagcaaaagaacatcatttgaatatttaaataaaatatgcattgattttgatttaaaattgaattcagggttgaaaattgtgaaacgtacctcaatttcatcaagtattgttgaatttttaatgatgaataaaaataaccgattagataaactcattgaaattttcaccatatcgacaattcaactagttgagaaactattacaagagaaatacattcttgcaataccatttattttgtctttggttgattgttcattgtctttccgaccagcagcacttacaaaatcgttgattgtacaaatactaaagcgagtatcgaaaataactgagagtctattgtttttgttgaattccaatcttgatgaagatgatttagccaattatcatgatgttccgtaccaagtgatggtattagagaagtttatctttgtggaatgtttggatttgatggaaaggttagtgactttgactacaacattcgatattgagtttatcaagaacgtatggcaaaaccgcattttaccccaaaatataataactccatgcctacctgataattctgaaaagatttag

SEQ ID NO: 1628 - DNA, 261 bp, Candida albicans
cgcaagttgccccaagagttgcggtacttgggcgaccagtatgtgaaaaaggagttcaaagaccataaaaagattgacaaccccctccacatcgtcggcttcttaaccgaatggcaagactacttgaaacagatcgacggcgggtcttggctgcacggaaagttgagtaaagatgatctcgacaaaatgtcgcctgaacaaatcggacagctacacgaattgatggaagcaacaaagaaaatcggtgaagaaagtatatag

SEQ ID NO: 1629 - DNA, 552 bp, Candida albicans
aaaatttcttgttcgtggagaaacaaaaaggaaagaaaaaaagaaaaatccaattctctttctcagataactgttaattattcctacaccatatacttcaacatgagtaaagatgataaagatttagaagagatttggaaattgtttcaagattcaaatgaagatgtacagaaaagaagaaaagaaataacaaaatctattcaaaaagatacaagtttgaatgaataccctggactggtgtcgatgatgactgcattagacgagttaatcgcttgctttgcattgggaggtcaagtgaaaaactattatagatatggaacttatgactcatgtacaagacagagagaaaaattttggtttgctataaaacatggatcatttagagaacaggaagaaagaccgcttgaagaatcgagcgaaagggagttgaccaatcgtatcaaagtgcaagaattttataaaaagagattccttgaagataaagccaagggaagctcagaggatatttggaacaaacgtgaggaattattaagtaaccctttcaagaaataa

SEQ ID NO: 1630 - DNA, 879 bp, Candida albicans
acaaaagaaaaactgaacatacaattggaaatttgttcaaaaacaatcacaccttttaaataccaattcgaatcaatgtttacttttgctaaaaaacttgttgacagatttgaagggagctcggcattggactcaacttccaatgactcttactttaaaaatgccactgcaatcaataacaaaggatatgccctccgagtgttgaatgtcattcctcattctactgcacaccaaaaaggttttgaatcttggtttgattacatcataagaataaacaaccatgaactcccaatgctttatccttcgttatcgaatttttcgtattctattaatgacgacggaaccatcaattatggtggtaatactacccaggaacaagcagctgcagttaattttgaattgctcatgcaagaaattaatacattggccaaacatgagcaagatcttgttgttgatgtatggaatgcaaaaggtgggatagtccgacaaatctctttaccattgtcaaaatatgaacctactgattcatcaaacaattccgatgaatctgtccatcaattatttgttaacaacttcaaacaattggggttgactttggaatctcagcatttgactacagcaacatatgtatggcgaatcttagcaacacatcaaggttctccagcattcatgtcccaattagtgccatattcagattatattattggttgtgattcagcttatccaacagacaccaatggcaaggggttgcttacaaaaggtggcgagtctttattgtcaaaaacagtcttgaattactacaattatcattattcaatttccaatgaagataatatcccattcttcaccaccggctggaaggaccacgctcgcggggca

SEQ ID NO: 1631 - DNA, 2742 bp, Candida albicans
acacattttaccccctttacaaccaacacacgccaattggttcccccattggcttcatatattgaaaatccggatgatgaagaaaattcacagtttccattgttaattaagataagtccagagtttaataaattgaaattacatgtatccatcaaaccggtcgttggattcgagtcacgatcgttaattattgtgaaatcaaggggcgtgacagatgttgatgtcttgaaaaatcagttgtatgatgataacacccaagataaacccatgactgaattgtcaaagttggagtataggaaattaccaatagaagaaaataaccatagtttccaaaaaataataattaacgattttttcgaccccaaaattgtgaataataccaaattgaacatttctttatgggaacatgattcaacgtccaatgagtttcgtcactttcttaattttagtgtatggatcgataaactagctcctgttgaaacgccgataaaccgctcactgttttctttggcaacaaagggccaaccattggaagaaaaatcaccagaaagcaaattgtttagtttgggtgatttcagaaaggagtttaagattgatattgaggatgggcccgagttcagaaaaacattgacgcgattggaaaataatatcccctgggctaagaaaatatattctaatttagttgacgaatttagggtattggaatccaacgttaggagggtgacaacttcaaaaatcaaagtaatggatactatagatcagattgttgatcttgaatctacatctttgttgaaagagtttggattcaaactggatttccacatagtatttaaagccatgtttgagccatttgaaaagaatctcaatttcttttttgagaatgtttgtgatcataaacttttgaataaaatatatgccaatatcgggtttactcaaattgattcgagtgctgtttatttggagctacaaaagaaatttgaagcagactcgaaagaatattatagttggctaaataaatacctttcaaatgaaaaagaacgaccagaactgaagctattagccgaaagaaaagtttttgaattatcaaaatttgattacttgaacagcttaacaaaagttacaaataatcaatatgtgaatgaagtacttgaaaactttttcaaatttcttaatttaaaatatgatccacgttatccacggttattggattaccatagtttcaaggataagaaatctaaccagaatcttcttggtgataattatcaaatatatatgaatgtgttgctaagatttaacagtgagagatatcaatttagacagatgattgaggcttgtcaaactaacgaagagttgactaatttgattcgatgcaacagactaaatcataaactggtctccaccagtagcagctctccttctacatcgacagcctctccacacaatcttgtcacttccagtattgatgagttcattatcacaaaagagaactgggatctaatatttaatgatagtaaaccccctgataatgaaattggtcctgacgattcagagaaatcgggaatcttattcactttaggaggacagaaaaaacaaggatggcataaggaatgggtggttttgaagaaaggtcaattaatagagtatgctgattggagaaaaggcagaactccaataaataaaccaatagaaatagctttggcaaatgtaaaggcaataactcacgataaaaggcaattctgttttgaggtattaacttccacgggttcaaagcacgtgtttcaagcttttgataatgatgaccgtaataaatgggtgaaggcattacacaatgctgggcaattgattaatacgaaaagattggaacaagctcatgccaaatcgttatcgcaggagggaagaaagaaaactataggcaagctaatcaccgagtttaaggataaacctataattcctgggcaagatagatcaatttcacctatttccttaacatcaaaggcaccaccaattgaaaaggactatttgcaaatggtccgttctgcacctgatagtgataatagtatttgtattgattgtggctcagcggaactggtagaatggatttcaataaatactttaacatgcttttgtattaattgtgcttcgtgtcatcgaaatataggttcacacatcaccagaataagatccttgaaaatggacaagtttgagaatgaaactgaattgttattgaaatatattaataatcgggtagtaaactcatacttggaagaaaacttaccttcaaaggaaaaaatcacttgtgatgttgataatgaaaccaggttgaattttattagaaacaaatatcaattgaaaaaatacaagtctattattcctgatattgataaccttttaatcaaagctatacaaaaaatcaatgtccccgacgcattaaaatatattctttgtggtgctgatatcaatttgaatattcaaataaacatacctaatagaaacgaatatttggtgattacgttatttgaatattccttgagaaaatatattgaaatcaaagaggagcatgatcgtgaattagggtataaacccaaaaagttgtttattatttcggagttgttaattttaaatgggtgtaaagtttctcaacatatcaaagatttgcaaaaggaagatttggggttgactgatgcagcagtggaatactggaaaattcggagtttgaaattaagtggaggcaaagcaagttaa

SEQ ID NO: 1632 - DNA, 1422 bp, Candida albicans
actttacttttattaaacattattaagacactacacataatggatttcataggagagattatagagcatgagacagaggcacctaaagaaccaaccccaaaacccacaattggtggattccccgaacttaaaaaattaaaagaaaagaaagtctcaagatggaggcaaaagcaacaacaggagcagagcacaacttccccaaaaactactgaaatccgttcagaggcttccaaaattcaccaagaaaatatcgagaagatggctcaaatgtcagaggaagagattttgcaagagcgtgaggagttactaaagggtttagaccctaaattaattgaaagtttgattggtagatccaagaaaagggaagcaacagaccatgaacacaatggacatgctcatgaacatgcagagggataccatggatggattggatcaatgaaaacttctgaaggattaacagatttatctcaattagataaggaagatgtggaccgtgcattgggtataagttcattatccttatctgaacctgagggtggcagtaatacgaaaaaagtcgctttcgacgataatatcaagacggttaaatttgaagatttggatgatggaattgaattggatccaaatggatgggaggacgttactgatgtcaatgaattagttcctaataatgatcacattgcacctgacgattaccagattaatcctgatagcgatgaagaaggattgaataatactgttcattttacaaaacccaaacagccagatttggatataaatgatcccgatttctttgataagctacatgagaaatactatcctgatttgcctaaagaaacagaaaagttgtcatggatgacacagccaatgccaaaacaattgtctacagtttatgaatcaatatctgatatgagatttgacttcaaaggagatttaattgaattgagcgcagagggagaagaaccaaaagatagttcattcgaaatacctacttatatgggacttcatcatcattcggagaacccacatatggcaggttatacattgggtgagttggcacatttagccagatcgactttagctggacaaagatgcttgagcattcaaacattagggagaatattacataaattgggattacataaatacagtatactaccaaaaacagactcagatgatcagagttttacagatgaaatcaaacaactatcacttgactttgaagatatgatgtgggacttgatagaccaattacgaatcattgaaacaataacagaggcagctgatgaaaaaaagaccagaaacttatctgtcagaaattatgcaatagaggcattgtggttatatagaactggaggtggaagaacagagataactaaacaaaccgaagaagatttgatagcacaagcagttcagaaataa

SEQ ID NO: 1633 - DNA, 1719 bp, Candida albicans
gttattaatccatttccttctctctccattccattcatccttccttttttgcaaatgccggtgtttgaaaaaaaagatactgtacataccaatgttccatcccctagaccatccactaattcacatacttcatctacttatatccctcgatacagactaagtatcactactaatgaggatataaatttacaatctatagatcccggtacagttaaaattgattgttctggagcatttattgccaatgatgatttattacgagatactgcacctgaaataactgatgaaattaacaattcctcttcttcaacttccgggacacctcctctgtcaaatacatcgtcggatcttgaagatgacacagaagaatctgaatttgacacagaagaaaatggtggaggtttaagtgattcttcaagcacaacggtggaagatgacgaaaatcaattacaacaattgcaacaacaacctttatatggaggtgtcattaccaaaaacaatattaccctaccacaacacaatgatgaaatcatacatatatctgtggatataggtggtacattaaccaaattagtttattttactaaatcttcatcaaataggaaaaattcttctaggaaaaccactggtggtggaggtgggggtaaattacatttccaggatttccaaacggaaaattttaaaaatgaagctatgaaattcatgattaaattaatacaaaaatcaattaataaatctaatataaatcctcctataacgtatattatggcaactggaggaggagctcataaattttataatttaatgaaaaaaacatttaaaaaacataaattacccatgaaaattattgctaaagatgaaatggaatgtttaattaaaggattagattggttaataacgaaaatccctcaagaaattttcacttatgatttaactgaattaacaactaaatttgaacccattcaatcgaaaaaagaaatctatccttatttattggttaatataggtagtggggtgagtatggtcaaagtgactaaaccaggacctgaaggatttgaaagaattggtggtagttctttaggtggaggtacattatgggggttattatcattattaactgatgctaaagattataatgaaatgttggaaatggctcaaaatggagataatgaaaatatcgatttattagttggagatatttatggaactaattataataaaattggattaaaagctaatcatattgcatcatcatttgccaaagttttcaaaaaattgagaaaattcaactcgtctacgaacagcaataacaataacaattccgataatgatagtgatggtaaatttaaaaaattgactgctgctgaaaaattggctcaatttaaacaagaagatattgctagatctttattattttctatatctaataatattggtcaaattgcttatttacatgcattaagattcaatttgaaaagaatttattttggtggtagttatatatcaggtcatatgcaaaccatccatacattaagttatgccgtgaatttctggtctaaaggggaaatgcaaagttatttcttacgtcatgaaggttatttaggaagtgtgggggcatttatgatggttccagctccaattcttgaagaaaatggcaattcatcaaatgaaaataatcacacaaataatgttaaaattgccaatggagttcaacattaa

SEQ ID NO: 1634 - DNA, 477 bp, Candida albicans
atcattgttgctttgaaaaatatgaaaaaagcttctgatcttgatccacatgattatgatatctttttcggtagtgctgatcatggtactttatttgattatccacacgctaaagatttacacaaaattgctactactgtttataataaaggtggtgttgtttctgctgtttgtcatggtcctgccatttttgcaaatttgaacgatccaaaaactggtgaaccattaattaaaggtaaaaaaattactgggtttactgatattggtgaagatattttgggtgtcactgatatcatgaagaaaggtaatttgttgaccattaaacaagttgctgaaaaggaaggtgctacttatattgaaccagaaggtccatgggataatttcactgtcactgatggtagaattgttactggtgtcaacccacaatctgctgtcaaaactgcagaagatgtaattgctgcttttgaatgtaattaa

SEQ ID NO: 1635 - DNA, 378 bp, Candida albicans
actacaacaattccattagagatgtttaaaaaatttaccagagaagacgttcattcacgttctaacatcaagtcatcagttcagagaggacttaaatccaagtttgttggtgtatacccagatatagagcaaggcatagataacctcatacctaaaaagtcccaggtagtggttgttaaatgtgaagacaagattcaattatatgccgtggaacagaacgatgaacaagatattgttatgttccaacacttcagtgatgatttagtaccaaccttgaaaactgttcataaatatccagagtgtttccctcgagttcaagttgatcgtggtgcgattaagtttgttttacgaggagccaatataatgtgtcctgagtaa

SEQ ID NO: 1636 - DNA, 525 bp, Candida albicans
aagacattaccatataccactaaacaaatgtcagacttgcttcataaattaaatttcaaaattgctgatgcatcccctgaatataaacaacgtcgtaaaattcaaatgatacgttttttcacggcgtcggcagtgactatctttgccctgaggtttgcctatcgtgcaactgtttctcgtcaatatattcctacattattccaaggcaaccattctcctcctttaagttataattttactaccgatgcggctgttgctgttggaacagggacattgttgtgtggatcagtcacaggaatgactgtatttggactttgttggatcttggatgttagcaatataaaagagtttggctggagaatgaagagtatgttgggaggatgggagctggaaaagaaactaagtgaagcccctatggatgaggagagttcgtatatccaagatagtttgaatgatatacttgatggaaagtatgattttgagaatgacacagaagaagtggcaggagaattaaaaacaaactaa

SEQ ID NO: 1637 - DNA, 711 bp, Candida albicans
gttactaacatttcttccccctccgaactgtttagaaaagcagcaaaaatcttatcatcgttcatcaaacccaatcaaatagctggtcctgatcaaattatccctccaagaatattgaaaaatgccaagggattagccattataactgttttgaaagcagggtttttattttctggtagagctggatccggggtgattgttgcccgtttaccagatggatcttggtcagcaccttcagcaattgttactgctggtgctggtgttggtggacaaattggagccgaattgactgattttgtgtttgtattgaatactaaagctgcagttgatacatttgctcaaatgggatcggtgactttgggtactaatgtatctattgctgcggggccattgggtagaagtgcagaagcagcaggtacagccactgttggtagtgtatcggcagtttttgcttattcgaaaacaaaagggttatttgctggtgtatcattagaaggttcagcaattgttgaaagaagagaagccaatagaaagttttatggaagcaattgtaaggcaagaaatattcttgctggtcaagtggatattcctcctgcttgtgaagcattaatgagagtattggattcaagagttttcagtaacaaacttccttatgatgaagatgatctgtcttcagccacgggcatagaagtaccgcgtccggaaggtaca

SEQ ID NO: 1638 - DNA, 1338 bp, Candida albicans
tatatatttgacatgggattactttcatcgttgctttgttgctcaatagagtcgaaagatgataacgatgacaaagtacaccgaccatctacatctaatggtattgcaacaaccacatctaacaagagcaatgcagctgtgacatctgcaagtctgaagggaaactcatcgcggaataaccagcaagacaaggcgaaaaagataaatacaacaaccaccaagacaaccaaagctaatacaacaataataccaacgacaaatacatccaaactgcaatcaaagaacactccaacgcgacatggaaaggatgcaaacaccaatgaaaacaattcagacttgactaaagataatgatattgatgtgatgggggatgaagatgaggatgaggaggatgaagttgatgcattgaagccatcgaaaaaggatctattagatgatgatcaatcaataaatgaaattgaaactatagctaatacgaatgacgagtcaaataataacacaccaaagtctagtaatgatacaaccaaaactgacactaataatactaaaattaatactagtgatataataacccaagtgccagagaacggaggggcatatacaactactaactcaagcaataattatcaaaaagaaagtcgtaacctggtgcataagaacgagaccagaaatggtgaagatgaggatgaagaagtagatgaagacgaagacgacgatgaagatgatgagtcacttgaggatttaactagattacaggatggacaagcatttaatccagaaacaggatacttattaggtaagaaggataagaattttggtaataaaaaatgtcttatcttagatcttgatgaaactttggtccattcaagcttcaaatatttacgtaatgccgactttgttataccggttgagatagataatcaaatccatcatgtttatgttgtgaagaggcctggtgttgacgagtttttacaaaaaatgggcaaattatacgaagttgttgttttcacggcatcagtgctgaaatatggagacccactattagataaactagatatatataactcggtacatcatcgattgtttcgagattcttgttacaattatcaaggcaattttataaaaaacttgtcacaaattggtcgtccattagaagataccataataattgataactcaccagcatcatatattttccacccagaccattctatacctatcagtagttggttcagtgatctgcatgataatgaattgttagatttgattccatttttggaagatttagcaaagccaattgttgatgatgttggattggttttagatatatccttatag

SEQ ID NO: 1639 - DNA, 1305 bp, Candida albicans
aaaattatagtgaattcattgaaaggatctttttatcaattggcaacttctgcttatgggaagtatttgttgattaagcttttgcattatggttctaaagaatctagagctattatcgttgatgaattacatggtaaattgcgtaaattgatgagacacaaagaaggtgcttatgttgttgaagatttgtatgtgctttactcgacttctgaacaaaggcagcaaatgattagagaattctggggatcacagtatgctgttttcagagactctggtaaggggaaaaccgttttagatatcaccagagagctggctgaaaagaaacaattgattatgagtaatttatatggtaccattaaagcctcagttgaaaagggctctaccggatttcaaattttgcatgctgccatgaaagaatatgtcactgtattgaaagatgatattgacgctaacgattctgctattcgtgattttattgatttacttggtgaacaatttgcagagttagttcatacccaagaaggttctgatgttgcttgtaatttaattgctcttgctaacgctaaagaacgtaaggtaattatcagaggtttgaaaacccacactaatgaattgatcaaaaatgaatatggtaatatcgttttaattacattgtttatgactgttgatgataccgttttaatttctaaatcttttggtgcagaaatattcacttctgagttagttcctcagttaattcaagataaattttcaagaagaccaatattatacttattgaaaggtttagatggcaaatattttgctcctaatgtgaagaatgcgttattaggatatgaagaattggcttacaagaaaacttccaaaaaggataaagagcagagaaaatcagaactcttggaaagatcaatactgccaatttacaaggcattgttggatgaagaatctatagtcaaattattgcaagtaaacattgctgctcaagtaattactgaattaatcctcacatcaaccaacgtcgaggatgttaataaaaacttgagacctcagttggctgatataatttttcaaaaaacaatctgtggagatgtgcttgaagattaccatttactcaacaaagccccatttgcttcaagattggtgaaatctttaattcaaggtaacgaattcaaattcgacaatgaatctaagaaattagtgaaaactggtcaatcagcatctcctggcattggcagcgagtttgcagaaagggtagctgatgaaatcaatgtcgaagattcttcaccacgccacggggctggaaggatc

SEQ ID NO: 1640 - DNA, 2838 bp, Candida albicans
acaatcaatttttggtcaaaacattttgtgacaaagaagaccccaaatatgctgtctgaaactatttggtctagtggacataattccccaattcagaataaccttctgttggcatctaccacaactaataatatttctcaatataaatcagtaattgatcaagttgatccagatgtaaatcggttattcgccaattcaaaatcatttgatcggttatcttcgtcaacaggaccaggaacaacaggacatacttctggattaacttcgggtacagatagaagattatcatttaatgatggtagtgacattattgaaagtgatttttttggatttaaacgtggtgccttatcagcaattaccgcacctgtagttgggaatggaaataatggtcgtcatcataatcaagtgacaaataaaaattttggaactgcttctattagtggaggtattgctaatagacatccacctcaagatagttttttacaaaaattttctagtgttgctgatgccacaagagaaattgaattgggtagattatcattagatgacagaaataatggtaataatcaagtttccagtgttaatgaaatcaaaatggttaatactagtgcattcacttcacctcatggatctttgaatgaaaatttgaatatgccagtaccaacaagaggaggatcaagacatcagtcaataagtgaaaaaattgataattataataataattcacccattcaaacagctgcagcattatcgataaattctgatttaaattctgacactgtgaatattaacagcaccacaactaatagtaatcacgatgccactaaaaatcaaggaaattattctcataatttttggaatccagcagctgctacttcatttactcctgtaggagcaataccaacacctaattattttattgatgctaatggattacctatacctccattaccaatgccacctcaaggattttatccacctcgtggtggtaatgcttctaattctggtggagctaattctattagtcctccacctccatttatgattccatcgcccccacctccatttttggacccaagtgtatatagtatgatgtatggtggtaatttccctcctcctccacctccaccaccatcacaacaacaacaacaacaacaaccatcacagcaacagcaaccatcacattctaaccaagacaaaaaggcaaatgaaactaattccaaatcaaaagaaaccaaatattctgatacagaatctcatgaagaagataatgagaaacaagataattatcatggccctggccccgtaccaggtccaggtccgggcccaggtccaattggtgtcggtcttatgaatcgtcaattttcacctgcttcatttatgtttcatccatttaatccttattctatgtatcaactgtcaccaccattagtcccacctgaagcagctttaggaggaatggcctcacctcctcctcctccaccattaccacaacaacagcaaccacaacaacagtcagcaccatcttcccaaggtaaatctacatcaggcgtttctggttcttctacatctacctcaacatcacatcattcacaatcaaaacatcatcatcatcataacaacaacaacaataataataataataataatagtagtggcagcactcctggtgttggatcaaagaggaaaggtaatttcaaaggtaaaaacaatactactaatggtggtggaaatcatatttatcgttcccctttattggaagaagtacgttctaatcctaaaccatatcaattgaaagatatttatggacatgcaattgaatttactaaagatcaacatggatcaagatttattcaacaaaaattacccgaagctactgaagaagaaaaagaaactattttcaatgaaatttgggagatctcatatgaattaatgaccgatgtttttgggaattatgttattcaaaaatattttgaatatggtactactactcaaaaacaagttttacttgaaagtatgattgggcatatacatgaattatcattacaaatgtatggatgtagagtagtacaacgagcattagaagccattgacaatgaaggacaattgagaatcattgaagaattgaaagatcatattttaatttgttgtaaagatcaaaatgggaatcatgtgatacaaaaatcaattgaaaaaattaaaccattttcacaaattagatatattttaaccagtctagataatcagatttatcatttatctactcatccttatggatgtagagtgattcaaagattattagaatattctgatattgatgatcaaaaattgattttatctcaattaaataattttctttattatttaattttagatcaatatggtaattatgttattcaacatattttagaaaatggtactcaagaagaaaaagaaccaattttagaaattgttttaggttcagttgtacaattttcaaaacataaatttgcttcaaatgttattgaaaaatgtattaaatttggtgatataaatcaacggaaaagaattttacatgaagttatgcttggtaatgaaaccattttgggtgatgatgatattgatggtgaaccagttaaagaagattcaccattggcattaatggtgaaagatcaatttggtaattatgttattcaaaaattggtggaagcatttgatggtgatgaaagaaaattattaattattaaaatcaaaaaatgtttaagtttatcaagtaataatttggccagtattcgtaatattagaaatattattgatcatgttagtgaatcaaatctggatttaaaagttgaatcgtaa

SEQ ID NO: 1641 - DNA, 1122 bp, Candida albicans
agacaagaggttaatacctccaagagattagaatccttgagaaagcaaatgaaagaacacgatttaggtatttacattgtcccatctgaagaccaacaccaatctgagtatgtttctgcgtacgaccaaaaaagaagttttattagtggattttctggtagtgctggtattgcgattattactagggatatgaacagtgttggtgacacgtttgaaggtactgctgcgttatctactgatggaagatactttactcaggctgttgacgaattggattttaactggattttattaaaacaaggagctaaggatgagccaaactggaaggaatggactataaagcaagcagttcagttaagtttagacagtgggtccactgtaagaattggtgttgatccaactttgatcacctacaaattgtacaaagaattccagtcaattcttgacaaggagttggccaaaaatgaaaaagtgaaaattgaatttactgccgtgaaagagaacttgattaacaaaatctgggaacaatttgaagagttgccatctaggaattttagagaaatcaagagcttggatataaattttacgggtagaaatgtgcaagataaattggccgatgttaaaaagcatttgactggtgatattaagggaatagtgatttctgcattagatgaagtagcttggctattaaacttgcgtggtctggatatccaatataaccctgtgttttacagttttgtgatactcacagaagagtctacaacgctttatattggggaaaataggttactggaagatattgttgaaagcttaaagacagcaggtattactatagaaccatatgaatccttctactcaagtttgaccacggtttcaacaaagttatctgaatccaacaagaagttttatataccagacaatgccaactgggaagtagtccgtaatttgaaatgtgaatttagtcaaggattatcaccggttgacgagttaaaagcaataaagaacaatgtcgagtcggaacgtgctaaaattgcgcacttgaaagatggtcgagctttgatcaagttttttgcttggttggaacagcaagtgatagagaaacaagaattgattgacgaaatt

SEQ ID NO: 1642 - DNA, 318 bp, Candida albicans
  unsure (50),(214): Identity of nucleotide sequences at the above locations are unknown.
actatcagttggtccttaaaaaagaaaaaaattttccgaattacgatgcngcatgtaaaatatattcaattagacagaaatttacccaatttcacagggttatcttatgagactatttcttcaacaggtgctaatgccacaatcctccattatggcccaacaaaaaacgaacatctgataattgatccaactaaaccttatttaattgattcangggctcattatcttgaaggttccactgatatcactcgaacctacaagttgggatatcagggatggactgatcgtgataaattgtataatcctttagttccttaa

SEQ ID NO: 1643 - DNA, 765 bp, Candida albicans
aaacgaattcaagcagcgagaagacattttgttggtttgtcttttgatactattagtgccactggagcaaatggagcagtgattcactacaaaccaacaaagggacaatgctccactattaatccacgtaaactttatttaaatgattctggatctcagtttttggaaggtactaccgatgtcaccagaacggtgcatttccagaaaccaagtgctgaagaaattacaaactatacattggtgttgaagggaaacattgcattgtcaactttgagattccctcagaacactacgggtaacttgattgatgctattgctagacagtatctttggaagtatggacttaattatgcacatggtacttcacatggtgttggtgcttatttgaatgtgcatgaaggtcctattgggattggcccaagacctaacgctgcagcttatgctttgaaagctggtaacttgatttccaatgaacctgggtactatcaagaaggggattacggtattcgtattgagaatgtgatgtttattaaggagagcgatttgagatacgacggtaaagcatatttagagtttgaaactgtcactaaggttccatactgtagacgtttgattgatattcatttgttaaatgatgaagaaatatcttggattaatgaataccacgctgacatctggaacagtttccatgaaaactttgataagaatagctatacttataaatggttgaaaagagaaactgaacctttagtaaaatcaaaatag

SEQ ID NO: 1644 - DNA, 1422 bp, Candida albicans
ttgatattgagaagaggaacagaaaaaaaaaaaaccttggtacaaacaaacaagttctttttaaagagacgccaatttaagaatcaaattgaatatcaattcttattactttttgcttgttttcccttcattatgagtgcatttgcagctcttaaaaataatccatttggtgaatcaatatttaataataccagcaatggcgataatcacagtcgggatgatgtggaagaagatgaggtggttcaatacatagccaattcctctgatgaagatgatgatgacgacgacgacgacaacgacaacgatcaaggtaatgaggataataatttgttcccattggaaatatctgcacctgaagatacctcaatatattcaacaccagcgccaatactcaattcccgtattactcaatccaattacacgccgaatgaatcaaatctaaaattttctgataatcatgttacaataacattaaatccatcagaatatataataatatcaggtcaatgcaatttgaaaataattaaaggatcaatcaagataaatcagtgtcattgtttaactagtgaagacaacaaatcttataatataattgcattacaatcacaatcattaccgattataagtcactatacaaccccagaaatggaggaggatggtgtaacttcagtttcaataatacaattggagaattcatttagtggtattgaaaatatttctcaaattgaaccagcgtttaaaaacttgatttctggacaacctaatgttgaagaacctagtttatttaaaaattattcatttgatatagtactaacagaaacaaatgggggatatggattagatataaattcttattggataaatgaattgaacctattgaaatcaaataaagatgatccaaccccgaaaataatcatgattattggtaataaaaacactggtaaatcaacgttttgtaaatcattaataaatgaattactattaactaatcctaatcgtccagtatcatatttagaaatagatcctggtcaatcagaatattcaactccttatgccttatcattatcagaaattgttcaagctcaatttggtttagcggcattaccccataagaataacaatattgttaaatctcgtgttgaacattattttggattcactagtgctgttaatgccccaacacgatacgtggaaataattgaggaattatttaatcattatcaaactaaatttagtcaaagaaatcatttaattataaatactcctggttgggttaaaggttatggtaaagaattattgaatcaaatcactaaaattatcaacccggataaattaatattattatctaataatttaaatcaagaatacccggataacgccaatattttacaagatttaacttatcaatcattatctataatt

SEQ ID NO: 1645 - DNA, 987 bp, Candida albicans
attttagtgaaacataatttacaatcaactatgccgtttgtccaatcgttgaggaatttgacatcgtccactgagtctaaaataaagtccgccaccaataatgaacctttaggtccctataaccatgaattgactgaattagcaagccttacatttagtaaaaaacatttgtctatcataatctctattatcaccaaaaggttgaaaccagttttagatatatgtcctacaactatgaatagcacagggatgaagcggtcaaatacatccaaattatcatccaccattcacagaacccacagttttccaagaagatccaaaacattgcccagtccagatacacctagcgatgttaatacacttaaatacaaacaagtattagatgacaaagtttaccttagtcttttaaaagcattgacagtcatactataccttttacaaaatggttctgtgcaatttattgattggttattgaaggattacaaactgattatttcccccttactgcgcatttcgtatccttccacatacaaggaaccgatacggcataaagttaacaaaatcatatctttattggaagcaccagaagatttgaacaactacagaatcaatattcataaattaagaacagatatgttggttccaggattgaaaagaactagtttggatggcgtggatttattgcaagtcgagcaagaacattccacccgagaacaacaacaacagcaagcacctcgacgtcctgcaacaccaccacttttgcgactcagatcgataagcgaacatcacagccatactgaagatgaatatattaacagtaatgacgtctacaacagttccaacactgctgctgatttttcttttactaataatatggatggtatactaaaacaaccaagccggtatcagccgatcacgacaggttcaagccctccaaatacttcaccaaccatcactaacccacaccaattgcctcctattttttag

SEQ ID NO: 1646 - DNA, 768 bp, Candida albicans
tataaatttttcaatattcaaaaactacacttattcattaatcaatcatcaaccattaaactatttgtcatggctaaacgaaaaagtaaacaacaagatttagaaaaaaagaagaaacttaaacaaagtcaagatgaacaattatctacgggattgttcaataatgttggacagggacaacaccaaggggatgatgacgatgaagaaggtgatgaaatagattgggataatcaagagatggattatgaattaataccaaggaaaatcaccaccaagaaaacaattgaagcattaccaattaaaaaatccgacgggactatagaaagagttgttagagaagttgaagaagaagaagaggaagaggaagaggaagagcctgaagaagagcctgaattagaaaatgatgttgaaaatgaaccatcaaaacaagaaaacaaagaaaataaagaggagggggatattgataccgacgacacattaacaccacaagaaaagttaattcaaacaaaagaagaaattgcagaattaggatcaaaattaattgaagatcctgaagaaaatatagtttgtcttactagattaagaaaaatgtctgaatcgaaaaatttcatgacatctcaattatcaatattagcattaataccaatttttaaatctcttgctccatcttataagataagaccattaactgatactgaaaaaagagaaaaagttagtcgtgaaatagctaaattaagaaattttgaacaaaatttagtgataaattat

SEQ ID NO: 1647 - DNA, 237 bp, Candida albicans
atagatatggtgaaaatattaaaggattatggaacaccgaaggaaagaattagtggtgaaggaaattatattttaggaattgaacgacaaaataaagataaagatgttgaattagaacgaagtaatagtggtgcagcaacattatgggaaaatgtattattagataaacattattcaataatgattaaagatggttcaaggtcgttaatgaaaaatagtaaagccaacaccaattga

SEQ ID NO: 1648 - DNA, 657 bp, Candida albicans
aataggggccctcaagatcaacaagattatccaatatttataaaatctttaagagttttagaaactttattaaaagatgatgctgaacatggagatattacttttgatataataaaaatcatgacaaaatcaattaaagataaaaaattccgagttgatgaatcagttgttaatgtttttttatcaatttcattattagaagattatgatcctaataataataataataataaagatgatcatcacaacaccactttaaaaccaaaattaaaaaaaaaggatcgaattcatttatctaaaaaagaacggaaagctcgtaaagaaagaaaagaaattgaagaagaaatacaaaaggctgaacaagccatcactgttgaacaacgagaaaaatatcaagctcaagtattaaaaatggtattaactttatatctagaaatattaaaagcagggtcgtctagttcacaattaattgatggtgatggtaaaaaaactaaaaatgatgctagtttgttaatgggggcggttttagaaggattatcaagatttggtcaaatgtcaaatttagatttattaggtgattttttggaagtattaagagaaattatgaccgatatcattgaagaacataaacaaagtggtgataatgataatgataat

SEQ ID NO: 1649 - DNA, 516 bp, Candida albicans
  unsure (510): Identity of nucleotide sequences at the above locations are unknown.
aacttggataatttgtccaaatatatcaattctcgatttaaaaatatgttacctaaaggtgttaaaaaagacaagaagaaaaacaacaagaataataaaaaggggaaaaagggagacgatgatagtaacaaagatgctgaatcggaaaataaggaagaaaggaaatttattgccattgtatcaatgtcagctattagagcttgtgatatccatagagcaactaaagatttagtgggatcatcattaaaactaatcaacaaaaacaaactacacattgatttgaaacttgtcgaaagcacaagatctagagtattatgctgtactccaggtagattaagcaaagtattgaacagtgaagagtctggcttgtcaaaagatgaaattaaaattgttattattgacaattcatacctagatacaaagaaacagaatatttgggatataaaggaaacatttgaagctttaacggatgtcttcaccacggggctggcaggatccgcccataaggtntggcca

SEQ ID NO: 1650 - DNA, 1722 bp, Candida albicans
aaaaaaaaaagagcttgcaatgaaccaacgactaacaaccattttaaagtgtccaagtttgagagcatattaccagatttgtttacagtatatgaacatacaaataaagatgttttaaccaatgagatacttccagtggacttttaccaggaaaaccctatgaaaatagtgtcatcattgcaatcacacacaacaacggatgtcaccagtattaaaaataagtataaaaacggacagtattctacaccataccaattattccatgatattaaggctgttgcatccattttgttgaacaaagaagaaaatggatctttacaatataaagagttagattttttctacaaattttctacagaattgttattacgtgaagttggtaatttgatcaaattcaacaatgaaaccggcgagattaaaactgaattggaaacacaattagatgaagattttaccaagataatcaccaactataatatttccaatggggaagtcattacctatatttcaaccaccgaagaaccagaacctcaatcttccagcgtgctctatcaacatcatcaacataaggaagaaccaacgaaaaagacccaaccattgttctcttctgtaatttctaaatcagagttggataatagagcatcgattgttccttcaccttacggacttgcccaagttgttcctagtattaaagattcactgtccgaaaatacattggagaccttatcgcctattgccaatagaattccctcaccattggaccaaccaaccaatattttacacgactttttccaccccacttggtatactatttcggtgccagcttggttaacttacacctcacagactataaaaccagcaaaccttaataccaatcaagaactggaggatggagtcggtgcctcaaccaagacaaagctttcaattttgaagaatagagataacgattattcaacgaaaccaaccaatatttggggcccaggaaactactatcgatcatttgcaccatcacgtaacctgtctgggtccattgtgggaaacaaattgaaagctaatgtttggttgcaacatattggtatgacagagattgctgaactcaaagaaagttttgttgaaaataaaaatgaaacgaatcctttggataatgatacagtagtgggtaaagaggatgcaggtgaaggtaaatctagtaaagaaaacggggctgaacctaccaatggacatcaagccagtgaaaaaactcaacaaccgtcatctcgtcaagccataaatatcgccaatattatcaagtgggatccaacaaaagtcgaagagttgaactatttgaaagagcataaacaagatttggtcaatcctcaaaaacttcaaaaaatgatctccatatcattattgaaattgaataagctacgtcaacaaagatattcacgaagtgatgtacgaaacccattggctcctcaacatgaagaaaatattttgtacaatagagtggtcaaactaatttctatagctattcagttgttcaacgtaaacccaggatgtttttcataccaatttagtaaaagtatcccggtgttagtatccgaattcagtggtacattaccaggaattcctccaaccaaggcaattgtcaataacggtaccactgctaccactaaactgaaccggttgcctaatctcaagggtccatcagcatatagaaaaagaccaacaagatttgcttga

SEQ ID NO: 1651 - DNA, 669 bp, Candida albicans
aaaaaaaaaatacaaaaaaaaaatattcttttcctcatcaccaaaatgacagaaataccaacaattatagaaacctctgaaactgaatcgttctcagaaagagcgcatgtacctgacgacactgcctcgctcgatgatttgtttgcagatttgaaaaaggaatcacgatctctcccaaccgttaaagacttcaagtcaattgaaaagtccatacaaagcttgcctagaataaatgccaacttagaaacagccctacaaaaaaaacctatcaggatccatgacccagtaataccaccgaaaaagaagactacagaaacgtctgatgaaagatggttcaatatgaaacagccagaaatgactcctgaaattaagagagatttacaaatcataaagcaaagaagtgctttagacccaaaaagacactataaaaaggataaatgggaaatcccgaaattcttccagatgggaacaatcatcgaaggtaataccgaattctactcctcgagattaaagagaaaagagcgtggtaaaactatggtcgaagagttgctacatgacgataccaccaagaaatacttcaagagaaagtatcatgaaatacagcaaacaaaaaccagtggccgtaaaggtttttataaaaaggttaaaaatgctaggaaaaaatattaa

SEQ ID NO: 1652 - DNA, 423 bp, Candida albicans
ggctccttccagccgccgtgggtgaagacaggtcaatattattgtatacaatgtgccaaatattttgaaaatcaaataagtttggatcgtcatactaaatcaaaaatacataaacgaagagttaaatcattgaatgaaagaccatatactccattagaagcagaagctgctgctggagtaaatatggagaaatttattgctagtgtggaaaaatataaacaattggaaaatgataaacaagaaaataaacatgaatatgataaattaataaatcaaaagaaagataatttagatgctataataactggtataccttctgaagaatttcaacaacaacagcaacaacaacagcaagaagaactacaagatgctaatcaaaggacagttagtaatgatcaagaagaggttatgatgattgattag

SEQ ID NO: 1653 - DNA, 1374 bp, Candida albicans
ttggaaattagttacgataatatgagttctgtaaataacgcaaatatatccatcatgctgaatccgacaacatcagacagtctttcctcattagatcaacaagcaatttcattgtttgaacaagcaatcaaaaaagaatctcaaggacttatgtctgatgctgttgatttatacagaaaatcatttaaaataaatgaacaagtagataaactttatcgatcaattcatttaccgaatgctttacataaattacaaaatgaaagaggtaaaaattatatcactaaagtagatgaacataaagttgcaaaaatcaatgttgataaattacttgatagttttagacatgttgaagcagttgcccctgatcttttaaatggagaattgagtgggtttgaaggtgaaatgactataaaatttgccaatatgaatataaaccatcatcatcatcatcatgacatggtggcagcggcggtagtatcaccactagttcatctacctaacgatatttggacatacattttagaaatacttattcattgttccccagaatcatggtttaaaatgtctacaacatgcaagaaatttgcatatttagggttcggacaatctacaatatggcgtgaaatatgtcaacttatttatccttatcagaaatatgaagagaatcaattttatttacaaaacccaactttgaccagctcaatagatgactcggatctaccaataccacttaatcaattacaaatattaccacaatataatgattcttggaaatttatgcttcataatagacctttcatcaaatttttaggatgttatatatcggtagttaattattatagtgaagggggtaaagctgaattttccaatgcatggtcaaacccagtaaaaacaattacatattatagatatttaagattttatcgtgatgggacagttgttaaagttttatcagtactaccaccagatcaagttgtccctattctactgacacataataaggtattaccgagttcaatatctgaattgggcaagccaatatttttacatgatgaaaataaggaaagtcacaagatatatttgggtaaatggacaatttcttcaactggggaaattcatatcattattgaaaatggatcagtgtcatatttaacatttcattattggtttcaaataaaatctttgggtcatatcaataaacatgcaaaacttacatgggttagatacaattcagttagaaaaccaacacaaactataactgctgatggtgaagagacaattgatgatagagtaggtgaaataatggaattttctattagaaatgaaaaagcctttaaatttctgagagttaaaagttatacccacaccaattga

SEQ ID NO: 1654 - DNA, 1161 bp, Candida albicans
agacccatacaagaggatccaaagtatattttaccaaaacaagtgaatacatatccagccactctaccggaaagaaagcaaaatatagaatacattcttaatatcctaaccaagaaacaaccaaatatcaccaatccaaaactaaaggcaatagatattgaatatgaaatagctaaaaaatcaactaacgcgacttacaaaacagtatttagacaagaagtattcaaattaactaaacctacaaaactgccatcgcaacttctgccacaacaagaacgtcttaaaaaacttgatcaagaagcaaaagaattgaaaattttgaaagaaatggttgtttctcggaaaacattaatagcttttggatatataatggaaccacctgaatctataccaaatgaaaaaatcacgagaatatgcaatcgatgtggaactgaatttcgattagatcaacaattacaaccaatagtttgtgaattccatcatgggaagaaacaaagagggaaatacatatgttgtatgtctaatgttgatggacaaccttgtagtaaagccaaaaaccatgtttacttattaaataccccagaagaaaagcaagcattattgccatatcagtttaccaaagaattatttaccaccaccagcaccagcaccaagagtaaatcacgagtacttggaattgattgtgaaatgggattcaccacaaaggggtttgaattgatgagaataacggcaattgattatttcactagcaaaacagttttagatatatttattaaacctattggtgaaatagtagattttaatactagatattctggtatacatgaattaaccgatgattttttatcatgggaacaactgatggaaaaattaggtgaaataatggattcagaaacaatattaattggtcatggattagaaaatgatatgaatgccatgagattaattcatgaaaatataattgatacttcgattcttttccctaataaatggaaaacaggaccaactagaagatggagtttaaaagatttggcatttgagtttcttagtcgtcgaattcaaactggtgaacatgatagttgtgaagattctattgctgcaatagatattgtaaaatattttgtcaaaaaacggttacaatctataggttcatctagttga

SEQ ID NO: 1655 - DNA, 2460 bp, Candida albicans
ttgactccaatcattacaaggaatcactatcactttttgttaattattgtcatattaaaaatgagttcagataattcattaatggaatcagaatccctgtttatatcaacaccacagaaactgcagaaacgtcaaagttttggatcatcaggatgtgatttacgaccacttcgattaactaaacaacgtaacagaaattccatcatatcaaattcgtcaaatagtcctagtggtactcctaccactccttcatttgattcaccaagcagaaagggaagtttgcccactaatgaagagtttcattgtcgaccaattagattagggagaaatgccagcacacactctgaagatagacacaactcgatatcttcaattaaaaaattgacgctggataataatatcaacagtaagctgtctgaaatcaagaaatcaattgacgaagaactactgacaacagattcccactcttcacatctgtcgaaacgacaacagatagattcacaacgaaggaaatcggattcttcaaattcttcaaaacgtaaatctattcaaattaagaacctccccatcacctccactacaacaaggaattcttccaaacgtgctagtcaatctcaatatgatgatatgatatttgccatttgtttagtagatttccatcatcaaagaggtccagaaattcaatggtggaaatcgaattatcatcctgattataaacaaggtttatttaaaaatattccatttcaagcccttcctgatggatcacatttatttgaagaaacattttcaaatttcaatttagtttatgattttgatcaaaaacaatcaattgatgatttcaatgatgtcaacaactttaaaggagatcctcgacatttgaaaacattatttggatgttcatgtgtaagacaagttaaaactagtgatttgacagaagaagaaagagaacggaataaagatatcactcgatctattgttcaaaaagctattgttgttattacacgaaagcaacctattttcaccaaaatcaaagataaattatcgataatagctaaaagttattttcaacaagaaacttttgataattttgaaattttggataatttatttgaaaatttaaatggtcaatttaaacttgttgataatgaaatgcatactgaattggagcaagaagaagaaaattatgtcaatttaaatttgaaatcgacagtagcgaaatttagatcgagatttttaattattttcaaaagtttattattagaaaagaaggtacttatatattcaaataacaatcttgaagcactcacacaatttcaaaacaatatgttatcattaatgccaaatttgattaataatcttgatgattctggatgtcctcttatagaatatgctgagactaatggacctttatcaaaaccacaatcactaaatacaactaatagagtatcaatgttgcgattttttggattgccattacaaatattcaacactaagaattcattttggaatccgtatttaccgttacaacaattggatgaattggcagtgaacagctttatgattggatgttctaatcttttatttgtcaatcaagctacttcatacggaattgatgtactaattaatttagatactaatgaagtcacatatccgaaaaacttgtatgcaacagaagatttacaattgagtgcactagataaaaaatttattcatcatttagtcaattgtgatcaaaccactactaaacacgatgattttattggtagtgatgattatatacgatacaaatttgaagattatttgaattcattaatatctaccatgagatataatcaatattcagaaagattcggacaaccaccaccaggatttaatgaagctagtcatataactgaatttaatatgaaatttattgaatcatggaaaaaaacccaaaatttcaaaatatggaatatgatggccgatgaatttattttcaattttattgaaccaaaacatactgcccttgatttaaaagatgaaccttattctattaataagaatatttccaattttttcaatagttttaaggcaaaaactacagccatcaccaatacatcatccatgaatgatcaaactataaaagctcacaagtttattgaagatgatgatcaagacgaagacaaagacgaagacaaagacaaagacaaagaagaagaagatgatgatgatgaatacaatgatgagaatgaagatactgttgatgaacttgtagctgggtttgaaaaagttgtacctttaaccgaagataaatctatggggacaccatcatcgccaataataccatcaacacctaaaacacctaaatccattaccccaacaacatctaaatcaactactcctacaactactgctagtactgaaactatagggaaacgattatctacttggacaattggttggggatttggaaagaaatag

SEQ ID NO: 1656 - DNA, 1320 bp, Candida albicans
gaaactacaaggtttatttatgtatatctgattgagttcttacagaatcttgtatgtaaaacaatgatattagtcctatcacctgcaatgagaaagaaaagctgtctaggcccaacacacaaaaaaaaaaacctagaccgatgcgacaattacattactgggttgcacatcataaacatacttcttcttctatactcatctcattatattgacagtttggaactcatttacccgatgaacgagacatcaaatcgagaccaccaggtcacaagcaaagagattcttgatgtggcgtttgaaaagagtaaatcaaaattcaccacaccacgacagacaatccaggataccgaggaattacaatcatatcaacaaaccaaaagaaaagagtttgaacaacatatcaacaaaaacagactaaaccttggccaatggacacgttacgccaagtgggagattgaaaacaaccatgactttccacgtgcaagatcgatattggaaagagctttagatgtgaatatccaacatgtacccttttggatacagtatattcagcttgaactatcccacaaaaatataaaccacgccaggaatctaatggaaagggctatcaatactttacctagggttaacaaattatggtttctatacgtgcaaactgaagaaatgcttaaaaactatccaatggtgcgagcagtatttgaaagatggcttgattggcaccctgacacttctgcgtgggatgcatatattaactttgaagcacgatatgaagaaaaagaaaacgtccgaaccatatttaagaaatacgttcacgaatttccaaatgcggggacatggtataaatggatcaagtatgaaatggaaaataatcgcgatgatgtgaacaccgttcgagctgtatttgaatcagctgttgataccttactttcgaataaactggaagaaaacgacgacgacgaagaatttgctaccataatttctagttggactagctgggaggtatcgtgtggagaggccagtagagcaaatgagatcttcaaattactactagacaacaaaactaataaattggagatttcagataaaaccaaaagttcaatttacactgcatttgtggagtttgaaaagaactttggaaacaaggactcaattgaacaaagtgttttgataaagagaagaataaaatatgaacaagaaatccaaaatgacccttacgattatgattcttggtggaaatacatgacattattacaaaatagtctgaataaaagtgatttagaaaatgcattcaaaaaagtcacaggaaacgttgttcacgat

SEQ ID NO: 1657 - DNA, 1698 bp, Candida albicans
tttcgagctcacctctctttcctatttccactcatactccaatttaatgcacaaatggatacacaggcagaaatcaatgctgatttaatatcatcaattataccgttccccaacttgactgatctatccaacaccacatctgatttcgacaatgatatacagattttattagattggttgtctccttatataccagcaacttctttaaccaagtatcaggattgtggttcccccttgttattgctaagagttcaggaaccgtcacaaagagtgaaatcagctattcgtgggtgtttgaaggatgaaatcaatcagatccaattcattgaattatacattaacacaatcaatgaaaaagtctcacaattttttgaatcgatcgtcacaaagaacttgaaatttattgaatacgttaatataattaagattttgctacattattacaattctcaatttgaatatctcaatttatctgataatgtttataaaaaatttcaagcaaaactcagttttataatcacgtgtaatttgcttaatgaacaatcgtcattcagggccaagatgaaccaattttttgaagaatcattatatgttagagcaactttgagtaacccactgtcatcgatcacattgaacttgattgatataatttccactctagcatcaattggcatgtctgatttgttgaatgaaattgtcatcaaattatccattgataaaatcaaacattttacaaatacatatagtagaaatgtatggaataaacctttactatcaaccatcaacaatttcattcaaaatgaaatttatccaaatttttatattgtgattagctataccacatcgtccaatttgacagattcaatgaataatgtttatctttatgaattggtgagaattgcacatgatgaactaataaatttaagaatccaagaaatatattctatggttttgcaatatcctgaatctcaagttgggctaaacgaattacatcactgtttactgaaagttaaatttaatctgaaacaatatgaattaacgttgctttcgtgtgctattgatcattcagttaatattcaagcagcacagagaactgaattggtaaatagttttatcgattactgtcataagaatattttgcatgccggcgccaataccattgacgtcataaccacctatatcaagactataaaatcatttttaattgttgatccaaaaggtgtattgctcgataaggtcgtgaggcccatacgacaatatttgaaaacgagagaggatattattataaaattagtgcatggattacttgatatttctcctaataatgaattgattgaattggctcgcgaattacgtcatccaagtaacaagtaccgttcaaaacatgatcattcaaaagatgtgttggaagatttgcttgatttgaattggcagcctgatcctattgatgcattacctgatttcaagaaaggtaaagtaagtgatataattgagtccttgatctcgatatttgactccaaggatattttcattgatgaattcacaaggttgtttggtgatagcttaatcaaattgaaggattataacgtggaagaaattgaactgaatttgaatttgctaaaatcccgatttggtaagcaaaattttgccactttggatgttatgattcgggaacataaaggaaaagggaatatttaa

SEQ ID NO: 1658 - DNA, 783 bp, Candida albicans
atgatttgtttgtccaggaacacgaggaataccaatttcaatacttctgtattatctcatttatattggtcgagtattttggagaacataaataccgatgctaacaattttaaagttcccaaagaaatcgaggacaagtttcaactgtttaaagataaatttgctcaagagaaatatggtagaactttggaactattaccaagtttagggttggttacattacaactagaatttaagaaaagtggtcctcgagtttttaaagtcactccagataaagcatcgataatctctttgttcaatgaaaaagaagatgaattatcagtgagttacatagctcaaacattgaacatgtcagaatatatggtttccaacgggttggcatattgggtgaaagagggtgtacttacggaattaacgaaaaccttgtatattgtcaacgatgatgatgatgaagaagaagaagagggaaatgtgtttccagaaaaggcagaaagctcaaaacatggaatcgatagtgctactagtaatctaacgtcagttaaatctggaatggaagataaattttcagagattgctattattgaatcttatattgttacaatattacaaaatataaccctgataaattttgaaagaatgaaaacattgcttaatttaatggttccaaaagataagctcgactttgccaatgttagtgaaagtctacttgaagaatatcttgattcgttagtagaaaattccaaaattgcttttcaaaacggaaattatagtttacccaagtaa

SEQ ID NO: 1659 - DNA, 930 bp, Candida albicans
caaacgacgtgtcaaatgagtaaattactaacatcattcaagtcaagtaaaactcaattaagacaacagttttgtgaattaactggtacttctaataccactgccacaaaatatctagagagtgtcagatatgatttagcaagagctatagacaactattataacaagcatcctaacaaagcccaagtaacgaaaaaaccggtcaaagttaaaatagatgatcgtttaattcaaatttttgacaaatacaaagacagtgaagatccaaataaaatagatattgaagggacattaacgtatttgggagatttgggtatttcacctgaccaaattgaatccttatcattagcattattattaaaatcaccaaagacaggagttttcactcgagagaattttttacatatttggcaatattaccaatgttttgatataggagcaatgagtgaatttataacccgattcaataaggatttggtgaataatattggtggattcaaagatatctctactgtatctgatgatgagaacaaactggttcctttaaaatttcaagatttgtacaattttacattcaagttttcattggagacagagagtcagaaatttttggatttagatacagctattgaatattggaagttattattgccaataatcaccgagacttatagtaaggacaataaacttgatgaagaatttaaaaatcacgtgaatgaaagagttgaacaatggtttaagtttttgacagatactgaatatatgaccaagaaatctattagctatgacagttggtcaatgttttatttgtttttcaaggaaattgttttaattgatcctataaaattcaaagattatgacgaaatggcggcatggccaagtgtagttgatgagtttcttgaatatctacatgattttgaattgttatga

SEQ ID NO: 1660 - DNA, 2028 bp, Candida albicans
gaaaaaccaatttttcaatttctctgcaactatatacaggtaataacaaaagtttggtgtctatactgtgtgctcattcgatctcagatgtcagaagatgtaggggatttgagacgaccaaccaataatcagcacagaccaaaaatgaaattcattggactaatatccggtggtaaagattcatttttcaacatataccactgtatttcacaaggtcatgagttggtagcattaggaaacttgtatcctgagaaatctgacgagatagattcgtttatgtttcaaactgtgggacacgatgtgattgaatattatagtcaatgtcttgatgtgccactttatagacagccaatacttggtaaatcaacgaatcaaaacttggaatacctggttacagaaaatgatgaaattgaagatttatataaactactatctaaaatagtagatgcccatcctgaaatagagggagttagttgtggagcaattttatctcattatcaaagaacacgagttgaaaatgtttgcgacaggttgggtttgacttcattgacttatttatggcaaaggaaccaatacgacttaatgaaagaaatgtgtgaaagtggattagatgcaaggattataaaagttgcagcaattggacttacaaagaatcatttaggtaaaagtatatctgaactattcccagccttggttaaattaaatctaatgtacgaagttcatatttgtggtgaaggtggagaatttgaaacaattgtgttggattgtccgtttttcaaaaagaagaaacttgttatcacccaacaagagattgttgagcacagtagtgatgtgttttatttgaggataaaagttgaattggcagacaaaaatgtcacatcggattacaagccacttgaaagtttgcctttattagaagatgagtttcaagatattgcagattcttgtccaaaggctgatatcagtttgtcgggattactgattgatagtcaaagaattgttccaaaaattgatgttacacctacagagactacactctatatatccaacttgacatcaatgaaatcgactattgaagatcaaaaaaaagatatttttcaacaattagataaacttcttggtgatcacaatttgacttttaatgacatacagcatataacattattattatcggacatgtccaactttgcaaaggttaataaattttatgggacttttttcaaagatatatacttgccaccatccagaatttgtattgagacagaggttgagtcgattcagttatcctgtattgttctcaaacacattcaaccgaaaactggtattcatattcgctcaagatcttattggggtccacaaaacattggtccatactcgcaaagcattgtcaatacacagtcatcttataagactgcaacattatccgggcaaatacctttaattccagcaacaatggatatctcaaataagtcgattgcatttgattcagcattatccttacaacatttggttagagtaaagaatttggttaatgtcaaacagcttgctctggttgtatgttttattaccgacgaatcatatgtcccaattgtcaggtcgtgttggactgatttggaaaataaaggcaatttagtgattgttacggttcggggtttacctcgtggggctaaagtagaatggggaggtttaagttttgaagatattactggcatatatgataactttgctagtgattcagaagatgaatcggatgatgattcggtttctcagtttgacaatttcgatgaatcttgcatttgtcaagttggaaagaaaggtgaattttcagtggttacattattcacatcagattcagatgtggttaaaagtttgtttacatttaaaggttatcgacaactcatatgtcatccaaaggattatattgaaatcaagggtgattatttaccagtaaacaccgtgtatgactacaaaggtaagaatcataaatatgcagttatttggaaaatagaggtacatagaaaaaattaa

SEQ ID NO: 1661 - DNA, 2262 bp, Candida albicans
tcaactacgattgtcaattgtatccttttacaaaccacaaagaattttgagttcaaaatgggattaagagatttgaaaaatgtattcaagcgtaaggaatacgatagacctccagctcctccgccaccaggatcgcaaccaaacgaagagccaattagagattccaaccctgcgccgacttccactcaaccagtaaacgggaaggatattcttagcaaccctatagcaactggcgaaccaccttcccttttcaaaagagtcaaacatcagcaacaaccaattggatgctgttgtgacgaaaaagatgccccaatccatacaaataacttttataacaatttaaccaccggtgaccaaaccatgccaatttggccattgccttactcgatgtggtacctgatcgaccctgatcaagaccatgggattgcattcaatcatacagatgcatcacaaagagtgtttggtcgtgaaccagatgctcccgttgcgcaatactatttcaacccacccaagattaagtcatttgttctttctgcggaaaactttaatggtaacaaattgacattaagtgatcatagagccctttcggtaactgctactttacaaaagggggacagtaaaatcatttttccaatagtgcaaggtatgggttttatcactgctatttacgagaatgctaaaccagttattgcgtcacaagttggtgttcaagagtttaaaaaacagaacaagattggcaattttcaaaaatatacagccatgttgtttaaccaagtgacgtggtcaatttattctactaatgaattgagtctaaaggatccaaatcatattgttgggaatggaccaggtattatacaaattgctcgtggtaattcaaagtattatgatgacactgcaggcggttatattgaccatgcagaattgtctgcctcagcagatggcgataggggtgaatacaaattttcttattctatcaaaggacaatcaagatcaggtaaaactcttgtatgggcacttccacatcatcaagaagtgatcactaatgtcaaaccaacagatttaaatcttgattcgccaacaaaaggtgtaatgaagtcatatgtcacgaatgagcttgttatgcaagaacaacttcctgtcgatattatgtgggatccatgggccacctttgccactaaagctaagtattccgacaacgctaaagaaatcattaaagaggcagctatagaagaagtcaagcaagacgtagtagggatggccgatattgattcgatgtatacttccggaaaaatcctagacaaatttgctcacattgcatatgtttgtcatttcatattacaagatgaatcattgactaatgaagttgttcctaaacttaaacaagcaattgagatatttgctcaaaataaacaaaaattccccttggtttatgattgttcttggaaagggttgatttcttcagccgaaccaggtgctgattttggtaattccaattataatgatcatcatttccattatggataccatgttcatgccattgcaattttatcacatattgatcaagattggcttcatgctaacaacgatcttattttcaattatgccaacacactaatcagagacattgctagtcctcaagctgatcaatatttcccacaattccgatcatttgattttttccatggtcactcttgggcacatggtattttcccatctggtgatggtaaagataatgaaagtagcagtgaaatgtatcattttgctcgtgccattaaattatatggtaatgtgattggtgataagaacatgcaacatcgaggtgacttgatgttggcaattatgaagcggtcggtcaatatgtatatgctttacactagagacaacaagattcaaccgccaaactttattggcaacaaagtatcgggtattctatttgagaataaaatcgattatgccacttatttcgggagaggtactattggagatgaatggattcatggtattcatatgttgcccatcacaccggtgtcttcttactttagaagctcgaaatttgttaaagaagaatgggatgaaaaattgggtgcaattgtcgaccaaatcccagatggttggaaaggtattcttatgctcaataaggcattattcgaccccaaatcagcttgggattggtttgcaagaaaggattgggatcctgtattaattgataatggtatgtctcgtacatggtccttagcatatattgcaggaataatgaactga

SEQ ID NO: 1662 - DNA, 1728 bp, Candida albicans
tcaaatcaagtcatgactatagatataactactacaaaatcagttggtgctggtcgtggatccactgctttatcatcatcatattattcttcttcgggtgaagatacaatcaaacatggtagactggattctatcgatgaatcaacccttaatcaagaaggttgtgctttaacttcaactatttccaatagtagcaataatagcaacaacaacagtaacaatcatacatcttatttcaataaaagaaggaaaagtaaagcttctgctgaacatttcaacactgtttatcatcaatataacaaatgtttccaaaattattatcattgctatcaatatttaaaaccaaattgtcaatatgttactagtgttaaaccatcagttaatcattggcaattacgtgatttactcaagtttaatcaatcaaacaatcaagtgtattatactaaagacgatgccatttacagctgtgatcttgacagttttaatgttaacgaatatattaaatttaattattatcctcgttgttttgaccatgttgatgattatattgttacaggaggattattgacaacttcatcaaaaatgttttctttaaatttacaaaatttaacttatgatagtccaaatgctactactaatactagtggcagtaccaattactataataataacactattaatagcttgtcatcagcttctatcagaagagtttccaaggggttgttttcattttataatcctgaattaaaacaattgaatacggttaaagttggtgaaatgatcaataatgatgtgacactttataaatcgtctaataatcatttccaatcgtacatttgtaataatgatacttttctatattgtcttgatataaatcaatctgaattcaaatgtttaaataagattaattgtgaaccaaacactagtttgaataatgtggtaaaaaaccctcaatcggaaaagattttaactgctactggtgattcgagtctgatttttttaattgaccccactatggggaaagtggtcaagacgattgattccaaacaagattcaggattcacttgtgcttatcattcttcagggatggtgtttaataccgtacatcaaaatggagtttcattgatttatgatcttcgaatgatgaaagatgttgtacaaatccattcaacaagacctggtcatcaatcaggagcatttagagctgcaaaattttctaatgatttgaatgatttattgattatatctgaacatgttggtagagtccacatcattgatttaagaaaattgaataacgttgacgatcatcaagttattgttttaccggcagcattaaatgaatatatcgataatgatgaagctgatccggataaacaaagagagcaactggaattcaataagccattagtttatgattatttatatgccaaaaataacaaacttttcaacacatcacaacactcatcctcattaatgttgtcaacatcctcatcatctagttctacttcaacttcatcagcaatggttaatattagttactcaccaacatcacgttgtgaagatctgtatcaacaatcaagtcgtcatctccacggtgaattagaattactggggattgaatttactgatgattctaaaattttaattggttgtcaagattcaggtatgttagtatgggatgttaatagcatagccagaagaagtattggtagttgtgatttcgtctag

SEQ ID NO: 1663 - DNA, 390 bp, Candida albicans
aaagattacagagggaaaaacaaatcgagagaactattcacttattcggccgttacacattacaaattgattccgtcggcaaggcgaaccatcaaaggagtatttccggtattccaacagggcccaattttgccaattatcctagagttggaaactggaacaaagaaccaaattcgagatcacatcatacaaaaatttggagttcctttattgaatgatgacaatttttctgatttcaagctaaattcggagattccaaaagagttcaatagtaaattatataaaagtaaccagattgctcttcattctggcttggtaattatggaaaataatggaacatcacaacaatttctatttccagtgaacaatgtgtatgatcgagagctttag

SEQ ID NO: 1664 - DNA, 462 bp, Candida albicans
aaagattacagagggaaaaacaaatcgagagaactattcacttattcggccgttacacattacaaattgattccgtcggcaaggcgaaccatcaaaggagtatttccggtattccaacagggcccaattttgccaattatcctagagttggaaactggaagaaagaaccaaattcgagatcacatcatacaaaaatttggagttcctttattgaatgatgacaatttttctgatttcaagctaaattcggagattccaaaagacgtcaatagcaaattatataaaagtaaccagattgctcttcattctggcttggtaattatggagaataatggaatatcacaacaatttctatttccagtgaacaatgcgtatgatcgagagctttggggaagttttgttaatgaaaaaggtgagtttattgatgagatacgaaatggattgattaattttaaaatataa

SEQ ID NO: 1665 - DNA, 261 bp, Candida albicans
gttctaacgccggcatcattcttgataactattagtgtgtcgacatctaattattctttagctcaattcggagccattttacatgatttgaaatgtattggagtgattcatcgtcaagggaaagatgccgctgttcaaccattacaggaagcatattactacatgcctgaaaatgatgaagacagagaaagaactactttggtttctaatatcaaaggtcatggtggattaagatcctgtagaaaaactcataagcaataa

SEQ ID NO: 1666 - DNA, 870 bp, Candida albicans
ttgtttttaattgaatattcccttacctccctttttttttacattgaaaaccctttattaataacaatgtctgaattgaaaaacggtacaactgaacctaaaaaaaatgaaaccactcagctggattctaaaagtaaatcaacctcaaccaacaaatcatcagtcccaccagcatcattagttccagttcaacctacagcactcacatctcgtgacaagactactcaaagattaattgtcgttttatctcaagcatgtttagaaacatataagatgaattctgggggaccaggtggtgatagatttgccttgttaaattgtgatgatcatcaaggattattaagaaagatggggagagatatagctgaggcaagaccagatatcacacatcaatgcttattgacattattagactcaccaatcaataaagctggtagactacaagtttatattcaaactgccagaggtgttttaatagaggttaacccaagtgttagaattccaagaacttttaaaagattttctggattaatggtacaattattacataaattaagtattcgttcagaaaattccaaggaagtattgttgaaagttattaaaaaccccatcacagatcatttaccaactaaatgtcgtaaagttaccttatcatttgatgctgaacttaaacgtgttcaagattatgtgactactttagatgaaaatgaaagtatatgtgtttttgttggggcaatggctagaggtaaagataattttgctgatgaatttgttgatgaaaaaattggtctttctgattatccattatccgcttcagtagcatgttctaaattttgccatggttgtgaagaactttggggtatctactaa

SEQ ID NO: 1667 - DNA, 1020 bp, Candida albicans
ttctcgttgcaggaagcttacacgggggcattattatcagcaagaggatcacgattgtcagatataaggacgattttggcagaaaaaagatttgatcacgaagattgggttagtataaggtatggtagtggtatggcttggaaacgttgttttgctgtcgttgagccttcgaccttaaaaaagaaagtgtttacccctggtcggatattattttatgaaaatgaacagaaaaagaagaaacaattgatggcaatggtaaccaacgccacagctgttgctgctatatatccacaatcacatttattgattgaccattctacaatgttgaaaatggaaggttatattaatttcacgtctccaagtttatctactaaagtatctaaaaagagtgccagtgatttcaaacacacatcactttttttaatgccagaacagcattcttctgtacctggatttgacacattgattagatttttagtgccgttattagattctttcggattgtacggaagaccaaaaagacttaaagccaatagaaatgatacggactcattattatttggtttgccaactttacctcatgtacattatttggaattgaatgatgtcttggatttaactagaggtgattttttgagttgggatttgaagacttggatagataatattaaaggtattttgaaaacaaaaattgatagaggatacgaaggttgtggaagccaaagaggaatcaagggggctgttacctctttaagcagtccagtgacttcaactggttcaccaagatttgctagtggccaaggattttcttcgagactgacatcgtcttcctcgtctcaacctagacagaatcagcaaacaccccaacaaaggaaaccaccaccgccaggacctgaattgaaacctgctggtaaaagttttgataagaatgttaatgatttacatattggagtgtccaatgataatctactttcggctgataaaatgaaaaataatcacaaatcagtgcaattagcataa

SEQ ID NO: 1668 - DNA, 819 bp, Candida albicans
aaagtgcaaagtatggtgaagttgttcttcaatacggttcttcaacacagatattgggctgttctaagagctgaaactttgagtatctattcatcatcgaccaatttgtatttccctgtattggtaattgatatcaagaaatgcttgtataccgagattatcgacaaggaaaagttgaatcgagaagctatttcgccagtgaaccgtggcacatacagtcctaatggcggattatcaggtactgcaactccaagagcctctactttagaaaacacagcttcagaacttaatagcatgctctccggtgattcatacagtccaactgaagacaatgtcgaaacaacagcatcaaccgtctggttcaaattagttacaaaaaagaaaacttacaagttcagttgcgatagctcgttttcagccagacaatggtgtaacaatataacaaaattgatttttcaacacaataacgccaattctaatggagaggttttaattaagatcccgatttctaaaatagcagaatacaacaaaagagcgttgtttagcgaagaggaagaagaagacaggactttggatgccacaatgaacgacataccgttaaatgtaacaataaaatacttggacgataacgataacgaacgaaagagagataaattgaagagaaaatacaaaggtgaggagcctacaatcgaggaagtccactttttatttcccaaaagtggtgttgagtttttcgaaacttttgataaattagtgaatcctgtcgttctagacaatgactacttaagtagccgacacgagctggaattatcgcgtccg

SEQ ID NO: 1669 - DNA, 1014 bp, Candida albicans
cctttacaaggatcaataaaccttttcagtggctctcccaatgtcagcggcgacgaaggcacagatgcagataatgagaatcctgaacatagaacaacttatcattccttatcgggacgagtgaatcacgacgatgacgacgaagatgttgccaaattagaagatattgttgggtttttcacagggttattgaataccacgacagtttgtgctggattgggaagtttgaacaacttgaaaaagcattatttggatgagtttatcaaaaaaagtgctttgaatccattgagaccacaaaattatggaccagaaacgagcagtaaacttaataataattcgattgaagaattactcaataatggtgacacaagtttggaaaaagtccgaaaaatgagcctctatgattttgatgaacacacttcagattcagaagaggaagattcagctgacgaagaagaggagctgatagcagaaaatttgaaaccagggaaaagtggtaaagccaggaatcaccctagggattcaagaaccacagcaaccttaatcactacccaaataacaagaacagagacagcgacgacagcaacaccgacaccgacaccgaccagttcagtcgatacagatgtcacagatgtcacagaacccattggtaaagtcaccacagagatccctgaagagcaattacaaggtctcaatccattacagaaatccgtggtgaaaaacttggaccctcatcacgtgagagaaggagtattgattaaagttaaaaattcagagacacctttgaaaaatgatcgtcaggaactactcgaaaagattcagctacggttaaaaattgccgataaactacagagagtttttgatttaagcgatgaagatacgttttgtggaaattacagtgcttggttgattaaggatgtattattacaaggacatgtttatctcacaaaagatgcagtaccatatttttcttcactcacggagctgccaggatccgcacttattgtgtgggga

SEQ ID NO: 1670 - DNA, 507 bp, Candida albicans
cgctggtccttccagcccgcgtggtggaagacgaaggaaggatttagacctgaaccatatcaatggggtagcaattttgaagttgagttatacaagacaagaatggaatacagtgattctgaaaatcgagaaatccaacaatatgataatctgattgatattaaatttgcagaaaagaaaattgaaatggcaagagtgagaatgtttgaagacagactaatggctgcctcgggattggacgtccccattattttggaagattcaccttttttcaaaacagaattgcggccatctacttcttataatatcacgttattgactattggttctcgaggtgatgttcaaccatatattgcgttgggtaagggattggtaaaagaaggtcataatgtcaccattgctactcatgcagaatttggagactggataaaaacatttggattagggtttaaagaaattgctggggatccggccgagttgatgtcttttatggtaactcacaattct

SEQ ID NO: 1671 - DNA, 762 bp, Candida albicans
aatcatgggatgtcgatcctgaagaagacagaaaagaagaaaaaggaagcaaaattgcaagaggctaaaagaaaagctgaattaaaagccaaagaggatgccgaaaaggcgaaaaaagacgccaaaagaaaagaattagagcaatttgatcaattagatgaaagaactcgtaaggaattgttgaaaaaagctgaattgaatgccgatttgaacaatgctgctgatttgtttggaggattgggcgtcgccgacgataatgacgatgatgatttcgatatcaatgaacatccaagagaaagaataaccaaacaacaattagctgctgctgctgctagtaagagaccagcattaactaaggatacacctttggaagaacatccattgtttcaacctacaaacaaacaagaatatgaaaaattaagacagactgttggtacttcattgacaagattaaatgaagactcttcgttgttatatgcatctagtctggccgttgatttgataagagacttgtcacagccattatcagtggaaaaccttaggatagtcctaagcacattacatgtggtgatccatgaacacgatagacaagaaagacaagcaagattaaagaaggctggtggtactgctactggtggggccggtaagaagaaggccaagcctcttgccagaccaaatgtgggtggcgggttcaaaaaggatgcctttgatgatatggatgatggtcaatttgatgatttagatgacgatgattttatgtaa

SEQ ID NO: 1672 - DNA, 627 bp, Candida albicans
cgattaaaaggcatcgtatttctattcatattcgtgatggtactttatttggaaaataaacatcaatttaaatttgattttgaaactacaagtttagcttattttaatagatatcctaatccatatgctaaacatgtattatcaatagatactattgagtcatatattgataatcaaggtcaattatgtactactagacttatagttaaaactggtcgattaccaaattttattaagccaatattaggtaatagtttaaattcttggattattgaaaaaactataattaatcgacatgataaaacattgatttcttatactagtaatcttgatcatcggaaatttattcgtgttgaagaatatcttaaatattcgggtcatcaagaagataatgataatggtgatggaagaggattgacaaatttggagagtaaagtgaaatttagttcaaatttatttgggtttaaacaaaaaattgaacaatggagtcatcaaaaattttccactaatattaaaaattctcgtgagggattacaatacgttatgatgaaattgaaacaacgaagtaatggattattattacaagagagaaagctaaagccaaagccaccaagtcaatgtgattaa

SEQ ID NO: 1673 - DNA, 876 bp, Candida albicans
aaaaaaatgctgctgctgttgttgttattatcacgtacaatcaaacacaattccataccaattaaaaaacctttatttacatttacaccaacatccacatccacatccagatctatttctatttctacttcttctacttgtaatatcatccgttattatcattctcaagatcatataaatattaatactattgataataataataaaattgatgatcaaatattaactacagcaattaaatatattcctgaatatgggtttcaatctcaatgtattactaaagccattaaagaattgaaatatcctgattcaatgaattctcttttcacatttaaaaaaagtgaatctaatcaatcattggaattgcaattaatgattcattggttaaaattacaacggtataatttagaaaaatatattgaaaaaaatccaaccccaggtagtagtagtagtagtagtaccctgtatgaggatagattaattgaattaattaatgttcgattatcttataataaaccgattttaaatcaattaaaaactacgggaatcagtcaattaatcttaccttataatttaactcaaggattaaatgaattatatttattaagtgatgatttagctttttatctgggagatgaatctaatgattttagttggtatagtaaacgattaagtattgcttcaatttatgttagctcagaattatttatgttgaatgataatacaaaagattttgaattgactcaacggtttataaaacaaagagtttatgatttgaaaaaattaagtgatggttataataatattgaacaatggttgggatttaatggtattagttttattaatttaattaaatctcaattaaccagaggttaa

SEQ ID NO: 1674 - DNA, 1638 bp, Candida albicans
ctagacaaagtcttcaccctccccccaaataaaaagggtttatatcattatatacggatttttgaaattatgtcaaatcttgtacgctcaattaagaatgttgctgggggatattcctctgctcaacgagttgttagaaatgccacttccaatgaccccactggacccaccacgtttgatatggaagaaatatcatcatttacataccaatcacaaacagaatttatggaagttatggatatgttagatcgtcgtcttaatgataaaggtaaaaattggagacatgtggccaaatcattgacggtattggattatctagttcgttatggatcggacaaatgtgtgttatgggccaaagacaatctttacattattaaaactttaagagaatttgttcatttcgatgaaacaaacaatgatcaaggtgcgattattagagttaaagctaaggaattggtatcacttttgagagacgatgagcgattaaaacaagagcgtgctaatgctaaaaagaataaacgttatagaagttatgatgatgatgatggtgatggtggtgatgattttgattctgacagaagaagaagaaatagagacgaacgtccaagaagagacgagccttatgatgctgaactacaacgagcattagaattatcaagaataactgctgaagaagaacaaaatcgtaatagagaagaagagaatgatcctgaattggaagcagccattaaattgtcattagaagaagaagaaatgagaaaacaaaataacaatttattggatttgaatgatgaaacaccaccacaacaacctcaatattatttagcaaccggattctatcaacaacaaccacaattttatgcccagcaacctcaatcgcaacaattccaacaatatgatatgtttgggaacccaatacagaatccaatggacacaggattatataatcaacaggcctattatcaacaacaacaacagcagcaacaacaacaacagtttcaaccaaaccagtttactggttttaactatggacaaccacaacaaccacaagcgcaaccagaacctttacaaccattgaaaacaggatccaataatccatttgccatgtcttctgggtcagacaataccaacaagccaccaactcaatccttaaacagtttagctgaacagcaacaacagcaacagcagcagcaaccacaattttttactcagccaactactgctccactcaaacaacaaaacacatcatcatcaaggtttaatgaaactcatgagttgaatgatttattaactcaaggaactggattagatacattcggtaacactggagatactagaatcccacatcaacatacaaagacacaaaattttataaattcaagtggaactggatataaacaaactggtaatgaaccaattagattaagttctaatgctaaacgtaatccatttcttaatactggtattggatatcaaggtgctacacaacagcaagtgccacaacagcaagtgccacaaatcaatcctgcttatactgggtatggatttggtaacgctcaacctcaacaacaccagcaataccaacaacaacaacaatcacgtaatggtaatgatggcccaagtttaatagatatttaa

SEQ ID NO: 1675 - DNA, 1059 bp, Candida albicans
aggcgacagagacaacaaaagaatattcaagaaggatttttttttttggagagctttctatttttttgcaatctattcattactaatcaatacgattgtttcaccgtccaaatgacagaaagagattatactacatttgaaactatagacttaaccagtgaagaagtgttacaatgttcatattccaactggtcgaaattgtttcctggtaaaacattcccatctaaaattatcaaacctttgccttccacctttttagattatttggctagtgagagtattcgtttgccttcaaataccaacaataagaaaataacagtattagaagcagatagcgataatgaatatagtgattgggatgatgaggaggaccaacaacaggatgctgagcataatgacaatgtctttagtcagttccaagatatacaagataaaattgatgcctcgatccaagaaatgggtggagctgtattcactaaattaaattggtcgagtcctaaagatgcaaaatggattatgccaggaaacacgattaaatgtcaaaatgttagtgatgtatatttgttattaaattcttcagatcatattggtgatgatttggataatccatttctggaagtgcagcaaaaggagatgatccctgaaaaagttgattacgagttggtgttaacgaaatggcaagagataaatccggcatatgagtttagagtatttgttaaagatcatcgaattattggtatatcacaacgagataataataaatatgaatttttacaaggattaaaactggaattgaatgaaaagattacacaatttgttgaagatcatgtgatacctaaattaaaatccgatacccaactaagcaaatatattgtcgatgtgtatgtgtccaagaatgctatttacataatagacattaatccattttctagaaaatctgattcttgtttattcacatgggtagaattattagacaaaaaggacaaccatgacaaccaccacgaattaagattagtggagaatcaaaattttgctaaagaatgtagtgaatctcaagta

SEQ ID NO: 1676 - DNA, 219 bp, Candida albicans
cactggatcctgccagcgccgtgtgtgaaaacagatgatgaaccggatgaatgggatcaaagaataattaatactggttgccataaagagaatttaaaattacaattgtgccatgctgatactggtgattggaggcaatgtacgaaagaattgcaagcttttaaagaatgctgggataagaataaaaacaatgaaagaaccctgacagttgataactga

SEQ ID NO: 1677 - DNA, 693 bp, Candida albicans
caagccttgaagttgaaaaaaaaatccataagcgcatctcatacagctcagctcgtcttacataaagaaagccaactactgtattatacaacactattatatccaatggcagcatcagacgctcataacaacaataagaaaaggtcaaatagaagaagaaaaaagagaagaacagaagatttttcttcttcgagtgaatcatcctcttcatcatcctctgaatcagatcacgaagacttagatgaacctgaaaaagaaatactgaaacaagatataaacatcgatgatatagatatagaatcggacaatgaaaatagtgctttgacaaatgataagggtaataaattgataccgcagaatttatcaataactgaaaaacaacaattaagtactgtaccattcacaacaacatcgatttctaatatcactaatgataatcaaattaaaaacataccaaatataaatgaaattagcaaaaatttggatcaaaagaaaactcaattgaacaatgaattcttaaaaattatgactactgaatttggcgatgatttagatgaattaagaaagaaaccagatttcacagaaaaatcattggtgatactagctaaaactttgcaactgggggttaatatgtttgacattgatgttttaaatgggttaatacaagagagtggaaatactagtaatcaatag

SEQ ID NO: 1678 - DNA, 294 bp, Candida albicans
tcgaaaaaaatgttagtcaagttgccgttggaaatacaaattaaactattattaatggtacccaactcaaatctaaagtttgttaatagtcacttttatttactatataatgatttatattatcataaaattgtcaatacatttggtgaagctactgtcaaagttatcataaagattttaccctggttaaaaccttatatcaaatcattagacgtgtttaggaaacaagcaagattaataatagttaaaagattgcaattgggaagagtcacctataattgttcacaaccctga

SEQ ID NO: 1679 - DNA, 978 bp, Candida albicans
aaatcacaaatcacctcgttcatttcttttgctcctccaaataacacttacaaatataatacgaaaaacaaaaaattagaatattactgttcattttacacagtattgtttaccatgaagatactaacacgtcaatatcatacaatacgatcaaactatcgaaagctacaacatattcatttcccggggatttcctcatttcaacatggtttgaacatccaacaattattagtcgatgccaaccttgattataaatcattagaattcaaatatcgtagaattcaacgacaacgtcaacaaatttccaccaataccaatgattcatcacttttggctttgaaaaataaaattgagaatttacaaccattaccaacaattcttacatttgaatttgataatgtttatgccggaggattacgactgaaatctgaagtttcgccaaatgatcttgaagggttcaaacgtataggaggacaatatttccaattagaaagaggaggacaagttacatggcatgggaagggacaattagttgcatacttgattttggatttgaagtgttttgtaaaattatcaaccaaatgttacattaataatgtcttgttgaaaagtattcaaaatctcttgaaaaaaacatatcatcttgatagtgttgttggtgtggaaaatcctggagtttggattaaagataataagtctaagctgctgtcagaatcattgaaaattagtagtgttggagttagaattcgtcatggaatcaccgaatatggaattgctttgaatataaatcctgacttgaaatatttgaatacttttgaaatgtgtggattgaaaaacaaacgtgcaacttcgattcataaacaacttagtcaccttccggtcccatcagttgaacatgttggaaaattgtttgttgatgaagtggcactagctttagaaatgaattccgtggagcatatcaatgctaattctttgtaa

SEQ ID NO: 1680 - DNA, 999 bp, Candida albicans
tatttcgatacgtttatcgagtcggcgaaaaaaaaaatactagttgtaatatctgaaaacatcatcgattcacctaacacgccaatagccatgccactaaaggaactagttagccagtttagttttaccagagtattgaaaagtgactctcaaactaaaacaatttctatactaggtaaaatagataacaaggatgcaattgtaaccattgagaaatcccattttaatactggctcagatcttgacttgcagaaattaatcactgagttatctttaatcaattccaatgatgtctactattggtcaacagcaactttattccaggaggtgttggaattgcccggtgcaaaattgaacttgatttatccagctacggaaactcacattagaaaatacgatgatcaaaaattgcattatgtcagagagacaccagaaatgtaccaaaaatatgttattccctatattgaaactatgaaaggtgatagattgaaatgggtttacaatatattgtttgagggaaaggaaagtgaaacatttgtatatcatgataagtctcccacaggatttgtgttgttgcccgatatgaaatgggatgggaaaaatttggatacattgtatttatgttgtattgttaacagactagacatatcttgtgtgagagatttgaatgatagtcacattgactatttgactaatttgcaaaaaattgtgaaagaagttacagttaacaagtatggaattaagcctgaccaattgagagtatttttacactatcaaccatcgtattatcattttcatttacacattgtaaatgtgcagcatcctggattaggagatggtatagctattgggaaagctatattgctagatgatgctatagataacttgaaattggatggacagtattacaccaaaaaaaccattggctttgtattgggtgaaaaccatggattatggcaaattgaaggttatagagatttacattttaagcaaaactaa

SEQ ID NO: 1681 - DNA, 816 bp, Candida albicans
atgaaaaaaaggttagttttgtttgatgattctgatgataattctgaaactgaatcagataagctgaaactcaaatcgaggaagaaacagtttaaaattccagaatatccccaaccaccatcatttcctgtcaatgaacaaaatgaagattacatgaagtatcaattacaagatgacaaacacgaagaaccaacggagtctgccatcgataaaaaagattgttcactatttctgaacccaagcacatcaattggtctctcaataatggaaagaatggggtttaaaattggaaatgctttgggtaattccgccacagcaattaaagaaccaattgaagtatctttaaaaagtggtagacaaggtctagggggtgggttcaaaccacttcagtataagcaagaagatgttgaaaatttgaaattaaacctagcaaattcgtacaaacaaagaatcgaattaagagatttgaagaaaatcatgaaattatgttttgaattaagtggtgaatatgataaatatttggaaggggaagatattaccgaagtgaatagtctttggcaaccatatgtaaaaatttatgttctgaaacagcagagtgcagctgtgggttcagtaaaagcaaagtttaatgcagtggaaacactacagctatttgaaagagaagttgaaaataccgagcagacattatcggatctactaaattatctacggggaacccacaactactgctggtattgtgggctaaaatataatgaccaaaacaacttgctagcaaactgtccaggtaaaactcgtgatatacatttaactatttaa

SEQ ID NO: 1682 - DNA, 1200 bp, Candida albicans
acggagaatttttacgagagatgtcgcaaaagcatttcaatttcaaacgatacaattgtcccaaaggcgttatctgaatttcttatcaaggtatcagagttgagtccaaggttgattttgcgtcagatgacaagtatctcccagttattggataatagtaatcaaacgttaagatgctctgtagtcgaagcatgcggtaatattgttgttgatattctaaagaacagtactaaagatcaaggtgaggatgaagacgcagactattatagacaccaggttgccaaactcttgaatttgttggaagagagattcttggaccagaatccctatgtgcgtacaaaagcgttccaagcattgtctaaagttgctgatctaaaagtcaaattgactgaacgaagacagaaaatgatgatgttggcggtaaggtcacttgaagatagaagtactttggttagaagaaatgcgattaaattgatgtctaaattgatacttaatcaccaatttcaaggttcacatggaactcagttggcattaacattttggaaacaaaaattagaagatgcagaagctgaattaatgaaatatatacctgcagatgtccaagctgggcctgaacagcaatccgatactagtgacgttgaagatgatggagatgaactggataaagtagaacaagagaataatttgaacggacaagcagaagccactaagaaagatgaaccaactatggatattgacaaagaggatgtcctggaagaaggtgaccgtgaaggtgaaagtgatattgtcgctaacacatcatctttcaatgataatttacctgatgcaactgtcttggcaagggtcaaattaacagccaattattataaagatgctgtggattttgttgaagctgtccaacatggaaccgacgttatttctgggttattattttcaaagaatagaaatgaggcgatagatgctatggatttcctagttttagcagatgcgtacggagttgaaaactcccatgttggtattagaaagatgcttcatttggtttggatgaaagggtcttctgatgaaggaaaatcagtacctgctcatctcattgattgctacaaatcattgtttttaatagctccaaattctgccagcaagattgagaaagctacttatattgccaagaatttgattcttcaccaccgctcgaagacacgt

SEQ ID NO: 1683 - DNA, 261 bp, Candida albicans
tttcccttaccaatggattttagcctctcatcatattttaacgcgtttgatgttgataaggattatcaaatagagttttctgacgtggattccaaattagaatcaattacagattcattggcaaacaatccagaatccctaaattttaaccaggaattattggaagatcttattgagttgacacatgggtttagagaattagaagagaaaaagcgtcatcagctgtcttcaccatcggggaatggacagatgcccgctaat

SEQ ID NO: 1684 - DNA, 975 bp, Candida albicans
  unsure (125): Identity of nucleotide sequences at the above locations are unknown.
gggattatttttaaaccaacaaatttatttaaagatccaaatgttgcttataatacattagaggaattatctgaaactttggtattaacaatttctataattaatcaacttgaaaatgaacaacnagaagaaggagaagccgaagccaataaagcacagaagaaaatctctaagatttcaaaaattttttatgatgaaattattgatcaaataaaattattattttcatcgataattgaattaaatcaagaattgataattatcatcaacaatgaaaatgagaaagacaaaacgaatgaagatggtgaagataatgacgacgacgacgatgcaggaagattgataagtgttgggaaaatatggtcaaattgtgattcattagatcaattattaaatgaaggagatttaggattacttactactaaaattaaacaaagtatatcattacttgatgatggatttgaagaatttgtaacttgggctaataatcctgaagaaattgaagatgatccatttggattcagtgatgatgaagaagaagaggaggaagaagaacaagacgatgacaatgataatgattcacttcattcaattatagatacaaaagaattatcagaatttgctaataaatgggttaaaaaaattgaattaattaaattattaatttcatcatttaaaaaatcatcattaccaccaccattgaaagcaaatccaaattcaattctgggtaatacaattgatgaaatcaataatttacaatcaaatcttgttcaattaatagataatttcattattgatttaatgattgatagaaatattcatgatgatgaaattatcaggtatactaatagaatcattaatcaagctataaaattaagtgaattagccatgattatttataatcatcaacctttgacaaattatgaaaaaaaattgaaatggtatgaaacatttattaataaaatatctctataa

SEQ ID NO: 1685 - DNA, 849 bp, Candida albicans
aaaaaaaagattgatcactaccacaatttattcaaccacttgaaaagcatggtaaaatcaattgcagtatttggtggaaacgggtttcttggacgtaaaatatgtgaggtgggagttcgaagaggctatgatgtgacatctttttccagacatggtgaaccacctgaagcagtagtacaccaaccatgggttgccaaagtaaattgggaacaggccgatattttccagccattgacatatcaagataagttgaaaaattatagtaccattgttcattcaataggtatattgtttgaaaaccaatcatataaaaaggccatgaattcaaactttaattttttgagtgatatccaaaacttggcaaacaatataatgggaagcaacccaatgcaaaaagataacgtgaagagtacatacgctgcaattcagcgtgattcagcagtcgtattggctgacaactatattaaatccaaggctgaacctccacgcaactttgtttatgtgtctgctgacaaagttcccccattagttcctgaagaatatatcactacgaaaagggaggctgaatttgaattaagctgtaaaaaggggttacggagtatatttttgagaccgggagcaatgtatgatgaaactcacgagggtggactaacaacaagagatgttttattacggggtttgagatttggtgttgggttaaaagaatgtattgttgggaaacatatagcaggagacctcgttaggccagtggtctcaactgaacaagttgcagagtctttatatgatgcattagacgataaagagtttgaaggtgtggtcacggttgaacaaatacagagtaaaaaataa

SEQ ID NO: 1686 - DNA, 1476 bp, Candida albicans
gttaaagtgtcacccaacttccattttcatccaatgcatctaccttcacaaacagaacagcaacaacaacaaaacccaacatttccaccttcacctgaaccagattgcaaagataaaaagagactgtcactacctacacgattgaaacaaaaacagacaggtgaagttgaaaatggaggtattgattttgtattatcaccattcaaactaactccttctcagccatcatatccaaatgatgatctgagtgtattccctgaaacaaataacggtaaagcaagtgttatcaaaaggtattcggcaaccaaaccaacacattcaagatataatagtcatgatcttgtgcccattaaagttgaatttgaaaaattggaatcgggtgttagaagtacttcagtaccagaaaaatctttgaaagaactgctgacatgtgaaaccatagacgaaaatactggccattttgaaagtattagaatgtcaaagtataggaatggtacattatttgccttgaatggatatggtcatgacactaacaacaacaatgaagaggaaggtgataatgattatgatgacaaaccagcaaatacatctaaaaacttttctgaaatggatatttcatcgaaaagatcaagctatttaaacagtgatgaaaagactaaacaagagattatgaaattgaaatttgaattgagatcactaaaattacataatgagaaattattatcatttatcggatttgaattacaaaaacaaagaaataacttgaaaaaattatcaaaaaagcaatcagcaaggttattggctagttcttctaaaaatattgaatattccgatgctaaattaattgagaaatctcgagatttgttaattaataaaaaacgagtcttacgttcagtatcgattaatactggatttaaagataggttcccaataaagaatattggcattattgctcctaatagtgagccggcatatgtcaatcattatgatgatagtcataatgattatgaagatgattttattattgatgatgatagtcacgattttctcgatatgaattcactttcacataatgataaaatgattaaaaaatttgcatctcaagtgtttaataacactaaagctttatatgagtatgatctggatagtgattttgaaaatacatcacattgggtgcttgaagaaggcgaagaggaaaacgaacatgctgacgaagaagaaaataattccacctctaacactagtggtagtggtagcagtagtgaagaagaacagatgggagttttcagtcaaatcaaacatatggttattggaggtgataagacggttaataaatccaagaaaaagagatctaaaagagatgatcaacatttagtggatgatggattaaaatttaagttcttgactattgcattaggtatagtaattattggattgaaattaactcctcacaataaccaaaatattaccagataa

SEQ ID NO: 1687 - DNA, 621 bp, Candida albicans
  unsure (1): Identity of nucleotide sequences at the above locations are unknown.
ncaaccccccaaatttcgcagcagcgcgatgctgaaagttacaccaaacaaattgaagaaaaagacgttcttatcaacgaactaaaatcgtcgctcgacccaagtgcatgggatccagaacagccgcaaacggccacaaatatctccgaattgaaccgctacaaattggaaagattagagttgaacaacaagttgctttacttggaacaagaaaatgtaaagttaaaggaccagtttgctgagtttgaaccatttatggaccaccaaattggcgaattagacaaattccaaaaagtcatcaaagtgcaagaagaacaaatcgacaagttgtcaaaccaagtcaaagaccaagaagctctacacaaacaaatctacgattggaagagcaaattcgagagtttgtctttggaatttgaaaactatagggccatacataatgacgacgatatatcagatggcgaagttgaactccaagatgacgacagatctattttgagttcagcaaaatcaagaaaagacatttcatcgcaattgggcaatttggtgtcgttgtggaatcaaaaacacgcctccagttctagccgtgactctacagaccgccgctggcagatccatgtccgc

SEQ ID NO: 1688 - DNA, 825 bp, Candida albicans
gcggttccttccagccccgtgggtgaagacgatgtaactactccttgtcttaaccatctaaaacgaataaggaaagttgatgatcatttagaggtaataatttatccgtacgaatccgacgagcagtgtgctagtattatggagttatcccggaaattccctgaagagtttagtattgacaacttggaggtaaaagaggttccacagaatgcacctccaactaaggaacttactcaacagtggtctaatgggtactggccgattacatggaaaggaaatccaaaccaccaattcttgaactcggtcgaaattgatattgaacaggagaaacaaatgataaatacgcttttggactctttggctgatgcagccgtatcacaggactctacatttaactttctgggtacattaatagcttcgaaagaagacgatagaattgaaatacatactatatgtattgcttctgatatcaacaatgatccgcaggggcacagtgtcatggaggctatttcaaaaattgctgaaagggaagtcatgaacagaaaaagtaaccaaagtgagcgaggatacctttgtaatgatatgcttgtctatacaacccatgagccctgtgtaatgtgttgtatggcgctagtacactcaagaattggacgaatcatatacttgaaaccagaaaagagttctggtgggttggaatctcattatcagctcggtgatcgagatggactaaattggaaattcgaaatatggaggtggttgggagttgatgaattggcgcgattagatagaataaacgaaaatagatgtccatgtatagaatattaa

SEQ ID NO: 1689 - DNA, 804 bp, Candida albicans
cgtcacataggattgagaaaagtgaaaaccactatagatacccagtatcacaatttaaacattttgtcgagctcaaggcatctcagtaattgtaaatctttggtcgataagaccaagacaatagcgttgcaaaaaggtaacattttggaagtttgtcgaagccaaatctacgatgttgttggttcagttaaagatgcacgagggaatttacacctatataaaaggaagaggggcgtgtttcagggattctcattgctgtctatattttgtgacatcctatatagtgcaatggttcatgattgttttcaattcttatggaagtcgaaacaggattttttatttgtacgattggtagatgactttttacttgtaacgcccgattcgaatatttatgatcaagtgcacaatatattatcaggaaaaatacttgagagctatggagcttttgttaataaagataaaacagtcgttgttaatcaaacaaccacgaaaccaagtatatatttcgttgggctcgaagtgaatacaacagatctaagcatcaaaaggaactccggtctgataagtttggttacgacaaacttcagaacattcaagactttagttaagtatttaaagactttctatcaattgaatttggaggggtttctcttggactgttcttttggggtattggaaaacgtgcttgaaaatatgggaatcctccttaagttggttttgagggaattccaaacaaaatttaactcaattgttcaatatgatacatttcaatgttaccaatttatcaaatttctattgaactaa

SEQ ID NO: 1690 - DNA, 561 bp, Candida albicans
cccaataactccatgccagcttatcattcgacatttttagcagaagaacaaaatcaaagtatcaattctggaattcgaaccattggtaatttatcattattaccatttcatactaatttccgaggtccaatttattctgaaaataattctgattatgatataattgaagaagtattagatttatttagagctaattcatttttcaaaaattttgaaattaaaggaaattctgatcgattattaatttatgggattttatttataaatcaatgtttaaccaaattaaccaaatttactaattcacaagaagccacgaaaatattaattaatttaagtgttgataatttccatttacctggagatattggattcccattaaattcattatatgtatcaccagcaaataaatcagaatatgaattattgaaaaattatttgactcaatttagacaagaattgagtgatcgattaattaaaagaatttatcatgatgatcctaatattccaagtaaacattggttagcttttacaaaaagaaaattcatgaataaaagtttataa

SEQ ID NO: 1691 - DNA, 288 bp, Candida albicans
gatccttccagccccgtggtgaacacagaaccacaagatgaatatcctccagaacaaaaggatgctgaatttgctagattgaagagagaaagagatgaattattggttagattttttgaaactacaagaaaatggattgaatcgactaaccctcaagtgtctgatagatatttgaaggataaaatcgatttgaatattgctctttccagaaactatattcaattagatccatatgttagaaaccgtggtatctatgatagagatcatacattaagtattggacattaa

SEQ ID NO: 1692 - DNA, 732 bp, Candida albicans
acagattgcacgcacttcacatatatagatatcaatattttcatcattttttttccaactcttgatatatttgaagtgtttagtttgctatatatccatattgctgtacctactttagttaaaccgactaccatgagttttatgcccagcggatctaatccggaaacagcatcattcacatgtaatacatgtggtgttaagtttatcaatgcagaattgcaaagacaacatatgaaaacagaatggcaccgatacaatttaaagagaagagttgcgggtttaccatcaataacagcaggagtgtttgccgaaaagatactcacactgaagcatttagcgaaaaatgaaaacgaggatgagtacgggttttatgtggctacgaggaagaagaagacgaacggagaacgtcaactcactaagaagtttctaaaatcccagaagaacagaggtagaacagaggaggttaaacttacaatagacggcggcagggaagcaagtcctgcggcatctctcacctcggatttttcggagttttcgttaggcgactcagatttccatgaggttgaatctatagttacaggttctgagataaactataccgaggagtctgatttcaccgatttggaaggtgagctattatcagaagaagaagaagatgatgaggaagacgcagaaggagcagcaaacgatacctcttcaccagaggtctggaagggcagtgctgccccaaca

SEQ ID NO: 1693 - DNA, 798 bp, Candida albicans
gatagtgccgggctctcagaggctatggagtctattctaattactcattgtttttattgtggtttgaacaaccgtgaaatacaaaacaatataaaacacatgttcaataagcacgggttgtacattcccgaaagatcctatctagttgatccaagtggtctcttagagtacttgagtgaagttatttcattagactacgaatgtttggtatgtgggtttgaaggtaaaaatttggaaagtgttagacaacatattgcatccaagggccattgtaaaataccatatgaaaccaaggaagagaagctagccatatcacaattttacgatttttcagtggaagatgaaccaaaaacgcaagccaaagaaagcacgaaaaaacatgtcgagtttagcgacgaggcaccatcgactatagttgtcgagtacgaaaaccaacctggcgataatgaaaggggaactggagataatggaataaacgacaattatgagttagtctacatagaccaatccggagttgaacttactacaccagcacgttacagaattggccaccggtcaatgcaaaggtactataaacagaatttgcggtcgccaagagagccaacagtagcacaaactacacaggcattggtcgatacaagacttgcacctggattgtcaccgtactatgccacaaaacaagaaatggacacaaggaggactgtatacaagaccagaaactatgtggaaagaaagaggtataagacaagaagagccaattaccataaacactaccgtgacgaaattttgggtacatga

SEQ ID NO: 1694 - DNA, 999 bp, Candida albicans
acaaggagtatttgtgtcttgattactaaccacacgttagagcatattgaactgtacttggctcagaatgattccgattctccctgtccagtttgtggttctaatccgatatcaactgttcctatcaacagaatgctacccgttgaactaaaaaactttttcattccgacaccacagcaaattgatttgttgacaagctctgggaaatttcagtattgctcattagttgacagaattaactattataggtccactatatccaaaatgaatgaaaagttgaaaaaacaaaaagagtttctatatgcagcaaaagaagaaataacccaactaagtaaatataaactccaggttcaagaattaactaacgaaatagatttacttaggaagcagctacaaagtacagctcgtccagacacttttgatctatcgaacgataatgaaaatgagaaaagtggagagtttgaaaacaatatttttacacgggagctgagtccgactcaaactgctctgcacacatttatcaataaggtccatcgagaatctttacagaaagtaataccaacttcaaaacctgatactgatgatagaaacggttcaacaagaagaagatctttttttgctgaatcaacgaaactaggagaaattaattcgaggtcaatttcatccagcaatgaatctagcaattcgctaaatagtttaaagagatttagttttgaaagtcccaaaaagaagtatttacaaaatccaataggcaaacgatctgccactagtcagcttgcaacccgaataacagctaacatgaaacttggcgtccctgtgagtgcatccaacgcactgtccagaagctatcaaaatggttatgttaacaaagtgtcgagagatcccacattaacgagaactatgagaagagctagcgaggcatcaccgtactttaaagggctaaattacaagtataaaaacagcagtcatgaccatcatcaacaccagtataaacgctag

SEQ ID NO: 1695 - DNA, 1011 bp, Candida albicans
ctctggaaattgcttttttttttggcttctcttcttcccacttggcgcaacctaaaaaaatctcaacgattgttgcacttttttttttcactatcttcaccagccatgacaaataactcaaagtctttgcctattcctgtccccaagaaggaagatgctaaactgaactcattgaatatccccaaatcaattagtcaaccattatcgccattgtctacccctactccaatcaccgaaaaggcaatggcgtctattgcaccaatgttagaaagtttttcccccaaaacacatgcagaagattctgtctccagattaaactctatttcatcttctgcagggcaagtcagtgatgacgatttggtacagcccataactgcagaaaacttatcaaacatcaaatcttattccaactcatttgtcgatggggcaagaatcagtcgtaccgtctcaaacacatcaaacgcctcaagaaagtctcatgcagaagtatcgaaactaccaaagatcgggactatcggtgtttgtgccatggatgccaaggcactttcaaaaccttgcagacgtattctcaatcgactcattgaaacgggggagtttgaaactgttatttttggtgacaaagttatactcgatgaagctattgaaaactggcccacttgtgactttttaattagtttcttttccacggggttctcactagataaagctattagttacgtcaactatagaaagccatacatgataaatgacttggtgttccaaaaagcactctgggatagaagagtggttttgtctatcctcaaccacgccaatgttccatcaccagaaagattggaaattagcagagacggcgggcctcatttggattcgcagttattggaaagattaaaagaaattggcatgtctgatgagaaacttgaaaagttgactaaccaaaatgaacctgactgggagatggtcgacgaagacacatttcgagttgtcttcaccagacggatggaaggacaacgc

SEQ ID NO: 1696 - DNA, 1182 bp, Candida albicans
ggacgcggatcttccagccccgtggcgaagaccactggcctcccaaaaatgccacagccatttgaagtcatcaagcgagtgtgtgagttgatgaatttttaccaccaaattatgaactacaactttgaaacgaaaaacgttcaagagtttcaaataaactggtgctgtggcgaagatccatttttgtttaaagagaggtgggataagttgttccaggagtttataagcgttgaaaagacccacccttccaagatctcggaattatacgacacaatgaagtatgacgccttacacaatcgtcatttccttcaaaagattttctcatatgacccaaacgataaggtgttgctttcgaggttgacggagacttgtggtagtaccgtcaactcttcagggttggttagcgagtaccccatcaacattttggcaatgaacaactttaaactcccagaatcggcatcaacttcggccaacaattcatcgtccaatctcaattcaaactctgctgctgggtctcttggctgggtcttgagtggcgctgccaccaccatgaaatgtgaatcaaaagatacaagtgcttctccacaaaccccatttgatcatcctacattcgcaagattgcgtgagttgtacagattgtcaaaagtgctatttgattttatttgtcctcaagagtatgggattaaagatgaagagaaattggatattggattgttaacttcgttgccattggctaaacaaattctttcagacatatatgacatgaagaaaaacgaccgacctgcgcttgtcaattactttaccaaagaatcacacatctacactttgcttaacattatatatgggtctcagctccctatgaaaattgctaggaatgcacttccagaattggactacctatcacaaatcgtttttgaattgtacgaagctgaagacccatcgagcccaactggtaaaaagcactctatcagattatcattgtcgccaggttgtcacactcaagatccattagatgttcaactagacgacgaccattacattggatgcattccaagaataagtttgacaagacatttggatatggatttggttacgcaaagattgaaatcacggttttcaagagtctcgttgccaaagaagtttacccctgtcaacataacaggtcctttaaatagcaagtaa

SEQ ID NO: 1697 - DNA, 693 bp, Candida albicans
  unsure (86),(131): Identity of nucleotide sequences at the above locations are unknown.
agtcagtttgaacagaaagcccaaaaatgggtatttaaaggcatggttactgttattcgtcacgctgatcgtactcgtaaacaaanattcaagtactcgttcagatcaccagtctttatctccttactcanaggccatagagaagaagtcatcattcgtgcggttcctgacttacaagttgttttggaaactgttaaaatagccgaggccaaaggtcttgaagacttgaacaaactcaaacagttgcgtattgcattggagaagaaaatggacttcccaggtaccaaaatccagctcaaaccaacattaaacgccgaaaacccagaagttgttgacaaagtacaattaattttgaaatggggtggtgagccaacgcattctgccaagcaccaagctaccgatgttggtgagcaaatgagacaaaaccttcaattactcaaccgtgaggcccttgatgacgttaaagtgtatacgtcctctgaaagaagagtcattgctagtgcccaatactttagtgcatctttgttgtccattgatgaaccgttggcagacgactttcttattgtccgcaaagacttgttagacgattccaatgctgcgaaagacttgatggataaagtgaaaaagaaattaaagcctttgttgcgtgaaggtgctgaagccccatcttcaccacgggatgagatccgcgtc

SEQ ID NO: 1698 - DNA, 483 bp, Candida albicans
attgaaatggccagcaatttacttgaatgccgaatgtttcctttatatgatccaatttttaacgaaaaagataatgagatactcaaagactttacaatcgagaaagaattcaccagcgatagctctaaaaccttatattttctcccccatgcatccttggaacttactgaggaagtgctaaataccaaccaaccaaaatattttcttgccaacgatgtgatagctcatactgacagattgaccaaaaaaaaacttgcagacaactaccccaccctttctataattgtgcatcttctaggggaaaacaaagtagatgacggatttacacgagtttctcgaaagaggtttaaagaaccggtgataacctatgacattgattcagtatactttgataaagtacagatttctcgatatctacacaccaataaaaatgacgcatggggtacttcctttaccgatttagcataccattatatttcttaa

SEQ ID NO: 1699 - DNA, 1041 bp, Candida albicans
aatgacagtggttccaatactaaaaatattgcaattgattgggtttgtaaaatatgttcatttaataatcacctagcggctgactataaacttaatgaaaacgaactacccaaatgtacttcatgtggtatacgacctagtaagtcatatcttatgcaaatattagactcagcacaaaataatatcccaattagagaggactcaccggcttcaatgactccagaacctgaatctgtttctccaaacaatgacaatcaatgtccgaaatgtacgttcattaaccatcctgctttgaggtattgcgaaatatgtgggacagaattaaaatcatcaaataataataataacaacaacaataccaagctatttaaagttactcaaagtttaagcaatgtgtctataaatagtaatccactgaacttgaaattggaaactggggaagaactgtataccaataatcaaccatatatcaaattgagtttccgtaaaggcggggaatccaaattttatcaagaagtttgtaaagttttggatgatatcaaatggcaaattctagaggaaaagggaggtataaataaaaatgccgttaaattggttgataattcgagcacagtcaataataataatactgcaagtggtggtggcggtggtggtattcatgcattggagagacttggtgagttacaacgaaaacaaaatgaaatgatattaaccacttctttggatgatttggaacaattgatgttcaagtatcaagatttaatcaaattatcaacatcttttaataagttaattaaacaaccaccatcgacaacatcaggggtggtaattcctgcattgagtattaaaaaatcgtcgccattatatcatcaagaattgagtagacacattagtgaattttcaataaatttcaaattgacacaaaagacgtcaatgatatcatctcaagatttatttgctgagtataatcggtttcttattagaaaccaaggatttggtagtgaattaataaattgtgatgatttcaagtgtgccatttga

SEQ ID NO: 1700 - DNA, 1095 bp, Candida albicans
cagccaattaaagaggaagaaggcaagaaaacgaaaatggccaaaaaggggaaatcctcaaagtcaacaccagagccaactcaaactctggcttcgacaaatacaaagtcgaaaaaaaagaaagacgtgacaccaacaccatcaactattgcaacacaagcaacaacaccaaaaccacaaagaggattggcaattggggacaattttggatggaccggtaaacttcctgttactttgcttaatgagcattgccagaaacaaaaatggggcaaatgccaatacgacatgagcaagaaagcaaaagggtttgttggtatagttaccttaacttgggaaaatcctaaaactaaagagttgataccgatcaagttctaccctaactatagtccaaaagagaccaccaatgaagcgagacacatggttgccacttttgtgttgcatagaataaattatataaaaaatatgaaaatgttgttaccgattattttccgtgattattggaatgaattagaagatgagaggttaaaattgttaaaagaaaacaaagaattgcacgacaaaagatataatacaaatccatttacagtttatttacaacaaagagagaatgaggaaaagaaagcaaaggaaagacaaatcaaggaacagaatgagttaaagacaaagaaacccactattagtcttggtacaaaatcttctacaaacagtgctacatctgctactactaaaccattaaagatagaatcagatacgagaaaatttccaaagaaggtgtgggagcaagctccatttatagatatcccatctgatataagaacatccattgaacattcaatacgaaatcatattgattgggttaataccgatcaagatttgttaatcaacaacccgtcaatggcaaaaactgcaagcgaaaagttgtcagcacttggtttcagagaatcccacattaaggaatcttttaattacagctcaaggttttccgaatctttagaatggttgttgtttcacataccagaagatgatctacctcaatcttttgtgaagacagacaaagactctaaagtgcaattgaaaatttcacaaaatttggaa

SEQ ID NO: 1701 - DNA, 387 bp, Candida albicans
  unsure (187): Identity of nucleotide sequences at the above locations are unknown.
aggaaagcaagggaacagtacaggcaattagctgctcaaccacccagtccaatgttccccatgctactcaaagatgcgtatgttgcataccggtcgtcacatcacaccacaaagctttatgtgagggatttaacacctactagtacttttgccaccttactctttggcggtgactttagttacgatntgaacatcaccctcggtcaaacttcgcctggtatcgtcattgataattggttaccaattagaacctggtgtaagaatggggttctaatcaaacatttgagaagactcatagattcagtaatcgacgagaaattatctaaccctgaatcacccttagatgaggatatattcaaggtcatagaacgaattataaatttatag

SEQ ID NO: 1702 - DNA, 729 bp, Candida albicans
agaatggcaaatgctggatttgatcaggatgagattcttgaagtctacaatgcaaataataacgatgaacacaaaacgtgcgttgaactaaccaagatgctactaccacaaccactcgagtctcttgctgaacctgaaagtcaagaaatctggaatgaagaaatcgagggacttgaaatgactggaataccagtgaaacatgaaaagaatgtagccacaatcaaattggaacacaatttcttaaatgtcaaaatattcaagagcgaaaactaccctaacgaaattcctggtattcacatagttgtgtcaaagaatgaatacacattggcaaattatatcaaattggccattgttagagagctattgaaatatttaacagatcatattggtcaatgtatgatttataccatctttgaatggctcaacgaccatgtgaataaaattattgaaaatccaggtccattgatgaccacagaaaaagttactaaaaaagttgttgttagtcaaaaaggaaacaaaaaagatcacaataaaagtgtaacatttattagtgataaagacattgaattagtaaaagagtcatataaaaagagaaaacattctgacgaatttaaagaaatgttaattcaaagaagtaaattaccagcatttgccaagcaagaaagcttgatgacagctatcaactctgggtcagtaaccttaattacaggaagaaactgggtcaggtaa

SEQ ID NO: 1703 - DNA, 354 bp, Candida albicans
aacttcatcaattgcatatctcaaatcatggcatcatctaaatctttaaaattccacgctggtaaagtacaatacgacgaagaaactaaccgttgtacccctttacaacataagggagttatatcaataaaaccaagtgctgaagaaaccgactttttagatttcacatggacaccaaaacaagatcaaactcaagctacacctggtaatatagagaaagatgaatttttattaatacctggagatgtcactattaaacatatgaaatcatgttatactggaagagtgtttgctttgacatctttaagttccggtgctaaatatttatattggttacaagatgttggagatata

SEQ ID NO: 1704 - DNA, 1863 bp, Candida albicans
  unsure (1139): Identity of nucleotide sequences at the above locations are unknown.
acaaatatttccctgcaaaattataccataaaaagtatcaatcttgtgacgaagaaacagacttcaatgccaggaaatgtccataattcagacttcctgttcaaaaagtcggactcattcaatgaattcaatacaaaaaatacgatgtcaatgggtagcatgatgatggcagccatatatgatgaatattcagatatagaggaagaggaccaggaggaagaagaagaagcagaagagaaacaagcagatcaacctaacagtcaacctttttatgaaggaaaactcaacgatgatacatctgataattttcagaagtatggtatcggggcaaaattattaatgaagatgggttatcagaaaggaaaagggctcggggtaaatcaggaaggaataatcaaccccattgaaacaaagctacgacccaaaggactaggcgtgggtgcagttaaagagaaagcagataacaactattcagatagcgacaaggacgatttggccattgatttcgaaaacaaatcgacaaagacaacagcatcttccttgtcagataaattatatgatacaatcttgaggtttgagaaattaaatgtaaacataccttcacatgttaaacattttttggatcaaagattatcattgctggatgagtcatttgtcctgaaagcagaagttcttctcgggagcttaaatgatatctatggtgaagtaaccaaaatcattgatcgagaaaatattattgactatctgataaaagaactcgagaaaacaaatgagtcaactgcaatagaaaacttgcaaaagataaaccagatattaaggacattttcaagtagtgaaataacatatgaggaggcatcgaaaatgatattaacagatttcaaactggaaccaagtgcagcgttggcatatctttcattaaggagggaccaacttgaacagttgacagatgtggcattttctgatttatcgtgccaaaaagagaaagttatacctatcttgcatagtattagaaacgaatttcggcaatttagtactgaagtttcaacagcacatttggataaatacttgtacaacaaatattccaaaattattaaaaaaatactatattgtgcccccacagatgatgaagatgaatatgnagacatactgaatcatgaagttttgttatctgtgctatcgttgtgggagagtagcccaatatctgtattccaagataaacgaatgactcagcttgcaacaaatataatagttccatatttgagatcagagttaaacatacttgaaaatgataatagtacaatgtacagtctacctgaatacctattagattatatagcgatcttttgcaacgatgaattgggcactttcgaacaagtatttactgaatatgtggatagataccaaaactttcttgatgtcgaagctccatcttccttgtggaattttttgaccctggaaagaaaagtggagcaagtatttaccatcatcgatgaatttaaccacaattgggcaccagcagttacaaagtttttacccagaaaaattgagaaattttacaacacgttttttagatcatttgccaaatggcttgaaggtattctgtttggtggagcagacgacgacattacgagagttgataatgcgtttgtattgctcaagtatgttgaacacaaagatctattatctttactacaatttcggattttcaatcgatggttgcaaacgttcctccaatcatttaccaacgagccacataatgttccaaaatggtatagcttttggtactcatactttgcaaataagctacaagaatgtgataacatcacttcagaaacaattaattggtatttaaacaaggcgtgg

SEQ ID NO: 1705 - DNA, 351 bp, Candida albicans
caatcaaagatggcaactactatagatccaactgattacgttgaagttgaaaatggtactttagcattttccgacccaaaacaacaagccaagtttgaactcggtgtgtgcatggcgatatacaaatgggaagaattgacaacagccgtggataatctctggggaggtcccaaatcggccgagaagagagattggatatctggtataatcattgacttgtttgctgaatctaaaattgtggatatacaactcattgaagaaacattgttgtacgctatggttgatgaatttgatacgcaaattgacaacgattccgcattggagataggaaacttgattgtaaagctatat

SEQ ID NO: 1706 - DNA, 570 bp, Candida albicans
ctcaagtctttacgccagcgcattttcaacgatcagatgagtggaacaggaaattcgttgacgactagtgaaatcaaattgataaccgaatatgctgagacacaagttgcgggtagtccacagtactgtatttcatcgttgtggacttggtgctacggtaattatgaaacatatacggtagtaggtaaggatggggaaatttacactaaaaagaaaaacgaagttttgacatgcactgataaaagctcctacgtgtttgattatataaatcagttagagtccattggcttggagatcattttagcttatgcctaccaaagctcaacatttaccaccacactgtatgaaaagcaagtcagttcgagaaacgcaaagtttcagcttgcctttaatgggatcattttcacttgttgtgcacaatttgtgaatttaatatgcctttttgtcatctactccaaccgtggctcttcaagagacttgtcaaagattccttctttggtcttgcatgttgtgacattgatttcattggcctcctcgcttagtataattataagactggcgatgatcaca

SEQ ID NO: 1707 - DNA, 339 bp, Candida albicans
caactactagcaatgggattctttacaagttcaggcgaagaagtaacatttgcaccaaacaaaggtcagcgtgttgtgtgttgggaaaagcgtgatggattttttgaatgtctcagtaaaaattatattgataattcattggattcaaaagaattagataaagtcaataaacaatgtggaactgaaaagaaagagtttgagcaaaattgtgctacaagttgggtgaagtatttccaagaaaagagatacaatgatttggtcagacaaagatatatcgataaattggaatccgaaggtgcccaaccattgccattcaagattgaaggggttaagaaatag

SEQ ID NO: 1708 - DNA, 1806 bp, Candida albicans
tctatatcaatagcatattctatcatcttagttacagtaatgtcatctgaaagcaacggatcggcttccaaaagaaggaaggttttagaaccatcaaagtttagaccagggtttattagaaaagttagggtatggaacttcacaacatattcatacaccgaattcaatctctctccaaccttgaatatgattattggtcccaatgggagcggtaagagtactttggttgcgtctatatgtattgggcttgctggtagcattaacttaattaaacgtaaaaacttgaaatcgatgattaaaacaggtcaagagaaatcgtctgtggaaattaccattgaaaattatgaaggtcactcacctatagtaattaaaagagagtttactgccaaagaatcaaattggacagttaacaacaagcgggccactgaatcaaaaatcaaagatataagaaccaaattcaatatccaactagacaacctttgtcattttttgccgcaagaaagagtagcagaatttgcaggactttccccagagaaattgttgatggagacagaacgtactcttggtgatggccatttgttgatcatgcacgaagatttgattgccaaagataacgaaagtcagcaattgggcaacaagattaaagacattgaagggagattagccaaattacacgaggatagatcaaaattggaagaagaagcacgaaaattagaggagtacgatagaaagtctgaagaagttgataatcaccgtcttttgatcccgtatgcaaaataccaagacttgaaaaaccaaagaactcaccttaaacgattgagagatgaagccaaacacaagcttcgtactttccaagccaactttaaaccattggaaaatgatatcgccaatgctgaaaagtcgattaatgaagaatcagaaaaatattcacatctcaaagactccctcaagctgactctcaatgaaataaaccaacacaaaagtactcaaaaacaagttaccactgaaataagtgaattacgagcaaatttaaagtcttatcaaacaagggcagaacagaaaaagaaagagctagaagaaatcaagaaggagatagcagaattacaagaaaaacagagaggtttacctcaagttgatccagaagaaatgcagaatttatctaccgagctgacaagtaaaagacatgagttgagagacttagaagagcaatttcaagaagtgaacagtcaaagaagcgatataggtagagagttaacacatctcaccgaacaattaaggggagctgaaaagagacttctgactaaagacaaattggatatgttggtgagtgatgccagacagaatgggagatcttatagacttcgtgacgaagctttcgatgtacacaaaagattgcgaaatgaacctgaatacgaagggagatatttcgaggcaccagtgatttcatgtaatgtccccgacataaattatgctgctgctgctgaaaaaatcattgacaacaacacattgtttgcctttactgtcacaaaccagagtgattttgattttctctccaagttctcgcaacaaactaataccaacactcctttgagaatggtgaattcagtagtcaacccaactcacgagtatagcaagcaccaattacgagaattcgggtttgaaggttatttgtcggattatattgttggccctaaagaagttttatcaatgctttacagcacttccaaaattcacactattcctgttagtaaacatcagttatctagtgagcaagtgagaagattaaccaacgtctctgggaatgac

SEQ ID NO: 1709 - DNA, 1446 bp, Candida albicans
  unsure (622): Identity of nucleotide sequences at the above locations are unknown.
tttaagtatgtccttctagcggcgttgtggactactattcaaagatccaaatatggaagtcaacaggcgttttacattacagaaaaaataggcagatcacagtattttggagttcaagggttatcacaagaagccaaagatgccattaacgcagaaatctccaaatttaaggagaagattgagcagaaaaagcgagcctatgagggtcatagaaataatattgatagtttcaatgaacgtttgacggaaattaaacattacattcatgacattaagcggaaacaactggaattacaagagatatcgaaacgtgcaggacaacttcaaaccaagatagagttgaaaaaagaacgagaacagaaattagaaaaggattctaaaagagactattcgctgaaaatccggatgtttgagcaaaagattgatgaaaaatatctagcatctggtgaattatttgcttctttgtcgaattctgttttagagctttgtgaaaaagaaaatcaaatgaagttgaaaaaattggaaattattggctataaaaataaaaaacttacggctgaaagtttactcgatgaattaggagcaagacaggaaaagttgaaaaatgactacaacagatatnaaagagaatacgatgaaattacacaaagtgaggcattcaaagaaatcgaaagacaaaacgaagcgtacaccgatgaagaacgttctagacttgctgatttggcccaggtttatgttgaaaatggcactttcacagaagctactattcgtctgaaaatagatttgttggaggacgagttgtcactcttgacaactgccgatagaggatcaatagatgcgttgaaacagaaattacaggatatacagttagctgagacaaacttacctttgcttcaaaccgagaaggaaaggttagacactaggataaaaggtattcaagaagaatacgaaggagagctaacgctgttggttaacaaaatatcgttggcgtttaataagcgattcacaaaagtggctagtgatggacgagttcaattggcgaaactggaacggtttaaagattggaaattacaaattcttgttaaatttagacaggaatcggaattgaaagttttagatcaccaatctcaatccggaggtgagagagcagtttcgacgatttttttcattatgtcgttacaaggtttaactgatgcaccatttagaattgttgatgaaatcaatcaaggtatggatccaaaaaatgaacagatggcacatcgttatttggtccatactgcttgtcaaaatagcaaatctcagtatttcttggtcacgccaaaattgttaaccggtttatactaccatccagatatggtagtgcattgtatttttacaggaccatatatcactgataacgaggagaaacgtgataatagtatgggtatgttagattttgctgtataa

SEQ ID NO: 1710 - DNA, 1374 bp, Candida albicans
gagaaaatgtcaagttttgctaatttatttggaaagtctacaaaagtggatgaaaatatagagcagttattcaaaaacacaagagatgggccggtttcgaaggatgagcttgtgaagaaacaaagaactgtgataaaaattccaaaggtcactgctcctaaacagcaaaccaatgaaaatgagtctactttgaaccaatctgctgatgaatcagacgaagaagaagaagaatataatgatgaaagtaacgagggtgatgacagcgacgatgccgaacaaactgaacctacatctaaaaatgatgatgaaaatgaaaacttggaagcacaatattttgacaaattgttaagtgaacaaaatgaagagcaagatgaatcaaaggaatcctctgaggcaaaatcttcaaaggttgcagaagaacgcaccaagacaaaagttgccactactgttgatttaaaagaaaaggaattggaaaaagctgatagaactgtatttgttggaaatgttccagcagacgttatcacatcgaaaattattgccaaaaacttcaaaaatttgtttaaacattatgggaaaattgattctatcagatatagatccatttcgtttgatgaacatttgcctagaaaagttgcatttgcaaaaaagaatttacataaatcaagagattcggtaaatgcctatattgtatacaaagagaaacctgcatcaattgctgctaaagaattaaatgccactgtgtttgaagaccatcatctccgagttgatcatgtttcacatccagcacctaaagacaacaaaagaactatttttgttggtaacttggattttgaagaaaaagaagaaactttgtggaaatatttcaatagtaaacttgatcaggatgttgagtctgtaagaattattcgtgattcaaagactaatttgggtaaaggttttgcattggtacaattcaaagacactttatctgtcaacaaagcattattattaaacgacaagccattggaaactggaacccagaaaaaaggtcgtaaattgagaatttcaagagccaaatctaatgctaaaccttccttaatgtcacctaatcattttgataatcaaaagaagaagtttgcagctggtaaatctcaacagaaattaaatgacaatcaaaaaacaaaaattggaagagctcaatcaacattaggtaaagccgatagatctactgtgggaaaagctaaaagaattatcttggaaggtcaaagagccactaaaggagaggccataaagggaataaaaggatcaaagaaaggtaaaaaagtaaagaaaccaagaattagagaaagatcaacaaagtttaaggaagaaagaaaaacaatgaataaagtatag

SEQ ID NO: 1711 - DNA, 2109 bp, Candida albicans
aaaacaatgtccgaggtatccaacaaatcccaagagaataaggaattattatacgctgataccgacgctccaatcgtcgtgttatatgctttaaaacattttgaggcattatcatcgaagaatgctaaaaagtatgctcattatttgtcaagggcatccttcgaaggtacaagggccgtgttaagatctgtttccccagaaagtgaaccaatttttgatatgattttagctatccatggtaaattgggaactccaaagtctgttgaagagtatcaacaaaaattagcaccattgactaagcaagatgttcaacattatttggagtataccttacagtttttggataatgctggaaactataaatcatttggagacaaaaagtttatccctcgtttggaatcagaaactttcgataaattgatcaaaattgtcgacgacgctaaagtttctgaattatatagcaaggtcaaagaagcattattcagcacagaaaagggtttgttgggctatgccgaagctggccacttgtccaattactaccctaacagtgaaactataaccaaacaagaaattgatttggttaatcagttgcttgctgaaaatggtataatgccagaaaataccagagtagagaagaagtctgactcggaattcatagttcatgttgcatcttcggagactactaacaaaacaacttattatccaaaagacaaattgacatcaaaggatgataaaatcacagttactttccaatttggtgaccatcacgagcagtttcaaaagatagttgaaaacttaaccaaggccttaccatatgttgctaatgaaactcaagaaaagttgcttaaatactacattgaatcattttcaactgggtcaatgaatgcacacaagcaatcacagattgaatgggtcaaggatttaaaacctgaagttgagtccaatattggttttattgaaacttatagagacccatcgggagttagaggagaatgggaagggttagttgccatggtgaaccacgaaagaactgccaagtttagtaagttggttgaaaatgccggtacatttattaaggaattaccatgggataaaatatacgaaaaggatacattcaccccacctgatttcacttctttggaagtattaacttttgctggttcaggaataccagcaggtatcaatattccaaactatgatgatgttagattgaactatggattcaagaatgtttctcttggtaatgtgttgtctgccaacccaaagaaccctaaacaaaaggaagttatcacctttattggtgatgatttacaagacgaattcaagaaatggcgtgacgaagcttttgaagtccaagttggtttgcacgaattattaggtcatggaactgggaaattattacaagaaacctccccaggaaaatttaattttgataacaatgatgatagaatcaaatcatggtatggaccaaatgatacttggagttcattgtttggaacaacttctggatcatacgaagaatgtcgtgctgaattggttgccttatatttgattttgaaaaaaccagagcaagtattccctatttttgatattgaaaagaaagatgaacaaaccatagtcaaattcatttcggcattattgatgatcagagctggtttaattggattagaattctgggatccttcttcttctaaatggggacaaccacacatgcaagctcgttttgccatcatgaaacaattgcataaagccaatgtttttaaatttgaatattcaaacccagattattctgatttggaaattgtggttgataaaactaaattgactgacggtactgctgttgatgctttaggtgaattcttatccaatttacatattttcaagagtactggtaatgttaaacaaggattagagtattacttgaacaaatctcaagttgatccagaatatagcagattcagggatgctgtgttgaaacaaaagaaaccaagaaagatggtgattcaagctaatacttttttcaatgaaagcactgatgatatcgatgttgttgaatatgaggagagtgaaataggtatgattcaaagttattacgatagaaacgtttag

SEQ ID NO: 1712 - DNA, 750 bp, Candida albicans
ctcaaccacttaatttaccaccacgtccaactaaagataatctcaccaaggcaagaacaatctccaataatttacaacaacaacaacagcaacagcaaaacttacaagaacattatgacactttggatggaaatcccgataatcttaatgccattgaaggagaagagatttttccatcaacaaataattatgttgatgatgaagaatttgaacaagaaggaatgcccagaagccagaaaacccacccaccatgttgttgatgacaacgatgacgatgatgggttttatgatataactggagaaccagtcattgttcaaccaccattagtaagagcaaaatcagtgaaaaattccattaaacgtccaagtagacatacaaaatcatctaaagataaacataaccataattctaatgattctgaaaatcatcataatgggaaaacacatcatggtagtagtaatagtaaaaaacatcgtaataataaaaaatcaagagggactaatggtggtggtggtttgaaaccatttagttatactacattaatatcattattagaaagtatgaatggaacaataattggtgaagaatttaatcaattaaatatccccataaaggaaaaacaattgattgaaaaaattattgattcattaagtagattaacttcagatatgatattagatcaacaacgttatgaggttggtattgatcgattagaaaaatgtttaagagtattagaaggatttatgtga

SEQ ID NO: 1713 - DNA, 474 bp, Candida albicans
aaaacaatgttaagtaagtcctatcgtgctatctcgaagagatcattttctcaatctctggttgtttttgctaattatggaaagccacaaaaccctccaatagatacagaaatcaagttaaaaattcaaccaattgtcagaactggtgagactatcgaagttaaaagagctagattattgtaccaatcacgaaagagaggtattttggaaagtgatttgctattgagtagatttgccgataaatatttgaaaaccatgaccatggaagagttggacgaatatgacaaattactcgatgaagcggattgggatatctactattgggcaaccaaaaactacaagattactccactacctgataaatggaaggattcaaagattttaaaagaaatccagaaaattgctaataatgatgaaaaagttatcatgagaatgcctgaattgaaattagaacctgaatccaacaccaaatga

SEQ ID NO: 1714 - DNA, 885 bp, Candida albicans
cttcacatctacagattgaattcaaatatggcaaaattatctcaaaattggaagaaattaagttctaaaatacaggataaacctaagaatggttcagtgaaaaaacctactttaaaaggcaagatctccaagaaagttaaagcttcaatatcggaaaaattatcaaccaccaacaataccaccacgactactacaaccaccacatccaccaccgatgttgttcctatagcatcctcaaccaaacctactgcgacaccactagaatatactctctggacacaaaatcacaccataaatgtatcacatataccgaaaacccctaagccattaccgttatctaggaatgatagtaggaaattagatccaggtaaatatgtagccatagattgtgaatttgtgggaataggtaaagatggagaagaatcggcattagcaagaatatcaattataaattattatggagttgtactattagatacttacgttcgaccacaagaaagagtaactgattggagaacttgggttagtggtattcaaagttatcatatgcaagatgctatagattttaaaactgctcaattgaaaactatggaattaattaataataaaatattagtgggtcatgcagtgaataatgatttggatatattatttttatctcatcctaaatcaatgattagagatacttgtaaattcccaaaatttagagaaattgctggtgggaaatcaccaagtttgaaaaaattgattaaacattttattcaagttgatatacaaattggtcaacattcttctgttgaagatgctagagcaacaatgttacttttcagattatttaaaagggaaatcgaacaatccatgcgtaatagaaataaacgacaatga

SEQ ID NO: 1715 - DNA, 861 bp, Candida albicans
gtgataatcaaaattgtagaaaatttcccatttcagcaacagaagcaaccacaacgacaactacaggtacaggaaaaagagatacggtcatcacaaaaattgttatctagtagaggattagataatcgaatcaaagaaatggaagatttatttgagcaatatcaaacttcggatacgttagacaattggtgtgaagttgaaatcaaatcagagaagttattagtcaccataaaagaatcttcttatttgaatgttgaagtatattatgatgaattaatatctctgtatccatttttggatgttaatcatagtgataatctttcaagatttactggtaaaaccaaaccaaatgttagcaatgacgatagattttatcttggtattattatgttaaattcaatttttagaggttatgcattatacgaacaagaatttgattttatattaagagaagaattgaaaaatcttaaacaaagcaataatccaatcataccttcaaatggtgggaatagtaaaatgttgaaatattttgggaaaaaatcgtcatcacttataaagaattcaacttcatcaaatcaatcatcaccagcaacatcaactaatactagtattgtggatgtaccaattgaaaaatccactagcaatataggtgataattctaataatggtacatcaagtttatatacaatagtgaatgaatttatcaatactccagaagatgtttatgaaaattcagttaattttgattatggtgatactataatgaaattattacaaatcaataaaaaaatatattgggataaatataatgtaccagtaaatatcttcaccacggggctcgaaggttccgcgatagggtaa

SEQ ID NO: 1716 - DNA, 789 bp, Candida albicans
tggcggatcttccaggccgtggtgaagacatcgattttaggagttgatgaaataactacatcaatatcaaaaaccaataaagaaaccaataatggaattgcagatttaagatattatccaataattcgtggtgatattcatttccctaaagatttattgattactatatttgaatattcatcagatttaggaaattatcgtgatttattttcatttgaatatcaagatctcctaaatttaagtcaccatactaataacaattttaatgattcttcaaccaacaacacgataacattcaatacgtcttcttcttcttcttctttttctttttcttcttcttctttgccataccaattgattcaagatttacgattaatggtacctaaatggattggtcaaccaatattatttaataaacatccaataaaggaatcccccaaaataacatttcaattaaccgaagttgattataatcaattaccgtcatatttaaaaattggtgggaaatcaaataaaaaaattaaaaaattacctgaattagaatcatcaattaaattaacatctcataatatgttaagagtactgaaaattttaaattatttagtggaaaaatttgctaatactactaaagaaatgaaagataaaaatttaattcccagtgattggttagtattacaatgtaaaggtcaagaattaaataatgatttaactttacaaactataaaaaccaagatttggaaaagtagtagtgatattgaattacaatttagacgtaaatatgataaataa

SEQ ID NO: 1717 - DNA, 183 bp, Candida albicans
  unsure (26): Identity of nucleotide sequences at the above locations are unknown.
acattggattttccagcccggcgggngaagaataaatatatagagatgaatggtagacatgttttagtgactagtcatgtttatgaattgctttgtaaatggtttgaaaatgatggtgactgggaaacagctttcaataaagtgttgccaccaagaaagatcaaactgaaaagtccttcataa

SEQ ID NO: 1718 - DNA, 678 bp, Candida albicans
  unsure (8),(68): Identity of nucleotide sequences at the above locations are unknown.
atgacagnacaaactttggaagccacggtggttaataattcacctgctcccacgattcctaaaattanacgagaaaaaccaactccggaagaaattgaagaacgaagaaaattaaagcaactcgaagtagttccagaagggttttcaagaaaacaatggaaacgagaattgaaaaaacaaagatggcaagatacaaaacaagaataccttgaagttcaacgagaaaagaaacgacttgcacgtcaaagaaaacgggaaagattgaaggatcttgatgaaaatgatgaattacgtaaagctcaacccatcccatctcgacaaatatcaactaataatgtatcagttattattgattgcgatttcgatgaattgatgcatgaaaaggagattgtttctctttcaaaccaaatcaaagcgtgttattcagccatgagacattgtacatataaactcccaatacaaattacatcgttcaacaaacgactcaagcagaggtttgaagcacaattacatgattaccatctttggcaaggcaacatatcttttactgatcgatctttgaccgaatatgttactggtgcccctaattctgaatcaaaagataatgacggtaacagtaacagtaacaccactaattcaacagacacggtcttcaccacgggctggaaggaaccgcca

SEQ ID NO: 1719 - DNA, 1095 bp, Candida albicans
ccatccagcatgagaaaaggagcttattggagcaatattgatagttcaactaatcagtatattgataatgatgatattagtaaattattacaaaaagatacaccaacaactgatttcccattgtttattcattttgaacatttcaaatcacaatttgttactattcaattagtaatgtcatcgaaaacaatcgatggcaatcttttaagttatatgtcagtaatggaagaaattttttccttgtcaatagaaatacctaaagaagatggtagtgttgaatatattccttatgagaaagttattgctgatattaatagagatttaattgaacatcaattggataatggatttgatgatcaatttttagagttaataactgttaaaattaaattcgaaattaaaaattatcaaaaagccattaattggttatataatataactaatcatgttaaattcgagatgaatcgtattagaataattattgaaaaaataatcaattcattacctgaaaagaaacgtaatgatgaattaatgatgcattcatcacaatgtcgtcatttatttaatgaaaactcattgagaaaagctcaagattcgatatacactgagtcattttataagaatttattagaaaaaattgacaatcaagataatggatttgaagaaattgaaaaagatttaaataaatttaagcaacaattatttcaattggataatattaaagtgataattttaggtgatgttactaaattaaaaaatccagtgagtagttggaatcgatttataaaccctccaccaccacgacctaccactactaaaacttcttccaaaattatcccattcaaagatttacccaaatcttatcaatatcgatcatcattaggtgaatcctgtcatggagaagcatttgttgttaatatccctagtgctgattctactcatttaacaagtataaccaaaattcctcatggtaattatcttgatgaagatattttccgaattgctcttgccacagaacttttaactgttatggaagggacaattttgggaaaaccaataaaaggtgccggggttaacttatgggaattcatatga

SEQ ID NO: 1720 - DNA, 636 bp, Candida albicans
aagaatatgcatagagaatttccgccccaaaatttcatttgcatttttacaatttggttgcttctttattcttgttttttttttctttggctgggaaaatttttttttacaaccctaaataaaagatttcttatattaataaccactatccaccaccattgccagtcgcccataatttcattattcaatcgcttaataggaaagaaattgttggatggagttactcatattacaatgacgaaatttaattcaccatttattaaacaaacttcatttgaagttgattatgctcccactcatatcaccaaatggaaatctcaaagaactggattacaattaacttatattaatcaaccatctcccatagttaatggatattttgctgttgctacagaaatttttgatagttctggtgcaccacatactttggaacatttaatattcatgggatcaaaaaagtttccttataaaggattattggataatttaggtaatagattatattcatcaacaaatgcttggacagcagtagatcaaaccgtgtatactttgagaactgctggttgggaaggtttcaaaacattattaccgatatatcttgatcatttaattaatccaacattaacggcatcttga

SEQ ID NO: 1721 - DNA, 798 bp, Candida albicans
tttaacaatgaattgctttcatcaaccaatatggggacttttaaacgaccatttgttgattctaaacatgatgagccactcgaggaagtaattgttaaagaagttgaatttccggaaaatgatgaaaccattggtgaactatcaatttcttggattggaccagtgtgtaatgatacattaactaatcttgccgttgatatggtgggtgcatatttctttgatagtcgtatttcaattttcaataaaaatttgattgaaattgaacatccattagccactgaagtttactacgatactgatgacttttaccgtaccgcattaaatttcaattttggcggtgtccccacggaaaatttacaagaattagatactaaaattaaacaattacttaaagagcaaaccacccctaataaaattgaattagaatatatgaaacaaataatagaacaacagaaattgaaatttattgctaatgttgaaaattctgcttcacttttttctgaaatggccacattagaatttatttatggtgccactgatggatcagatttatctaaatggactaaagatttaaaagaatttgaaattttaatggattggacactggaacaatggagccaattaattgatacttttttcgttcaaaataaatcagcaacaattttgggtaaaccatcatcaaaattgaatgaatcaatgaaattacaaaataaacaaattttagaagatattaaaaccaagtatggtgaagcaaaattggcagatttacaattgaacttagaagctgcccaatcttaa

SEQ ID NO: 1722 - DNA, 594 bp, Candida albicans
tccactaactcggtccggcaggccgtggtgaagacatctgttttgccaagtgaatttcttaaactatatccgtatcgtttaagattctattcaaccaatgatctgttttctaaagatgaaatcgacaaatcaaagaaatggctagaatccttcacacacacccaaattcctacacacttatttgatatttcatatagtagatcatcagggcccggtgggcaaaaagtcaataatacatcgtcaaaggcaacggtatcactacagccggggttgtggttggaccctcgcatttgcttttggattcctcaaccaattcaagcacaactaaaaagcaagggcatacgctatgagaccaaaggaggtgggttgttaatacaaagtgacactagtcgtaatagggaacacaataccgagctatgttttcaaagacttgtagaagaaatcaaatcaaaagtatactttgcaagtgaagtaagtcaagaggataaagaaaaatggcaagaattggaagaggactataaggaacgtaaaaaatttaacaaaaaaaagcaatccgataagaaaaaaaacagatcaaagaaatttgattggtaa

SEQ ID NO: 1723 - DNA, 1425 bp, Candida albicans
tataaaatggtgaaatcaaatctggaacttctttttttcgatcttgcgacacaaaaaaatctctatgaaaaaatataccatgcgatggacctgagcttggccaaccctataatgaaagactaccttatacaccttgctctgacatttcctaagtttaggatagcggagttagaagcattagcagatttatacaatatagatgtggatttatcaagtcataatgaagattctacatttttagtggtttccttggaaaacgatgagcaagcccgtcaattgatttcaagatccgttatgtcctttggaatttacgagttgtggggttatggggagacttacgataagcttcatgaagatgttcgagcaaagtcagctgacaagtttgaaaaatacaaagatgtttcctttaaattcgactttaagaactttcgaggaagacccagcaacaagggaaaagtcaggattatcgagtccttttcatatttgccatttgaaggaaaaatagatttgaaaaatccagatgagatatttacggttgtggaagagtataaatacaacgatagagccaaaagtgaatctccaattcacatctggtttacaagacaacttcaattgagtgagagatcgaacggattggtagaaacttatgacttgaaaaagagaaactacataggaacaacgtcttttgaagccgaactatcgttggttacttgcaatctcgcacaaatagcaccaggcaaaatcacatatgacccattcacaggaactggttcgttcctagtggcagcagcacattttggaggataccctattggatctgatattgacgttagaatgcttaatggtagaggtaatgacaaaaatgtgaaatcaaatttcaaacaatatggtacctctggcaattttattgacgtattgacaatggacttcactcataatgccctccgtaaagattttcaaatagattcaattgtttgtgatccaccatatggtgtcagagagggacttcgtgtgttgggtgctaagaacgaagaaaaagcagctggacgtgaacatgacgtttttgatggggaaattgcatatctaagacgtgaatttattccacctaagaaaccgtatctgttggccaatttattggaagatttgttacagtttgccagtgagagattaccagttggtggtagattagcattttggatgcctacagcaaatgacaattttgaagaaacacaaatacctcagcacgagaggttagaattgttgcattgtttagaacaactgtttaaccaatggtcgagaagattattagtatacgtcaaaagagatgtatcatataagggcataaccagtaacgggttgaaggagaaaaacatccgagatttcagggtaaggtactttaagaggtttattgataaaaatgaataa

SEQ ID NO: 1724 - DNA, 348 bp, Candida albicans
ttgacaatgtgttgtcgccatgtctgttccttagaacaattattaccacaatcaaggaaatatttgcacgaccacgggttcacaaccgtacaatcattcaatgtattgaaaaagttagtgtcatgggcagtggacaaaaaggacgcacaagaaaatggtatacttggtcttaatacacatcaaagagaagaaattgggttgaaagctagaagattaatagatgaatctcgagttcatgctttaaaatctattttgaatgataaatacaaagtggagatattttggtatgttcaaaaagatgtgactctagaaaatgtctgcttatcaatttctagaaggactaagtaa

SEQ ID NO: 1725 - DNA, 936 bp, Candida albicans
  unsure (785): Identity of nucleotide sequences at the above locations are unknown.
ggtgagtatcttgatgcaatttttgctaacaaatcaatttatctaacaacaatgactatactagaaacaaagaaaagaaagcttgatcaaaatgtcttaacctgtgaatatattctacctagaaagaatagaaggtgcaaaatgttacgtaaaaaagatgcaaagtactgttcagaacacttgattcacgatgaaaacttcaatggagaaagaattgcatgtccctttagttctagtcacacagtgtggaaaaaggatttgaaacagcatatgaaaaaatgtaacgatagaccaaaggaaaatactaactcatgttatgaacttgacttcaataagctgctaaacaacgcagagaactttgaattggctaatgaggagaaagaggagaatactgagttgatggaaaagtacattcatgttttgcaaaaaatagagtttgaaccactagagtttaggatacttcatcatgaaggattggaaacaagattgcaagaaaaaaccaaccagaaacaccccatacaacaaaactctataatcgccaacatggatctgatgggtttactcagtaactcatttctttatttggaatttggtgctggtaaaggtgaattgctgagatatttgaatcaatgtatattacaacaaaaaacagaatgttcatgcacttacggttttggattaattgatagaggtaaaaacagattaaaagccgacagcaagatcatttctgattctgaaaccttacaaactaagccacaaataaaaggaagcaagatagatattanagacttgaatttggataaatttctagttgatctaaaaattgataaagttgttgctatttccaagcatttatgcggagcagcaactgatctcacgttgaaactgattttaaattcgacactattgctgaatgatcaatttggagtgccttga

SEQ ID NO: 1726 - DNA, 936 bp, Candida albicans
ttaaactcaaataattatatatatatatatatagagagagaaacgatcatgtcaacgaataacaccactacaaacaatgaagatctaatatcctcattatatccaccaccaccgccatactataaatttttcaccaaagataatttacaaaaactttccacgtggcaagaaaacaatcaaacaacaacagtatcctcagaggttaaattagaagaagaaaatactgatcctgattctaataatctggaagaaaattctatacctccaggagaattaagatttttaataccgccaaaacaacctgaaggtccacaatatcgaggatatggtaatatttggttatttgaagataaattgcccaatttaaaagattctcaatgggaacaattatataatacttccacttccacttccacttccacttccaccgccaacaccaacatcatcaccaatactgacactgatatcaatgggaatcaagaagtcgatgccggcgattctacgggcgatgaaaatttaacttcggaaacaaaaattaaagaattacacaaattaatggattcattattattaaattttttagaattaattggaatattaagtattgatccaataaaatatgataaaaaaattcatgatataaatttaattttaattaatattaatcatttattaaatacttatcgacctcatcaaagtcgagaaagtttaattatgttattgaaaaatcaaattgattataaatttttagaaatcgatcaaattaataaaaaatgtcttgatattaaatccaaaattaaaaatttaattaatgaacgaataacagtggtaagtgatggtacaacaacaaatacaacaacaacaacaaaaacaacaggacttggtgatgatgattcaattgataaaaaggaacaattgaaacaagatatcattaat

SEQ ID NO: 1727 - DNA, 1593 bp, Candida albicans
tccatgactagcacaccgaaattagatgctaatcaattagcaagacaacggaagaaattggaaaaagaccgaaggaagaaagtttatgatgatcaacaagttcaaggtaccaacaactcatcaatagtttcgaaacgtagtgtggaaaagttatacactcaagttttgcaacctgaactaggagaatggtttcaatattttgtccccaagggtaaaagacgatcaccagcaataaaccgtggctattggatcagaatggaactgattcgacaaatggttataaggataattaaagccaatagtcctaatgtaaggataaatgttgttaatttagggtgtggatttgatcccttggcatttcaattattatcacttttcaagaatcaatataatttaaactttattgacattgactatccagatttagtcaacaataactataatatgattcaacaatcagatgaaattaaacagcttatacgtgatccaggtatcaaatccactgatttatttgtgatggaaacggataattatcaattagttggatgtgacttgaaaaatttggcatattataaagaaatactaccgaaattagtatcacgtaatgttgatccacaccctacatcaatcaatatatttattgctgaagtttcattggcatacatgaaaccccaatttgctaatccggtaattgaaatatccagccaagtaaacaatagtcattttttaatacttgaacaaattatgcctgatggtgcaaccaatgcctttgctacaaaaatgttgtatcatttccagcatttaagaagtcctattcaatgtgtggaaacgtacccgactgaaaaactacaactacaacgatttaaacggtattataagcatgcggagattaagaacttgtatggaaattggaagtttttgattgactatcaaatgcagaagaatatctctacaatcgaagaatttgacgagtgggaagagtttattattttttgtcaacattatgtgattgtacatgctacacatatggaccaattgatatatgatgatgaaagtagtgaggaacaaaagaatgaaaaagctttctcggaaatgagtttagattcctcggttgcaatttctcatgatgataggtttaatgatgaacaattgcagttaaagtttccggctattgcttcttttaaagataaaatttacgttaatggtgggttaaagcaaactcgaaatgacgaaaatttggaaattgatttacaaactggggtaattaccaaattggatcaaactgagaatttaccaacagcaaggatgtgtcatacattaactaatttaggcgagaaccttgttttaattgggggaagatcccgaccaggggtatttttcaaagatgtatatatgtttgacactgctaagaaatggacaagattagccgatttaccagttggtcgttcaagacatgcaaccgtgaagatcagtgaccacgaagttttaatatttggaggactagacgcgtcttcatcaactactggagatgaattgtttctcctatgcaataccaatactaattcttacactcctgtcaagcctattgggtga

SEQ ID NO: 1728 - DNA, 366 bp, Candida albicans
agagagagaaaagaaaaaatatcagcaaagaaaaaaaaaatattgcaccaaactgaaccccatctcatcatgtactttactaaacatatacatatatcagtcatgtcggatacaataatattacctggagacaaactccttatagatgaagatatttttactgtgaaaaccaccattggacctggaatttacaaaaagccaaagactcaagaattaattccatcagcagcaggaacattacattatgaacgagcaaaatcatcatcacagcaactaatctatattgaatcgaattcgaagagatatattcctcataccaatgattatgccattggaataattactggagcaataagtcttgcccca

SEQ ID NO: 1729 - DNA, 1968 bp, Candida albicans
  unsure (1190),(1352): Identity of nucleotide sequences at the above locations are unknown.
ataattagaatcgccaaatatggaatcatcaaatcacccttagaatttcatactaaacctttacaattatattattttgcttatgtgactatatctactactgattctgaatttaataaattaaagaaatctttgaatggagttttatttatggggatgaaattgattatttctttagctaaacccaattatttagaaagatggaaaaaatcaaattccaaagacaaagacaaggaaggaggacgtagtaataataatcaaattaaacaacttgaacaattacgtcgtgataaaattgttgaatctagattagaaaaaatccaagaatataaaacaaattatccaactaataaattcacttcaaatttaattacttgttataatgctggatttaatcaaccagaaatatctattctggaacatacaacaaacaacatttcagcaaacacgaaaaatccaccacctaaacatcgattaattggatcaaaatcatatggtgcattaactcaaccaaataaattcaatcaaaatagatttttatatcgatcaggtaaagggattgttataagaggagttcatcgtaaaactcccagactgaatttaaaattaaaacaacaaactttaagaattttaattaatggagaattgaaaatttttaaaaattataaaactaaattatgggggattgaaaaaaataaaactattagagatttgacttggaaatatattaatggtgaatggagatctggtgatgatcatataattgaaaaagttacatgtggtatatcttctggacaacaagcagaaaattatagtaaagataatattataatagataaagaagacaatagtggtaataagttatctagtatcgataatgataatgacaatgacaatgacaaggaagaaattgacaagaataaatctatattagcatcaatgtttgattcatacgattttgataaaccaatagaattagaagagactggaaacgaaattcatggtagtggtggtaaagttgctactgctgctgctgatgatgatgatgatgatgatgatgaaattgaagtagattctaaaggcagaaagaaagcaaaacattacgattatgagattgaagggaaaatatcagaggatgaaccagaagaagaagataatgatgctgaaaaaattaataccgttgatattanatcagctaatcaaattattgaaaattataaacaatcatcaagttttgtgcctactaaagaaacatactatgacgaagatgacgaaagtaatgaaattgaattagatgaatttaataacaattataccactgaagcaattaaaagtaattatgatcaagatcntcccgatttaaacgtggagagggaggataatgatgatgatgaagaagaagaatttattccaacgtttggtgctccaaaaccaaatacaaataatactgaaactttaagagcattatttgatccaactacaagtaacacaactattcaaccaacatcaatagcagataatggatcatttaaacttggtttacaagatgatgatgaagatcttgatactgataaacaattggataatcttaaacaacaagaattatacaaaaaattacaaaagcaacgtcaagaacaacaacaacaacaacaagaagaagaaaccaataatcaacaattattatcaagtaataaaaaatttggattattttggtgtcattttgattcaccatttttatctactcaatcacaatttagtaaattaggtggtggtggtggtaatgggaaaataaaattaccaggtgaagaagaagaagaagtagaaggaaaagatgataaagatcaagatgaagatgaagaatcattatatgaaaaatggttttggagtatgagaggtgatatttcacgtgaatgtaaacgtcgtaaacgtgatttattaagaaccatacgtaaaaagaagaagaattga

SEQ ID NO: 1730 - DNA, 828 bp, Candida albicans
tcacccacatattacatcatgagacaaaagcgtgccaaggcctataagaaacaaatgagtgtgtatgtccacgcattcaaattcagagaaccataccaaataatagtagacaatgaactcatcaccacttgtcaatcagcatcatttgacattaataaagggtttactcgaactatccaagcagaaaataaacccatgattactcaatgttgtatccaagcattatatgacactaagaatcaaccagcaatagatattgctaaatcatttgaacgaagaaaatgtaatcatcgtgaagccatcgatcctagtcaatgtattgaatcaatcgttaatattaaaggacaaaataaacatcgatatatcgttgccagtcaagatttacaattacgtaaaaaattgcggaaaatccctggagtaccattgatttatatgaatcgatcagtgatggttatggaaccgatcagtgatgttagtaatcaatataatatgaattatgaatcgaaaaaattgaccggaggattgaatgatattgaagctgggaaattggaaaagcaaaatgaaggtgaagatggggatggggatgaattggaagttaaaaagaagaaaagaaaaggacctaaagaaccaaacccattaagtgtcaaaaagaagaaaacagataatgcaactgctgccaatactaatcaagaacagaaaaagaaaccaaatagaagaaaaagacatggcaagtcaaaagcagaagagaaggaagaccaagaacaggagcaagtgaacgaagcaacaactaatgaagatgcacaggaggcaataacagctactgaataa

SEQ ID NO: 1731 - DNA, 624 bp, Candida albicans
cagatgaagtacataatagaacatatggaggaaggtttttccgaatgggtgatactagaatatactcaaattataaaagatataggtaaagataaccttattctcacatcattaccgccatcaacaacagagaaagatattcctaagagactccttgaactcggtttgcagtggacaactaaagaatgtgttgacattgatggtggcatagacaaatcaaaagtgtgtttgttggatccagctgcagaaactgacttgactccacaagataaatccaaatttgactactttgtttttggaggaatattagggagtcatccaagaattgatcgtacaggacttttgcgtgaaaaatatgggttcagcggcagaagattgggtagtttacaaatgactactgataccgccataagaactactcaaagaattatcgaaaacggtgtggcatttgaggatattaaattcttagattacccagaaatcaagtataataaatatgaatccacagaaatgccatttcgctacgttactgataatgagggaaatccaattttaccagagggaatgttggaattaattaaaaatgatgcagaacaaagcatcgacgatttgcttattgaatag

SEQ ID NO: 1732 - DNA, 714 bp, Candida albicans
gataatcagcaaattacatttctttttctttatgtgattaaacattcgattataatgaaagtactattagccaccttctcaaatctatctgggtatactactttaagacgttcatggagtctacagtatacatttttgaggttattttccatttcaccagcgtcacgttctgctaaagaaactactacactgcaaacagttaaacataaagttcgatggttttatgcgctggacgttcccatttctaagcccgaatggtacaaatacgagaaagtcaaagagccagaatcttttataccattttcagagtatgattcaaagcaacttgaacgtgaattctcaaaaacagaacgcaatcttgtggaagtaaatgaagacaaattgtttcaagttgatttaaagaattttgagctatcaccaatatactgggatggaccaatttacgaagttcgaagaggcttatggtttaattcagatggaatgcccttgaaggcagaattaactaaagaaatcgaagaagggtttcagagattaaaaccgtacacttatgaaagcgcaaatgaagaacaaataaaaacgaccaaaagtaataaagagaaaatctccacattcaacaaattgaaacaagacacgcaaacagagataaaaattgatttagataagcaaaaggatgttatcagattgagtaacggcgaattagtgttgtacttttaa

SEQ ID NO: 1733 - DNA, 1524 bp, Candida albicans
atacagccagtctctttgttgggagttaatcatattcaacgtgggtattcagaagaactcaaagaatcattttttgacaaactatctaaaaaccctctaccgggaatatctgatgcatttaaagaagattttggttcaataattggaggcaaaaaggattcaaacaagaccaacgaggatgaaatgagtgatgttaatgaattggatgacataaatatgcagaagtatttggagtctgactatgatttagaaacttcaaaatcaaagtccaatcgtgaaattgaccatttagttttctgtattcatggaattggacaagttttgggaactaaatatgaatctgttaacttcacgcatagtataaatgtgttgaggaacacaatgaagggtgtttttgaacaaaatgaggaataccaaaagttggcaaattctaactcagaagagcacgataacactaacaacagaattcaggtcttacccatctcgtggagacatcgtattggtttcaatcctcaacaagaatttaatgctcaactgccctctagattgccaacattatctcagataaacgtcgaaggtattctggctttgcgagatgttgtcggtgacgtagtattggatgttctattgttttaccaacctaggtatttaaaagaaatcatgagtacagtaacttcggaattgaatcgtgtgtacaaactatatcttgaaaagaatccagattttaaagggaaggttcatatcttgggacattctttaggttcagcgattgcgtttgatattttatctaagcaaagtagttcgttggacgggccacttaaaattgataaagacttggctttcgatgttaacagtttatttcttgttgggtctccagttggtatgttcaaattgttggaagagaagaatattgtgggaagagactccaaaagttttgtaccctcacaagatgatactttcgcttcccctaaatgcgtgaatttgtacaacatcttccatccatgcgatccagttgcatatagaatcgagcctttagcttcaccatcatttggaaattataaacccgttgatattcaatttgcagtaaaggggctcaatactcaattcaaggaattgtcaaattttggagacgaaatatcagaaaagatttcatttgcaacaaaatggttgacttccagtaaaagtgatggaactgaaaaaactattgaagaaagagcaaacaaagaaaatgctctcggtgatataattaaaggggttgtaatgtccgatgagactgaccaggatcagaaagggttgaagaaaaaggttattctggggggagctttgtccaaaatgacaagcttaaatatgactggaagaatggattatagcttgcctcttggggtattcgatgtttcattagtatcggctatcagtgcccatatctcctactttgaagatgaaaataccgctggatttattctaaaggaattattggctaacagaagtacccccgtagaagaaactactgttacatcaaagtag

SEQ ID NO: 1734 - DNA, 912 bp, Candida albicans
aaaccaggtactttcgccattgaggatgaacaactgcaacaacaggatgcgtcgaaatcgagagatttccccactgaatcggcaaaagagaccattattaatcgattacgaaacataccacatgaagaactaaaagaaatattaacgaatcagcttgacttggagattcaactaaaacatagagaactaaatatatctgacaatgaaattggcaaaattgaatcacaaatgttaatgctaaggaagttctttgacatacctaatgataaaaaactcaacaatgaacctactgattttaccacaaaatatttcgacatacttcaaaaatcgttaacgtcaacttatgataatttcaagcaactaccggaagctccaccacaactcaaccccagttatttggatggcaacaaaagtggagcatcaccagtttctcaacctgtgcattcatacagaacaagatctacgacatcatcgttgcgtccatcggcgacctcaattgcttcagggatccggaatcctagtttgggatgtttatatcgacgaacagatggggttgttgtaaggttaacttgccccaattgtcaaagaagtaatttttcatcagcacaaggctttttaaatcatagtcgaatagcacattcaaaagaatatacctcacaagatgcagcagcattgaaatgtggtgacatattgcccgagattaaacaggatcttaccggtgaagcaagtataaaaatgttagtggagaggggacttgatccaactagaaacttgaatgttaatgagtttttgttcggaagaataaatactgcaacaacatctacaggagaacaaaatagtgccactgacggatcgtctacaatgaaccttagtagtagtaatgcccgaaaattggaaggggaaaagagataa

SEQ ID NO: 1735 - DNA, 981 bp, Candida albicans
tcaataatggctaagaaatcagaagaattaaacgtggtatcatctgaaccacttgattcaattgatgattcctccaagaaggatactactgtttcaactgatgataaagaatctacaactacgtcagaagacaacaaacaagaaaagactgaagaatcgaaaccagaagaaaagaaagaagaatccaaaccgacagatactacttcagaaactaaaccagaaaccaagtccgaggctaaaattgaggctaagactgaacctaaaaaagatcgtaagtctgtatcttttaaaaaggaaattgattcaactgaagaagttccaattaacgaagatgaacaagatgaatcagtgccaccaccacagccgccaagaccaaaggatccaactcaagaaatcatcgacgatatgaaacaagctttccccaacattgaagagaaatacattattgccactttgattgcatctcaaggaaaccccgatccagctttcaatgctttgttatatatttctgaccctacatttaagcctgaaataccagtctataaaccaccagctttagcttcatcaacagggccagttggtactggtggtggtggtagaaaccaaaaggaattgactgatgacgagttgttggctagaaagttacaaaaggaatttgaattggaagatgaaagaaacagaagaaatagaagaagatcgtctcatgaaagacagagagttgaacagcaaagacaaagacaacaccgtaggggagatgatgatgacgaattggatgattctcctgatgaatttgaacaaattaaggaaacatttactcaaggacttgaagaagccaaaagtactttgaatgggtgggtaagtaatattgccacacgatttgaaggaaataacgatggtaataaccccccacaaagaagaaatgacaatccaaaactatttggtgcccttggtgggtcatcattcaatgataacaagcgttaa

SEQ ID NO: 1736 - DNA, 744 bp, Candida albicans
gttcatagttgtcctttgttttatataacttttctttcaacaaagttcactcttactactactactactactactactatggatcttgcatcaatcacagaatggactcctacaactactccaacttcaactacattatcaaccattgctgccacttatgttccagctttacaatcaaaactctctaatgccatcgacacattaacatccaagggatcaaccattgatatagttgattatattagtgtctcacgaataatccgtggtgctcaggcatcattatcaatcatttctgcgcaacaagtactcgctactgccactaacattaacaccgccaccgccaccgccactgatgtacaattacaagcgcaaatacaagcgcaagcgcaagcaatacaaatcatttggcaagcaacagaaaatcttctagatttggcatgggaaatgaatgtttatgctattccaaaattaaatcgtgtggctaatatcctattcttagtgattttcgctataacctttgtcatgacttgtttaatgtggattaaatctcgatattggtggtttaatgtatcttggacttgtggtactgcattagaatttttagggtttttaggtcgggtattatcatttgatgatatgacaaaatttgattattatttattacaattaataactcttacattatcaccagttttcttgatggcaggaatttattttttattgtggtgcaattggtatctcact

SEQ ID NO: 1737 - DNA, 1056 bp, Candida albicans
aaaaaagacaggctcatgaatactatggatcttgcggtaattacagaatggactcctacctcaactgcaacttcaacaactctatccaccattgctgcaacttatgccccagctttacaatcaaaaatatccggtgccgtccatacattaacatctaagggatcgaccattgcaaatatggattacattagtgcctcccgaataatccgtggtgctcaggcatcattatcaatcatttctgctgagcacgtactcgaaactgccactgccaccgatgtacaagcacaagcaacacagatcatctggcaagcaaccgagaatcttttagatttagcatgggaagaaaatgtttatgatatacctcgattaaatcgtacggctaatatattatttttagtgttatttgctataacatttgtcattgcttgtttaatgtggattaaatcccgatattggtggtttaacgtggcttggacttgtggtacggcattagaatttctcggatatttgggtcgagtgttgtcttttagtgatatgaaaaagtttgattactatcttttacaattgattgcccttacattatccccagttttcctaatggcagggatttatttcctatttggtcaattagtagttattcatggtcggcaatattcatggttaaaaccacttcattattcatatattttcattacttgtgatgtggtttcattagtgattcaagcagttggaggtggtatgactgcaattgctgctcaagagtacgatgatgttgacccaggaacttataccatgattgctggtatcgccttccaagtgttttccatgtcggtgtttttattatgttggcttgtcttttgttggaatatctatttccgtgacatatcagtcaacgaaagcaaaccaagtccataccaaaagaaatcttttatgacatttattaaattgttactaaatggtgatgatgccaatatgtacaagttaaaagtgttggatatatattacaacctgagctacaaagatttttttaaacagcagccactagcaggtattatg

SEQ ID NO: 1738 - DNA, 1362 bp, Candida albicans
gaaacttttcttggtgtaccagttcattcccacccttcaactatgagtgaaatcttgaattatttatcttcgtggactccaacttccacacatacatccactacattatcgtcaataggtacatcccatgtttcaaaactttcccaaactgttgcctcagtgatttctcaagccaccactgaaacagattggtataatttacggtcattgtcacaagcatatcgtggtgctcaagcttcattaacaatcatttcggcagaaaaagtgttagctaccgctactgatagtcaagtacagtcaagagccacacaagcgatttttgaagctactttaaatcttaaagatttatctatggaacaaaacatttatggttatgaattaaatcgtgcagcaaatatcatatatttagttgtttatgcaataatttttggttatacccttttaatgtgcattaaatcaaaatactggtggtataatgtgacatttgtctgtggatatggtttagagtttgttgggttcttaggacgagtgttgtcatttaatgatacttccaatatgagtcattatataatgcagtctgttgctttaaccatcgcacctgcattcatcatggcaggtgtatactttttatttgggcaattggtggttattcacgggagacaatattcagttttgaagccaatgtggtattcttattttttcatcactgccgacgtggtttcattattgatccaagctgctggtggaggtattgcttctgtggcgtcaagtaaccataaagatagttcagtcgggactaacattatgattgctggtattgctgctcaagttgtggcgatgacaatattcttggtgttttggtttgagtttcttaatcgcttatactttaagaattctcgttctgatttgattgtcgattgtccctatggtcgacgttcgataagcaattattttaaattattgttgaatgtcaaatcggtaagaggtcatcgtcatactcatttggaaaaatactataatgagaaatttgctagtattcgacaaataccattattcgattatatggtgcttgccatgaccattgctgtcattgttgtttatattcgttgtgtctatagagtggcagaattggctgaaggatggggtggatatttgttcacgcatgaaccatatctcatgattttggatgcagcaatgattgctattgccggtctaattttcattccattccatccagtttgggtatttggtaaaaacaatattgtcaagttggcaaccatcaagaagaatcttgatgaaaatgaaaaaaatcaggacgttgaatataatggtcttcacccacggggctggaaggtcccgcgc

SEQ ID NO: 1739 - DNA, 1506 bp, Candida albicans
  unsure (851),(922),(951),(1032): Identity of nucleotide sequences at the above locations are unknown.
tttaccctaattatggacggagtctctcttttaaatcaatatctaccatcatggacacctacttccttgccaacttccacaagtattagcaccataaatcctacaaacactgctggtctagcgttgacattacttgagttacagaatgctatacaaacagaaacaaatacaatctccttatattttctttcacgagcagcaagaggggttgctgctagttatactatcatcagtggtcaacagtatttggcaactgccactgccacacaagacttccctgaggtcacgtcagcaatggtgaatgccacattaagtttaaaacaattagaatggaaggctaatttatatgctattaatctttcagtaccatttaatgcattttttgctgccatgtttggagttacgttaatttgccttttgggcattgggttctcaacaaaaacaaagtattttactatttgtttagcttgtggaactatcttggaagttattggctatgttgcaagaactttagcccattattcttggtcggatcccaatttatttttgtgtcagattgttagtttgacggttgccccagcatttattatggctggagtttattatttattatcgcaaatgatcattattcatggagaacagtatgccatattgaaaccaattatggtatcgattatctttatattctgtgatgttgtgagtttatttgttcaagcaagtgggggtgctgctgctgccgtttcattacgactgtttaaagatactgaattaggtacctatattatggttgtggaattggattcccaagtggtatcaaagactttgtatctaaatttccaatttgattttgnttatcgatcatttgtcacagccaattccaatatcaaatattctttcaccacatattgtctgttgcttatcnataccaaaaagggaagactattacgccangacttggaaccattctatgatgttggctacatacatataagacatcggagtttattcaactatatgccgttggttataatnatatctgttggatttatttacatacgatgcatctacagagtgattgaactaagtgaaggctggcgagggtatttgataactcacgaggaatacatttttgcattagatgcattgatggtacttctcacctgtatcacatatgtgtttttccatcctggtttggtgtttggtaagcagatgacagcacaaatatccgtctctgcaaataaaagtgaaagtgctgccgatcatgaaagccattgtggcaattcaaggatgtataactattctaagaaccattctaactcaccacagagttctcatgatgaaaagttcataatggatcagagacaaaagtattacaatccctattttttaccaacaaaattttctcaatacaactcccactcgtgcccttcttctgaaacatatacgtattcctcatataattcaaaactagaaactaaatcagagagttcatggcaaaatagctaa

SEQ ID NO: 1740 - DNA, 1272 bp, Candida albicans
gcaataatggccaagagaacattaaggttagcaaaagctgctaaggccaaaaaacaaaagaaagaacaagaacatcaagaaatttctgccagcccagacgaggaatcatcttcatcaaaccaattgactattgagttaccagaagaaatcgatgcaaatgatgaaatttctcaattaaaagggttgcataagacctacttacaatcggaaagagacaatgagttacttgtgaacggtataattcatgaatgtgacagattattgcgtgaaaatgattcagagaataaacaaccactcccagctgtcttccacgctatttacgcaattgctttagctgaactaagtaaattccatactgaagaattggataaagtcaaggaattttttatagcagctttggaaagagttgaactgggcttggaaaaaaatcccaatgatattaacttactagttgccaaaaccaaaatattacttgatcaaatcctgttgcaatatattgccccattaactttggaatctgacgtaaaagaattagataaggaaatcgatgaattgttagatgccgcattaagtgtttatgaatcagtggaagctagagccaaagaattgaaggactattccatatttgatgactctgagactttggacattttggaagcattagatgatatactagacattgtcgataattttggtaaggaaaaccaaggtgacgatggctctgatgaagacgacgaagaagatgacgacgaagaagagaaatcggttgaattggcagaaactcatcccttgtacaaaattaagaatagtgacaaatacgatcaatggtggagagaccatactcacttgtacttggataatttggaaaaattagagaatggatcgcccgaattaaaaagagaagtctgtcatagattgggacaatcttatttacaagaatctgaagtaccatatctggtatttaccacattgaaatatgacaatgagtatgatgggattgaagaattggaagggttgacagaaaaagaagcccaaaagatttctcaagaattgattaccaaggcgttagattacttgaaacaagccaaagatgaagaggatccagaaacatgggttagcatcgccgaagccatgatttcgttagggaacttgtatgaagttgatagtaaagaacaagaagatttgtatttggaagcagaaaagatcttaaaaagggcaaataatgtcaccaatggaaaattccaagaagaattagacaatcttttaccataa

SEQ ID NO: 1741 - DNA, 561 bp, Candida albicans
actatgaaagttactatcagattatataccgaatcatcattttcagtgactatcccagataatgcgactgttgatgatatgaaacaatccattaaagttggcttaccagccgatataacattgccacatgatttcaaagttatctataacggctcaaaattacaaccatattacgatgagttacagtcttttggaatgaaatccgccgaggataactcttacactgttattgtaatgtcggataatgtggatactccaccaataactccacaacagtcagtagaatcactcgcaaaatctagcactaccaccaccaccacaaccaccaccaatgctactatcaaaaagactaaaaagaaaagtaggtgtgccttccacaactgtaattcggcaccattgagaatggtaggaacttgcacccattgccagggtaaattttgtgctaagcacagattattggaagaccatatgtgtacgggattacaatactgcaaagataatgctcatgaaaagaatgccatgaaattacaaagcgagcgtactattgccaacagagtataa

SEQ ID NO: 1742 - DNA, 1413 bp, Candida albicans
attaatggaataatgtctgaaacaaaaaatattgagtctttgatttcggatgctggtccattgattacacagccagctactactttgcagcaatacgccactgcatattataccacaccaggggtgcatagtgagttaaaagatgaatatgctagacaacaattagcaatttggggtgatagtttaaaaattaaacagccaaaacaggaatatattgatagagttgtcaagtttgcgaaattaacaggtgattattctgtgttgtcagtgaacgatttgcacattgttgcgttagcatatgagttggagtgtttgaacaatggagaagacaacttaagaagttttccaggtgaagtcttgaagaatcaacaagctgaaaatgaaaatggctcaaacaaaatgtcaaacataataggggatgacgatgggttcgtagttgccacaaaaagaagaggaggtagaagacaaagagagaaggcagagttaaggaagaaagggttgttgccaacgttttccccaaaaccaaagggtggcctggaaacagaagaacctaatgaactgtcaaatgataaaactatagatgaaacacctcaaacagacttgatcaaaggtgttgatgtgcaagaacaggaatcccaagaagaaccagtatctgaatctaatactgttggtctagatgaaataactgaagaatacaatgaagacgatgatgacggggaatggattactccagaaaatttacaagaggagataataaaagacaaaaatgaacaagtccaagagtctaataccaatggtccgcttattaaagtggctcttgcaactggtgattttgcctgtcaaaatgtggccatgcaaattggtataaagttattgaacgcgatgtcagggaaacagattactcgggttcgtaattacatgtatagatgccatgcttgtttcagattgacgccaatgagtaaagatggtagaccgaaacatttttgtccaaaatgtggtggcaatacattattgagatgtgctgtatctgtcgacaacaagacgggaaaaataactcctcatttaaaacagaactttcagtggatcagacgtggtgaacgatactcgttaccatcaccattgagtaagaaccaaaagaaattacaaggtaacggaggctatcagcataataaagaaaaccgtcacaagtcattgcagacaccattgatattgaatgaagaccagaaggagtatcaacgggcgttaaaaaatgacgagtgggaaagaaaacaacaagataaaatgttacaagaatggattggaggaggcagtgctgacaattttgtttctccttttgggaacacgattagaaactctggtgtcaaagtgggacgcggaagatatgcaaactcttccaaaaagaaaagaaagtag

SEQ ID NO: 1743 - DNA, 903 bp, Candida albicans
agcgtaaacacggtatctttattatcatttcccagaaggatttactatcacaaacttcaagattgttttatgaattacttaacaactatacaactatatgagtcaaagaagaatgttataaatgatatacaactatggtctacaaataaaactttgaaattgcctaccattacttcttgcaaaccaatatcttacattaaatacgcttcattgccattctatctagtatactgttgtccaataattgtatataccgatgatctggatacatctgattatttcaaaactaaattagtggagactccgttgttgtcaaatggaaagagtggtggtgttggtggtggtggtattggtttactttgtaaagtggatgtcaacacttttctagtgttttattacgaagataatgtcaaaatgttggttttaaaattttccaaattcattgaaacattaccacagttggatattccatctatccccaaggatacattactagatttaaaaccatctaaaagaatacgaaccaacacaaaaattattgacaagattatagaaaagaagaagcaaagactgaatctgtttatagctaatccaaacactaccaaggtgaatatttctagtggctcactgatattgacaaatcaagaccaaatcaatacggcaattaacaaaataatcttttccgggttgcgaatacggggattgtcatcaaacgttgcttcttctttgaatgataaacttacaattaaagaaatccaccagatgacattcaaggcaacacaatttgcattgagaaaacataactatagttttaacaaacgggaaacaaagaagccactacgattaaacgatctacaagatattattgaaaatctattgcaattatttgttgatattgaatag

SEQ ID NO: 1744 - DNA, 1083 bp, Candida albicans
tatcaatctattctatcttgttcaacaactacaatggaggagtctaatgattatccatcatgttcacttcaaaattcatttatatcaacattagatcatctaccgtgtgatattgtccgatcactctggttaattcaatcatgtaatttaaaaattgataaatataaacaagaattaaatgaattattagagaaatatgcaacaacaacaacaacattaactaatgaggaatcatattttttgaaacgaatagtggaattgaagaaacgaatagaatatttatcaagggaaacgattcaagaatcacgatcaatgaataatcaattaattactcataaattgaatttattagaagaaatgaatcaattaaagaaaattgaaattagtaaacataatttaattgatgatattgagatgaaggaattaagacaacaattgaaaactcattataatgaacatccattagtttctcaaatggaagctgttcaagaacaaaaagatttgataataagttccaatgataagagtcagaccaatgacaaaaatggtggcagtagtgatagcagtagtaatacgaatggtattttgaagaataaaattaaagatgaaccggaaaaatcaaaacttaaattaatattaagaatccctaaacaagataaagtcattaaacctaaaaataagaagattgtcaagaaggtacaaaagaaacctactgaaagaaatacagtaattagcaaagataataaaaagtcaaaaactttaaggaagaaagttccacaattaatagaattgaaagaagaaccagagaaagaagaggaacaagaagatactacactttattgtttttgtaaacaaccatcttttggtaatatgatttcttgtgataatgaaagttcatgtccaaatggagaatggtttcattataaatgtgttggaatattaaatcgagtggtggcattgaaatataccacagggaaagaaagttggtattgttctgagaattgtaaatctatggctttacaagccaaacaatctaaaaaacagaaaaatggaaagagaagaaaacgaagaagtcattggtag

SEQ ID NO: 1745 - DNA, 360 bp, Candida albicans
tcaatcatggaagatacaagtctagtcgacgataaaattaatctagctatactatatttcaaatcacaaaattatgaaaaagcacttagcacctacaatgtattgataaaccaattaaagaatctaccacgatctacgatcaaacaaatacggaaaagttataatctactagaaacccctctagtaggtccagcaatccaccctaaactaggttctttactagaccaaagagcagccacctatgaaaagttaaatcagctagctagtgccttgaaagatgggcgtgaactaatcaagcttgaaccgatcggatgtaaaggctatttacgtactgggaagatattgtatagcctagaataa

SEQ ID NO: 1746 - DNA, 702 bp, Candida albicans
  unsure (681),(697): Identity of nucleotide sequences at the above locations are unknown.
ttaaagtatagaagaacgacaacaatgccaccaaaaaagaaagttaaccaaccagcagataaagccaaagccaaggctaaggccaaatctgctgaggacaaatcttttggtttgaagaataagaacaagtcgaaaaaagtccaacaacaaatcaaccaaatgaaagccggtatcgatggaggattggctaagaagaaagaggccgaagccaagaggaaagccgaagagaagaaggcacaagaagaagcaaaaaaggaagcagcagctttgtttggtattcaacaacaaaaagtcccctttggtgttgatcctaaatcgatattgtgtgaatttttcaaacaaggattatgtacaaaaggtaataaatgtaaattcagtcatgatccaaatgttggacgtaaagttgtcaagaaagatttatacactgatagtagacaagaagaaaaggaaaatgataccatggataattgggatgaagaaaaattaagaaaagtcattttatccaaacatgggaatccaaagactactacagagaaagtttgtaaatttttcattgaagcagttgaaaatggtaaatatggttggttttgggtttgtcctaatggtggtaatgaatgtaaatataaacattctttgcctcctggattcgtcttgaaaactaaagaacagaagaaattgganagactagcggcagaanaatga

SEQ ID NO: 1747 - DNA, 1230 bp, Candida albicans
ctttcacaaacttttattgatttctgcaaaaccatgtcggactcatcatctctagatttgggtttagtcatatattcagcagtcaaaccaatcttcaaaatatatttcataataaccattggtgtttatctagctaaaggaaatattgtatcagtttcaacatgtcgagacatttcggacactgtcgtcacggcaattatgccatgtttgatcttcaataatattgtcagtaatttgaaatcatctgatatcaagaatatagggataattattttcacttcagcattactattcacatttggagggttgttagcatatggaattcatataattactaaatcacccaaaagatggttaggtgggttaatatcggtaggtatttttcctaacattagtgatttacctattgcctatttgcaaacttttgctaaaggtggagtaatcttcacaactgcacagggtgaaaaaggagtggcttatgtttgtatatttttgatggctatggtaatgtgccagttttcatttggtttatttaggcttattgagtacgacttccgagatgagttgaaagttgacgaggaacataaagtatgcagtgattcagaaagcagtaccagaaaccaacctgaacacgaaaaagtcaacaattctagtcctgttggtgttggggctgataaatctcggacaacacaaaatggttcaaattctgattctgattccataattagtcaggcagttgcctcagatcgattagatatcgaagaagaagaagaagatcaacataaccaattcctcaagacaagggcagaacaagcccataagtccaggagcggactgtcttctgtccacagtgaagggtcagctgtaagacgccgtacatcaaatgcatctgaactaagtgttccatataccatcactctggtgctttctaggacaagtgatttgcgaagacaaagatctcagaatgtccaggatgtcattaacgagtactctgaatttgatgcattacgaagcaacgaggtacaaaggaccagaactgccacatcagaaattgctgttgaaccctcagtaaaggctgaatccaaagttaaaaattatttgaagcaattgtacaagaatgtcactacaccatcgtctcttttcattaattatatcaatagccattgcaatggctccaccactcaaagcattgtttgtcaactcaaatttctatatgccaaatgctcctga

SEQ ID NO: 1748 - DNA, 645 bp, Candida albicans
tatattcaagatgattcctcattcccaccagggttattgagttacaaattattgccagaattgattaaccaatacaagcaattatccaaatcccccacagcagacccaggacgtcaagaaacactatcaactatacttaatttgacaatcaagtttgggattaaattagaagctgatgaattcaacaagacgataaagccgattattattgatagttttgctcttgcagatagatcaattagactagtgttgttaacacatttacccgactaccaacaatttttaactgaaacagatattcaatacaagatatttaatcaattgataactgggtgtcaagataccaattttatgattagagaaaccacattaaagtcaattacaattgttattgataaaatatcagttaaacaagttaaccaagagctattgaggattttagccaagtctcaaatggatccaaaaccatcaattagagtgaatacagttatcttaatcattaaaatttccctgaaaatttacaaatcctcgaaaaataatgtgttaatcactgcccttgcgaaatcattacgtgatacatatattccatgtcaaatgaccgcattacaaggttttgagtcattgatagacgagtgttcgttatga

SEQ ID NO: 1749 - DNA, 720 bp, Candida albicans
tccattcataataaaaaacgacagctaaacaagtcactctccatatttaatcaacatctatcgccagtgaatttgtggaaaatgacagaagatatattggacaaacaaacatatgttagcagcacaagtctacaatttttgcttcaagagttagtaccgacctccattcgtgtttcgcataaacttttagatccaactgtctcgacgtttgcagaagagtctgaacaaaccagaatagatcaacaactatcaacaattaaaagtgatttccctggtacagtcaatgtcttggattcaccgttgttagacaatgatgaagtcaccattagagtggaatcatatggttacagtttgggattgaaaatagctgaagtgttactatataaaagttcgggcaataaggtggtggatattttggacattatgaaattcgtgtgtcgagacgtttggaaatgtttatataacaaacaaatggataatttaagaaccaaccaccgaggaacatttgttttggttgataacaactacaaattgatttctctgcttaatagttctaaaggtatgcaagagacgttgagcaaggcaaaagtatatttatggttcccctgtggtgtaatacgaggaatattgatgagttttggtattgaagctaatgtttcagctgaaataacccaatttccagctgtagtatttaatatccatacgagcataaataattag

SEQ ID NO: 1750 - DNA, 2697 bp, Candida albicans
  unsure (657),(737): Identity of nucleotide sequences at the above locations are unknown.
attatggaaataactggtctggaagatacattaaaatctccagaaattgaatcaaatgatggaaataaaaaggttggcaacaatctatattcaactacacctagttccttgttcaatgtattgacaggaaaccaaaataccaaaaagaacacaagcacttcaaaaatacgaaaggacaaagaccaactgtatggcggcgatgaaaaagtagtgaatggaaccactgaaaaactagaaaaccgtcctacatctttaacttcgaaggatattttcagaatataccgagagaaagacaaacagaagtacacgcttccagatgatcaagaaccaccggtacatcatcaaccccacgagacacatcaagcttttcccaaggatatgatttgcaactcgttggaaattctggatttcacggccgacattgagtccaaaatatttgctaataagaaatcaaccacagtgaaagacttgtttaacaattttagaccaaagaaagttgttaccattaaattgtcaccccaaatactaaagaatatttctccaaatccttcaaatattaacctttccaaagattcgagtacacttcctgattcaagacctgcatttactgcccaagatatcttacaacgcagaaagcatatattaccggttcatatnacagagaaagcagccacaaaaattgatagccaattgcatatttcagatataggacggaaaatctatggatcaaagcccanatttagtgttcaagatatactaaagcgtgaaagaaatgatcatcaaataataaaaccacaaccagtaccaaggccaacatatttcattactttgaaagtaaattcaaagcatctagctgaaattaaacaatatgacaacccactaataacaaaaggaaacaagagcaataccaagggcaaaacaggtgcttctttatttgctagtatgatgcaggcaagcaaatctgccaccaagttagaatctatgcaacaattgaaaaacaccataatactaccaaaagccttgaaaagggaagagttccatatctatgaaaaagaagttttaaatcctaggaagcttttattggaagaaaggaatagaaatgtccgctgtgatgttgacaccaaaatttttgaatcttttaccgatttattcacgagggaattgacttctagatatcactatcagatcaaagataaaattgacttgagacagtatgcactgtccaaattaccaaacttatcaagatcaccagctcttgagtttgtttttgatatgattggccaacccaagcaaggaatgtggacagagacatttaaaccacaaaaaatgaatcagttactcatacataaacagaacaagaatgatatttataattggatttctaattcttttcttaaactaaaatctcaagcaccaataaagaatatcaaacaaaagataaagcaaaggcgtcaggaatccttcattgtatatgattacgaagacgaggaaactgaagaagaagtttattctccgtttctaatactccaaggatcgtgtggctcaggaaaatctacggccgtgtttactgctatgaatgaattagatgggtttgttcatgaaatcaacactggtcaaaatagaggccgtaaggacatttttgccaatttaaaagaactttgtactacggaagttgtgcgtgatactaaagagttccatagaggagtgattttgcttgaagacgtaaatgttttgtttgaacaagataaaacgttctggctggtagttcaggaagttatcaatatctccaaaagaccaattgttttgacatgcgaggagatttggaatatccctaaaaacttgattgagtttgctcagcatgacgagtccattatttttatggatgattatgtgattctgaaaaacttggttgtcgattatctttggttatgttgcttagtctacaattgtgatgtagcccgggatatccttgtagaaattattgatgataattggaatggacacaatttcgatattcgagggtgtcttatgaattgtcaaattatgtgtcccaatcgacctgaaagtttaactgtggttaccagggtgtctgactcgtcaacgaaaaaagcgtgggaaaacattaatgacgtttcacatctacttgatatcaattcttgttgtgatgtcattggagtaaaatccatttcccagttagcacatacattacaattgaacgaattggatgatgtttactgggtagatgattcccgtaatcatacattaccgtatgagttgaatataggaaagaagttgaatcacaagttggaaggatttgaattggacttttctgtccctgaacgaaaatttttaatgaatgatttgagatatgaagcaaatagattcattggatcgagaatgaagtatttttctaatagtgaattcaggagatcaactagatctggtggtggtgagtctaatgcacacttagatactataggaatccctgatacatcgtttttgaaccatattgcaaatagttcgtttattctcgatttgctcccaatggcaagactttggagtcagttccaaaacaatattgatcagcttgaaaaagaagtcctagcggaaggcaagcctagtattaaaagatttctcagatatcgagacttttgtcataaaactacattagacgccaccatgaatagagatttataa

SEQ ID NO: 1751 - DNA, 837 bp, Candida albicans
aaaccaatggccgcccctacagctataaggaaatccactgaaaagagtggtataaacgagcaaatacaagaaaactctactttacaatccaaccaagcattagatcaaaacaatgatgacgaggacatgttaatcgatacaaatgccattccaactacaacagttgaagaccaagaccaatctgaaccttcaaattctttaactatacaacaaggagaaaccactgagcttcaactagatgaatccggaaaaccaaagttctctgctgcatccaaatccaacatgaaggtcaaattagaaagcagaaaagtggctgtaccacctcatagaatgacaccgttaaagaatgtatggagtaaaatatatccacctttggttgaacatttgaaactacaagttagaatgaacttgaaaactaaaacagtcgagttaagaacaaataaatacactactgatgtgggcgccttacaaaaaggtgctgattttgtcaaggcttttacattgggattcgatgttgatgacgccattgcattattgagattggatgacttgtatattgaaacatttgaaatcaaggatgtcaagactttaactggagatcatttgtctcgtgcgattggtagaattgctggtaaagacggtaaaactaaatttgccatagagaatgctaccagaacaagaatagtgttggctgattccaaaattcatatattaggtgggttcacacatataagaatggcacgtgaggccgttgtgtcgttgattttgggttctccaccagggaaagtttatggtaacttgcgtacagttgccagtagaatgaaagaaagatattaa

SEQ ID NO: 1752 - DNA, 561 bp, Candida albicans
tggtttttaccacaagtgaaaaattggaatattggtaaaatcaattatattatggatactctttataaacatttgatttatttaataaataatttcaatttagaagattcaaccaccatcattaaaaatgaaagatctgtagggattatacctaattcaggatgtcgcatcttacgtgaacaattggaagaaatggtattatcttgttcaagaaaattaaatactgttctaacgtcatcgtcaaattttgccgattccactgaagctctttgtgttgatgatattaaagtttgtgcctttaatggtggtagcgatgtttgggtagatattggtgataaagccttaggggtagaatcacttcaaaaatacatttgtcatgacgaaacagttgatcatgtttgtcctattggtaaatcggaaagtttacatattggtgatcaatttgctagtttgggtgctaatgattttaaagccagattaagtgcttgcacagtatggattgctagtcctagagaaaccgtggccattttagacgatttaattgatttcatagaaggttag

SEQ ID NO: 1753 - DNA, 618 bp, Candida albicans
gtcatttcatctataataataatattttatatttgtttcttgaattataatttatcaaactccgtcttacacacattttcgaatagagcgatccaaaaagacaaccacattttcctgatcatgacatctagatatagagtagaatatgcattaaagagtcatcgtcgtgatgaatttattgaatggatcaagggattattagccacaccatttgttttgcatgctgatgattctcatgctgatgctcaaatcgtggccgaaaattgtcaagctagatattatgaaatctttaaagatgtcgaaagtttagtgaaacaaacgatttttttggatgaattaaatgaacttgatcctaagaagaaatcaattagtcgattacgaactttagtaccgtcattagggaagttcttcaccgaattacctttagctgatgcatttttattagaagatgaacgaagagcgatttccaaaagaagattagttagtccttcgttcaatgatgtgagaatgatacttaatacagcacaaattatggcccttaccaatatctataaacaaactgaatacaacatcaacggcataagttggcagaaccacaacagcaacaacaaaagttga

SEQ ID NO: 1754 - DNA, 495 bp, Candida albicans
ggcgagcgtggtttcttccagccgccgtggtcgaagacgtgtctcaatgaaaccaaagacaaaattattatgatatcatcttcgaaacataaaaaccgttggatagtccccaaaggtggcaatgaattggacgagtctgaattggaaactgctgttagagagacttgggaagaagctggggtagaaggaataatcataaagaaattgccagttgttttggactctagagggagtctagcaccagttattaagggtgaatttgatcctgatgttgctactcctaaatccgaatttcatttttttgaattgcaagtcgatcaattgagtacatcttggccagagatgaagaaaagactaagaaggtggtgtacttattctgaggcaaaacacgagttgctaaaactgaaaagaccagaattagttgatgcattgaacatgtcatctattttaaaagacactattgacgacgaagaccctaaacaagataattattag

SEQ ID NO: 1755 - DNA, 1026 bp, Candida albicans
ttgcgtccaaagctcttaaatcaagtactccctgaacgtgacatgagtgataaacttgcaagaacaattcaaagatttcaagccaaaatcgatagtggttcgttctatgaagcccatcaaacattaagaacaatcaccaacagatatgttaaagcaaaacaatataaagaagctcgtgatttgttataccaggggtccacgattttattaaaaaataaagaatttgcatctgcatctgacttgataaattatttaatccagatttatgacgaagaaggaatcttggtgagtgataaggatgccaagttgaaattgattgatttgatttcgaacttgcctaacaacgatcctagtttgagtgacttggccaaatccagtctcagctggtcaaagaagtctcctggatgtgagaagtttggtgattgcgagttacatcatttatttggttccaagtttctaaagtttgttgaatatggagcttctcaacacgatactgagctggaaaatggcaaagtagttttggatcctgaagaaagagcaaaagtttttgcgatagcagaattgcatttggttttgggtacttttgaaagtgtgccattgtatattaactatttagtaaaatatgcaaaagccaaccctgaagttgatccaggggtatttttgggccgggccatcgtaaactattcttacttgaagaatatcaaatttgtcaaagaagcacaggatatttttttgaaagagatagaagtgacaaataaggaaacactaaaatctgatttccagttttatcaaaactacccggttttgaactttttgcaattattggttattactttacaaaaggagcacacgtcaaatagtcaaaagtttgtcaaattatacgaacaatacaggggcactttgcaacaatacgaacttcttgctcctgtagaatatttgggcaaaatctactttaacgttaatattggtaactccaatcaacaggggaatatgttggctaatattatgagtggcttatttaaatag

SEQ ID NO: 1756 - DNA, 1611 bp, Candida albicans
tttttcaatcacttcacaatgtcttcctcttcttctacccctcaagcaactggtttgcaaatgagtgatagtatcaaatcttccacagatagattgttgtaccgcaaaaatgatattgtcagtgctaagttaagctcggataatggtatttatttatccggacaacctttacaacatcaaccaaaacatgaagaatcgattttggatactttaagtgcatgttataaaacccctgacacaacagaatcagatttcattccatttaagaatatattgaacgtagaatcgattgcaggtagtgtcgacgaagcagatgaagttggcaactccaatttattagagataacctatgctttaccattcctggatttgaatcacgacttgaagattgataaaataaaagttgatatagaaagtggcccggaaatacccccttcccttgctcaatttattttaacagaatcatatgggaaaagtataattcggccctctattttggtattgataaacccgcatggcggccaaggacacgccaaaactatttacaaaaataaaatcttaccaatattacaagcggctcgtgctaatgttacgtattttgaaactaaatatcatggacacgccactgagattgcgcgtgagctagatgtcaatgattatgatataattgtttgttgttctggcgatgggatacctcatgaagttatcaatggcttctatcttcgtccagataaaggtttactggcattcaacaaaattgcagttactcaattaccttgtgggtcagggaacgcgttgagtttgagtacacatggtagtaaaaatgcttcagttgcaactctttatatgttgaaagctcataagacaaaattggatttgatggctattacccaaggtacaggaagtgaaaagataacgaaattgtcatttttaagtcagtgctacggtattattgctgattctgatattggaacagaacatttacgttggttgggtcctatacggtttgaacttggagtgatacaaaaagtgttctcgggggcaaaatatccttgtgacctatttgtgaaatacaagtacgataataattcagagattttgaatcatgtaaatgattacttgagtaataatgatactgaaaacgagttacccattgtcactgaagagaacttgcaaataacgagccctgatttagatcaacctgtccccaatgattggagacatattcctcaagaaatttctcataatttgaacatcttgtatgttggcaaaatgccattcgtgtctgcagatactcagtttttccctgctgctctaccgaacgatggttcaatggacatgattgtcaccgattccaataactcagtgtggaaattgacatcgatattattggcagttgaaagtgggaaacatattgatgatgaaaaagtgcaccatacaaaagttttgagttatcgtttgataccaaacattaaagatgatagcatacactacatatctattgatggcgaagatttcccttttgaaccttttcaagtggagattttgccaggtgtgttgacaggattactacaggatgggaactttgtagaaacatcatttaccaaatag

SEQ ID NO: 1757 - DNA, 1008 bp, Candida albicans
  unsure (874): Identity of nucleotide sequences at the above locations are unknown.
agcaaaactagaaagaaacttatcatattcaacttcatgctaccttttaagaaagccgatagtccatttaaatcaaacccggtatcacgagttggatcttctactcggttgaatcaattgggtaatataaaatcaaatccaactacacctaatgcagcgttatatgtcacttcatcattgaatccactgaaaaatttgcctacaaatgcagctaacgttaaactgagattacaaacacaaaaggatttagatgcatttaagcaattaccaatggttcaaaaagtcaacgaatacgaaagattactcaacgaattatcggaagccgtgtcacaattcaaaaacgatgaactacaagagaaaattggacaaattataacttgtaatgatgttttgaaacaacaaatcgaggacttgaacaaacatagaaactatagctacgaggtagacaagctatcagacagaaataaaatattagaagagaattcaaaatttatattgaaggagttagtgagttatagaaacgaactaaaaaagttaccaaaattacccaaatcggataaaatggttaatcgcaatgttgatgtagatgatattttgaaatatgcttttaaattagccaaatttaccaaggcaccagcaactgtcgccaatatgcctttccaaatacatccaaacaactatgtatggcccgctgaagattcattgagacgcggaatgttagcacaagcatctttacaagcagaagagataatacgacacgaattgggagagacagataaggaaaaccctaatgaagtgaagactgaatccaaagttgatcgtgatgacgacgacgacgatgaaagggaagatgtgggaatatcgaatgaaaatncgagcgatgaacaaagatctaaaccacctgcggctagtgaacatgacacaagtaagagaaaagaggaacaaaatcaacaaccagtggatcttaacttggacttgtttgatcctgacgacgaatactcagattga

SEQ ID NO: 1758 - DNA, 1428 bp, Candida albicans
  unsure (1226): Identity of nucleotide sequences at the above locations are unknown.
ataatgcacccagtattggtgtttataatttacctggctcccgtacttcaagttggcaatatgcaagctgatgcaatttttaaagaagaacttgagaacagagcaagactcagatcaagcgatttaatcaatttgcaaaagcaaaaagacagtatttcacgcgatcttgtggtttcacaggtcgctattgagaaatttaaaaaaaatattggcactttaagtaaagccttgactcaggctgtaagtttaggtaaccatgcggatgttcaaaagttgagacaagctattcaaacacaaaccgaattatccaaagctccaaaaatgaaactaaataaatgtcaggagatactaatcaaaattgaaaccatgatttcactgacaaaaagggagttagaagtgatctaccaacgtgttagaaatgtgggacaccttgctaactcagcttttaatccatatgaggcacaaatagttgcggatagacaaagagttagggtagatgaatcggaaatcaaggatttaattgataatattagaccagatgaggatttagaggaaggattggagccaacacctcccgaattaaaggtgaatttgttgaaacatcagcgcatggggttgacatggatgaaaagaatggaagcatcaaaagccaaaggtggcatattggcagatgatatggggttgggtaagactattcaaacattggcattaatgatggtcagcaagggtagtaatcttattgtggcgcctgtgtcgttattacgtcaatgggtggccgaaattgaatctaagacaaagtcagacgtttttctttcggttggaatatatcatggagatgataaaaagaagatgaaggatttcgacctaatgaaagagtacgatatagtattggtttcatatactacactagttcaagaatggaaaaagcatttttctgaagatttgaaagaacatcaacatgaaagaaactattttccaaatcgatctagaggtggtaagtcttatgtgtcaccgtttttctcgagagagtctcagtttcatcgaataattttagacgaagcacaagcaatcaagaacaagcaagcgttagcatccaaagcaatgacgtacttgagggcccaataccgattttgtttgactggtacgccgatgcagaatggaattgaggaactatatcctctcttacggtttttgaaaatacaaccctattgttctgaagagaaatntagagcggatatattaacgccaatcaaaagcaaaactgacctttacgatgaatatgatgtcaaagaaagtatgaaaaagattcaagttcttttgaagtccatgcttttactgcgaacaagagattcgctaattgatggtgttccaatattgaatttgcctgaaaaaaccgttttgtcagactatgtgactcttgaaaaatga

SEQ ID NO: 1759 - DNA, 1371 bp, Candida albicans
aatcaattaaatatttcaaagaaaatgtttccaggacaaggtagacatacatacggaggacaacagtccaattatagtaatcaacaacagggttacgaccaagggtataaccaaggttacggccaagcttatggccaagaatacaatcaaggatatgacagaccttctggtccaccaccaggccaaggtcaatacaatagaccatcgggtcctccaccaggtccaccaccaggtcaaggacaatataatagaccttctggacctccaccaagtcaacaaggacaatacaatagaccttctggcccaccaccaggtcaatatggaaataatcaaactaggggatcaggaaacgaacaaaattatggtaatatgcatggtagtggtcattattctcgtccaccaactgattcccaatcttttggtgttgagaattacaattatcaatattccaactgtagtggtcggaaaaaggcattgttgatagggatcaattatattggtactaaaaatgaattgaggggtccaatcaatgatgtcaataatgttgaacaatttttattagctaatggttattcaagtgataacattgttaaattgactgatgatcaaagagttcaaagagcaattccaactcgacaaaacattcttgatgccattcaatggttagttaaagatgctcgtcctaatgatgcattgtttttccattattctggccatggtggacaaacagaagatcaacccgatgaatatgggaattatgatgaagatgatggctacgatgaagttatttatccattagattttgaaaccaatgggtttatcattgatgatttgttgcatacaatgatggtgaaaacattgcctcaaggttgtagattgacagcattatttgattcttgtcattctggatcagttttggatttgccttacatgtactcaaccaaaggtgttttgaaagaaccaaatgtaatgaaagaagccggagcagggttattgcaatctgccatggcttatgcaacaggtgatagaagtcgtatgcttctgggtcttggtggggttgtcaaaacatttatgaaccaaggtaaggcagaaaaagctaatgagtattccaaacaaaccaatactgctccttgtgatgctatttctttgagtgggtgtaaagatgatcaaactagtgctgattctaaagaaaatggtactgccactggtgctatgagttatgcatttttgactgttatgagtcaaaatccaaaccaatcttatttgagtttgttgcaaaatatgagagaaattttactggccaaatacagtcaaaaaccacaattatctgcttcccatccaatagacaccaacttgcaatttattttttaa

SEQ ID NO: 1760 - DNA, 837 bp, Candida albicans
ttatcaataatgtcgacttcaccaaaactttcagaaattaccattcctaaaacctcattaatcatatcaaatttaaacaaggaagattttgtcaaaccatcttcttctcaagattcacaatccaccaaattaatttctaaaaacttagcacttgttgatcaaatcaaattgaaagtcttgaattttgaagatgatatcgcatctcatatcagtcattggtcaaatctcccatttttaagtcgagttatagtgattttccaaaacgaaacaacagcaaagaaaatatttgaatttttaactaaagaattggctaaatttgatgatcattattcatatattaaaatccatttacaagagaatcttttacaaaagagtaaatcatcagataatttacatgattgtcaaaatgagaaattaaatgtcactaaaagtttaaacaatttcagaaatttccataatgatcctaaaaatgaattcactagtgaatatgtggaaccagaacctgctaaatttaatgtatataatgatttggctaatttgggaatagatttgtctcaatataatagtgctgaacaactcgaagaattgaaacaactgcaacaagaccaaaaccaagatcaaaaccaaaaagaagttaaaaatagcagggatggtaactcacatctgaataccaactcattgccagtgcaattgggtcgtaggaaatcaactacaaagactttatttaaacctgaattaaagttgaatactactgccaagcctggtctccttaatgaaaaacaaaaagaacaagattttgtatcgtcccctacaatcactttagatgaaacattttga

SEQ ID NO: 1761 - DNA, 321 bp, Candida albicans
cttcaccagtccctgcaaatgacaaagacttcacacttgattatattgccgtgtcattcaatatggaaatcagggcctaatttaggggaaacacgagatgaatggcatttagttgattttcaaattgaaggatatgatcatcttgcatttaaacaacagattctcactagtcttcaacaattgcaacaagatcccgagtcatatctaataatatcaggaggtgaaacaaaattagatgctgggcccatatcggaatcattatcttattatttgttagctagtaaattgtgtcaaaatgatctgtcgatattatcaagatag

SEQ ID NO: 1762 - DNA, 810 bp, Candida albicans
ccaaatccctttgtatcacacactcttgcgatgagctttcgagatgcgtttcaaaaatacatagaccaccctgaacgacacgacattgtgctcttccacgaccaaaacgtgattataatcaaagacatgttccccaagtcgaccagacacttgctagtcattccccgaaaccgccaggtgacgaaaaaccatccgttagatgcattctgcactgattatccagaattcacaggacacgagctctacaatatggtgctggggtatgttgagaaggcaaaggatcttattattgacgagttgttccgctactccaacgtgaatgacaagtcgcagctactggagttcagaaacacgtgcattaaagcaggggtccacagcattccttccttgaacaacctacatgtccatgtcatcactcaagacttccattctccgagaatgaggaataagaaacattacaattcatttaccacaaagttttttgtaccttttgaggagttgaatcctgagttgaacgagagctactgtcgtcgcacctcccaacctttctcagaaacagaactgtcacagaacagcaatagcgactgcaattccaacacacaatacattgtccacgaacgctctacgcaagtaatggagaagctcatcaaaacaacccctttcaaatgcacatcgtgctctaaaacatttggtaacctgatggtcaaactaaaggctcatttacatgaggagtacacgaagaaatatgcaagtttcatcgttcccaacattttaatccctaatggggtttgtgcaccatgcactaaatag

SEQ ID NO: 1763 - DNA, 378 bp, Candida albicans
agaattaatttagcttcaaaatttcctgaattgaaaatatgtgatatcccagcacaaagatgtatagaaaattatcctgaatcaaattgtccaacattaattatatatcatgatacaaatgttgttaaacaatttatcactttgactcaattgggtggtaatgcaacaactttgaaagatgttgaaactgctttagcagatttaaatgtaattggattccatgataaacgattaattattaataatgatgaagatgaggacttggaacaagcaagaaaattaagatttgcaaagaaatctataacagatggaaataggaataatgaaaaagataaagatgatgatgatgatgaagatgatgacgatttttacgattag

SEQ ID NO: 1764 - DNA, 858 bp, Candida albicans
tcaagaccatctatgtcaagaggtaaaacaataagaccgtcgtattacgatgaagaggaatcttcacaagatgaattgagtcacactttaagtaaaggccgttcaaatattggctcacaatcagatgatgaagaaatgtccaaaatatcatttggtgctcttaatcgagcccaatctaaattgaacaaacacaatcaaaaacataaaacacaggaggacaactataagtcttcagaagaagagtttttcgattcaggctcagattcagatggtccaccagaggaaacaagttctaaagatactaaaaagaagaaaaacaaacatgctccatcagaatcctcttccaaaagaccagtttcaaggataagagatatacctggattaccgtctagaaaacaacaaactttgcataccgatattaggtttgatgctgcgtatgggaaagctgatttggccaaggcaagaaaagattatgcctttttagatgaatatcgaaagcaagaaatagcgaatatggaaagtttattaaaagataaaaagagtagattgaatgatgatgaaagagaagaaatcaaactacagttacaatcattaaaatctcgtatggatactttgaaaaatcgtgatttggaaaataatatcttatcaaattataaaaagcaacaaatggaaagtttcaaagaaggtaaagtgaataaaccttattttcttaaacgtagtgataaacgtaagatattacaaaaggccaaatttgattctatgaagcctaaacaaagagaaaaggcaatggaaaggaaaaggaagaagagattgggtaaagaattcagacaattggaattcaaaccaactaatcgttaa

SEQ ID NO: 1765 - DNA, 657 bp, Candida albicans
agacaaatacttataatcttcataaccccaatgtctaaagctttatcttgttacgcatttgaatctttactcttcaaattgaatcttgaatccaataaaatccccttatccaagtattttgaaactttacacgaatcattcaccgcattgccatcacgagcaccactatttataacatggaataaaaatcatcaattacgtggttgtattggtacattttcacccttaccaattgaatcgggagtttctagatatgccttacatgctgcattgcaagatcccagattcttcccaattagcacttctgaagttgaatctttggaggtttctgttacattgttagataatttcgttactatcgataacccactagattgggaaattggtgtcaatggattgaaaatctcgtttcaattaaacaatgaacattattccggcacgtttttgccaagtgtggccgaggaggaaaattgggataaattgactactttgcactatcttttgaagaaagctgattatccagtaagtcagaagaatgtatctcagttttacgaaaaaggtttgaacgagggttggttggagctaaccagatatgatggattgaagaaccgtttagactacaacgagtgtatcaggattagaaatcaagtggaataa

SEQ ID NO: 1766 - DNA, 633 bp, Candida albicans
tgcggatcttccagcgccgtgggtgaagacgaatataaaccagtgacagttgataaaccaataccaaatacttatgatcttggtaatttagcaacatttgatcctaatccattagataatgaaaaattattatccaaagatgaatcaataaaagaagatcatcttcaatcagtaactagagataatgttcaattattgataaatcaaatattatcattaccagtaaagaccactaccgaaactcatggatcttccacaggacaaaactccactatgactttaattcaattaccagaaccaacaacaatattacctagagaaaaacctattccaaaggctaaaccactcactaaatggcaacaatttgctgctagaaagggaattaaaccaaaggctaaagatgggaaaatggtttatgatgaagatactggtgaatgggtacctaaatgggggtataaaggtaagaataaactgattgatgatcaatggttagttgaagttgatgataaagtgaaaaatactgaagatgaattgattgatccaagaactttgaaacgtgctgaaagaaagaaattgattaaaaagaatgaattacaacataaacgaaatttaagaaaccaaggtgctgtttaa

SEQ ID NO: 1767 - DNA, 2433 bp, Candida albicans
  unsure (75): Identity of nucleotide sequences at the above locations are unknown.
cccccaatgaaccatttttcgaaaaaaaatgaattggacttgattaatatttgtgcaagagcttggcacatagantaccccactagagcagtagccttatactcagcagcacaatctgcagatgcattggttgattttcccttagatactgcactgaagaaatcaactcctgtaaacattatagccagtgaaaaattgtttcatttatgtaaacagatggtagaagatgggaacttggattgggatgaaaaaaccatatggtcaattgaagatcaaaatgaatgggtgaatgacttgtctgaatcttatagtcaagtatttaatgcattgaaagaaaaccttcaattgatattcaatgaaactgtgaaacctaaattcggtccttatttgcaattccttggtgattacattgaatcagatgcattattcccattgatggaagagacaaatttacctaaaaaatgggaaaaaaggcttacaaagtcattaatgaaagttgctggaggcagatatggagaataccttgctagtttacctagaaatggttcagtcaatgtgattcacataattaatgtttgtgacagtttaatagccgatatcaagaagctacagaaacgttacaagaatccattattaggatttttaaatgtggcgagaactgttgcttcaatcactacgggaatgtttgctagtgatgctgaagcaactcttaactacattaaaacaatactacaaaacaatgatgaaagaataccttatgccgatgccttggaggtttatcaattgcttaacgaaattagagatattcataatcaagtaacgccagctggctcggtgtttaaatttgatttagagaaattcttttacccttatttggaagcttgggtcaatgaaagtgatgagaaagtacatggtattgttaatgaggcactcaaaaaagataactatgaacccattgatttagatgaagatgataaaagaagcagtcatactatattggatatatttgccattattaagcaatatgtaatgacaattaaaaaacagaattggaatgatgaaaatcagatcaacaatgtttatactgttttattgaaaagtatttccaatggagcattgttctattctgaccaagtttcaaaaaaaataatacaagaattacaacctccggccccagaaccaacagaagaagaaattcctgaatcgaaaaagaattggttgcatgaagttaaaaatgtggtttcaaatattcaaaattttaaaagacctgaacctgaagtggtttacaatttcgaagcaactacttgtgtggcattgaataacttatcagcaatgatgaatcaattaacaaaacttgaagattggattgatgtggaaacactttctgcaacttcttcatcaccaaaacaatatttgagtcatgttttctccattagaattgttcgcggtgaaaatcttcgtgcttcgaaagatgccatgtgggggaaaattaatccttatgtcgccgcagttgatttgaatggtaaaaggttacttacaaggacaagaacaatcgatcataaccctgatcctgaatgggatgaagaatttgaaattaccatcccaccagaacagtcatcacttgatatttcagttgttgtttgggatgatagatttggtcaacatcaattatgtggtaaggcattccttgaattaaaccccagaagatttagtaccagtggtatccctgaagaaatcactttagacctagatttccaagggaaagttgtacttgaagttgccgttgaaagtgaaattttggatgccaaatttgtcatggggagagcttttagagctttaatgagagctcaagaaagatcaattaaattgatagttgagaaattttcaggtttcattcagagttgcttttcacgcgccaatttgaaatcagtttgtgctaaaggtcaaccatcaagagaagaatttgaacaatcaatacaaaatttatgtgattatttgaatatgaatttaagtattctcaaagggttcttgatgaatgaaatctttatgaaaactatggtggcaacttggaaaaatgttgttagtgctgctgatgaattaatgttacctaaattatcaaaagcgaaaatcaatactgaatctggtggtacatcatggcaatctgtatcatcaaaactcgccacagtttcattatcttcaattgggattttaggaattgatggaccattatcaattaatgaaattgaaactgttttaggttggcttaatttcttgtgtacatttttccatcatgaaggtaatggaccacctatggaagatttaaaaactgatcaatatctatcattacttttagttccggctttatatgatcaaaccgatgaatatttgattgaagaagtagaaagattatctactgcttatgtacaaatgtag

SEQ ID NO: 1768 - DNA, 927 bp, Candida albicans
tttttgaaattacaacatcaatatcgtcatacaatgaaatcgaggaattcaccttctgtggatctgccgagatcacgaagagtattgagtatggcgtccacgtcgactatacagatttcacacttgggtccggaaccggctagtaaagaggaattatacaaatatgtattgaaagttattcttttggaatatagtaatgaagctcggtttagaacaccaatactagaatcaatcaaacaaacaacacgtcctagtagcaatagatcaagtatggtatttgaccaaaagatcccacagtatgctttgaaaaacttgaaaactcaattacaattgatcatgacaaataaaaaacaagttgacgaaaaatttcgaagatcattattaagaatatacggtgaattattagatcccaatctggaaaatgaggtgcggaaaattgattttttgatacctaaatttgctgcatttgcaaatcaagaattaaaaaaagtgtcacaaatgaatgatgacgagataactgacactgtttttgaacaaactagacaatttgttgattttcttatagaaattgtgacggcaaagaaagattacgatccagcattgatatcacaattgaaagccagaaaagattctttccaaacatcaaatgccaaactacaacctgaatccaatcaaaatgtcaagtatccaactaaatcctatagaataagtgacatgaataaatcatttgttgatttacttaaaaagattttcgatgttgacgatacgaaattacaacaagatgtattcaaatataaagacatagcattagctaaaccattacatcatgatgtccaagaattagctaaaatacaggtgaacctagataatttctcatctgacactgcattgcaacaatggaaagaaagacaagaacacattaagtct

SEQ ID NO: 1769 - DNA, 744 bp, Candida albicans
ttttcagctattccagattgtcaacaatatctttcttattgttcaaagaattccataaacacgggatcaacagttttccgaggaacattatacgaactacacgttaaggcattcttcgagaaatatctcaattgtgaaaacttgattaaaaatggtggtgcatatgataatggagttgatataatagggaaatggaatttatccccattctataatgaacaagaacgtgaatatgaatatgacaccaaacctataaaactttcatcaaaatcaatattaaaatatagtcaagaatcaaaattcaatattgcttctaatcccatatcattaattaatgatattcaagtattaattcaatgtaaaaatgttaagaagaaaccggatgcaaaaataattcgtgaattgtctggaatattagatttccataaatttaataaaaaatcaacatttatgtttattgttactccttatccatgtactccacaagctgttgttcaattagatactacgaatcatgcaattatccattttatgatatctccattaactaataattctgtaaaaattacccgaaaccaagataatgatgataatgataatgattatagtggtgattcttttttcaatttggattcttggaaaggtggtgatttgaaattagtttatatgaatcgacaagcaaggaaattattatctggtttaaatatggaacaaaaattgaaattaattctgtttatagattga

SEQ ID NO: 1770 - DNA, 408 bp, Candida albicans
agaaagatccttaaagaagaattaagtaaagataaatcatatattcgtatgcctaaaattgaacgatcaggatattttgaaaaattactagacacaagattaaaacaaaaaggtataatcattgataataatacaggtactactactaagaagacgaacctggggatggtacaaaataatttgaaaatttataatccaaaagttgaattaacttataaagatgaattaggtaatgtcttaaatactaaacaagcttataaacaattatctcataaatatcatggaacgggtttagataaaaataaaaagaaacaagaacaattgaagaagaagcagcagcaaaggggtagtaaatccaccaatatttcaacaacatcaacaacggttaccgaaagagttattaactag

SEQ ID NO: 1771 - DNA, 513 bp, Candida albicans
agagctggatcaataacaaccaccatgaggatttggacaacagaatggctcgggagaagcaatcaaaaatccgaattattaaaaatgaaaatctcaattgaagaaagaatccttaaagaagaattaagtaaagataaatcatatattcgtatgcctaaaattgaacgatcgggatattttgaaaaattactagacacaagattaaaacaaaaaggtataatcattgataataatacaggtactactactaagaagacgaacctggggatggtacaaaataatttgaaaatttataatccaaaagttgaattaacttataaagatgaattaggtaatgtcttaaatactaaacaagcttataaacaattatctcataaatatcatggaacgggtttagataaaaataaaaagaaacaagaacaattgaagaagcagcagcagcagcaaaggggtagtaaatccaccaatacttcaacaacatcaacaacggttaccgaaagagttattaactag

SEQ ID NO: 1772 - DNA, 1608 bp, Candida albicans
acatcccatcccttctattcaagatcattctttctacttgatgtatattcatttcaattactaaacatgtctgaagaaatatctttatcattagaagagacaaataaactacgaatcaaggcagggttatcacctataccaacgacatcatcacaactgaatgaaaaagttagagaagtgatatctttatcaattgaagaaaccaataaattaagacaaaaaattggattacctttactacctacaacaacaacaacaaatatatcaagtgatagtaccgaatataagaattatgaagattatgaacgggaacgattacaaaatttgaagaataatcaattaattgaaagaataaataatgccaaatttaattccaataaacggaaatttctaactaatgaaaccataattgataatgctgaagatttggatactgatgattggttaaataatttaggtgaatctactgaatctagtaaacctcacaagaaacagaaaacaacgattgttaaatcaaaccaaaatgatacaggtccaactaccactattattggtcatactactaaagaattacaatcactaggtaataatgaaatattaacattaaaagacactgatctaataaacgatgatgatgaagatggaacggggagtattttaatgaatcaagatttatctaataaggcaaaattgaaacgaaatttagcagaaaggaaagaagcagagaatattaaatttaatgggagacattatagaagaaataataaagaagaagaagaagaggaggaggaagagtttaatgatattgatgggttattaactaacaataaagtgataatgagtggatctactattgatttatcttcaaatactgctaaaccaccaccaccaccaaaggataaaaagaagaatatgatggcaattactaatttatttgaagatcttgataatgtcactttaagtaataataacaacatcaaatcaaatgttcctataaagatgaaaaaaatcaagaaaaagaaagacaataacaagaagaagtcaaacaagttgaaattgttagatgatactataaaaccagttgaattactggtagaaagtaatattggtaatgatgatgatattgatgatattgaaaatcaattatctaatagtatatccaatttaagaaccaaaaaattacaaactagattggaatttactccagaacaattagctgaagaaatatctgctaataaacgatgggaatttgaaaggaaattagaacaagaaaatttgaaaaacaacaacaataataataatgtatataatgatacaataggatttttaaacaatttggagactaatattttgagtgaatcaggtgaagttgaagttactgcaaacatcaatgaagaaagtgctgatgatgatgatgaggatgatgtccaacaacaggaagtagaatcgaaacagactaatcctggagtgtatcctattgttgaagagaaaccacaagaagatgaagcaccaaaattcagtggtggattagctgaaactttaaaatttttgacatctcgtaatatattagaacctgaatcattaacaaccaccaatgaaagaatttag

SEQ ID NO: 1773 - DNA, 507 bp, Candida albicans
  unsure (10),(11),(27),(34): Identity of nucleotide sequences at the above locations are unknown.
tattattttnngggtcgtgcccttcgnagagaanacgatgggcattcttcatcttcaccttcaacaccaataatggcattacaacaacaattaattgatgaatctataccagattattcacctgatgtaactacgacattacctcctaataattccaaatgtttaaaaattgaatggaaaggtcaaccaatggatttatctaatgatcctaatttaaataaattgactcatccagcagaaattttattggctagtatattaagatcacccgtggcagtatatttagattctaaacgaatattattttatgaaaaagtatcacgattaagacaaggtaaaggatttagaagaactgatgcccaaaaggcttgtacaattgatgttaataaggcaagtcgattatttgctgcttctgaaaaatttggatggttaattgacgaattatttgaaaaatatttattaattttaatatggattttgttgatgaaggtggtcatccttttcttc

SEQ ID NO: 1774 - DNA, 501 bp, Candida albicans
  unsure (431): Identity of nucleotide sequences at the above locations are unknown.
acgaaaacatttattcctttcatctcaacatatttcaatcgttacattttttttttcattcccactatcctccacatgtcaaaaccattccagccgattagtgatgtgatcaatacgtcacccaaaaacaaatcccagtcttttaatgaaatatacggagagccagaaaactttcttgaaatagaggtgaaaaacccattaactcacgggtacggactgaacttgttcactgattacgagatcgtttgtcgaaccaacatcccggcatttaagaaaagagaaagtcgaattcaaagaaggtatagtgactttgttgcctttcgaaagattttggaacaagaaaccactagagtaataattccaccattaccagggaaaatattcttaaatctgaataaattcaatgatttgaatattgaaaaaagaagacnaggcttagagaaaattttgattgttgtaagtggccaatcaatggctccaaaccggattggaattcgttga

SEQ ID NO: 1775 - DNA, 1434 bp, Candida albicans
acaatatacaccacacgagcgttgcaagagagagaaagaaaggacagcctcatgattaccccactgttgaaatacaaacaagcacacagacaaaacgcacacaaagatatagaaaagatttacaaagacaacactcaaattgattcagcaattaataaatgcaatttggacgtggttaaagattatggagatgacaacagttttaatgcaactccaaatactacttcattatcagtcactaaaaccaacaacctaaatcgagaatctaagatggaacatgaacagtcggctaacaatccccggccaatttcctttttcgatcaaactcaatctgattatgaatgttgtgatttgaggaacaaattcaatatcccttattcagttttgaagtataatttaactcctgagagttgcagtcgaagtattgtagataccgataatgatctacagttctcattcacaccagaaatgaatctagatgaagttacacatcagagtcaagatcatcacacaaaagatactgccacttccataccaaaccaagacaactccaacaagcatacttaccaggaagaacatattggggcattttcaggctattttgccattcccaaacttacaattaatattccaaaccgcgtgcaagacgatgaagatcggttgaaatacatttccaatgttccaacaatttgctaccaaaatcattttgaaattgaagattcaacatttatatttggtggtctttgtgcatctgaagtgaatagttttgagcatttggggttaccaccaaatgctgatttagaaaaagttcaaatctatttcccatttgaattgccgccctttgtcaatacaagattattaacaaacccatttatggaacccaatccttattttcttcaatataatgctacgaggggctcggtgacgtatttggatacagcattaatgcaagaattccccaagaatataattggaatggcatctaccagaatatcatcgaggcatttctttttctatggaggattccaaattgaaaataagtctttgcgtcctaacaaaaatggagattgttggatagtggaaaaagctattattttaaacgaagatggctatattattgacaccacaacattaaagttttcaaaagttaaattgactcgaaataacaaatcgataaaggcaggtagaataggtatgggaatatgttctaatatccatgagcctgctgattcagtcctcgatagtaactttattaatgggaatcatctgtcagcagctgtatttgacactgaatctaaaggatcctcaaagcaattcaataacagaacagaaggatatgcaaaggagaaaaccgtcctgaatccactggtaccattggaaggctctcactcaataagggatcttcaccacggggctggacggatccgcgcttag

SEQ ID NO: 1776 - DNA, 1818 bp, Candida albicans
caaccacacaactcctcaatgctatctattagggagacgatttcaagaatagggaaatctatacggcagatcgacaatgtttccaaatcaagcaagaccagacccactataaatccccatcgtcgtggccggctactccacaaaaccaacaactacttgcccaacgaaaaactttcggaactcaaaccactctacacagatttccaaagaaaagtgttccaggactttctcaaaccaatagagatccccaacttgaaaacgttcaatgctaaagaagagtacgatagtgcccaggcatcaaggaattggtcgcaacggtcttctaccaacccacaggacatattagccaccttccacaaagacaaagccgagttcgacaaattgataaagtacttgttggaagtgactccaccacagctaaaaaatatcgactaccaaaacgaactggctatgcgtcgaatcctagaccagcaaaccaaggtctatgatgtgccgcaccacgcatttcacgaaatcccacccataccgtcgccactaaccaaagactccttcgaacaatacatttaccacctaactcattgcaagtttcactatagaaactccctgtcgttgcagtctggcattatcccccatatcctactatacacacacaaaaccactaacgaaaagtttaggccattccggtctaccaccacattcaattggttgatcaagtatttcggtcacgacaagaaccaaagctcgtttgcacgagaactattgcttgtgatgaacatagagggacacttgcttaacaccgaaacaatcaactacctcctaaaagtcattaaagtgcattcaagaatccgatcaaacacaagctcgtttactttggcattaaagtacctaaaattgagccaaaagttgggaatagatgtcaacttactgacatggagtaaagtatacgacattatcgacaatgtgcatttgaaggaaacatttatcagtttcatacaggaaaatggcatacccatactgagaggtttactattgagaattatcgacgactttgctagagtagctccgacagcagccgacttgacctactttattgagaatgatttggggtatgcgcaatgggagcacgacgatatgatacgaaataaagtgatattccatctggcacgtgctaatggtgggaagtttactggtgctaacgaatacgattttaagagttggctattgggattgaaaagtagcggccagccacaaaaagtcatgttgatgctacaacagtattttgagagaacagtagagatccatgaaacgcttcctatattcaccatcattatcgatactttggttgaagagtatacagatataaggcacttaaagcagctagtgtttgttgtgcgaggcatggtatatgaggctactcgggtgctcgacttaccatgtgaaatcatccagtacaccgactcggcacaaacaattcccgaaaattacaagatgcttgctcgaagtctgtatggcaaactacacgaattgcaggccagagttgagttcgccaacaatcatacttttgaaaacatacccccgccatggcaaatgctctcacaacaagaaatcgaaaggtggaccgtgttggtaaagaacaccacccaactattcccagaatttgaaaacccaactgtttttccagcacccgaaatcgataaaatcgtgagccatatcaaagccaaaggcattgctagtagaaacaggactcgagtccataagctaactcaaggacttgataactacaccatcaatctaatgaaggagaggtgtttgctatag

SEQ ID NO: 1777 - DNA, 606 bp, Candida albicans
atgaagcaacgtatcactggtttagatttacaaatactcacttcagagttatccaaggagttatctaattatagattacagaatatctacaatgttgccagtaattctcgacaatacttgttcaagttttctattcctgactcgaagaaggtagtagtcttagagtatggtaacagaattcaccttactgattttgaaagaccaacaacacaacaaccaactaattttgtgaccaaattaagaaagcatttgaaaacaagaagattatctggtattaaacaaatttccaatgatagaatcttagttttggagtttagcgatgggaaatactatttggttttagagttctttagtgcaggtaatatcttattattggatgaatcccaaagaattttacccttgcaaagattggtttctgccaaacaagagaatgataggtatgcagtgaatgaagagtacaaaatgtttgacaagtcattatttcaacaagatttccattatgaaaaaagactgtatgacttggatgaagttgaatcgtggattcaaacccacaaattgaaattaagtcaaaacagcgataataaaaaggcaaaagtctttttctaa

SEQ ID NO: 1778 - DNA, 546 bp, Candida albicans
gcgtggtccttccattgcgtggtgaagactggattcgcaatagttgttgataataaaaagaaggagctagaggaaattagattggctcaaaaagcaagtgcaaaagaaaatacagctcaggaacaacgcgttgatgaatcatctgaaagtgacgataatgaagatgatggtggtgaagatgctgatagtccagacactgatactgtttctgttgatgccaatggtgaggaaaagccggtaatagtccaacaattacccaggggtaaaagatcgaaactcaaaaaaattgctgcaaaatacagagatcaagatgaagaggaaagaaaattgaggatggatgcgcttggtacacttaagcaagtggaggaaagattgagcaaaactcaaattgaaaacctggaaaagtcagaatcagtaaagaaacaacaacaaaaggaagtgattttggaaagaaaaaagaaacaaaaagaaagagaattgcaaaagtatctcttgggtgatgacaacaatgatgaagagactaacaatgaatcacacattgtaaat

SEQ ID NO: 1779 - DNA, 1233 bp, Candida albicans
  unsure (18),(24): Identity of nucleotide sequences at the above locations are unknown.
ccattcatttcgaaaccntttaanccaaaaccagggaggattaaaattcttctcggtttcgggttatcaataagaacttggaacagttttttttcaaatattgaatccaacaaatttttttatgaaaggttgaacagccaaaaggaaaatgccgcaaggagactcgaaaaggcacgaagtgaacgtgataaacaaattgattctttagttgctcagcagagattaaatgctaaaaagggagagttgattcaatatcattctgaattggtggaagaatgtcgtagttacgttcaactgtttattgatcaacaaatggattggactaatattgaaactgttatatccttcgaacagaaaaagaagaacgaattagctcaacatattcaattaccgttaaacttgaaggaaaacaaaataaaagttttattagaggattttgacgattatgaagaaattacggaatcagctagtgctacagaaactggatccgaaacagaaactgagtctgagtctgaatcaagctcagaatcagaaagtgataacgatgaggataagattcctgtaaaacgtactcaaagaaaaacgaataccaaagagaaacccaaaagaaaaactattcctacttggattgatttatctcagagtgcatttgccaatgcaaggagttatttcgattctaaaaagactgcagaaaccaagcaagtaaaagttgaaaatagcacaagtatggcccttaagaatgcagaaagaaaaataactcaggatttgacaagaagccttaaacaagaaaatgatacattaaaagaaatcagacccaagtattggtttgaaaaatttttttggtttgtttcttctgagggatacttgtgtttggcagggaaagacgcgtcacaaactgatatgatttattataggcattttagtgacaatgactcaattgttagtgctgatatggaaggttcattgaaggtgtttatcaaaaacccgttgaagggagaagcattaccaccatcaacacttatgcaggcaggtatctttgcgatgtcggcttcctcagcttggaatgggaaagtcaccacttcagcatgggtgctccatggaacagaaatttcaaaacgtgattttgatgggtcaattgtcccagaaggtgagtttaattatctcgttcaaaaggaatatttaccccccgctcagtcattgttttcaactgaccgacggccgtcagtgaccaag

SEQ ID NO: 1780 - DNA, 315 bp, Candida albicans
acaagcaacagagacaagagactataccatatttacacaatggatgagtcgttttattttgctctactaaggatatctattgctcagattttgaaggctaatggatttgacaaatgcaaaccttcaactttaaatgtcatgacagacttatacttgcaaacctttcaaaatgccattagggaatcactcaagtgcagcaatatgcgaacaaactcaaactcacccgagttgcaggatattacacaagctttgatcaatataagcatttttaaagcgaacgaagccacgaaaattcacgatgagtattatgaatag

SEQ ID NO: 1781 - DNA, 1215 bp, Candida albicans
ctaaggcgaaatttcacattgttttttacaaaccaatttgatcaagtattgatttcaatatattcgaccattttgtcattgccaactactactccctttctgggaaaaatccctcctagtggactagtcagtaaagttgccaatgaaacgataaaggaattgatcagagtcacatccgcctccaaaaacacaccaatatacgatcaattcaatataatcaatctggattgtcttcggagccacgaataccaaccaataatattacagttaataagaaaaaggttattagagatatgccatagcaaaaacaattctgttaacaaattaccagagtctacgtctatactgctcaatagtacagtgacaagaaactcttccgtttccaacttatctttgagtgatatgaatctaatgaattacaataactcaaatcagaataatactgcagtgaacttggcaagatcacgatcgtcgtcaatcaacttgagaaagcagtccctaaccagaaacaattccaacaattggttgcatgttgggaacattaacaatttgagaccgagtggaaatccagactttaatatgagtacagactcgttgcaatcattccaagattttgttcctcaatcaataattaatcgtacatccaatggcagtggtaatgcgaatgtgactaacaacagcaacaatttggtcagttcctcaagtaatgttggtcaattgaattctatgatgatggactatcacataactcctccaacctcacataagggttcaataagctcgactaacctgccatacaatattgttcataacccttgtacttctgattccgaagagtttcagtttttgcaaagatcgagatcctcgtcaaggggtaacaatttgccacaagcactcaatatcaatactgacatgtctaatctacaggctttgaattctttacaagggaattcaggcaattccaaatatgtgcaaccaggactatcgttagactctccatttttgtctgctacaactccaggtgacgaatactttagtgggccactgtttgctaaccccagcaataacctgaccacggctgtaattagtgcgggttccaactctgtcgaaaacgcagaagcaggtggtgacacttctaaagcaaatttacccaatcagtacagtttaagtgagaaaaagagagattctttgaaaatgaagcgtggaattcattag

SEQ ID NO: 1782 - DNA, 348 bp, Candida albicans
ccattgtatctgggagtgttatcgttgttggacaatacattgtacgtctatgattctatgcaaatagacgatgatgaaatttcagaaattcaattgaaaaaattggtccagaaattacaaagctgtaatactattgttcatggcaaattaaaagtacggcacttgaagtgtgaccaacagcaaaactttgatgattgtggagtatatgtgattatgattacatgctacttgataaatcaacttctacaccaggacgaaatgagcttagacattagtagagttaaattcaatcctcttgatgccaggttgcatatcatgaaactaatatctagactaataaaagaatag

SEQ ID NO: 1783 - DNA, 1476 bp, Candida albicans
atgattcagtcaacaaataatccactaatatccactcaacggatagaaattaacgatgaatacgaaccagaaaataatctggaatgcagtcataaacccactgactcaaatatttttcgactattttataatatcttgaaatacttgaaggtctacattttatcgactttatttagaagaattgaaccatccaatagacatcttcaactggaggaaaacaaagaagaagatgatgaatatatcaatttatcttcagaagcaagttcagatatagagataattgctgttaattataaaccaacaaatgatttccatttaattaacaaaactactcgaattcaagataatagtatattaatagatgacacagaagaaactccatttaatattgccaataacgattcaacaactgacttattaagacaattagcaaaagatagacttaaaaacaggaaaactgtaacaactcaatatggcacggatttgacaatttcaaaacctatcaaatactcatcactgcgatatcagcaatggccagtaacacaagcggaaacaacaacatcaacaccagaagaaaattttgatcatcaaccaacattattggatattgaacctattacaaataaatatcaagaatcaatattaaattattatgtgccgacaaaaccattatcaataaattcatattccgttatcgacaatgtaatatcgaatttttatattgataaaatttcatcaatttatcataaaagtcatgaaacattacaacaattaatcactaaagaaagaattgattctcaaagtaaaattaaaacattaccttcagaacaattaaatcaagttttaaaaatttggtcaaccaattctcgtcaattaatcattgaaaattatctgattgaaatatatactcatgatttacatactttaaaagattccaattggttaaatgataatatcattgattattatttcaatttaatcatgaaagcgaatcctaatgtatttggttggactactcatttttatactacattagtccaacgaggatatcaaggagttgcaagatgggctaaacggaaaaaaatcaatgttttcaccatggaaaaaattttaaccccaataaatatagggaatatgcattgggcattagctgttatcgacaatataaagaaaactatcacttattacgattctttgggtgggacacataattcaggaaatccacaagctgtacaaactttggcacattatatgaaagaagaagctaaaagattgggtgtgatgggaaatgaatataaattgattcctcacatggaagctccacaacagaaaaatggctcagattgtggtgttttcacttgtactgccgctagatacatttctgccaataaacctttatcgtatagtcaaaatgatatgaaaataattcgtagaagaatggtctatgaaattttagataatcgtttactagattaa

SEQ ID NO: 1784 - DNA, 510 bp, Candida albicans
gttatggaggagcttaaattagaccgatcaacaaagtttctcgtcataagcatagagaatatatcgaaatccaggcttaatcagcttgaagaatggaaacagttggataatccgaacaaatcctcagttgatagactaaacagaaaaattattactgaggtcaacctcaacaatgatgatgaagataatgatgaaagtggaagacctagcagggctaatactcaagatacttacaaattatatttggaggacgtttcaaccaaaaaaattactcaagcttatgaaaatgaaccattgcggtttttacgtacagagaatacaggcactcctctaccgataaaacttggaggtagattaactgttctaaagggagcactgatttacaatggggtactactactcacgaataagaattgtgaataccatggcattcatgcggacgatgcaagctatgtatctatattaaatgatggtgtaattaaaaaacaaattgagttactccagctctaa

SEQ ID NO: 1785 - DNA, 249 bp, Candida albicans
atggagtcagaaagcggtacccaccaagtaaagaatatggcatataaaacaccgccttccacatacaaagcgttggtggaccatgtcgaatatatatcactcatgaatggctggctagtacataacgaaatgttacgtattccaagtacccgaaatgctgctattatgagctgcaaaaaaatacccgtgctaactaatgaaccagagcatattaaaataatacgtctattggatataattgcattataa

SEQ ID NO: 1786 - DNA, 1008 bp, Candida albicans
acgtatctatatatcacattcgtttcactttccaatatggagcattcagataaaaattttctaacggcgaatgtctcaaagctagggccatgttgggttcctatatatgaaagcccagttggatttaacgtacaacattttgaagcagccatgttgaatatcatccatcagcccaatattaactcaaccgttattatgagagcagatattttgcgagaaaatgtgtttgatccagatgaaggtgatacaacattcaccagtaaaatcgcaaacgaaatcccggagtttcaaactgatgatgattcaaagttgttgttgagagatttgaaagatatcaaagtgaggcagataccagatgtaccagacattcagtttaccaaaaggcatgaaattgtcagaagagtaattccacgaaacccctttaaagattacataataaatcagacatgtcttatgttgactgacaacaaaaagaatagcttggtggtttacatccctcacatagattctgtggaagaaacaccatactatttgccaccagtttatggaattgggatactctacaatgattttaaggtttctgtccattacttgccttttggttttgaaacacccaacggtaaggagtttactttattaaaatccatgacagaacaggacagaccaatcagaatagcattaagattattgagcacggccactaaacattctcagggtaggaaggcaggttatgaaaaaagagtaaatcatgatctagtggtaccccaaaccaatttccaaaaccaatatatcacattgaaaaagaaatacctggattatttcatgaacaattggggcgagtctactgatccaaggaagcatgtatttgaagatatcgccattgctgcattcataatagaatattggaaactaaatagttttgagccggaaaagtttgaatttcgtgatttgggttgtgggaatcggttgttagtgtcttctaccacgggggcccgaaggtcgcgcgca

SEQ ID NO: 1787 - DNA, 516 bp, Candida albicans
cctgaaaattcaattattgttaagaaatgggaaggccaacctgatgaatatttaatttcattgattccattcttggaatacttggctacacaaccagtcaaagatgttagaccaatcttgaattcatacaaggataaatccaatattgtcgccgaattcgcagaacgtgagaacaaattgagagaacaatggagaaaagatcacggtggaaataatgggaaaccaaatgccggtaatttcattgctaaattgttaggtattccagttccagaaccaaaaatgccattggatattattagggaacacggtcaattgcaatacgaacatttccagaaatacttgcaagaaaatgcccacaaattcttagaagaagaacagaaattgaaagatgaatttggtaaagttactttgaataaattgattactgaaggtgctcctaatgctgaagaaattgccaaagtgcaacaacaaagagcattagaggaagctcaaaagcaacaagagggtcacaaataa

SEQ ID NO: 1788 - DNA, 558 bp, Candida albicans
gtctttccagcggcgtggtctaatacgaaatatacctcgaccagttatagattaatccatcaatatcaaatgttaataaaagttttcactgatgatcaaaccaaatttcaattattacaaaaggagtttttaccagggttattgtcggatatgtctaattttttagatttattattaagtaaatttaatgatagttaccctcatgctgtcagtcggataaagaacggattgccagcaacgattgaacaaattaacggcaatcaaccaacaagtgccagtgctagattagtggcagagattacagggaatttcattacatgtatggatgcggtcaagctaaattataaatcaaaagaacaattacatccgttattgagtgatctagtggtcaatcttaatgagcttaatgaggagttgcaatttacaggtaaatcgaaattggtcaattggttgattaaaataaacaatcttcaaactgaacttacacaagaggaagctgattcatttttaaatgatttggacatagcatataaaggattctatacaactctagaataa

SEQ ID NO: 1789 - DNA, 399 bp, Candida albicans
aaaatatcaattgattatcctgaagatttaatattccataatcctaatgacatttcaatattgtataataaattcccatattattttgaacccaatgtcaaacatatttgtatttggtcaaaattgaaaatccccgttgataaaaatagtgaagttggtgatatctcggtcatgacgaagaaattaataaatagataccttgaaaagacatttgttgctaaaggtatatcatgggatcaaattgtatggtttaaaaattggttgagtttacaaagtgtaagatcaattagtcatattcatgttatattaaaagatgttgatgataagtttgtagatgaattgattagtggtggaagtggtgaagtattaactttagatgattatagaaatttagaatag

SEQ ID NO: 1790 - DNA, 1263 bp, Candida albicans
ggccaagttgttttttttttcttccaaaaaaacacgacttggaaggagctgaaaattgtgtgtgtgtgtgtgtgtgtgtgtctgtcgtatttttttttgttcagttgcaatcaatcaaaaagtttgtctcatcgctcaacagtaagacaaaccaagccaagggtaatgacagatgaacagctagagtcaaagacttcaaagggaaaacaaaatcgtaaccgtaatattgacaatgacaatgaaaatgacaacgataatgaggacgataaatttcaaacagaacaagtctatgacgttgaagatgaaattcaagattggaaatttttgaataaatcaactataccgaaaaggggtactaaagaatttgaacctgatgggaccaattatcaaatttcagcattagaacaatcacaacaaaccatgtttcaagcaattaataatgttagaggacatcatactacgaaaaaattaattggaatttggatgattgatgagcatgatcaatattgttttattccacaaattcgtggtaattattttaaagatttggggaaagcaatcaatattgggaaatttcaaggtatgaaattgaatagtttagaaacaatttatttagcagaaagaggatcattgattgtatatttgggaaaccaggaatattccgattggttgtataatagtgctgaggtggaagaaaatgaagatggggacaaaaatgtactgttcgatgtggagtcaaatctaattgcattggatttggaatatttgtatagtttgttaactatcccactagcgaattatcaagtttatgcttatttaaaaagattaggatatatcatacaggaatataaagtgcaagatgatgtgatggacaaaacgttattatcatcatcaccgacaaaggacccaaagaaactagaactgttggttcaattcacattatggcctcgtgaatgggggatcatggcatatcctcttttccattcattacattttaaaacgaaacattatttcaaatatactgatgtatttaagaatttaaaattgaattttaaaccaattgaatctgaccccaatgaatcgaatataaatataacattcaatgtatggaaaccatcaccatcattttctaaaaagactccaccaccaccagattttcaattatgtgtcgttgattcatccaaaaataccgatttcttaaaacttccacaaatacaaagattattcttccaattgtcaccaccaccatcacaacaacaagac

SEQ ID NO: 1791 - DNA, 1443 bp, Candida albicans
acacactacataatgccagttcaaaagaataaagttccggaaaaggaaagatttatacaatgttgtggtgatatctccttagaattagttgcatcactcaagagctccaaagatatcaatttgaatggattaataacacgatatgccaaaaaatataaattaaaacaacaacccagattaaccgatatcatatcttctatacctgaccaacataagaaatatttgattccaaaattaaaggcaaaaccagttagaacagcgtcaggtattgctgttgttgctgttatgtgtaaaccacacagatgtcctcacattgcatatacaggaaatatctgtgtttattgtcctggtgggccagactcggatttcgaatatagtacacaatcttataccggttacgagccaacttcaatgcgtgccatcagagcaagatacgatccttatgagcaggcaagaggtagagttgatcaattgagacaattgggacattctatagataaagttgagtatattattatgggtggtacattcatgtctttgcctattgattatagagaaaattttataacccaattacataatgctttaactgggttcaatgggaataatattgatgaagctattgagtttagtcagcagctgcaaactaaatgtgttggtattactattgaaactagaccagattattgtacggaaacccatttaagtgacatgttgaaatatggttgtaccagattagaaatcggggttcaatcggtttacgaagatgttgctagagatactaatcgtggacacactgttaaagcagtttgtgaaacatttgctgttgccaaagatgccggttataaagttgtatcgcatatgatgccggatttacctaatgtcggtatggaaagagatttagagcagttcaaagaatactttgaaaatcctgaatttagaactgatggtttaaaactatatccaactttggttattcgaggtactggtttatatgaattatggaagcaaggattatacaaatcttataatgctaatgccttgattgatttagtggctcgtataatggcactcgtcccaccatggacccgtatttatcgtgtgcaaagagatattcctatgccattggtgacctctggggttgaaaacggtaacttgcgtgaattggcccttgctagaatgaaagactttggtacttcatgtagagatgtgcgtacaagagaagttggtatacaagaagttcatcataaagttgttcctgaccaagtcgaattaattagacgtgattactatgcaaatggaggttgggaaacatttttaagttatgaagatccaaagcaagatattttaattggattattaagattgagaaaagcaagcaaaaagtctactcatcgtaaagattgtttcagctcgccacgggcaagagacgcgtctagacgg

SEQ ID NO: 1792 - DNA, 1008 bp, Candida albicans
agacacaaaatattacagacaaaaaaaaaattgtacagagagaaagagaaaaaaaaaaatttaatctcatctcctattttttttttaaaaaggattttacacaactatcatcactataaccaccaacagctacaaatagaaatgcaactttcatggaaggatataccaccggtacctacatctaacgatatgttagatatagtgttgaaccgtacccaaagaaaaacgcctactgttattagaccagggtttaagatcactcgtattcgtgctttttatatgagaaaagttaaatttactgctgaaggtttcactgaaaaatttactgatttgttactgggattccctaatattaatgacgttcatcctttccatcgtgacttgatggacactttatatgaaaagaatcattataaagtttcattggctgcagtttctaaagcgaaaactttaattgaacaagtctcaagagattataatagattattgaaatttggtcaatcattatatcaatgtaaacaattaaaacgtgctgctttgggtataatggctaccattgtgaagaaattaaaggatccatttgtttatttagaacaagttagacaacatttgggtagattgccaagtattgatccaaacaccagaactttattgatttgtggataccctaatgttggtaaatcttcattcttaaaatgtattactaaagctgatgttgaagtccaaccttatgcattcaccaccaaatcattatacgtgggtcattttgattataagtatatacgtttccaagccattgataccccaggtattttggatcgtcctactgaaaaaatgaacaatattgaaatgcgatccatttatgctattgctcatttaagatcatgtgtattgtatttcatggatctttccgaacaatgtggattttctattgaagcccaagtgaaattgttccattccatcaaaccattattcgccaacaaatccagttatggtagtaatgaataa

SEQ ID NO: 1793 - DNA, 570 bp, Candida albicans
accacaaatttttggaagaggaagaaggatcgattagtacaagaaggattttacgattctgattctgatattgaagatgaagacgctgaagagattagagaaaaggctcaatggataagaaataaacaaaagacaatgataattgaaggaagaaatagaaaatcattgaagaataaagctataatgccaagagatcaaataaagaaaacattcggtgatatggagaaacatatgtataatattggtcatgatactgagaagttgagagaaaccgtgggtaagaaatcttcagataaagccatgtcaggagttgaaatcttgaaaagaagtcaaggtatcaaagctagtaaattggctaaaaagaaagctgctgctaatcaatctgatcgtcttaatgatggtttgaatgatggtgctttgagatctcaagctgaaagattggctaaaatacaaagaagagaaagaaatagaatggcaagacaaggggaaggtgatcgtcattcaactgctgccttacctaaacatttgttcagtggtaaaagaggtattggttctaccgatagacgttga

SEQ ID NO: 1794 - DNA, 516 bp, Candida albicans
gggggtaggaatcaagaagatcatgtttggtgtgaatactattcattaagctcaaaacgttggatacatttggatccttgtgaaggtgtttatgatgaaccgttgttgtactgcaataattgggggaaaagaatgagttatgtcattgggtttaattataattatatgattgatttgagtgataaatatattgtaccggaaaaacaaattcctaaaaattcaattgtaaatgtccaaaatgtgaattttgtcatatcatatctgaatggtatcaatcaattgaagcattttaagagaattgagcaacagcaacaacaacaagaagttgatgtaaatgaacagagaaatttggctttcctcaagctttatcataatttcctagttccatataacaaggaaattaaccaattgaaaccagaattaacaaaaactacaccatccacggatttaccactgggtaggcaatcgggatcaactgaatggactaaaagtcgtggtgaaaatggtgaatcctaa

SEQ ID NO: 1795 - DNA, 1491 bp, Candida albicans
aggagtcatttggttgaaaacaaaatcttgaagcgcagagtttgtttgattatttctgaatgggtcagtatccaatgttcaagagagctgagagtgtctatttacaagttgttgttaaatttcttgcaaccagaaaataaaatcaacgataagattgttaagatttcggctgttcaaacgttgtgtgctgttgttgacgattgggatttcagcaaaactgattttcaaccatttttaaatgattttgtcaagttgataattgggttgcttgatgaattcaagtttacagaatctaaactatacattttaaacacattggccaaagtcattgaaaagtgtaatccattggtcgattatcaaacattgcttgatatattgcaaatcattcctcccaactgggaaactactgaaaacgaacagattattaagacttcattattgaggttgttgagaagtttggttgtatcgttaaatgagaactccatggaaacacaccagattgccattcctttgattaaggcatgttgttccgaaaatctggatgtctatttgcttgtttctgaagatggatatgacttgtggctagcgttgttgcaattttgtcctgtcacacagaacttgaattcagaattggtcgaattgtttcaattgatcccagttggattaagaaactcaactgagattcttccaacaatcttgtcaattatcagaagttatgccttgtatgcgcccgatgtattttctgaagatttggcatcagaaatattccaagttattgggaactatttaagtaaaatgagagatgatgcgtatgccatttttattgcgttaatggatatattgttgattaatccaagagacgagatgatagatagaattgtttcaagcggtttattcaactctatggttcgttatgtgttggacgatagcatgagcaacttcttaattgctagaatgtatttattgttttctaggattgccatgaaagagtattttctcaaaattttagatgttacttctgttgacttgaaattgtttttcgaaagatggttagaatattacaaccacaatgggaacccaagaaataaaaaaatcaatttgttggggttactttcagttttgtcttattctgttccacaaaaaatagaagtgttgtgggagttgtctcctaaaataattaaaaacacattgttcttcttggaagaagtaaacgaagacacaaacggacggtgtgattcatacaattccaatttgatttacgatgacatagatgattatgcgtatttggatcctgatatcaaagcaaacggtgaaaaattgagataccatgcattattagatcagtttgatcgagtttattctgtcaatcttttgctgcttttaaaagaatgtatgggtggtttaagacagcagttgggtgataccgatttcaacaatttcattcaattgaatgacagttacaccatagaaaaactaagagaaatcatgtaa

SEQ ID NO: 1796 - DNA, 642 bp, Candida albicans
ttagcaatttggagagaaatgtggtttgttggaaataaccttgtggctaccaaacaaatgatgattatttggaatcggataataaacacgttgtccactgttaaaattggaagagcacatcatgccatgcaagcaaaagcagcaatcgttgtcaatgtcttggtcagatggtactcaaagttctttacgatgtggacatcaaatttggatttcactataatgcagatctgttatttgtgtttaaaacatttgagacgaattatacctgagggttttgatcaaccacacaaggaccaggacattgttgaattcttgaataatacaattgatcacttgcaaatgatagtgttggaacatgataagttcaatacagatttgttggaacgttatgtcaagtgctatagcaagctatatgtttcgttgatcaaaacaaaccctaccagttttatattgttgccttgttgtgaacaaatactcacaacatttctttcgatattagaacagaaggcagaagtgatctacaactcatctgaagacaatgatttttgggaaattttggctttgaggagttttagtatattaaagaaggttctggcatatatttatagagcagtgcgtcctcaccacagcctagtggtccgc

SEQ ID NO: 1797 - DNA, 1287 bp, Candida albicans
ataaaaaaaaacaacagcataagctacaatttgattgcctcacttttcgtctccgtcaaaaatactatggaccccgatactactcaatacgataaggtgaaaggagaatggtccgaaaatctgatagatatcaaaagcaatctaaaaagaagtaaaccctcacattcaataccgtcaaaaagggtcaaacatgatgtagattcatcgccacttgtggaggaatccaacgaggaaatcgccagacagtacaaaaaattcataaatgcacctaaatacgatcttaatagtgaagaattgttttgtgtatgcagacgtcccgacttgggtgaaatgatggttgcttgtgatggatgtgaagaatggttccatttcaagtgcatgaaaatcaatgaaaaatactccaacttgatagccaaatactattgcaaattttgcgaatggaagggggaaggtaattctcaatggaaaagaaaatgccgcctagaaaactgtaatgagccgataggagagagatccaaatattgttcgaaagaacacggaatagaatttataaaactgctgttgttggaatcaaaaacaaactccaccgatagtccctccttacaaaacttggatgcacattttataaaggatgttttgaactatgtatcaggtgactttgataaactacagcaaatgggatcaagttttccagagttggaggtagttaagaactataaaaatgataacacagctttagatggattcccagagactgtaaaaatagatttacaaaggacaaatgaaaaattggatgcgttgtcgaaacaggtaacaaaacaagaacaagtattaaaggcattagttaataccaaagacaatataaaacatttgaatgaaagactcactaatatagtatatgaagacctgtctctggacaagcagacttcgaaaaagaagaaaggcgctagaggcaagaaaaagatagatatctgcttttgtgataaaggcgaccaactgattgtacaactgatcactgattctgaaactatctttgatgatttattgaaagttataaaagcccgagtttttgagaatggggaagctgaggaagaagacatggattggtttatgaacgatttgtgtataaaagacaagaagaagtgtgttcgtcatagtggttggtggaatctatactacgatgaagctggcagaaacttggagcagttgcagagcaagctcgaagagacaatggaacaaaaagaatccatactaagaaattattctatcagtgtatacgaatcttaa

SEQ ID NO: 1798 - DNA, 1002 bp, Candida albicans
cgcaagctcggggccttccagccgccagtggtgaaaacgaacactattcagggggtcaaaaaaactgatcttttaagattgattcaactaaatggagggaaatttaaaagtgaggataagtatgttaatcgtttggaacaagacggaattgtgaatggctcaagtcaagatttatgggatgacactgataataatgaaaagaaaaagattcctgattttatgaaatctactgcagaagtgaccaaagcgtcggttgttcctaaaactttgaaagtgaacccaatcaaaattacatctaatgaattaacagataagaaaattcatgccggtaaatcgtataatccatctttagaatcttggaaagagttgattaatcaagagtatgacattgaatataaacgcgagttaactagacaacaaatcgaggaacatcgtaataagatcaaggagttgatgattactttagatgataatatgttatccgatagtgatgatgatgaggatgatgaagataatgacaaggtggaagaggaagaacagttgaacgcaaatggtgagaaggattactctttatctataaataaacctaataaaatcaagatcaaaacgaagactaaaagaaataaagagttgaagcataaagaaagagtgaagttggagcaagaaatcaaagacttgaagaaacagttaaaagacttgtcaaatttggatgaaatcttagaaaagcaagcagttaaagatcagagtcaaccaaatgaaaagaaacgcaagagaagagaaaaattgttcaagtattcacttgtcgaaactccattggaagttaaattatctgatgagttgagtgggaacttgaagaatttgaaaccagaaggtaatttgtactacgatcaaatgttgagtttacaatctagtgggaaaatcgaatccagagtgcctgttaacaagaaaaggaagtatactaaaaaaatcactgaaaaatggacttacaaagatttcaagtaa

SEQ ID NO: 1799 - DNA, 1026 bp, Candida albicans
accccatcgatgtatgatgccaataacgagcatagtgcagatgataaattgacagcaagggaattatcacctcagtcggttcccataaatctcgaagcaaataaaataaccaaaaaacgtaaaaagaaaaagaagagcaggaagaagaaaaccaaaaaccagaatattggagattcagaactagatagaatagaacaggacactcaaataacacctcaggttgaaagagatgactttcctgctccactaccttacgattatgatcctctaagttataatcaatttgtttcaccatctgacacgtctcacgagaactccaaacggtatcgaggtgaactattgacacatacaattgatactcttcctgcaccagtcaagaaattttggaaacgaaggtatgcactatttgaaaaatttgatgaaggaatatacctatcatctgaattatggtatagtgtcacagcagaatccatcgccaaatatactgcaaatttattccgcgatttgttgcccaatgccacatccgggttggatctatgttgtggagggggaggaaatactattcaatttgctaaaatttttgacaacatcggtgcccttgatataaatcccataaacctatactgcacaaaaaacaactgcaaagtttatggtgttcaagataatgtttggacgattgaggctgattggaacgaggttagcgaattaaaggatggaaacgttaatacagaatggattccagagggtattcgtcgttctgaaaatgaagaaacattacaatttgattttgttttcagttctcctccttggggtgggacaagttataatcgaaaggtttttgacttgaattcaatggagccatttcctataacaagaatgctacagcagataaaacggtacactaataatgtcggattatacctaccgcgactgctgaatttggaacaacttcaagaagcagcattaaaaacctttggagaggaaggaagatgcagagttgtccatatacgctctgatgctaggatt

SEQ ID NO: 1800 - DNA, 1176 bp, Candida albicans
ctacaacttatacaaatatacatacaatttcagactatggcagccagtgaagaaagtacattggtcgacgagtatccaataaaatctatactaaaccaaatatcaccttggttcatcgttgatgagacaaaatatggtggcagaggctgctttgcaccaaaagtcattccacagcacacagttattcacctgtgccaaactcctattgggtccactctcagcaaaccatttaaaaaagaagtttgttcccaatgttatacttatacttatggtgaaacaatgaagttcaaaatctcgaaaactgaaggaaaacatgtttactccctttttttttgtagtgaagagtgtaaatcgacatttacacaccaagatataaatcgtgttttagttgaaaacttgctagcagtggagaaaaattatttggcgggattatcaaaaccagaaatagaagctatggaaccaaaaaattttgctgatgattatgtcaaagaatgggataaggttgcctcatgggaaacaaaacttgaatcactaaaaccatcgaaaagacaaaatcaaatattcagaatcgatgataatgagtatcttgaaatcaaatatgttattggagtgctatttaacatgtataaagttcactgtaacgatcatattccacattttgattatcctaatttagataaaaatgaagccaacaaagttgaattactcctatttgatctattatattcttcagaatttgaaaaagtaaaaagatatccatacctattatactcgtacataaacatttacaagttcataaaactcacatgtactcctgagttgcaggctttcattgattctacaactatacgatctataattgggaaaaatctatctaatgcatttgggatatggtcagaagtgactgatccttcagaagataaagaatttttgggatttggtgtatacccttcggcatcattcttcaatcattcatgcagtccaaacattgtgaagacacgaaataactctgaaatggttttcacaacatccaaagatattgaaattggtgaggaattgtgtataagttatggaaattataccgacgagcccgtcgaattaaggcaaaaacaattgaaagaatggtttttcgattgtgcatgtaccaaatgtcaaactgaattgaaaacaacttaa

SEQ ID NO: 1801 - DNA, 735 bp, Candida albicans
accagagtctcgtcaatcaaggcaagaatggccaagttatctattggacaagaacagatttataagagtttccaacagttaccaaaaacccgtcatgatataatagcgacaccagaactatttagtatggaagtatacaagttccctaccttaaatggaattatgataactttacatggaagctttgatgaagtcgcacaacctgaagttgacgggagcgcttcatccgctccctcaggtccaaggggtggttcaaggtatcattcagggccaaagcacaagaggatcccgctaagcaagaagagctttgatagaacatttgttgtgatacctggtccaaatggaagcatgatagtggccagtgatactttattaataagaccatataccagtgatttcccatggaaagtacaaaaattgccttccaatccaactgccgctacaccaggtgtttcagccacctcaactccgtcaccactcccaccaacaacaattacaactccacaactagcaccacctggtaccggaccaactacagcagatttaccagcagatataaaggctcgattaaatcaaatacagcaagagttgttggtgaagatattgctagagacaaagttaaacattaactacggaataatgttatgcgaacagagtaactgggattatcaacaagcatcagtcaatttcaaaaactcggctgcttctttgcctagtgatgcatttgtacaatag

SEQ ID NO: 1802 - DNA, 963 bp, Candida albicans
tcctcaattttagtctttagtttttcatttttttcattttggaatatgagttatagaggaagaggaggaggttacaataacaacagaggtcaattttcctcgggtccacaccagcaccaacaaaatgtcgattcattcgtagcagcaaaccaatacccaattgaaataatgggatggaatggtgcgagtctgggtgaatgtataaatttcatatctagaaaatgtaaggtcattgtatcaaactattccgttgattcgaacagtggtgttttgaaaggatatgtaaagaatgaatcgcaagctaacacattattgaattggtcaggagtgaaatttgctggacaatctttgagattttctaaaggtgtatcaaatatatccaatcagatgggaggcggagcatcgacaggctctcaatctactattgaaacaatttcccagtttttgaaagctagataccaaccagaaatcaagatgttaaatctaagcaatgtgaaacaggatccaactttgactgctcaaggtttttttggatcactatctgtgagttcaaaatttttcccagcattgatgaaagtagcaagtgatttgaaattggacgttgacagcattgatttgtccaacaatgaacttcaagatttacaaaccttaacgtcgatggcacagacattccctaaattacaaaacctttccttacagaataacaatttcaccaagatcaaagttttcgaaacatggagacataaattaaactttttgagggaattgatcttgtttaacaatcctattgtgcaaacaaatgaccctgcagagattcagaccatcaagttagagttgatgaaaagtttcccgagattggtagtattgagtggcgaaatattaagaaatgaacaagttttgattgccaatctttcatttccattcgagtctccagaaacaatgtttttccaagatgaagattca

SEQ ID NO: 1803 - DNA, 513 bp, Candida albicans
tacactattactattgttttatatcaactaaaagaaactacagtcatgcttactacaattcttattatactcattattttgtattttgccagaaatatttacaatgagttcattaataacccaagcagtccactagacgtatccacagaaaaggaatcaaccatagtagaaggcaaattcacccctatatcactcacaaaatacaacggtaaagattcacccaaaattttcattgctgtaaagaacagggtctttgatgtaactcaaggtggagcattttatggaccaggtggaccatatgagaattttgcggggagagatgccagtaggggattggctaagaactcctttgatccagatgtattaacagacattaacgagccaattgacaccttaacggatttgactgctgtagaaaaagagtcattggatggctgggaagagcattttgaaaacaggtataaagttgttggtactttacatgaaaatggtaccgttgaggagaaatcataa

SEQ ID NO: 1804 - DNA, 1440 bp, Candida albicans
atgtcacgtaaatcaggaagaagaggatataattcggatactagtactgcaagcaatcgagggagtggaagtagagaaccacgagaagaagaaattgttgatttggaagaagaagaagaagaggaagaggacttgattgaagaagaaggaggagaagacgaagaagatgagattactcgttgtatttgtggacaagacgaattaactaacgattccattaatcctgaattatcgacttttttgaaaagaacatacaaaatagaaatagatcaaggtttatttattcaatgtgagaaatgttcagtttggcaacacggatattgtgtgggattatttgaaagtcatgatgtacccgatgaatattggtgtgaatcatgtaaaccagaattccacatccttgtcaataatgatggatattcgaaaagaacattatataagccggtcaatgataaaaggaagaaacttgaacaaatgactttcaaaaacaatgaaacaagccatagtacaaggagaagaggaggtaaaaatgaacgaaacaccccacaacaagacacaagttctaatatcaaggataaacggaaagaacgaagacaccatcatcaccaccataacattgatgaagatgacgatgaatacaatgaacaattgaaaagagcattaagggaaagtgcccgagaatcaggggtcaaattaagtgaatcagaatcaaatgaaaggggcaatgggaattcagttaaaagggaggacaataagagtgatgggaataatagtagtggcagagaaggttcaagaggtaatggatcaaggaaaagagagaccagtcggagagaaaatgccgataatagcgattcaaaacgtcttaaagttgaacaatctgatcatcctagtggttcagagttgaatgagaattcagaacaagaacttgggtcaggaagtgaggggtctagaagtaaaagaaggggtgtggctggcgctggtgcaggtgctggtagtacgaaaaccactaggaaaaagaagagtacaccaccaagactgtccacaaacaataataataataacaacaaaaagcaagatgattcatctaatgaaaccaattcattgggaccaactaaagaagaattaattcaacaaccatctaaaccacgttatgtaaatgataaatcttcgatttttgaattacggaaaagaacaatagcaatattagaatggcttggtcgttctcaagttgaacttcaggaagaaaagcaacaaaaattagaattattttcatttataagtgatgatgatgaaaaagaaggatcatcaaattcttctaaagaaaatgctaatgctgatgcccttgcattaaaagaaacatttgatgagaatttactactaatggaacaacttacagaacgaatcttagcatggcaagatacatttggtaaatatgctgtttag

SEQ ID NO: 1805 - DNA, 1482 bp, Candida albicans
cagttttttataatggtagaagactctatattactagtcgataattctcaacctgtggaatcatcatattctacaaacccccctgttgcttcaggatctacatcttcctcacgaccaactccaactgatacagtacaatttccaattaaattaatcaattggagtttagatccccaaaatcaaaccattataaccaccccgatattattacaagaaataaatggtccatgtccattaattgccttatgtaataccttattacttaataatgatatacgaaccaattcatttattctggatgaaggtgaagatgaagataagggagttgatcaattgaaatttgaagctttaaataattttaaaactaatattattaataaatatcatagtttaggaaaaattgatttacaacaagtattagaatatattggtgatttattattgatacacacagagaatataactgattggaatagaaaccaccagaactacaacaacagcagccaaaaagaatttactatcgatgaattattattgaaattaccattattacataccgggttaaatgttaatccaatattaatttcaggagattttgaatatgatttggcaacacaattatttgaactatttgaattaaaattcaaacatggttggattattgatccaattaatcaacatgggcaccaccaccaagaagaagaaggaaattctcaagattctcaaaattctcaaaattctcaaatttggactaatcaagaatatggaaaattagttaatttatttgatcaattagaaaattttgataaaattcaagattatttattattagatcaacaacaagataaagaggttttgggaaataaattattaattgaaaaatggttaaatttaaatcaaactcaattaactttacaaggattaaataaattaaatgatgaattagatataaatcaatttataatttttttcagaaataatcattttaatacattatttaaaaaatcaaatcaagaattttatattttattaactgattcatcgtttgtcaatagtaataagtcatcaaaaataatatggcaatcattaaatagtgtatctggtaaagatgatttgtttttcatgggtgatttcactccagtcttggatattgatcaagatttacccaatgtcaatactagtaaacttggtggtgatatttattctcaagatcaaaatccagattatttattattgaaacaattacaagaagaagaagatcaaaaatatgctgaaagattacaaaataattataataataaatcacgtcaatctaaatctaaatctaaatcaagttcaacaacaaaatcgagcctttcactgaatctaaatccactggatccaacaacaacaacaacaacaattactgaaaaattgaattcaaaagaagttatcaataaagatgaaaagaaaaagaagaaattaaattgtacaattgtataa

SEQ ID NO: 1806 - DNA, 1494 bp, Candida albicans
aaacataaattgacggcgttgtccgaaatggtatttgaagcagaaattggactcaataagcataaacttatgtggtctaaatccatagcatccctatcaaatatagcagaagcaataacgttcactataaataaagattctatatccttgtctgcaaccaataccagtaaaacctcctacgcgcaaatatatttcaagaaaacctttttcaacaaactttccgttgattttaataatatattaccagaaggatatgatgatgggaaacaacagaacgagaaaccgagttattcttttcttattaattcacgacatatggcaactctattcaaaagtctagattcaagtggtatgaaacatttaagttttaggataaattggtctcgtaatgctccaataaacctgaggtataaattatttattgaaatccatacgaaaaagttggttgttaaaaagttccaagctagttatactccagcaactaaacagaatctatatattgcttctatttataaggacaccttatataaacaacgagaagaagaagatgatttacatgataaaactcgaatcaaccacataatgatagatcaattgatacccaaacagtttcttgaaatggtccctgcatctgctgaagatttcaaaatagatatcaagagtgaaagaatactgttttgtggttatactaaacaaataatcaaagatagagattatttgaaacaacccatggcagtaacagtaactatcagtctagatgaattaactgattccaatttactactgtcgaattcagatcaagaacctatacgaaaacaaattaattttggcatgcgtgatttcaaaaattttttgaatttagccaattttttcacaactccatcgtcatcctctgaacgattagatgaaaattatgtaactactgccaataatgattatttccacatatttttcagaaaccctggagatcctatattatttgatttacaaaattaccaacatacagaagttcaattcattcaaatcacttctgaggataaatctgagttacattcaaaagaaattgacgcagagttgattagaaaaggtttaacaatagaagccccaataccccaaaaaattcaaagtaacgaaacagcaacaactacagcaagcacaagcacaacaaaaacaaaaacaacaaccccatcattgactagactcaccactaatactgtatttggtaaaccttctattacaaagaaaagaggaaaacataggcttatcaataaagatcaagtatctcaaggaacaataaatgatgattttgacgatggagttacatatggacaagaaccagaaccagaaagagatagagatagagccaattatgctgaaaccgattacagtaatagttccgaagatgaatctaaagagccaccatttaaaaaacatgcatttgatgaagaacttggtcctacacaactcaacaataaacctaaatcaatattttga

SEQ ID NO: 1807 - DNA, 243 bp, Candida albicans
aaaacgggccaaatcaagaaatcggattttaaagcatttatgtataccgggatcaaggattatattgtttattccaatcaagaattcatgcccattggttcatataatggtcaaaacggattatttatggacaagtcattattatcgggggttagttatagttgtgatacttttggaaatgaaatattgaattcatcaccacaaaatgccaaatttggttcatttcaaaataaaagagactag

SEQ ID NO: 1808 - DNA, 1083 bp, Candida albicans
aatcctgtcaagaaactattaataagaaaatataatttaacactcatgtcatttctttttagaagatctacagaacaacctcgagtgaatgaggaggagaccaataaagagataaaggatgaaccacaacaccaacaacaagaaaaagaagacgataattctaagcaagaaaaattattgtccgattctgtaaacgagaaaccaaaagagcaacctaaaccagtgaaaagaagagggacattttttggtaatatacttggaaatggttcaaagaatagttcttctgcatcattaaactcgtcacattctagtgtttctagtctgagtaaattccctccattgggaccattgacacttactgggtataaagaatcaactcatcatcgattactagatctggaattggcaaataatataaggaatgtaatcccggctcgatttcaattatttgataattgggagttggtatattcattagaacaacatggaatatcattgaacactttatatcggaactccaatccagaacatcaactaagactactaaaaaaacagaaagcagcagaaaaggggtttgccgattctatagtaaagaatatggtggttggtgatacatctagacccagatattcattcgaacccaaaagatcacaatcgtacgttttagtgattaaagacaatcataataacaaatttggtgcttatttaagtgagaatttgaaaccaatggaacatagaagatattatggtaatggtgaatgttttctttggaaatgtgaaaaatatgatccatctaaattggatcatgccgttgataaacgggcaactcaagaaatccgatttaaagcatttatgtataccgggatcaatgataatattatttattccaatcacgatttcattgccattggttcatctaatggtcaaaacggattatttattgacaagtcattattatctggtgttagttatagttgtgatacttttggaaatgaaatattgaattcatcaccacaaaatgcaaaatttggttcattcaaaataaagggactagaagtttggagaataggtaccttagagtaa

SEQ ID NO: 1809 - DNA, 603 bp, Candida albicans
ggtctcactaaagaacaagaattaggtccggacctgaaacgtgtattagctcaagctgaagaatgtaatcgtaaagctgccgaatatgttttccgtgaaaataatgaagatagtggacccgatgaaattgatttacatggattatacgtcaaagaagccgaatggattttggaaagaagaatttattatgccgtcaagacaaatcaattgcatttgaatgttattgttggtaaaggattacattcagccaatggagttgccaaaatcaaaccggctgttgatgaattgtgtgatcaagttgggttaaaccattacattgataaaaagaatagtggagtgttagttattgatttgaaaggtgttaatcttgatagacttccaagttcatgggctcaaggaacaaataatgtggcaccacctcaacaagcttatcacggaactggccaaccactatatcaacaacaacaacaacatcaaggacaacaatcacataaccaatatcaacaacaacaacatcaaggtggccaacaagacattaaaactggtaatgatttggttgatatggttcttaagattgtttgtggttgtctcaacagtaagtga

SEQ ID NO: 1810 - DNA, 555 bp, Candida albicans
ccatttagtatgagaccacttacagaagaagaaaccaaagtcgtatttgaaaaactagccaattatataggtagaaacatttctttccttatagataatccagaaaatcctcatgttttccgacttcaaaaagatcgagtttattatgttcaggaatcaattgctaaatttgctactagtgtatcacgtcaacaattaatgtcattaggtacatgttttgggaaattcactaaaacggggaaattcagattacatattactagtttaccttatttggctcaatatgctaaattcaaaatttggattaaacaaaatggtgaaatgccatttttatatggtaatcatgtattaaaagctcatattgggagaatgtccgatgatattccggaacatgctggggttattatatattcaatgaatgatatacctttaggatttggtgctagtgctaaaagtactgctgaagcaagaaatttacctccaactggtatcgttgcatttagacaaggtgatataggtgaatatttaagagaagaagatacattatttacttaa

SEQ ID NO: 1811 - DNA, 729 bp, Candida albicans
caccgctgtttatatataaataacttgatgagattaacagcccaggtgataaatgaagcaccggaaatattgaatccagaagggaagttgactttgttgctacgagatctccaaatcacagaactagagaatcttgcaatcacacaaaacaagtatcaagttatagatttatcaaataatgatttaattagtctaggtaatatacctaaaaggttcaataatctacaatgtttattgttgtcaaataataacatctcatatatcgatgatgagagtttccccctggataaccacataacgtcgataacattatttaacaacaacatttatcagtttcagaagagtttcaaagataagtttccgaaacttgagacattaattcttttaggaaatcccataacggaaatggaaaattatagatatttcataatatggctaatacctagtttgaaagtattggatttcaagaaagtgaaacaggcagaaagaaaaacgagcgaagacatgtttggcacaaatcgcgatgaattcaactctttggcacaacagatgtttaagaatgaaaatacagaaataaaattagatggaaaatcagatagacaagttaagaattttgttaaaaagatgactgatgaagaaagacaacaattgttaaaaaaattagagacagccaccagtattgaagagattgaaagaattgaaaatgacttaaaagaaggagctgtctaa

SEQ ID NO: 1812 - DNA, 276 bp, Candida albicans
ggaacaaaaccaagaaatataaatcaactcctgatccagcaaaatacaaccctaaatttttaccaagaaaattggattttagatcaagtgattcagcaagcagaaagctcacgtggggctgagacaacatatcttgaaaaattgcagaaaatgagttccaacccatatgacgaaactaaatggggagatgaattgaaagatttagagcaatcttggttacttcagggtaacaaaggggatgagtttgccatgttacagtgtggctgttcaagctaa

SEQ ID NO: 1813 - DNA, 468 bp, Candida albicans
ctaaataacaacttcatcgaaataatgtctgcccaaccattcagtgccgaaaatgccgataacttagaagaaatcgaaatgcaatttgctgtcaaagcagtccaacaagctgaaacttactggtccttattagaaaagattcctggatctaaattgaagttaaccaaacatgatgatgatatatttaatcaattacttgaagatttccctgaatttaaagaaccaagcaatgttgccgttattcgtgaagaagatatgaaaagcacctcaggtaaagctagatggagagctttctgtgaaaaattcaatgaaatagaagactacaactttggtacattgctcaggttgaaagccaatgaagaatattcacaagatggaaccatgtttgccgttagaattcaattttatgctattgaaattgctagaaacagatatggtttgaatgactggatttctaagaaagaataa

SEQ ID NO: 1814 - DNA, 1584 bp, Candida albicans
cttgtttatggccatactgcaatgaatgttggatctattttaaatgacgacccaccatcaagtgggaatgcgaatgggaatgatgataataccaagattattaaatcccctactgcataccataaaccttctgttcatgaacgtcattcaataacgagcatgttgaatgacactccgtcagattcaactccaactaaaaaaccagaaccgactataagtccagagtttagaaaacccagcataagtctgttaacttctccaagtgttgcacataaacctccgccactaccaccgtcactgagtctggttggaagtagtgagcattcgagtgcaagatcgtccccggctatcacgaagagaaactcgattgcaaacattatcgatgcttatgaagaaccagctactaaaactgaaaaaaaggctgagctaaactcaccaaagataaaccaactgacaccggtgccaaagcttgaggaacacgagaatgatacaaacaaagtagaaaaggttgtggatagtgcacctgaaccaaaaccaaaaaaggagcctcaaccagtttttgacgaccaagacgatgacttgacaaaaatcaaaaagctcaagcaatctaagaaaccacgtcggtatgaaacacctccaatttgggcccagaggtgggttcccccaaatagacagaaggaggaaactaatgttgatgacgggaatgaagccataactagactttctgaaaaaccggtatttgattataccactaccagaagtgttgatttggagtgtagtattactggtatgatacccccaagttcaatcacgagaaaaatagctgaatgggtgtatgccaatttttccaatgttgaagaaaaaagtaaaaggaatgttgaattggagttgaaatttgggaaaattattgacaaaagaagtggtaatagaattgacttgaatgtggtgacagaatgtattttcactgatcattctagtgtgttttttgacatgcaagtggaagaggtggcctggaaagaaataacaaaattcttggatgaattggaaaaaagtttccaagaagggaaaaagggaagaaaatttaaaactcttgaatctgataatactgacagtttctatcaattggggagaaaaggtgagcaccctaagcggattcgtgtaaccaaagacaacttactatcgccaccgagattggttgccatacagaaggaacgtgtggcagatttatatattcacaatccgggctccttatttgatttgaggttatctatgtcattggaaataccagtgccacaggggaacattgagtcgattattaccaagaataagccagagatggtcagggagaagaagagaatttcttatacacatccacctaccattaccaaatttgacttgactagggtcattggtaataaaacagaagataaatatgaggtagagttggaggcgggtgttatggaaatatttgctgctattgataaaatccagaaaggggtagataatcttagattggaggaattaattgaagtttttttgaacaatgcaagaactctcaataatagattgaacaagatttgctag

SEQ ID NO: 1815 - DNA, 738 bp, Candida albicans
tccaatgttgaagaaaaaagtaagaggaatgttgaattggagttgaaatttgggaaaattattgacaaaagaagcggttatagaattgacttgaatgtggtgacagaatgtattttcactgatcattctagtgtgtttttagacatgcaagtggaagaggtggcctggaaagaaataacaaaattcttggatgaattggaaaaaagtttccaagaagggaaaaagggaagaaaatttaaaactcttgaatctgataatactgatagtttctatcaattggggagaaaaggtgagcaccctaagcggattcgtgtcaccaaagacaacttactatcgccaccgagattggttgccatacagaaggaacgtgtggcagatttatatattcacaatccgggctccttatttgacttgaggttatctatgtcattggaaataccagtgccacagggaaacattgagtcgattattaccaagaataagccagagatggtcagggagaagaagagaatttcttatacacatccacctaccattaccaaatttgacttgactagggtcattggtaataaaacagaagataaatatgaggtagagttggaggcgggtgttatggaaatatttgctgctattgataaaatccagaaaggggtagataatcttagattggaggaattaattgaagtttttttgaacaatgcaagaactctcaataatagattgaacaagatttgctag

SEQ ID NO: 1816 - DNA, 732 bp, Candida albicans
atatataccaaatacttccaagaagcatttcaaacaataatggattttcaaagtgattacgagaaaattgatttatcaaaacaagactttcaatacgtgtttaacaacatactacaggcgatcatggcaaaattgaaccttcatctaccggcagcacaaaatgaccctttaaaggagcaagtttctacgatattagaggagtttttaatcaatacttttgataattccaaatactccatattggccgatggactagatttacaaaatgttctgattcatgatattttatcgttgaaaacattagaaaatgttgaaaaaatagattctgaaataaccatacaattacggaaaatttttcaagaatttgaacaagaaactgttgatgtgaccaaattacgacgagatttacctaaacaagcaagcgagatgtataatgacattattaaacaaacagatggcgaagtttccgaaattataaatatgattgaacaacaaagccaagagtatcaaaaggtgcaacaagctcacaataacactgatgataggtttgaaaaaattatagagagcatggacttttcacagatcaatcagaactacaatgatcatctacaattgttgaatgaaacaaataaaaatttaccaagtttgaaaattgaatttgaaaaatataacagaacagtacagtttttagaagatgcataccaacaacagttaaaagaaatggacggataa

SEQ ID NO: 1817 - DNA, 1524 bp, Candida albicans
aattatactttatactgcttgatcaatatggcaacaaatactatcagtaccactaaagtgacaacaaccaccacagatgtcacaggcttatcattgattgccgcacattctcatatatcaggactaggattggacgacaatttacaaccaaaggaaaatgctcaagggatggttggacaattatctgcccgtaaagcagccggtgttatcttaaaaatggttgaagccgggaaaattgctggaagagcagtgttaattgccggacctccatcaactggtaaaactgccatcgccatgggattatcacaaagtttgggtaatcaagtgccatttaccgctttagcagcatcggaagttttttcattagaattatctaaaactgaggcattaacccaagctttccgtaaatcaattggaatcaaaataaaagaagaaacagaaattattgaaggggaagtggttgaaattcagatcgatagaacaatcactggcggccacaagcaagggaagttgaccattaaaaccaccgatatggaaacaatttatgaattgggtaataagatgattgaagggttaaccaaagaaaaggttttggctggtgatgtcatctctattgataaggcatccggtaaaattactaaattaggaagatcattcactagagccagagattatgatgccatgggaccagaaaccaaatttgtccaatgtcctgaaggtgaattacaaaagagaaaagaagttgtccacactatctctttgcatgaaattgatgttataaattctagacaacaaggattcttggctttgttttctggggatactggggaaattagaccagaggttcgtgaccaaatcaatactaaagttgccgaatggaaggaagaaggtaaggcagagattgttcctggggtgttgtttatcgatgaagttcacatgttagatattgaatgtttttcattcatcaaccgagcattagaagatgaattctcccctattgttattatggctaccaatagaggtgtttctcgtatcagaggcactgattataaatcaccacacggtatgcctatggatttattggacagatctataactatccataccacgtcatatactgccgatgaaatcagaaccatcttatcaataagagcaaccgaagaagaagtggaattatcaggtgatgcattggcattgttgactaaaattggacaagaaactagtttgagatatgccgccaatttgatctcggtatcacaacaaattgccttgaaaaagaaaaacaatacagttgatctacaagacatcaagcgagcatatatgttgtttttagattctgatagatcagtgcaatatttggaagaaaacgctgatcaatatatcgatgattatggaagagttactattggtcaagaaagtacagatgggtcaactcaacctcaagcaaaacaacaagaagtagcccaaccagaagcaacccaaccacaatctcaaccagaagatgataaaatggaaacagattaa

SEQ ID NO: 1818 - DNA, 279 bp, Candida albicans
gaaattcaatcgcggatccgtcgactcctagcaggtgaagaacaaagctatttacttagtggtggtgatgattgtcaggcattggtatgggacatcaacaatttgtcaaatgcaacgaacggaagcacgaatggaagtaatcattcaggtacgattattgatacacctgtattggcatattcagaagacttggaaatcaataacgtgtgttggagacagaaccaaggggattggatgggtgttgttagtgggaaaggtttcccaacacttctgatatga

SEQ ID NO: 1819 - DNA, 1509 bp, Candida albicans
  unsure (1484): Identity of nucleotide sequences at the above locations are unknown.
aaaaattttatggattggtataataacagatctagacgaagttcaataacaacaggtcaacccacccaatcaaacccagcgtttcatggaattatcaattctaataatagtaccaccgcatcaagttcattatcttcttcatccaattcgtattcctcatcgtccatgattaatccaaataagtatcccacgcaacagcaacagcagcagcagcacggtaatattccatcgccccttaatctatcgtcgcaacaaactatgggtcgtaatttgagtccggtgtctcaaacaaactcgcctattgtgacaattcctccaacaccattagaaaggaactcatattattttagtgagttcccactttatgcatgtgattggacttgtttaaacaatggacaaatggattgtattgcagtgggttcatacaaggaaacatttgccaataaactagaaatcgtccatggcagtaactatgaaaatgaatttaatatggagaattcacttagtcctggcacagacaattcgttcaattataataacaaaaacaacactaatgcatactatgaagatgaagagatagcgtctcgtgatgaagggttctgtttccaaaaagtttgtgatgtcactttggattatccaatcactcatttacaatgggatccactgatgttactgtacggttcaagcggtgttgaaagattagctacatctagtgaagtgttacggttgtataaagttgctaataacggtaatgattcttattcattgcaacagactcatgtgttggctaataatactgctagctgttcgagtacttcttccaacagcaacaattcatcaggatccagcagtgctcgaactattgaagatgtaaacacattccctcccgtgacatcgtttgactggaataagactgatccaaatgtactaataacctcgagtgtggatacaacatgcacagtgtgggatttgcaccgatcacccggcagaacagcaatcaatgaagaaatgctagatacggcgacggtcaagacgcaattgattgctcatgattcagaagtgtttgatgtcaagtttttacacaagtcaactaatgtatttgcatcagtggggaatgatggatcaatgagagtgtttgatttacgatcattggagcattcaaccattatatacgaaccgtctccgtcggcctattcatctgcaacagcatcggcatcagcatcaacgtcagcagcaaaccactccttgtcagcaactttcaattcaaaggctttgttaacattaagtacgtcgaatgtcgatcaacatcatctagcagctgttggtgtcaactctaatcaaattattatcattgatatgagaatgccaggattacccgttgtgataattgatgcttcattaggtgggatgaataattctctgatcaatctgataaaatggcatccaacatcaaactatttacttagcggtggtgacgattgtcnggaatttagcccaacacagccctga

SEQ ID NO: 1820 - DNA, 1659 bp, Candida albicans
ccacaaacaacaatgtcttcacctgttctccctaatagaaggtctattcaggtatgcttaagattagacgagtcaccaaacgaggatgtccaggaattgaccaccatacaaaacacttttgataagtcaacctcaaactatttgttacagtcaaaacacaatcagttgtcaatcaagttccaagataaaaacaaccaaaccaaagattccatcaactcgagtgcagaaaatatcaaaaagacttttcaagatataaagagtattgcaggtgggtttggcgacgtatttgaaatcgattgggagttttggagtttggtggttaatgattatgatcatgtggtaaaccatgagctggataaattaaaccagtgtataatatcaggaataccaaaagagttcagaggcattatttggcaactagtggccaaatccaaagattctcaactagaagatttctaccgccaactaaaactagaatcgtcaatccatgaaaagggaatcaaacgagacttgactagaaccagtttctttaccaatgtcgaggcggttagcaaaagcgatgagcttttcaatgtcatcaaagcgtactctttgtatgaccccgatgtgggctacacccaagggatgatttttattgcagtgccattgattatgaatatgaacgaatcggagtgtttttgtttattggtcacgttaatgaaagaatacgggcttcgcgatttgttttgcccggaaatgaaaggcttgcatgttttgctttacgaatttgatcgattgttggaatcgtattctccagtgttatacaatcatttggtcaaacaaggtatcaagtcgtcaatgtacgcttcacagtggtttcttacatttttcgcctacaagttccccttggacattgttttaagaatttacgacataattgtcacccaggggatggagtccatattgaaatttgctgtaaatttgatgattcaaaatgagtccaacttgttggcattatcgtttgacaagttgctcgagtttttaaaagataagttgtttaatgtttatatcgccgaagcatttatcaaggacgacaagggtaaaaagagattttcgttgctgcgatgtgctaccagcacacccgctacatattacaaactagatgaattagtgcaagattctatgcaagtaaatgtcgaccctgtggaattgactaaatacgctaaggaatttgaaagtatctacagcaaagaaagggccaaggtagacgatatcaaaggtatgagactagcaaacggtaatctgagacatagaattaaagaattgcagtcacaatactcagccctaaacagagaccatgttgatattgttcaaaaaatggtcgatttgaaaatcaccctacctgatttggttaacgagaacgaggatcttaaacatacaatagaaaagctagaaaaagatgtcgaagaattggaatcaaaaacacaacctgccaacgatgtcttgcccagtgaaatcgaagaccaaatacaacaactatttgtgatcaatgctcaggaagtagaaaagtcggctaatttagaagaagagttgaattcgttgcttgagcaagaggaaaagcttactaaattgataaagcaggcaaatagaaatagtacttggttcaaatggaataaatag

SEQ ID NO: 1821 - DNA, 615 bp, Candida albicans
tcgatgcggcatcggtttccacttgggggaagtagaaatggtcatggcctttatagctcaggaaagagtggaagaagaaaaaaaaaaattttgataatgactgaaaaatcaagccaatttcagttcccaatctctttgtcatcaccaaaactgaaaacagttaatacaccaaggatatcaaaacttcgaagtagcatcatgtttagattaataccaagattaaaaccaataataccatcaataaatcgtatttctttgtccgttaaaccacaaccatcaacttcacaacattgtcacacattgcgagctttccatacatcaccaatttcccttcatggacacctcaaaaaacctaatccaggtgaagaattgcatattacatttataactaaggatggcaaacaattaacttatgaagttgctgaaggtgataatattttggatatagcacaagcacataatttggatatggaaggagcttgtggtggttcatgtgcctgtagtacatgtcatgttatcgttgatccggaatattatgatagattagaagaacctgatgatgatgaaaacgatatgttggatttagcatttgtctcccacgggtggaaatccagt

SEQ ID NO: 1822 - DNA, 1953 bp, Candida albicans
gtttacaacaatttaacaacttatctaaaagtaataatggcaaagaaggataaaaaatctaaagaagccaaaaaggctagagcagctgaaaaacagaaaaaaagtgctgccaaagccgaattaaaagataaaaaattggccaaaaaattaggtgaagccgatgatgatgaagatgatgatattgatgccattttagaaaaatatgctaaagaacaattagaattcaccgaaattaaaattgaaatttgtgatcatcatccaacaaaaagattaaatccaacaatggttagtaatccattacataataaacgtgaattaatattatttggaggggaaaatactgatggtggtcatagtaaattttataatgatttatatacttattctattgacaatgatacttggaggaaaatttcaagcaaaaattctccattaccaagatcttcacatgccatgtgttctcatccttctgggataatattaatgtttggtggggaattttcttcaccaaagcaatctacattttatcattatggtgacacttggatacttgatgctgatactaaagaatggcaaaaaatagattctaaaaaaggtccaagtgctagatcgggtcacagattggccgtttggaaaaactatattatattacatggagggtttagagatttgggtaccatgactacttatctaaatgatgtttggttatttgatgttacggaattcaaatggactcaagtagaattccctccaaatcatcctattcctgatgctagatcaggtcattctttattgccatgtagtgagggtgcggttatttatggtggttataccaaaattaaggctaaaaagggtttacaaaagggtaaagttttgaatgattgttggatattaaaaatgaaatctgatcctaaagctgtacgatttgaaagaaggaaaaaacagggtacattgccatcaccaagagttggatgttctttagtatatcataaaaatcgagggatgttatttggaggagtttacgattttgaagaaagtgaagaaactttggattcagaattttataatcaattatatacttatcatattgaaagtaatcgttggtataatttacatttaaaacctcaaagaaaaaagaataaggaaacaattaaagaaaaaactcgagatgaagatttagaagaaattttaaactcaattttagcaaaagcaaatttaaatgataatgataatgatggagaagaagaagaaattgataatgaagaaatgaataaaattgaacaattgaaacaacttgaaaaaattgatgagccagagaaggatgttatggaatatcctattatgaatcaattacctcatcctagattcaatgctaccacctgtgttgttgacgatgttttgtatatatatggtggtattttcgaaagaggagaacaagaatttaatttagattcattatatgatattgatttagggagattagatggtgtcaaagtattttgggaagatttgtcagaattagaaaagagtgaagccaattcagatgaagaagaagatgatgaggacgatgacgatgaagaagaaggtgatgaagatgaagtggacaatattcttgaagatgaactagaggaggaagaagacgaagaagacgaagaagaagaaactgaagaagaattccccgatgcaagatcatggttgccacatccaaaaccttttgagtcgttgcgtgctttttattctcgtactggagctcaatttttggaatgggctatttcaagtaatagagatgctcgtggtaaggatttgaaaaaagctgcatttgatatgtgtgaagatagattctgggaaagaagagaagcagtttctgtagctgaagataatttggaagaaatgggcggtgtaggtgaagttgttgaaaaagatactagtaaagccacatccaaaagaagataa

SEQ ID NO: 1823 - DNA, 894 bp, Candida albicans
agagccaaaccgctgacttcaaatccatcggaatccttcaatctactgcaacgtgatgttttccaaattacaaaagtattggaagatattaatctttatttgaatgatttactcatgatttttaataatgttgagcaggcgtcaaaaaatgttgttgatgtattggattggtattttgaagggaaatccttgttacaagacctactacgaaatattgaaaatattgattccattatatcccaattgttattagtggttgaatcatctaataatcatgaaagtattggtaataatcttctagcaatatttgaagaaattagtgatttagtgttggatgtgaaaaaatccctgattatgtttaaaaaatatcttgatatttctatcaattatcgggaaataattgattcagttataaaatcattgagtaatgaaattgaagattgtataaaatgtattttgaaattaaaagaattgaaattggctagtcctaaaaatgttttacctaattttactttacaatcaattatttccaaaatgaaaattaatgatttatcaagtggtacattttcttttaaatcaatgagactacctacatttagtgatttggatgaaaaattatataatgattatcttgaattagaatcgaaaattgatcctttaagaacttctttgagtattgttcctttacgaattgatgattttaatacaatgtgtgccggacaattttttgtaaaatctcgagaaaacgttttggatgcttatgaagtattaattctgaaatggaatatgttgttgaaagagaaaaattcttataaaaaggataatattaatgttaaatggaatgaaatatgtgaatatttgattgaagaaattgtaaagaatgtggccgattga

SEQ ID NO: 1824 - DNA, 1578 bp, Candida albicans
ttgtgtgtgtgcttgtttgtacaattttttagcaaccacttgacaaccaatttcaaactcttttcatgtaaaataacaaaacaagatgaaaagtattcagacaaccaacaagcgtcttcaaacttcaaaaataatggtttccgtttcagtttctttatcttattgcttcttattcacttttttgtttggattcatttgcaaagaatggaattaataaatcaatctaacaattctttatcaacagggttacatactgcttggcttttggcaacattgggttcaaaacctagtattcgatctaaattaatcaaaaaatcaacaatcaattatcttctgattcctgaattgtgtcatgaattattagcgtcaactaattcaaccattaacgatgctcaagataaagatgccattatatatgaaccacatactcctggcaataatattcgatatgtttccaacattatgcatgggatttcgattttatatcaaacaaaaatcaattatttgatgaatgatttgatttatatcgaatctcgtcttaaatgtcactatcaaaacagttacaatgatattgttgatttatcgtcaggttcgttgattaaaacatgtttggtaccttcaatggctaaaaagcgggcaatccagtatttgagtgatgatccagcatttagtattcaattaggattagtggctccctttacggaagaaacagatgagatagcaaagagaaggaaattagatattttacaaaaagataatgatgatttcccgcttgttaatggtaatggtggtggtcttgttgatcaattgaattttcattctatgacatttacattacatccacaattggataatctgtttgaagctgaggatcattcaagtttgaataacggtaataatattggactttctactgatagtgaagtgattcctgattttgagtttgataataatggtgatatcgttggtattgctggtgaaaacttattgttagacagtagatcaccaacgagggagttgattcataatgaacaagcagatgccttgaatgttacatttgatgacaatgatgtacatgaagtaaatccaatcccacttaatcaaactactagtatttccaatgatttaaatttttataccactaccgacacaccattgccaaatagcacccaacgacctattcctcaacaagctttaggtatggagaaattacctttccggaaattgctcattgataatcatacccgaattgatagtgattcaatgattcactttgtaatgaactatgaatcaagaatgaatactgttatggaaccagttaaatctgtggatgaggttgtaaataatatatacggtgttgttgatgctgctacaccgtttacgagatttgttaataaggtaaccttgcctaatacaaacaacaataaccataacaatagtgttgaacaatcatttttcacacgaacagctagtattttacaaaaaacagaggaaacaggtaatgagaatactgaagaaggaagaaataatatgaatataagaaattacggctatggagccagagataccagatcctaa

SEQ ID NO: 1825 - DNA, 789 bp, Candida albicans
atcaacaactccattacatatctcaatttactgaatcgaacaaattacattatggctactagaactcaatttgaaaactctaacgaagttggtgtcttttccaatttaaccaactcatactgtttagttgccgttggtggatcagaaaacttttattctgcctttgaagctgaattaggtgatgttattccaatcgtgcatacaaccattgctggtactcgtattgttggtcgaatgacttctggtaatagaagaggtttattagtcccaacccaaactactgatcaagaattaatgcatttaagaaactccttacctgactcaatcaaaatacaaagagtggaagaaagattatcggcattgggtaacgttatatgttgtaatgattatgttgccttggttcatcctgatattgaaagagaaactgaagaattaattgctgatgtattgggtgtggaagtgttccgtcaaactattgctggtaatgtattagttggttcatattgttcattgagtaatcaaggtggtttggtccatcctcaaacttctatacaagatcaagaagaattgtcatctttattacaagttccattagttgctggtaccgtgaatagaggttcctcagtggttggtgctggtatggttgttaatgattggctcagtgttgctggtttggatactactgctccagaattgtcagttattgaatctattttcagattacaagatgctcaaccagatgctattggtggcaatttaagagacactttgattgaaacttattcttaa

SEQ ID NO: 1826 - DNA, 243 bp, Candida albicans
gactcttataaaatcgatcaagatgaccaacatgaaccactacaagagaaacctaatagtagtggtaaccatcatcatcaccatcatagtcaacatattgccaaatttgatccgaaaaaatggctagatcaaacttgttattatatacattatcaaggatggaattccaaatgggatgaatgggtaggcattgatagaataatggaatataatgaagaaaatgaattcgtaaaattagaataa

SEQ ID NO: 1827 - DNA, 1170 bp, Candida albicans
aaacaacataatttacaacatatcatgagtgaaaccaacaatcctgcctcgtccaatgataagaaaccagtagtgtttgctgttccatcttcttccacccgaagaggaataaatgctgtgcatgtcaactcagctcgtgaaatggtcaggttacacacgcaaggaagaaatccaccagctgctagacaagccaacgtgccctctattccaagcagagtagtggaagcttctcatgctccaacgaaaaaagctacagactcaatgccatccaagttccccaacattcagattccattacatcacgatgaaacagaatgtaaaaatccacaatgtcaacactgtggacaaattattatcccctcccctcaatcatcttatccaattcaagacaaaccttgtatatcagtaaatggctggagtgtatttaccaccaagaaacctatacttaattccttggagttggaccatttagcagagaccaagtttgagttccccttaccagaaatgatatttggaaataacaatgttaggatacgtaatgatgttaccggtggaacaatagaatttaatgccattgatgcattgagctcgttggatccaaattgtcctttgaaagttagttgtcatgaggaatggttgaaatctagacgatcgaaacatgcaagtttaaaacaggaacaatcactcaaaaaagatctttcagaattcacagagaatctagatgggttgaaaccatatgattggacgtattcgacaaattataaaggtacattacaaaatcttgatttgaaatcttcgacattgcatgagatcccaattgataaattgacaaaacctgatcctattttatttttcgatgaagcaattttatttgaagatgaattagctgacaatgggatatcgatattgagttataaaatcagagttatgcccacttgtttgttattgttgtgtcgatttttcctccgaatcgatgatgttatattcagagttagagatacaagatgttacattgattttgaaactaatacacttaccagagaatacaaggtacaagagcaagagtatgataaagttatgagtttggttaaagtgaaaaataacaaagatccaaagaaactatttagggattcaaattgggttcagtcagaacatacctgttctcaataa

SEQ ID NO: 1828 - DNA, 1011 bp, Candida albicans
atcatgccaatacccagatcgtttatatttgaacctgagttggaacagctactaaaaagagacgaaaacggctgtgtctcttgtccaagctcagcaggaagttgtccttcctgtccatcgggacaacaatgtcaattatcgtcacgtacatgtaattcttgtcccaaatattattgtgctagtgtttcgtcaaaaaaaggttcccccataggtggcatcgttggtggggttattggaggagtggcatttttggcacttgttggtgctgtcttgtattattttcttatatacagaaagaagcatccacttatattagatgaagactttgagaattacgaagatgatgaagactttttggaggatgaaacaagcggatacgcactgagcaaattaacttcgaacaacgggaacggactagatgtctcgtctccaggatacgatagctccagtggtaatgtggtttccccagttagcgctagcaatgtcaatactactaatggcagcagtagtaatggacctaacactacagtcagtctgacttcagttggaaacacctcagtagagagagcagcaggaccaggagttggaagtggtgccgctatagtggcaagaaaacaaattgctggtaattctgttagtgctgctaaaagaagacaaatgaaaagattatcgtcgtatgaatcttttactagaccaaaagctagtggaaacaataaagctaaacagcaacaattacaagctagaagagctagacaacaaagaatcattcgacaagcaaatcagcaaacacaacagcaaccacaacaacaattgcctttcaaccagtacctacaaccatccaaccgtaattcagtggcaacttcattttctaatgcatccaatatattaccgattgcctatattcctggggttactgtgcgacccaccaagaacaatacaaggtctatttactcttatgataccgattcgttgttctcggacctgaatacgatcgtttttcaacagaccgga

SEQ ID NO: 1829 - DNA, 969 bp, Candida albicans
caactagattcgattcaactcaagtcaactagaatgtctaaactagttagaagaacaattttgcctgctataacgattgtgcttattgttttctttgtcgtactagaatcctcaaaaaaaccaaacgattctttgtatgatgctggatctcacatttttgattcgataagtcatttatcatttgttgatggacaactaatagaacagaaaccaccaaaccaaccattcacaaatgaacagctgaaacaaattgacagtaccccagataacagtctacaacccactaaacaagaagatgaagaaaagaaaacactaaaggaaaaagaagaagaagagaagcaattagacccttgcacagtattcaatccaataagcaaaggtttcattgatttgagtggattatcgtcattatcaaatgagggtaaagcattgccatgggtttctaaaggatatgatagtggtaaaaattacaccataggtgtatgttcatctccatttaaaaaacatcatagtgaaatcaatgaaattcaagataatctcaactcgagtttaatcggtgcttattatgtcgatcccgaatctaaaaaatacgtatctatgggtaaatattccactgtacctaaatttagaggtagaaaattgacgttaacgtatgaaaatggatcgtattgtgatataatcgataagaacacaaatcaaagactacgcaagtcgactattttaacatttacttgtgatcgtgaaatgtcggctagagcactggtttcatatatcggtcaagcaaatgaatgtacttatttcttcgaagtcagatcacaccatgcatgtcctactgctgctaaagctaataatttagctgctgtatggatatttttgtttatatttttggctgctgtatttgtttacttttctggtggattgttgtatagacagatgaaacaagcatccaccactagaagtaaagtatga

SEQ ID NO: 1830 - DNA, 453 bp, Candida albicans
aaaatcatgggttcggtatttctcccacatttaaagacagcatggcacgttgatcaagctattctttctgaagatgatagagtagttgttataagatttggtcgtgaagaagaaactcaatgtatgataatggatgaaattctattttcaatatctgaaaaaattaaaaattttgctgttgtatatttagttaatttagacaaagtacctgatttcaatcaaatgtatgaactagatcaaaatcccctagagccgtttacaataatgtttttctatcgaaataaacatatgatgtgtgattttggtacggggaataacaacaagttgaactttatgatatacgacaaacaagaaatgattgatattatagagacagtataccgaggcgcaagaaaaggtaaaggtttagtaatgagtccaaaggattatagtcgttcagctaaggatatatag

SEQ ID NO: 1831 - DNA, 1017 bp, Candida albicans
ctactaaacatttttactacaatggcaacactaaagaaaaaagacaagaaagcatcagcttgctttacttcttcaaccaccacacctttaaactattctaatcctgtacgacttgcatttttaggaggtccaaaatcaggcaaaacgtcaactatatccaagctaactgcaggaaacttccgagacacgtattatccaactcatcagatacatccaattcttttcaattacaaaccttccaatgaagcttcaaaagtcttaactgaatttgtgaaaggaaatgaagacactattcttagtccaatgttaaactcaaatgagctcgttcccaccaatgagtattacaaagttggtaataatgatgttggtccgatcttggttgaattgatagatacaccaagctttaacccacaacaagttgttccattcttggaagcatcattgtataccaatttagataaagaaattttgggaaaccttgccaacgaacctcgtaaaccagtatccaccaatccgttactagttgcaagtggagcaagtgaattgaatggtaacataaatggttatttttttgtctatagtgcagttccaggctcgtcacctccgggatatgatgaagatctttcaaactttaccggcgataacacgttcagtttattaccggttatcaaaggggcattagaggatgcctggcaggagtataacgaatatatcaggaaaaagaatgcagagaaagaacaagatttattttcttttaaagtggctcttcgaaatctactaaaagaacctagtagtaacaacagtgataagaaaggtgttgaaaccaaagattattcgcctccaatttggattctatgtacacacaaagacagcaatttagcatcgccaaaattaatagaacaagggaaacagttggctcgtgaatggaactgtgggtttcttgcaatggataatctggaagataacatagatattttattgacattaatgattagagacattatagaaagaaagtaa

SEQ ID NO: 1832 - DNA, 1623 bp, Candida albicans
  unsure (3): Identity of nucleotide sequences at the above locations are unknown.
tcnatcacggtctttggaccatctgcattgaaggttgaatctacagaattaactgatttcttgtttgattgttttacagcaagattgcgaacaattacaaataccaagtcaggggcatttaacatggcaatccaagatgatggtaaacctgccaacgccatgggtgctggtgatatagtgttgttgagttactggttgtcctcattacaatttttgcatttctattttggtaaaaacaacatttatttaaaattccccagatttttacaggaattgatcaatttagtccaatcattaactgcaacattatcgttttcaattaattccagattaaatttacttgttgatgattgtattatcaatttcactaacctagtggatgtttctaacgtattatatgccaaagattggaacttgtttaagaaaaacaagtcgcaccctaatacttatgatgatatcatgaatacattatatccaccaactcaaatggagttaatgaaaccatcacctattaggtatttgcaagttttaggagctttggattatgtgttgagaattcacaaggttgataatttgcttcgcctggaagccttttcacaagtattttattatatcaattgtaccattttcaatcgattaattagtcaatctaaatactgttcccgtgccaaagccattcaaatacgtcttaatgtatcagcaattgaagattggttaaggtcacataatgtgaaagtgtataagccagatacgattggtggtttgaataaattacttggcaatgaagatgtcaaattgcacaaccttttgaatgaggatccatctttgaaacatcgcaagaatcctcattatttacaattttattacaattcactttatcatattgggaaaaatcagttacaaccaacaattgaacttttacaatggttgcaatgtatgacttcgttatcagatgaagaaagtttgataaataccattaatcaatttgattgtttgaattattatcaacttttcaaagttgccaataagttatataaatacgaagttaatgaagtgaaattaccgaagaaattgattcaagtgatcaaatcattaatgacggaacaaggacctaatcaaattcaaagaatgtttttgcattatatgacacaaacaacttttttgtctaaagaggaatatatttacttgaatccaaactacatttttgaagttgcattacctaatttaaccgaattaattaatagttatggtgcaggtcttggtggtgttagaatacttagaaataaaaaataccaaccatcattacctatttcaattatggatgacattgatgagaagttgactgagaataggtcatggcaaaatgaaacttacgactatgataatgagaaggatggtgaagatgatgaagaagaagaacacaacgaaggagcaaatgcaaatggtgattctggatctgttcatccaggtacttttgaaaagaaaccgacacatactaaagaaattgaagattttaaaggagatgaattattcaaacaggtacaaatgccaaattcgttgcttcataaaaattggggtgacacctcaacaggagtagaagattttgaatctaatccatggtga

SEQ ID NO: 1833 - DNA, 1326 bp, Candida albicans
  unsure (965),(1253): Identity of nucleotide sequences at the above locations are unknown.
cttcccccagaatatgtcgcggttccgggcgcctcgtggagagaacctataggtaattttaaaattgaaccacttttaagttcaagaacgttgaatttcaatttcattaccaattcaattgaaaagaaattcaaagaagcaattaaagaaagcttggtttatccattttgggatgatattgtgttttacgatagttcagatcaattgtatcgtgctggaatttggaaagaaccaaaaattgacaaagacgaaactactgccctggaaaaggaaaatacggaaaacaatcaaactgataatgagtccgctggtgtcgacgaagataattcgacaaataagtttgatgatattgatgcaaaatcagaattatcaacgagttccagatcattaagaaatggcaagttttcgaatacattaactgatttaactaagcgtatgaaaaaaaaatcttcaccatcattatctaatactgaaaatagcttatcggtcaatactaataacactgcaagtcttagtgctagtaacacaacccttaacaaaactccaagcaaactggatctaacggcatcgcaatctccaaacaccaattcaacacttgtttccagtacatttaaaaaaattggtaaatggtatttcaaagatgatggatctagtaaaaagcaacatgatgaaaaattaggttatactcctcctgaaatgatatcaagtagacgagcacctagaaaatcgtctagttcaatgacgttgggatctgattctactcgttatacattagcaaccgaagaaaacaaggatttaccagatattgaaagtgctaacacaaccagtgcatcagtttccaacactgctactactgcaccatcactggaactttccaataaaggtactaccaccactgcacctgtaaatgttatcagcttatccaacaattttacagttccatctgtcgcagtaggggcagatgntacaaccacagcaccagcaccagtggcaaactcaaagttgacatcgacgccacttgataatcaaaccccatcatacaacttcagtcgactagataataataatgaagatctttcaatatttagtgttgcatatcagaatgctgctcaaataattccatcactgactccaccaccattgccaccacgtgatatatcagataatttgtctattagaagtggaagtttggttggtgaaccaaccatcagtttatctcaaccaaattctcctatacgaaccaaaacattaantagaaaaccaccgccaccaaaatctccattactacatgcacattctccaaatcaagatataaaagatttatag

SEQ ID NO: 1834 - DNA, 1602 bp, Candida albicans
ctattcctcccccaagcaatcataatcttaacacgttccaaatttacacacactcttttttttccctttctttcttctatatctttcaactcatctacaattaatcaattagtagatgaacaaataatggggcttgtttatttcttatttgtttatgtactaggtggattaactttcttacctggattggttgccctatatttttatctcgccccaaaatcaaccttatctgatgataatgaacttgacgaagagaaaccatctggtgaactagaagaaaaacatcagtctggtttagaagcatataagagtggatggatatttgtcactcgtgattacattgaaagtcccgatgaaatcaattcaaatactcaactgataaccgaatcaaatgataataaatcggcttattcggcattatataaattggtgaaagacctggcaaccaaaaaattcaaagacaattcccaactgaaaaagcttcaaccagaagagaagaaattccttgaccatgacgataacgatttagatgaattgaataaagatacatttgcgttgccaaaggataccaatagtccaaacccaaaatcgtatagccaccatcaacgtcatgatccacaaccacaacataatcaccagtcgcaaaatcaaccacaacaacaaattagatcatcacagaagaagcatcgttactttgctgttttaaaacatggaaatttgtttttatacaaagatcaaactttaaaagatgtcaagcatgtgattgtgttggcacatcattttgtcagtatttggcctcgagatttaactgatgcccaattatttacaaaatattcagctcttgcattaatcaaccctagcaaattgactgacacaccattttccactaatgacacttttaattcaactgtcaatacatccaatgggacagaaatttcttcatcaaccagatcatcactttcatctcgtactacagatcaacaacagaacctgcaacagcaaactaataacaatgccccaccaggaacatttttcatttattgtgaaaacaattgcgataaagaagattggtattttgccttgattagagccatgaaattagaaaaatctgaactacctgatatcttgaatccagaaaaatatgccgaaacgtcacattttcaaacaaaagaaatgataaatttaatacaaacattgtatagttcagaaggtcaattgcaaaccaaatggttgaatgcaattatcggacgatggtttttggcaatgaaaaatactaaacattttgaagattatgtttacaaaaaattgagtaaaaaattaaataaaatcaaaaaacctgggtttttcaatcagtttgaaatcactgatattcaaccaggtaaactggccccattcttcacctatccaaaattgaaagaaatcaacccagatgggacagttgtagcttcatgttatgtaacatacaatggtggattatcggtaacaatagaaaccaaagttgatttaacttttgggaccaaattcaccaatagagaagttgatttagtgttgaaaattaccttgagcatcttccccaccgggctggaaaatcaacgctccact

SEQ ID NO: 1835 - DNA, 366 bp, Candida albicans
tccattatgtcacgacatcaatatgatttaattcaatgtatgaaacaaccaggtaaatcaataggattattatgttcaaattgtgatgggaaatgtccgatatgtgattcatttgttaaacctactgaacaagttagaatatgtcaagattgttctcaaggtcatctttctaataaatgtatattatgtgctaataatttaggagaaaataatgaaaatggtgtactggcttactattgtcttgaatgtgtaaggttagaaaaacatcgagaaggttgtccaagaattataaatgttggtggtactaaaactgatatgatttatatgaaaaagaaagataataaatcaagtctacaaggattttaa

SEQ ID NO: 1836 - DNA, 780 bp, Candida albicans
gactcggatcttccagccgcgtggtcgaagatatcaaagttgtatttgaatttaaaacaatattggcaaattcaaatccggaaacgtgataaagatttatttaaacaattatggcaagaaccagaattatcggaattaattaaaaaattcttaattatattttatcaaccattaatgacaattttcactaaaagtgatgttcatttagcttttagaggtttacaaaaatttattgatgatttaattgaaaccgtaacgaaaattaataatgaagaaatttattatttaaattcatttgaaatttttaataaattgaaaaatttattagatcgtcatgaaaatgttatttgggaatttattcataaaatatatattaaagatgatcaacatttatttttgaatttaataaaatggattgaaaaatatttaaccatgatgagaattaaatttattaatccagaaattgtcaaaataaatatccatacccccaattctggtggtggtggtggtggcgatggtgataataatttagataaacaattatttatgaatcaattgaatagtcgagtgcaaaaaattgttacaaaacgtaaattgtttaaagaatatcttgaagcaaaagcaaatttacaactacaagacccaaacaacaatgatattgatggtaattgggaagatataaataataaaatatttggtaataccacgagtgatgagtttggggttaaaaccgatgatttagaagaatttaattatcttaatgctgaaaatgatttataa

SEQ ID NO: 1837 - DNA, 882 bp, Candida albicans
tatctacatctaacaatgtatcgcatagtaaaaaatgctacagagacatttaagaaagtgttagaattgactccaaatactggtagcaaaattgatcatttgttgacactaacaagaatagattttttcttcaacgatttgccactggttcaaaagcatttggaacaaattggccaattaagtgagaagggaggtgattgggaacgtcgtaaccgtttcaaagcttacaatggcatttatatgttggcaacaagaaactttgctgaagcggcaaagttgttaattgattctttggctacatttacatctaccgaactctgttcttatgaagcaattgctcactgtgctatcgttgccggtgttttgtctttagaaagggttgatttgaaaaacaaaataattgattctcccgagattttgtccatcgcatccacaacacctaatttagaaccgttgttgaatttgacaaattctttatatacttgcgagtacaattgctttttccagtatcttttggaatcgtatgaaaagttgttgttgccaaataaatacttgtacaaacatgctaactttttccttagagaaatgagatgcaaagcttataaccaattgttggaaagttataaatcattatccttgaaatctatggcaactaatttcaacataagtgaagagtttttggatcaagatttgtgcaaattcatccctaacaaaaagttaaattgtacgattgataaggtgaatgggataattgaaacaaatagaccggataacaagaacaaccaatatcatgccttgattaaacaaggggataacttgttaaccaaattacaaaaatacggtgcagcagtcaagttgagtggggcagaaagagttgcttaa

SEQ ID NO: 1838 - DNA, 1866 bp, Candida albicans
atgatgaaatcctctatttatcccaaattaaagagaattttatggaggttctggaaaccctctcatcaagttaaatcatgggctaatgatacaattgcggacggatcaggtggaccatctgtacaagatttagaaaatgctttgaatggtaacaatgagtctccagtagacaaatccaacatcgaggttgtcaataccgtggaagatgctagtgatgacgagtacaatgatttcaaagagctcagtaataaacacggcgaaaatgaagacgaggaagaagaagaagaaatgatgagcttaggagacttaccaactaatgaagaaaataaagacaaaaatgaatctggtgaaaatcttgctgctaatgaaaacatatctgacttggagtggcttaaatctaggagtactcgtattaaagaaaatggtgaagtgccagaaattgtacccgaagtaaaagaagtcaatgaagttactgaagctacgcagcaatcagacaatgaacctgaaatgacacctgaagagcaaatagctcataaaattgaagaaactggaaggttatttataagaaacatatcttatgaagccagtgaagaagatttcagaagcttgttttcacaatacggggctcttgaagaagtccacattgctatcgataccagaacaggcaagtcgaagggatttctttatgtgcagtttttgaaaaaagaagatgcaacaagagcatatcgatccttagacaagcaaatttttcaaggacggttattgcatatcttgcctgctgataaaaagaaagatcaccgtctagatgaatttgatttgaaaaatttgccattaaagaaacaacgtgagcttaaaaagaaagcacaagctgcaaaaactcagtttagttggaattcactttatatgaatagtgacgctgtattggaatctgttgcatcaaagttgggagtgacaaaatctcagttaattgacccagagaattccagttctgcagtgaaacaagctttagctgaagcccatgtgattggtgatgttagaaaatactttgaggatagaggcgttgatttgacatcgttcgacaagaaagaaagagatgacaaaattatactagtgaaaaatttcccattcggtaccactatcgatgaaataggggagttattttctgcttacggacaattaaaacgtatgttgatgccaccagcaggtacaattgctatcatagaatttcgtgatgcaccaagtgccagggcagcattttccaaacttgcatacaaaagattcaagagtagtatattatatttggaaaaaggtccaaaagacttgtttacccgtgagccaaccaccaacgaggttgctaccattccagagcaacagcaaaatgaacatgcagttgaagctaaaatatctgctaatgaaattttgggcgaatctaaagaggatgacgaaattgaactggtacaaggtccaactgttgctgttttcgtgaaaaacttgaattttgctaccacagtgcaagctttgtccgatcttttcaaacctttgcctggttttgttgttgcaacagtgaagacaaaaccggatccaaagaattcaggcaaaactttaagtatgggttttggatttgttgagtttagaacaaaagaacaggcaaatgttgctatttctactcttgacggtcatgttctcgatggccacaagctacagttgaaattgtctcataaacaaggaaccggtacctctgcttcttcgataaagaagtcaggtaagtcttccaaaatcattatcaagaatttgccatttgaagctaccagaaaggtcttctggacttattgtcttcaccacggcctgccggatccgaattatgag

SEQ ID NO: 1839 - DNA, 321 bp, Candida albicans
  unsure (298),(299),(300): Identity of nucleotide sequences at the above locations are unknown.
ttctattatctcaaatcaattattacaacgatgtcaagattaattgttaagggacttcccaagtattatactgaagaaaaacttatagaatttttctccaaacaaggagatgtgaccgatgttaaattaatgaagaagagaaatggtgaatccagaaagtttgcattcattggatacaaatcggctgatgcagcagaaagagcagttaaatactttaacaaatcatttatagataccgccagaattgaagttgagtttgcaaagacattctctgatcctactgtgcctctttctttcnnngaaaagagaataagagaatag

SEQ ID NO: 1840 - DNA, 876 bp, Candida albicans
atgtcactttcaccaatagaaaaagcagcctctggggctttggcatcagctattgccaatacattggtttatccattagatttgagtaaagttttaattcaaactcaagtcaagaaaaacaaacccaaaagtggttctaatgggatccctaccccgccttcggaatcggatttagaagattctgtttataaacaaaaagtggatgaagataacggattaaaatataaaaacaccattgatgttttaactcagatttataaaaagaaggggatcttgggatggtatcatggattgttttctaccgttgttggtactgccgcacaaaacttttcctacttttactggtacactatagtcaaaagagtgtatgccaacttatacaaacacatacctaaccataaaccaggaacttttaccgagttattccttggtgccttggctgctgcaatttctcaatgtttcactatgccaattggggtaataaccacccaacaacaaaccgataagagtcataaaaacttgtttcaattgattcaagatattttggatcaagatggtattagcgggttatggagaggattgagggtctctatggtcttatgtatcaacccatcaatcacctatgggtcctacgaacgtttgaaacaagtactttacggtgacaaacaatttttaaaaccactcgagtcattttccttgggtgttttggctaaatcattagccaccattgccactcagccattaattgtttcaaaggcaatgatccaaaagaaatcatcgcctaagaagaacaataaggcaacagataaaaacacagatttagattatgaagagcagatccatttatctctcattgtacctagcaacacaatataa

SEQ ID NO: 1841 - DNA, 249 bp, Candida albicans
aaaaatgcgctaacagagaccaacacagaagaatatatgaagaggtatattaaatttgatcatttcaccgatggcttaccatacttgtggcgtaccgaaaagttccgtggattatacaaaggtattgctccacaattattgaaaggggtgtttgttcaaggtttgttatttacatttaaggatcaattaaacatattatttttgtttttgttgtccttgattaagaatagatctgttctcaagaaataa

SEQ ID NO: 1842 - DNA, 1263 bp, Candida albicans
  unsure (157),(173): Identity of nucleotide sequences at the above locations are unknown.
acaattaccaccccactagcaataccaaagctacgtaatctcataactcaaacacgttttataatcatggcaggagatccatttttatctgatccttctaagaaaagaaagcgtctgaataaattgactagtaaaacaaaacgatctaaatcatcanccccaaccccaacacntacacctacaccaaatacaaaccatcaagatgacgatatatcaagtggatccgatagtgaaaacggacatgccaatggaacaaatgaaaatgatcatggcgataatgaaagtgaattatcatcagatgaagaatttgctgatgaaaccgttaatgataaacgtagaagattagctaaacaatatttagaaaatttgaaacaaaatgaacatgaattatacgatgaatttgatgctaaagatttagatgatgatatattagcaagaagattacaaaaagacattgctgaaactaaaggatacgtttataaatttgtcggtgataaaataaaggatcaattagatgaagcatatccattagaattaataactacaagaattggttgtaaaaatttaactagtatgacaattaattatccatttttatatactgtttctaaagatatggaaatcattaaatgggatataaatgaaacccacaagaaaccgaaaagaataaaacatactaaaggtggcaataaatatttcgaaataaataccataaatcctcaattaaatcatcattggcaacaaattaattgtatagctgcttcacccgatgggaaatatattgttactggtggatcagattctcgattaattatttggtcaagtgaaaatttaacttgtttaaaagttttaccaacgagatcttcagtgaattcaattgttttcagaagaaatagtgatcaattatttgctgcttgtgctgatttaagaattagaacttattcaattaatcaattcacgcaattggaaatcttatatggacatcaagataatattagtgatatatctgctttggcaaaagaaacttgtgtttcagttggtagtagagataaaactgccatgttttggaaaattgctgaagaatcacgtttaactttccgtggtggtgattcactagaaaagaccaacaaaaagaaaaagaggcactaccaccaggaggaggaggaggcggagaccgagaatgatgaatcgacattctataatgaaggatcaattgatgttgtaagaaagattgatgaatcgcattttgttagagcctcaggg

SEQ ID NO: 1843 - DNA, 1035 bp, Candida albicans
gttgggttaggttggttggttggaaaaaaaaaaacactcgaaaaaaaaaaagataaccacttgttggcatcaactaatctaataacaaacctagtttacaacaaccacaacaacataatggaaaagttttcaagttggagagataagggaacgggtatttctccatttatgcctcaaaaattaccaacatttcaaaagaataattccttattatcagtagcatcaaaatctcccatttttttaattaaattaccatttttcataattacatatttgatttatacaattactgggtttgcatttatattaaaatttatattaacgattctttttggatttaatagaattgattttggtgttgatggtattaaaaaatctcaaattgataaattgacaagttataaacctaaaaaaggtgatttaattgttactaattatattactccattagatgggtattttcttttcttattgagtgggactttttcttcttcttcttcttcttcttcttcttcccaaattgttattttgattcctaacgaatcaggagatttatatcaatattcaccattggggttgtttaatcatagttttacttattctaattctaattctaatttttctagttctgggaaattagtggaagatgtatcaaaattacaaaataaaattgtgtttttatttttagaagggactttatcaaataataaatctattttaccatttattaaattgaattctaaatattcatttgatgattttaatattaaatcattagttgtgaaattaataccaaattattttacattaccaattcctcatgttagtaaattacaatattttttcgaacttttaacaaatttatctcaaaaactggttcgttataaaatgtataaatttgatgaatttgatattgccaagattagaaattcatttgaattgaattctttaacttcaatgagtcaagatttgaatattgattccaagaataaatttatagactattattttgatcatagtataaagaagaattaa

SEQ ID NO: 1844 - DNA, 1341 bp, Candida albicans
gaaatgtcaaatcacaaaaaaaaaatttatggcattgaaaaaaaaaatattattaagattccttttcaggataagcattcaaaaaaacgaccaagtttttactttgccatgtcgtttcaagacgttttgaaaaggggagatgagtttcttaatgactatcctagaaccaacccgttttggaacctagcatcccatgcaacctgtttgttcatgatcactggatcaaagataatattgaatacattctacaaaccagttttacataacatagaaaagttggacaatgctctacaaagagcgcgcgatgaaaacagaggcttgcttactgtgatgaaccatatgtcggtggttgacgaccccgcattttatgcgtcattaccttggagatatcacttagatatagatactataaggtgggggtttggtgcccacaatatatgttttagtaatgttttccagtcgtggtttttcaacttgggcaaaatattaggaacaaaacgatttggcgagggcccatttcaaggctcattggatgcggcaatcagaattttgagtcctgacgatacgttagatcttgaattcacaccaggtatcaaagatgagcagaaagccgtcgttttgcaaactgtaaataatataactgattgcagaaacaaagaattagtgaaatttatcaagccagctccagaatcaacaaatgtattaatgagcaaaaacccattcataagaaccaaaacgtcttggtttcatgtatttcctgaggggtttgtgttgcagctacaggagccacataacaactctatgaggtacttcaaatggggagtgtctcggttaatattagaaagtacgcgaactccaatagtggtaccgttattctcatttggatttgaaaaagtggctcccgaagattcagccgaagaagggttgaaaagatggctaccagcaaattttggtgctgagatacatgtttgtattggagacccaattaaagatgatgttttggaaagttatcgtgagcaatggagatcactagtgtcaaaatatgtagacaagtctaatccgactgacctttctgacgaactcaaaactggttcaaaagctcaaagtctaagatcagatttagcaggttatcttcgcgagaaggtgttggaaataaggaatgaaattggcttattcaacccagaagataaaagattcaaggacccaaaattctggaagttgttcaccaacacggaaggattgagtgacccaagtgttaaatttgtcggtaaaaactgggctataaagagactccaatctcacttgcctgagtatgatcccagcgaagacacaaaaaactaa

SEQ ID NO: 1845 - DNA, 204 bp, Candida albicans
cgcggatcttccacccgtgggcaagatgaaaaaattgcacaacgtggtgttgtcagattgtttaatgcagtgttatccacgcaaatcaaaaccaatcaagaagtcaataaggagaagttgggacaaaccaaaaaggaagaaataatgaatgaagtatctaaaaacaaattcttggatctaattgcagctgctggtaatgaataa

SEQ ID NO: 1846 - DNA, 705 bp, Candida albicans
  unsure (287): Identity of nucleotide sequences at the above locations are unknown.
aaaaaagaagactgccaaagtgtgatagaagaggaagagcgagcccaatccaattcatctgttcaagaagtggaaattgaagatggaagtgattcagaattggaagtagcagataatgatgatttagatcaggaaataggatctgatgatgaagttaatatggcagatgcttcatcatccgaagggtcggacgcaagcgaagatgaaaatgaaaatgaagaagaggattttccaaaactaaagaagagaaaaacaaagtctacagaagacgggtctgaatcttttgntgatgccttgaactctattgttaactcaaaactaaaagcatacgatagaaaggatccaattttggctcgaaataaagtcactttaaagaagttagaactggataaattggaaatgaaggccaagagagccttattgcaagaaaagaaagtgttacatgacaacgccagagttaaaaacttgttgccaacaagtaatgaaccggagaaagttcgtcaagtgattgaaaaggaaaaggcattgaaaaaagttgcacaacgtggtgttgtcagattgtttaatgcagtgttatccacgcaaatcaaaaccaatcaagaagtcaataaggagaagttgggacaaaccaaaaaggaagaaataatgaatgaagtatctaaaaacaaattcttggatctaattgcagctgctggtaatgaataa

SEQ ID NO: 1847 - DNA, 975 bp, Candida albicans
gaccttctagggccgttgtggacattttttaactgttttacgaaagggtttgttattcaacgaaaagaattagaagaagagccactttggattgcacccaacaaggaaggtaaattaccgtcttcattgtataagcatactttgttcaagtcacaatttcaaaaatcagtaattgccatgctttcatatcctttgttacaagaacaatacaagtcggtattgacgatattacacaagagaataataccatatatgtcccaaccgcaatcattgatggattttttgactgattgttatgatcttactgatgatttgattgttcctatactagcattaaactcattgtacgagttgatgaaaaattataatttagagtacccagacttttattccaagttgtattcgttgttgacgccagagcttttatatacaaagtaccgttcaaggtttttccgtttatgtgatttgtttttgagctcaactcacctatcagccaatttagttgcgtcgtttattaaaaaattagccagaatatcgttggctgcaagtgcttcaggggttgttatcatcataccatttatatacaatttattaaaaagacaccccacatgtatgatcatgttgcacaaggaagatactgaatctggttaccaagatccattcaacagtgaagaaaaaaatcctttacatactgaagccatcaaatcatcactatgggagttggataccttaatgacacattaccacccgaacgttgcaactttggctaaaatatttggtgaaccttttaggaagcctagttacaacatggaggatttcttagattggagctataattcgttgttacaaagcgagtacgatagaaaattcaaagataaaaactcagctttagaatttgaagagtttgacaaagtacttgatacttcaaatagtgacagcaaaagtctgttgttagaagggtggactttagtttag

SEQ ID NO: 1848 - DNA, 225 bp, Candida albicans
gggatcaagaactggttattttttgctcgaaacgatcactgggtcgctaatgaaattagagaatacttgattgataaatatggcaatagtgacaatactctctgcgaagtatgcgatgatgagacaaatcctatcagtcatagtttctgtgttgctcagagtgatcaatttgcaaagatcacagtagcaagaatcaaagaaatttgtaacatagatttagattaa

SEQ ID NO: 1849 - DNA, 765 bp, Candida albicans
tatctgcaaccacaaatgactgtaacttacttgaacaccacacccaaaacaccggtttaccataaacccccgttagagaaatcgactgctacaaatatatttgttttaattccagggaatcccggattggtagatttttatatatcgtatttggactcaatacgtaaacacttcccacagttcgaaacgttatgtattggccatgttggatttcttgactcaactaaaagaaaaatttatgatgttccttctcaaatcgaacataaatatgacgttttgaaacagttgatcttaaccaaaaacgagtctaacataattcccaatttgtattttttgcaccattcaatggggtcttttgtttatcaacgcacgattagaaagttgtaccacgatgaaaacttaaatgggaaatttaatattaagtttagcggattcgtcactccaaccattcataatatttctgcgtcgtcctcaggaagggtattgtctggcttaatgcaaagaaatgttccaatcgtcagtatcgtacttgtctttagattttttgttagtttgattcctgcattaattttacgcaaacttttgcattatcatttattaggcaacaaaactggcgacgggtttgaaaattctgttgaaggtgcttataaaatagttaaatccggaactgtggttaatcaagcattagaaatggcaaaggaagatatgttaattatagatacacaagacgacattaacgactggtactttaaccattcaaattaa

SEQ ID NO: 1850 - DNA, 996 bp, Candida albicans
actcgcaataaattaaaattcaaagttgaaagtgcccatgatgattcgataaaccatattttaggtatgcccgctgtatcagcctatcattatctaacgttaggatctactactttagcacacattgatattagaaagggtatcattacacaatctgacgaccaagaagatgaattattggcaatgtgtttccctagtgatgaagtatctcaatcaaatgataccgttttggtttctcatggagaaggtttgattactatatggaagaattcaaagaataaactcatggatcaattgtctcgtgtaaaagttaataaatctgcatctatagatacgatcatttcaactatgaatgccgataatgaagatatggcaaactcagtttggtgtggtgacagcgaagggttgttgcatagaattaattataaaagaggtagagtggttgagactcgtttgcattcagtggccaaaggcaaacatggtgcagttgacgaagtgggaattttggatatcgattttgattatagattggttagtgctggtatggacacattaaagatttggtctaacacacaagatgaagaacagaatgatgaagatgatgatgacgataatgatgatagtgatggagatgattctgagagtgtatctggtgaagattcctggagtgatataagctcttcagacgaggagcttgacacgaatccagatgatgattctgataaagacgatgtagacgtcgaagacgatctacagttacgcaagaaacgagatgatatttctcaacttatatccaagcccaaaagaaaaacaattgacattaataaattgacaaaagcaactaaagacacacaaccagaagatgatgaagaagaccaagaagtgcctgaaccttctcagaagaaacaaaaagtcaaggagaagaagttgacaactaaacaacttcgtaatatgcaaaaacatgaacacggtattagaaaatttgaaggtttgtaa

SEQ ID NO: 1851 - DNA, 636 bp, Candida albicans
  unsure (626): Identity of nucleotide sequences at the above locations are unknown.
ttgtactataccgccatgggtaaaaagaaatccaactcttctaatgctgcacaaatattggaatcgtctgtatcgccaattttagaaattaattataatgatcctttattcactgccgcatctcatcctacaaaaccaattttattatcaggtttagctactggtcatgtctattgtaattcttatgatgcagagaaactagaagaattgactcaatcgaaaagagaagaatatgctacattggaaaaacaagcttatactcaaggtaaaataccacacatcaacaaatcagtctctcaactgaagaaaaaatggtggaccatagttcaagacaacactgaaattccaaacgatggagatctcatcaaaactaattggaaaacaaaacgtcataagggatcatgtagacatgctatctttgagccattggaaaattctgtgggtgatttcatttatacttgtggaaccgataatattattaaaaaggcatctactgaaactgggaaagtcgtggggaaagttgatgttctgtctgattactccaacaagaaagattatttaaccaaattatgccactcggtaactcatccattttatctatccagggacagaggatggacatgtgntagtctatga

SEQ ID NO: 1852 - DNA, 1320 bp, Candida albicans
  unsure (22),(116): Identity of nucleotide sequences at the above locations are unknown.
attgatcattatatgccgaaanatttgacctttaaacaattaccagaaaaattggctgaaactagtgggaaatctaatgttttcaaagatttaattaatgttttaattgatgatanaaataattatctgataaatgttggtgttgtgattaataataaacgaaatttatttgatttaattgatgctttattattaggatgttctcgatcaaataataatgtgacagttatacgatattccggtaataatgttttacgagaatctaaaaagaaagctcaaaataaaaccactactagtaatagttcaactactacatctacaactactgcaactactgcaatagcaaccactactactactactgctactaagaagcataagaaaaagcatgctacaaaggaaaaagggtatgggaaacacaaaatacaaaatcattctgtaacgattcatttaattccgcatgatggacaaataagtaaaggtaaaccagatttaaaagaggttaaatttgatttacttatagttttcgatggatcagttgatactgaaagtgattttttcaaattattaagaattcaaaatcgtaatgtcaatatcaataataatgttaatgataatgttaatgataattttatgacactgaatataaaactggatcgaggtcgactcttgactagaggcagacatctgactagaggaagaccttcaactaaagaaaaccttttagttgataaaaattcttctgaagaatcaattataaatttacctccatgtgcaattattagattaataccaacaagaactgtggaacatgctaaactttattataaaccagatgaagataaacctgattatttaactaaagtgatttcatcaattgtatgtttacgtgattctattggacaattaccacccgatatttatccaatttatcatcaaaaattgacttatttttctcatacattttttgataaattatttcaatcaacaacaatggcccaaacaaaaataaatggaaagaataagtataatgatcattacaatgatgaacatgaacatgaacatgatcatattcatgaccatgaccatgaccatgaatatcctggatggccattacctgatttacccaagattatcaagttttctccttatgatgttgaacgatcattattaactgaaactcgattccattatacaccttacgatttcaatcctaatcatttaaataatgaaaattcatcaaaagattacaaaaatcaattgaaatcaacatattatgaactgtcttcaaccacggggctgtgcaggatccgcccttag

SEQ ID NO: 1853 - DNA, 267 bp, Candida albicans
atggtaccaccacctaaaccttgtattactctagcaccaattaacatgggcatatttttcgctaaagcagctactaatgacccaatttcaaatattaaaatcccgaccaaaagacaatttttccttccaaatgcaacggcaattttactatttaataatgataaacaagccataggtaaaagatatcctgaagttaaccaaccaattttatcaaatgctttaaagttatttccaacatcactaataattgtcgttactatagtttga

SEQ ID NO: 1854 - DNA, 1596 bp, Candida albicans
acagcactacttcatagtcaggtttggtttatacaacgacatattctgatgtacgaccatttaccaagaatactaaaatggagtatatgtttggctatcgttttttggtatattaaccagaatagtattctctttgtcctttcaattatttctggaatcattttactatgccttgtcatggtatactatacaacaaaggtacaaatatcgagatctcctcccattcaaagaagacatagacggttcaacttcacactttcaaaacattggaaacaggaaattactcaactacagaatgaacaaatagaagtgaaaagaccaatttttctggagtcatttttaatttctgaatctttacaacggtttattgatttgattattcaagagtttatttcaccctggtacacacaaataacccaatcagcacaggtacaaactgatatatctttagagtttaaagaagtgattcgaaatttgcagaatagagcaaaaagcattgactttgcccaactcttagtatccaacatcctaccgctactacaagaacactttgaagattatttgagagcagaagatataatcaaaagccaagggaaattttcaaagtttgactcaaatgagtatcatattgcagttgcatctcaatttagaagaggcaaattacatcctgctgtcacaacatctttgattgtgaatgaggaaaccaattttaaagaaaaacaatatttgcgaaagaaaatgaagaatgtgctagagcttgcattgtcagaaaatgaaaaattcaatgatgttggcataagcttagtgacagagattcttgcgtgcacagttctttgtaatgtcataaacttactcacagaaagtgatttttacaatttaatcattgtgaagttaattggagataatttaagacgaagagatcaagtaaagcaattgagggcagcattagaagaacatacacaaaagtgctcaaaagagattgacgacaataaagtacaagtgccagatatggcatcagcattgttgacacctgattcaaatttacaaaatcagcttaaattgaaaattagtgaacgaaaacaacagagagaaaaacaaaagagtttaaatctcaaagatatcttgacagataaaaacaatttccaagtgtttaaagagtttatggaaagtgaaggtcggtccaagttagtcgagttttggaaggctgtcgaaatgatcaaggcgccattagaaggtgaagaaaatgatgacgagacggatcctttggcattatcattggaatttggtaataatgacgatgtttataatatttataccaaatttatcaaaaccaatgaaatacctcaacccgatactcatattgtggaagttctatccaatagtggaaacagtgccaacgtgagaacgtaccaagaagcacgaacatatttattcaaaatgcaacgcgattgttttgatcagatgcaatcacacgatttgccagtgtttgttaattctgacatgtatctaagactagtgagtccaaaagaatctgctggaagtaaatccagacgtcataaatgccgtggaaaatgcttttacattgattatgaataa

SEQ ID NO: 1855 - DNA, 459 bp, Candida albicans
gaattgaaagaagtcgctaaggtcaaccaatttgtattaattccaacagatgaacatattgaaatgaagaaacaagctgaagccactattcaagataaattagaaggaactgattggaagttgattaagaatgacgagtatgatgaacttttggtaaaggcccaccaaccaactattgatgatattgctagaaatgcaacagcaatcgggtttggtgtaatgtcggttgaagctatcaataagatgaaagaacaagcaaatgagtctatatatgagagaggttccagagagggtatggttgttatgtcaaaagaacaacatgatgaagtgagagagaaaattcagactccattagctgaaagggccaaatctgaaggatatgccttgattaagcctgatgaattgcaaaaattacgagttgcagagtctcggaccgctcgaggacaaagctttagctga

SEQ ID NO: 1856 - DNA, 756 bp, Candida albicans
acgcaattgcggtccttccagcccgtggtgaagaccatcaacattttaatagaactaaagaatctattccgaaacttgaaatggtttgctgaattaaaccataaaggatttatcaagatcttgaagaagttagataagaaattgacttcgattttaagccagcatagcggtgtttcggttggtggtgtttctaatcataaccaagaagcttatatgggtagtagaatcaatgccttgccctttgcaaatggcacagaggcttccaattgtttggatagtattcatcatattttatcgagaatcgaaaccagaaacgatgtcgtccaggaaactatcccggttgaaaacaacgaaacttcaataagtgctctcattaaaaatgacgactttgaaggattgaagaaacatatcactattaaaagttctcaaaagttcttgatatccactttaaacaaagctgcattggctaattccaccaaatgtattgacgttatttggaatcaacttgatatgttatatgatgattccgatttcaacggtagaaactttttccatcagcatattattagtttaggaaaagctcagttcattagagaggaacaaattgtccctggagaagtaacaaatagacttattggaggtgataatggtcctgataacagtaataaaaacgacaaccctattggattattttacattctcaacaaattgaaacataaaaggttgattttggctcaaatcattaccacttcttaa

SEQ ID NO: 1857 - DNA, 264 bp, Candida albicans
tttaaacggttatttagttttcaattcccaatgaagttcggtaaaacatatgtgacccatcagattccagaatggtctatctatgatatgaactacaagcaacttaaaaagataatcaagtcaatcgattctgctgccaataccaatgtcgatgaaagtaaatatccagaagttatctccgacacattaggatctttcttttatgatctagatagagatatagagaagggtcttcaccacggcctggaaggaccgcgatcgcgt

SEQ ID NO: 1858 - DNA, 2421 bp, Candida albicans
aaacggtgggttgaagtaacaagatatttagtagagtttggggttaaatggggattgattaatacatcgatttctatagatgatgttagtatttggggagaccaagaagggttaacacctttacacttgtcaattataggtaaacatcctaaaaccactgaaactttgctcggtttcaacaaggcgcaaactttgacatgccccaatttattgttgttggcagttcgtttgaattcaccgcaaattttaaactcccttatcgttgaaggtaacattgatgtcaactacaccgatatagatcatcgtaatgagactgctttatacattgcttctaaattgaatcatcctgatttggttgagtttctattagaatcaaatgcaaacactgagattggggaaaatgtattcggttggacaccaattttcattgctgccagtgaaggattcatgacgatcgttaaattattaaaagaatatggcgcctcgtatgatatcgtggacgattcaggctggttaccaatggaacatgcctgtcttagaggtcatttggatgtcactgatcttttgcttcctaagaatgaaaaattattgttgtacgacatgtaccacccagaaaacaatttgccaagaataccaagtcttgctgctagtcctgtgttaactggttcagatgatggaactgtttcgacctctagtatcgataaactccctgaaccacaaaaaaacacggttaatcaattctataagcaattgaagaataattcttcaaacaacgtttccagatcgacatcaccaaaacgtaacaagagatataaaccagtgaaatcttttggtcaccgatatttgaatgaagatgaatctttgatattgcttactttgggtactaccgatttgcgtgacaccaatgtccctgttgaattaaacaaagtctctttagctaagagttttgctaccgaattggatactgctttatcattatcaattacttgtcgtcataaattgacaaataatccagtggaaccgcccgtggttgttgatttaccattagaagatttccatggaagtgccaccgatcctatttcatttaagttatcaaatgatttgactgtgaatgatgtgataattacttttgatataattccaacttatcaagttaacaaaaaggtgatcggaagagcaatcgcgttacttaaagatgcatacaccaaagtaggaccaaatttgcgctcattaaataatagcattgatattccaataattgaatcaacaaaccttgacattttagggacaatcagatttgaatacttgcaagtcttacctttcaaacacaaagctatgagtattgctagaagcgacacttactggaaacagcttgtgtccactagagtaatcggtcatcgtggtttaggtaaaaacttgagtggccagaaatcattgcaattgggtgaaaacactgttgaatcatttattgctgctgcatcattgggtgcttcctatgttgagtttgatgttcaattaacaaaagatcatgtccctgttgtttaccatgatttcactgttgcagagtctggggtggatattccaatgcatttgttaactttagagcaatttatgggatttaatacacccacagaaaaacccactcatacagttgatgacgaagttttaactagggggaaacagagagctcaatcatcgtatcaattgtcaaataatcacaatgacgatattgagaaagagtttgctaatcaaagggatgaaagaatgaaattcactaaaacatggaaaaaccaaggttataaagggaatttgagaggttcatctgttgcttctaattttgtcacattgcgagaacttttccgtaaattaccaaataatgttggtttcaacatagaagtgaaatatcctatgttggatgaagctcaattagaagatatgggagaaattggtgtcgatttgaattttttcgttgataccattttgaaagttatatacgatgaaaacaccactggaagagacattgtattttcttcgttccatccagatatttgtttattgttatcattgaaacaaccaaccatgccggttttgtttttgacagaagctggtacagcaccgatgtatgatattagagcaagttctttgcagaatgctgtcagattttctaaaaaatggaatttgttgggtattgtatccaatgcattggcattaatcaaaacacctagattggcccaagttgttaaatcgatgggattggtttgtgttacctatggtactgagaacaacgaacccgaattggctaaaattcaaatgagagctggtgttgatgctgtcattgtggatagtgttttagcagttagagaaggattaagggaacataatgaaaccatgaatgagtttgaggattcccctactgaatag

SEQ ID NO: 1859 - DNA, 420 bp, Candida albicans
ctccaatttgtccacgttccttatcatttagaccatggaccttgccctagtctgtcagatataatgattaaattatctgaaagtaatagaaaccaaagaatcgaattgactatagatggtattacacagcctgatcttcatcctggtgacgaagtacatatcacttcagaagtagctattacatcatcaggtgccagtagtgctggcagtagtactcatagtggaagcagcagtaccagtaccggtactagtagtagcagcagtagtggtagtggaagcaacaatagtggcagttatggtgacaagaatggaatttggtgtgttgctactaatcaaaatcaatggtcaaaagatttgaatagcttattgggattcaatagttcatttagagatcaaaaggggaagaaattacacctctaa

SEQ ID NO: 1860 - DNA, 627 bp, Candida albicans
  unsure (14): Identity of nucleotide sequences at the above locations are unknown.
ttgatgaatagaanattggaatgtttaaaaacttataatttagatgttaaaaataaatcaatatttggtgatttatttaataataccgtgacgacattaattgattgttctgatggagttgcaagatgtgggaattgtcattgggaagttcatggatcaatatgttctcattgtggtactcgatttagaagatcaacaagaaatatcaatggagaaagtgaagaagatgaagatgaggaagatgatgatgaggatgatgaagatgaggatgcatttgaagatgttgttgcaggatttcgtcaaagtgtggaaataaatgaatatgattctgatgatagttttattgatagtagaactgctaatgaaatacccgttggtactgatagtgatagtgaaatcagtatccatattaatactaataataataataataataatggtaatgtttatgataatgaaagtaatgaaaataataacactgatgatgatgatgaggaggaggaggaggaatatggagataatcatttaggtcatactgaatcatttggtaataatagtgctattcatgacgattggcatggatttgaaatagtcttgcaacaccgggctggaaaatccacgctgcga

SEQ ID NO: 1861 - DNA, 564 bp, Candida albicans
  unsure (413),(417),(419),(426),(551): Identity of nucleotide sequences at the above locations are unknown.
tataaactcacatatatatatatacttaatatgacaagcaataatacagataaaacaccactactaagttctgaaatcccggagaatccaatcgtattaccttcatcgacgcagcaactgtcgtcgtcacaactgctggccaaaccgtcatcatcatcatcaacaacggcttcaacttcatctattactccaacaccatcattagtatcactaaaacaaccaacattatctccttcatctaatactgctaaaacaaattctaaattagtcaaatctaataaaattggattacaaagaactagtagaacatcgcaaaaactcaaattagtacctgaagatcctgatctagatattatgaatacattaagtggcaaagatggtgattatgacgacgaagaagaagacgatgattntgcncnaccagcnagaatatatgctcaagttaagaaaatcactgatacttccgcacgtaaagaagccgaaacctggaataaacggcttcgtgaatttatacctaatatccctgcctattggtactggtggattccctngaatgaaagtatt

SEQ ID NO: 1862 - DNA, 597 bp, Candida albicans
gtcgatttgaaaagtgaaaaattatctgaagaagatatacaaattgaagaatttaattattatataacaaaatcatatcaaccaagaatttataatgattttattacattaagagatgatgataattatatgttaaaattatctatatctcatggattggcccaatcagtgaaaatctcattatttgaagaattagtcgataataccattgaagatactcaagaaatccctcaacaaattgcacatacggggaaagttgaaatgacaagagatgaaatcatgaaatctattggagaattatttatcttaagaataaatattaatttgcatggatcagtattggattcaccagaattaatgtgggctgaacctcatttagaaccaatttatcaagccatgagaggatatttagaaattaatcaacgagttgaattattaaatcaacgattagaagttatatcggatttattactgatgttaaaagaacaattgggtcattctcatgaagaaaacttggaatttattgtcgtggttcttgttggtgttgaagtattggttagtgttattaatattattattgatatcatggcgttttga

SEQ ID NO: 1863 - DNA, 243 bp, Candida albicans
acacatggtggtggtggtggtcatggccactatcaacaacaacaaggatataatgcttatggaccaccacctccacaaggtggatattatcaacaacagccaggtggtggtggtggatattatcaacaacaacaacaacctatgtatgtacaacaacaaccacgttctggaggtaatgattcttgtttaatgggttgtcttgctgcattatgtgtttgttgtactttagatatgcttttttaa

SEQ ID NO: 1864 - DNA, 894 bp, Candida albicans
cgcggtcggccatcccgtggtgagagacaaagaaatttgtgtgcttggatcttgtgtatagttgccatttgcaaaaaaaaaaaaccgaaaaaaaaaaagaccagttacagtatatattttcatcccatataccagaaagacagtatgactgacattgaagtcaaatcacgttccagatccattaaatctttttcctccaatgaattgaccccggactcgtcagttcaagaattaatcaacgaattgagttctgataatcatatgtccgaacatagacttagattaactaaattagaaaatggcaaacaagtagctttgattcctcataagacttttgctgagaacggtatcccaaagactgcaagcaagattgaattgtttgtcaaagatttgggtccgcaaatctcatggagaactgtttttttggttgaatactttggtccctttatttttcatccgttattttactatgtccaatcactctatggttctggatctttcgaacacacacaaactcaaaaatttgcctttgcaattgtccttttgcattttttaaagcgtgaattggaaaccatttttgttcataaattctctaacgcaacaatgccagctttcaatattttcaaaaattcaggacattattggattttgtctggttttaatttggcatattttatttatggtccaagtgataaactgggggttttaaaatactttttccatgttaatgaattaccaagctcagttgtatatggtcttttcggcttgtgggttttcgccgaattatctaacttgactactcatttaattttgagtaacttgagaaaaggtgattccaaagtttacgttattccgttcggatatggattcaattgggtttcttgtcctaactat

SEQ ID NO: 1865 - DNA, 1320 bp, Candida albicans
  unsure (34): Identity of nucleotide sequences at the above locations are unknown.
atggcggtgcagggaactttcatttcgcccagcnacagtaatcccacttttttctcatcgttgaaatatttctttgtgtcaatgaaagatcaatggtttcctaatatgtccgatgataccattgctccaattaccctgagacatagtcatagccataatgcatctggtacaatagctagcccccaccgaaatgtaattggtgaaattgataacgatgatggcgatgatgattctgaagaattggcagaagcattggaagatgaatcagtagattatcaagacattgaactcaacaagcaaagtagtcgaaatctgtatcgccatcacaattccgatattcaacaggccaatttagaaaatttccgaagacgacaaagaattattcaaaagcaaatgaaatcgattttcatttatccatttgcttattgtcttgtatggcttttcccatttattttacaagccacccaattcaattatgaagaagaccaccatgcagtgtattggctcaatgttttaggagctttgagtcaaccattgaatgggtttgtggatacattggttttcttttatcgtgaaagaccttggagaaacactgccatgaagaattttgaaaaggaaaatcgtcaacgagtggataatatcattgtcaataatttagaacaacggaaatatagtgaaggcgccgaatcggctcaaacagtggccactgcaagtaaaagaattgccaaaaactccttaagtgccagttccggtcttgttaacataaatgcatataaaccttggagacaatttatgaacaagtatcgcttcccattttatcaattacctaccgacaagaatattgccaaattccaagatcgatacattaaacgcaagttgagagattcaagaaaactagataaacttgtgcaagaagttacacgtgatcgacaggatttaactttcccgactaacattgctgagaaatatggtgacggaagtggcaatggtagtggtagtggtagtggcggtcatcatggaggttcaaccataagtaatactaatgatagtagtcctatgtccatgggtgcaggcatcaattggacagagccaactaatgctcatgatttctccaacattttgaatactggtgggaactctaatgtttcttcatggggcaccaaagacgttcctgggtttaaacccaattttggaaaattcacatttggtaacagatcatcaaatttattatcaagaaagagtagtacggttattggattacatggtacgggaagaaatgttagacaacctagtaatgacagttttaatgatgcccgttag

SEQ ID NO: 1866 - DNA, 1320 bp, Candida albicans
cacaccatcatgcataaacacctccaccatgtttcccataccataaagtcctatttatccactcttatagccttggagaaccttaaggtagtggcgtttttgatttcccttttgtcttgtcttgtggcagggtcgatattattgtttacattatatacgtcgtcgttccatgaagtgttggggctatcgtacttgcaaatcaacatgatctcgtcgttgtcggcgttgggaatgtacttttgcttgccggtacttgggtacttggcggattcgtatgggccagcgttgttgtcgttatttctgatctggttcttctgtcccagttactttgtcaatagctatttggttagcacccagagtggttcggtgattgggttttgcgtatgtttttgttttattgggctagcgacgtcgtcattatacttttcgagtttgattacgtgtgcacgtatatgcccagaccacaaggggttggccatttccttgcccataacttgttatggcctttcggcgttgctcggggcacaaattttgaagttgccatatttccaccgccacgacgtgttggatttggaagttgtgtttctgttttttgcatggctttatttggtcgttggcattgctagttttgtgtctagttctattgttattgttgagctggagttgttgtttggggttacgccagatgaggaaacggctttgcttgaacttacgccaacgagatcgctcgagccgcctaaccaccgccagaggtttgtgctgtttgtcaaagacccatcagcatggattttgcttgtgtcattgatcctcaatattggccccatggagagttaccagaacaatttaagctcgattttgaaacacactaatggcgcagatttgccgaaccaggtgagtattatggcggcgtcgtcgactggcgcgcggttgttgttaggtgtgttgtcagattacctgtcgaaatatgtttgtcgagtttggttgttagtggtggtgattgtggtgggcgtggcaggacaaatgtccgaaacttctgccatcctcaatggcgtgtcctacgggggcatgttcactatttacccaacaatcgtggcgtcgatctggggcattgacattatggggtctacgtgggggtcatttatggttgcgccagcacttgggtcggtcattttttcgatgttttatggacgcaatgccgattcgtgttctgactgtttactgcattatttctacacaactgccggggcgatgattgttagttgtatatttgtacttttggcatggaagatttggtacgcccgtgggtttacgagattttga

SEQ ID NO: 1867 - DNA, 1305 bp, Candida albicans
ttgaacccagttatccctccctccatattgttacatacacaaatgggtaagcacagaagaaataagaaaactcaaaagtccagacatgatccattatccaatcctaatttgaccactagtgctgccattaatgccgttcgaggttctggcaaacagtctaaaataggacctttaattgataaattgaaatcactggtgcttaacgacaaatcaatggcgataggtgtgattaatgtattggctgaggatgaacagatgagacaagagttgattaataatgatattgtcctagttctaatgcagtattgtttgaatgatgccaatgccagtgaggatattttgattgagtcgtttgggttattgagaaatttaatcattgaagaaggatatgacataattcagtttatttgggataatgacatttggacaattgtggaaaacaatttgaacaaaatcaacatttccttcaattatttaatgaaccacaacaataacgatgatggaaccagtgatggcaagccaaagaaaaacttgagcaaggccaaaatccaatcactttatgaattttcggagaatctctttacattgataatcatgcttattacctcagatgagagaatttttgactttgtctttaatatcaacagcaatggcgagaataatactggcggtaacaaaatcgatccaattgtacaatttgtattaagtttaattgatagtcacatcaataacaaattaagattatcgaaaaaactattcaacactttgttggaattattattccaattatctacagaatcgatctcatttgttcaaaaattaagcacatcgtttgattgggataaacttggacaatttttacagagtgatgccaattatgactcaacatccaaaatatattataatgggatattcttttcgttagttgagattgtattgcagccatcgccacaagagaaaaaagaagagctaatgagacaagtattgagtgatatcataaaggcaattaccgtcaaagaaggctcagaatcaaagccaaaagaaggtgaggaacaagagacacaagatttggcagcatttgaggcaggttgtgatattatagccactatttgtgagtatttggctaccgatgagaccaatcctgaaacacctgcaagactttcacccgagactttacaattactagaaatggttggtaatcaattggtgggcaaaattgaagccatgggggtgtctgaatcagaatcaagttctgctgaagcagcaattaataacttgcaattggtaattagctttaatcaataa

SEQ ID NO: 1868 - DNA, 2094 bp, Candida albicans
ttgtttatttccatttatactttggttgttagtaagttaatatcggttatggctgttgataacgaaaagaaaaggtctactccagactcgttaaactcaccgcatgccaaaaagctgaaaccaatgcaagagttgagcgagtcaggaccattgactcaggcagatgtggtttatttccagaaagaagccatttggagacagatgatacaatacaagcaacagatgatgtctatgcgtctggagctaataagattgcaacgagaatccgatgctctgaagcatattgtcacagtgttgactgcgtggtacgagcagatacttgctctttttgatgaactaaacagtgaagaaaccagcgacttgttattagctattacaaagaatgacgatgaacaacttgatttaattcgaaaaaaattatcgaatttgatttcaagtaaagtgacatttgattctgccaagtacgagaaagtgtctggtgagttggctcttctttctcgccaaaacgaacaaatgacagaagaaaaacgttcacttggtgaaagaatcgatgaattagagtcaaagataaccgagttagctaaagagcatgaaagagcccagtcaaagacattaaaaaggttggattcacaaagacacatcaaaaccgaggaagacgagcaatcaaccaccaaagaagagaaccctcaaccaaatggccatcataaagagaatgacaaaactgccgtagtggattccgaagagctagataatcttaaatgcgaattggataaattgaaaaccgctaaccaacttcttgtacaacaagtggaacaacttacgaaagagaaccaatcactaattcaaaaatcgttgaacttggagaataaactacacaatttggaggaatcggatttggaagacaatacctattataaaaaaatcgtgaaaaacaaccaatcattgcaggaacaaattggtaaactaaccaaacttaactcaagtaatgtgtcacgcttaaatgagttggaaagacaacaaaacgatttaaagtcagttattgaaggtgaaatcattgaggaaaatgaaaaattgaaacagcagttacaggaaagcgaaaacaatttggtgagaatcagaactactcgtgatgagttgttgtctaaaaataacattctcactagtcaattgcaagatcaaaaaacaaacgagtctttagttgaactaaacaacgttctttccaaaagggttgagctgttgacagaggagagactagaagcaattgtcggcacaccagggacaggcaaactcgaagatttatcgcaacaagaattgattcacaagattagccaattgaacaacgagattaaagaagtggaattggctttcaaacaaacaagagaaatcacattaaaaaaattgactagctcgattgatcaagaaaacttgacaaagaaattaaccattgagaagaataaggcggaccagaaatatttctctgccatgagagtcaaggattcattaacaaatgagaacaagttgttgaaagctcaaattgccaaatcacaagatttaattaaaaaccttaatgatttggaaaagaagtatttgaataaaattgatcttttaagtaatcagttggttgattttagaattatcaaggaaaactcattagcagagaattctaaattacacgatgaattgaaaactttgaatatagctcaggatgcgttacaccaagaagttgaaagagtaaacgccaaattggaatccacattgaaagaacatactgacttgcaagaatccaacaagaaacgagaacttgaattggccaagcttcagaagcaattgcaaagtactgaaaacatcttacaaaaatacaaaacaaacaataccaactcacttttacaagaagatgaacaacaactagaggctttaagatccatagccaagtgttcagtatgttcgaaaaattggaaggacacagcaatcacagtttgtggtcacgtattttgttctaaatgtacacaggaaagattggcagccaggttgagaatgtgtcccagttgcaatcgaggggtttctgctaatgacttgttatcaattcacttgtaa

SEQ ID NO: 1869 - DNA, 855 bp, Candida albicans
  unsure (51),(153): Identity of nucleotide sequences at the above locations are unknown.
acaggatcaaaatcaccaccacatccaccatcatcaagaatcagtcccttngtcaattcacaaaccataaaatcaacgtttcgtaattattcatcttggcttaattatttattaattcaaccattgattattataatattagtaatatttcgnatattatcaacaattattaacgtcatttatattcaaaatcaatcaccgtcaatagttaatgggagtggtggtggtggtggtagtggcagtggtatagatggtagtacaaataataatagtcgatgtgaatttgttgatccagtagctaaagctagtaaatttattagagatttggaagataatttacaaccaccgctgatattgcaaggaaatgatattaatagtggtggtggtggtagcaatgatacacactcgccgataacactggcaacaagacctgtatcaggaacaacagtaacgacgacaacaacgacaacatcaaccacgatatctaatagtgagagattaccaccattttttcaaggaagttatactcaggcattatatatggctactaaaagggggaaatttttatttgtttatttaactaatcctcataatgaaaatgccaatggaattttcaataatattattactaatgaaatttttttaaaaattttccgaactaatgaaaatataattatatggggaggtgatttaactaatcctgaagcttatcaattagctaatagtcttgctgccactaaatttccatttttaggattattatgtttgacaaaatcactgaaaatgacacctgaaggaccaaggaaaactgttagtaaattattggtccaccacggcgctggaaagtcccgcgct

SEQ ID NO: 1870 - DNA, 699 bp, Candida albicans
  unsure (670): Identity of nucleotide sequences at the above locations are unknown.
ggaagtactattcttgaatttcatgaaagccatgcatatatattatggttaagatatttaaacactggattaattgccaacgatacattccaaactattattcagaaatcagattattggaagtccttacaacaaggattaattagtgattctcatgaatatcgtaagttcagtttatcaatattacaagtatctttaacgtcaattaataccgatcttaataatgattatattgtttgggaaatcaccgataaacaaaaataccttaatgaatggtcaagatatatgacattatatgaaattattgccattgatacttcattaaatcaagctgaagcaggtcaaaatgatatcacggggctaatctcaccaacttctttgattccttattcttgggggtggtgtttattatcaacaggtcttcaagctacccttgaatcagttagaaaattcacattaagacttcttttatcgatcccatcagaaaatttatatttaatcaaacatggattacctattttggagaaagcatttttacccaatttaatgaatgcatctaatttaaatgtgaaaatcacttctaatgataaattagattgtgaatatgcttatcaattgaaaaattatatttgtaatatggttaagaatttatcacctgatcaagtatttnatcagccaggaggtcgaagatataggcga

SEQ ID NO: 1871 - DNA, 1485 bp, Candida albicans
tgcggctccttccagccgcgtggtgaagaatccgtttatgattatataattgataatcaacaatatttccatttattcaaaccattaaagaatactgatgcattagaagaatggacgagaatgcaattatattcaataatattatcattatctgataatttaactaatattgatttggatattttccttgctagattagccacagaaccaagtccaatggttcgttcttatattgaatggataattgctcttaaattaagtgataatggaaattatgttgacaaattattaaatgaattattccagaaaataaatattctaaaaccttcagtggttacatcatatttgaaaatattattcttattcattcaacaacaatccaccaccaaggaatgtcaattattaacaaaacttttatatacggttatccctggatgtaccgtatcacgtaaaatgattagacatttttcactatcattaataatttctattcatgatgaaattaaaaggaaaaatttacctttagatcctcgtgtacttgatattgtcaataatatgtatttaaatgccattgaatcagaaacatttgctcaatatagaaatggtgatgaattattatgggatattgtcaaagatttaactttggtcaatatttctggtggagttatgttaagattatctgatagaactgatttagattttattaaaaaagaaaattttgataaatatctttctcaggatcaaatcaatttattgaaatatgatattggtcaagatcctcaattatggatgataaatgaagaaaaagaagaagaagaagaagaggattatgataagaagagaaaattgaacttgaagaaaccaattgttactcctattaaaccagtagacagtaatgaagtgtcgtcttcatcatttttacaaactaaaagtggtgcctggaatacaattatggatgctgatgctgttgttgatgatgttaataatactaataacagtgttcgaggatcagaaattccaagaagtgaattaattgttgtttcttcattagttgataaaccaccaaatttaggtgggatatgtcgtttatgtgatgttttaggagcagggttgttaacattacatgatattgaagttaaaaatcatatcaactttaaaaccgttgccgttactgctgatcaatggatgcctatgattgaagttaaaatggaaaatattaaacagtatttattagataagaaacgtgagggttatacattaattggattagaacaaactgataaatcaattgaattgaacaatgatttgaaatttcctaaaaaatcattgattttgattggtaaagaacgtgaaggtattcctggtgatttattagctgaattagatttttgtgtggaaattaaacaagttggtattgttagatcaatgaatattcaaactgctacagcaatcattgttcatgcttattcttcacaacattgttaa

SEQ ID NO: 1872 - DNA, 762 bp, Candida albicans
ttaaaaaatgaatttgttaataatataaataatggtggtagtatcactgattctgaaaaacgaggggttttcgggttttttggtaaagaaaaaggtgaaaatgatactcgtatgagatcaactgctggttattggatgggtgaaaatcgatctcaattaaaaccaactttgaaaaaaatatttttgtttaatccattagttccattgtttttacgtgtattgattattgtattctgtgctattgcattggcattagctggatcgatatttattttttcgaaaagagactatgaaggacataaagtggaacaacaaccaagtactataatggcattggtagtacaatcgtgtgccttggtttatgtgatatacattgcttatgatgagtatacaggtaaaccattgggattaagagaaccaatgagtaaaatgaggttaattttattggatttattattcattattttttcatcagccaatttatcattggcatttaataccatgaatgacgatgaatgggtttgtaaagcgaataaaactcctggattagctgatattggtgttgccttcccgacaattggatcaatttgtcgaagacaaagagcgttatcatcatttttatttatggtgcttgtattgtgggtcattacatttacagttagtttgttaagagttattgatagagtgaatactccaggacccagaaatgtatatagagctttaattgttttttatattgtaataatggtacgtctattataa

SEQ ID NO: 1873 - DNA, 1077 bp, Candida albicans
ctaaacatgtcaaaaaaaccaaaagtattagtaattggctcaggtggtgttggtgcaatttcagcactttcattaaccaccaacaataaatcagaagtgacattagttgttagatctgattttgaattaatttctaataatggttattcaattgattcatgtacatatgggaaattaaccaattggaaacctcataatttagccaaatctgttgaccatgctaccactgattttggtccatttgattatattttagtaacgacgaaaaacgttcctgatggtcccataacttgtgaagaaatcattaaaccagcaattaaaactggtaatgaagtgattatattattacaaaatggattagggattgaaaaccccatgtttgaagcctttcctaaccatcttatattaagtggagtctcattaattggttcaacttattatcatggtcatgttaaaaatttaggtaaagattttgtttatcttggagatttcaaatcaaaacagaaaagatcagatttatcatttgaaaaaatccaaaaatttattgaaatttatcaaaatgatgatcctctgaaaaataccattttattagatgaagacgttcaaaaacgaagatgggaaaaattgatttataattcggtattcaatactatttctgcattagtacaattagataatactagaatacaaatgacaattggtaatgaagaattaattcttcccgccatgcttgaagtcattgccattgccaaatcagtaggagttgaatgtgatcctacattaattgataaatatcttcatattggtgatggatttttttatagtccatcaatgtgtgttgatgtacgtaaaggacaattaatggaattggaaattatattggggaatccaatgagaattgctaaagaaaataatgtaccaacaccaattttatcaacaatttatccattattaaaattagttcaatttagattaaaagaagaaaagaaaatgtttgaaattgataaaaatgatttccaaggaaattctgatgattatcaaaaaatattttcagaaaaatatactactaaacattag

SEQ ID NO: 1874 - DNA, 609 bp, Candida albicans
acgtttaattcttctctttcaattaacaacatcattaccatggcagggtcccagttaaaacaacttaaggctgctcttaaagacaaaggattaattggtcaaactaatgtttctcagaaaaagctgaagaaaaagaattctcaatcttccaccaccaataacaccaagaatattaatcgagatgaaaaattacaacaattaaaagaaattcgtgatcaatttaataaatttgatcaaaaaattaatcgatccaaacatgacatttctattattcatcaaggtaaatttgttaaagttggatcaaaacagcataattctctggctataaagaatggtaatatgcaaagacaaatgaaaatgcaatatgatttagaaaaattccaacatggtaaaactggtgggatattagataaaagatttggtgaaaatgattctcatttaagtaaagaagagaaaatgttagccagatttactaaagaacgacaatccgggtcatctaagaaaagaagtgttttcagtttagcaagtgatgatgaacaagaaccagacgaaagtgatggcgaagataacggtggtcttcaccacgggactgccgatcccaatatatta

SEQ ID NO: 1875 - DNA, 546 bp, Candida albicans
tttatacaagaaatgtcgaatgttgatccaaataaacaaccagaatatgttaagaaaatatgtgaaacttataaaccaaatttagctgaggggaataaagagaaaatgagtaattttgttggcatattgtttgaatatattttacatattgccaatcaatatcaagattttgaaccatttgtgaaaatattaataaaattggccgaatcatcaacatcttcaagagcaaccaccatcaccaccaccaccacaacaacaacaacaactaaagcttacaatgaatcattagttgaaagagttcgtgaacatattaaacatattcaatcaagaatcgataagcaattgactcctgtagaattagtatttttcaccctaattgcatatttattttcttcttcagatcattatcatattgtaatcactccaagtttgattttaatttatcaaatactaagtaatataatgtatcatccgaaaaccgtgactgacattgctcctggagtttatttaatcgatgttttattaatgttttcccgatttgcttaa

SEQ ID NO: 1876 - DNA, 1608 bp, Candida albicans
gcaaatacggctccttctagggcggtggtgaaaatcctcgatttatcagttctatttatgaatgaaaaatcgttgttaacgaaaactttagaatggaatttgaaattatgtattgataatttcatatataatcaacaggggcaaatcaatgggaaaattttaaaagaatacaatcgaaatcaattagctcgagaattaacttcaagattcaaattggcggccattataaatcttatattatcaccatttattgtcatttattttgttttattatattttttccgatatttcaatgaatataaatcgaatccagcatcaatattgggattaagacaatatactccatatgctgaatggaaattacgagaatataatgaactttctcatctattcaataaacgattaattatgtcaatgggaccagcaaatacttatattgatcaattcccaaaagggtttcttgtggtcaatctaatgcgattaataaatttcatttcggggtcaattttagctgtacttgtaattatggggattttgttagaagatgaaaatcattcattttggtcatttgaaatcactgatggtagatcagcattattttatattctgatttttgggacaatttgggctataactgctagttcagctactggtactagtcatgaactgacaataagtacaacaagtcaatcttctaattcaaattcaaattcaaatgcagcatcgacatttgtttatgatccagaagcaagtttacgatatgtggctcaattcactcattatttacctagttcatggaataaaaaattacatacaattcaagttaaaaatgaattttgtcaattatattgtttgaaaatcattattattataaatgaaatcctaagtctggtattgactccatttatactatggtttaaaatatctcataatagtgggaatattattgatttttatcgagaatatagtattcatgttgatgggttaggttatgtctgttattttgccatgtttaatttcgaagaaaaagataaaaatatgatgagtgatttgaataaatcaaagaaaagaaggaaaagaatgaaaaacaaaatgaataaatatggtaagacaaaaatggtaaacccaattctgggtaaaacagttaatagtgaaattgaaatgacaaaaatctccaaaagtgaactggaaagaagtagtgatgatgaaagtggaaatgaacaagattatgataatgatgaagaattggattatttatcgtataaaaaagatgataaaatgattaaatcatatatgtatttcttagaaagttatggtggatctaaacagccgcaaccacaaccaccacaacaacaacaacatccacaaaatcaaaaccaaactgttggtgggttacgaaatcgaaatccaattcaatcaattgatccagcaataatgactgggaattattatgatcaacaaagtttaaattcatcgatttataatataaattataaatatgatgatagtggactattacaagatgaaactatgaattctagttcaaggaaaaaaggaggtgttttacgtatattgaatcaattttataaacaagatatcaatacgtaa

SEQ ID NO: 1877 - DNA, 735 bp, Candida albicans
  unsure (698),(718): Identity of nucleotide sequences at the above locations are unknown.
accgactctaccagtttatcagattccgcaagaatttcgaagacaactgtgccacagcagcaaagagcactggcaactgtgaacactaattatcagagaaccaggaataacaatagaagatttattattccacccaaggaaagagcattgtatctttgggcaaatattactaatatggatgaatttttaagtgacgtttattattattatcgaggtcgagggttattgaatattgttttatcacgaggatttgatttaattattcttatattcattttaattttcacagtatttttgaaatggggtattgattattcaatttttttcgataatttacatcaagaagaatcaaaacatattactttaaacgatatgataatccctaattattttgcaacgatacctttatcgatcaaattcatattatttggattcagtgtatatatattgttgcgtctggttcaattatatcttgattataattataaattaaaagaactcaaaaacttttatcattatttacttgatgttactgatgatgaattgatgacgattagttggaaaaccattgttgagaaattaatgttattaaaagactataatagtttaacatcaaccaccaaatcaaataattttctggaaaatcattatgttaatgatttatcatctaaagtacgcctgaatgctcctgatattgntaataaagtcgaccacgggnctggaagatcccgcgct

SEQ ID NO: 1878 - DNA, 183 bp, Candida albicans
tgggaccagaacccgatcctattgattagctttgccccatcattgaatttggaagattatccaccatggcatattagattgagtgaaatatattgggagccagataataaggatgttaattatgcagtatttcttcggggtttgcaacaattttccaattgtaaaatcaatatagggaaataa

SEQ ID NO: 1879 - DNA, 954 bp, Candida albicans
actttttcaagtacagtgatcatcaagtttatcagaatcctttccacagcggctaacatgaatgtaacttcacccaagatatctgaaaatgttcgattacgtaacaatggaaatactcaattaaagaacataacttgtgatatgaataataacgacaatgaatcaaatgaagattcggagaccaaagcaccaccaaattcttatcggatatataacatctttagtataattttggcgttattccgtagtttaatcaaaactactagtaagaccactaattcagtgtttcaaatgtcgatgttttatattaatcattttatcctactaagtttattctttatgattgccatatataagaatttccaatatctttatcgtcgtgtatatttaaaatatttggcagtaacttattatccaagcaagtcaccacaagtgattagggaggacattaataaattggaaaagatcccgaaaattgttagttgtatattagatttacaggatgacgaagatgaaaatggtggtaaagatggattaatcaattcaattagtgagttgacagcatggtcaatgagtgctgggttaaccaaattgattatttacgaattcactggagctttaatagaaaacagtggttgtattgttgatttacgtaagtacattacgaaaacattggtgttatattttggaacagaggcaattccaacattttccattagaatccctcataagaatttgatcatctatagtgacaatcatattgatggcaatgcagttgacttagagattgatttgattagtcgtattgatgggaagccaacattggtagaattgactaaaaccatgagtgagttagctgtcaatcgagaattactgataagagatattactattgacttaattgatgaagaattacatgaattagtgggaccagaacccgatcctattgattag

SEQ ID NO: 1880 - DNA, 1206 bp, Candida albicans
tactaccttgcaaacaccgttattacacaaatcagtacactttttcatcactcagttattttattcaacatcatgattaatgtattcaaacctattgttcaacgtgatctagtgccaactgcctattataataatgaaatcttacaatacaacggcgtttctcctaaagacacacctatacttccattcaaccaaaccatagaagacttgaatagagatatttacgccaaacctttacattctcataacgactactggagagaatatccattattttcagcattgagtgcaggtgcaattagtgtcgaaagtgatatttggtatttcccacaatcttacaaattgacaagaacggttactccatctacaagcaaatacaacaacaataacaaacaaggcaacagttcagttaacgaaacgctaattttcaaaaatgatgaaatttatgttggccatagtcaagaattcttgaaaccgataaatacattatttaatttatatttaaatccactatctcaattcttacaatttgtcaatccaacatatgagatcattgatggtgatagcaactctgagaattctcgacttgaacaggatttttttgcacaatctcaactggagaggaacagtgttttttataacaatcctggacaaccactttatttgtggtttgatttcaaaaccgaagctaattcaacttatgatgccttaaaaccattgttgaaaccatttatagataatgggtatttagcctattataatacgactgatgacaagtattattctggtccattaatcttaacaataacgggtaacttaccagttgaaaaagtaactaatgaaacaataagatatttgtttttagatggcccattagataagtttacaattgataataacaatacaaataaagatgaattgaaaaaatggtcaaaattatctcgtgtggcaagtggttccttagagacaattttgggatcagagtcatacgcaactagcactaagaatgatttcaatgaagagcaaaaatcacaattgaaacaagtgcttgacttggctcatgaatatggattaaagacgagaatttggggtgatataacttggccatggaacgttttagatctgcatttgaaaattttgtttgaattaggttctgatttattgaatgttgatgatttagaaagggctctgcagttattttcataa

SEQ ID NO: 1881 - DNA, 645 bp, Candida albicans
acgcggtatttccagtcccgtggggcaagacgaactcttaaacgtgaatgtgccaaaggttatattgatgggtttgttgagttattagtagaagacttgagactgcatttcaataatgttcctgtcaaggatactttgaacagaatatatgtgaataaagataaaaccaagaaatacaactccaatccaattaataccacttatctcaattttgatgaaacaactaaagctactttgcgtgaattcgttagtaatttggccaaagcaggatctttatcacaagcatattccaactaccaatcaaaattcattactgaaatcaaagacatcattaaacaaaatttaccattacaaaaactgacagatatgtccaacacttcatcacgagcatcgccaatttcaaatgcggagccagtaccaccaaaacaatcaaatgcattaagttcaaatataaaaacattaacacccaaagagtttgaaaacatgctttccaagacgtatgcacaactttcggaatgcttaagaagactcacagtgcatcagaaattattattggatattgcattgacaagtattccaccaactagtgacatagacattatgtctttggatattactaatgccattcataaggctatagaatag

SEQ ID NO: 1882 - DNA, 1464 bp, Candida albicans
gttaacagtgagaatcaaaaacaaaaaaaaaactacttgaccaaaaacagattggtgatttacatacatactatctacactctcaatatgactgatgattctttgaatctacctagtcgtgtttcgatggatgataatagtataaatttgaatgatgatttagtggttccttcggaaaactcatccaattcagtactatccagcaccagcaacgtcaataccaggacccccaccactatcataaccaataacaacaacaacaaccatattcaccgtggacacagacgtactggatcagcaatttcaactaattatagaactagtattgacaatgaaagttatattctgtcagggacttttttcaattttgcaaacctagaggatcaaaaagatgatatatactcgccattgggtcccaattccatttatgcattaacaatcggatcagatattgctagagccaaacgtcatcgagctccaaaaacaaatgtgacattaaatggaggggctactactatatatcatgtaaatacacctacaacgaaagatataccgcaaattcaattagtcaaattgaaaaataaagtttccagcaaagaattggatgaaaaatatgtgaaaaatattgcttcagagtataaaaagtttgaatcaagttataaccctttaactgaagatatattactgaaattagctcaaaatgaacgtaaatccagcattacttcttctacttcatcgttaccatcgccatcaccatcgtctcctacaacaattgacaatctaaaagggttatcaactcaattagacgctattcctcaagtttttcaagagctggatttccggttagatgaccccagagtgtttaaacaagtattgaaaggcactacgctaatgtttgatgaaaatgatcctaatctgagtatcactaataatacagaattacaagaaaagttatcggattatttggatattgtggaaatgaatttagtagatgagattgctaaatcttctgattcatttttcagcacatttggagatattgaaaatattcaaaagaaatcaaccgaatgtgttaccaattaccacactcttatgaataagattgatcaattagagaaaaatcaatcacgtaagggtcttgatatattgcataaaatgattgaacggaaaaatgttgaaactctcgaacagtcattattgcaaatacagtacataacatcattatttcaactagctaacaaatcatttactcatggtgattattctaagggcttgaatcaaatatctgccgtggaaaatttgttaaaaggggttgaccatgaggatattactgatgaagaaacccaaaaaatatatccaaaactaaatcttattgatttgtcatatttgccagcatttattcatttacagaatgatttggcaactcttaaacgtcttcaccacgcggctggaaggaccaacatt

SEQ ID NO: 1883 - DNA, 900 bp, Candida albicans
gccaactgtgctgggtccagtataagaagatactacgaacaagcattgatccaggaagttagagagttattgcacgattggaagaatcagctcgcagagtgtactgccatctacatacgtgcaaatggtgcatcgaaccgaaaagtcttggtcggcgaggtttctcccattcaagccaacgatccaagactaagggggttcccattcacaaccagaagagctacaacatcagagctaaagagggcgtgggtggagttgactcatttgcatgtagtggacatgccaaaagtcgaaaagaaaaaggaaacaccaaagaaaatcgaaaaaactaccgtctcaccaccgccaccacccacaaacacattatccactgacctcattactcttttgaaaaaacaaaaagcaccaaagttgattaattttgtcaaacaaaacagtattgatgtcaacgagtttaggctcgactacacccacacaccgacattattgcactatgctgctgcaaatggtcttggccatatggtgcaagtcctactcgtaaacctcaaagccaaccccatagtttacaatgccgcaggaagaacccccgccgaggttgctgacacctctgcaagaaaagtattccaaatagtcagacacaaattaggcgaagagtattgcgattggaacgccgctaaagtggcaccccccaaaagcaaagaagagatagaacaagaagaacgcactttgcatgaacaacttgaattggaaaagaaacaattgatacaacaagagttgaccaagccagaacctaaaaaagtcacacccagtttcgacttgaccggacttagcgatcaacagaaaatgagagtattgagagaacaacgagctcgcgcagccgaagcaagaatgaaacgttaa

SEQ ID NO: 1884 - DNA, 651 bp, Candida albicans
ttggatcctagattggctaattcgtcgaaacaaggaatttacttgaatttactatttaaatcattgaaaaacgacattgctaatataccaagagtattggcatttgtgaaaagaatgttgcaaatatgttcacattggttgaatgttggtgctgttgcaggtatgttatacttaatgatggagttatcgaaaacaatccctgaaatttctgatttattagtagaatttgcttccagaccagacgatacagaagaatcatcagagaaggataccgaagaagttgataaaaccaaggatgaaaacaaagacatagagtatgacccaagaaaacgtaatcctaaatttgctaatgccaatagatcttctttatgggaaatacaccaattcttaaatcattatcacccaacaatcgctatttatgcatcttcgttcttggatggaacagaacaagttaaaccagatttgggtttatacaccttatcccatttcttggatcgttttgtttataaaaatgctaaacaaaaaccacaaacaaaaggttcatctattatgcagcctttgggtggtgctcatacaggatctttgttggtccgatctactaatcttgtcgataccacagttcccgtgaatactgaaaactggctttggtaa

SEQ ID NO: 1885 - DNA, 537 bp, Candida albicans
agaatactctttaacaatcattactctgtttttactgtgtcagtcatgagttctggtttaaatttgtcctcattgaaggataaaatattcagtaaattaaatttacagaaagacaaccaaaccaaatcacaacaaaaatcaaagaaagcaagttcaaatgacaaagagatacaaaaagataaaaagaaaccagcaacaccagcaaaagcaaacgccaaaaaaactaaaggagttgatgaaatattgcgtcgtgaggcattagcattgggtgctactgacgaagatttgaagctagtagaaggtatcgaaagtgacgatgacaaaagtgaacaggaatttgacgacgactcgaaattggacaagaattttagtgctgatttgagtaagttcatgaaagggataggtttgggagaagaagaagctatggtagtgagtgaagaagaagaagaagaagctatggtagtgagtgaagaagaagaagaggaagttcccgagctagtcgaaggagaagaggcggaagaagaaaaagtgtcagaa

SEQ ID NO: 1886 - DNA, 615 bp, Candida albicans
acttcacaaaagaagttcttttctcaaatcttgtctgatggtactttgaatgataaaatgtcagcattgacattattgattcaggaagcacctttacataacttgaaagctttggataccttattggcatattgtgacaaaaaatcaagaacagctgctttgcaatctattgttgcattaaaggatttgtttgttaatagtttgttacccgatcgtaagctatttgcgtttgacaaacaaccattaagaaaagatgatagcgatattcagttggccatatattattttgaagatcacttgaaaaaagtgtacttcaaattaatccagatattggaaaagttatctcacgaccctatagtacatgtgagaatgacagttgtgaatcatatttttgacttgttaggtgctaagccggaacaagaagttaatttgttaaagttgggtgtgaacaaattaggtgatattgataataaagtgtctgccaaggcttcctatttgattttacagttggagcaagcccatccagctatgaaacaaattatcaccgatgctgttattgatgttattttccaaagcaataatgacgaccagtcttcaccacgccctgagatacga

SEQ ID NO: 1887 - DNA, 771 bp, Candida albicans
aataattatcaggaactacagacaaagaaaatggctaacgcagtagctgagaatgttttgggtactataggtaccgtgttatggtgtattcaacttattccacaagttatcagaaactatagagcaaagaattgcgaaggtctaccccctttaatgatgtttttatgggcagctagtggtgtccccttttctatatatttcattgctacagatggatctatcccattaagaatccaaccccagttattcacttttttctgcacactatcttggatccaaactttgtattacccccctaagaaagtttcaaggacaagattggttacatttgttggagcttttattgccatctcaatcggtttggaagttgggtttatcttatggttgagacctttgtatagaagaggaattgagtggcccatgttaattattgggatagtggcatgtattttattggccattggattaattcccccatactttgagttagcgaaacgtcaaggaagagtcattggtattaattttgtatttcttaccttagactcattaggtgccttgttttcattgttgagtattgttgttggtactatggacattatgagtatagtgttgtatgcaattgtgttggctctagaggtgggcattttcgccagtcacttcatttggtggttgagaatagggagaaattcagacaatgagtcggtagatgtacagagacatcacgaaacacatagcaatgacgaggagaagagtgaagtggtagtcgtatag

SEQ ID NO: 1888 - DNA, 489 bp, Candida albicans
ctagtgcgtgattttcacgtgacaagcaaaacaaaaacaaaaaaacttttccccaaaagaaaagtcaacacagtacacatcccatcaaccatgaacgacgatttgactggtgttttcaaggtaaccaatttggttgttgctgggctatgtgtggtcgggggactttcgcagttgttctatagtttccatgcgtttgtttgtgggttgtacattattgtgtttggtggggtcattggggcgttagagtttactgttcctgcagaagcctatgcctatgcgtcgtttttgttttcgtttattggcagagggattttctacacgtttcttggtgttagtttgagtggcgggtcattctttagagtgtttgcagggttggtggtgtttggcattgggttggcgtatgtggttttagagactgtgccaagtatttcgccaccagataatatgaacccggacggggcggtagttgggttagacgatgaggtgtag

SEQ ID NO: 1889 - DNA, 819 bp, Candida albicans
tgccagggggaagtgtatccaaatgataatcgtatgaccggctattcagagttcaaggaaatgggtattgtcaccacagaagaaattgatcacttcactggtaaaaataacaagcaagactttaatgccaaaagttctatatttattcgggattttgccgttacccatcagttgaaattaaagacatccaaaaagttattaggagaaattgacagacagttttcagtttaccctttcaaattagattatgccagtaagaactttcctataaacacagaaagttcagaagatgaaattaaacagcaaattgctgctattggtcaagacatgaaatctaacagattgggtgctgctgaattatcgaatcgtcatttaattcaaccaaaacctattcaaactaccaagtttattcccttaaaagaaatcttattaagtgccaacccaaccggaaagcatggtattgatgctactaaaccagtgttaccaggaatggagattcccttgccaaatttgggtgtatcttctttgaagttaaagtctttattgaagaccggaagaagtatcaacaatgtaagagagtcaacaactgttgcaattaatgaaaacaaccaagaattgattagattgactggtggtgaagctactgccaagtctaactgggtgcattctcagtataaattaccagcttcattaaacgagactattggtcaattggtgcaaataagtaaagataaaagatttggtataaagatcaaggaggtggttccctacaaggtgcagcaatctaacatgtctgtagaatccatgcaaatagattag

SEQ ID NO: 1890 - DNA, 840 bp, Candida albicans
ttgaagaccatgcagcttgcagttcgtcaagaagatgctgacatcttgttaaaacaaaagaatgttttggatgagcttgttgttgaaaaatatagggtcgctggtcaaataacccagactgccttagcatatatcacatcattgataaacaactcctaccatttacaaacatccccaaagttgactattcagcagttgtgtttattaacagattcatttttattaaagttattatcccgtcaatatgttaacaaagtcaatgaaaaaggtatcgcccacccaacaacaataaatgtgaatcaattactaaatgggttttcacctgaaatcgatgacgagcgtgaattcttcttgaaccaaggtgacgtcgtgactataagtttaggtgtccacattgatggttacacttctcaagtcagtcatactttggttatttatccaccatctgcagatgccaaaccagagggtccattattgggaagtaatgctgatgcattatgtgcttgtcatcttgcaactgaatctgtagttgtgttgcttgggtgttcattgtctccagaaaagttgccagctaatttgaaaaatgtgagtaacactgtaactggctcacaaattcgtgaattggttgatgcaattgctgattcattcaactgtgttgttgttccggggtccaaaataagaagagtcagaagatttttagcaggtcaagccgaaggtattgttgccgaacgtgatttcaaaggtgttgtttgggatgaatcgcaccaagaagcccgtttgttgacacaatctaataatacttctacagatttgattttactggattccaatcgtcttcac

SEQ ID NO: 1891 - DNA, 2010 bp, Candida albicans
agacaaaagtcaactggtggcgcaatcagagcatcgcgtagcaagataaaggcgtcaatttttaaatcatacgaggctggagagataatcagaattgacaaggtgttagtgttggtgatgaaaccaccaggcagtgggcgggtttctgaacgatggagagaatatattgctgttttgagaaaaactgacctggttgccgagcctttgatgttgcagttttatgatattgacaaatcgcctgaagaatcgcatccgcgagttggattcaggctcaacacacaagttaaagcggacttttatagttatttggacaagactattagtttaacggtgcttgaaaaagtgcaatacatcttaagactcaacaaccaaacaaattcgttcagatggctatattttataaaggaaacgttgggcgttgagaccgaaattaacttgtttaacatatatgttcccaggttagggtattttattgaggtggaagtaccagaaagtgtttttgccaatcactttaggagcaaccaaaacatagttgtgacaaagcacgaggctggctatgaaattgaatgtgacgggatttcccagtacttgaagcagtttcttcctaagggcttgtcgagagggtggttttgcttcagaaaatatgataggttggagtgggcaggaagtaccggagagcaattgtttatacagaatatgctatttctgcagaatcaccagctagaatatagagaatatgaggcatccgatgttccacccagaccaatagaaggttttttgggaaggttgactaatgttagtggtaaagagaaatctgtgttacgagatttccataaaatactgtacttctacacgaatagaaacttattgtttttcacaaagtactaccgggcagtgccgccaccacaaggaggtgattctttggtgaacgaagttgatttgtttggtgatggtcatatggagtggttggagtcagactttgatggacataacaaagctattgtggaggaaattggacgacgaacagatatgatagtcaaagctgaaggggtgattgacatggcagatatatgtgaggttaacatctcacactcaacacaaactcagaatttagttcactgcgcgttatggtattccaagccggagttggcgagtgagaaagagattgttgattcttgtttcgaaatacaacttaaatggggtgccctaatcaagttgcaggcacagaatcaggcggctcgtgatatttggattaccagtctaaatgatatgtgtaggtactggaaaaggagacaaacagagactcttgctaaccacatacagatttcagctaataatattgagcgtctactggcaacacaatacgcagactcgaatgcttcagatgagataaactttttagaatcacaacatgcaatagcttgtggagcaagcatcccgcatctactacctaatatgttggtgattaagagtgggtatttgtacgagaagaataaaaaacacgctagtttcaatcacttttatgttgtgctatgtcctgggtatttgattatctaccacacctttaggaggtccagggggacaggaactccgaaactgacagcattttatgagcattatattactattccattgtcacaatgctatgtatacactggtaaattaacagaactagacttgttgaattgtgaaactcgaacaacacaggtcgatacccattcagtcccacgagtctaccctgatggctggaaatccatggaagaagattgtgaattatgtttcacattatggtttggcaaaaagagaaacataagtcattacgaaaaacagcttccaaaactgttggaagtgggggtacagaatgaaaaaaatcctggaatggtaacaatgattagaaagttgggaataacgggaaagagtattatgtttacagctaatagtcgacaagaaagagatcgatggacaatgtgtatattaagtgagatggatcggcttacgggtcagatgtaa

SEQ ID NO: 1892 - DNA, 1188 bp, Candida albicans
ccaagcgtcggtccttccagcccggtggtgaggatatcatggatagctttatcaccttttattataaataaaattgagaaagcgacttttggatttataaatatcagttgtggacccgatggaagtcaatgtattagttttacttcagtgcatagaattaattttgctcttggtatattacatttaattttggctagtttattagtgaatgtgaagtcaacagctaatcctcgagctataattcaaaatggttgttggaaattgaaaatatttgcctggataacgtttatatttatcaattttgttattatacccgatagttttttcatattttatgggaatcatattgccataattttttcgacaatttttctaggtattggattgattctattagttgattttgctcatgcttgggcagaaaaatgtttagagaaaatagaaatggaagaattgactggtgaaggtgatgccagtttttggaaaaaattattaattggaggtactttggcaatgtatattggaagtattattttaacgattctaatgtattggtttttcactggtagtggatgttctatgaataaaactgcaatttcattgaatttggttttttcaattattatttcagcaatgtcaattcataacacggttcaagaatataatcctaatgcgggattagcccaatcatcaatggtggtattttattgtacttatttagtgatgagtgctgttgcatcagaacccgatgataagttttgtaatccattaattagatctagaggtacaagaaccgccagtgtcatattaggtgcattttttacttttatagctgttgcttacactactaccagagcagcagcaaattctgctttcagtagtgaatctagtccaaactttgttacaacaggaatcactactacttctcaacaaccttccgcaagaaatgagatgagatatcaagcaatcaagcaagcagttgatgaaggactgttaccagaaagtgcattaaaccaattagatttatatgaagatgaagatgttaacgatgaagaaatacaatcagtgcaatacaattattctttgttccatatcattttctttttggctactcaatacgttgctacattattaacaataaatgttaaacaagatgattatggtgattttgttcccgtggggagaact

SEQ ID NO: 1893 - DNA, 831 bp, Candida albicans
ttcggtgcttgtgaatttattgcccaacagacgagacaaattattgaagaaatggaaaaatcaggccataagatttcatgtatcttcatgagtggtggacaaagtagaaatggtttgttgatgagattattagctgactgtaccggtttaccagttattattccaagatacattgatgcagcagttgttttcggtgcttcattattgggagctgttgccgctgaagaagcagtcgctgagcattgcagagataaagcaaaatcaagaagatcgtcactttttggtaaaggttctcacaccaacttgaaagatagaggttcgacttctccatacactgcaccatctgctacttcaaccactaatttgagtatgttagcttatgctgaatctcatcaaggacaagcccaattgactccaatgaacgaagaaactgattactttaaccaagcagctcaacaaaaaggtggagcaggtgaacaccataacaatgctattaagagtgatgatgagtctgatgacgacgccacattatcatttggttctaaacaacaaacccaaaaaggactttctcaaaagttggcaagtttgaatttgaaaccattgacttcttcctccaaatccaatgctcctggtgctgcattgtggaaagtcatgaagaagatgactggtcctggtaaagttatcaatcctcaccctgatgacaatcctgaacgtagattattgaatgtcaaatataaggttttcttggaacaatgttatagtcaaagaaaatttagagatatggttgataaaattgaattagaaaatgcagagcttgccaaaaaacattag

SEQ ID NO: 1894 - DNA, 363 bp, Candida albicans
  unsure (20): Identity of nucleotide sequences at the above locations are unknown.
aggagcaatgtttgtccctnccgtctgtgtgaaaatgatgaatctgaggacgacgccacattatcattcggttctaaacaacaaacccaaaaaggactttctcaaaagttggcaagcttgaatttgaaaccattaacttcttccaccaaatccaatgctcctggtgctgcattgtggaaagtcatgaagaaaatgactggtcctggtaaagttatcaatcctcatcccgatgacaatcctgaacgtagattattgaatgtcaaatataaggttttcttggaacaatgttatagtcaaagaaaatttagagatatggttgataaaattgaattagaaaatgcagagcttgccaaaaaacattag

SEQ ID NO: 1895 - DNA, 963 bp, Candida albicans
  unsure (827): Identity of nucleotide sequences at the above locations are unknown.
agtactgtttgttacgttattgaatttgtccattgtcaacaagaaacaacaatggttcaaaataagtcaaatgtaagtcttgccaatagaagacaatcctcattctttcgtcaattgccaccagcagagcctgatgtttactacattggagttgatgttggtactggttcagcccgtgcttgtttaattgacacaaatggtattattttgggattagcagaacgtccaatcaaacgtcaagaattagaagctaattatatcactcaaaattctactgaaatttgggaagccatttgttattgtgttagatcttgtcttagagattccggagtacaaccagaagatgtctttggtataggttttgatgccacatgttctttagttgcaatttctgaactgacagatcaacccgtttctgttggtcctaactttaagaatgataaagataacatcattttatggatggaccaccgtgctgtcgatgaaaccaatgcaattaatgccactaacgacaaatgtttgaaatatgtcggtggacaaatgtcaattgaaatggaattgcctaaaatgaaatggttgaaacatcacaagcctggtggaatcaaagattgtaaattctatgatttgcctgattatttggttcacaaggcaactggtaccgagaccagaagttactgttctgtggtttgtaaacaagggtttgtaccaattggtgtcgaaaatagtgaaactggttggtcggaagaattcttactgtccattgatatgcctgagttggttgaagaccactttagaagattacgtggtattccagcgaaaaatggtanatatttgactgctggtgatcctgttggaaatttgacacctgaagctgctgataaattgggtttaaccaccaagtgtgttgtccgttctcccgtcattgatgcttatgccggatgggttggtacagttgcccgctaa

SEQ ID NO: 1896 - DNA, 717 bp, Candida albicans
acccacactttgcgcatgttatctagtccgggcctctttcgacttttcacaatatatttctccatggttttaatatatgcttcaactatactagctgcattcagtgatccagggagaataacaacaatcaatttgaaactgtatccatatacccccaatcaattgatatttttcgatgggaaaacttgttcaacatgtcacatagccaaaccagcacgctcaaagcattgttcagtttgcaaccaatgttttttgttatatgatcatcattgtgtatggataaataattgtgttggctattataactacaaatggttcatgttgtttttgatttccaacatcaacatgttaggatacggtggatggttatgctattgggcattgactcctgtatcttggcggaaaataacatcaacgaacaatgcaaataaagtcactgggattttcttgatcttgtgctccatatttattgtgataacaacactattcacttttttgcatttaaggtatatttatcttggtgtcacgactaatgaattggataaatggtctgaaattgaccatttggtcggattaggtgtgctttaccaaatagaaccatcaattgccaatgaaaattatgttgaacgggcaatcttagatggaaatgcggtatacattagcttaaaagatgagagaattttaatttataatagcaatgtgaaaaacttaaacttc

SEQ ID NO: 1897 - DNA, 2064 bp, Candida albicans
ttaattaggaaaatcgaccatctgttggaccattgttttacttggcaacatttcaaagacccccaagattttgaaagctctgttgatatctttttcagtggtttggaagacttatggacaatcagtcatagctatctaatgacatctaatattacacagcaggctgaaaatcaaaagaattccaatacagacaacggtgtcttagattcggttatcctgggtgttttccaaattgaatctcccgccataagatcatcagaacagaacaaactatattcgatccttttggcgtttcacgatgcggtgcgggtgagtttcaaaatctggaattggtctgattcaaaaacgacaaccccttccacagttaattactactcagatagatcgttgacgtatatttcccataagctcaagtttagagctaggaaattgttggaatcgttgttggatatggaaagacaggaagtggttgagtctattttgattctgaacggttctgtgaatgctaaactcaagttaatggatatattggacggtggcagacctcaaatgactttgccttcaatattaaagtctattttattgagatccaatttgccagtgttttcagaattgtcgcgtgtggctgttgatttggacttcgatttgaatatgaaagagctttcgcggttcttagtcgactttttgaatttcatcgataatgattctgttgcggatatttggaatcatataatggtttttttcaaagatgttcttactcatgtcggtgcttttgatgaaattttgctggattgtctacttatttgtagcggcttatccaagaagttgacttccatcaaaaatagagaccacaagtatcagaaagaattgggtgatatctttgttcgtttatttaatcaggttctaaatttgaaacagtttttagttagcgacatgtcaaagaataatacaaagacgacgcgcaagggggatttagttagtagcaagcctgacttggaaaataattttagtacactttgccaaataattcctgtctttgaagacattttgcccgacagcgataaagtaagtctgctagccaacttgactgtcactaattttattatcgcgcgaacaaagctgaaaacagtttccgagattcctgaagatgttgtcgtgattataaacatacttggagaaagtaactcttgtcgtagttggaagacattggtttcggatttgttcatggataagagttttttcaataacacactgtcgatgtcaagtgtttggagatctgttatcaacagttggatggtacatgataaggagagatttggtgagatcatatccagaataacagttacttccggcgcttcaccaagtaatttgtttgtatggaatgagatgtctgaaattgaaaacaaggctaacttgttgaaaagattggtctatttgattttggttcttcccaaggattactttttgaattatttggaaccactatttgataaggtgaatgttcttttgaatggaaactgcccggacatcattcgtattcaaataatgattctttttagagctgtctgtttgaaattcaatgagttgcacctattgctgaagtggactttgattacacatgaacttttatctacatttaaaaacttgttagccaaatccgctaaagagttatctaccttgtcacaagacagcttacaacttatattttttggctgtaagctattagatcaattgttgattttgagctacgatgagttcaacttgaaagagtgtttgttcgtatcaaccagtccagatttggatgatggtgagtccatttcaattattagcaaaatatcaaaaaagtacgatttgacttacttgaaagatgagccattcaacgtcgatcaagccctgcgtctgttacgtcccttgttggacgggaagagaaagattgagctgttaacacagttaacgcttttttttgactcgcttggtttgatcaattatgaaagaacatacagcttgtaccctatagattatgactcctgcacaaccgatgctttgagcgatttggtaaattga

SEQ ID NO: 1898 - DNA, 2112 bp, Candida albicans
aaattgcatgataaagacgacttatcggaaaagatgagctcccttctatctaaaacaaaattgtcacccaaggataaaaagtattcacaactggtcgagaaaacactcgccacgtttgattcacttgaagaatgggcagattatattgcatttttgtcaagattacaaaagtctcttcaattgaatatagacactgcaaaggaatcatactacgttccatattcatcccaagtttccaatcgtttggcattatgtctatcctcagaccttcccaatggtgtacatcaaaaagctttgagtgtatatgagtacattttcgaccgattacctgaatcaactttgaataaagatataaatatttggttgccgggcttattaccactcttttcgtattcatcgatcctggttaaacctctacaaatcaagatgtttcgccatttaatattatcacagttgagtgcaaccacattatgtggcatcagcaaaccatttattctatgcttgcttgcaggattagacgatgaaaactcagaagtatttggagacgttattgaattgttggatgcttacaaactgaaactcaataatgattcgcatttctggcaaagtatgtttgtctgcattatcagaaaccccgaaaggagacttggtgcattgcattggtgtgtaaagaggcttcccctgtttatcagcttcaaagatcaaaacggaaaaacagtactatccgaagaggctcagctctgcttaaaaccagaaccagggttgctaatcagagcaatggcaatatcgattgataatccagagtcgtttgatgtagttgttgttagagggttttttgacttaatgttgtctcatatacctttggatagtgatgttattactaatcgaatcactcctacggacagagaagtacttataatggcatgttccaagattacattgcgcaaagacatgagcttgaatagaagattatggacttacttcttgggacctgaaactgagcacgaaagtctgaaagcacttacgcgaacagagtactttaagcaatatgtcgaggaaacattaattaatggtcttttagcaatggcacattctgataaaatcgaattaaaatgtgacgcgttcaagattttgttgccgttaattatggataaatgggagattggaaatgttttgactcctaagttattctcctcgtttttaaagatcgcatacaataatcgtgatcaccaggacttgatgatttcagcaagcactcttttcgacggagtcgaatcaatttacatttggtccgatatcattggagttatattgtcagatgaaagcgacgaagaggaacatgaatttgatgttgttcattttgttttaaaggacttcaatgtcaatgaagaagaaatggctacacttcatgtgccatttgcaattttgtgtttgcttgctaaatcgacagtaactcccaaaagattagatacattagaattgttaataaatttggtttcagctcgatctttggacactttagatgaaggagttacttgttgcgaaagtgagattatcaacaaaatagaaacgtggtactcttcaagtcttaaaggtgaaagtcctgatacccccttttcacaaggtcaagtttcgtttttgatagtcaatttattacaaaaagtttacgtcgataatatggaagacacccggttttgcattaaggttgctgaattattgaatcatgtaagaaactttgccatgatcaagtcgagccacgggatccaagattcaaagttggtggaaaaaattttgaatatttctgttccggatttcagttgtgagcttaataaccaagatggattattagtcgcatttggaatttcaaagcttgtgggaatattctcaaaactgttgaatcacgaaactaacgaaaaagtattaaaagtattactttcaaatttgtggagtgcagtggtctcgtctgatccagcgaactatcaagtggaagcagtgagagcaatttttgaattggagacatgttactccttgaaaaagcttgaggcagggttggtagaattatttctagctttacctgagaatcgccgtcttcaccacgggtggaagaccgca

SEQ ID NO: 1899 - DNA, 1053 bp, Candida albicans
gaaaattatgaattagaaaaagcttatcaaatattaactcgtggatgtgaattagatccaaatgccaacgaaggatttgaaaaatttttatatttaggacaaattattggtggacaagatggtataaattatattaatattgccatcaataaattgcaatccttattattagaagaagaagaagaagaaaaaaatgattcaactaagaaatcatttttcattaataaattaaatctggcaatttttgctgaaattgaaatttggatgactgatttatgtatggaaccagaagcagaatcaaaatgtaatgaattaattgattattcattacaattagatgataataataatccggaatcttattcattattatcatcaattagaatttctcaacaaagaacacaagaagcaattgaagcattattaaaatcttgggaattatttaaattgaaaaaatctaaattagaagaaatggctaacaatgctaaaactgatcaacaacaagaagcagaagaagaagaagaagaagaagatgttggtggtaattctggtgattcatttgaaattggtatggaatatgttgatttgattcaaccattaattacattatcgagatatgctattgaattagaacaatatgatatagctatacaaatcagtaataatgttcaagatattaatgaaaatatattggatagttattatattgaaagtttggccaatattttaaaattgaaaaaaattttatatccaaatgaccaaaattataaagatattgaattatcagaaattttgaaccaagtcaatggtgataatgatgaaattaattcaattttacaagatgttaaacttagtttaactatggcttataaaatcattaatagtgatattggtgaagaattcgatcatggattaattgaacaaattaatcaattattacaagaatttggtggtcatataatgagtgaattaatgcctcaaagaagacgtggtaatgatgatgatgatgatgatgaaatagaaggttgggaagatgaaattgtttctgattga

SEQ ID NO: 1900 - DNA, 1131 bp, Candida albicans
  unsure (235): Identity of nucleotide sequences at the above locations are unknown.
atgccaagatacccacggattcaaatcatccaaaaattcaaaattgaaacacgtaatggtagaacaatttcaactcaacaaattcataatcatcttagatatttaatacttacgcctgttgaacaacatattattgcatcgacagattctgataaatcaatattaattttcaaaatagattttaataattcaattaattgtttgaaattaattaaacgtcaaccattcccaaacngaccaagttcaattactattgattcacaaggacaacgtgcaattgttgctgataaattcggtgatgtatatactgtatctattaatgatgattatagtatgtcagaaatagaaatagaaatagaaaaagatatacaaccgattttaggtcatgtttcaatgttgactgatataacaatggccaccacccatcacaataataataataaacaattcattataactgctgatcgtgatgaacatattagaatatctaattatcccaaaagttatgtaataaaaaattttttatttggtcatgatgaatttgtatctcaattatatatccctgttcaatatgatcctagtattttgattagtggaggaggtgatgattttataaatatttggaaatggtatgaaggtgaattaatagaaactattcaattaagacaatatattgaatcatatttatcagatgatcatttaccacctacaagatttagaactgaaacttcaccaaaagaaatttcaattgctaaaattgcaactttaagaactaatgatgatgaggaggaggaggatcatttattgattgttttagtggaaaatactccagtgctattggtattcaatcttgatgattcttataaggccaaatatttacaagctataattgttaatgattcaattattgattttgctattgctgctgataataaaacaattataacttcattagaatcagaacaacattctataaaatatttcactttacaagaagaaaatgatgggaagaaattttctgaaattcaaggaccaaatattgaacaattcatcccaattgaagttgaacaaaaactggattttcaacaattatataccattttccaattaagaaaaagaagtgatagctaa

SEQ ID NO: 1901 - DNA, 1341 bp, Candida albicans
aattttttctttagacaccaccgatttcttcattaccaaatgatagacaactttgatttgaaactagaaactttactacattgggtaaagaacacagatgatgagaaaaagatatcaaatcatacatatatttctcccaaaattgatgtgaaagatgtgagatcgtcaggtagaggtatctatgcagttgaaccattgaagaaaggagaattgattcttaatatcccacattcgttcttattaaatttcaccactgttatggcacatattgttaaatataatggaatggctatagatctgcacatacacgtaccgtttgataaatcagaagatgaatacacagaaatatatcgtacattgacaaaggaagagattctagaactctcatcatttcagttactatcgttgtacttgacttttgaacgaaaaagatctcacaaatcgttttggaaaccatttttggatatgttaccatctatggatgatttcgaattgatgccaatagattggccacaagaagtatgcacgcttttaccttcatctactgaggtcagaaacaaaaaagttcgttctcgatttgacaacgattaccaggttatttgtgagttaatcaagacaaaaattgacaaagatggagatgtgacaactttgctcccacgtcaagaagtgttattatcatggttgtgtatcaattctcgttgcctttacatggatttaccaacaagcaaaaactctgccgataattttaccatggctccgtatgttgattttatgaatcattcatgtgacgaccattgtacgttgaaaattgatggtaaagggttccaagtacggactacttctcaatacaacactggagatcaagtttatttgagctatggaccgcatagtaatgactttttgttatgtgaatatggattcgtaattcccgataacaaatggaatgacttggatattagccaatatattataccgcttttaaagccaccacatgtggaatttttaaagtcgtttgattattatgataactatacaatgacaaaagaaggaatctctttccgaacagaagtagcattggctacgttacaagagtctgatcctcaaaattcacgaaaattattggcattgataaatggttacaccgatggagacgtattcaaagagcattcgaatgcattgctactggtcatattgaataagataattcacgaagcagaaaaacatcaacaccttcaatatgatgatgacaaaagaaagaaagcgatcggaactttgtatcacgacatgaaatctattgcttcaaacgtattaacatatatacaagacgaaactagtttataa

SEQ ID NO: 1902 - DNA, 747 bp, Candida albicans
cataagaccaatcaaatgacagatatccctatagctcttgataattctcaattacttaataacaacaataatcttaattcatcaaaccatcataatcacaaccacaatcacaatcatcatcaccatcatcttctgaaacaaaactcactgcagacaacagtaccaaaatcatcaacatctttttcagaacaacaacaccaacaaccattccccaatttagaaacaaagaagagtggattgatatatatcaagaattcacaaagtttaaagaatggaacaaaaatatctaataaagtacctcgatctaatagtagtagtagtggaaatggtggattaagctctaatacttcttctgttgatgctaaatcatctacagcagcattaggcaggaaaagatcaaattcacaatcacaagtagtatcgattccaacaaaaccaaaatatactacagcttcaacatcgcgtgatccatcaaaaggaggaggatctctgctactgtcactgacatcaagaatatcatcaaatccaagtagtaataatggttctttatcaaatcataatcctcaaaaacggaatcaaattcaatattatgttactcttttacctttaaatgatacatttattaagaaacatctccctgtggcaacatatcctgaaacaacaaaattaggtagaccaactggtactaaatttaaacctgatgtaactaatggatattttgattcacgagttttgagtagaaatcat

SEQ ID NO: 1903 - DNA, 339 bp, Candida albicans
gaacataaaatcactaataattcggctcccattcttaaagagctaatgggccattctgatactcgagctattttcaacttccttttgcttaatgctacatttatgtttgttcaatttctatactcattcagttctaaatcgttaggattactttctgactcattgcatatggctttagattgtatgtcattagtattggggttaattgctggtgttatttcccaacatgaaatagatagcaacggaaagtacccttttggattaaaaaactttgaaaattttggcaggatttaccaatgggacattgctagtcggtataagtggatctattttatttga

SEQ ID NO: 1904 - DNA, 618 bp, Candida albicans
caatttttttcttgccttgtgttcataataaccactggtctatccatcagattatacatatatatccatacatatctattcaactatagagatttcactgaaatgggttggtttggaggaggcagcggtagcagcagtacacctccatctaaagtatcaattgtaacagaatataaaccggaagaaaaaactcaacaatatcttgaagatttaccaccaaaatttgaagattcagaaccaatacctgaaagacaagccacattaatggatgctgctcaacggatcaaactctcggattttacagtggacagatttataagtatgccatgttttagagaggccatgattacaggattccaagccatgggtgtattaggagtagttacatttttgatccacaagaatgttcaaaaaactatgaattggtctgttggtggtttttttttaggtaatattattggatgggaacaatgccgatctttaagaaggaaatcatttcaaatgatagagaaagctcaacaagaaagagatgaaaagaataaaaagaaatgggcagaaatgcaacagagtgatgatgaagatttaaagaagtttcaagaattcaatagtaggaaataa

SEQ ID NO: 1905 - DNA, 1125 bp, Candida albicans
attcaacatttaaatatttcaatcatgtctacatcaattcctactgaatcaccacttactaccaataacaccaccactaccactgctgctgacatcagcaccactagtggtactactgcaactccagctcaagcttcagttccaacttcaacttcatcaattgctgatactcatcattcatcttgttcaaccactgattttttgacttggaagaacccaatcaaaactggtaaagtttttggttcccttgtttttggtttgattgtcttgaaaactgtcaatttattcaatatctttttccatttagcttacattggtttattgatctctgctgctgctgaatattccggtaaattgattactggtaaagggttccttgctaatttcaaaccaactggtaaattgtacgctaaaagattcaatgatgaagtattgccagaattggccaactttaatgtgcatttggaagaaagttttaataaaattgtctattcacatgacattgaaaccactttgaaagctgctggtatttcttatattttatataaattgacttcatggttttcattgtacactttgattttcattttcgttgtgttgattttcaccgttcctgtcatttacaaaacttacaagaaggaaattgatgctgctgttgccgatattaccaagaccattaaaaccaagtctgctgaatttactgaaaaggctcataaagctgctggtccacatattgatactttaatcaagaaaactggtccaattggaagctttattcaatccaaactcccagtcagaactgctggttccactgttggtgactcaaaggcaacatcttatggtactgatgctgacaaaagtatcgctggtactacttctgctactggtacttcttctgctactgctaactcaactactgttcctgtttccgttcctgctgctacttctgctacttctgctgaaccaatttcaactggtcattccactggtgcttctcaattcccaagtgctccaacttctggtttacacccaagtaccgttgaagatgttatcaaacaagcttccgaagaagccgatgaatttgctgacactactcaagaatcatttaaaccaactttacattaa

SEQ ID NO: 1906 - DNA, 381 bp, Candida albicans
tattatggatggtgtaaattaatcccattaacagcccaatgtgacgaaatcaagaaaagagtagatggcaaagatgtattattcaatcatggcaatgaattgaccaatgaagaaagagatattttccccatggtgatgtcaataggttggaatccttattatcacaacaaagataaaactgctgaagttcatataattcacaagttccagaaaaatttatatggatcaaagattgaatatgttgtattaggatatatccgtccagaattgaactttgatagtatagacgagttaatcgataccataaattccgacattgaatttgttaaactgaaattaaagagtgacgaagaaagtggcaaggaatatttcacgaaatga

SEQ ID NO: 1907 - DNA, 564 bp, Candida albicans
atgaaaagagaccaaaaaatattgaaacaagagaagtcattatttgttttgaattcggttgactgttttaacaatcttttacaatcgattttgccacaattatcatccatctcgattttttcaagttacattcgccagtttgcaagcattgatgcaagaactgccaaccctcaaaaagtaatgttaattgttgcccctgataatgattctttggaaaccaagttatctgatttaaaaccatgggagttcccagagcagatcactcccgaacaatccgaacaagaacaggataaaacgttaaaaaataatttattacattttttgaatggtcatttgatcaataactttgaagaaaatcttgttattgataaaagttcaactgacgcagtcacaattatttctaagctaaataacgggaaatttttaaaaattaaacaggaccaattaagtcagaagttttctattcgtttgcttgatagtgaaaattggattgacgttgaaactatcaaacaagtagaaaatggatttgtgttaataataaacgattccttggtcaaaccttga

SEQ ID NO: 1908 - DNA, 1413 bp, Candida albicans
cgaagcttttttttttttcattcattcattcatccatccacctatagattatcattgaaagtcattaaacaactaacaatgttgggacaacgaatgatattacggaacacttatagattgacagttccaaaactggtaatcctaccaatttgtcgaacaaattattccacatcatcatcatcgaataatccattcccattgaatgataaagaacggaaacaagcaaagaaacaatcgcaattaccttggtataaacgatggactaattattccaattcggaacaatttcaaaataaaaccatgccaaaagtatatatatgtgcgtttgttgtttctttagtaccaatgtatttttatatgcgagatagatatcatgaagataaacaattgaaacatattaatgctaaatatgctcaagatccttcaagtttatcggaatatgaatatttagtattaaaatcaatgaatcatctggaaaaattacgtccattagaattgaaaaaatataaaatctatcaattaatgagaaaagaatttcgacgtaagaatttatttaatcaagaaatgttcaatccaactccacaagaattaaatgattggtatcaaaatcaagttaaatatgaactggcaagtaaagttgttccgatattagttgataaaattgattctaaagataaaatcaatgctaatccagcgattcaaaatgctgaagatactacggcattttatgattctaaagctaaagaatatgatgatgctgtgaaatgggaagaacgaggtatatttatgggtagtaaaagaaaatggttaatgagtcaagctaagggggatgttttagaagtttcttgtggtacagggagaaatattccttatttataccttcaacaaattaaatcattgacttttattgattctgctcgtaatatggtagaagttactaaagagaaatttaaaaaggcattccctgaatttaaaaaagtcgcttttgccgtgggtaaagccgaagatttgagtaatattgctcaagatgttaaatatgataccattgttgaagcctttggattatgttgtcatgaagatccagttaaagcattacaaaatatggctaaattattaaaaccaggtgggagaattgtattattagaacatggtagaagtaattgggggtttattaataatcatttagattttagaagtgaaaaaagaatggaaacttggaaatgtcgatggaatttagatataggtgaattaattgatgaagctggtttagatataactaaagagaaaagagctcattttagtacaacttggatggtggttgttaaaaaaccagaagatccaattaatcctgatgaaaaaccattcttagataaactttttggtagagaatctagaaaagtacaaaaatcataa

SEQ ID NO: 1909 - DNA, 1272 bp, Candida albicans
tcgcaattgtgtgcacctgcccgaggtgaagatatatgttcctgggttactagtttaggactttattctttaattgattccaaaattgccagaattgcaactacaacattattactggcaatgagaagtaatggtgaagaagtgaaagagattggaatgaaagctattgtggatatattggcaatttatggtatgagtattcttgataaatcatctaaatacaaatattcaagaatgtttttcaaagttttaaattcatttgatgcaccaaaattacaatgcattgtcgctgaaggattatgcaaattgtttttagccgatattttgtacaagactgacaaacggagtttatttggaaatgctattcaaggtggtggtggtggtggtggtggtggtaatgatgatccaactaccaccaatgacgatgaaactgaagaagaaacagatcgagagcatgaaaagcatttatttgaagcgattgtacttatttatttcaaccccaacaccaaatcaaatcaagaattacaacaaattttgtcattttgtattccagtttatgccttttctcatataaatcatcaaatcaatttagctgcagttagtggtgatgttatttatcgacttttcactgaaacagaaacagaattatcaccaagtgttataatccctcaattaatatcatggtgtgatcctcgaaatttagttaaattatcgaatgaggaaataaatcaagcaacatcacatttatggcaatgtgtttatttattacaagtggttgaacaagtagatgctcgtaatgttaaaagatgcatcattaacaatttgaataaatttcatataacggaagaattagaatcaaatcaattacaagctttaattaaagctcttgatgctacagttgaattatttactaataatgaagataaccctaattttatcttggataaaccaacaaagaagaattttgatacttttattgaatcaataaagaataaattggaaattgctcaaaaaagagaagaaaatgaactgattaaaagtggtacaaattcaatattacatgaattagatgatttagatattggaactggagagagtagtcaaatatctataaaatcagaaacaaaaagaagagatctggatcgatctctgcaagttagtaaaaccacatcaccagaaacttcagaaaatgaagatgaagaggatgataatgaggaggaggagcacgagaaaaagaccaattttactgatggaaaaataaacttgaattaa

SEQ ID NO: 1910 - DNA, 2586 bp, Candida albicans
atattcaagcgttgtccgccctccgcgtgtgaagacgatgaggaagatcaagaaggagaaggagatcaagaaactccaatttcggaattcatatcatatttgataaaatatttattgagtgggatagaggctaaagataaactggttcgttatcgtgttgtacaaacattagcatacttggttgaattcttgaccgagatacacgagaataatacattggaagcgttatatactttattaagtaataggctacaagataaagagctgtcgatacgtattcaagctgttgtggcattatcacattttcaattatttgaatttagtattgaaggtgatactggagaatttgaggatgaattaatatcaagtaaccaaattcagaataaattgataaattccattcaaaatgatgatagtccagaagtcagacgtgcagcattaatgaatttggttaaaacacaagatacaataccgattttacttgaacgagccagagattccaattctattaatagaagattggtttattctaaaatagctcgtgaattaataactgatttggatgatcttgaatttgaagatagggaatttttattaaaatgggggttaaatgatcgtgatgaaactgttaaagcagccgccactaaaatgcttaccatttattggtatcaatctgtcaatgaagatttattagaattaattgatcaattaaatgtcaagagtgctatagctgaacaggccatattagcattttttaaaaataaaccagaagttcttgaaactattaaaattgatgaatcatattggaaaaatctaactacagaaaaggcattcttgatgaggacgttttatcaatattgtaatgagaatcaattacatgctttaatggatgccaatttccctgaattacttgatttgtcaataacattagaaaagtatttgtcagtgaggttgaaaactataaatgaaaatgaaaatttagttaagacatgggaaacttataatgccaagattgacgaattagataatcaaatatttagtcttgaaaaccagatttccagaataaatactgatgccgataatttccgtaaaagtttatctaacattgaagaagatattattgaaatcaatattgctaaggatttgttcaaaaagagaattaaacaattgaaaaacaacagtgggaatctagaagatttgattactgaagaaaatcaagagattgctgatcaaatcaaggatttcctgatggaagatttgcaacaacaattggaagatatcaataaaaatcttgatgaaattgaacatcaaccagaagatataacggctaaattagaagaacttcaaacaaaatatgattcttgtattagggcgcttgaaaccactagtgaattgaaaattcagactgttcaaatctttgaacaagcacatgaaaatgattgtatcccctttgtagatgctttgaaagaattagaattcattattaatcaattattattaattgttaaagattttgattatggagatgaaatggcaagaagaaaattgttacatataataagaatgacattaactgaagataaattacctgatgcgttaatatcagtggcacttagagtattacgagcactttctataaatgaaaaagattttgtttccatggcggtagaaataattactgatattcgtgattctcgagatgatgaagagttccattctgctgccgctacatttgatgatgatgatgatgatattttgggaaatggtgatgatgaatctcaacaatcatcatcactcagtgcagtaacaaagaagcgaagaattgaaccagatatgccaccagatgatattgtgttaagatgtcttaccatgacacaatatgtattggaagtaattactcatagtttggatgatcatctttcattgagttctatttacagtggtattgtcaattatgctattcagaatgaatcgaaaaagaaattatatcttgctgggttaacttgtttaggactttattctttaattgattccaaaattgccagaattgcaactacaacattattactggcaatgagaagtaatggtgaagaagtgaaagagattggaatgaaagctattgtggatatattggcaatttatggtatgagtattcttgataaatcatctaaatacaaatattcaagaatgtttttcaaagttttaaattcatttgatgcaccaaaattacaatgcattgtcgctgaaggattatgcaaattgtttttagccgatattttgtacaagactgacaaacggagtttatttggaaatgctattcaaggtggtggtggtggtgatgatccaactaccaccaatgacgatgaaactgaagaagaaacagatcgagagcatgaaaagcatttatttgaagcgattgtacttatttatttcaaccccaacaccaaatcaaatcaagaattacaacaaattttgtcattttgtattccagtttatgccttttctcatataaatcatcaaatcaatttagctgcagttagtggtgatgttatttatcgacttttcactgaaacagaaacagaatta

SEQ ID NO: 1911 - DNA, 2334 bp, Candida albicans
gtaagaaaaacacagactcaaatactcatacatactgaaacaaactgtagacggcggagggcagcacaaaaaaagaaaaggaattcagcactaaaaaacacgggagacggaaaaatggccttgaaactactagggaaaaaatcgtcaaaagtcaaagaggaggaaggagacaacagtattgatacaacagaatccacacaaagcaaatcgccgtcaaaacatcatcgacggtcgtttaatatttttcaatatcaaaatcatagaaatagtcagggttcatctgacaattcatttgaatttagaggaatggtaaacgctttgaacagatctcattcaacttcaaagaaaactcgaccactttcaccatctcctcaaaagagcaactccctaattgtatcaagttcaaattcctctaaagtaaagaaacccaaactatccactgcagacacatcctacgaagatagaaggtataaccttccagaaaatcaagaaactcaaaccaatattgatcaactgtcacatgataaaatgaattcaatggaggatagaattgcacttagacaagatcaaaacgatcctgcgatttcatttgatgtcaaattaacaagtgcacaaggatcagaactattgctaaacccccccaccaaagacaccactgatcgatcatcgacgacgtcatcatctaagcaaccctttcctcattcacccagtaaaagtcaacttagtaatcaagaaactggcacttcaccacaaccacaaccaccaaaatcagaatcaaatgggtttttgtcgagtttattgaatgccgctgccaataaaatgatttcttcaacaccaccatcgcctcctccagaagacaagaaaaaagatcattcattttccagcaaattggatacattattgagaggagttaaacacgaaggttcgaaatcttcgttggtggacggagcagctacagcttcggcagatgttgattctttggagaataaacaaattacaaactctacagaattaaaatctattcattcacttacacatgatgttcaatttgagccagttagagaatctcctttaaatacattaggaaatggagacttgtccttagctgattttgacaataaatttgcacgtgaagaactcggaatgggctcaagaagaccgtctttcagatcagctgacagcattaccaaacgagctacaactcctgaacttatgcccaactcagggtcactaaatggaggtgacacaagacgactcttaagtcgcagcttaaacagaagcaatagcagtttgataagtattccacaaagaccgtcatcacttgggaaaagcccggtagcagattcccgtatggcgaaaagttcagatgatccaaatagaaattcaacaataactgagaatggacgagttgatgataatgattcgggggtgcttccaggtaatttcgatacagaaaacatcgaagacattgttgattataccaaaaagataaagcatgctctgaaaaagagaaataaagaattccatcagaatttcaaaaaattgcccactaaggagaaattgattgatgatttcagttgtgctgtgtccaaagatattttagttcaagggaaaatgtatttgagtgatcattatgtttgctttaattcaaatattttaggttgggttacaaatttggtcatcccacttcaagaggttattcaaattgaaaaaaaatcgacggcagttttattccccaatgggatagttattcgtactttgcatcaaaaatatgtgtttgccacttttttgagtcgtgacagcacatttgatttaataaccaatgtttggcatcgagtattgttggagaatagtgatattgaccctaaaaaattacaagctcaaattaacaaaggtaaaagaagagcccgtgcaggatcaagggtttcgaacttttcatcgacaagccgtgatgacgacaccaacagcttggatattagtgattctgatggactaggtggatctgacgaggacaatgataattccctgtttgatgaggatgaagacgcaaatgattctggccatgatgcatctttggagagtgatgattttgagtcagatggaaagcccagcgatgcaagcgagtcaaaagatggcgacgtggctgcaacttcaggttcaggaaacacatttaaaggcttaccaatcgttggtccgttgacacacgcacctactgaaactggttactccaaggaatctagtgagacattcatttccgtagacacaattaaggcaccaccaggagctgtttatttgattatttttcatccacggggcctggaacgatccgcgcat

SEQ ID NO: 1912 - DNA, 741 bp, Candida albicans
gtcatgccttgttccatttcatttatatcaacaacatttagcactacatcgtgtatcagctggatatttgctcagttaccccaaatattagagaattatcgaaacaaatcagctgaaggaatatcaccgtcattcctcatactttggtttatgggggattttttaagtttcaccagttgtttagtgaacatcgatattgtattagattttcaattatatctaagtgttttcttcctatgtaatgatgtgacgttatgcttccaatattattattacaatagtgtttatcctaggttacaacaacaacaacaacagcagcagcggcagcaactgtatgtgccgttgagtactgatacgagtgactcttccaggcttaccatgacgaacaacgaagacagagatatatcgatatatcaagcacaagatattcaacaaattaagcatgctaattcaaatcaatccacaagtgaagattttgtcaactcgacccccagtagttatgattcaataaatgataatgacaatgggtccataattaaaaaatccattgtgggggccattttgaatactggtcatgccgtcgcgttgcccatatcgacagaaacattctgtaaaagagacacagaagataaaagtaccagttcagtggggttgtatcttgcatgggggtgtacattagtttattgtttatcaagatgtcctcgattataccagaattataaacgaaaatcggttgatggg

SEQ ID NO: 1913 - DNA, 1584 bp, Candida albicans
tcactacatatttgttttcctttacaaagtacttcaaaaaacatgtcacttaatccagcattaaaatttagagattttattcaagttcttaaaaatgaaggggatttagttgaaattgataccgaagttgatcccaatttagaagttggtgccatcacaagaaaagcttatgagaataaacttgctgctccacttttcaataatttgaaacaagatccaggaaatgtcgaccctaagaacttatttcgtatattaggttgtcctggtggattaagagggtttggtaatgatcatgctcgtattgcattacatttaggattggattctcaaacaccaatgaaagaaatcgttgatttcttagtggcaaatagaaaccccaaaaaatttatcccaccagtacttgttcctaatgaaaaatcgccacataaaaagcaccatttgactcatgaacaaattgatttaacaaaattgccagttccattattacatcatggtgatggtgggaaatttattcaaacttatggtatgtgggtgttacaaaccccagataaatcatggactaattggtcaattgctaggggtatggttcatgattcaaaaagtattacggggctagttattaatcctcaacacgtgaaacaagtttctgatgcatgggttgcagctgggaagggggataaaatcccatttgctctttgttttggggtcccgccggcagcgattcttgtttcatcgatgccaattcctgatggtgcaactgaagcagagtatattggtgggttatgcaaccaagctgtacctgttgtaaaatgtgaaaccaatgatttagaagttccagcagattgtgaaatggtatttgaaggttatttggatagagatactttggttaatgaaggtccgtttggggaaatgcacggttattgtttcccacaagatcatcacactcaaccgttatatcgtgtcaatcatatatcttaccgtgacgaagcaatcatgccaatatcaaacccagggttatgtaccgatgagactcatactttgattggaggattagtctctgctgagacaaagtatttgatttcccaacacccagtgttatctaaaattgtggaagatgtgtttactccctacgaagcacaagcattatggcttgccgtgaaaatcaatattcaagagttgattaaattgcaaactaatgcaaaagaattgctgaacttggtgggagatttcttattcaaatccaaggaatgctataaagtttgtctgattcttcatgaagttattcttgttggtgatgatattgatatttttgatttcaaacaacttatttgggcatataccactcgtcatactccagttcaggatcaggtctattttgatgacgttaaaccttttccattagccccatttatttctcaaggtcccttgatcaagactcgtcaaggtggtaaatgtgtaactagttgtattttcccgaaacagttcacggatccagactttaaatttgttacttgtaactttaatggttattccgaagaagtgaaaaataaagtatctcaaaactgggagaaatattacaaatga

SEQ ID NO: 1914 - DNA, 2034 bp, Candida albicans
gtaatactgttatttttcctatttattggaaccctcaatatggtcatactcataccaataaattataccggtagcagcacaggatatacagcatttggattggacaaacttagtctatcaaatattgctaccaccaatgtgtcaagactaaatgctcattttttaatgggactaataacaatagggtttttccattggttgattgtttatgaattccaaagttatgtgattataagacagtcgtacttgttgtcacagccacacaaagattccgtcatggcgaagacattactaatttcaaatgttccaccatatttgcaaaaccatgaagtgttgaaaaccattttccaagtagtgcctggtggcattaaagatatttgggatataaatgagtttgaaataattgatcaccaggtggaaatagctcaagatgctttacattatttggaaaaatcgcaagtattgggactcaaaaaatattaccataaaaaggcgcaatggtgtggatcttcagtgggggactcagtagaagaaatcaaggaatttattgaaactcatgaaatatatttttaccctccactatatctgggaccaattaggattccacaaattgagcgaacaattcgcattacactaccaggatggttaagaatattttgttttcaaaaaccaatccccatgtacgagtggtctctccaaaccctttctgaatgcaaccaaaaaatagacgaagaaaaattaaaactcgctgaaggtcaactagccaaacacagtaaaatatttattgagttcacttctcaagaaggctcctatattgcccaccaatgtcttttatctcaatcacaaggtttccttgacaaaacaactatcgaaataaatcccaatgatatcatatggagaaatgtttgtcgaaatgatggtatagcttgcaagtttgaaaaatatttggttacaattgcctttatcagcatcataattctctatgtcattccagtgtcattgattggcttggtatcacaaataccattgttaactcagttattaccctttttagaatggatataccagttcccagaagaggcaagagaaacaatagctggtttcttaccttcgatattgctcggcgtcttgactgagattgtcatgatcattttcagatttctaacatactttaaaggaagaacaactggctgtgaggttgaaatcgatttacagaaatggtactttgcatttttgtttgtgcaacagtttttagttgtcaccattctgtcaagtgtcacggtgatattgaaacaaataatagatcaaccaacttcaatcccagtattacttgctaccaatctacccaaatcagcaacttttttctttcagtatatatctctccgggcatttgcattttgtggcaacaactttttaagaattagtccattaattcaatctttgatagtttgcaaattcattgacataacaccacgacaaaagtttaatcgtatcacaaatttgcctaaaataaaatggggtacgacatttgcagtgtattcaatctatgcatgtattggtatttcgtactcaataatttctccattgatatcaatattcatcattttctttctcaacttatcaatcttgtattacaagtatgcactcaaatatgtatacagtcatatcaatgaatcagaaacaactggcagactataccccacagcgttgcttcatctctatactggtgtctattgtctcgaatgttgtttaattggtgtttttttccttctgaaaaatgataaaggtggctaccccatgagagtacaaggttggatcatgacaggaatattgatcttgacaatttttgccaataccatcatttacaatcgttatatcccccatttttccaatttgccaattctttcagataaaacatttaaagatggagcaaaaccaatatcagaaagcagtaacaccaacactgacgatacatgtcagctgaaccacaaattgttatatctccatccagcattcaagtatgatagttcctaa

SEQ ID NO: 1915 - DNA, 1218 bp, Candida albicans
cgccacatgacatttgtcctgccagcggcgtgtgtgaaaacaactgcatttgagatgtcaattaaatctcatcaaactatgttaaataatttgtttatattcttggaaacttcattgaatgaatatggtactcctgccactactgaggaatacgtcaaggctggttttactgataatccacgtcaatttgttgttgagaatttctcaatcttattagctatgaatttgaaggtctttttgaaagatccaaatttcacatttaagaaaagatttcatgaagaattaatgatgagtgatcatgcaagaactttccccttgtatcaatttattttcaaatgtactgatttatggactgatatttttgagaaaaagaatgatttccccaaaattaactcggcaattttgagttgggatttaatgatctattacactatgaatcatggattggtcttgtggcaagaaaccagggctcaattggataacaaagttgatattgccaagatcttccaattattgtactccaacattgaggaaattgaaaagagcgggcaaagcatcgatgaagcattggcatcggaaggtggtgccattggtgatgtaagacattttcaaattaataaaattgaacaatccttgaaagaaaaatgggctggtaaactatttgaattttataaggaattggatagagaagtccacgaatttgttagagaacaacgtattttgaaattaatggaaggaaatatgattacccttaatagcaacactggtagtaaccaaatattacttcgcttgacaccaaaccgtcaatatcttgaatctgaagataattcaattaaggtgccagtggttgaaattgtcgatataaaaatcgttaatgttggtggtgctactggtgttgacaagaaaagtttagtttccatcaagacaaacctttacagaataacccttgtgggtaaggaaaacaagcatttattatcatttttctccgactcccaatcagcgtttgatgggttgaccatgatgcttgggaaaggttcagtttcagaagaaactacaaaacaaattgatacattaattgaaattagatcaaaaactcagttattagatttgaatgagattgatgatagcgatgatgaagaagacgaagcagacgaagatgccgatgaggttcttgaagatttgttagaagtgataaatgaagatttctactataaatag

SEQ ID NO: 1916 - DNA, 351 bp, Candida albicans
ttgatactacaaaaagtccagaatatgaccgttgccacacagaagttttactatcaacccagcatcgaggccaacaaacagaaattacaacatgtacatgatgttgcatcattagcattgggagttggttcaggaatattgacattagaatctatgaatggatttatattttatttgataggaataacagtcactaatttattattttacataatatgtggcgaaggcaggccatcaaaatatttcaagaatcctttgcaagaggtgtttataagtggggtttttagtaatatacctggcttcattatgatgtggtgtttagtttatgctttggtaaagtcaagttcatga

SEQ ID NO: 1917 - DNA, 1125 bp, Candida albicans
tatttgcatctaattcatatgttgtttgggaagataaaatggttctgtatttttatgataacttttggtgcttgttgtgtttatgcattttttataaataataaactccctgaaagagcaaaaatattggccattctgcatgccattactttcactatttgtactcgtattgtatcaatggttaatttatgtcgtgaagaacaacgaccatattgtgaaccaaatttcactaatagttggtggtcagtactattgttacattttgctgcgtatttattaccggcatgtatcaaatcattttatatgttatcagattcttatcattcagcagcaccattatggataggtacgggtttgaagtttttgttatttatgaatgccgtttattggacatttgaatatgtttccaatagtgaatatttcaataaattgaatttgattatagggttatcattgataaaatcattgaaattagcaattgctagattggttttatttatttcattgattttagccaatttcagttggtcaagaggtcccttgtgtgttaaattagagttgtcagaggcatcaaatacaattgatattgaagaatccgatgatatgagtcctggcattaataataataataacaacaatagcaacaacaaaacagctactattcttgggtatggaaatgtttatggatcatcttactttttgttggtattaaactttaccgtggctataatgttgacaactaaaccccttggatcgttatcaataagtttattaattgttcagatattatcattattagaaatattagatgttttatcaataagacggaatttaattaccccaatcattttcggtttattaggatatcaacattttttcagtacgggacatcaagccactattccatcaattcaatgggaactaggatttatgacaacagaaacaattgttttcccattcactcatctaaatatttttttaaatacttttggaccatttttcattccggcattagctatacctttaataaccatttggaaaattgttccttcatccaaaccaataactttattatcacaaatcattactaatataaccactttaattacttatcactttgtttaa

SEQ ID NO: 1918 - DNA, 378 bp, Candida albicans
caatgtcatttgaatttattggatcagtgtgtggcgatgacaataatgggattggttttaagtttttcaatttatattgtattaaaaccaggagatttcaccttgaaaatttgtttggctattggggccgccttgggtatggtgattggattttgggctcctataatggatagatttagtgtggggtttatttggcatcaaacagtggattttttcctttataatttcaatagttggtctcttatggggattttatttgtttcttttcattgtttaatatttgcatctaattcatatgttgtttgggaagataaaatggttctgtatttttatgataacttttggtgcttgttgtgtttatgcattttttataaataa

SEQ ID NO: 1919 - DNA, 921 bp, Candida albicans
gaaaattgtacaaaatgggatttgttagtagggcattttttaagagtggatcatgttggacatcgatttggtccccaacactattctatgaaagataaattaaatcaaatgaatcaagtcatttccaaagtgattgaaaatattgatgataaaaccgtgttaatcgtaatgggtgatcatgggatggattcaacgggtaatcatggaggtgatgcccctgatgaattagaaagtacattatttatgtatgctaaaaataagaaatttttgaaaaaagatcaatcattttataatgttagcggattaggtgaaaattatcggtcagttaatcaaattgatttagtgcccacaatctcattgttattagggttacctataccttataataatcttggattccccattgatgaagcatttgggaatgtagatgaattatcagtggcatcacaaaagacaatcaatcaaataaaggcatttagagatgatacacctaatttatcaggatcattaattgaacaatatcaatcatacgcaaccaactattctatctttggtgggaaatccaagaagcattattggcaattaattgaacaagccaaacaatatcaatcattatctttagaacaatgtaaaacattatgggcaagatttgatttaagattcattggtattgggattggtattcttttccttgcattgacatttatgataacttatgcaagatcaatacctgctgtacgagtactgacaatgtcatttgaatttattggatcagtgtgtggcgatgacaataatgggattggttttaagtttttcaatttatattgtattaaaaccaggagatttcaccttgaaaatttgtttggctattggggccgccttgggtatggtgattggattttgggctcctataatggatag

SEQ ID NO: 1920 - DNA, 270 bp, Candida albicans
  unsure (17): Identity of nucleotide sequences at the above locations are unknown.
cacttgcgacattccancccggcggttgtcgaattggtgatgatactgggaagcgtgtttaatgaatatattcatcctgattttaacttcccttatgattcattaaatgtttgggatttagatactgttgataatggagttattgaacatttatttcctttaatcagtataagaaaattgtacaaaatgggatttgttagtagggcattttttaagagtggatcatgttggacatcgatttggtccccaacactattctatgaaagataa

SEQ ID NO: 1921 - DNA, 489 bp, Candida albicans
acaatgcaacaagacgatgattctttaaccaatcgatcgtcacctccaatggcatcaaaagattcacgattacaaccaccaactagaacaagaataagacaacaaaaattaaaatatacatttattggttatattattgtattaatatttcttgccattactcaatttattggtgttggatttttcaaagaaggttttttactttcacgtaccgtattaccaaatatttccaattgttcacaacaaattgattgtatgacacccagatttgaaaaagctatactattggttattgatgctctaagatttgattttgtgataccaataccggggtcaaatgaatattatcataataatttccccattttatatgatttagcatcatcttcacaaaataatgccatattattgaaatttattgctgatccacctacaactaccttacaacgcttgtcttcacacacgggcctggaaggacttatgtcccac

SEQ ID NO: 1922 - DNA, 792 bp, Candida albicans
ttgaatggatatactattgattgtatcgatatggaattatccatgattccaatccttggtggtattgatttatttaatttccatcaaattgttaaacacactaaagcaaatatttatgttcctgatttattaccaaatttattcaattcacaaatcattactgacaataaagatttaaaaatttggattacggctaaatatatgacggaattattattagctaaatttattttaaataaattgattcagaataataataataataataataataatcaacaacaacaacaacaacatttaattatggaaaaaattaccatgaataaaaataaacttgatttaatgattttaaataatcaaaaaaatttattaaatattatgtttaaatatggagttttcattcaattaccaaatttaggtgaattaaagaattctactatattggttcaaggttgtattaaagaatcagttgatgattgtgttagtgatattaatggtattgctactgattattatactgttgatgttgtcagtccaagtattgttaacaacgacaaaatgggattgattcaattaatgcaacaaaagaaaacttgtaatgtggttatgaatgaacatggattacaattcaatggacgttctgatgaaattaaattgatattgaaaaatttagcaactaatggtaatgatgttggtaatggtaatacttgtctggcaattaaattaagattagagttaggaaatgatcaacgtgattttattagtggtaaaaagaatggtaaattgattaaa

SEQ ID NO: 1923 - DNA, 1008 bp, Candida albicans
actcggacttgctcttcccgacaaggtgtgatccatgtgacaaacaaagtttttttccatgatgattttgaggtcccaattgaagaattgatcaagaccacatatgattcaaatttccctagcttttttatgtgggatattttaaaaatgtatcccaatataaataaggtgattaccgggaagcagccttattctttattgattccaacagcagagtctttgaaagactttaatatcaccacctcaatgaaggatctattgcgattcattgactttcatttgataccaaacagtgaagtcacaaaaattctcgattgcatatcaggagagggatataataattctgttatcaaaacgaacttatcagaaggtggcttaacatgtaaacacaaacctcaaacaaacaaggtaatgttacagttgcacaaactaaacacaatatcaactgtttcttacaacaaggatcaagaggtgagattacttagtcatgggtgcaccaagaaatatcaaagtggaacagaccaattatcgtgtgtattcttgattcaaaagccattgaactttgaatggtttgagaaccccaaaaacggagacaactttttacatgtgcacttgggattggtcagtgttggtgtgggtgtcattttaggattaataatatttggtggtgtcatggttggtttgatgttttgtattggaaaaagagaaaagaataacaataaagacgatttcgagtttcctagaccagactccgggttcatgagtgttttgacagatgatgacgagtacgttccttacgatagaggctatgagacagacgttgacgttttgcgaacagaaactgatgcattgcttcccagtcacatgaaaagaaaaaagcgtgttaaaaagccagattatgggtctacaaaacagggaagtaatggtgttacgttaccgagagacataggcgatatcagaagcacattgaaccgtgaaagaaatctcccaggttattcacagtattga

SEQ ID NO: 1924 - DNA, 681 bp, Candida albicans
  unsure (577),(584): Identity of nucleotide sequences at the above locations are unknown.
agacaggatactatgcattccttgcttgataccaaactttgttcaaagaagaaaataggtgggtgcttcaagttaaagttctcaatttcaaacgggaagaacaatataacagttaatgatgaggtacacattcaagcgtataccccgattgcaaatgagagtgttgtatttgtggccaatggagaaatcaccccaccagttaatcttaaacattctttgggtgacttgatttcaagtggagctgtacatagacatttggagaatattgaaattgaccaaggcagttgtttgaaaactttggagtacatcaaccgttttggattgtcttctttgcgtgataatgatgaagggtattctatatttttgccatgcggcaccactgacacaaagggtacatggaaagatttggggttgatcttaacatatttagagagaaatcctcatatgctcgaaatggtagtcaaaagcatgtttatggaaggagtggtgtattcagattttacttcacataagacactaaaagacttgaacggaaaccaggttaaattcaaaagtcgcaatatcacaaatgatgcanacgaggntacgtggaacaacactcaactttctttcccgttgaactcggacttgctcttcccgacaaggtgtgatccatgtgacaaacaaagtttttttccatga

SEQ ID NO: 1925 - DNA, 1185 bp, Candida albicans
acagcaaaaaaaaataataataatataaatcaccagctctcaagtaatcgtgaacattcatgcacaatcatgaaaccattttggatatatatttttctatttatactaagtagtgttggtgccaatgaatctactacatccacatcatcatcggtggaacctgcaccaacaccttcgactttagttgacatactatcagaacgtccacagttttcgtattttcttcgacttctacagcgacaaggaatgataccgacactaaaccaaatggaaaatgttactttattagccccaataaatctggcatttgttggaaaaaaaagtatcgattgggataacaatagtttaaataggtatattgtcaatcaaaaacttcgtgttggattattgggcaagtcagaatcagtttatcaaacattatatagggtgggcaataccaactatctgatagcagtaagtccagattttgagagtttggagtatgtgattgatgaggtgtcttatattgtggaagaagatatctatgcaaaacaccagcattcttatattcaaggcatcgaccaattgttaccagaaaaaccaactatttgtgatgttctaatgaataacaccaaccctgaaatatcgttattcagtaagatttttcaactgctatttatagatactgacgagcaacaagtacagagtaaaaagaagaagaagaagaagaaacacaagaaacctaaaaagaccaaattaccacctttacccaactcatgcaaagagtttcttaatggaacaggaaccatattggtgccatccaacaaggttttgaaaaattcgttgacagatatacaattacagtattatttagcaaatagtgattttgcaaggtatgcaactaccacagacgcggtatttgaaattaaacacgatgttatgagtttacttcaaagtcttatgtttcctgcattgattgtaggttccaataacaccaattctaaaataaaatcaaatttggggagtagccataaattcaagctcaaagacggtcatgtggaagttgataaagtggcagtaactgaaagtcatgtctctgctgatggtgtcattcatattttcaaggagacagatctgctttttgaacagctcaacatcgcaacagcgtattcagcacgggcccgaaggaccgcgtaccgcgtcgcg

SEQ ID NO: 1926 - DNA, 738 bp, Candida albicans
ttactggttcaatcatttagtgttgcatttgttagtttatataatatccccaatttattaatggggtacgttggattttctacattatgtggattagcaggatttgttttcaattggtcatcctattttgataaacctgaatgtcgatcaattagaattgggtttttccttggattatcattttctggggcaacagccatgatttgtaaatcttactatgaaggaattatggccactttatcattttctgctccgcttgtttataaaagttttatatggtatttaattggagtagggttttatggtggattaataccagaaagatggagatatgatgttataattgaagaaaatcatcttaataatcgtcatacttataaaccaactgatgtcatattggaaaaaatgggtcatgatggtgaagatgaaatggaagaaatcgaagaagaatttgaagaaattgttgatcaacatatatcagaatgtaacgacactactacaagtaataccccaaatcatgatattttcgatcatgatcaaaaatttgctgaattgattgccaaacattttaaacaaaatcctattaaaaccccttatagtaataatttcttatcactttggtgggttgattattttttagcaagtcataatatttggcatatttgtgttgttttaggtattttaggtcattatgtttgtcttttagatatgtttagaggtttggaaaaattggtataa

SEQ ID NO: 1927 - DNA, 753 bp, Candida albicans
cactacgttcatctactattatacaactattgtgttcggataacattcttgacctcattgtctttagttgatatttacaatggcgacttgatattcttagctaaacgacttggtcgaatcccagctaattgtttaccaacaatattgtttttgactttacgtccaagtcccttacctcatactttatatttgactttgatcccaatacataaatggttgtccagactaataattattcagagtgttatacacacggttttataccttggatattttcaaaaaacgaacacgacccaaaagactttcaaacccgaaaacaactacggttgggtagctttgttaggatttgtaattattatgataacttcgttatcctcaatgagaaaacgctggtataaggtattttattgcatgcattacctttggacatggacaatagttgtgtgtcttcaatttcatatcagaccaagtcccttcacattctatacacttgctaatgtttcaattttggtcggacaaattgcataccgtgtatgtttgaccagagtgtcaaacaaaggtgaagtcaaggtgtgtgatgtttcaccaaatatagcaatgattgagtttccaaacctgttgattgcaaaaaccgctactgcacctggagcacatattagactaactaactacagttcaagtttcatagtcagagcattcaaacagttgattccaaattatcttccctacccccttattgtcctttcccactga

SEQ ID NO: 1928 - DNA, 231 bp, Candida albicans
aacaattggtgtatcaatgaaggatttacacagtgctcaggtcccacagaagacgaaaaccacaatttgatttgctgccgtgacttaccacgcaataaagttgtccaagaggatttaaatgcagaaaagatctgggttatttctgcaggaccaaaaccgcttgttgaaaatgttaaattatgggccactgaatatgggttgaagtttcacgaagaagcattctattcataa

SEQ ID NO: 1929 - DNA, 540 bp, Candida albicans
ccatccacacaatcactatacacaccagcaatgaaattgattgataaagtatatttatggtatttcattattcatattcccataacaattctcattgattcatcaattgttattcctaaacattatcaattatcaatcacgaaatcaattttagaatttcatatatcaaccaataatgatattttattagcatatccacaaacctggtttaaaatatttggatttattgaattaatatttcaattacctttatttttctatttcatttataaattactttcttctaataggagggtgttggatgttaattattatttatggagtataatatatggttttaatgctggttttactacttttgtttgcttaatttggttaattattgaatataaaaatttccaattactggatttacaattgataaatttattggcaatttatattccttatttattattacctttgatattattgattcattcatttaaacaaatacaacagtacaataataacaaccacaacaaattgaaacaacaataa

SEQ ID NO: 1930 - DNA, 840 bp, Candida albicans
cttcaattatttgaatttaattttcacattatggctgaagaaaagaaagctggtggtggtgattctgctgctgctgcaccagcaattacatttgatcaagataaattacttaaaaccgtccagacattacaatttggttggtttgttggtaatgtattaacattattaggattttttttatttacattatcatattttggaattttacctgatgttggatttgtatggtatttaatttcattattaggagcattgatttcatttggaattttacttgttcaatttattcaaaaaaatggatttaaagtaccacttttaattaaagatgataatttccattattttttattagcgttttttttaattgctatgagagcttatgtatggattacattagtaccatttgttatattttcaagtttccatgttttaaattatgttaatactcatttattaccaattgttggattagatggtaataatccaatttcaaaacatattactgcctttgttaataaaaataatcttgcttcaattcaaattgctagtggaattgaattactcacggttgtttggttattccttagaatgatcacatttagaaaaagatctttaactccatttttagtatttcttgttttcttaaagaaaagacatgaagtttctccattcacaagaaaatattttgatttctttgctgctcaaggtgattctattgtttctactataaataaccctgtgattaatgatgtttggggccatgttaaaacagcattcagaaccattgatctgtttaaattggttcatgatcgaaccaaagatgaagataaggccaaatga

SEQ ID NO: 1931 - DNA, 528 bp, Candida albicans
ataattgtctttaacgcgaggcaatttacgatggcaatttttattagcagaaaaagtaacggaaaggccaaaaaaaaagaatacaatttactatcaattaaaagcaatcaaatcctctttgctttcagacagtgtcacttgttccatcacccttgctttccctattactcattatatacatcaatgccaccaacacaacctacacctacaaactctgctaatctcagataccgaactcctttacaacaacttgtgacattggctaaaacacaacagttttattggttccttggccatgttttcgcagtgttatttttcattcttagtacccttacagggttttggaatcgtcattcttctttgaaatactaccggttttcattattatcaattatattgacgtatttgattgttattcgacaaatccatttcaaatctacttttaaactttcaagcatcaattatctaaatgtttgcggtgatgaaaaatgttaccatattttattggttggccggtggttattctaa

SEQ ID NO: 1932 - DNA, 600 bp, Candida albicans
caacgcctgccaaagcttccttcatactatttacccaatttaacaatattaacaatggcatctgcatcagctaagaagttggcagtagccaataccaacatattaaatcaattattaatcatttccgcatcaattaacattattgtgtttttaattatctccattttccatcgtccatcttcctataaaccgtggataattttctccatcccaagtatatttttacaatattctttggaaaaatttggtcgtcccaaatataccaatggtaactctttagtttcaagtggtgaagacattagattactggggagtttatatgaatattattttgatgttatctatttgacttgggggttcgatattttgatgattatttttggaagtaataaagtatggtatgggtacttgataattcctggatttgctatttacaaattgagtaattttattttaccattcattaaaaagaataaatcaaatggctctacaccagaggaacaacaagcagaaactaaacaaaccaattctgctactagtaaacgtcaacaaaaattgcaagctagaagagaaaagggaccagctgttaaatatagatga

SEQ ID NO: 1933 - DNA, 837 bp, Candida albicans
gataaaatccccgtgaatcaaccaattgatcttacattattaaataatagaattatacaaactgaacaagggaaagctattgttcctcgtgttttcaattatatttccagtgggaaatatttcaacattgtatctgatgataatgggaatatttggacttggggtgataattcttgtggacaatgtggagacattaatactactgatttgaaaccagtacctaaaattgtattcactaaatctgatattaaacgagtattaagaaatactattcctcgtgctagagaagaatttattcgaattaaaaaattatgtactggtgatgattcttcatatgctcttattaattatttggataaagatgtattaatatcttttggtaatggtattaatggtcaattaggtggcggtagatatatgcaagtatgttgttggccagaaattgttaaatcattaattggattgaatgaatttgatgaatcttcaaattcagtgaaaccaataactattaaagatataagtgttggtaataaacatcttttcatcactttaaataatgtgggacatcataaagatgtttatgcattgggagaaaatgaatcaggtcaacaaggaaatgggaaaagaaataaatcatgtaaaccaatgaaaataccaaaattgattgaaccagaagatggtaaagataaattacaattggtgaaaaatttacatgatgtgaatactaaaagattactgttattaaatgaatgggaaatttctaaaaatactgttgatcaagttataatggcaggagatgatgcttcaattatttattataagaaaacccaaaaataa

SEQ ID NO: 1934 - DNA, 360 bp, Candida albicans
agagaacaaaaactgactggttctggttctggttccggttccggttctcgatcttctgcattacaaattggacaaatacaatcgatattaatcgatgattcttatagatttcaatcatctgatgatttgaaaaaaactaataagaatttatctcgtggtaaagttgttggtatttcattaacttgtgctttgggttcaacaactttattaggattattatatatcataccttattttgcattattcaaaaataggaaagatggatatttccaaccagaaagaattcatgaagatgaaatgatggatgcagttaacccagaagatttactacatgaaattgatttacaaagagagaaataa

SEQ ID NO: 1935 - DNA, 1251 bp, Candida albicans
tcgtcaataaaagacttgtctaacaacaatcaatcagtatcatcagcaaataattttgcgttgtattccgatgatcaatggtatagttttggaaatgattatactagcaatgattttaatcaatttactaatcttactttagatctggctgaatattatgtgttttcaggtaatggacaatttagaacttgggataatgataatttcaaatgggttactgatcctactaaacaattaaatcttactcaagcggctcaaatcaatgatcatcaacaaatcctcggtggtactggatttagcaccatgcaattccagagtgttgatcaagcttatattgcagatgggaatttcagtaaatttggaattgatgtcattgccaataaatcatttatgattagtaattcatactatgtgaatagttcactaagtgttattggaggaaaatttgaaactaaagatgttaaaaatgttggactcataagtaattctgatccaaataatactatcagtgccttacaaggctcaatcgtatggggtgataatacattgattcaatctttatacgttgatagtagtgatgaatatctttttatgggggttaatggatcagtacaaatcaatgagcaaactaatgttacgggtattgttatatatgatttagtcaacaatacttttacatcattccaaccagcagaactttctcatagtaatggtgatcctatatcagttaattctatggttttgtttgataagggcaataaattattagttggtggagattttgatcttgctggttctttatcttgtccttcattatgtgtttatgatatcactaacacaagatggatcaacccacaaaatgatgctactactacacaaagcataggtggtgttgttactgatatgaaatttttccaaagtaatcaagttttaattactggtaatggattacaattgaatggtaatagtggaatcaaatttttaatttataattttaattccaattcatttagtgttaaggattcattgaataaaattgatcaaacagtggaaaaattcattttaaatgatgaaaataataaaaatttggatggaagaatgattgcttttggtgaaaaatccattagtggatttgatggatcaaattggcaacgtattgatagtgatataatttatgaaaatttcactaaatttaatgatatgaaattattaactttagataaaccatcagattataatcaaacttatttt

SEQ ID NO: 1936 - DNA, 1428 bp, Candida albicans
gaggtaatttcaaattcaacaatacttatagtgcggcagtttataatatcactgccaaaaaagtccactcaacacctttcccaagggtttggaccaaactcttcaatcaactcgattgccaaagtcttaaatggagacaaagaaaaagaagacaatgaagaagagttagggtctattctttttggaggccaatttgacacgcttggattatcggatttattggtacataatattacttccaataatactaaaaagcacaacactagtaatacatccataattagtgctgaacaattgatttcccttagacatggtactttcacttcagtcaatggagaatcatctgaagaagatgcagcagcaattgtttgtccttcggacaataaagaatgggcagcacaaaagaattctggtgctgaatggaaagttgaattaccagatgaaatgaaaggtatccatccaaccaaggctaggatttatatccctgaaggaccaaatggtatcaaattatttagaatttattcttatcctaacaatggtattatgaatttaacttatattgaccctgctactaatgaattggcctattgtgacgcatggtgtccattgctcaattatgacgatttgaatgatcatgtcgataataatatccttaatgctactgaattaaatgagaataattcagtgtttgttgatgaacaagatgggtcttatttccaatattatgatccatcaactaaaaccaaaaatttaggttacgcatctaatttccaagaatttgcctttgttgataatgttggagtcgataccgttggtgtgactattattgattggtacggcgatcaaggaatattagctgggtttgaattatatcaaaatgccatcactgtttatgggaatgattcattaaacgaccctaattgtcaatctgatgcctcagatgatactaataataatgctgtgatcaattctggtagtttcaaatcagttcaatctataaatccagccataaccaatactgattatttagtcacttcagataccaatgctaaaatcacattatatccaaacatttcttacctgggtaattattccattatcatgatgactcctggttgtgcttacgatggatcttgtgcaagaagagcaattgttaatgtgacagttgttggagatgacaatgatgtattatcgacaaaaacaatatatcagaataatgagaataataaatttgattatttgttttatggtcatttgaatggatctaagacaagtacttccagcaatagaattgaaatttcttacatggggacagtaactgaaggggttcaagatccttatatggttgttgacaaggtaatagccaacattgtttcattagataattattacgataagatatcaacgccgcctggaaggtcaactatt

SEQ ID NO: 1937 - DNA, 306 bp, Candida albicans
atggtatttttactctgttcaataatcaatcagttattagtcccattatttttactatttcctcccagagaagtgacaaaaatattcaatgatgatataaatggttctgttaaaactatatttcttgacaacgacttgatctatttaggaggtaatttcaaattcaacaatacttatagtgcggcagtttataatatcactgccaaaaaagtccactcaacacctttcccaagggtttggaccaaactcttcaatcaactcgattgccaaagtcttaaatggagacaaagaaaaagaagacaatga

SEQ ID NO: 1938 - DNA, 1158 bp, Candida albicans
gtcgagattagatgcatgggggatgaagtgtccctaaagttttatgggtttgttataaggtatttatttgcagttagggagaattattttggtgacaatatacactttaagacatttgaagaatatacaagtcaagaggagacacaagaaaacgaaagtatcgatggtacttcctcacaggagcctaattattggaaactaatcaaaactgagaatgatatggatgtgtttttcacatttcaagttagaagtggcttagttatgttaccttatcatacctatagttgtcagtctcatattgggctaaactttgacatgctagatatagacatacgattttgcaactactacatggacatgcaagttgatttcagtccaatttcagccgtttttgttgaagattactacagtgttcatgatccattattgagtgtaaatgaatacgtggaacgttattttaacagaaaggctgacatgcatgttgatggttttagcgttcatacacacagaatgtttggggttccacctgaggaactaaccttctattgtaaatgggatttttgtgctggtgattggctagttgatagcagtccaatgtttatgagaggagttgctggcggcatttctaattttggagttggcttcctggatctggaaaatgcgttggatgtggctttcccgcctgcttttgatgcagccaacttcactttcaagtgtcccaattttacatttcgattgaggccagattcgtcatcgtgtttagaaatacagttagtggactttttattgtcgtacaatgacatgagcaacaatagatactccagtaaacttgttgtttctatacctaaaattagtctaaaggtacttgaaaacgatatgattgcagctttcttaaatacatcattgattttcacaaacatttgtcagaaaaaagatatgttgggccatagagacactcagcaacttcacgtgagaaacagtgatgctccatttcatagatcaccatttattcttttggaagagtatagggatgatttttatgaaacctccaaaggttgtttgtttaccccactctcattaccaaatgcttcaatcccgttgacagaaatgacctttaacacatccgaagatcttcaccacgagtgccagtgccgctag

SEQ ID NO: 1939 - DNA, 1173 bp, Candida albicans
tacaaagtgcttgggcaagagaagcctcaaaacacgagatatgaacccaatttcaattggcgaggattaaaaagatatattggtgataatcaagatgactcggaagtgtttgcatttttgaactcagatgtacagtatgccaaatatagtcttatattggattcagtagcgacaaggttgatctatttctacgataatcccggtattcagccactgcaaaccaatttgagaacacaaatgccgcctgaatccggaattgaggtggaaatatccaatggaacaattcactacgggccctggacagatagagaaagagttcctatacagaatatgctattcccaccagtagcaagagactcaagtccaacacgtggttttttgaaacccggatcacaaagagagtatggcggatttaaggtgacagtgatcgtcaaagatgaagtaattattaggataccaacaagagagccaagtaaagacaaggaactcataaaacagaatgctgcaaataacggtccaactaagaattcacgaccatttggatggctagaaatcaaactaagcgaaggatcaaatgtaagtactttcacctcatacgttgccaaagaagatggatggccaaatatcatgaaagtcaacttcaatctgccagagattcgatcgtctgtaaatcacgatgtattgtttattgccgattctcatgaaatagatgccaaaattgggttcccattgcaatggaatggtaaatgtacttgggagtttgatcaagtcagtttaaatcctaaaattttttttctaagagaacacacaatgttattttcagacttgtttactgattttggactgggtgatccacagccgtatgagtacttccgtctatttgtttacaatataaagtggaaattactcaattataaattctacttgaatgttattgatttgaacatagtgaacaacccattagactttgagagaaacaagtacttgtctttacagggagaagagcttgattgtgatatcaatttgccacttaatgggcttttgacgaaatcgaccactgtgctgttcaatattacaacccctcattttgatcttgtacttgatactccaccatggcatacggtaaatgcattttggaaggagtcttcaccacgcggtggaaggaccgcactt

SEQ ID NO: 1940 - DNA, 3516 bp, Candida albicans
aggcatatgtttctcctggttaaatccattgaaattatcatcagcacgttacaagcaatggaggattactcattggatactattatggatcagcttaatgtgagcacaatcaagttcctaggaagtctcatacactccactgaaacagtaaagaattgcagaattgttaatcacgatatatcaataaagcttggagaatttcttcttgttgatcctaaagagctcacacaacaagccaaaaaacattcgaccattaacttacagatttctgatttgtcgttggcgttatcagaaaaagccagtaaaacagtcgatgaaggaaatattacaagcaatgaagagctttcgcttgctttgcatataaaagacattcttatatcagttgcacaaccagttgtttttaatgctgccgtgatatttacgatacaagaaattgaatattggatggaattaacgcaagatgattttacagcatccggaaatgttgaggcaattggtttcaacattgacgacacgcaaactacttggttggctgatggtattacacacattattgagaacattgaggaattgaaagcaacatttgaaaagcacagtcatgaaataaatgcaaacgcatgcttggtacacgctttaacattagcgtcgattgagtattatattgactacgaatcagacgttttgacaaaacccgcatacattttgcgagctaaaaaggaacacattagattttttgatagttggaaagtcattgctcgtcttcgacatattttacagagtcttcctgctgactggcatcacgaagtgaacaatattttgcgagataaaaactacattttaccagagaattctttggaagaagttacagaaattttttcaaaatggagagcctgggaggcaaaccaggaggaacgacggaaattgcttaatcgtattttttcaggggataccgcaaatatggataaaaggcaaatgcatttgcaattcatttttggaaatatatcattaaaattggtatcatcaacacaaaccgattatattgttttgcagcaattatctacaacagtcgatttaaacactgagaatgaaaggaaacctgttgatgttgtagttggtcttgatgcctatcaaagcaatattaccgtgttaacatttgataaactcaagttattacaactgattaaagagaatgaaaagagcaatattgtggtagaagagggcgagtcaaagaatttttggcaacatattgacttgagtatttctatttatattgaagcatttagccaacgagtcctgctttcaactttagttttagagctacaaggtaataacttagcatcgatagctaccataaaggaagaaatgaaacacatttcgaattcttttactttgaaaaatgcagtatgtaatttatggggctcatccaatcctgtttattcacaagcgatggagaacataagttgggttattgccagaaccaatactcttggtaaagaattgtacaaggttgattttgaactagacaaagtagatatacacatggcaaacaaaaacgataagattcttacaattttgcaatcaatattggcctcagacattccatatgtgaaagaattgttatcggaatctgaatcgaagtcgtcatcaagtttgaatatagtggaattattgggatgcatctccttgaaattgaatattcaggagtttaattggagaatcgagattttgagtccccttgtattggaaggaaatcctattggttgtactataggcgcttccaccattggtgatgattttgtttttgacgcagattttttaaaaggaaagtttagcataaacattgacgaacaaaatatcatagaaatagagagttcaaagtttgtaaatgtgatagagattggcatttgggagaatttgatgttgttttctgtacagtcctctatgggatacgtgaaattattgtcaccaaatttaatttctacaattgtactattggacactaatttacctaaattggaaaagaagattgatagcttcagggatcttttggttagtcgtgaactgacgaaacacagtgaaaccactgtgcaagagaaggaatttgcttttaaagtacagttttcaaatgattatatgggtgtatcgacttttgttaacaagacaaaacttttatttgaagttgaatcctttacactaggtgcttataacgttgaccaagttgaaaatgaaaattccccgcatttgcaacagctagttccaatttacggtgtcatatctgttcttgcgattcgtatttcaattcttgagagaagtatacctattggattgtccaatttgtttgacgtcaattttggtataagacttttaggtgttgatagtgccggagaccttcaaaccttacaatttgaatcacagtactgcagaatatgtttatcagagccgatcattttcaaattgataaaaattagcgatgaaattttgaaagttttgccaaaacaaaaagcagaaaaagtacaagaagaaccaaaagaccctatcacagaaataggaagtagcgatctagaaaagcttattttttcgagaatctcaacagttcagtttctttcgtacaacttctgtgttgggtggctattcaatgattcttcgaaagactatccgcgaataataatgggagcagaaagattttttgccgcaactgaatttaaactagggaaattcacattaatggaagcatatttttctgttgccaatggtaatcgttcttcaaacttttacagtaccctgtcgcagaaatcgaacttgaatagagcgtttttgcccaatttgcaacttagttactttattgacaataaccgccagggaaagaacttgagcttatcaatgcacggtgatgaacttgatgttaagtttctttccacatcagttgcaattattgaaaaggcggtcaatctggcctcaaatgtgcaatcatatttggacaaaagattgaaaccattttatcaagatattgaaaaagatgttgcaactccgcataaagagtcattatttgctaatacttttgattcaatagaattcataacgacttttgcaggttcaaatgtgttaatccatcgattagacaacgatgattccgaatctccagcatcactctacttgcatgcgccagctatcaaaactgctataaagtatttgaataaaaaaaatcaagggaaaagtaaattgatgggtgaaattttgactacttcatcggataacacattatattcgaaatgtatgccggtagtgatggatataataaatggcacaaaggggttattaggaaaatccaagaaggttaatagcaacgacttacttgtcgaagagcaaccccaaagctctgattttattagaacaattttagatgaaactgatatacattttggtgtgagtattgaaaaccaatcattatcgcttagttgtgaacccacagcaaaggtagccgctatagttggtcttgaaagaattttatgcaattga

SEQ ID NO: 1941 - DNA, 1755 bp, Candida albicans
gactctagagatattagtgcatctgccggtataaagaatattttgttaacgaatacatttgaattcagtgaagtgacaaggttgttttcatctggatccattagtgatgccgatgcttatatcaatgtgaagcaataccaagatgtcgaattgttcaaagatatttggtttcccaaggaatactttgaaaactattatactcacccttatccagaggaggagcaagaggagtcacctgttgatgatacatttgagggattggctttggcccaaaataggaatctttcttcaagatttaaagaagtttcgacaacatatgcttttccttggattgtggcatttgttatttcaaatgttaacgccagggtagattttggacaatcacttgggaattttaatttacacattgagaacttttgggcagtttccaaaaagtcggttgattggtcacaggatttaaagacaggcgtcaacgaggtatcgttgacctcagttggtagattaggagggagtctttttatcagaaatattaatttacacactggtattagttggaaacttgatctgggaattacgttggatgtacctttaattttagtatctggtggtgttgaggaactacatttgaaaatgtcatttgatcatcatgtaattgcaattgccaattttgaacaattttccatggatatatataataaaaagagtgaaatatcgattgcaaaagatcatttgtttatgacaaccacgttcaaaacagcagagatatatgtaacttctttgactgcttcaaactttatggatatccagaacactatatcaagaatggtacaggaaaaccaacgatcatataaggagacccttagggactcatcaaaggggaaatcacttgaagagaagaaaagaagaaggtattcggaaaatgctattttagagacagtgaaaaaactagagacgagaatccacgtctcggcagggaaagtattgatccatatctacccatcgtcgatggataatagcaaagtgttggtgataaaacttgatgagtctcgagctaaattccaacaaaatgagtattccagtggtatttccaacgagttggatttaaagttcaacgatttgaaagtttcactatcgtcagtttctccagtgctggaagaatttgttaatgaggcttcggtttcagagctcactcaaaacgcccacaaggctagtggaggtacaatatttgttttcccttccttcagaatttcaatgcgtacatttcaaaaatacaattctaatttaattgagtatatgtttcaatcaacttttaatggaactgttgatataagatggaatttaggatcaattaactttattagagaaatgtactctatacattccaaatcgttagagtcaagaatggagtatagaaggaaaatgcaaccatttgatgaaggtgctggtgcaatttctaaagcaatattggaacaccaagtaaaagaagaagataccactcaaaaaattgatgacgcaataaaggaaacaatcgaaaaggttgaaaggtcctcaagattcaagtattctgcattggcaccgccgataatcgaagaacctcggttgaaagagcttggaaatgccactccaccattggaatggtttggattgcacagagaaaagctaccacacgtaacacaccagttggctattgttagtttacaaaagctaatacatgagattgagctggagtactccaaaatgttaggcaaagcataa

SEQ ID NO: 1942 - DNA, 774 bp, Candida albicans
tcaaattttgttatggcattcgagtcgctgcatatatcggtgacttccgagcctacgatcaaattatcgttctggatatactgggctgattggatattagcattaatattatcacttggatttgtattttatttccacagactactcggttttattgtatcctttgtgtttaaaatatttctatggagacattataaaataagtgtcaatatacaatcatttaaagtgtcaccacttggtggtcgactatttatgaaaaacctaacgatcctgacttcagatatgacaatatcgatagtaaatctaacttttacatggaggtattggattttcagattaaacagactttcaaatttttattttgaaatagataatgaagcccccgagatatcacagaaaagaaatgacaaactgccgtcaagattcctcttggttatcgatggtctagaagtattcatttacaacagaactgttgcatacgataacataatggacatattggaaaagaacaacgatgtttccagtagtgaggaaaaaacggaccaagagtctagtttgtattcagacgatatcaaaaatggcaatttgagatttagaaacaggataagagcaagcaatccatcgtctacttcagacgaagacctgaattctgaacaaacctccaaaggttatctgtcgttattctttttattgcaagtgcttcctattgctgtcaaaataaaaagaagagctattgtaattggcaatgtaagcacaccttctattcctatgggc

SEQ ID NO: 1943 - DNA, 1125 bp, Candida albicans
acatataaaaatgtgaatctatcagaaaacaataatagcattcatttctcttttggcacaccatcgcttgcaacacatctagctatgtcacttttaaaggattctacagttgcagtcattaccgggacatcttcaaatttaggattcaatatagctgttcgtttgttggaggggcttcctgacaacaaagaaattactcttgttgttacttccagaacattaccaaaagtaaaggaagtgatttctgatattaaaaaatatattgtggcaaaaatcccaactaaagtaaacaaggtggaatttgactatttattggtggatttcactgatatggtatcaattttatcagcatattatgaattgaataaacgatacaaacatattgattacttgtttattaatgcggcccaaggagtatacggaggcatagattggactggcgcagttctcgaagttttgcaaagcccaattgaggcagtcactaatccaacttataaattacaaaaagttggagtagaaagtggcgataaattgggattagtctttcaagcaaatgtgtttggaccatattattttatccacagaatcaaacacttgttggaaaatggtgggaaaatagtgtgggtcagctcattaatgtcaagtccaaaatatttgtctttcaatgatttacaattattgagatcaccagcaagctatgaaggctcaaaaagattggttgacttgatgcattttggaacttacaacaagctagaaagagaacatggaatcaaacagtatttagttcatcctgggatattcacaagtttctcgtttttccaatatttgaacgttttcacatactatggtatgttatttttattctaccttgcaagatttttagggtcaccatatcacaatatttctgggtatattgctgcgaacgctcctgttgctgctgctttaggtcaaactaaacaaaactgcaaaactgcctcggcttgtactagatctggtaaagagtatttattagaagaagagattgacagcactggtctggacgacgttgtcctgtatttggacacacttactaaagagtgggacgaaaagttgaaggatcaaatagtaaatacacgtcaaccttga

SEQ ID NO: 1944 - DNA, 435 bp, Candida albicans
ccgtaccgcaagttcggttccttccagcgccgcggtgaaaaactaattgttataagttcagctattgcattaacatccgctaatatctttgatttggtgaataatttcaacactggtggtagacaacaacagaaccaaggtgtaagaacacctcaagaatatgaaagtgtagttttgaattcccaatgtgataaatatctatgtccagatacgggattatgtgttgaggcaccaaagtattgtccttgcccttatccttcttcccagataagatgctttttaccagatggaagatttgtgtgtatctcaaaaccagctggagagggcatttctgaaaagtacaacgatccaaagaccaattggaaaatagatgccaaggatgacaatataagagactgtggctgggtaaatagagcctggaggggattagtatga

SEQ ID NO: 1945 - DNA, 555 bp, Candida albicans
atcatcaccctactgataatgaataatcatattactatcagttttaatcaaggtgaggaattatattcaacatataaatccttttatactttgaagaaattaccaaatcaattatttaaatttaataaatcattatcaatagatgaaattttaaatcaattatcattattagcattagatcatactttaccaacttattattgctataaacccatatttttagaattagttgcccgttgggttaataacactattgaattagaaagtcaatacaataaatcaaagtcagaaactagaagaatttctggttcagtaatattatttgcattatcacgattattacatatctcaaccgaatatttgaatttgtttgaattatttttatcacataatgccttttgggataatattggaattgaagtatttgaattagagagtattttacttgcattttatagactattgaaatttgataccaatagattcaaatcattcatcaaaccaaaagcattatatcaaatcactaacaatcttcacaacgggtggaaatcgcgt

SEQ ID NO: 1946 - DNA, 1350 bp, Candida albicans
  unsure (1299),(1331): Identity of nucleotide sequences at the above locations are unknown.
attaaagaatatgttctttataaagtatttgaggatcggaaagttttcggtgaaaaccttatttccagttgggaatctgctagaagagttttcagtggagacaaagaaatgtatttggagtctactttgaaacatttgattgatttagaagctcctaataaccccaaagtataccgtgattcaaaatctattgatggattatttgatgaatggaattccattatggaatcaacgatagatatgggaccggtagaatcattattgaagtctgtgttcacttcttcagaacaaggtgtaaacatgatggaaatgttccaaaataatacttcacagtttattatgagattaaagaagaattatttgctttattatgatttgaatgatattttatgtggttatatatatggtatgaaacttggatttgaaatgataaccattgacaagaaccaaggcaaatatttgtatccacaaacttggtcgattgatgtatgtgattttacaagtttgaaatccgttgagagagttttcccttctgttcaagattttgccaaaacagttagtattgactcactggcagctgaattttttatggcttatttcatcaaacttggatttgcacatagatgtagtgaaaatgagcaacaacagaaacaacaacaaacacaaagtatattgattcaatcattgcaaactttgtattacagatggtcacttcgtcgtatcaaagaagtaaaggaaagcttacaacaaggaagtttatacaaatataatgaccctgatgaagatattgaaggtgactttaagaaattattccctgattatgaagatgtattggatattgatggaacaacgaatgccaacactttgaagaaaaataatgcaagttttgaatcgatttatgaatcgattgcctcggattatatcaaggaatatttgttacaagagaaagatagtgttattgatattgttcatcaaggtagtgaattgataacacatttaaatcaatatgagaataatttgtacaagatttcaaataatgcttctatgatgacttcattggttaatgaattagccaatactcataccaaattcaatcaagcagtttctgatttcaatttctatcaagatctgaatccaactgaagttaaacgtgccgttacaatcatgacaacagtgtataatttgtctaaaaaattattagatcaatggccagaacatgccactttgaagaatattgtatttgccaccaatgaatttctttcttatccgattggtttaccattaggaagatatttacanaaattggaacaaatctatacgtttattgctgnatgtcttcgccacgggtag

SEQ ID NO: 1947 - DNA, 2103 bp, Candida albicans
caggaaaagggaaatgatgatgcatttgtcatgtgtttcgaatatttggaatttttagcaacagtgtttccgggtggtgtttatgttaaaaaggaattttccccagttttaagaattagtttaacagaatttgggttccatttttgggaggtttttaatgatgtttttcaaattgttgaatcaagattcaaatacaaacaactaaccacggcgtttgtgaaattttcagaatggtttgccaagcagtttggaggcggtcacacaaataatggagtcatctcattgcgtgatatcttagcatggacagaatttataaactcttgtcctgataatttaaacccaatggcggcattgtatcatggtgcatctatggttttcattgatgctttgggaactaataatacggcatacttggctgagaatgaatcaagattacacattattaagcaagaatgtgttaccaagctttcattatttgcagattatgatttgactgaatttttgaataatcaattccaagtaagtattggtctgcatgatcttactgctggtttattttctatacctatattggaaggttcagaacataacaagtctttcaatttggaagctccaaccactgctgcaaatgccatgagagtaattagagcaatgcaagttaaaaaaccaatattgttggaaggtagccctggtgttggtaaaacaagtttaattacagcattagctagtgccactgggaatcctttagttcgtatcaatttatcggagcaaactgatttagttgatcttttcggttctgatgcacccgctgaaggtgggaaagctggagaatttgtttggcgtgatgcaccatttttgagggccatgcaaagaggagaatgggttttgttagatgaaatgaatttggcatcacaatccgttttagaagggttaaatgcttgtttggatcatcgtggtgaagcatatattcctgagttagacaaatctttcaaacgtcatcctaagtttactgtatttgctgcacaaaatccacagtatcaaggtggtggtagaaaaggtttgccaaaatcatttgtcaatcgtttcactgttgtctatgttgatacgcttaacgccgaggatctcaatatgatttctcgtcatcttttcccttctgttaatgaaaatgattgttctaaattgatagaatttatgtcacaattggaagaacaagttgttatcaaaaaatcatggggagctcaaggtggtccttgggaattcaacttacgtgattccttgcgttggttaagtctttatacttctggcaatattagccaagatatccaattatctgattttattgatatgattatttgtcaaagattccgtaatggcgatgatcgtcgccatgcacaaaagttgttcctatccattttcggggaaatcatagagcgtgataattattacaattgttctgaatctttcattcaagctggtggagcattaattgcaagaaatgatttaatccagtatgtcaatggaggcaaattgttgccattgcaatgtaattttacatttatggagacagctttcagatgtattagcaataatatcccattgattcttactggcccaacaaactcaggtaaaactgatttagtcagatacttggccaattctgtaggtgccaaacttgatgagttttccatgaatagtgatgttgattcaatggatatattgggaggatatgaacaagttgatctttctcgagaaaccaatgcattgtttgaaaaaacacacatacttatcaatgaattgattgtgacaaatcttagatatcagggaagtaatgctgaaatattagctaaagcattaaaattacttgaatttattgaaaaccataattctgttgataacgattcttctttttttggacatttttgtacaattctttcagatttttccaattatcattctatcccagaaattaaagatttggttaatgcagccgaaattttgttccaaaaattgaatgaaactgctagcgtcaaatttgaatggtttgatggtttattagttcaagctgttgaaaaggtcttcaccggcggtcgaggatcaacgtag

SEQ ID NO: 1948 - DNA, 4014 bp, Candida albicans
  unsure (4005): Identity of nucleotide sequences at the above locations are unknown.
gggggcggtgcggatcttccaggcctgggtccaagatctattcaaatattgtctttatatttacaagcatcagaaatttctaaaaataaaatgattgatactcatctcccaaggaataagaatttggaatccaactatgaaggcgaaacagtgaattattattttattgcattattagaagctaaacgaatttcaaattttttaagtttaccaaaagtggaatacaattctaacccggagaagaccaaaagcatacaaatacctccagaatcgttatcttccacggtaacttctgtttgtggtgtcttggtaccacatttaaacatttcaaaatcagaatctgctcctcttcagcaagaagaaaccaaatttgtccccacaaatagtgctgttgaagtattaaggaaattagcatctagtgtccagtttaataaaccagtaatgctttacgggaaagctggatctggtaaaacttttttgattaatcaattagccaattacatgtcatattccgattcaattgtcaagattcatcttggtgaacaaaccgatgccaaattattgcttggtacatatgcatccggagagaaaccaggtacgtttgagtggagaacgggtgtgttaacttctgctgttcaagaaggtaaatgggtattgattgaagatatagataaggcacctactgaagtgttatcagttttgttaacattgttagaaaaacgtgaattgagcatcccttcaagaggtgaagtaattaaagccaaaaatggattccaattattttctaccattagaacttcaaatgattcaaagaaagattctatccctgatttaattggtattcgattatgggaattaattaaagtcgaggtccccaacgaaattgatttgaaaaatatattggttactaagtttccgttattgatcaatttaattggctcatttatcaaatgttacaatgaaattattagaatctattcactttcatcgtttgttacactaaacaagggttcacatcctagagttatttctttcagagatttgatgaaattttgtagtagatgtaataacatgttgatggtggaagggataattaaacctgatcagttacttgaatcgtctatttttgataacatatttgccgaagcagttgattgttttggaagtgccatcacagaaccacaagcattaactccattaattaatgttattggcgagaccttagaaattccaacttctagaatcaacttattcttatcaaaacatgtacctatttttatcaatgatgacgaaaaactaaaaattggaagagcagtccttaagaaaacagcacaagacaaggctttatataataagcgtctgagcaataacaacaacacttcatttgccagaaccaatcactcacttcgtttgatggaacaaattgctgttgccattgaaatggtggagccagtattgttagttggtgagactggtactggtaagacaactgttgtgcaacaagtggccaagttaatgaacaaaaaattgactgttatcaatgtttctcaacaaacggaaaccggtgatttgcttggtggatataaacctgtcaatacaaaaaccgttgccgtcccaattcaagaaatgtttgaaaatcttttcattggtacattttccgaaaagaagaatgccaaattttctaaaatattgagtaaatgtttcaataaatctcaatggaaaaatgttatcaaattatggagagaagcattaaagatggccaaagatatattatcagaaccagaatctgaacatgaagaagaagaaggtggaccaagaaagaaaagaaaattgaaatcatttgaaaaatctgttttacttgaaaaatggatagatttcgaaaataaaatcaaagaatttgaactccaatcatcaacgttggataattcatttgtattcaattttgttgaaggatctttggtgaaagccgtgagaaatggagaatggttgttattggatgaattgaacttggcaacttctgatacattagaaagtattgctgatttattggccgacaccataaatcaaagatctatcttattgtctgaaagaggtgatgttgaatctattaaagctcatccagaatttagaatatttggttgtatgaatccttctaccgatgttggtaaaaaagatttaccattgagtattagatccagatttacagaaatttatgttcattcacctgatagagatatccaagatttattagccattatagacaagtatattgggagatttgccgttggtgacgaatgggttggtaatgatattgctgaattgtatttgaaagcaaaacagctatctgaaaccaacaagatagtagatggtgctaatcaaagaccacatttcagtattcgtacattgacaagaacattgatttatgtttgtgatattgtttcaatttatggattaagaagggcactttatgaagggttttccatgtcatttttgactttattggacaggaaatctgaagacatattaaaaccagaaatcttgaaatatactgttgatcgtctcaagaattcaaaatcggtaatgagtcaaatcccaccagtcccatcatcaaatccagatgagtatgtccagtttaaacattattggatgaaacatggtccacaagagattgttcctcagccacactatatcattactccatttgtggaaaaaaatatgcttaatttagtccgggcaactgcaggaagaagattcccggtattaattcagggtccaacttccgctggtaaaacttcgatgattaattatttggcaaacattacaggacacaaatttgttcgtatcaataatcatgaacataccgatttacaagaatatttgggtacttatatttctgattctactgggaaattagtgttcaaagaaggtgttttggttgaagcattaagaaaaggtcattggattgttttagatgaattgaatcttgcaccaactgatgtacttgaagcattgaatcgtttattggatgataatagagaattatttattccagaaactcaggaagtgatacaccctcatcctgatttcatgttgtttgccacacaaaatcctcctggattatacggtggtaggaaagtattgtcaagagcttttagaaatagatttttggaattgcattttgatgatatcccccaagatgaattagaaatcattttaagggagagatgtcaaattgctccttcttatggtaaaaagattgtggaagtttatcgtcaattatctgtgcaaagacaatctaccagattatttgaacagaaaaactcgtttgctacattaagagatttattcagatgggctatgagagatgctgttggatatgaagaattagctgccaacggttatatgcttttagctgaaagagttagaaaggaagatgaaaaggaagttgtcaagaaaaccattgaaaaagtcatgaaagtgaaattagacatggatgaatactacaaaagcttggaagttgaagcaatattcaaaagtgattcttccatagtttggactaaggcaatgcgcagattagcagtattggtttctgcatcaatcaagtataaagaaccattattgctagttggtgaaactggttgtggtaaaactactgtttgccaagtggttgccaaatttttgggtaaaaaattggttactgttaatgctcatcaaaatacagaaactggtgacttgttaggtgcgcaaagaccagtgagaaacaaatacgaaactcaaagcagtttattcaaccatttgcttgagttgtttgccaaattgggtattgaaacagcaacagctaccaccgcaagtctaacattagataatttgcttacccaatacaataaaattaccgtcccagaagaatacaaggaacttgttgaacaaattgaaattgagaaaaagaacttgtcattattgtttgaatggagtgctggtccgttgtggttttcaccaaggggcaangatcagtgt

SEQ ID NO: 1949 - DNA, 621 bp, Candida albicans
aaaggaattagaactctgtcttcatcaattttagtagctgttcaaaaaatcatggaaattcaagaaaaaaatcaagaaattaatagagatgatgatgattggttaattttatcacaacataaacttatcaattatatgaagaatcttcatttattaaccatttcaaataaattgaaaaaatgtatggaaatcatttcattagtggaacataatcaacaatcatcgaaattaatatcagcattaacttcatttacattgccaattgtcaatcattattatcaattatgtttgaaaatatttgataaagtaagattaaattattatgatctttcaaaggcaacatttatattatcatcatcactttatacattagcaaccaaaggattttgtacccctgaggcaccaaatgaacaaaaagatgataatactaatttacatgatggtactggattaggtgatggagaaggtgctcaaaataattctaatgatgttgaagatgatgaagatttatctgagcaagcacaacaaccaaatgaagaaaataaagaaaaagatgatggagatgaagaagaagaaaatgatgattcttcacccgacggctggaaggacacgactgtgcgt

SEQ ID NO: 1950 - DNA, 528 bp, Candida albicans
  unsure (525): Identity of nucleotide sequences at the above locations are unknown.
cttaaaccacatgctaactttagattatttctaacaatggatccaaaatatggtgaactttcacgagcaatgagaaatagaggaatagaattatttatggattccttggaacaaagggcaactgagtttgatcgtcaaatccttggttttagtccatgtacaactgacgaatcattgcaaatcaaaattgaggaattagacattagcgataaaagagtggttcctacttcaagtttcaatttggacaaagaatctgcaataaaatcattcagtttgattgatgatgcattctctttgggaaacattagtgctagtgctttatggagttttgttcagttgaagaatttcccattacttaaggattgggcaagtgttgttttctcgagctcggaatttgcacaaactagcaaaagctatactgaaaagttatgtgacacattgaaatatattgagcaaacttctttggttgatatatccctgtcactatatttcccattttcaacagccgtagcggcacatttgtcncca

SEQ ID NO: 1951 - DNA, 774 bp, Candida albicans
gcagtaatttatatacatattatggcacttggcactagtaccaataaaaaaactacatcgtggggtcgtgtaataattataattctggcagcggtatttctcatagttggtattgtcttccagcaactttcatttaatacttcttcatcggcatcatcctcaattcaaggcaaaaacaaaggaactacaaataatccttttacaacagggcttacagaaacaacagaatcaatgagtgtatctgctattagaattcctgccaatgggtcactggccaaagctgcagtgatttttcttcatggattaggtgatagtggagatggatggtcttggttacctcaattggttagtcaatctaaattaatcaacgacccaatcaattatgtatttccaaacgcaccaaaaatccctgtcacaataaataatggatttgccatgccagcatggtttgatatttacgaacttggtaatcctcatgctaaacaagatgtcacagggtttttcaaatcatgtgaagtcttgaaagaatttatacttgaacaacacaataagttcaacatcccattggaaaagattattattggagggttttctcaaggagctgccatttcattggcaacattagctcttttggataccaaaattggtggctgtgttgctttatcaggattttgccctgttagaaatgaaatcaccgaatcgtttacattaaaaaacccaggtagtgcaatttggaataccccaattgttccaaagggacatgggtacggttga

SEQ ID NO: 1952 - DNA, 255 bp, Candida albicans
  unsure (34): Identity of nucleotide sequences at the above locations are unknown.
agcataaatcggatcgggccgtcggttagagaanaaaaaaacgcacgagtcaattttgataccccaattttccaaggacatggtaccgttgatcctgtgattaattacgattatggtaaacaaaccagtgaattgtacaagcaattgggattcaagaatttgaaattcaatacttatgaaggtgtggctcatagtgccagtgaagaagaattggccgatgtgattaagtttattaaaaatattgtagagaaatag

SEQ ID NO: 1953 - DNA, 657 bp, Candida albicans
ggtgggggaatagtctttctacggctgttgtcgaatacaacagggtttatatgtgggcaatcttctatttttttcattgattggttaatttcacctgaatgtccgttccaattatcaaaaacgttcaccattttagaattaggatctggcagtgctgggatatgtgcatcagttttactctcgaaagttcaacactttattgcaactgaccagaaacatgttttgaagttgttaagacaaaacattgaaaataatgtttcaaattttactagccagagtagtttcaaaactagtggtggcaacccccataaactaattgatgtcgtggaatttgattgggaaaacatcgaaatggggaaatttaatatacaaagtttaaacatgcagaaagaacatcctgatataataattgcttgtgatacgatttataatgaatacttgattcctcattttgttcaatctttaaacgcattgatggctgggaatcagcaaactgttgcattagttgcaattcaattacgagatctgattacatttgaagtgtttgttaccgaagttgttcaaagcggggaactatcactatataatgtacctgatcatttgttaagtgatgatctaaagaatggttatgtagtttactgtattttaaagaattga

SEQ ID NO: 1954 - DNA, 441 bp, Candida albicans
  unsure (22),(44),(61): Identity of nucleotide sequences at the above locations are unknown.
acggggaaacaaagaggaaaanagaggaaaaaagaagaagttgntgacaaacaaacagacnagtaccatcactctttccaccacatccaccaccaccaccacatccccataatggataaatcaacatttaaacaattaactaatgaatatgatatattatatcttatttatcatcgatctaaaaatcaacatcgtcaacaaatttggttcaaatatttaaatatgatgattcgaaatttacgtaaaatcttaaaacttcaaattgacatcaatagaataagaactacaaccacaaccactaccacgaaagataaaattgattataaaacaaatcaaatcattcaatatagtaataaaatattaaaattaatgaaatcatcatattggaattataattcgattttagtattaggacaatatattaatcttggattaggttaa

SEQ ID NO: 1955 - DNA, 624 bp, Candida albicans
  unsure (610): Identity of nucleotide sequences at the above locations are unknown.
tcttccagcggtctgtctgatgtatttaaacaattaactaatgaatatgatatattatatcttatttatcatcgatctaaaaatcaacatcgtcaacaaatttggttcaaatatttaaatatgatgattcgaaatttacgtaaaatcttaaaacttcaaattgacatcaatagaataagaactacaaccacaaccactacaaccactactacaaccactaccactaccactaccacgaaagataaaattgattataaaacaaatcaaatcattcaatatagtaataaaatattaaaattaatgaaatcatcatattggaattataattcgattttagtattaggacaatatattactcttggattaggtttaattggatcattatcaaaaatcactcatttaataattaatggtataaatggggttcaaaaacgaggaataaatagagatagttttataaataaaatgaataatgataggcaaagggttgatggggttgacgtcgtgggaagtaaagatttgaagagtaataatgaagatgagatagattttggtgaagtgataccatatgaagaagaagtagagaacgtgtcgattaatgatgacgttnagaataactgttag

SEQ ID NO: 1956 - DNA, 1584 bp, Candida albicans
ccacaatctcctcaactaggagctcaatcatcgaactttttcaacaatagaaaagacttgtcttcgatagctatgttcaataattatgctaataatcactaccaacacaatggggacgggaactttgatataaatgactcgttttccaacttgaatttaaatgctaaatttaacgatttccaatccaggaggcccagtcagttagtggatttttcattcagcccctttggtgatactagacaacaacaacaacaacagcaacagcaacagcaatcacaatcgcaatcgcaatcacacgtaccaaatcaaaacctacaacaactgcaaccacatttgacaaatgcgggcaatagtgcaccttttattgcctatcagaacaaacaaagtatgaatagtgcgcaaaatcaatccatgggtcagggaaatcctatcaaattggaaaacggattaatgttacgagatcaatacattgtggcttctcctgaattgaaaagtttgtatatgaaaaccatcaagtatttccaagatcagagcatcactgctgacattttatctaaattgaataacttgttaactaatccagttataataaagttgattacatttattaagaatttgaataacctcacatttaaccataaaatcctttgtcttgttatcaacaaaaacggaaagtttgatttattgtcttaccctcataattctaatatatttttacaaaagaatgatttggttattgtcgatggtgatcgtggaaaggatttggttatgattgttgaaccgttagtgaatttgaattttgcaatcttattcaactttttaaagaaattggagcatttgaagagtttgacaattattgagggacacgaaaccaaaactaacggtggaactcatccaaccactatggatgcatcaacaataattaactcacacctgaacgaggacaatgaattcattataactttacctacaaaacaagtacttcgttttgcgacacctaaagaagttcataaaattagcgggaagtttcttgaggaaaagaaggcatttatcacctgctacaacaaaatcaaagagcttaatcttgattctgatttatcacttataaatgtcgagtaccaatgtgattttaaaaagttgatattttactattttgccggattcaaacgtattgacttccgaggtttgatcaaagaattgtttaaaatttataaaacaagaatttggttatgtgctgtcttgccctataacaaaccagaattgtacatcacaatggataaggaggattctgaaccgaaggttgtacaagtgaataataatttagttcctagagagtatgagttgacgaatgatcaaattttgaatttttctatcaacgaatttgacaatttagccaccccaagctatttccatctgaagaatgttcaaaatttgataaagcatatgactaatgaaattaagggtcatttctacggtttcaatacagggaaaattgaaggtaattatcaacccgtgaaaacagttgatttatcagatcgtagcagaattttaccaaactttaacccatttggagattttcaataa

SEQ ID NO: 1957 - DNA, 915 bp, Candida albicans
tcatttactaatccaatcatatatcattacacatacaatatgcaatacaaactgagtggagctacatcgaaattgtctcaagttgaaataatacctgctaaaactgacgttggtgctttggctaatagaataaatcttgaaaccagatctttgcacgatagagcagacaagacagttaccttaaaatttgcccttgctttgagaaattacaaagtttatcgtcaaggtttgcaagcattctatcatgtatttgctagtattgaaaaggccttgtacagacagcttgaaaagaaagatgaatggagtgaaatgttggagcaagtttggaaaccggagattgctagagctggtaaagccgagcaagacttgttatttttctacgatgacaacaaggaaaaattcatcaaacctattatgcctgcacaaattgagttttgcaaacacattttggaagttactgaagaaaaaccatacttgttgtttgcctacttgcatgtgatgtacttggctttatttgctggtggtagaataatgagatcgtcggtcctcaaagctactggtatgtacccacaaagagatggtttgtcacatgacgatgtggtcagaatggggactaattttttcacattcgatgttcctgatgaagatttattgagattgacatacaaaagagattacgagttggtgacaagaaatggtttgacggaagaacaaaagttggaaatcattgaagaatcaaaatacattttcgaacatgacgttaaatgtgtggctgaattagaaaaacacaacatggacaaactttcgggtacttggacatatttcttagtgacaagaggctactatgctgccttggtacttttctctttgttggctttgatctacttaagaagagttgtcaataaattaacctaa

SEQ ID NO: 1958 - DNA, 243 bp, Candida albicans
ggacgcggatcttctacccgtggtgaagacaatttcaaattctttgaaatcagtcaaaagttattgaatgtggtgttgaacaattttgctgtggataaattaactgaagttccaggtttgatgaagattatggagagcattataccttataatgaacgtcattataatagaattgaggaaatggtggaacagacatatgttttggattatactgttgaacaaatgaataaactaattgcatag

SEQ ID NO: 1959 - DNA, 693 bp, Candida albicans
tatcataccatggatgttctaaaaacaacatatgcacatactgacattgaaccaatttatgttggtgggacaagtgccagtatttctacttccaacggtgaattattattagccactccattaaatgaagatgttataattaccaatttagacaccaatgaaataatatacaaaattcctggtgatggagaagttatcactaatttaacaatcacccctgatgggtcctatttagcgatgatatcacaatctcaattattaagaatttttgatctcaacaaaggctcagtaattaaaaattttaaattaccatcaccagtatacatttctagtgttgattctacatctagtttatttgcctttggtggttctgatggggttatcactgtatgggatattgaaaatggttatgttactcattcattgaaaggtcatgggacaacaatttgttcattaactttccatggtgaattgaattctcaagattggagattagccagtggtgatacgatgggtacagttaaaatttgggatttggtgaaaagaagatgtattcatactttaaaagatcacaatacggccgttagaggagttggatttgatcaagatggtgatttattcatatcgggtggtagagacaatgtggtgattatttacaacaccaagaatttcaaaacaataaatacatttcca

SEQ ID NO: 1960 - DNA, 744 bp, Candida albicans
agtcggatcttccagccggcctgggttaagacgaattgccggaaatcgggtattatcgctgacattaaatatgttggtcctgaattcaatctcttagcaatggcaacaaattctccagcattgagaattgttgatattgagaaaccattggaattgagagtgtatgagggacatacagatattcttaatgctgttgatgtatctactgatggtaaatggatagccactgcttctaaagataatgaagctagattatggcgttggaatggtgaattacaagattttgaaccatttgctagattccaaggtcatgctggcgctatcactgccattagtttatctaaatcacaaaatgaacccaaatttttaatcactggatcgactgatttaacgattaaaaaatggaatataccaaatacaccgaattccatagtgaaaacttcagaatacactagaagagctcatgataaagatattaattccattgatgtttcacctaatgatgaatattttgctactgcttcgtatgataagttggggaaagtatggcaaactgatagtggagaaactattggggttttaaaaggtcataaacgtggattatgggatataaatttttataaatttgataaattgatagtcactggaagtggagataaaacaattaaagtttggtcattattggatttttcatgccaagtatacattaatttgcccacacggcctggaaaatccggatgttct

SEQ ID NO: 1961 - DNA, 2217 bp, Candida albicans
ttttctatcttacgattcaaatatcccaacatatatgtggcaaactttaatcatttgaatttcagtttacattcgacctcaagaaggaatttacctgaattgccttcaaattcattatttggttggattcctacagtttacaaaattactgagcaagaaattttggaacatgctggattagatgcagttgtgtttttggaattttttaaaatgtgcattcgaataataagcatatgtttagtatttgccattattatcatatctcctatcagatacaagtttacagggagagtagatgaagattatcccgacgatgatagtgacaacgatgacgatgatggaagtaataataatggtaccacaataattaagcatatagtgtcagctggaattctggtggcaagtaaaaataacgatggagaacagtatcaacaatttctttggttatacactattttcacctatgtatttacatttgttactgtttactttctattcaaacaaaccaataggattatttctatgcgtcagaagtatcttggatcgcaaaattcagtcaccgatagaacggtaaaaatatctgggataccaggatcattacgagatgaagtggcactcgcacggcacattgaccgtttgaatattggtgaagtggattctgtgttgattgtcaaggagtggcaaaatctaaacaaactattcaaaagaaggagaagaatagttcgaaaattagaggaaagttgggttgaatattttgaaaaaaatgggataaccaataagagcgatttgatatcgttgcatccccaagttggcgaactgtatcgtttttccaataggtatactgatgatgcagaagaatcaccagactggggatctcaaaattcgaactctgcacaagcttcaataatagatcaagactcagaatctgttgaaggagattcttctgacactttgaatcgcttgttgaatgatgaactgagaacaagaccaagtcttcggaaaggttggttcggattgtttggacctaaagtggattcaataaactactacaccgataaattggaggtcatagataaagagattaccagggccagaactagagaatatcccgccacttcgactgcatttctcactatgaaaaccgtggctgaagcacaaatgttggcacaggcagtcttggatccaaaagtcaatcatcttatcaccaacttggcccctgctcctcatgatatccgatgggataatttgtcattaactagacaagacagaaatacaaagatccttgctgtcacgatatttattggtataatgagtttgttgttggtttatccagtcagatttatggctagttttttaaacactaaaagcatttctaaaatatggccatcattggggaaagctattgaatcgcataaatgggccgaaactttgattactggattattgccaacttatttatttacaattttaaatattgtgattccgtttttttatgtatggatttctgaaaagcaaggttatttatctcatagtgatgaagagttgtcatcggtatccaagaactttttctatatatttgtgaacttatttttggttttcacaacttttggtaccgcctcttttgttgatacgaccaaaattgcatttgatttagcaagatcactcagagatttgtcaatgttctatgttgacttaataattctacaaggattgggtatattcccattcaaattattattggtggggaacttacttcgctttttagtgaattcattatttaggtgcaagaccccaagagattacttgaatttgtacaaaccgccagttttcaattttggtctacaattaccacaaccaatattgatatttattattacgttggtatactcggtaatgtcttcgaagatattaactgcagggttactatattttattattggttattttgtgagcaaataccaattgctttatgcttgtgttcatcctccacactcaacgggcaaagtttggccaataattttccgaagaatcatattagggttatttctttttcaaatcacaatggttggcacattagcattacaagatgcaatcacatgtgctactttcttggcaccattgccgtttttgacactttacttttggtggagtttccataaacaatatattcccttgtcaacattcattgccttgagagcaattgaacgcaaatcttga

SEQ ID NO: 1962 - DNA, 1989 bp, Candida albicans
  unsure (56): Identity of nucleotide sequences at the above locations are unknown.
ttaactttaatagctgggatgttttcatttttattgttttgtatgttaagattcanatggccccatatatatgctgttagaacattgagacaaccacgaaataatctgcatattttgcgacctttgcctaataatttatttggatggatcaaagtagtttataaaataactgatgaagaaattatagcttgttcagggttagatacttttgtatatttgaggtttttcaaaatggggatcaagatttttttaatcttatcaatactggcaatatttgtcctaagtccaatacgatattatttcacaggtaattatgataaagagaatataatgacaaaaccaaatcaaccaccagatatcaattatgatttccccagtttctattgggtgtatcctattttcacctatgtgttttcaattgttgtgttttattacttgtttgaatttactaccaccattttgcgaacaagacaaaaatatcttgcttcacaaagttccattactgataggacaattaaattggatggaattcctaaaagattactacaacgagaaaaattaaagaaatttattgaagatttaggtattgggaaagtacttgatgtcaaattgatttacaattggacccccttggaagacttgttacacaaaagacaagagttgatgaataatttggaatgtatatatacgtcaatgtacaaaatggacattgatatttacaatcaacatgaagtcccggcagtcaatccaatttggtctgaaccattagacaaaccacagttgaatgaattagctaataaatacacccaggaattaattgaacttgatggcgagattaaacacatgcaaggtaaatttgacagtgatttgtccactatagatgttaaagagaatcgagaatttaagcaagtgccttcagcatttatcaccatggattcagtggcatcagctcaaatggcagctcaaaccattttggatcctcgtgtatataaattaattgccagtttagcccctgctcctaaagatatcatatgggagaatttgaaattgacttattttgaaaggaaaatcaaatcatattttataacccttgtgattgttttgagttatgggttcattatatttttggttattccattgacatctttgcttgatttgaaaactatcagtaagttctggccagcattaggggaattcataggtcaatccaaatggttaactacatttgtaactggtatcttgccaccattattgtttacacttttgaattttctgttcccatatttctatcaatatttgtctcaattacaaggttacacatctaacagcgacgttgagttatctacattactgaaaaatttcttctttatattttttaacttgtttttgatttatgttgctgcagggactttttgggattatatgtcatatattagcgatacgacaaagattgctgtgcaattagctacgtcgttaagaagaatggcattgttctatgttgatttaattttattacaagggttaaccatgttccctgttaaactattacaagtgagtgattttttcttattgaatgtcttgggcaaattgttttattttaaaagattgatattgaaaacaccaagagattatcgttcttactatttcactccacaaatatttgactttggtatcaatttgccacaacacattcttatatttatgattattttgatatattcagtggtgtccacgaaaattgtcacttgtggattgatttattttatcttggggttatttgtttataaatatcaattggtctacaattttgttcatccacctcattctacgggtaaagtctggccaatgattttccgaagagtgatttcagggttaattattttccagttgtttatgtgtggaacattagctctagagaatgccctattggtggtcgattttatgtacccacttgatatttataacaatgattattccatggaattttga

SEQ ID NO: 1963 - DNA, 939 bp, Candida albicans
agagcttacacaatcactacctatcatcatcatcaccatccattttcaatgatctgtatagaatgtggatattctaatattgattgtttatattccaagtataaaagtgattatatcaaactaagtgtatgtcccgaatgtaataaaattgctgataaatatattgaatatgattcggtgattctatttttggacattttattacttaaaagacaagcctataaacatttagcatataatttaactgaaatggaaatggaaataggatcatcaactaatttccatataaatgataatacaaattttaaattctttcatacttatagaaaacttatgaaattgatatttatgattttatcatttgaagtttatttaacatgggctaatgaagagaaattattgattcattcacaattaattaatttaattttcaatcaatcagttgtatatcaatatttatttttcattattaaatcaagtctagaaaaccttatattgaatttatcattacaattgattctaagactaggatataaatggggacaaggtccacagaaaataaatggtaatatcagggataaagaattatttggatataaaacatcagtcttattggtaacaacgatggtatcagggtcaatcagattatttcatatattgatgtttatttggccatacgataacatatatatcactaaaccattgataaatatgattgcctttataaatatcgtggaggcattacgagttgtcacgagtttgggatacgtggaactaatactcagtttggcgtttagtattgttatcagaaatatagtgtcaaaactgttactagtactaattgtcagactatttttggattttaactttactgaggtgtattacaatgaaatgtatcaattatattcacagattcaaacctatatacgttggatttaa

SEQ ID NO: 1964 - DNA, 1011 bp, Candida albicans
cagcctctggtatctatgttcattgattttaccgttgttgttctacttactaagttgatctcatcgcatattatttcactccatcaaagatacaacacccaaaaaaaaaataaggagaaaaaaaatgtttacaataaactctttcatttactctttgctcatcagaccccaactaaattcaacaaagatatgtcaagaaccggagtattagtattgggacctgcaggtgtaggtaaatctacattctgtaattctatgattgcgtatatgcaatctataggacgtagggctcatattgtcaacttagacccagcggccaacccaaccgagtatgaattcacaatcgacgttaaggatttaatatcattacaagatgtcatggaagagatggaattaggaccaaatggagggttggtttattgctttgaatttttactaaataacctcgactggcttgatgaagaaatcggtgattacaacgacgagtatttgatttttgattgtcctggacaaatcgaactatatacccatataccagtattaccaactatagtaagacatttacagacatcattaaatttcaacctatgtgccacatatttgttagaagccccatttatcattgataattcaaaatttttctctggtgccttgagtgccatgtcagccatgattctattggaattaccacacattaatatattatccaaaattgatctagtgaaagatgagtacagcaagaaacagttgaagaaatttttgaatcctgaccctttactacttgcaaaacaagaagattatataaatcctaaatttgccaaattaacgcagtccattgctaatttggtcgatgattttggcatggtgcagtttttgccattggattgttcaaaggatagtagaagtgtagagacaattttaagttatattgacgatgtcacacaatggagtgaagctcaagaaccgaaagagcctcatgatgaagttgaattaccagatgaggtattttaa

SEQ ID NO: 1965 - DNA, 1227 bp, Candida albicans
aacaagctcacaaactggatgctccttaataataaaaagatatcgtttatacatagatttataaccaattggttaataatggatcccaatctaatatctcattacaacaataccaacactcgaagatttaaaaattatcaaattgaaaatcaaggtcaactgaatttcatttattttttaggtggtcgattacatactatcaagaccaaatatccaattaatttaataacattaagtttaataataatacccgggatattatatataatatttgaattatcatggcaatggagaaatttttcacccattatagtgattatatttttatatatttggataatttcaatattccatttttttaaattatctaccggtgatgctgggaaattaccgaaaaatatccatctaccgaaaaagttaataactattactactactactactactaccaatgataatgaaattgatcataggaacaattataaagtgaggggttcaccacctgatgaatatttcaatactgttacattaccttattggaaaaccaataatgacaataatgacaataccaaaatttcaaaacttgctaatgcttatcattctcatggagttcaagtgaaatattgtggaacttgtcatatttggagaccttcaagaactagtcattgtaatacttgtcaacaatgtatattaaatcatgatcatcattgtatttttttaaataattgtattggtcaacgcaattataaatttttcctttggtttttattatatattgtcattgcttgtttatatttattaattatttccatcttacaattatgtcattataaatttgcatcacataaagaactggaaataattaccactttcaatcaatcaattaaaactcatccaattagtttattattattgatttattcatgtttagctatttgttatcctggtttactattagcattccatatttttttaaccagtcaaaatataactactagagaatatcttaattttgtttataaaaaaccttcaaaatctactgatggtggtgatggtactagaggatttgttaatgtttataatactcattcaatttgggaaaatttatatattaattggttaggtaaatctaatggagttagtttaactttcccaagagattattatcatcaaggtgatataagatttgccaatatagaaccattaggtacatttaccaataaataa

SEQ ID NO: 1966 - DNA, 807 bp, Candida albicans
ccgtgggcaagggtttctggtgaaaggttggataatttgaaatatatggaacaaaataacattgatccatctgaagtttcatcttgtttgtctcatattttcaataatatgatttttacccctggtgttgccttgcattgtgatcctcatggtggtgatttaactattagaaatgttcctccatccaaacacaacaagagtggacattattttgaaataattttgtatgatcatggactttacagaacgattcctcttcaaatgaaacgtgattatagtcatttctggttagctgttttggataatgatgttcctaatatgaagaaatatgctatgaaaattgccaatattggcgatgatgaccaaaaattcagaattttcatgagtgcaattaccggaagagcaccagaggaagctttgaattatgatatatctagtcgtagatccaatgaagaaattcaaaaaattcaagggcagataaataatgataacagggttttggaagatttgatggatattttgagtaacatgccgagaatggtattattgatattaaagactaatgatttaacgaggaatttagatgaaaacctagagagttctttaggacccgaaagaacttttttgatcatggcaaattattgtgcaaaatgtgtttatgatgagctgaaagaagaaataaaccacaaatatcgtggttggagttggttgacacattctatttcaaactggtggtattatcaaaagagattgagtacgttatatctctacgattttgtgttgatgatcagaagacttacattttag

SEQ ID NO: 1967 - DNA, 660 bp, Candida albicans
aaatcatcatcatcatcatcatctcgatatggtaaattttttaagtttggtttagctattgggttagggacaactattttgtattacacaaatgattcattcaaacatatagttttaactattgatagagtcaacactgtaactgttgctatgatccgttgttttgccttatataaagaaacattaggtgaaacttatgatagtgatattgatcgtcataaagcattatcgaaaacacacaaaaaagctgcagaaattaccttgaaagcattagagaaaaatggtggaatatacattaaattaggtcaacatattacagctttaacttatcttttgccaccagaatggacaaataccatgcttccgttgcaagataaatgtccacagtcatcactagaagaaattgaaaagttatttgaaaatgatttaggtaagaaaatgtcagatcttttcattgaatttgatccaaaccccgtcggagtagcatctttggcacaagttcatatagcaactttgaaaaatggagagaaagtggcggtcaaaatccaacatccctcattacaggagtttgtccccttggatgtcgcactcacgaaaatggtgtatgatttaatgtataaggtattccctgaatatccattgacttggcttggtgattaa

SEQ ID NO: 1968 - DNA, 957 bp, Candida albicans
accccacagaagaatttcaacataacgtcccctcagaacatgaaaaaaaaaatatatataaactccatgtcttatctctatttttctttatcaaattcacctaaagtatcaaaactattatacacaatgtccgacgaagaagccgatgtcttgtacgaagtcagagatagaactgctatcatcaccttcaatattccttccaaattaaatgccttaaatggtgaacaatatttaaagttgggtaaattcatggaaagggccaacgaagaagaaggcacagtcatgactttgattcaatctacaggtagatttttctctgctggtgccaactttgccgacaacggattgatggatgttgacccccaattgttatttactcacgaatattggttgggaaaatttgttgctagaaacgtttggttgaccaacttgttcaatgaccacaagaagattttggttgctgcagtcaacggtccttccattgggttgagtactgggttgttgatgttggtcgatttggtttacgtccacgatttgagcaaattctatttattggcaccatttgccaacttgggtttggttgctgaaggtgctgcctctgccaccttgtttgccaggttaggatggtccaaagcttcagaagctttattgttggccaagccaattagtggtgctgactgctacaatgttgggttgatcaacaaacactacgacggtaagttcaagtccacagaagaattcaaccaacaggtgtacaaggaagtgaccgatgcatttgaaaacttgcacgaagattcaattcttcaaaacaagcaattgttaaagttgaacagagatcaatacataaaccacgccaactcacaagaagtcatgagaggtttgggtaaatggttagaaggtgttccacaaacaagatttgttcaattggcaaacaaagatgttaaacacaagatttag

SEQ ID NO: 1969 - DNA, 687 bp, Candida albicans
aaagaccaaaccacgaagagggccatatcttcatttggattcaatcaaccggcaggtttttctctgcaggtgcccatgctgatttggttaccttcccaagataccggacttaacatttgtttgaacttgtcagtggcaaagcaaacatttttggtgcaaacgtttcttgcccacaaaaagatccttgcagtcgctttgaatggacctgctataggattatcagcatcctttgtggcactttgtgatttggtctatgtcaatgacttgtcaaaaacattctttttaactccctttgcaaatattggtattctcgctgaaggtggtacatcggccacacttccaattcgtttaggctggtccaaagctgccgaagcattgttgttgtccaagagaatttctggtcaagatttacaaaatgctgggctcgtaaacaaacactatggagggaaatttaaaacagctgaagagttcaattccaccgtcttgggcgagttgctcgacgctacagaaaacttgcatgttgactcgattttgcaaaataaggaattgttgaaacagatttacaagccagccattagtatggttaactctcaagaagtctccagaggagtttataaatggacttcgggaatccctaaagatagattcaagaaacttgccagtggcgagttaaaacacaagttgtag

SEQ ID NO: 1970 - DNA, 561 bp, Candida albicans
cccagggtaaggaaaatcttggaattaggtgatgcttcggcattaccatccttggtatgcagtcttaatcatgccaaagaagtaattgtcactgattatcctgatccagatttattatctcatatggaatatagttttaacgatttaaaggagaagaccaaatacgaattgagtccatggaaagttaagggatatatctgggggcacgatttaggggaattattattcgatgagccaggaagaaaattagccgaagaagagaaattcgacttgattatattatctgatttagtgtttaatcattcagaacatcataaattattggacacttgtcgccaaagtttgaaaagaaatggtggaaaatgtctagtggtgtttagtcctcatagaccatatttattacaagatgatttgagtttcttcgaaactgctaaacaatatcaattcaaaacggaaaaaattgaaatggtcacttggaaaccaatgtttgaggaagatgaagaaacagccgatattagagccagagtatacgcattctttttaatacccgaatgggaataa

SEQ ID NO: 1971 - DNA, 846 bp, Candida albicans
cccaaaccgttatttttttctatactttgtttcacacatatatatatacgtttagtcatgtcagaagatgaaatatcaatagaaggggatttatttgaagaaccagaagggtttcttcctgaacgtccgtcatcccatttttcaacctataaacgtaaaatacccaatgctgagccacaggaaataacaatgaagttggttggtcataacccattatatggacatttattatggaatgccggaatatacacagctgattatttagataaacattctgacactttggtccaaggtaagaaaatcttggaattaggtgctgcttcggcattaccatccttggtatgcagtcttaatcatgccaaagaagtaattgtcactgattatcctgatccagatttattatctcatatggaatatagttttaacgatttaaaggagaagaccaaatacgaattgagtccatggaaagttaagggatatatctgggggcacgatttaggggaattattattcgatgagccaggaagaaaattagccgaagaagagaaattcgacttgattatattatctgatttagtgtttaatcattcagaacatcataaattattggacacttgtcgccaaagtttgaaaagaaatggtggaaaatgtctagtggtgtttagtcctcatagaccatatttattacaagatgatttgagtttcttcgaaactgctaaacaatatcaattcaaaacggaaaaaattgaaatggtcacttggaaaccaatgtttgaggaagatgaagaaacagccgatattagagccagagtatacgcattctttttaatacccgaatgggaataa

SEQ ID NO: 1972 - DNA, 432 bp, Candida albicans
tcaatcgttatgtcgaaagtggaagctagtctggggactaataagaatcctgtctctacagccacaagcacagttggagagagtgccacagctacaacagaaacatcaacagaattgagggccaatttcgctgaggtgacagatccaaaactaaatgcaaaaccgcaatcttctccgttattatcatcgacgccgcctctggtttccaaggcattggtgaactcgtatccttacttgattattatcaataaactcctttcaataacaacatggactaatgacgattactgggtcaacgtggttattatcagcttgtatgcgttggttgttttatactttgagaatttagtcatttggctgggtcatttaattcttgtggcaatattgatttcgtatacgttgttgaacactaagatcattagacagtcttaa

SEQ ID NO: 1973 - DNA, 564 bp, Candida albicans
ctatcagatgtgagatgtgattacgttccaataaagcatgttccaattcaaagaaagcatttttataaaatggtgaatggttctattttcctaacctcccctcaatttggagttctgaaaacgttaataccgcctcaaaaatatattttgtttttaggactcttcttgttcacatttcattcaccatattcgtttgctattcggagattactttggagatcgttgtatgttagaattgccattctttatataactggattggacatcaaaataagaaaagattatgatccaaatgattatcaaacagtttcacgagttgcaagtgcaagcaacagtgatgcagaagggttggggggtattccggtattatcagattttaaaatcataaagaaaagagtattttctcctacacaactcaaacagacagtattttttgaaattttggaaaacgaaaggagatggttgggtgtgggttggtcatcattgttgtaccctagtgaacgcccgaacttctgttacgagggttcttacaatttggctccgaatattaccgttcacaaatag

SEQ ID NO: 1974 - DNA, 492 bp, Candida albicans
gcgcaactcaagtttgagccgcgaaggtatttttcagttgcttcttcttttttttatcacttttcctttgctagcaaactaatcgacatgtcacaaattcaagatcaattggaaaatatccctggatatgatgttgtaatggattatttcaacgaatatggggaagaacattggaatgctaaggttaacccttttgaggatgagaacgggaacaagcgtcgtcttcccaaagatttagcaacgaaacatgatcagcaagtatggaaacagattcaatcacaagcatggactgatgacaagtgttttctagggagttgtgctgtggggttagactgtggtttgggattggctcccttggtagttttgatatttccagtgttgggtccacttatcatgtatggggttcatactagagtgataaacatagcacagaaaaattacaatttgcccaatacgctcattgctcaactaccgaacgactattatgattga

SEQ ID NO: 1975 - DNA, 630 bp, Candida albicans
acaaacctagatcatttaattacatttggagatgctaaccatgatccttattttgaagagatcccggaaaacgaattacatttctatcaacggaaaggagctagaagaagaagaaaattgcctgaattcattcccaagcacgatttaaagattttgaacagtgtcaaaaacagagcttatcatttagacttactgttgaatttgtgtggattaagaattggttgggctggggtcattgggttgattccttggataggtgatattattgccttttattttgcattgcaattagttagaaaggcaagaactatagatggagggttaccaaaagggttagaagcagaaatgatggcgaatgtcatgtttgattttggtattggattaattccaattgttggtgactttatcaacgtcttatataagtgtaattcaagaaatttcatattgttggagaagtatttggtcaagaagtataatactgttgcaaatccgcttcctccgtctaaccctgttgttacagaaactcccattaataattctttaaaccctccgtcgaatccatctggtaggaagacaccgacagccaatatttcgaatcgcccacctaacccgcctcctagagatttataa

SEQ ID NO: 1976 - DNA, 1152 bp, Candida albicans
accgaagggttccatccgacaaaattccctagtatcaggcctattcagccgttcgttttagaggaattgggtgaaggagttgatggtccagtgccacacccagcgtcgttttggagaccaactccaaccactgccagatcatatgatgcctctcatgcatcagacaccgagagcaaatatcactccaagatccctagaaagcacactgagttgattagttcatcctcatccgatgaagaaaatgaaccactatcaccaaaaccagaaattatcccacccaaaaaagaaatcttaccaccttcaatcaaagttcgatcttctcaaattgctgatttagaagaagtaccacatggaattcaaagacaagcattgaaattagaggattatcatttccccacacatagattggcaaccacattaactgatgattcgaaacatccattggttattgttgcttgtggatcattttctccaataacttatttacacttgagaatgtttgaaatggcattggatgctatcacagagcaaaccagatttgaagtcattggtgggtactattcaccagtttcctctaattacaaaaaacaaggtttggcgccagcacaccaccgagttcgaatgtgcgaattggcatgtgaacgtacatcatcgtggcttatggtggacgcctgggagtctttacaacctaaatatactagaaccgcgttagtattagatcatttcaatgaagagataaacatcaaacaaggtgggatcatgacccgtctgggtgaaaaaagaggggttaagattatgttgttagcgggtggtgatttgattgaaagtatgggtgaaccagatgtctgggctgaccaggatttgcaccacatattaggcaaatacggttgtcttattgttgaaagaacaggatctgatgttagaagtttcttgttgagtcatgatatcttgtatgaacatcgcaaaaacatattggtgatcaaacaattgatatacaatgacatttcatctacaaaaataagattgtttatacgaagaggaatgtcagtgcagtacttgttacctaattcagtcattaggtatattcaacaacataacctctacggtgattctgaaccagtaaagcaagttatgtccgatagagctgattaa

SEQ ID NO: 1977 - DNA, 630 bp, Candida albicans
ttcattgtgctactatggaaccttcttggaacccttattatggggttttgggtaacaaattatgtgattcacattcattcagaaaaaactttccaatttatgttgtgggatttgatcaaagaattggatggtggcagtgctgatgacgaagaggaggaagataatttcattggatttgatacatttgatgaagaaaataagatgaaaagaatattgaacttgggaaggttttatggttttcttttggctgaaggttccatacccttgcacaatcttcgtactgtaaatttcttaacagcttcaagtgatacggtgctattcttagaagtgttgttagtcagcttttttgatcaagttggtaaaaaatcacggaagaactccgttggtggtggtttacaaaacaaagctaaaggaatgtatgagcagaaatatgatgatagattattagttgagcgtgttttgaaagctaaagaccaaactactatgttgagaggtttacaatattttgtacaagaaaaagtcaaaacaagtgaagtcgtttctggaaagaaacaatcgaaaagagtagcatggggggtcgatgccttgtttgatataattgacgaatttttgaaagattcagaagactga

SEQ ID NO: 1978 - DNA, 1581 bp, Candida albicans
actcagatccgggcagaattggagtctgagggcaataaggatgtcgcaactgcagaagaaaaccgaaaagaagaggagagtaagaaagaacaagatgacgaaagaaaggatgcagcacaagaagatgcaaaggagaaggggaaagaagcagagaaattgaaacaatcatccgaacaaaatgacaatgatcaacccaaagactttgaggaagaaattaagcctgaatccccaaaagacgagaagaaagataaacgagaaattgtcaccaacagaaatgatttgaatagagtactttacgttccaaaaatggaagccgttttgaaaagtgggtggagatacaaatccaatggtatctggttaaaatatggtccacatagcagcaaaaatgcggtgtcagccattgatttattatttgggtatgaaacagttgatcctagaccaaattggaatttaatcaaaaccccaatcatcggtgtttccaatccatcaaacttaccggcatacatcacattcagaagaggacccaaaattgattacaagaaagagattggaacaacattgacaatgaactcagaagacaaatttaagattcttcaaattgcagatttacatttttcaactggttatggtaaatgtttagatccacaacctccatcttcggcaaagggttgcaaagccgactctagaacgttggaatttattaataaagtattggatttggagaaacctgacatggtggttttgactggggatcagatatttggcgatgcatcgccagatctggaatcgtctgcattcaaggcattaaacccttttgtagaaaggaaaattccatttgcaattactgttgggaatcatgatgacgaagggtcattgaaaagagaggagattatgggtctttatgctgatatgccgtactcagttgcagccatgggtccagcctcaattgacggatttggaaactatgtggtaacagtacaaggaaaatcatccaaagccacagcattatctttatattttgttgattctcatgcgtattccaaaaccccgaaagttacaccaggttatgattggatcaaagaaaaccaattaatttatttgaagcaagaagctgaatcaatccagaatagtgtagaaaaatatagaaaaagcaacaaaatcccattggcaatggcattcttccacattccattaccagaatttagaaacttgaatcaaccttttattggagaaaaccgtgaaggtgttactgctccacgttataattcaggagctagacaagtgttaagtgagattggtgtaagtgtagctagtgttggtcatgatcattgtaatgattattgtttgcaagatacgcaacaatctctgtctcccggagataacaaaatgtggctatgttttggtggaggagcaggattgggtggatatggtggatacaatggatacattagaagaatgagagtttatgaactagacaccagtaaaggagagattaaaacttggaaacgcactgaggacaatcccggtaatatcatcgatgaacaggtattagtatcaaacggtgacgtggttaattggtag

SEQ ID NO: 1979 - DNA, 2820 bp, Candida albicans
acaaaagtggtctcagaactgttttgcagaaaacagagacaaaaaaaaaataacaaatcaaaatatcaccacacacttgtacgcatttactctaatctaagcagaatctctgtcaggcgctttccacttttatacgaatcaattgacatgactacagggaaggtattagaaccatccttggttaaggatttatctaaccatatatatgaaaagagaaaggctacagcatttcaaattgagtcattgacaaaaaatgctttgggacacaatgacagtcaaacgatctataaaataatcaacgaactcacagagttaacaagcacaggcacaaacctggccaagatgggagcaatcactgctcttggaagtgtgtctgttgcacttgggtcttttgctattgcgtactttttggaggatatcgtcaaacccatcttttcaacatttaaggacaccgacgcacgcgtcagatattatgcttgtgaatcattatacaatgttgccaagatagccaggggagagatattgatttatttcaacgacatttttgatattttgtgtatcttggtcagcgattcagaaagcagtgtcaagaatgcagctgacattctagataggttggttaaagatatcgtgagtgccaaggcaaccaactatgttagcatattgcaacagcaacaggagtctcaaatacgaagcaatttggtcgatgctcaaggtaacgccatccaggtgaacgagccacaagaccccagcaaggcgttctcgttgccaaaatttgtccccactttactagaaagaatgtatacaaccgacccgttcaccaaaaaatttttactaagctggttggagttgtttgacgacatcccatcattggagctagttaggttcttaccggagtttttgaaaccgttaattcagtttttgttcaacaactcgcccacggatattcgctcagaaacagagaacctattgaacgtgtttctagaagaaatcaagtatataaccaagataaagattgatgcaagaaagaaggagttggccaataagaaaacaaagcaggcagagttagatgcgaatgtgaaaaaggacaaacaagaacatggctcaccaaacttgaaattgcatgatacggaatccgccattgatgaagacagtggagccgacgatgaagcatcaataaagtctgatgacaccacaattgtaagacggccactagccagcggactcaccaccaagccaacagagggtcacaataaaattgaagtatctggtagtgatgctaaggaggagcatgaggaaaatgaagaagtaacacttggacaagatattttcattgattacgagaaaataattttgattttgttgtcgtttctcaaatcccccgaatcagaaagtagcttcaaagatttgggtagcgaaccgcatgagatctattgccaggtacaatttattgctatcaaatggttacgtgatatattggaaatggctccatcaagcatcttaaagcagtttccggaatgtgttggtgttactttgaaaaacatctcgaaaactgataaggctcaggattttgagttgagggactcttttcttgattttaatatggctatgcaactgtttttgtacaagttcaatgatgctagtttagacgagttcaacgaaactcttggtttagacaaggaaaccaatacggagttcaacgaagtcaagctaccacttactttatcggcgatagttaaagagtatttggactctgttagcgaactagctagaaccacaagtttggattggatgatattcatatacgagagaaaccccacggagtttatgtcacttttccaagcggaagcaaacaactttgagttgactgacctattgaaatatgacactagtaatgaagtgatactcaaggtcttgactttgatggcaaaaatatctgaggcaaaccagcaatttttcaagaatttcattgtcaaattggtcaaaatctttgagttggacggcacagaaaagactttcaaagttgagtttattattcgtaagttgtgtgtttcgctaaactcggaattgatattcactgctttgtcagaagtgttgattactttgagtgacttggatttcttgaacaccatgattgttaccttgaacaacatattgctaacttcgcaggagttgttaccgttccgtaagaaattaaaaggcttggattccaacaaggtagaagattggcaattattttcgtcgttatttcaaagctggtgccacaatgcacctagtgcaatctccttatgtttattaacttcaaattacgagctatcatacttaataatcaagaacttgtctgaattagaagtgacatcgcaattattgattcagttagatgttttggtccaattattggaactgccaatatttatgaaattgagattgaacttattggagccagaaaagcatccgtatctctttaaaacgttgtacggattgttgatgattttgccccaaagcaatacgttcatgtcgttaagaaataggttgactacagtaagtaactacaatagtaattctggtccccaatttcacttgtcgactccattaacaacaccaacgcctgcgccaggaactacaacagctcctattccaagcgggagctctaccaccagccaatctattagaaggaaaagaatttatgagatgctagataagtttattaaaatccaagactcccatgagaagtacaataacagtaataagagaatgaacaacccagttggttataaccttgagtcggcttccgtgttcccagttaatctgcttaaatag

SEQ ID NO: 1980 - DNA, 993 bp, Candida albicans
  unsure (946): Identity of nucleotide sequences at the above locations are unknown.
gttagactatatcaaattgtcatgtcatggttaagatatttaggattaaccgttcctttagcggcgttacgtagttatctatatatggcaacaacagcaacaacttcattatttgtattattaccaattgctatgattacttatgatcaatattataaaactttaatacctaatgaatcatcaccaattattccattaaattttactaccactaccatcacttataaaaatttaaaactgagcagtaataataataataataataataacaacaacaacaatcatatttcaaatactaaaaatatattaatatctaatgctataaatccaatttttcaaaattatcaatatgatgatcaattaatttatattttcaatattaatattcaagccatttgtttacctcataataatttacaacatgaaatcacaaaaatcaattatgaattaatatcaagtacaacaacagagactacaaacgacaaaaatgataatgataatgataatgataatgataataataataaatcatttaaacaaggatcaattatattaaattgtgatccatatgtgatttatagtcaaaataatcaatttattccatttaattttcgattttggttaagtccttatttaattgaacattcacaaattaataatataaatttattaccattagaaattcctggtgatcaattgaaaaattggaataattttaaaatcattttaaataataataatgataatgataatattaataatcaggtatcaacaccaacagcagcacaaaatcaagagatacgatatttaattgatgataatttttcatggattcaatttgatgtgaaatggactggatttagatattatatggttaaatattattatagttgttatttaatcgggacaataattttctttatggttagtgctggtgttggatttntcactaattatacaattttattacttaataatataaataaactataa

SEQ ID NO: 1981 - DNA, 1422 bp, Candida albicans
  unsure (150),(1287),(1346): Identity of nucleotide sequences at the above locations are unknown.
atgcctccggttataacaaaacaaccaaaagcttctaaattcttcagtccattcagagttttagggaatgttacagactcaactccttttgccatggggacattaggttcaacattttatgctgtcacttctgttggcagatctttccanatttatgacttggctacattacatttattgtttgtttcccaaactcagactccttcaagaattacaagtttggctgcacaccatcactatgtctatgcatcttatggtgatcgtattggtatttttagacgtggtagattagagcatgaattggtttgtgaagggaactctacagttaaccaattattagtatttggagaataccttattgctaccacattagaaggtgatattttcgtatttagaaaaactgaaggaaagaaattcccaactgaattatacactacaatcagaataattaattctttagttgaaggagaaattgtgggattaattcatccacctacgtatttaaataaagtaattgttgctactactcaatctgtgtttgttataaatgtgagaactggcaaattattatacaaatcccgggaattacaattcgaaggcgaaaagatttcatcaatcgaagctgctccagttttggatgtaattgctgttggtacatctaatggaaatgtatttttattcaacattaaaaaggggaaagtgttgggccaaaaaattattacttctggaactgaatcttcttcgaaagttgcctcgatctcttttagaacagatggagcacctcatttggttgctggtttgaataacggagacttatatttctacgatttagacaagaaatcacgtgttcatgttttgagaaatgcccataaagagactcatgggggtgttgcaaacgccaaatttttgaatggtcaaccaatagtattatcaaatggtggtgataatcatttgaaagaatttgtttttgatcctaatttaacgacttcgaattcatccattgttcctcctccaagacatctcagatctagaggtgggcattcagcaccaccagtagctattgaatttcctcaagaagataaaacccattttttattgagtgcttctagagataaaacattttggacattctctttgagaaaagatgctcaagcacaggaaatgtctcaaagattgcaaaaatctaaggatggtaaaagacaggctggacaagttgtttctatgagagagaaattcccagaaatcatttccatttcatcctcttatgccagagaaagtgattggganaatatcataaccgcccacaaagatgaaacttttgcgagaacatgggattcaagaaatanaagagtccgtagactttggttaaacactattgatggtggcattgtgaaatctgtatgtgtgtctcagtgtgggtaa

SEQ ID NO: 1982 - DNA, 918 bp, Candida albicans
  unsure (136): Identity of nucleotide sequences at the above locations are unknown.
caacttgaagcacctatcacatccatgatatatcacaaactgtctgatctggttgcttgtgccttggatgatttgtccatagttgttattgacgtgactactcaaaaagtcataaggatattatatggtcataccnacagaatttcaggaatggatttctcgcctgatgggagatggatagtttcagttgcattggactccactttgcgaacttgggacttgccaactggtggttgtattgatggggtgattttaccaattgtggcaactgcagttaaattttctcctattggtgatatcttagcgacaacacatgtctctggaaatggtgtatccttatggactaatcgtgcccagttcaagcctgtgtccaccagacacgtagaagaagatgagttttcaactattttattaccaaatgcttctggagatggcggttcaacaatgctagacgggtttttggacgaggattctaatgaagacggcactattgatgaacagtatacatctgctgctcaaattgatgcatccttgattactttatcatcagagccaagatcaaaattcaacactttattgcatttggataccattaaacaacaaagcaaaccgaaagaagcacctaaaaaaccagaaaatgcacctttctttttacaattgactggacaagcagttggtgatagggcatcggttgctgaaggcaaaacttcagaacaaacaaataacactgttgaagaaaccaacagcaaattgcgtaaattggatacaaacggtaaccacgcatttgaaagtgaattcacaaaactattaagggaagctggagagagtggacaatttgaaagatttttgacttacttacttaacttatctcctgctgtattggacttggaaattaaatcacttaattcatttgttcca

SEQ ID NO: 1983 - DNA, 954 bp, Candida albicans
  unsure (9): Identity of nucleotide sequences at the above locations are unknown.
cctataccnctatcgctgttgagacggtatccagttgaatccggtagtgcaacaagttctggttctggttctggctctactagttctggttcatctggaagtgattcttcaaattcaggtagcacaagtggtggatactacactactgtatctcaagctgttcatagtttgtcgagtaatgtgaatccacaagtgttgggaatggcacaagtttattctgttggtttctggggttattgtcgtggttatgttattcaagatgatagcaaaaaaacgaaaaagtttgacaacagtaatgttaactacacttggtgttcggaaccaaaagtttcctttttctttaatccagtagaaatattcaaaaaagaaatgaacaacactctttatggaattcaagtatattctcaagctgctggtattggacagttatcttacacccaaaaaagtgaattgaaagtgttgatcgatcatttagatatagacgagttgaatcttccagggaacattaatggaaaactacaacaattacacaatttgactaatgcgtcctttggattgttaatggcagtcgcagtcttatcattcgtctcagtcttgattcaaatgcttgcattttgcttttccccagaaaaatgttgtttatcatttttaaactttttattcgagtgcatcattggtttaattgcctttgttggggcagttgttgtcactgctacctattcatatgttaaagcccaggttaatggcaatctggatacttttggtgtcaaatcattcttgtcaataaacttctacgcatttgtctggtcagcagttattgtgtgcatcttggttgtctttttcaatttattgggtcattgctgtgggttatttggaacaagaagacattatagaacagtcagaaatccacaaccagatgctgaacaacataaagaagaaactgaaagtgattaa

SEQ ID NO: 1984 - DNA, 930 bp, Candida albicans
  unsure (819): Identity of nucleotide sequences at the above locations are unknown.
cctaaccttcacccatatatcagtttactttacccattcattaatccaattatgacttggatcagaactgattttttgataaaggggaaaattatcaaaccttttttacccaatgataaacatccaaatttgaaaaataaaaatttcaagaatttatatcctggagatcaagttttcatttttgaagttaaagatactaaatgggctagagttcatgccgtgactaaacctctcccaacagattatattgcctgtacagcttttttacatgatttattagttgacaagagtaatgttgttgttgttccattaagttatatcaaaattttgaaagaaatgccatcagaagacattcgaatcagtaaaaaattcaacaatatccatgaaaatagtgaaatccctactattcgtgatacagaattagcacgtcaagaagctgtagatggtactattttgaatgaatttattaaaaaatctgtcccaccaagacccaccaaaagagaccattcacgtgatacacttcttgatgaaattaaatattcattagaattacttaatgctcatatttttgctgtttattctaaaagtgaatttagattatttgaaaagttgacatcaatttattatagtttatatgagattagaactaaattgaatcatcatttattgacatctgaagaagctcaagtggctagagaaactgccactttcttgttgaatagaatacccaagattttagcttctagaagttctagattgggtaaagatgttcttgaattggataatccgacactgaagtttccggttataatctatttnatcaaaagatgcaaaaccggtgaagttttatctttgaaaacagctttaccaaccaaaattaacaatgcaataatgaattgggtgctttgggtcctaatttatcccaattaa

SEQ ID NO: 1985 - DNA, 1089 bp, Candida albicans
attgctcgtattgataaagaaattgctgttgataatgatgatcgtactttacatcttgcggacttgtattctcgtgacgatatgtacacagtcattattgcagtgaatgagatttgtaaatatgagtatttccctagccataattggctctctttacaagccatcattgctgaaagttccttatgtgtgttggaactcctttctccggttattttccataaatatatcatgggaatctctttggatattaacttgtgtggtgaatttttaagtaccttgttaaaattggctatcttggatacagtagctctggaaggcttacctgttttagctagagctgcttctacttccattacttgctctattggtgcaagagtagagttacttattgacaaagtatggggacgtttaggagattatgtcaacaaacacaaacttgaatccagtcttgctacacttgttttagattatgatttgatccacaatgttgttttatacactttaaaatgcacccaaacaaggaaaactggctccaaattattaatttccataatgaaaaattacaaccaaactgaagttgaaagacagtgtattatcagtttatttgacatttattgtaatgggctatatgaaccttgtgaatcggatgaactgggattcattaataatttaaacgaattttcaaccaccaatgaatctgaaactgatcaaataagtatgttgtttgattttgttgcatatctttctcggtttattagggttttaaatcgattaattagagtgccagacaccgttgagtttaatgatgataaagtggtgtataaaatacaggcattactttatttggttaatgttggtgaacctgaaccattacgtgaatttgtcggggatctttataaagaaactattgcacagaaagatcatattcaagctggtttatatttagaattgttggcttctacgttcccttggtcacatggcgaatatgtcactgcttcattgattcccgagttgcccatacaaacaaattttgaaagacgagaagcattacttgaactaagtgcagaacattacatttctggccacaac

SEQ ID NO: 1986 - DNA, 2571 bp, Candida albicans
tatgattactatttgagatacattcataatttatttaacgaaatcgaaacaattgaaacaatcacaaaattgttaaatgaagttacaaaaatattagctcgtgtgccatataaaccatctttgtcgtctagtagtatgatatggctggaagtcgcatcgaaatattgctacatgctagctcgagataaatcaaatggagaaatattgaatttaggtaattcgataccaccaacaattgccaaagctcaagaagagcttatattaactaacaacaattcagtaaatattccaacccaatctcaattaacacttgcaccacataatttcaaagaatacaagaatagtcatcttttggtcaatataacagatgtacagggtgattcatctacccagtcaacagggttacataatttatttcttcatgtttatcttagaaatgaaactaaaagattgacagaaccgtttgttttcaaaactaagtcaattgatgatttacaaaaggttgagactattagctccattctatttagaaatttgccagaagatcaatttgaccaaaatgttttcatggttttcgtacttacagaggaaataagtctaatgcgtagaaagacatttggtaatttgaaatatataaaaaaaggtgtggcagccggtgttatcaatatatataaagtgttcactcaaaaccaaccaaactttcattttgatatcaagttatttggtgctccattaggtggtggtggtaaaaaatcatcgaaatccactttcagttggggggttttagttgacaaattgattcgaggaaatatcgagggacttgttgcttcgagtccaattgttcaacaggtttctgcttcagtaaaactaattaaacattcaccatttggtttatctacaaaaacaaaattttccaagcatcattccaatttgccaatcacaatgataaaaccaatgtttttcgatcctttcacagaaacaactgaaagattatatatattattaggtcaattggcattaaagaaaaagaaaaattctactgatttatattcagtggaaatcagtgcgccaaataatgaaacgattaaattctctcaggcaacaaatcaaagggagaaaaagatatggcaattagttggtgttacaagtagtgaatgctttggagaatttattaaaatagataatatatcattgaaaaacaaaaacaagaaattacccatagatgattatttacaattgacagtttatatcaatggagttttatctggacaggggcatctacattataaatcgggtaacaaattggttgaatacagatcaaaaccacatgctgtagaaatattttccacttccaaaggtaatcaaattgcaagtattgaagtttcttctacatatgttgggaaattatttaattcagaagtcacgattgataacatcttagaatatgaatccctatatcatagtggaactcctggtattgatggtctttctagttcattggaattattccaaaaagtgaaaaagaaacatttgataagacggtttccagaattgttgacttcgttatttggtataattataatatctggtgctgatactgattccactaatttacaaaatttacaggaaaacacctttaaagcaattgtgtttttattgaatagtgtacttttcaaaccacaacaacatggtcattttttgcaatgttttgaagatatttttattaatcaaccgagaattgccgtgtttttatggacaaaattgcgggaagtttattatcgtggtgaaacgatttgggattcatattccaaatctgttgccaaagttcaggagatattgattcgatttgccactaaatctattcaaggaagctgggaatttgaagaatataatgaaactgtggtgcaatcctacagagcaatggcacattttctttcgatgaaatcatcattattgattgaagaccaaataaatttgttaggaatagtggaccttatgttgaccaataccatgtattttgataaaagagttgttctcaattggtatgaaacatttattgatgctattagattgcgatcttttggtggacatgagaaactaatggaggatcaagaacataaaattcagatttccaaattacttttgatacttcgagtattaggcacagaattgaacagagataaagatacaagaagtaccgtacttttaaaatccattgagtgggctgttgaaggtttccctgatgtgacagatattgaaagtgtgcgactcgcatgcagtattcttaataaatgttgtactgttatttatgaattattggttgaaggggaaactgatattattgaagtttgtcattttcttttcaaacttttgcctgctttgtcaaggacatttttaaaatatagccacattggtaacctggcacagcagaaatcttttggaacacaattattccctcaagtatacccttttgaaacggttgcaattgatcagtcatttaccgatgttggattttgtgaagtattggtagcactagcagttttcaccacaagcagccagatccgcacttaa

SEQ ID NO: 1987 - DNA, 2955 bp, Candida albicans
  unsure (557): Identity of nucleotide sequences at the above locations are unknown.
ttcttattgactaaagttgaacaaattttcaatagagcaggatcaagttggaattcggtttctagatcagtttgtcgtgttctttcgattattttgagaatttcgattttatcaatgaatgcaccaaatgaacaagatttatatttacaaacattgaacaatttatttaaatcaattgcttatcttcttactttggattccaccaacatgattgatgatcaagtacttgttatggatattattgattatatttttgcctttgacgtcaatttcaaaggatcagaacttgttcaaataatgatcaattgtattgattctattggtcttaaaggtgtgggagttgatgaacttagtatggagtcaactccggctggttctcgttcaattaaagatcacaagatcattattggtaaattattattaattttgagattactcaattctgatttagtcaaagaggaaagtagtagatgtattttgattccaaaggcaatcacatgggccgttgatgtattccttgcccctactgatattgaggcaacaagattggcatgtantgtgcttaatgctgcttgtacagctttatggaatgatggtgtcattggtaaatatcaaggagatatggagatttgttattcattggccaagtttttacctgctatatcgagaactttcatcaagtataacaagtttactagaggtaatggttcattcaaaaagaaacgtgtgttcactcaattgttcccatcaacgtatcctttcattgaattttctattgacccggtagttaatgatgaaagtatggttgaagttttagttgaacttgcaattacattttcatttgttgctagagtcgggaaagaagcagcaggaaatgagggttatatcacaattttggattcacgaattgaaaatgattttttcatcccggaaaaatatttggcatctgatttccatggtgaagatatacttacattactttcagggattagatatatgagattgggtaaatatttccctgaaaccaaatggtattcgacatattctgtcattattgaaggttgtttatgtgctattgaattggtgagaccattagtgattatcaatcaattaccagcattggatgattctgaatcatttgatagaaccctttgggggaactatcttagaagtttgtataaattgaccgtgttaccacctgtggcagtcgagcatttgtctgatgttccaaaaagtgcttgtgccaaaataaccaacgatgttcgtaaacgggctgcatttttaattaatgaagcttgggattctttagcttgggatgcaactgatgaagatatgcttagatttaatttgaaaaaatttggtggttatcaagttgaatttattaatgatgaatttggaatcttgcctgatttgatgttacttggattacaaagagatagtgaatgtcaaagtgttgccatcaagattttatggtcgatcatgatttccgaatatattttaagtgatactcttcaagatgttgaaagacaatgtttacttggtttacatgaaatttatcataataattcttataaaccaacgtcattggatcaagaaaatttcattgaaagaatgaaaatgacagttagattggatagagaagatgaagcatttgatattatttataattttattcaaaatctttcatcatttttcggtactcttaattattatattagtgtaccatttggtcctgaatatgaagaagatagaattttccatgaaattaaattgaaagcacaaattaaaaatgccgggaaaccagaacttttcaattcttatattcatcaaatgtatgaaaagtatctttctcaaaatgattatgttcaggccgctttaagtttggaattacttgccagtacttattcttgggatcatcatataattgtaccagcaagttttagaccaaaattcccagaacaaagttcatttgaaagaaaagaaatattattgaaaatgatagctaataattttgttaagggaaatagtcttgaaaaagcagctgatacttataatgaattattagattcatataatgaacatacttatgatttgaaaagttttgcttatgttcataataaattggctcaattatatttggatatggaatcttcagataaattaacccctacatatttcaaagttgaagccattggtggtgggttccctacttatttgacacaaatatctcaaattttccaaggtttgccatttgaacatatcacatcaattcatgaacgattccttaaagttttccctggtgctaaaatcattagtgatgatgctgaagctattcgtcttaaagaaaaagccactaatggaagatatttatacattaaaaccgtggaaccagtttatgagttttctgacaagttgattaatacttcacttggggtaagacaatatgctagaaacaaagatttacgatttttcaccagtttaaagaaattcccaggggctacttcggtgtttgatttatggacagaagaaactacttatgaaacatggttatcattcccaactttaatgaatagaagttttattaaagattcaaagaccgttaaattgtcgccattggataatgcagttagaacgatagctgccaagaatgatgatttgattcaattagaagcgtttatcaatgcagctcttaaagaaaaaactgattattcacattatttcaatgatttatcgagacaattggcaggtacggtggattcgccagtaaatggaggggttggccaatatcgtgcatttttctccgatagcaaatatcaaattaatgaaggaagtattgctaaaacagagttgttacgtaatgcattcaatgatcttgctattatcttgtatcgttgtttgaatttacatggtagtttgattggactagtcttcaccacgggtcgaaatccgcgtcaa

SEQ ID NO: 1988 - DNA, 948 bp, Candida albicans
aaaaaggtcgttgccgctggtgtagctgatatcaccagaattttccttagagcagaaggttcacttcaatctggtgaagcccataatttttcaattaaattgtttggttcttatttgagtaaaaaaggtcacaagaatatggtggaagatctcagaggtcatagtcataatggttggggtgaacttgttgatagaattattgctggttctagtcaaggagtagctgttaatccaagagcagaaaaattggtgatcacagtaaaggaatttaaacatcaatttcaaggtaatgtggccaatcaattatcatctagtgcaccaatatctagaattaaaccaattttctttgatccattggcggaaaattatgaacgtatttatttgaaaatgggtaaagttactttattaggatctaatgccagagaagatttattgacatttgaagtcagtactcctaataatgaattgattacctttgccaaggcctccaatcaacaggaaaaaagatattggcaatttatatctgtcttccccggtgaatctattggtgaaattgttaaagttaatggagttgcgttgaaaaattcatctaaaaaattacctaaagacgattatattcttttatcattatatgttaatggggtcctagctggtgaacgaagattactttataaatccggtaatagattggttgaattcaataagaaaaagaatcataccattgaaattatttccgcaacccataatgtccctatggctcatattgaacttagtactgaatacgtcggtaaagtttataattctgacgtttctattgataatattttccaatacgatagatttttccaaaaaggaaaaaaacgtattgatgaactttctaattcattggttgctttcaccaagattagaatattgccccagttgttaaatatttcccagaattattaa

SEQ ID NO: 1989 - DNA, 981 bp, Candida albicans
tgtacgtttattctgaaacttgatatcagtgtttgtgataatattgctttactaacgagaatttcaagtatctttaccaggaaatactccagtgttccatattacatgttcttaactagtttagtatttgcattcgtatacaagttttcggtgtattataatttgcctaaatcatggaagaaaatatcaagttcagatattgcactagtcacgggtgggtcgaatggattgggtttaggtcttgtcaaagaacttttaaggagaggcgcatctgtatacatctttgatgttagcaagccaaaatttcagcacgacaaccttgtatatgtatactgtgatcttgatgacgaacaaagtgtcaacactgaacttgaaaagttgatagatgagttaaactccaagaacacatggattaatattttgatcaacaatgctggtatcagagacaacaagccattgataaaattgagtggcgatagagtgaaaacaatgttcaatataaacactatgctgccaatttggattctacaaaaggtgataagtaatcacattgacaaagtattatctgttcaacctgatggccaattatttgttgttacagtgtcttctatattggggactttagcacccaaaaatctatcggtgtattcagctaccaaagctgccactatactgatacacgaggcattacaccaagagttgaaagagtatctgaataatatcagattgttgttggtcaccactggtcagatgtctacagccatgtttaaagatgtggaaccctcaaaactattttttgcccctatagtcaaccacattgagttagcaaaacttgttgttgataagataaacgttggctacgtaggttgcatatcaaaaccgttttatgcaaactttttgccgggtgtccgaacagttcctcagtgtatacaagacttttgcagatacatttctgaaatggacaataaaattaaagaatag

SEQ ID NO: 1990 - DNA, 1383 bp, Candida albicans
atggcaaactcgacaagtaatcctgctatcatcatggctaaagacgataattctgtttctggtcagcacaaacaatccctgcaaaaccaccgttctaaacaaacgaataagaaccagaaaagacaaaatagacaaagtcggtacgatcattctaatgaccacgagttgaatattattgaatcacaattgaagaatgggaagaaggtcaagggctccaaaaatcaaatctcgatcaaccatttattagaattccagtcataccgcgatctggaagaatatcgcagcaatcagcaacggaacagaagacgtagaagcagtagtcataagaggccgtattctcacaataagattcaattaacggggatgaggtttataaacgttaactttaaatttgttgttgatggtcggaaagattatagagtccaagaattagatccaaatgtccctgttgatacggacgatattatccgaatcattgctccacgggggaattcgtgcccaatttgtttgactgatgactttgtagcacccagaatgatcacttcgtgcggtcatattatttgtttgaaatgtgtcctatccttgttgggtaatgaagttccgcaggctaaaaagagagaatctgcggccattgtggaaaaatatcgagaatgcccgttatgtttttctatcattagaaagcatgaactaaaacctgttttgatgaacaatgtcgatgagcggtttgaagttccaaaagttggcgacgaagtggtaatgacccttatggctagaccgatggatcaaatattagctttgcctaaattgttggcatttgatagtcatattagaggttttcctgatacaaaacagtttgagcttttgccgtatctgagaatatttagaggagactcgcaatatatacttgaaatgtatgaagaagagaaaagagatatcatggctgcctatgaagaagagaagttggtgtatggtgatgactccagtttggttgctgagtcaattgcttatattgataaagaggttgaacagtggaacaataaattgttgcaaaatgttgtgaaggagccaaatccttctcacactacggataatagtcattcaatttactatttctatgaaactgggttcaatgcgggctgtacgtacgtattgtcaccattggatatgaaagttttgaagacaacctataatgattatgcaacgttgccttcatcattagttgcccagatcgagaacattatatatgaagaattgactgctgaaacttcaatgaacaggtacaaatatttgagccatttgcctttgggttctgaaatacgatttttagaatgtgattggagcaatattgaaatccctagtaccgaaacttggggagatttttaa

SEQ ID NO: 1991 - DNA, 2040 bp, Candida albicans
gatttcagtgccgctgctgataatgatgatgatgatgatgatgagttattcttgtcgtgtatttgtgccaaatcattttatttatcccagttttaccaagatataaatgacattttaccactatttgagaatgtttcatttccaaaattcaatacttggtttaaaggaataatacttccatataagtactattacagtcattttggtttggcctatagtaccaatacacttaacagctacctttctcctgaaagttcttattcactgagattgcatcttttgcttggtccgttaaagacagaaaaaattcttaacaatgaaggctggtttaaaaatgtgatatttccaatcgttgattattatggtaaagatctccacccattaaatgagtggttatttgataatgaaaacggttactgttccaaacctgttgagagtgttgttagaaaataccagttttggcatgtatgtttgaaatgtattcaccaccactacgaccttaaggattaccagataattttaaactcattcttgagtgcatgttatttttatggattcaaagaagacactgattctgtgtcgacgattgaacttgtggaaatatatgatttgataattgacaccataacactctttgatatacatactgaggagttgcgattgcctgatattgattataaagacattccctttgactgccataacttgaaggagttccaatcagccacaaatcccatttctccattgttccagatcggagctattgcatatttaagacaagttatagaaacttgccagaaattattacctattaataggcttactataaagaaatatttccaactcaagtaccaaaataaagagatggatacaaaaagagaaattttgaaaatcaccaacaacatcaacgcctccaactggaagcagttattaaattcaatagccttcttccagaagaattttattttcaatgaaagaatttctgccattgtaatcgaaaggcttttacttgcaaacttgtttgacgtagtcgatgaggtatattttgagaaaaagttgggtgatattactgttaatgaactatatgatgttgtattagataaattttgggattgtatgaaccatgcaaacagcttgaatgataaatctggactgcttcataatgcagagctatgtttgaagttgtttgataaattggtcctcgaaaaagatttggcagaagataaccatcgtgatattgtcaagttcaagcatttgttcaaagccataaatgctctaaaaaggtttaaacttctaaatcgaaaccagccttacactccgcagcaattaattattaactttgcaaatggcaacatattgaagctaatcaatattgtattggagcaaaacccaaagtcatatttggcctttgataagttataccgaatcttaaatgatatgatattgttttataacgatgataaccacaaggatggcaaacaacatgcagataattattattttaataaactcaaaaccgcttgtatcgaaagtgctttaattgataataatttcaactacgcctacaagcagagtttggaattgtttgattacttggatggcaaagaagatagctctcaaatagatgacttgtggttgacgttttatcaagttggaaaatacgtctctcctctgtggtttgagaactctggagaacaagtggacttgggcatattgactaaacagagagagattctatccttgactattctcaatttgcaattaaaggaaaatagcaaagttgtcttggctcaatggatgtcgttaaacgataaaattcagagacatagtttagaaaataacattgaagctgtgaaagaaaggtttgataatgaaaactcgcaattcaaacactcaaagaaacatttggaaaatattggtaacttggccacagaaataatcagtgatgcaagtaagactactaacaatgcaagtgaaaaattatcaaacttatttgtttctggtcttggttgggctattggtgctaatcaacagctgtga

SEQ ID NO: 1992 - DNA, 1395 bp, Candida albicans
cgattttgtgtggaggatgatccatttgaaacagaattgggtatgatatatcaattagggaaagttgaacaaagaaaaagactcgaactttataatttgtttgagaccaaagcaagtactagccacattgatactgaagaatattttgacaatttgagtcgattgaatcgcactatatcccagtcctggatccgtaaagtgaatgtctataaaagcaaattaagaagtgagattattgcaaacaaagattatttgctcggaaatgaagttaaattagatgagtccttgaatgatgatgtggtaacatacgcatatgcactgccactattctcagtctatatggataagttccaaatagacatatccaaaccaaaattcaatatcgatgaagtcgccaattttatatacgattttggtcaaggagtacccaaaactactgaatacactttattgatacccatgtatatggctctacaattaggggaattgagaatgcacttgagagattatcctttacctttattgcattctccacgtaacaaagatatggatgagacaagtttcaaattaaatggccatttggtgataagtgaagcatttgccaaagttatagaacatatgagacaaatcgatgttccgatagtaccagtacacaaacataaacataaacagttgaataaatttgagtttttggttatggaagaaactttggcgagtgtaaagttgtacaccgatttggagtgtgtttttaattcaaactatccaacaagaattgtttggggtgcttcttacaattttggaattcaacagatgatggcaaactttgatcggttttcaaaaccaccagtggatccatctacaaaattaggattttgggataagttaaagtatatcttacatggtaaatgccaaatcagaactaggaaaagtttagaagttgcatttaaaggatcaagagatccgtatgatttgttcacgactgcaggcgggtttgtattgtcatttagaaagaatgttgtctgggacatcaataaagacgataattcgaaaaattacttcgatatcacggcagataaagtttcctggtatattccaaactatttagcaggaccattattggcttggacaagaagtagtaaaaattcaatttatttaccaaattcaccaaatgtggttaattcttgctttgcatattaccttcaagattttactggacaagctgattttgatcatgctgcccgagtatttgaaagaaatgtggtcaatcttagtggaggaattcattttcaagttgggtttctacttgaacgtaaagatacaaatggtaagagaaccgatgaattcaaacctcattacgatcttctccaaggagtcgacgtcccgaataagaaccca

SEQ ID NO: 1993 - DNA, 1149 bp, Candida albicans
  unsure (1142): Identity of nucleotide sequences at the above locations are unknown.
gtttgctacggcgggtctgtagatgttgatatcgatccggatagaatagaaagtattggtttaagagccaaagtagatgattttatggttgatttacatcaaagaaaagagccagcaaccctttaccatgaagaattatctaagaatgagaaggtgatgaaaatgaattttgatttaggagaagtcgttttatcaggaatagacttacgtgtcatgcatgtttcatttctccaaaatttatacactcaatcacattccaattcaggtgacgctaaatcaacttataatatttacgacaatgatcatcgatggtttgatattatggatttccaagaggcatttttgacatcaattaaggattgcgtcaggacagttgatatttatccattgatgtatttacaaagattcttttatgaaagagatacacatggtggcaagtctgaggatgagactgcatttggaaaagaagttattcataaatgtaatttgggtgccatgaatcccttggaaacaagattgaatgtattggttcaaagacttaacgctctacaagaacaagtcaaaaaattgtccaaaacatctgctccagaacctgtagcagatttgaaaaaacgaattctgtttttgcaaaaagagattagcacaaccaaagctagcgttaagtcgaaaatgcgtcgtacatccactataaatggtatgaataattctgaaaattaccacaataagtttactttctataacatgcttcttaaatggaatttcaattgtcggaatttgacattgaaatacatacattttgtgaaattgaaatcacagcttcgaaattacttgtcacacaagtccattgaaacacttgaaaaaatgatggatagtgtaaatgcatacaacgatgaggacgatttgtcatcgacgtcagaaataatccgtcgtttcacactggaaagggttaaatcacagacatctaccagcaaagatatcacttcacaacagaaacttgacaatttcaacacaatattacgagagaacagaccagacgatgaagtggttgaggattatttgattgacgtgatcgccccccccattcaattacaaagtgaggataatcctgattctgttgtgctcatctctacaccatctattanaagttaa

SEQ ID NO: 1994 - DNA, 801 bp, Candida albicans
ggcatggtacaaggtttcaatttgcaagaaggagccaaatatcctcaattattgggtcctgatattaacgaggagaagaagaaattggacagttgccataatgaaaagcccataatctccatgtcttggacagtgttaaatgctgttggtgggattcctataatcaaaaatgccaagttagagacccaacgattgcagttggagttggaatatgctaccgctaaaaaacttgaaagctatttgttccctaaagaagcaaataccgaggataccgatgagcaagatggtgatgagtttgatgacatatatgttaacaatcaacaaaacagcatgtctgatagtactagtgatattgagttgtcaagtaacgattcggtcttatccagcaaaaacccactaaagagacttatgtcaaagagaagcaatagactgccaaaatcgtcatccgattcagcaactagttctccacaacagtcattatctttgaattctggtgttagaagttcaaatagttcggctttaagttcagatgagatatcgtttggtagtggcatcaaattaaaccgaccacaattacatctccccttgcaaaagaaaagagagcaacaacatgaagaaaatgatgatgaaatggaagttataatagctcgatctttgaaattcacatcgttgattgatattgaaattgctaatttccaaatgattataagtttttcagcacccagtacattgcatttacttgatgttcatcgtttggttataaatatcccaactttgagatatgttaataaaatctggtct

SEQ ID NO: 1995 - DNA, 1059 bp, Candida albicans
attttccttttcgtttatatttttcattgttcaattttacaaatctcatatttgattagttttcatcttcttatcattataatcatgcaagattcatatactttattaagacaaagaccaaaactggataatagtcaaacttcaaccgagttagaatccactccattactgaaaagattacattattatcatgaactagatgaatggcaacaagataatcattttattaaatcaggttatgtcaaacaaactaattcatataaagaatgtttcaaatcattaacttatttacataatgaatccgtcaatatttattctcatttattacccctgagtatatcattttgggttatattatattatattaactatatcttacctaaatatgataattatcttggagtttgggaaaaattgaattttcttcaatttggattggcatgtacgttttgtatgtttatgtcatcgactttccattgtataaaagctcattctcatccagtatcaaaatttggtaatcaattagattattttggaattgtcattcttatcacttgttcattaatatcaattatattgtttgcttattatgattatccttggtatagaaatatttttgttggattatcattgtttttcgggaccgtatgtacggttttaacattggatcggaaattttcaacaaatgaatatcgaccatttagatcatttatgtttatactatttggattatcaggggcattgcctattgttaattcaatgtatatgtttggatttgaaatcactagacaaaaagcaggtgttgaatggttgattttggaaggggtgttttatattggtggagcagtattatacgctgctagagttcctgaaagattcactcatgttgaagatgatgaacatacattattaaataatccactgagtggtacattcgacatttttggtcattcacatcaaatctttcatgttatggtggtaattgcagctttttgtcattggaaaggattagtacaatcttatcattatttgcatttacaaactttgccaaacttgtaa

SEQ ID NO: 1996 - DNA, 1347 bp, Candida albicans
ataatcatggcagtacagttaaaatggcccatattgggagtgattattccttgtataatcattttttcattatcttatggatcacattattttattcttcgacaccatttaacaatgaaacaacaattgatttatgaattttatgtgactatgatatggatatcttatttattggcaatatataccaatcccggacgagtcccaaaaaattataaaccatctttggcgtcgtctacaagaattgaacaaaccgaggatgattctgatgggttaggtctagaatctagagaagatgaaaccctaataagggaggaaccaatcagtggagatagatgtgaatggataaggtattgtaagaaatgtaataattataaaccaccaagaagtcatcattgtaaaatttgtcaacaatgtgttttacaaatggatcatcattgcccttggacattgaattgtgttggaaataataatttacctcatttcatgagatttcttggatggatcatttggggtacaggatatttaatgattcaattgattaaactaattattaattattatgaaaatctgaatatgccacactatttattcaacaagacagaattagtggccataattgctattactccattaaatttttttgtctttgctagtatattggtgttgttcattcgatgtttgattaatatatgtaaggggatgacacaaatagaaatatgggaatgggaaagattagaacttcaatggtcaagtaaacgattatggagattgattcgattcaattatggaagattacataaaggtaaaccatttcctgaattgaacacctggactaataccaccaataatgtcaattataacgataatgatgatgatggggatgaggatgttgaattaattaatttagcaaccaataataatgaagattcaacaatagtgccacaaaatttcactattgatgatttgatatttccttataatttaggaatatggaagaatttagtaaatgctttgggttatccttatatgtggttaataccattcggtaaacctaagagtaatggatatcaaccacaaatttcccaagattataaacaagatgatcaattgaatttaccttggcctcctgatggtattagacaaaaagaaattgaaattaatgtgctacaacaacaaggatatcagcgtgatagggaagaggaagacgaggaagaactacgtagtattagaaattatcaagaattgagaagaagattagatcctagattgaatgttcaacgttcagatttcattaatgatatgggagaagggttaactgattttggtgttgatgaagatagtgattaa

SEQ ID NO: 1997 - DNA, 1020 bp, Candida albicans
acgtggatcttccacggctggctgatatcagctaatttagaagaaactgaaaggactaccaataacaatgataatgagtctgggcaagtggaagtggaagtagaagcgaatatagatgaggacgtggacgtggacgcggatgcggatgcggatgtggatgtggaagaagaaattgtcaatgatgaagatgatgacattgaacttatttgggataataaaccttattacactaaggggattgatattgcatcagctgtacttacttcaatttcatatttatcatttgtatatttattaactatccattcgggtctttcattaccattatcaatgttacaaggtacatattcgtcaatgagacgtgcttgggtagaaactaatcaattattggcatttattgaatcttcaaaaagattagatactcaattagctaatgctagtgctgaggatttatcacaatctgatagtttatgtattatatgtcgtgaagatatgcattcagttgaagattatcaaagaattttcaaaaaacctcaatcaccaagaagatctcctaaaaaattgaaatgtggtcatattttacatttgggatgtttaaaagaatggttagaaagatcagatagttgtccattatgtagaagaaaagtattttctaatgatggagcaactaatgccactaataataataacaataataatggggagaataatcaaaataatggaaatgtaccaccacctcaaccaggtgatgtgcctgtaccaccaccagctcccacagcaacagcaacagcaacagcagctgcggtaaatgctgaattacaacgagaagtgagagaaattaatgatttattacaaaatgccgaaaatacaatagcaccgcaagaacagcctattaacactgctgctgaaccaattgaaggaccttctagaacaataccattaccatcatcatcatcgacattaccaatacctcaatctaatgatttatcacaatcaatcacattaccaaaaaatgcatga

SEQ ID NO: 1998 - DNA, 609 bp, Candida albicans
accaatcatcaatcattattaataaaccccatttatacattctatttccaaatcatgctaataaataagactcaacaatatatcattggatattcttcaatatccattgctctactaagttggtcaatttatgattccttaaggaaatcatttaattttgttatgtttttagttgaattcactgatgggatcaaattagggataatagttaattttataattttcttatttttgatcattgataaactgcttcaaattttattatttggatcattaagaatgattgaagttgaacatttatttgaaaaattacctatatttgtcattaatttattattgaatttagctacgggagataataatattattatgaatgtatttttaatgggattatcaatgagttttaaagttttccatgttataatgtttgatcgattagattatgttaatttaattattgttaataaaattaatgatgaagatatttatttaaatcaagtaatttatcattttggtacatcaataaatttttggttaaatatttttttcatatttgctgattttagtcttgccaaatttttagtttatgatgttttcccaaggtattaa

SEQ ID NO: 1999 - DNA, 405 bp, Candida albicans
ctacacacaccactgatgtcccaagaatatataaatcccagcacattaaactcttcgaattcattgcttatagatgaattaactgaatcaaatgatttggtagttttggaggagcaattatcacctgatgaagtgattctcaacgctgacattataaatacagagcgcttgattgaagaaagtagatccttagaagagcaaccatcatatgtcattgatatttttggaatactaaagaaagctgccatcaatttggttctaccatttattaatggtatgatgttgggttttggtgaaatattagcacatgagattgggttccgttataattggattggtgcaagagtcgagcctccaagaagaatggtgcagaaaaagaatgagtctgcttccaagtatttgtag

SEQ ID NO: 2000 - DNA, 1161 bp, Candida albicans
cagcaaccaataatcatgaactttctaattagaaacactattattggtcagacatgcaattccaaacaaatattctacaagcatgctagaacgttggctatcaaatcgtcattgaccagttctataagatatcccttgcagccaagtttacacaacaatctcaatgccaacacaatcaatttcccgttggtgaaatcgttcataagacacaactcaagcaaaccgcagaagtcattactgctgcctgaacaaataaaggaaaaagcattagagacgctagaaaaatcaccagctactgaattagtacacaagacagcagaggaaccaaaaaaatctatttgggaaaaagtcaagcatgaggcaaagcattattgggacggtacaaaattgttgggatacgaagtcaaagtgtcaactaagttattgctcaaattgatggcaggttatgaattatcacgtagagaatcgaatcagttgcaaagaacaattgttgatgttgtcagattagtcccattcgccatgtttgttattataccatttgcagaattattgttgcctattgccttgaagatatttccaaacttgttgccttcaacgtatgagtctactgttgacagacagaagaaattggctaaattgaagaaaaccagaaaggctgcttctgagtttattaaaaatactatggctgagagtggcggtttgaaattactgaaaaaaatcactgaccaagaaagagaaaattttgtgcaatttttccactgtatttccatgggtaagaacccagatcgtcagcaattgattcaagttgcaagattatttaagaacgatcaagttttggataacttgtctcgtcctcaattggttgccatgtgtaattatatgaacttgagaccttttggtactgattcgattttaagataccaaattagacatcgtttgttgaacattatcaaagacgataaggttattgattacgaaggggtcgacagtttgtctatacttgaattgcaattggcatgtctgcagcgtggtatcaaaacaagtgataagtctcctgctagattgagagatgatttggaaacatggttggacttacgtttgagacagaaaatctcaagtaccttgttaattttgtctagtgcatacacgtatggagaataa

SEQ ID NO: 2001 - DNA, 546 bp, Candida albicans
  unsure (521): Identity of nucleotide sequences at the above locations are unknown.
ctcggttccttcgaggcccgtggtgaagactatttgagaaataatcctgaagcgattagtaatatcttgaccaacttcgacaagagctatgtggataatttgtttgagcaattagcgaatgaaaatgatgttctacaaaagaggattttgggtataattcaagctttagtccaaaatagccattttgtaagacaatatttttcatttgaccacagttccgggttaaatgatttaatagcgatttttcccaaacttggtccaaactcaaagtccagggcaagtaacattttagaggatttacaattgttcccagtaacaaacgatagaagatcacttgaagatcaagatcctgaatcacaggtttcaaaatttattcagaattcctttgttggaaataaacttgacgagaagaatttcaagtcttattttgatcaactagtaaatttgcatcagctgaataagagtttgcgaccaagtggtgactttctcaattggttagctgaagaagtggagtcgcgttnagagaataacaaaagagacgattat

SEQ ID NO: 2002 - DNA, 852 bp, Candida albicans
cacgacagaaaggggttgtactattttgtaacacatcccaccgtttggcccttttacataaccatattgatacctcaattggtccttacactagtcatttacctgattatgttttcattgttcttcccacctcaagctattgtatatacattgttaatgggaccattaggggtgattggtgcgtggtatagtttgatcctgcaagcgagcacattgtctatatttgttgtcacaatatccttaatgcctcacatacaacgagtggcatatgatgcaatattgagtagagagtgtgcaaatgatgtggtactaatgggaaaacttaggaggtatagaaaactacccattagagtaagggccagagaataccttaaggccattccagatttttcgatctttcccttctctttgctcaagctacttgtgtttttcggtatttacttcataccctttgtaggtccaatcattgtattgtttttccaatcttccaagcgtggactaaaggcacatgcaagatactttaagttgaaagggtttctgcgtagtgacataagaacaatccacaagctaaacagaccagcatatatggggtacggagtggttgcgctttggctcgagctgtttccatttatcaatatgttttttatgttcaccaatactttgggagctgctttgtgggcagttgatattgaacaacaagagaaggccgtcacagagaatgtggccgcagctactaccaccgccacagatacgaatagcgtcaatcaacaaggtctagttatacccgtacacaatgaaccagcaactaatatacctgaggctaccccaaaaactgctacaaataccatctaa

SEQ ID NO: 2003 - DNA, 1929 bp, Candida albicans
aaaatcgatttcaaatttcctttctcatttatgtctaaaaataaactatcttcactaggtaatcatggtactactactacctcatccttatcctcatcctcatccataagtaacaatacttctattgccagaatcatttttgttttttcaaatattttaaaattagtacaatcaattcctattggtcatattacccatggaaatgttggtggcgattattctactgaaactaaacgaccagtattaactcctgaagaattttatatgaatttattcacttcgatttttcttgttttggctggtggggtatttgctggattaactcttggtttaatgggtcaagatgaagtttatttaaaagttattgctcatagtggtgattcaactgaacgtaaacatgctaaaaaagttttacaattgattggtagaggtaaacattgggttttagttacattgttattatctaatgtcattactaatgaaactttacctattgtattggatcgttgtcttggtggtggttggccagcagtggtgacttcaacggtttctattgttatttttggtgaaataataccgcaatctatttgtgttagatatggtttacaagttggttcattatttgcaccatttgtattggtattgatgtatattatgtatcctgtggcttatccttgtgccatgttattagatcatattcttggtgaagatcatggtaccgtttataagaaatctggattaaaaactttggttacgttgcataaaaccatgggggttgaaagattgaatcaagatgaggtcactattattagtgctgtgttagatttaaaagaaaaacccgttagttcaattatgacaccaatggatagagtttatactatgagtgctgatgcccttttggatgaaaaaaccgtggaagaaatttttaatgctggattttctcgtattccaattcatttacctaatgaacccactaattttattgggatgttattggtacgggtattaattagttatgatcctgaagatgcattaccagttgcttcattcccattggcaacgttaccagaaactggattagatacatcatgtttgaatattttgaattatttccaagaaggtaaatctcatatgattgttgttagtgaaaaccctggtgaaccaactggtgccgttggtgttttaactttagaagatgttattgaagaattaattggtgaagaaattgttgatgaatctgatgtttatattgatattaataagaacattaaaagaaaacacccaggtccattggctaaaagaaatttgacatcttatttacatacattatatcaaagaaattcttctagtaatccaaattcaaaaagaaattccattgattcatcagtttatcgaaatgcaaatgcaaatgcaaatggaaatggtggaagagtttcaccaccattggatattagtgaaagattaagacaaggttctgaatcaagtcaaatttcatacacaacaaataataacaacaccaaaaaccgtaaacaacaagatcaaaatgaagtagcaggtgctgctgctgccactgctactgctgctactaattggaaacctaaaaatcctgcttcaaatccattagaaacgaaaaagaaatttgttaccatcaaaagaccagatcaagataaaattgaatcgatgaaaaaaattacatctcctaaattagtgccgacacaagttggaaccatttattctacggaaaagggagcattagaagaagctcatagaagatcattagatgaaagagagcatggacccaaatttttattaccaatggaaagagaaggagatgtatcagaaattaatcaacaaaattatcatggtgaaaatggttctcatcatcatattgatattacccatgaatggcaatggcaatggccatggtaa

SEQ ID NO: 2004 - DNA, 2277 bp, Candida albicans
tttcaatatattttcatcacactatttaccttatcgaaccggattgtatcgtttagcactgacatcccatgggaagcatttcaacaatttcttcaatcacgagggattcaacggatcaggaaacaacatcgtcgtctgacagatacaatccgtagcagagctacaagtgatggaaatgtccgtattagtactataatgagtaatattcgaaatgaaaacgaagtacatttttctgattctgatgatgaagtgataattgaagatgaaccattagggataattcaaataaataatgagattgatgatgattttgatagtttttataataccaggagtgaaagttttggtggtggaaggaatcataactttatcatttcagatcgatgtaataatgaaattgataaatcatatgaatatgtggcagcacaatctaccactacactgattgaaagtgtgatacccgatgaactgtataaagatagatttgaattcaaaattccaagtcaagatttcaaacatgtcaactatacggctatggatacttccgattattccaagattttgcataaatcaccttctgataaatttgttaattttttgaagctaaaacattttggtatcaaaaaattatttgctgaagatttccggaaatttaaaaataacctatcaacaattatttctgatggtatggttgagtatctagtgttaggattgaattctgaactaatagtttttggttttgatggactaaccaacttaccatccaaacaattgcttcgaatagacacacgtccaatgtacacctcaagcactgatagactaatatctacatggccatattttccccatactatcaattatttgaagactggtaatttcaataacaagcaagttttgggggtatgttctgatgatggtaccttgtttatatggtacactgaaacaataatcaacttagtgaaaaaatttggaaactcaaagaaaccgcagagtaatgacaatgatcaagagactgaaaatccagtggcaacagtcacgttatcttctacagcgtcatcatcagtggcaacacctaccattgttaaaccggattttagaatcaaaacagaggcttcattatggggtctagatttcaaaacttataatggacacaatattctagtagcttctgataactcacagagtgttgttctattgtattatcacccagtagatgaaagattctataatattaagtctcatcaaattttacataatattccagatatctccattgtgtcatatactcaaaaaggagagcgacatacagtacaggtgtcatgtgtgtctatatcaggagaaatcattgtgtttgaatttaattttgcaatagcattagggcctttaaataaagaggaatttgaatatttcagaaaagaaccttattattatgttgatgcaacaatggaacaattggagaatcgaaatggaatagattctcatgaattggctcaattaaagctgaagaaatttagacgagtaaaattcgctgaaccattatgtatttcaagagttgtattgagtgaggactgctggacagttaaacccatgagctctaaatggtttttgccagttgggtcacttaaagatgtatttggtgacgatagtatcgacgagtcacgtgaattgaaccgtataaggtatgaaacacgattgcttaatgctctgagtggtaaatttcaatttttccctagtaagacggttaattttgagtctcgattggaagataattgtcacaacaataccagtactaccactaattgtaaaccaactaccgttgatgatgaatacagaagaatacataaagaattagtgaatgggtctagtgatgaatttttgctagtgtctactgctaagaagttgtcaatgtttaggttcccttcacttttctgtaattgttcaaccctgaaaatatttgatttagcaataccatttaatgaagaaagtaagttcaccaatcgaatatccattagcatggttgtacctgaacttctgtgtttcattgctgctacccaacaaggattgataacaattatgagattatgttcatatcaaggggtttatggtatgagacaagaacatattttcccaaacgcattgtcgttatcattaggttatcatggatatagaactattattggattaagtgtaagaaaaagaacattagagaaacctatatataatttatatgttacatataatgatgggttgattattggttatcaaatttcaatataa

SEQ ID NO: 2005 - DNA, 339 bp, Candida albicans
agatcaatggctcaactaactcctatacgagggtttaccaacactcctgtaacacgatcgatatgtatgatatcgactgttgtgccgataatgctatcggtgttggctataaaatatgtcgtcaagtttgctatcgatccttacatcattcaatacaaccaattctggagagtggtgacttaccaattatcagtagtcaatgaatcagactacttgattacagtattattatggtttcagttcaaagttttagagagattctacggatcacggaagtatttaattattataacattgtccactgtctataaatgcggttgcattgctaatttatcatga

SEQ ID NO: 2006 - DNA, 615 bp, Candida albicans
gcggatccttccagccccgtgggtgaagacgtaacttttttaaatgagataataccaggaccattgggtatactttcgtctttgtatgtgtgttacggagcaaacatcccggtatcatactatttcaagatattattgaaggatccaagaaatgcagatcaacctgagacaagctctccaagtaaggaattaaatttgaccaatctttttcctatacacatattatacactattttgatactaaacaacgggttgcgttcaataattccatgtctagttggtttattgattggaaagttgtatgtttacgaattgctccctggtggatcatcgtggttgttatcaaatacagtattccggttgtttataaacccagttaaaagagcaggcgtatggctagaggctgtaaggagaagactttctatcagatacgaaagattgagcagtggcgactcgcaagaagcacttgaagaagaagaacttaatgaaaacaacgacgagcctgatgataatgatgaaattttggatgagacaagacaacaagagaaccaaatcagagcagaaactccggttcgacctttgggtagtcaatttctcgacaccttcagaacgtaa

SEQ ID NO: 2007 - DNA, 948 bp, Candida albicans
aactacaattacttatcctccaccagttccatccatccaacctatacttatcattccacattttcaatcatgtcagctatctataaggcattacaatccaaatcatctaaggaaacatcggaaaaaaccaaacatattaatagacaaagattattggtgatatcatctcgtggtattacttatagacatcgtcatttaattcaagatttattagcattattaccacacgctagaaaagaaccaaaatttgattctaaaaaaaatttacatcaattaaatgaagttgctgaattatacaattgtaataatattttcttttttgaatgtagaaaacatcaagatttatatttatggatttcaaaaccaccaaatggaccaactttaaaatttcatattcaaaatttacatactttagatgaattgaatttcactgggaattgtttaaaaggttcaagaccaattttaagttttgataaaagttttttagaaaatgatcattataaattattaaaagaaatgtttcttcaaacttttggagttccaccaaatgctagaaaatcaaaaccatttattgatcatgtcatgactttttctatagttgatgggaaaatttggattcgaaactatcaaatcaatgaaactttggatgttaaagaaaatgataaaattgaagatgatgaagattatgatgttgatcaattgaatttagtggaaattggtccaagattagtattgactttaatcaccgttttagaaggatcattttctggtccaaaaatatatgaaaataaacaatacgtttcaccaaactttgttagagctcaattgaaacaacaggctgctgatcaagcaaaatctagatctcaagctgctttagaaagaaagattaaaaagagaaaccaagttttgaaagctgatccattatccaatgatgctttatttaaatag

SEQ ID NO: 2008 - DNA, 396 bp, Candida albicans
  unsure (316): Identity of nucleotide sequences at the above locations are unknown.
gaacagacaatggccggtagtagtattcctcaaagttccaattcttcggtctcacaattcttatccactttaatccccactttggtgatttcagtggtgtttttattagcattcattgttattcacagtaaacaaagaagagtgtatgaacctcgtgctgtagtggaatcactccctgatgatttaagaacagaaactgcccctaaaggtccattcagttggttaacttatcttttagccaaaccccgtactttttacattcaatatgctggtaccgatggatattttttccttagatttttatttgaatttttcntgtgtatgtgtcttaggagcagttataacttggccattcttttcttttgcccagcggactggaagatcatgcgtcccgca

SEQ ID NO: 2009 - DNA, 984 bp, Candida albicans
gaatatagtattggttctgaaatattgcaaaaacaaaaacttacctatataaatacctatcaacttgatatgacacattccctacgattatttgacaacttcttgtccaacatatcaaagacttcaagtatcatatctttaacaatatggctattcacccatataccacaaataattctaaatcataaacgtagggatgtttcattatcaatttcatttgtcggattaacatttcttgcggatatcataaatctaacatatcaaattctgattaaagattctccatattctattttgttagtatacatgataatactagatctaataataatttcacaatacttttattattcacgatattttaaaaagccggtgtctccaccaccaccacctcaacaacaacaacaacagccaacattggtcgatcgaatattgggtgctgcgttcgtaacagatcttgtcctggctatgaatatcaaggcacagcaaccagaataccaccaccagaaacaaacatctcctgttcattttgattgggttcaaattttacccatagtgtgctgtttcctatacataatactgagaatacctcaaataaggcgcaactatatcagaaaatctactacgggactctcattatacatggttctctttaccgtcttgggcacaatatttaatctactatcgattgtaacagatacaaacctttataatgtattgtctatcaagatatttttaattggtagtcttgttattgtgttaatggatggggcattgttatatcaattttggctatatcggaaacacatatccgctcatgaaaatgacactgttgatatagatgaacagccacaatggtatgtcaagaatcagccattagtattctaccaatcgtgtgaaacaacacaaacacaaacagcaagaactagcattttcagcatcgggtaccttcaatcacttctagcctccatttttccaacctga

SEQ ID NO: 2010 - DNA, 246 bp, Candida albicans
tcaatatttgctgaaattagtataatatcatttatattttcatttgtggtgttatatataggtaataaatttgctgaaagattttggggtaattatttagaagtaataaaatttgtgattatagttggtagtataactaatttattcacggtgataattgctattatttcgaatattattatacaagatggtaaaaatatggatcaaccattacgtggaggaatatcgtattatttcggaatttag

SEQ ID NO: 2011 - DNA, 1326 bp, Candida albicans
  unsure (1298): Identity of nucleotide sequences at the above locations are unknown.
attagaaaagtcaatgttgataaaacaactaatattatgcttgtggtcttcggtactttcatttcaacaaaagctcaacaacaagatcaacaacaacaacaacaacaaggtcaacaacaaggtgaacatcatcatatacctgaattagcacaagaaactggagaaatacctcatcctcatgaattatttgtaccgttattaacgtttataccgacaaaatcacctgttttaactcgaccatgggttttattaactagtggatttattgaagaaaatttcattgaattatttattagttttatattgattttttatttagggaaatatttagaaaccatatggggatctaaagaattttctaaatttataattattaatgttttaattagtaatttgatcatttatatttattataatttaaaatcttttatcgttgaattaactgatgaaaatttacctccagttatattaagttcaatgtcaattaatattggattaattattgctatgaagcaaagaattcctaaacattatttgatttttttcaaaggtaatttaagatttaaagtcacttatttaccatttttaactatcttattaacttggatattatccttattaagtgaagaattttatatattatttgttatgagtattgttgggtttattgttagttgggcatatttacgatttttcaagactggcgctaatgaaagacaattgtatattttaccatttgcattaactcataaaaggaaaaatagattcaatactactaccacaaccaccaccgtcaacaacagcaacactagtcatatttcgggttctaattcaacaagcaacaataacagtaatcataccaatactgggttttccttagataatgatagtcttaaaggtgatagatctgagcaatttgcattatatacatttttcccatatccattatcaataccaattaaatttattgcaaattttatttttgaaattttagtggatcataaattattaaataaacgtgattttaaaaattatgacgatgaagaagataataacaataacaacaacaataacaacaataacaatgtgagtcatgtacgggggatatctaatcgttatgaagatgtagataaattgaaaaataatttatttggactttcagcattgaatggagcacaactggtttcaacaatttccatggcttcatctatgaaaaaattttgggattggctaattcctactaccaattctaaatctcatgaaacttctaatataaaaataaatatggacagacgtangaaattagcattaaaagagatagaatga

SEQ ID NO: 2012 - DNA, 546 bp, Candida albicans
aaacatgttccatttgctttaatgatattcagtagtttatggtcaattattattagtcgatcattatatcctgctattccttcaattggtagttttttcgtatcatatttttatttaagatttttccaatcattaaatactgaacgtacattacccatagcaacaactacaacatccacaacaacaacaaatagtggtaataatggttcttccattgatatgcaaaatagttctattatgattggtgatgcttcagatacatttcaattgattgatttcttcccacaagtgactagaccaatattaaccccaattttccaacatggatatgatatttctgtgtttttaggtattattactccatttaatgatgaaattgttgaacaaagtaatttacgagcacaaaagagacaagaacaaactaatcaaactcaaaagaatgttgctaaatcagtagctgaaagacgtagacaagtggctttacaagtgattgaagatagaattaataaagaaactgctgcaaatggtgccgtgaccaatcaatag

SEQ ID NO: 2013 - DNA, 564 bp, Candida albicans
aaagtattctccccaaatatggatcataatcattcaagtaatttatttcgattgccatcaattcaattacctaaatcggccaaattacgatcatttggaatatatttatcaggagcattatctgctataggattttggtcattagttgatgcatcaatatatctgaaaacgattaatgctagtgatgttcatgttcattttattgattggattccatttttagcttcttcaatggggatgttaattgttaattctattgaaaaatcaaatttaatgataaatcccaataatcaactggattttacaggaagtggtggtaatggtggtggacatgcttgggcagcaagaataattttatttatgggatttagtttattggctggtggattagctggaagttttatggtttttatattgaaatacttaatgaatcattatactttcccaactttaggtatgggggttgctaatattgtatgtaatggttgtgttatgttgagttgtattttcttatggttgagtcaaaatattgaagatgaatatagttatagtttagctttataa

SEQ ID NO: 2014 - DNA, 1242 bp, Candida albicans
  unsure (471): Identity of nucleotide sequences at the above locations are unknown.
aaaactatcatgctgcaagataacgacaatcaagatcttgaatcaataaccataaaaccccccacatcacaagagactacaacttctagtagtagtggttcaactgtggtagtgccgcccttgcaaacacctcaatttcaaaacgttaaacatgaaatagaatatgaaggtgaaatattgactatagattcaacaaattggcgtaattctcgacttttaaaattgcaaatactagtatcatttgctgtatttattttatttggattagctgaacaaactgtgggcacaataatcccaaaattacaacatgattatgctatcaatgatattcaaattagttttatatttttctgttctgtcagtggttatttattaaccgcaatgatcaatagtataactcatgaatatttagggatacgtggtgtaacagttctaggatcaacatcaatggcattaagttattggattgtntctcataagccaccatttgtgatttttttaatgtgctacttcatgagtggtgtagggtttgttactttggatgcatcaataaatacttggatggggaaaccttgtgattcaaatcaattgttaggtattgttcatggatgttatggaataggaagtttgatttctccaagtttgatatcatatttattatcaaaatctaatcatctctggaaatggcagaactattatgttattttaagtgttgtagcaggattttgtttggtatcattgatccttacgtttaaatatgaaactcccaagaagtacaagtatatttcggaattacgtcatcaacagcaaaaggaacaaggacaaacacacaaagatggtagtattgaattagaacatttcactggtattcatggaagtactactaaagatagttttgatttggaagctactgtcgaggacaaccaggaagatggtgaagaggaagaagatgacgatgatcaccactctacatcagtgagaaaaaccttatcttcaacattggtatggtcatttgcattgattttatttatttatgttggtggtgaggcggtatttgctgcttggttagtgacgtttttattaagaatcaagaatttggattataaaactgcatcttatatggctactacattttggtctggggtcactattggaagaattggtttaggatttgtgaccgcacatttctttagcagtgaattctggttttcaacacgccgtagcggcaacaatgtcgggaag

SEQ ID NO: 2015 - DNA, 1518 bp, Candida albicans
ttctattcaaaaatgagaaggtttagtaccacggcaaacgaatcacaccactctgataggcagttccagcaatcagacgaaacacaactgaataacccaatatttatcggggacaatggaatagctttggaaaccattagttctaacacatctgatgactcctctaggtctggttactcaacccaggaactgtcccaccttatgacttcaaccaacccccccaaaaatagatggcggattgcctcaactatattattcaattttacaagtgggtttagtgatgctgctcccggtgcattgttgccacacattgaaagctactataacattaactatgccattacatcgtgtatctgggttagtaacgcagtggggtttattttaattgctgcattttctcacaagatccagccatggtttgggaaacgcaatagtttacccataggcaatgctttaagttgtgtgatgtatgctattgttgccagcggaaccaagtttcctgttgtcgtgcttgggttcttctttggtggttgtgggttggctatggttgctgctcaatgcaacatctttttgagtcggctagacaaacaaagcaaatacttggcttattaccatggtagctacggaattggtcccactattagtccgttgatagcaaccagtattgtcaacagcggggtcagctggaatctttttaatttgatcttattgggtttaatggtaatcacagcgatcaatttatatttctccttccaaaatgccgatgaagatttgaaaccttgggatcacgttgaggcagttcacagctcatccacttcggttgagttggaaaatttggactctagaattacaaacacaactaatcacgcaaacagtactactcaaacgtcagaaatggtgttggccttgcaaagccacgttacttggttgatagccttcttctgtttgtgctatcaaggagcagaagtttctttggctgggtggatagttacatttttgttagactaccgtcattctgatgcaaatagtactgggtacattgcttctggtttgtggggtggcctcaccttaggaagattgttgttaacgagaccaattcacaaatacattggcttgagaaggggcgtttttattgtttcattagtctcgattattttggtattattaacgtgggtggtgcctgtcattgttgttgaagctgttttggtatcgcttgcaggaatctttatcggaccaaattatccattgttgattacttacgcagctttacctggattgattcctagaaagattcaagttgtttcgattaccattatgactgcctttgggtcaactgggggtgcattatttccatttatagttggtgttttgctgcaaaaagttggcacatttgttgtgttaccggttttcattgtgctttacgcatttatggtcttcctctggatgctcttacctaatacagaaagacaaaataaacaaaaccaaacccaattgaatttttgggaaaggatttggtga

SEQ ID NO: 2016 - DNA, 3207 bp, Candida albicans
  unsure (15),(18),(153): Identity of nucleotide sequences at the above locations are unknown.
ggaattttaagtatnatnagcaccattcttcattttcatgagatatcgccgtcatcatctttaagttcatcaagatccaaaaaacaaacaagtcagtataatactcaagacacgaacaataatagactaagttattattgtgataaggaaatnatatcatgttcccaattgaattgctcactactgattggaggctatagtggagatttgcaacaccatgttgtaattggaggaaaaaatattcttcgactattgtgtgtttctgaatctcagcaacgaataattagtggcattaatttacttgaaagtaaatcaatttataactcccgtgctccaaataaattgataaatgtaaacacgataaagacttttgcggacaccatagcaactggattatcgaatggggtagtttcgatttataagatatcgccaaatggacaaagcaaggtgactggcaagtattccgatcataatcgaaccataaattctttggatttcattgaatcagaaaatcaattgctatctggatctcaagatgggacaatcaaattatgggatttgaggagctcttctacaaagccagtcatgacagtccaagcaaatttgcattctgaccctataagagcgtgtcagtattctcctcactccgcagttaggaacaagatttgtgtattatcagttcacgattctggtgcattatgcaagtttgatttgagaacgaaaagtggcgggaaagtctatagccccgagaaaaaatggaatttgcatacagggccggcgttgtctttacatattcatccagaaaaagagcttgtggtgactggtggtagagataaaagaatctctattttcaattatggcgagagacagtcaagaaatactccacaaaacttgatcaacacttatggtcctgttgtgaaggtcagatggagtacatatacaaatacagaagaaactgcagaagaattcgaagaaaacaaacaagcaaaaccaaatacattatataattacgatattgcgtgtctgtatctaaacgatgatcctaccatcacgatttacaatttaggaagaaaatttatcccaaaacaaataatccattccaaaaaacccattcagaactttatatgggcacgaaatgaaactagatcccgaaaaatttggacgatatccaaatctagcacttttagttcttacaaccttgatagattggaagacagtgacgtcagtcggccaatagaagatttgaataacattgccatgacctgggataacaacaacgatttctgtgcggttagtcaagcaaggtatgattatgatctagagacttatgagaatggcattaatgaaaccactgaggaaaattttgatgcagagaggaattatagtctcggcaatgaagagttaattcacagccaagcaaattctcttaccgcatccccggttgataagccacaattaacgagatctttgacatttaacccagcactgctgttttcaacattttctccagttcttgtagctagagctgccaccggttttttgcagaacgacctggccacatcatcatcgtctattccaaatatgcaagtgtcatcttcgagacctaagttgactcgcaacacatcccaaacaactcaagattcgtcttcttctcaatttgcttcagttttaccacctccatctgcctcccaaacttattctagcccgcagtataaaaagaataatccacctcgctttatgaataatccagcttatgtcataccagtgtcgattccaattcctgcaaatgatgaatacgtttttagaaaattgtcaagcgagtctttagtgagcaccccagatggttttacattggtagatgtgtgtttattaaatgcttctgttgctgctagtgttggtaacaatagaacaagtcaaatttggagacttttggcagtcagcatacaagaggaatttgagtcagggattgaaccaaggagaatctatgcctttcaaccagaagctatcaataagctaccccaagacgtacaggagacatcgacaaacgctaatgacacactccacgcagagactaccaacagcaattttgttgaatcattcaaatccacatcaactctgggctcgcagtttggcaaacaaagtgacaaggatgagagaaaattgcaaagcaaaaatagttccggtaatctaatggatatgattaataaggccaacagaacgaacagcttttcggcgacaagttttaaatttaaagaacaggagcgcaaagaggacgaatcacagaaagcccaaagcattaaggatgagaacgaaagagcaagtatacactccaaatcagccccaattctgattagttcccacccagaggatttggatgatgaaaacatgggtagcaacaactctgccgcgttaaagtttagtccaccttcagtaggagtgtccattccatcaaccagaataatttcaagctcgttggcttcgtctccaaaatcagtaagagggccaagtggtgtaaaactgcacattagcaggagtcgaccctctccgcctgtacagacgtggttgaaacaaaagaatttggaagtgtccaacgggctggcaatggctagtacttcaggattatctttgacattaaagagaaacaaaaccaacgaggaaggtgatcagctcaccaaagcttggaagtttaaaagcttgttaagaaaatctttagattatgccactcttcaaggagacataattttctgctcgacagcagcactactattttatgatattgttcctgaaataatatcacaattcgaatgcttggagtggctaggtatttacattgaggttttgcaaagaaagcgattattcgttaatgctataaatgtaataaaatgtgctacagcagatatacaggaaaaattacaaaagttgtattgccaggacttgagtttgcggttttattgttccaactgtcaggcattattagttaatgaaaaatccaagttttctggcaagggtgagtttgggtattggtattgtgatgagtgtagcaaattacagctgcagtgtgtttactgcaatgagccatgcaagggtttggcggtaactgtagggttgaagtgtgggcatcatggtcattttggatgtctacaagaatggtttattgaataccaaaacaccgaatgcccaggtgggtgtggctaccagataatatag

SEQ ID NO: 2017 - DNA, 648 bp, Candida albicans
tgtgtaaaatttcgaacgcgctccaaggagaaaggacaaaaaaaagactccaaaaaaaaaaccaaaacaagatccaaatatattattgcaaaactccaaccccaaaaacacacaatgactactgattattatgacctagatgatatactagctgactcagaaaaacttacttgcaaattcaatataactgttcctggtttaggatatttagaaggaaacccagggaaacctatacatgaagataccaaactcgagttgccacattggctatcgggaatattggctacagtggccatcgacgaagattcaaatatcaatttcctagacttggctgatccagatataataaaggaaaaagttataaatgccataaaaaccgatccattagcagttgatttacacaaattgacaccttactattatagtctaattttaaaatgggggaacttgtatactgataaaaccttaattgccaacgtcatgaactgtttgaaagccagaagtttggaaatttacaattttagtaataatgcaaacaaaactttgaacaatgagtttctttatactttggatgagtttgaaagggcattgtttaaactgacttcagatagtaacaagtccatgagaaaatggttgaaaactaaatag

SEQ ID NO: 2018 - DNA, 507 bp, Candida albicans
  unsure (17),(40),(43): Identity of nucleotide sequences at the above locations are unknown.
ggcttggacactgatcnccttggcgttgtggacactcatnaanagttattcatagatgatcaattgaaaaataaattgattgacgcagagaaattatctcaagtattgtatgactcacgacaagttgctaagagaaggtttgaatacacgaaatatacacctatggctaatacattttccaacaaagttacatgtccagtaatggcattcaatccaaaggaaccatggggatctattgtatcacaatacaatgttcctcatttcaagcgtccagtggttgaagttttgtataaatggagagatttgatggctaaaaaacaagatgaatccgtgaggtatatcatgcctaatccattgcttgttagtttaactaacttggaatcaccagtggatttgaataaagtgctcaatgtttcttatcgtatttctgatgcagttagaatcaatgcgaaagaagtagcagacttgattgaaaaaaccttaaaagaaactgaagctaatgattgg

SEQ ID NO: 2019 - DNA, 312 bp, Candida albicans
taccttgataatggtaaaacttctaccacaacaacaataagtaatgaaaaggcatcgaaaatagaaaaaccacaattaaaattcaaagtccctattgataattcagaatcaggacctttcaaaccaaaactttcatccaaacctcatgcattagtaccatttaatgattctttgattaatccacaaccggtttatgaggactcaattgagattattgatcctccattttatgcccaaccttatgaatatgaaattgataatcaaccttatcctgatgccatactagctaaatctgatgctattccaccaaaa

SEQ ID NO: 2020 - DNA, 975 bp, Candida albicans
ataatattgaaccaattaatttttacaactttttgtacaccacacgtgggagtactgtaccctcaaagtcataatttctcagctcgattaaataatagaatagctccattttttttagcagatactggatctcaatttatctttgaagataaagttggagaatttggtaaaccattattagtatggatggctgaccgtagatataaattttataaggcattggcaacattcaaatataaatcactttatgccaatgttgtcaatgataaacggtgttcttggtatactgcttccatatcgcccgatgataaagttaattcactgtataataaacgaccagaaaatatcaattgtaagtatataaagggataccaaccaaatgtcattgatgtcaccaaaccattttattatgaaaaagttgataatttaagggaatcatccaatcatcgattcaaatggttttggaaaactttaaattggataaaattgataggaacaattactgtttattcaccaattttcattataacttcaattgtccaaagaatatataataggaaaagagtaagtgaatttttccaaaatgaatcaaatgatttattacacatgtatgaacatgagcatgaagtaggaggagaagaagaacaacaacaacaacaacaatatcattcttcggtgtttgcagatatttctaataaagttgatgatgaacaagaaacattggttgaagatatatatgacgccatgaattggaaagttagtcattcatcaactttcccaccaataagattagatcataatcaatcttatattgttgaaaaattaaatactattggttggaaaaaataccctattattattagacatactaaaggtactcatggtgctgctattataaagcattatgatccaaattttgatgaaggtgaggttatagttagacattttgttaaagaagtatttaaattagattag

SEQ ID NO: 2021 - DNA, 669 bp, Candida albicans
aaaaagtttgtttacggcaacgcacctatagatcctgatgatgctaaagtgggcaatgttcagcgtttgaaacgtcgcacattggacagacacgagtcatttaaaggagatacttcttatttgacagaggataccatggaccgtgtcttatatgccgaagaaaggtatttgaataaaagtagaaaagccgggtctattaaaaatgaggatgatgaagatgctttggtagctgaaaatactgattataacactgattctgatggtgtcgatgagagttcggaggctgatacgttaaaatcaaactttaaatcaattgaaatggatattgaacaaaatgataaagtcatttcggaaagcatagaaacgttaaaaagctacgagtctttcccattattccaagatcacaagtacaaattacctttaaatgaagataaactgttcattgtaaagaacttgaatacattggattggattaaaatacctgtatttttggatgtttggaatgctcacgacggaattgtaagtagaagaggagcaaagaccaaccctaagggggcatcaacaattggattgtgggtgtcgattcttcgaaatcatttgcaagagaatggtcgtgccgatgcctcggtcaacgggaatcaagaatcaaccattgctcatacttcctag

SEQ ID NO: 2022 - DNA, 1086 bp, Candida albicans
  unsure (231): Identity of nucleotide sequences at the above locations are unknown.
tttcatattattttggttgataaaataatttatacaaaatctactatgagtgacatcaacaagagcctatcatcaaactctaaatcaaaatcaactcatttgtttgtgttaatccatggtctctggggtacgtggtctcatatggcgacaatagaaaaattcataaaagaaaatttacccagttcaactgacgataaaattgcaaccattaaacgtgcgttttttagattntggaaaacttatgatggactagaattaaatgcaaaaaagattatagctgatattttctatgaaatcgaatcattgaaacaaaataacgatcttgaagttacgaaaataagtatcatcggctattcacttggtggattaatttctagatatgtgattggtttactaaatgaattagatttctttgaaaagattgaaccaatatttttcagtacatttgccacaccacacgtgggaatccaattttttaatgacaatatctttgatgcagttgccaatagactaggaccatatttattcgggaagtcagggggacaattgtttatcgcagaccacgacaagatattagttaaaatggcagatccacaagaaaagtatatgcgaggattaaagaaatttcaaaagcacattcttttagcaaatatcaaaaatgatagaaccgtggcgtttttcacttccttcataacagatgtgtccccatttgaggaattggataacataaaaattgtttacttggataatctaccccaagcgaagattgctaataaactagttcgtcccaagtttgtcgatttaaccaaatctcatcgtttatctttaaaggataaaaaaatatttcttgggaatcaacaggaggagacaccatttattagaaagaatcgatgggccaagattttagttattgctttattggcttgtttggttgttcccttttgggtgccatttgttcttattagttccaccactgtctcgatctatagttttattaaaatcaagtttgtcaaaggacctttaagtcctcaacactggctgagagtgaaaaaagtttgtttacggcaacgcacctatagatcctga

SEQ ID NO: 2023 - DNA, 669 bp, Candida albicans
aacagtctcctaatgtcattctcagttgaaaagaaaaccactttggctcatccatttcgtgctccaggtagtactttgattagttctgatcaatcaaatttaaaaattgtttataataaatacaaaacaagatctccattacctaattcgactaatcaattacgttataattttattttttgtcatggtactgggtttaataaatcaatttggaaatatcatatttcaaaattatatcaattatctcaatcattacaagttccatggtttttagattctgtcattgctattgatatggttggtcatggtgattcaagtttagaaaaccaagggaaattggggacgattttccgttgggatgatggtgctaaagatgtcattgccattattaaacatgaaattgcaactacgggtgatttccaaaataatttagaatcgcgtaatttgattattggacattcaatgggcggattcaattctttatatgcaacatttttagaaccaagtttatttgatgcagttatacctattgaagcagttatttatggtgctcctggtggacttgaaaaattctccaaaaaattcagtaaaatatctaaattattgattgatacatttgattcaaaagatgatattaattttttctttaaagaattttcatttttctaa

SEQ ID NO: 2024 - DNA, 921 bp, Candida albicans
tattcccagatatgcaacattgatactgtcattgctgctgatcatgttaacatgggagattcagccaatgtcaatcgaggtaaattgggacatgtatctgattggaatgattttgccaaggattatatcatgattacaaaaatccatgaaagagatgcatttcttcatcctaatgcttttaatgttgtggttgcacattcaatgggtggattcattgccatgcaaatgactgcaattgaaccaaacttgtttcaatcgtcaatattaatcaacccagtatgtgttacattccctgagttacgacaccacaatttgaaggtctatcaggattggtatcatcgtgactttgtgaaattttattttgataacatccccgaaggtgaaaattggtatcataagatctatgaacattacactaatagatctttctacagaaaatttcatcctgttgttttgcgtaatatgctagaagatgaaattcctgaaatgtacgatagatcgaaatattaccgaactgttgaattgaaacacgacggtttggaagactatattaattattataattccgaggagtcaatcacggccacgaagtctagttatgaacaaattagagttccaaccaaaatattatgtggagaaaatgatgcattggcaacttttattgattcacaaaaagatcaagaattgagttttgctgaaatccaagttcttgaagggaaatatcataatatgcacgctgagagtccagatttgattatgagtttagttaatgattttgttgtaacatgttataaagaacatcctaaaatcactgattttgaatactataaaaagtatggaagtgattataaactgattttgaggaaaaagaagttgcatgatttattaggagacaatacgaatattcctagcaaattatag

SEQ ID NO: 2025 - DNA, 3081 bp, Candida albicans
caatccaatgattccattggtgttgtcgaagttaccgttaaacgctgcagaaaattgaaaactggtaatccgacaaaaccaaagagtcttaacccatacgttcaaatcaaagttaccaacaatgggaaaatcgatgaaagaacaaaaactaagaaattggtcaatgacccagtatttatggagacaaaaaccattttagttaacctgttggaagggaatttcttgaattttaacgtatacaatcttattgaagataaaatggacgaccagttgattgggaattgtgaatttggtttgggtgaattgttgcaagaagaaaccattcaaggcatcacaaagaatatcatggaaggtgggaaagttgttggtaagatcgaattggatatcaagtatttcccaactatacaaccaacgattttggaagacggttcaaaagaagtcattacagataatgaagttggtatcatgaaattaactttacacgaagctagggatttggatatttccaagtcagttattggtttattgaacccatatgccgaaatttacgtcaacaacgaaaaggctaaaacttgtcgtagattaagacaaactaacgagcctggctggaatgagtcgtttgaaagtttgattaaacaacaatctgaaacatctattcaagtgttggtgagagattctgtcaattctgatattgttgccaatttggaggttaatttacaagatgttatttttgaatcacaaagaggacagcattggtttacttgtccaccaatttctaagaatggccctgctccaaaaattagacttactacaagctggaaaccattggccatcgatgaggccacaagcgaaaaagttgttcgtaatgctccaattggtggtatgagattacatttgagaggggctaaaggtctcaagaatttggaatctgttggatatgttgacccatacgttagggtaatgttgaatggtaagttaagagccaagaccgttacatttgcagaaactgtcaatcctcaatggaacagtgtttattttttaccagttgccaatgaacatcaacattacttgcttcaaattatggatgctgaacctgaaggaaaagatagatcattaggtactgctgcaattaatgttgccgacattttgagaaaaaatgaagaaggatattatttgggatatgacggatccgatgaaatcatcgaacagcccgtattatttaatactaaggaagctggttctattttctactctgtctcattctttcctgctattccaacttactctttgtctcaattgcacaacttcgaaacctaccaaaaagagttgaaggaacaagaagaaagagaaaaggaaagatatgctagagacgaaaagatgttcaaggaaaatcccgatgaatttgaatggattgaaattgaaaacgagcagatgaaagtaccaccaaaagttgaattgaagttacaagatgctatcaagtacagggctggtaatatgattgttcatttgaaaggtggccaatttgaaaagccagatgtttatgttcatactttgtttgatgaacatgcatacccttcgggtatatcccctatatctgaaggtaaaaaattgaccacagcctctgtgggtgagacatttattcgtgatttaccaaattctaatttgattttcagggttgccaaagtcgctgaagttactaaatctagtgaagttattgttgaaaaaatgtacaacacacttgacatttatgaaaaatcttttgaaaaaccaatcaagttgaatcttggcaaccgtaacaccattgaagtccaattggaatttattccttctactgtcaaattggcaccattggatactattttggatgttggtaaaattaaattggagattattggtggtgagaatttgaggtcggtcgattcaaatggtaagtcagatccattgtgtactgtgaatcttgatggtgttgaaatttacaagaccgacaagaagagaaagaccttagatcctatttggaatgaatcggttgaattcccaatgatatccagatccagacaagttttattggttgaagtatatgattgggattatactcatgatgacgagttattgggtgtcgcaaatatagatttgtctaatattcctgccttaaccacaacgcctttctcggttgatttagatactcagggtaaagtcaatttgagagcaacattcttcccagagtacataagaccacctttggatgcgaaatcagcaattccaattgatcttggtgcagtttctgatgttggtatgaaagctgtcggaggagcagccagcttggctactggtgcagttggaggtggtattggggctgcaagtgaccagttgaataaaggtgctgggttccttaagagtttcaaaagcaaaagaggcagaaatagtaaagataagaacaataatgatgactcgtcttcgttagcaccaagtgctataagtcaatctaagagttcagtgtcagacgatggtggacataatttgaaaccagatattcctgaagaggaaaaggaattgagagaagaacaaggtgaagaaattgagagtatacaagctgctccaaatattcgtgaacaagatttacctaaaccacagcaaccatttgttcctcacggtaatgtaagaggccatcagagaaatgttagtaatgctactgatgtgtcaagttttgcagctagtattcacggtgccgacgcacttccaggtagattgaccattgtggaagcacgcaatttcaaagctggagacaatttagaagtgaaggcttccttgaaaacctcaactaaagataaactgttattcaagacaagaggtaccaaatttgacaatgtttctgattcgtacaaatggggagaaagtgttccttttaaaagctcaccttcgggaaatatcattttacagttgagagagcatcatacttttggtaagagcgttgttttaggagaggcaactttaaatttggaaaactatgttaacgttagtgaaaacatcacattgccagtcggatcaggagagttgatagtgaatgtgaagtatttcacttga

SEQ ID NO: 2026 - DNA, 1923 bp, Candida albicans
ccaaattcaagacaagttttcagaatttgttcgaatttgaaattgttgattgacaaaataatcccaatttgtttcaaagaggatgagatcacttcttctaactcggccattttgagtgacccagtaattgacttggtatatcaagccgcaggtggtaaaggtgacggcaaggaaggtacttcatcgtacaagtatcgtggaagtttggtattttgtttattaaaagtgtgtgattggtattggcaacaggctgagtttgaattatccgataacgaattgtactcattgcgtgcattgacggcacaaactattgctgcaattatcattgaacgtgaaaaaagggacaagtatttgtttttaaatatgttgtgtcatagatacaccatttgtgttaacggagtggatgctaccccagttagtgccttagaaatggctgttgatatgcattctactattgttattggctcttcggggtatcaaagatgtatcaaatggttatggagaggctggatcatccaatcttcaactgacccccattcctatgtcttgtacaagggagcagcatcgcaatcatttagaactcattttgatcctgccagaatcaaaactcccttgtatcaaaatattttagaaatctttttgagtatcatttacttgattattttcacaattgtcgtgaatacccacagcacccttactggagacattgactttttcgaaacagtattgtatttgtttactgttggatacattttggatgaattgatcaagttttaccatgttggttggaattatttgggattttggaacgcctttaatgacaccatgtactgtattttgacggttgccatgtgttttagaattgccagtgttaattcccatggagttactagaattaaatacgatgaaatatcattcagagttttggcatgtgcctctccgttaatgtggtccagattattgttgttcttggatgcttacaaatttgttggagctatgattgttgttttgaagactatgatgaaagagtcgatattgttcttctttttgttgttcgttgtcattgtggggttcttgcaggggttcattggtttagattcatctgatggtaagaacgaagccacgcaaagaattttgatatcattagtgaaagctgtcattgggggttcatcatttgaagacatggggaacttggttccaccatacgcttctgttttgtactacttttaccaattcatgttgacggttatattgatgaatatcttgattgcgttatattcaactgcctacgccgccattgttgaaaacgccacagatgaatattttgcattggtcgctcacaagacgttgagatacattagagcaccagatcaaaacttgtatgttccaccgttcaacttgattgagcttttgatcaccccaattggctggtttgtgtctactagcacatggaagaacatcaactactatgtgatgttggtaatttattctccattattggcatatatcacatcagacgaattgtccaacgctagaagaattcaatacaaccgattcaagggagttccagacgatgccaatgaaattgacaccgagtgggacttgactgatgggtacgatgaagactcccctggggatggagatgattgctgggatagaattagggaaagaaatctggaaatcaccgaagaattaagaattcaacgtgaaggtgaaagacaagatccagaattcatgatcaatactcatcagtttagtgaaaaaattgataagattgtcaaaccagttggacaagcaagtaaagttggtgtcaattggcaaatttatgaagtcattgaaaagattgacaaattgaccaatttgttggaagttgttgttgcagaaaataaagaattgaaaaagagacttgaaaataaagcttag

SEQ ID NO: 2027 - DNA, 1833 bp, Candida albicans
tatattattgtcaaccatttcattccttttcccatctttatcttcatcttcataccagtttatttgaaaggaaagaagtggaaggagatcgataagattagtttcaacaaggtatatccgttttttttttttttaacaacttcaatcctacatttatacacaaacacttatcttcccactttattcaccatgtctagtataaaacaatcacgaccaagatcattatccaatgtactaatgatgtttaataaacagtataaaaaattaatgatttcacttgtgggattcattactttaacatttgtgattcatattttcaattcttcttcacctaccaaatcacccgatttatcattatttcaagctcaacaattacaaactcctggatttcttcctactaataaaaaagccgtacaaatcattagtgatttcacagtattaaaatgtaatatttatagtaaatgtaacgtccctaaaggttacattcaattattcccaagtttaaattattatcataattcgaaaattaaaacagattattatttaattattaaattactgtcaattgatcaaacaacaaaaataattactgatgttactaccactaacaaaaatgataatgataatagcgattcatcatcatcatcatcatatgaagaaattattattgaaccagggaaattaagtttatataaaaagacccaaatggttaatgttgatcaaccaattgatgataaattacctatactacgatcaatagatgtattatttggtaataatgatttaattgattctcgacctcatcataaatcattacatttatctaatagtgaatcaatgcatacaatcttatcattaaatatgatgacattaactgatcaaaatgatttacaagaaattcatcaacaaactattaatttaagaaattctcaattgattgaaactatgaataataaatataaaattatgcaattatctgatttacattttggtcaagatttaggtcgttgtgatgattctaatacttctagtggtggtggtggtgacggagacagagacggtgacggtgatgagcatgttgatgagtttaaatgttcatcagatttgaaaactttgaaatttattgaaaaatcgattcaagaagaaaatcccgatttgattgttattacgggagatttaattgatattcatcgatcaattgattataaatcaattttattaaaatctttacaacctattttggctcataaaataaaatttatttatacatttggtgatgaaattaaagatcaattgacaaaaatttctattatacaatttttatcaactttaccaaattgtttaaatactgtacctcaagaagttattgaagataataataataataataataacaaaatgcatggaatcacaaattataattttcagatcaaacaaaaaagtagtaccccttcttcaagttcatcaatttctgtgacggtcttagattcagaagatcatttaattgatgattcacaaatgacttatttatatcgaattaataatgaattattaaatgattataaattattatttttccattatccattacctcaatttcgtccaaaagggaaatttaaaattgttggatcatataatgaaaaacatgaattagatcgtaaaacaaaattaaaatttcatgatgatataataagttgtggttataatgtcatatctgttggtcatgaacatgaaaatgatgcttgtttattatcatcgtcatcgtcatcgtccaactccgataaatcaatgtgcttatggtcttcaccacggacgtgccgatccaacttaatt

SEQ ID NO: 2028 - DNA, 1884 bp, Candida albicans
caaccccatagtacttatcatcctaaatcagtcatgagtgatgagaaaataaagcaattgcaagagatgggattttcccaagaacaggcagctaatgcattaaaagtttccaataatgtcttagaagtggccattgcacatttatttggagaaccagttgaacaaccacaggagaataaagaaaatacccaattagttccatacaacgaaaatgataccgttcaaatatcaaaccctctagatataccaaagtttccatcatatagagagacaccaacgagcagtaatggtggatggagtgaaattcaagatgaagaattgattgaaaattacgaggatgaagatgacaatgacaatgacgacgatcttgtagaccaatggacaaataattcaaaacaggcatcatcagaaaccatttttgattacccacaagcattcactagactgacagaaatgccaccttgtgtgttaccaaaagttactggtacattacaaagttgtttgatttcgttaattgtcactttatcacagattggcgaattaagaaatgtctttttcagtaaagattttgattacgggtttgatgaaaattggtataccccaaccactgaattgacagtagagacccctgaaaaattcaaagataactcattttatagttttgttgtcgaaattcagagaatatttgggtttttgtcaccaaaagtcagtaatcgttcttttataagtggaaaaaatttgttcaaatccttgcctgaagattttgcaatcgacgacgacgattgggaagatgtcattaaaaaagttcatcggtatatagcacttggatcagaaagtatcttggacaaagatttaacactggttttcttgagtcaagtggaatccaacggtgaagagactaccgacttgtcaattttgcagatagagtacgaagcaagaaatctgaatcttcaagcaagcttgaactctttgatttggaattctgaactaaaccccgtgttcacaaagttggggctgttgttgactatacagatgtttggtggtgacgaagatgatgatgatgatgggcggtgtcaagcacggtcatttgaaatacctgagtatttttacccaggcatatttacttctacttatcaagaaataattgcaaaaatgaaccaaaagaaattaaatgctacaaaagaaagatctagtacaactactaaattgttggggtttagttcgtttgaaggtaaaaaaataaaaaagattcttcaaaatagtattgattatttggcaacaactgactccaaggaggcccacgatgatttaaagagactttcagaaaaggtgcaaaatgaatctttggctttgaatgatcgattaaagtttgttaaccaggaatatctcaagatggacgtgaaaaatcctgataatatactcgagataatagaaaaagaaggtttacctccacctgaaaaatattacttaaccagtgtaattatttcagattccgagtacatatataaagcaaagcatttgactacaacagatttcgaaaatgaggattggttatacattgttattgatctggatcataataataaggttctggagtaccgtactgaaacaatgagcttcgaagctcttcaattgttcattttggaggaaactaagcttaatagaagacaattgatattacattatgttgctgaaagctcgctacaagacctggcaaaggtgccagaaaaactagttgaattctttgataaagataatcaattgttggctgaagaagtacatgaatttaacaaaaataataaggagaacgatgcagaagtttcaaatgactcatctgttgacgaatcttttcttgtgtctcactctgaaactcaatcgctttag

SEQ ID NO: 2029 - DNA, 1629 bp, Candida albicans
aaattctctcgcaaagaaaatagcctggacacactgacaagtttagtgaataaatccgacctatatacaccacgatcaaatcgaactttggactattctcctttaatacagtacattccagtctttttccaaaaaaattatagttccattgatactcctcataacaatgatttcctagcgttacaatctcctgcgactacacaaacagacagcaacaagaatctgcagaagaatgattccgtgcttgatgaatgtcatttcatgtcctttgaagaatggaaaaagcaaaaaatagaatccaatactactacatctaacaattactcaatgaatggatcatcagaattgaaatctattacaccttcaaaccactcatcggttatatcaactaacgtcactttaatggaggccgacgggaaggtttacaaggacaagtttaattttgcatcggttgattgtgcagcaaccattatgaaaacaaatgcccaagctaaaggtgcatctgccattcttaaagagaataaagattcatacttgttgaatgaatgctccgtcaaacacaagtacgtgattattgagctatgtcaagatatacttgtcgatctggtagtaattggtaattttgagtttttttcatccattttcaaagatattagaatcagtgtaagtgatcggttcccatcacagaattggaaagagttaggacagtttactgcatccaatattcgtgatgtgcaaactttcaagatcgaaaatcctttaatttgggctagatacttgaaattagaaattttaagtcattacggcaatgaattttattgtccaatatcaatagtgagagttcatgggaagacaatgatggatgaattcaaagaagatgaggaagggaatcagcatatgggtgctataaaggaggaagagccaccaacaccacaaacaattgaagaagatgtcttattaatcaatcagactacactaaatgaatgcagagttcgcttaccacatttacaattaaatgagtttttaaaatcgtttaatagttctaatcaagagttttgtgtaccaagcgacgccgagcctcaagtaaccacggcaaagacaactacagccatcactacacaagaatctatttacaaaaatataatgaaacggttatctttactagagtcgaatgctacattatctttactttacattgaagaacaactgaaattgttatcaactgcattttcgaatttggagaaaagacaaaccacaaatttcaacacgttaatcagttctgttaatagtactttaatgaatcaattaatggttttcaaagagtcttactatgagctatatgaacaatatgggaatctattcaaaatgcaggaaaacagtcacagacaattgttagcagaaacaaataaaaaagttgggttgttgtcaagtgaattgacattccaaaaaagagtctccattttcaatagtataattattatttgcttgttagtttatgtgattctcacccgtgacgttgccatagagtatccagaggacgagttgaacgaaaagtcacctctgcctcaatccaaaaaactatcatcaccatttataccaataagatacaaaaagtccaaaaaacgttaa

SEQ ID NO: 2030 - DNA, 378 bp, Candida albicans
tgcggatccttccagccgcgtggtgaagacaaaggtatggacgcattgatcaatgatatgttcatcaacactgccttgaacttgtattcattgtttgtggcatatttggttgcgttattggcatacttgtacttgaaattcaccaagccagagtacaattctggtggtgctttttatgctccggttattgcctttgcatttttaattgctggccaaatcaaccgtatctccttaacagtaattgaaagtggtaccgcgactttctttgttgccttggcgaaagacccagaaatcttccaaatgacaaatagaaatagattcgatgatatctttagaaattaccctcaagtattggaaaagattactagtgaccattag

SEQ ID NO: 2031 - DNA, 2292 bp, Candida albicans
  unsure (1684),(1738),(2264): Identity of nucleotide sequences at the above locations are unknown.
gttgtccctgttgatcagcgtcgattacgagatgcaattcaaattatcgatgagaataaacatttcaacactggtattctcgactatatcaacaaaacgtcacccgctgatgtaggcaacaactaccacattatttctgtttttgggtcacagtcgaccgggaagtctacgttgttgaataggttgttcaatacgaattttgatgttatggacgagctgaaccgtcaacaaactaccaaggggatatggttggcgtactcgccagtggtgtcgacgactttggggcacactacgagcaagtccaatattcttgttatggacgtcgaaggtactgatgggagagaaagacgagaggaccaggactttgagcgtaaagcggcgttgtttgcgttgtccacgtcagaagttttgattatcaatatttgggagacgcaagtggggttgtaccagggtgcgaatatgggattgttgaaaactgtatttgaggtcaatttatcgttgtttgggaagagcaaattggaaacacataatgaccataaagtgttgttgttgattgttattagggaccatgttggtgttacgcctgttgagagcttggccaagacgtttacgctggatttgcagaacatgtggagcagccttgccaagccagcagagttggagcatttgcagtttgccgactttttcgatgttactttccatgcgcttaaccataaggttcttcaaccaaaagagtttggcgagggtattaacagacttgatgataggttagtggtcagcaacgaattgtttaagcccgagtaccaccacgatgttccgattgatgggtggaccatgtatgctgaacgatgctgggagcagattgaaaccaacaaggacttggatttgccaacacagcagatattggttgctcagttcaagtgtgacgagattgttgagagtgtgttccaagagtttttggcaaagtaccagcaccactttaaggaggtggacgctgctcctgattttgaggagttgggtgcgttgtttgctgatttgaggcaagacgcgtttgaggattatgatgcttctgcgtctagatacaacaaggcagtgtatgaacaaaagaagaaaaaattgagatggttgatcaacgacaagctcaaggaggtgtttgatgtgcatgccaagaacttgtgtaatactttgttggagaagtttgagaaggatctagttgcattaaagggtaaggattttgctgtgaatgtcaagacattatctaccaagttggttgaggatgtcaatttccaagtcagtttgatgtcgttgcaaggtgatctttcgttggatgagataattttggcgttgaccaaggacattgatgctattgttgctaagcagcaggttatcgagttgaactcgattgttaacaagtcggtgaaaaagttatcggccagtttgtccaagtcgatccagtttgagttgggcgatccaaacgaggaaacctgggataatgttttgcagcagtttaagggtgtgtacgagaagtttggtggtgattttgggcttggcacgtcatccacgcagaaccagcaggccattgaaaagttcaagttcaaatcgtggtgccagttttatgatgtcacacacaagttgatttcgagagaaaagttgttggcgttgctacaagataggtttgacgacnagtttaggtacgacgagaatgggttaccgaaattgtaccttaacgagcaagatntggaaaagacatttgcggtgggcaagcagcatgcgttgcaggtgttgccgatcttgacttttgccaagttggctgatggttcggagattgttcccgactacgatatttttgactcaaagttaagagaacagtttttagggggctacgacgatagtgatgatgaagaagatcactgttttgccgagatcattaccgagcaagagaagctggaagttttggctaagttcaagaaggaagttgatgccaagtacattgagacaaaacgttcgattgttcagcatatcacgcaaatcccatactatatttatttgattatattggtgcttgggtggaatgagtttatggcgattatccgcaacccattatttttctcgttgagtattgtgttgggtgcgacggtgtacgttttgtactatttggggttgttgagaccggctttggtggtggcacaacgaaccatggatgaggtcattgttatggccaaaacaaagttgcgggaggtattgattgatgaccatgtcttcanacctttgcaatggacggatcagcgcttc

SEQ ID NO: 2032 - DNA, 453 bp, Candida albicans
atacagcagagtgatgaattgactacttttgaacaagtttctgaaaaagtatacaacgaaattcaaatgatattgctagctgctttagaccattgtatggttgccgagtatggtgatgatttagatttgattcgagggtatgacaaaaatagtgtcacaactatcgaagattgtgccgagttaataattaggttttggatgacagtatttctgcaatactttgatgctacacctggtaattttgtcccatttcgcgagacaggaaagggaaggaactcccgaaagacacctatccatatttatcagccagaggatagcaacgagcttcgtaaatttgtgactttttggaccacagtactcacagtgatttatgacgctgtgatggattcaacgcaacaagcagctttgaaatggttgatagctcgttggaataaaatggcagatactgtatag

SEQ ID NO: 2033 - DNA, 885 bp, Candida albicans
ataccagctatgtctcttccctctaggtatgcccctgaaggattaagtgaagaggatcaactaaaagttatcacactgggcgaaataaagccccgtaaacctatagattataaattaagaaccatagatgatagagtacaactggcactacacacgcacccaaacacgtcagaagacattgaaatgatacccattgaggatggaaaagaagtagacgtgatatcagaatatattgaatatttaagaggaaactcagtttatgaagacaagaatgaaatggtcattgaagagtcgcctgaatttgagattgtggggggaaatatttcatttttagttctcgatacaaattttttgatttcccatttaaacattgttgatactttgaaaaatatcgcttctgaatatggattgaaattgattattccagtatatgtggtccaagaattggatgggcttaagaattcaaatcgtttgcacaacaactcaaatgggaaattcacgggggagacggtttctcaattagctatatgggcaaatcgatggatatatcaagcattagcagactccctggcagtggtaaaaggacaaaaattgtcacagagaatatcaaaagacctagttaaagatgacgccatatttgattgttgtttatattttaaaaagacctacccacagtctttggtgattttattatccaatgacaaaaatctttgtgcaaaagctttgagtaatgatgttttaacagtaagtttccgagaaaatatgagtggaagattgattgcaaatactatttacgaagaaaatgttgaaagatttggaaagctacaaacaaaagtagagccagtggctccaaaaatccaaaaccattttcttccgaggtggtag

SEQ ID NO: 2034 - DNA, 1800 bp, Candida albicans
attattcagaatgggatatctcaattgctgagtgtatctggtctagatgaggcaaatttaaagatcttaatatgtactttgttatctttcccattcggtataattttcaaaagattgccagatcatgattatacgttaaaaaacatttacaacgtagccgtttcttgtttttatgtgtttggtatttgtgatttacgttttggtatttcaacacttttgatctcagcaacaggatcatactttattacaagatatgtacggactaaatcaatgccatggataaactttttatttttgatgattcatatggcttatagccattttcatttgcaatttttcaaagagtacgaccctaagctgattgatattactggtgctcaaatgattttggtaatgaaattgtcagcatttggttggaatatacatgatgggaaacaaccaagactgactttgaatgatttcaacaaggccagggctattacaaagcatccaaacgtgttgccatacattggttatgtgtttttttatgcatcattgttgactggaccagcttttgattatgctgattatgacaagttcatccatggcacattgtttgatgatgttccccaagacaaaagacccgggaaaaacaaaagaagaatacctagatctggtgtccaagcatttaaaaagtttctgttggggttcttttgggctttcttgttacttcaaagtgacaagtttgtcactatggaatacatgttttctcctgaatttgtacagtatcatggtttgttttaccgaatcatttacatgtggatattaggattcacatttagattaaaatactatactatttggacaattgcagaaggtgcttgtattttgtgtggtatcggatacaatggtgtggatccggaaacaggagagttcaagtggaatagagttcaaaatatatatccttggtcatttgaaaccggacagaatgtacacgcttgtttggaggcttggaatcaaaacacgaacatatggttgaaaaattacgtatatttgcgagttgcaaaacctggcaagaaaccaggattcaagagtacaattttcacatttactacaagtgcattctggcacggtactatgccagggtactatttgacgtttgtcgttggtgctttaatgcaaactgttggtaaattttatcgaagaaactttagacctatatttttggaagccgatgggaagacacctaaacccgctaaaattgtttacgattttgtatgttgggttaacacccaattggcgtttgggttttttgttcaaccgtttgtgattttaggatttacaaaatcgttagaatgttgggctactgtgtattactggttgttatgggttattgcaatatcatttttcgctttcagtggcccatttgcaaaatccgtaagtaaattcttcaaatcgttgcaaccatcgtacaaagaacaacagcgcaaatcaagagaagataaatacaagttgaataatgaggaagcaagtattgttgaacaagctgttggtgctaaactagggcaagattatgatatcccagcccttggattgcctccgtttgacgtgtttacggattttgatcaaacggaagttgatcatgacatacagcacttgcgtaaagcatggacttcatttagaggacgtagagggtctattactgagaatgattttgacgggttgaaagacgcttataataattttactaatgaaattaatgatatattcaataccaaaaaggaagaattcaagaaagaaaaactcaacaagcaaaactaa

SEQ ID NO: 2035 - DNA, 192 bp, Candida albicans
  unsure (159): Identity of nucleotide sequences at the above locations are unknown.
caacgcaacgaaattcctaaatcaatgagtagtcactttattgtcaatcgtcagcagcaacagcaacaacgaaatgaattacgtggttattataagagatacatgatcccaccattttatggtacaattgatctagtgattaaagaaattggatatatnaatattaaaccaaccggggaagaaaatggataa

SEQ ID NO: 2036 - DNA, 1383 bp, Candida albicans
aacagcaacacaatgtttagtaggctgatactactacgatcagtaagaaaatcacttggtagatactattcttcacaagcacatccacaaacatatatttacaacttgttgagtgatacgaaatgtcgatcgtgtgggattcaattgcaggataaatttcctgacaaaccaggttattatcgtttacctggtcaaaacgacagcaataccgacaaaaaagctaaaacttcagaattgaataagaaatatgaaaaaatactacaaaatttagacatctctgatagaaatttgttaatcaacaatttcagtgctccaaaacaagatgatgagaaagttgcatcagtaccaagtttacaacaaataacaccagttgaagcagatactcgtgacacaaccaaagatcaacaaacccatctggggcatagtttaagctgcaaacgttgcaatgatgtaatttataattccaaaactagaagtatttatgacccaaacagggataatttaaacaaatcagaattccccattcctaaattacaacaagtgttgtctactatcccagtagatgctccgttagtttatgttttcagtgcaaatgatttccccatggggataaataaggatattttccaatatcgcccaccacaacagatttactttgtcatgaccaagagtgatattttgatcccaaaaacaaatgttgccttttataataattttaagaaatttttacaaaattatatgtttaaaaaatttaatgtaccccgtgaaaatgtttttatcgcttcaggcaaagatcgttggaaaatgactgatttatatcattttatcccaaactattcgtacattattggtgatacaaattgtgggaaatctacgttagtgaaaagtttattgatcaaccatcatgttaaacactggaaatacgaagctcttcaacaaagaccagacgaaaaacaatcttcttctgcttcattgaaaaataaagattttaaaaaattggatagattaatcgattcattcagctccaaaaatggtcccggaacttcgcatatccctggattcactcgtgatgttgttcctgttgatattgatggtataaaagaattatttgatgtaccaggctttaccacaaatgagaatttacaagatatttttgataaattgaatcacaaacaaattgctcggataactaaaggggcaaacacttctaaatatggatcattgaaatcgaaatttgatactgtcaaaaatgggcaagtgttgagtttaaatggggtaggttacttacaatttccgggacaagattcaatgtatcaaatacgaaacgttactaaatttgcattgcataaatttaaaaatcttgaaaaagttgattcaatttga

SEQ ID NO: 2037 - DNA, 1020 bp, Candida albicans
cgcggacttcgacccgtggtgagcaatcctgcattggtatctcaattatcaaacaattcaaattctctgaactcatcctcgcctaatgtttctcgttcaaatagcaaaaaaggtgggttattcagttcactttcatcaaaatttagatcaagctcggcttcatctaaacaaccacaactgcattcatcgtctacaccatcaaccacaacgacaaatggtggcggtaactcgtccgctgctccaaaatcatcccatcactcccccaaatttaatccttcacttgttggtccagtatcaaagcacaatcgagaagctgaagatttggtgtctcttaccaatactttgcctgctgggagtggaataccaattaaacgtaaaccatcaataccgggaaattcaattttcaaagattcatttctcgatgatgcaagttcttcaccgtcatcttcattaaactctgatggggggcttaagtttttcaggagacgttcctctgtggcatctacaccatcaacacacgcgtcaacacctcgagtgattttgaacaaaaaccccaataggagaaaagtacccattgaagaaatatctgaagttcgattgcgtcgggttaccttttctgttgataaactcgagcacgatccgcaacagcagattccttcaagaagacctaaacgaggtaatgttttaattccacaggacatcaatgcaccacctccaagactatgtcttgggatttcagttaatgaaccaaataataaagatgacggtaaatcacacaaccattccaaatatagtgatcatgaaattgcattagctgaagatgctcaacgccgagcaattattgaagcagaaaaacatgctcaagaagctcatcgacaagccaaaaagattgctcaagaagtttctgggtatagatcacatagattcatatccattaaagaaggtggtagtgttggtaattctaacaccaacggcaacgacaatgattttcaccacggaatgagccacccacttgctaat

SEQ ID NO: 2038 - DNA, 618 bp, Candida albicans
accaatatgtattataggatcagttgcagctcatgtcatggctggtatcagtataagaattacaagaaatgttttcaaaagaaaccactgcatcatataaataatggcagacatagtccaataacaaataaacttgaggatcatgatgatgaaattggatttggtggtatttctaatttgtttggtttaggatatcgtaaatcatttacagttcaatttgggttgactccattgcaattttctggttatgtattgattccatttttcatttatcacatgtataaattcagatatataccatggattaatgatggtgatagttctttaatcaatcttgaatatatttcctatgtgctcaatttgaaacatccaatgtggaatgtttttgccttggggacattgatttattcaatgagttatcatggaactaatggcttaatgaaattgaaaggtaaatattctaaaacatggaaaaaaattggtttagcagttgttaatggggtgtccttacttggatggattagtgtatatttgtttaaatgtaatgttgaggtgattgacgttaatggatttttgggtaaatcttttacaaaatacttaaggtcgttctggttgtaa

SEQ ID NO: 2039 - DNA, 1065 bp, Candida albicans
attctattttgcagtaaaaaaaaaccagcccagaccatatctcatcgacacacaaaaaaaaaaaaaatttccaaaaaatactcacttatagtaaacaacatcacttaccaaaaagtccaacccaccatgtcaaaagaaacaaaaccaccattagattcaagaataggaaaagactctccattcacatttggtcaaagatatttagaaagtgaagaagatgtattcaatcataatgcatgggatcatgttgaatggggtgaagaacaaattaaacaagctcaagaattaatttctaaacaatatgatcatccagttaaagaatttgataaaaatttatataattctaatccagctaaatattgggatttattttataaacataatcgagaaaatttttttaaagatcgtaaatggttacaaattgaattcccatcattatataaagtcactagtaaaaattatcaacaaccaactacaatattagaaattggttgtggtgctgggaatacatttttcccaattttaaatcaaaatgaaaatgaaaatttgaaaatttttggttgtgattatagtaaagttgccgttgatttagtgaaatctaatgaatcattcataagtaatcatgaaaagggagttgcttattcatcggtatgggatttagctaatcctgaagggaacatcccagaagatttaccaccaaattcagttgatatagtaatcatggtatttgtgtttctggcattacacccggatcaatggaaacaagcagttgacaatttatctaaagttttaaaacctggtggtgaaatattatttagagattatggtagatatgatttggctcaagtgcgatttaaaaaaggtagattattagatgataatttttatattagaggtgatggtacaagagtttattttttcactgaagaagaattggaagaaatattttgtgaaaagggtccttttaaaaaggaaaaaattgccacggatagaagattattagtcaatagaaagaaacaattgaaaatgtaccgtaattggctacaggctgtatttagaggataa

SEQ ID NO: 2040 - DNA, 1131 bp, Candida albicans
cattctctggggaaatcagaaacctacaagacagtgtctactggtcccaggtatatttttggataccatcctcatggagttatttcaatgggtggggttggtttatttgctactaattcattacgtaacgagccatatacgccatttctaaaatttttgaaaccattcttccatgacagttccaaaggtgaacgtttatttcctggtcttggaaatattttcttgttgacaattaccacacaatttgccataccattttatcgtgattatttaatgggattgggggttactactgcatcagcaaagaatattagaagtttgattagcaacggtgataattctgtctgtattgtagttggtggggcagaacagtctttgttaaacaatatggttgctaaacatgccagagttggttatgggtataaagaaaaccaggacattaacggaagcgacgcagaggatgatcaaccagaagaagaagaacaacaacaacaacaacaaccaaatggaagtgttgaagttgacaagaagaccacgaaagaagttggtgaaaaaacatcaagccaaccatctaagcgtgaagttaaattgattttaaacaaacgtaaaggatttgttaaattggccatagagttgggtaatgttgctttggtaccaacttttgcatttggtgaagcagatgtttacagattggtccaaccaagtcctacatctatgatgtataaattccagaaatggatgaaaggcattttcctgtttaccattcctttattcagtgctcgaggtgttttcatttacgattacgggttgttaccatttagaaatcctataaacatttgtgttggtaagccaatatatatccccgctggagctttgcaggaatacaaacagcaacatccagaagagtttactgaggaagaaactaaaccaccaatgaaaaaatctgggtcatttaccgatatttttaaaatgaatggagaaacaccaaaagtttccacaatcaaaacaaaaataccacctgcattattggacaagtaccataagttatatgttgacgagttgagaaatgtctatgaagagaataaacataagtttggttatggagatgtcgaattcagtatcgtcgaataa

SEQ ID NO: 2041 - DNA, 603 bp, Candida albicans
agattgtttatgacattcaatatcaagttaatttttgtggctcattatttattaacattgaaatcattaccattttcacagtcagctgttaaaattggtgttacaccaagaattatcaatttggcttctattggacataatttccaatttaaacattttactcctgaacaaaataaattagacaaatttcctaatagtgtatttacttgggttagatatggtattgccaaatcatcacaaattcagtttgctaaagaattggctaatcattatcctgatattttatcagtatcagttcatccaggggttattttaggaacagaattatataatcattggaaaaatatcccaattattggtattggagcaagaggtatatttgctctttcagataaacttattggagtatctaatgaagaaggttctttggcaactttgagagctgctttagatccatctttaacattgaaagaaaatggtgaatatttgattacaggtggtaaaattgatgaacctagtaagattgcttctaatacccagtattctaaagaaacttgggattggaattatgaacaattgaagaaacgtggatacaacatctaa

SEQ ID NO: 2042 - DNA, 1206 bp, Candida albicans
ttgtgtgtgtatgtaatttgtttatatcaaactattcaaaaacatacacacattattacccaaatacccataagcttgggatctttagttaattccttaatttttcatttgtttgccttttccttttccttttccttttccttttccttttccttttccctttctttatttttttttttttgctgtttcatatttatgccctcctttgaactagactcattaccttatctcaatccaaatgtggatagaagaattgcatttatcactggtggaagtagtggactagggttttattcagttttacaactatatttacacggatacactgtttatatagctggtcgaagcaaatcacgatgtctcaaatcgattaaagaattgaaaaataaagccattgatataagactggaatatacttcatcacaattgaatgaaagatttttaggtgatttaagatttttagaggtagatttaagtaatttaaatctggttatatcggcagtggaaaatttcaaaaaattagaagatcatttacatattttaattaataacgctggagcaatggcattaccttatactttaaccattgataaatttgaaattcaattgcagaccaattttgtttcaccattggtactaacaactaaattattaccaatattacaaaaaactgctgataaattccccaaattaccaacaccaagaatcatctatttaggttcatttggtcatcagtttgcattaccatatttcaatttaagtaataatttgaatcattatcccaattttatattcacttggattagatatggtatggcaaaagttgctgggatacattttatgaaaatgcttacattgagaaatcctaaagtattatttttaacggtacatccaggtcttgttatgaatacaaatttgttttcttattggactagattacctatagttggaataatattttggtttgcattttatttgtttggatattttttcggggtcacaagtaaagaaggagctgatgtggttattaaatgtgctctagatgaaaatctaacggttgaaaatgataatggtaaatattttggacctgatggtaaagaatctcaaccttcaagtattgctacaaatatggactatgcggcaagaacatggatttggacaataaaagaattgagtcaaagaggtattgatataccaaatccttaa

SEQ ID NO: 2043 - DNA, 201 bp, Candida albicans
aatttattttttctttcttcttctattttccctatcaatacaaatagaatcatgccatttgtcaacaaaagtggattttttgatccatctacagcaccttactatgacccaaaggaaaccagaaaagtagtctttattactggaggtaattcaggtattggttggtatacagttcttcagttatatggacctgggtatatt

SEQ ID NO: 2044 - DNA, 546 bp, Candida albicans
gagcgcttgattttccagccccgtcggtgtaagaatgaatgtttacaaatttcaaattataatgaagcatttgcttctttacatcaatatttcgattatatggtttctaataattccaaatatttttatcattttgcattaatttctcgagcttcattacatcaatattttggtgaagataataaagctatggatgccattgaagaagccatttctgtagctcgagaaaataaagataattcaactttaacttatatattatcttggttatttaatttcatgaaaaataaacccgaattatggaaaaatcgacaaatattttataataataataataataataataataataatgaatctcaattattagattttttaattaaaaaatcaaaacaaatatcattactgctttattctatgagttataattttaaaactttatattttttgaataatggtgattatcaatcatgtattaatagtttaattaaatcaattttcattgctataaatgatgatgtgaaatcaacatttattaaatcagca

SEQ ID NO: 2045 - DNA, 1110 bp, Candida albicans
gatcttcaccgtcggttaagaatttgtacatcattgagttcacttaaatttgatgaaagttttttattatttcaagcattccaacaatttacagaaccaacacgacaaagatatgtcgaattgggaggtgatatcataaatgaaaataataatcttggtgatgatcctgatagggatttatttactagattgaataataatttaattgaattaggaataaacaattcaatatcattatcatcattatcatcgccgacgttaacgtcaacgccaacgtcaacaaaaatcatctcggtacctaaatatgattttcaacaattattagatcgacaaatttcattattggaaacttatggtacaccaactccacaatatttaaaagatataatgatgatgatgatatcaccaaattctaacgttggtagaattcaaaatattcaatttaataatttaccgtcatattattatttaagatatcttgaatgtttacaaatttcaaattataatgaagcatttgcttctttacatcaatatttcgattatatggtttctaataattccaaatatttttatcattttgcattaatttctcgagcttcattacatcaatattttggtgaagataataaagctatggatgccattgaagaagccatttctgtagctcgagaaaataaagataattcaactttaacttatatattatcttggttatttaatttcatgaaaaataaacccgaattatggaaaaatcgacaaatattttataataataataataataataataataataataataataataataataataatgaatctcaattattagattttttaattaaaaaatcaaaacaaatatcattactgctttattctatgagttataattttaaaactttatatttattgaataatggtgattatcaatcatgtattaatagtttaattaaatcaattttcattgctataaatgatgatgtgaaatcaacatttattaaatcagcagaattagcagcaatagtttggagtaaacttggtgaaccaatattaagtgaagtgtacaatgtcttcacctcggagtcgcagaccgcctatatttcccca

SEQ ID NO: 2046 - DNA, 699 bp, Candida albicans
caaattttcaaaaaactaactcaactcaaacgattgagattatgtgtcgtatcattaatcgactgcatttatttaactagcccctcacagtatatatccatattattattaagtttaagaacaatgctacaattagatctacctcacgttaatgttatcagtaaaatagacatgttgaaaaactatggcgaattgccgtttcgattggattactataccgaggctcaagatttacagtatttgactccatatttggagaaggaatctaattcggtattgggacagaactatgtgaggttgacagaactaattggagaattggtagaagatttccatttggtttcttttgaagtattatcagtggagaataaaaagagtatgataagcttaatgagtgttatagataaagccaatggttacagttttggtagtgagattggtggagatacagtttggagtgaagccactagacaaaatggtagtggaaatggaggttaccaagatgtggatattcacgaacgatggatagatcataaagaagagtatgatgccgaggaaagaaagcaagagcaagcatttgcggaaggtctaccacaagaagaagtggacaataagccattgacagaagatgaagaatgggaagcagcattgaaagactgggaagagaagcatgggggagagggtgctatgttgagatga

SEQ ID NO: 2047 - DNA, 225 bp, Candida albicans
tgtgtttattttctcatgtatggacagatagtaataggacctcctgggtctgggaagtctacttattgccatggaatgtatcagtttatgtcagcaattggaagaaagctgtgcattattaatcttgacccagccaacgaccgattacccttaccctgtgagtcggacatacgtgattacatcagtttagaagagataatggaagagtcagatctgggttcctaa

SEQ ID NO: 2048 - DNA, 363 bp, Candida albicans
ttcataatgggatttttccaatgtttatggtataaatttttacaaatttattcaattccacaagatcctaaatttatagaagttttacgtaaagttatgactgatcaatttttattttcaccaatttcattgttttgttttttcacatttggtacaattattttggaagataaaacttggaatgatacagttaataaattgaaacgaatttatttaaaaactttaataattaattatacggtttggttccccattcaatttttcaattttttaataattccaagagattatcaagtaccttttagttcatcaattagtgtattatggaattgttatttatcaatgagaaattccaccagttaa

SEQ ID NO: 2049 - DNA, 1662 bp, Candida albicans
accgtgaccatgtataacgaaaagtatgcactggattttccaaattcacattatttgtcgaatttaaacaacctaaatggaaccaatcaatcgatccatcttaatagattaccaacactaggagaaatattagccaacaaatcaaaatctcctgtcgatttgttcaccttttaccagtttatgaaagatgttgaaggaaaaatcgactatttggatttttggtttgatttaatcaaccacttgaacttgtgtaaacattatgtcaagggattaagagattcaatcattagacaatcatcaacatttcatcaacaacaacaacaactgcaacagcaacagcaacaacaaggtcaccgaataatatcttcactgcaacctcaacctcaactgcaagatttgtcctatgaatcaccagcaacagctacagggttccgcaactctatggccgtttccgagaaatcaaacagaaaatcattgagttcatctattttgttggacttgattatcaatgataatatacttgaagaaaatgactcgcacagattatcagcatttttaagaggtgacataaacttggacaatctagatccaaaattaaaagatttaattgaacaatacaatgccgaaattgaacccaactcaaaacattcatctcgtgtggacagtgtagctagatcgtcaccaagttatgtgtcaaaccctataatgggttcggcaccaatagcaaatcctcaacaaccataccttcaccaagatcgaaaaaccagctctcactcattgttgcttcatgatgatgacgaaaacaaccactcctactatgaaaatcaattagatattggtagagcagataaggcagtgagtgcatccaaatacatttccttacaatcagagaataaagatgtatttggaaaagaacaagagaatgaacgttttcagcatccaactaatccatttgccgatactagcgctataaataatcagaaaaaacgtgcttccactatcaatccatctttattagaaaaattgatcaaagactctccagcatcaaatggaacacattcttttattactagagaaaacttacgtgagtcgtcgcatcaattacttttgaagtattttgttgaagactcagaaaagaatcttaatttgccatccaacttgaattctcaaatcataaaagcaattgaagtcgacggacgtgatgacccggatgtattcaattatgttaaaaactttgttttcaacaaattggaaaatgaacatttgcccaagtttttggactttatggccaccagaaacatcaaccattccaatttttggagaattatcttaggattcttcttcttatttattgggttttgggtgagttttataatggtgtttctaaattatcggaaaggtttacggcctgttataattataccctatttcttggccttttattttctcatttcatcgatatatctaatagacccggtcatggcgtggatggggatatcagaaacgttttccaagagcaatggacgactgcttatgaaaatacgggaaaaattcatttaccgatttattgtcaaacgaagcctttgggtgttatttttagttttgatattcacagctattttcaccgttcttttcagtttggttccaggtcatcgattataa

SEQ ID NO: 2050 - DNA, 495 bp, Candida albicans
aaaaattgtagcgtcatgtcatttgtaattagagacaacgaatacaattcatataacgggacacttttttatttggtgggtgttttgattgtgctttatgcttatccaaaagacatttctgttttgagcattttattattgagttgggcagacactgcagcttccacttttggtagagcattcggtaaatatactccacagattgccagcggtaaatccttagcaggctgtcttgctagttgtgtaaccggagttttgactgcctatttgtggtatggctatttcattcctcaatataactattggaaccaaccaggtgaaatctactggaatgcctcatcaaacaagttgagtttaccaatttattctttgttgattggggtgataactagtatttctgaagtaattgatttagctggtattgatgataactttacaatcccagttttgagtggaacctgtatttattggttggttagattgacgcaacaataa

SEQ ID NO: 2051 - DNA, 711 bp, Candida albicans
ttctttgtttttaacttccttgacaagttgttttcacttttattatcaaccgattacaaagtttatacatatttttctttctttctttcttccatttttttttacaatagagagaacgaaaacgaaataacgaaatacccgatgtcctccgtaccatcctcaccaattagaaatgacagctcatttatggttgctgaaggtcaagaagcaagattaagaaaagagattaaaaagaccattttagactttgatagcaaccaatcatacattgaagaggaggatagaacatacatttacaataattcgagtatactagacgatgacgatgagttggaagatgccgaagcagaagacgatgaagatagttacgaattagatgatactgaaattgaaatcgaagaagatgattcgagtattgttttagaaaaagttgccaattcaaccactgattttagtaaagactccaattcatcagccacagaaaaaccttctttgactttctatcaattttttaagaaacacgaaattccaagaaaacttttccattcatcaattggtgtattaacattgtggctatatactattggtgtcactgtccctcaattatttataccattaggaagcgtgtttactgttcttttagtcaatgatttggttagattgaacaatcctgttttgaatgaaaaaattgtagcgtcatgtcatttgtaa

SEQ ID NO: 2052 - DNA, 1368 bp, Candida albicans
acttccatccggtctggtaaaaaagaattcaaggttgcggcatttataggaatttattttcttatttcacatgttgtacttgaaactacagatgtagtaaacgaaaaggggttaaaatctcatcttaaagttttaccagaagaagtcattgactactacggaaaacagccattttcaaacgtggacaagtatgcgtacatgcagtatgcaaccaactatgactatttgaatcttgcaataattaatttcattcacttgcgtaaagcaaacaccaaaatacccaacttggttattatttatgatgaagtcctacattactatgctagtgataaatggagtgagttgtaccaagtggcaaaccaatacaaaatcaccttaaaagctgcacctttgataaaagcaagttatcaagatgattctaattgggcagcttcgtttaccaaattccacatcttcaatcaagttgagtatgatagaattgtattttttgattctgattcaatgcttgttgatattccaaatgaaattgattttgacaatatggaaagcagattcaatcacattgacgagttgtttaaaattccacaggaattatcgtttgccctgccccaggcctattggctaaataatgttgttgaaggtaaaagcccaagacctagaaagaatgttgaaataccaaataaaaagcgatattcactcaggatgaaaaagctcgttaatgatttgagcatatatcaggatttcaatttgttgcccctgctaatttatgaaaatcattatttcgataatgctaatcattttttcgctaatcatataatggtgataactccatcaaagaataccttccaagagttgatgaggtatattcacaatccatggtggtggtctataacgaatcggggtagcttaagaaagccaaatgattatgatatggagatattaaacaaatatttgaataatgagctacaacgcaagagaataaatgtggggatcttacctcatcgggtgtatggtgttttaactggggaatttggtgaagaatggcacgagcggtttgtagtaaaaccccaatatttaccattcataaataaaaaatcaaataaaggctggctgccattagaattttttaagaaaatcaaagtggtacatttttcagatagccctatacctaaaccatgggaagaggaaaataatgaagaacattacaacatcaaaaaaatatattgtgataaaggcgatatggaaaagttccacaaagactatccggtgtacaaacctcgattaactgatgattgtgatagtgttctgatatggaattggtttagagaacaattctacaaagaaagactgggatattggtttgcttag

SEQ ID NO: 2053 - DNA, 372 bp, Candida albicans
ccaaggttgatcaatatccctgcgttaggctcaaatggtcatgttcggatcggtgtgcctactggggccgcaagaatattgcgtatgcagtttaaattgccagttaccgaaagatcaggattgggaattgcgtgggatgatgaagtacctccaacctatgaggacgtgagcactttaagtcctcctacatacaatgatcatacatcatcatcatttacgataactcctgttatgtctgatagtgagagaccaaccccaaatgttctttatggtagaggagaaactcctgtaataggaaactttggattggatctatcacacgtaaatagtattgacgctatggtcgacaacattcaagaattttcgttataa

SEQ ID NO: 2054 - DNA, 1512 bp, Candida albicans
  unsure (53): Identity of nucleotide sequences at the above locations are unknown.
gcaacgagtttcccaccaggtgaacatgcatatcccttttctcatctcttacntgggtcattaccaccgacctcaaaattggggtcattgcattcacaatcatttataaagtatgagcttgtggcagttgtaacagacactgatgggaaagtgaagaaattagtgataccagtgaacattgctcgactgattattagaggcccagatagaaattcggtcaggatcttcccacctacagaagtaacaacaaatgctgttttacccaatgttatctatccaaaggcgacattccccatagaacttaaaatagacaacatagtgagtagttcacagcaaaggcgttggaggatgagaaagttgagttggagaatcgaagagaatacaaaagtgagggcatacacttgtgaaaagcatattcccaaattacaaatggttgaaaaagcatatagtaaatcttccaaagcaaatttgccccacacaaccggtaccaaaacctcaagcatgcaccatagtacagtgttgactaatatctcattgatgaccagtccatcaaatttggagtcacaaccacaaaatttagatgatggcatccctgacagtgagccactaaatgatgctgaacatgacattgaagaaacaattagaagcgggccttcacacgcacacgagaattttatcgaggatttcgttaatccgaatcaaagaaacagcactacacatgaactggatttatcagttcagccttcgatccaaaccccacaacctagagacactgataaacatttgtatttagaagaaacaagaacagttagttatggagatatcaaatcgggttggaaatcggatttctcaggacggggaaaaattgagttggtggcaaatatcaatacaaccaattgttccaccgggatgatcaatcatataaatatgttaagtagcgaagatgcacctattgttttggatactaaaaaaggtgcaaatttttcctgcgatattgatgatccaacattgggagtatttgttagccatacaatgattgtcgaagtggtgattgcagaagaattggttcacaatttggagaggaaaagagcaggttcagggacatctaaggacttggctccagttcaatccagatccagtgttgtctcaaacgatggtggtaaatcctcatctaatggtcctgttcaaatgggtgtgcctactggggccgcaagagtattgcgtatgcagtttaaattgccagttaccgaaagatcaggattgggaattgcgtgggatgatgaagtacctccaacctatgaggacgtgagcactttaagtcctcctacatacaatgatcatacatcatcatcatctacgataactcctgttatgtctaatagtgagagaccaaccccaaatgttctttatggtagaggagaaactcctgtaataggaaactttggactggatctatcacacgtaaatagtattgacgctatggtcgacaacattcaagaattttcgttataa

SEQ ID NO: 2055 - DNA, 1035 bp, Candida albicans
gtccaaaaacaccaagaaagtttcatagctgacatcaaggttttactcctatcaattacaattaaatattacgccatgaatattgataatactaatgacatatcttccccaccaacgccaatacaccctgctccaaatgaggaattaactaatggtgtaccaacaaacactctactagcagattccaatatcgatttgaatcccgacctatatgaagaagaagagatggatatagaggaggcaaagagcaatattgttgatgaaattccacctgagaacttgacaagcaatgaccctgcgctacaaccacaaacaggaaatgcatttaatgacaatatcaatgatgctactacaaatgcagattctgatttagaagatgtggaaatcaaccaattacaccaaatcacattaccttttaatgaatcttatcaattgcttaaacaagagttccagaatactttaactaatctaggtcagtcacaaatcacgtcagcacaacaatctaaattaatcaattatatcgatgaaacattattgcaaatacaaagaaaattcattaaacaacaaaccgaactggaaattaattattctttgattcaattattacaagaattgtctacggtgattagtgttatatgggtatcaatacaacaaaaactggtcttgtatggacaaatcgaatattatataaagattcttggtgatttagaggattatgtgaataactataagacacttttcaatgaaacttggtcgaaaaataataatttacatattaatatgcaaaatttagtgattttttttaaattctggcagaagatcgatttacaattgagttttttaattgatgggtataacattgtattgaataatggcaatcaacaaactaagttgattaaaatgaatgttactgaattgacacgtttattaccaattgttactcgattaagaattgcaataatatcgaagattgatggccttcgtatgaggctgatgttcaccatgggatggaccataccgccttatatcgcggat

SEQ ID NO: 2056 - DNA, 855 bp, Candida albicans
tttgggcccaattttgcaacatgtgtggttatgggattggccattgatggtgaagttttttggattaggttgttagaggagaaagattatcctaacaaaggagcaattcctgtttacactggtcttacaacggggtttggcggaacagtctcgtcgttttcctcggtaatactagaggctttcaataaagcagcagacactgatattggtgtgcgccatcactatcccaatggtgcctatggtattatgcaatttcttgccgtgatactagcacaatttggattgtcgatcatggggttccatatggggaaacagtttctggccgttgtggataattatttaccactagttaccaagcgtatttacaaggtgttggagctcacctcaatgatattgggtgttgttcttgtggtgataacttgtattttaattggggttaagaaacaaggtagttggagaagttggacattctcgatgcttttcgctccgtttggcgctcttttaagatactacttgtccaagtttttgaataataaggtttcaaactttccgcttggtacatttactgccaattttctaggaacgttactacttgcggtgttcacacttttggcaagaggtaaattgcctggcggtaaaggacatattgtcactaataccattgcattacatgttttagaaggattagatgatggtttttgtggtggtttgacgactgtgagtacatttgtggtagagctatttgggttgaaaacgttattcagctataggtatggaacgatatcaatattggtttgttttgcgggtgttgttcttattttgggttcttataattggagtgttggacttgactga

SEQ ID NO: 2057 - DNA, 1593 bp, Candida albicans
tcaatcttcaaatacagacataaaaactattgccatatcgtatttggttatgtttatatatgcttctttagcccttggtggcaaactaccaagcgccaacttgtactcattggtgaaaacaagatttacattagggttttcgagtataattataattctattatctgtaacggcgtcagcgggatcttttctattattggattaagatctacattaattattgctgaggtgattccgtttttggtgttagcaataggtatcgacaacatattcttgatagtccacgaattgcacgtaataagcgagggcaatcctaatttggctttggaggtacggatttctcaagctttgaaacatattggaccttcgtgttttataagtgctgttttacaggtgtgcatgtttttgttggctacctctgtgggtatgccagcagtaaaaaattttgcatactacggagctggtgcggttttaatcaatttctcgttacagatgacttgctttatcgggctattagcattagaccagcgcagactagaagataacagagttgattatgttccttgggttacaatttctccaatccaattacaggacaatgatgaaatcgatgaaccagtacatcttgagtacaacttttctcgttggataggagatcactatgcgccatttttgctaaagaaaacaacaaagcccaaagtcataactttatttgtgttgtgggttgggatttccctcagtttgtttcctaaaatccagctaggattagaccaaagaattgccataccttccaagtcttatttggtcaactattttaattcagtatatgactacttgaacgttggtcctccggttttctttgttgtcaaggacttggattatagcgaaagactgaatcaacagaaaatctgtggtggattttctgcatgcgatgaattttcgttggccaacattttggaacaagagtttaaacgttcagatatatcaatgctttctgaacctgcatccaactggttggatgatttctttagttggttgaaccctgatttggatcaatgttgtcgatttaagaagagcaccgtcttcgaaaagactccagaattttgctcacctaatgcccctcaacgtcaatgccaatcatgttatttaaaccacaatcctccttatgactcaagtatgaaggctttccctgaaagagactttatgttttattttaatgactggatacaggaaccatcggatccgtgtccattgggaggaaaggctgcacatggacaggctatatcccgaaccaccgagaaaatcgactcgagttatttccgaacatcctttgcgccactaagaggccaagatgagtttatctatgcatacaaaagtggaaacaacattgtcaaagaaattacaaagttgattccttcaatggacgtatttgcctactccccatttttcatatttttcacacaataccagaacattgtgttgttgacagtagctttactaacagtagcaatgctaatcatatacgtaattagcacatttttcttgagctcattcagatcttcgccacgccgctggaaggtccgcacttgcggt

SEQ ID NO: 2058 - DNA, 1929 bp, Candida albicans
gaattctttagtagttcacttattctacaagctatgcgggctatctgtttattactattgacaatcaacctagcaatcgcgtcggtatcactgtctcacaagcctggatattgcaacacttatggaaattgcggtaaaaagtcggtgtttggcaaaccattaccatgtgccgagtttgtccctgctgttaaggcaagtcaggagtcacgagagaaattaaaatcaatatgtggaaaggatttcgactacatttgttgttctccagaacaaattgatattttggagctgaacttgaaaagagtcgacccactaatttcgtcatgtccagcatgcagaaagaacttttatgacttcttctgccaatttagttgttcacccaatgaatcccaatttgttgaaatcatcaaaactgaaactgctagagatacaggcaaagaaatagtaactgaaataaaccagtatgtggaaccaggaatggcaaaccagttttttgactcgtgcaaaaacgtaaagttcctggcaaccaacggttacgcaatggatttgattggtggtggtgcaaagaattatctgcaatttttaaagtttttaggagacgaaaaaccattattgggcgggtctccttaccaaataaacttcgtatacaaacttccagaaaccgactcgggtcttgttttgcgaaatgaaccattaagagactgtaatgacaaagagtacaaatgtgcatgtactgattgtgaagaatcatgcccaaaattgccacatgctaaagatttaaccaaaaaatgtactgttggtgttttaccgtgtttttcgtttagcatcataatcatttggtcatgcatgatagttttgttaggaggatatcatgtatacttggcaaaattgaagaaagaacgaagacgatcaattgcagaagattccgaagatgacgaaagcaccatgattaaccctttgttttatgctggacttgggaagaaacgggctaaacaattcctgagtgaaataggactgaaaattcaagattggtttgcaaatattggttacttttgctcaaaatttccgggtatctcaattggaactagtttggcagttgtggttttgctttctttgggactttttaaattgcaactagaaactgaccccgtcaagctttgggttagtccaaatgaccctgcttacaagaaccaacagtattttgagtccaattttggtgaatggtttagaattgaacaagttattgtaagctcaaaagacgatggacccgttttgaattgggatattgtcaagtggtggtttgataaagaatctcaattggaaacattgaatgagaatgttcgcttatctgatatttgctttaaaccattagatgaaacttgtgccttgcaatcatttacacagtacttccaaggcgatatttcaggcttaacagaaaccaactggaagtcaaaattgcaaagttgtgttgactctccagtaaattgtttacccactttccaacagccattgaagccaaacattttgtttgatagtaacgacatttcccaagccaaggcgttcacggtaacggtattggtaaacagcgatactcaaaatgaaaactacacttccaacacaatctcctatgaacatctgttccagaagtgggcagcagacttacaaacagaatatccaaatttgaatattgcttacagcaccgagatctcccttaaagaagaacttaatcaatcttcaaatacagacataaaaactattgccatatcgtatttggttatgtttatatatgcttctttagcccttggtggcaaactaccaagcgccaacttgtactcattggtgaaaacaagatttacattagggttttcgagtataattataattctattatctgtaacggcgtcagcgggatcttttctattattggattaa

SEQ ID NO: 2059 - DNA, 1722 bp, Candida albicans
gttgatgatgccataacatacattagcaagatgattgaagatattttattttcaataaagtatcaaaatgcaactaaagatattttggaatttaccactgctacgattttaaaattgagaagcagagccaaccctgattttcttgatgttttgaagaatgtaggtgattggagaaccaatgaaactgacaatttcccttacaacaaagaagcagaagatgttattgccgcatcgatctcatctatggggccagaagttgttttgagtgtgttgccattgaatttaactggtgaaaatggtggtccaggtagagcttggttattaccactcttaagagataatgtgaggtttgctgaattggatttttacaagaattctattttaccaaatattgaattctttgacacgaaaattgaacagtctaataataaggaatctattaacagcaagatctttcaaacgattgttgatcaaatttggtctttattgccacatttctgtgatttaccaaaagatttaacttctgcttttgatgaaacttttgctactaaactttcagatttgatgtttgcaaaagttgagttgagagtcccaatttgtcatgcatggagattattagttgagtcgaatgttgcataccgtgatggagccttagacgaagatttgttaatgcaacaagaattccctaaagaggaagcacgtaaaaatgttggatatttaagtaccattgctggtaacattttgactgttttgtttaatgttttcacttatacagtagctgattcgagaggatttgttttggaaactattgaaacttatttgaatatcataccaaaagatgaattagccaccacatttgacaaagtatgtggaatgttaaagcaagctatggatgaagaagcaggtcaaacttctcaacaacaacagcagcaaagcaagactgacattcctagtactagtattactatgatggatttgattgtagctatggctaaatacgttccagaatcttctcataacgctttgttttctatttttgttgctactgtttctttggtaaagaatccattaatgcaaaaaagggcatatagaattatttcaagattagcagaaactgaaactggtaaacaatcaattttgaaattcattggagaaattgaaagggttttgattgaaaccatagaacaaacacacaattcagcaagatcctcaagacttaatgcaattttattagttttggaattgctaccatctactgatttatatttcatcccagcaatcttgcaagaaatcatcatggcaaccaaagatgttaatgaaagatcaagaggattatcataccaaatattgatcaaaatgggacaaaagatgaatgaaggaggtgttattgagaattcgagagttcctggttttgactctgatgctcctaattcatcagcttcattgacagaatttttcacaatggtcagtgctggtttagcggcccaaaatcctcatatgatctcagctacaattacagcaatttcctgtttaatattcgaatttaaagacgttttgcctactgatgtgttattggaaattgcatctaccgttgagttattcttgactcataactcacgtgaaattgctaaatcagcaattgggtttgtcaaagttgaagtattgtctctgccagaagagatggttaaatcttcgacgacggcgctggaagatcaagcgctg

SEQ ID NO: 2060 - DNA, 969 bp, Candida albicans
aaaacagatagactcttcttgcaattaactaccaaactagtgatgaatgataataatcctgatggtggattatccatcgactcctttgaattagaagataaattatcaaagattagatctcaaaccaattccaaacttgacaaccaaaaacatttagcaataatattatctgctgtagaagagaacattgaagaacaaaagaatgacaaaacaccagttgcctactttgtatcgtttttgtcgttattagatcaatgtatttcaaatgatcaaattcttgatagtaatttggcagcaacaacagcatatttcttggaccttgtgttcccatttactccaaaaccattattgaaatccaaattcaatcaaatattagcaaaattagcccaacctttaacattagaaaatgccgaagcagcattggttagatctaccattggtgcattagaaagtttgcttttagcacaagacggttcatcgtggaattccaagggccaggtttctcctaaaagagcatttttagcattattggaaacttcttttgacccgagaccaaaagtaagaaagagagctcaagaggctgttagtaaaatattgtcaaacccaccagcttctccatcaccaacacatgtagcagctcctttagctgcagatgctgccttaactcagttgtcaaccttattaaatacatacaaaacccagaagaagaacaaagaagtaaactctcaaattattcatgttttgcaattaatcaaaatgattacttcaacaaattcatggccagttaacaaaattgaagagttgtgtgacattttgttggaaatttcaaagacatctgatcaatttttggtttcgtcggcatttggtgcctttgaaggattgtttcaatcaatgacagacgtgattgatgttgagaaattcactcgtttcttcacctacgggactggacggtgccgcgctacatgttaa

SEQ ID NO: 2061 - DNA, 786 bp, Candida albicans
gaacaagacttgtctgacttgttgagcaaattaatgagatggtcacatgaacacaagggccactttaaatctaaagtcaagcatattttggaaagattgattagaaagtttggtgttgaagaagttgaaagatgtatacctgaagaagataagaaattggttgctaacatcaagaaatcaagaaacagagccaagagaaaacaagaagctgagactgaagccgaaggtgagactggatctaaaactgctggatctagccataattctgaaaagaaatttgtttctgcttatgaggaagccttgtatgattccgatatttctgaagatgaagttgatatttatgatgaagatgctaatagacacagaaaggctggtaaatccaaccaattcattttggaaacaggtgacgagccattgaatttgttggatagacaagcattagcacatatatcatcatccaaaccaaagaaattcaccaaacaagacttgcagaatagaaaggaagaattcaagaccaagaatggaaaattggtgtttaaggaagataatgaagaagatccattggctaataagggatcaggtattgatgcttacttggatgctgtcaagcaggctccaattagaggtcaaaagaataaattgaaatttaaaagatcaagaaatgaagaagacaattggtctgatgatgatgcagatagtactccagttttgaaaaagggtaaaactttaggtaaatccaagatttctaaacctaaacaaaaatttaaagccaagaagaaactttag

SEQ ID NO: 2062 - DNA, 2727 bp, Candida albicans
gacaacctaacaagatatattattattatgccaacatcatgcttactagttgggtctaacccaaatgttgcattttacgcttggagattttatcaatcaaattcagttgccgtgtcaatagtgaattcaagtattgattctaaatcccctattacatggaaatcatctcagcttggaacgtctcaatatagacctgataactcatattcttcattcaaacaaatccctaccacagagaaatttgatattattatccttagttgcagttctttacaagattttcaaagcatatgtcaagggttaacacatttgcttaatcaagattctataatattagtggagctgacagggtacatcaaattggaaccatatgtatcgaccaatttccccaataacccgtcccttgctgtggggtccattatgaatgaaagtgatgttagaatggtatcgcgcaacgaatattaccaccaaattagaaataaagattcacgaatttatcttggttgtacttcctccgattcagcatcatccaatatagctaataataaagggttccaaaaagtttataaattgttacaaaccgtacaagaagaatcgcatggttctattacattgttgaaatctgtaaacccaactgagttcaccacttaccaatggaaattagcattaccccgtgttattttcagtccgatcatgacattatttgaacttacatttcctgaagcattggaaaaacatatattgtcgaaaccattgattacagggttgataaacgagttatttaaactcattaaaaaaatgggttgcaaattggtcaaagggtttgagaatgaaaaaaatttattaaactattgggagagtgttttcccacaaacgaagcaaaatgagaattatatcaattcgcctaatttcttttataatttccacaaacaatatgatttggaactcgatttattattgttgcaaccaattttattgagtgatgatagtggtgtgagaactccttatttggaaaatatttactcgacgatgagtcaatttcaaaaaatgaattcacctactggatctttgtttttcgaacgaaaatccggctccaaaaatacgtctgccagtaatggtgcttcatctaagcaattggatgacgacattcaaagaaaggtacaacaacagaagaaattagatctagcaataaaagatcttgatattgccaagatcagtttagataacgatatgatcaagcaagaaatgaatttgaaaagcatccaacaaaaaattgtcgatgctgaatccaaattatcaaacttgcaatatgatcaagacaggaaaaccaaatccattcaatatgagaatgatgaaaaaattaaacaacttattgatgaccacgaacgtaaatacaaatcattagatgaacagcatcaacagaaaattaaaagcttagaacaggaacacatgtcattagaagccaaatataaacaaaaaattaaagaattagaagagagatacaatagaaagaatcaatctatcccagtaaacaacacatcaccagtatcaataccggcacaacaaccaacaccagtacaagataatattgtatcaagtaccaaaaatgttaaccgtgattcagtgatgactctggatggtttccaagattataaacatttggtggaatgcgaaggagccattggtccaaatactcccgttatccaacaaaaaccacagaattctcccgtaacacatgtacaacgaaatggcagtgataattttgttgatgctaataatggtgaggcacaatcatatagaccaagccaaggtgacagagagagtcaagcacaatcacaaccacaacaacgacaccagccacaacaatatcattcatacaacaatggatctcaatctaatggctatgcttcttccgaacaacaatactatgaccaaaaccaaaaccaacaacatcaacaccaacaccaaccaccaacaccaccacagcaacaatatagaaatgttccaccaccaatgccacattattattacaacaacaacaacaacaacaacaatggaacaattccaccaccacagcaacaatattatcaaaataataaccaaccaaactcaagacttctgtacaatcaaggtaatggaaatatgtatgtgaacgaccaagctccacttcatgaattaccaaatggtggaatggcacaaggtaatttcccatcaaacttgagatctaacggatcaatgccaggacctaataagtatcaacagtatccatctatgcattcaaatcctccacatcaaaatatgcaacaaaaaagattggattctttaacaggatctattagttcatactatgattatcaacaacaacaacaacaacaatcacaagcacccccaccacaaccacatcaacatcatagctttaataatgctgcaccaattgatccattccttgaacaacgattcaaaactaaccccaaaaaatcaaaccgtcgttctcaaatgcctcttgctggtaatatagatgggttagatatgggtggtagaggtggtatgccattaccaggaaccaatcgtaaatccatgaatgtgattaacaattatggaaatggtaatggtattgctccagcatctagacgtgctagttccggtggtcccttcatgttaaacggaaatggtagtcaacaagcaccccagcaacaacaacaacaacatttagggccacagtattcg

SEQ ID NO: 2063 - DNA, 495 bp, Candida albicans
aatataaaacgagttcccaaatttcttcgatcttatgctaaacaattcattaatgcaccattttctcatttaatttcatttttaatacttcatgaaataacggccataattccattattttcattatggtattttttccataataatccatcatttattcctatggaaatcccaagttgggccattgatcaaggtgccaaaatcattgattatgccttatcaaaaatcaccaattgggaaatcaattcaaaagataaaatgctgattattattgaaggcgcatatgcgtttagtattgttaaatttttattaccattaagaattatagttagtttatcattaatgccatggtttgcaagatggtttattgttcctatactgaatattttccctaattttacaaagttattgaattataaaaaaattaaacaaaagcaagataaaacaaggtttgataatgctaaaattaaacacgttgaaaaacctagattatag

SEQ ID NO: 2064 - DNA, 1470 bp, Candida albicans
cccggcggtgaagaccctatgaccaccaccactaatttggaaacattattggaacaaaacgaaagtgaacaaattgaaggttatcaatgtattaaatgtcgagttagtaaaattgccatgaatgaagagcatttgaaacgtcaaattccattggaagacgttgattatattaacaagattattgacttaaataacaacccgaatttgtgcattaatgaagatttacctgaagatttagagaactttatcaagaattataatgttgaagggattgatgcttcaagaatcacttcgacagttcagaaaaaatcacaaattttgaaacctccaaaaatatttggattgcatctttcacgttcttctttcgatggccaagtagtaactagaaattcatgtcgagtcaagttttcagataaaatgacattatcaataggtaaagagtatcatgataaattaaagcaatttcaaactatggtgcaaaaagaagacgaaaagttgagagaaaaatatacgtctaatgtcttgaccacagatgagaatgatatggaagacgaagatgtacaaagagaagatattgatgagaagggggaagaagatgacgatgaagatgacgaagatgttacaaccgatgatggcactgctacagaaaacggtacagatgatttagatgatgagacagatgaagaggaagatgatgaagatgatatttcatctgtcatgtcgagagaaactgaaactcaatcagtcactacttctagtaccatcagaccaaattctggaccaactggtctgtctcaagaatactcaataaatctggctccaatttctcataagcaaactgataatttgaaagaacttttcaaacgattcaaatttaatgataatgatttgtacaagtatcgtttgagagctgttattaaacatatgggatcacatactcagggtcattatgaatgttacaagcataaaccactttatgtgaaagacaaaaatggtaacattttcaaattatcaccagagattaaagatgaattaactggtgaaattcattgtgaagccactcctgttgaactgaaccctgcccagtccaatgctaataatggttcagctacaatgcgttcgtctagtagtggttcaagtgaaaatgatgaagggttccgtcacaagttttcaaccatgatgggtcgtagaccttctgtattccaagctaatccgactggcgtggaagaaatcttactgtctggtttacaaactccagctgaaattttggtggatgatcctaatcaaaacaatttcgaaaatgcttttgctactcataattttagagatgcattcaacggcaataaagatactgccaccaataaaaaacaagaagaggaaaagaaagtgaaaatgaaaaaaattccttcaatcatttctaaaccttattggagaattagtgatgctactgtcactgaagttagtaaggct

SEQ ID NO: 2065 - DNA, 279 bp, Candida albicans
  unsure (101): Identity of nucleotide sequences at the above locations are unknown.
ttggggataaatttaaaatgggtgctttcatgggcttccatgttgggagtaagggggggtggttttatttggtgggttgttttattttacaaaaatggtgntggaccaaatggagtaatgggaacattgggtcaatatataatggggtcagttggaacctttggattatttatgtccatgggatcagtgattagatcagaatcgggatttcaaaattatgaaaaatctatggttgccatgcaaagagccaaattaagagcaatttacagagatgaataa

SEQ ID NO: 2066 - DNA, 696 bp, Candida albicans
ccccccgcacggataccttctttctcccggcgtgtacgactatttatgaacattagaataatcggatttgatttgacacaaaaattggtgccgggaccaaatccacaagatatatcatttcttccattgaatgctgagtttaataatatggtgaatcaaatctctagtataataaagaatcaattgagatcaaatcccacaaaagtgattagattgataattcccagcattctaaacccatctttatatcatccatcatgttcttcatctacatttattgtcccatttatacattcactacgttctttagtacgtcgattttctaataatctagtgttggtttgttctatatcattagatttatatccaaaagactcgagtttattattatgtattcaatcattgtttgatgccattattcatcttcaaccattcaatcaagaaatgactcaattactagaaaaagcttataaaaatgaaccaacaaagattcaacaaggtttagtgaatattattaaaatacctattttatctgaaaaaggtctaatgatggtacatgatggagaatatgcttttaaaaatggaagaaagaaatttgaaattgaagaatggagtatcccggtggaagatgattcaaaagatgatactcatcaaacacaagaaggaggtactacaaccaagaatattgatttttaa

SEQ ID NO: 2067 - DNA, 360 bp, Candida albicans
cgtgcaccaccattgggaagaacaccaccagcagtaacaggtaaaggtatcactacaacaacaacttcatcattccaattaaaatccaaacctaaatcaattgaaaaagataatgctacccaaatcatgcaaaacccgggtgtaagaccatcattagtgacttcacaaccaacaacatctactggaagttctgatttagataaaatcctattgcaccaaagattaccgcttgggaattcattattaattgaagaatcatgtactacggatttttcttctgttttgttaagggcatttgcatcacacgggattttgcacaatataatttcaaatgatattaatgctcatgtcattgttttg

SEQ ID NO: 2068 - DNA, 1359 bp, Candida albicans
ataccaaaccttagaaacacttaccaaaagccaatgcttcaaccgttatcaattaagtctaaactaggtttgggcttgcttttatcatatacttcatatgaggtttatatgcaagtgaggactcaatacattatcaaagcaagaaaagaagagtacaagaatttagaaaatggaactgatattgatatatctaaatttagatcgacttctgttggaggaatgtttgtcaacccatttgaggaatatcgtccccagacagcatttgagtttattttagtgaggattatgcaactttttgaaagtgtttatggtaatacgatcgagcttcataaaaaactcccacagccacatgatggtgccgttgaagtggaagatattttaaaagtattcaagcctgatttagagagatttagaaagaattcagaagttttaaaaaagtgcatagaaagcaataatttcctgcaattaaaagtaaagccaagttggtttaattcgattcccttgcatcaacaattacttttcacttggttgggtcaatcttgcaccttgtttcaaattctgggagttaattttttaactgatcctataattagtgaacacttgatcactccatctataggacccaaaagattgactcgttccccaatggatttggaccagattaaatttgcaactaatgacagcttgaattttgttttggtatcacacgatcaccctgaccatttagaattggatttagctgggaaaatcaaaaatacaacaacttggattgtaccccttggcttgaagtcgaaattggctcgtaaaggtatatataaagttattgagatggactggtgggatacaatagacattactaattatatcagtgataatttgtctgacaagtatgaaatcgagtgtgttccttctatgcattggtccggtagatatgtgattgattctaaccaatctttgtggtgctcgtatgtgattaaacgtaacggagaatcactagtgtatcatgcgggagatactggttatctgaaagaactatttgatgttataggtaaacgatgcggtccaataaagttggcattgttaccaataggtcaatattgtcctagctggcaccaaaagcctcgccacatttcaccagaagaggccttgcgtatttgctcgcaagtgcaggcatcatttatgaaaggtgttcactgggggacattcaagttgagtggagaaccaattttagaaccaaagaatttattgactgagctagcccaaaagattggaaaggcggaaacttatagagttccagaatttggtttgacatatctttttgatttacaaaacaatactgagacagagattcatgtttag

SEQ ID NO: 2069 - DNA, 1251 bp, Candida albicans
  unsure (14): Identity of nucleotide sequences at the above locations are unknown.
agaaagtccattanagttggggttatagcacaagtttatcttggtaagctttcacccaaagtattagaaagagctaaaaaagatgaagataaacttgttaaacaattgaaattacaagctgaagacaaacaggaacaattttttgaaaacattgttgttacagaacacttggattcaaatgaatttgttgccattaaagtgttgcatcctaatgttgaactcaaaatcaaccgtgatttaaagattatgaagttttttgctaatgtaataaacattatcccaacaatggaatggttgtctttgcccgatgaagtcgagcagttttctatattgatgagactacaactagaccttagaatcgaggcactcaatttggccaaatttagagagaattttaaaagtagattggacattcatttccccaaaccatatttgaactttaccaccagggatgttcttgtggaagaatatattcatgctatcccattgagcaagcttttatcattgtcagagaattatggtaagaatttatctaaagaagttagtgataaaggtttagatgcgtttcttaaaatgttgattttggacaattttgttcacgctgatcttcatccaggtaatatgatggttcgcttttacaaaaatgaattatacagacataaaaaggagtacaagatagtgaaaacttctaatgagacggagacaaacaaaataacaaacgaattattgaaattgggcgacaacaccaatgcatggtgtgaaaaattgtctgaactatacgaacaaggatatcacgctgaaatatgtttcttagatgtagggctagtaactgaattaaacaaagaagatcgaattaactttattgatttattcagagcattgtcagaatttgatggatacagagctggtgaattaatggcagaaagatcaagaaccccagaaacagtattgaataaggagatctttgcattgaaagtggaaaaattagttgacagaatgaaacaaagaacattcacattaggaaatataagtattggtgatttacttgatcaagttttaggaatggttagaaaccatcatgtgagaatggaaggtgattttgttacagttgtggtggcgattttgttattagagggaattggaagacaattggatcctaatttggatttatttgcaaggtttgtatatgcactattatttggttttcctactgaagaaatggagcttttcagcttgtttttggtccagtag

SEQ ID NO: 2070 - DNA, 912 bp, Candida albicans
agaccatcgaaattatattcacaaccacaacaatctttcaattcagagtgggtagaggatcaatcatataacaattcaccgtccaaactatcaacattattagagcttgaacttgaacgtgaacgcagtaacaacatcaacaatatgtcaggtacagtaagatcaattgatccatcgaaatttgaaaccccatctaaagcatccagtaacaacaaccacaacaacaacgcacttaatttcaactacattaataccccagtttctaatcacaaattagatatcaataataccagcactaataaggacaactaccattacaatgacaataacgatgaatatattgaaaaggcatcgaccacatcttcttcaaccaccataacgaccagattaccaaaagttagtaattgggatattttttggtcaatgcttaatgatcttgttggtaaagacaaaatggccaaagttggtcaatatactttacgattattagtttatcatgctgggaaatcacaaacttatttatctgataataatataaatattaaaatcattaatgaacggtataatgatactacgaaaaaattgaatttattgaagaattttttcaatcatccagctgatttcattaaaatcattgttattttgattctttcaatttttaaacaaaaagctgccgggatgattaatggattatcaatgtatagacaatttcttcgatttggtaaaactccatttagaattagagatttaattgttaaatttcatcataatgttttcaataattcttccgataatcaagttcaaattaataaatcaaaaatatttgatcgtaaaactttgggacaatttttatctttatattatggaattaatgatggatccatattactttataatgctcaccagccgtaa

SEQ ID NO: 2071 - DNA, 1497 bp, Candida albicans
ttgatgttagtttctcgtttgtctgtcaatactgtaagacctaaatttgctcataatattgccaccaccctttctaaaacgaaaaagaaattcattaaaagctcatctgattttgataaattcaagattagatacgattacaccagtcagtttgaaatccatccaaagactaaaagtatgtattttcccaatggagctttgattcaatcatttgatttattcaaaaatgaacagaatttcattcagcatggtgctccagtattgggtgtgggtaaagtcagatcagaaactaaattattggatcctttggttacattattgaaattcactcatgatggagaatggatgtgtacatttgatgaattcaccaacactgaagttgacagtttattattgaaaaatgaaaaacaatatgcattgaaattttggaaatatgttggccataaagagaatgcaaccagtggaattaataataacaataagactggtcattgggaattgactacaaagattattgatcctcatggaatgaatcctattttagccatgatcccagctccaacttcttatttcaatgggttggcattcttaactgctgatgataaaggtggtttgagaatttggagacctagtgtacccaaagaacaatataaaaccacttcagcaaggtctcagcaaactgcatggacacttagaaaatccagggctccaagtgcattgtcatcagatgccgttgctttaagttggtctgatgacaattcattgattttccttgcccatgaatgttccattcttaccattgattctaagagctttgaagaaattcctgatttcaaaattccttcattatcaggatcaagagtaagatcattaaacatggtcaataataatcttatagtgttatctaaaaccagaatatcatcatttgatttaatcacaggggaattgactagtttggtagccaaagtgaacaccaccattggtgctaagaatttaattgctattgatccaattaaaagattaatatgtttggcattaaattattattctgaagaaaacaataccctttccataaaatccaaaatcttaatttttaaaccaaatcaattaaaacctatttgtgttcaattgcatgagcaaggtgtttcatcgattcgttatttcaactcatcatttgtatttgttgatttggattgtcgagtcggtacaatttacagtaatgaggaaataactgaaacaattgaacttggtttaactcaagaaatcaacaatatgctaatagctgcacaagctactgctgatgtaataaacgatagaaatgtaaagactacagttggacatcaaaatggaaacaaggaaggagaaatggatatagacaacagtatggcatatgctgcaaaagtggttgatcttcacactttccaaccaatatttcaaaatattgaaggtgtacaagttgaatcattatttgaacgtatagttaacgtacttaaatag

SEQ ID NO: 2072 - DNA, 1035 bp, Candida albicans
accatctcatcatccaaacaaaaaaattttatagagacttttccaaaaaaagaaaaaggagcattgacatctttctgtacttctggtgaagctatactttttactctaatcatgccgagtgctatatcagaatggtcattatccatggccacaggaggtaaaccattatatttaccttgttcacaaacaactgcatctgtctattctcaagatggtcgatatgtgatcattgcattaactcatcaattgagagtatatttcatttcaacccgacaatgtattaaaactattgatttggatttacatgacttagctgatttgaaaatagatgttactaatggaaatcaagtgttattatttaaaacttctggagaaatattaactgtgaattggaaagataaagtttctcaaccaataatatctaccattgatataaataaaactcaatcgggtacatcattgccgttattatcagtcatatcagttaaacatttattttttattattgtaactggtagaaaagaaaagaaaaaggggactccacatactcgttatataaattattttgatagaaatctggaatcacttgttccaataattgaagttgccaattcaataaattttgcaacttctttggataatacaaaaattgcattcattaccagtggtaacgaaatagacttgtttgatttatcagggatattcaatgtcgacagtattgaaaatttgtcagataacgatatcgtcaaagaaactattccatttgtgtatcgatcaccggtgacatcaatagccgtgtccaacgattctatgattgctatcggtacatctgctggtccaattcaaatagtctatggtgggttgaccactccaaaacctcaacgagttttgaaatggcatcttgatcaagtcaaaggattaatgttcactgctgataacaattatttactttctggtggtatggaaaaagtattagtattctggcaattggacactgaaaagaagtcttcaccaggcgaaggtggatcagcgtcg

SEQ ID NO: 2073 - DNA, 1056 bp, Candida albicans
agtcaaaaactattattcaaaactattaaaattatgggttgtggagaactactatctgttccacttgtatttttatcattattttctcatgaaaatgtccctgttttaaacactggcacaacagatgatgatgggaaatgtgaattaattgggacattttcgttaatgactcaagccatattaggaatgttatgtctttcttcattattaattaaaagattttatgaatatcccatacgacgaacttggccagtttggatatttgatgtatcaaaacaattgattggagcattaggagttcatatatttaatgtgattttatcaatggttaaaactgccccagagatttggttaacccagaacaacaacaacagtagcgatcctgatgatgataacacgaaagatccttgtgattggtattttttgaatattgttcttgattgtactattggagtatatatcttatatcatgtatttaaaaccatgaataaaatatgtcgagattattggcatattacacagattgaaagtggtgaatatggaccaaatcccaataaaccatcaactaaagcattcctcaagcaattaattgtttatttcacttctttgatgattacaaaaattatattatatggattagttgaatgttttgaaacgcaattattatggtttacatctcatgtattattaatttggttaaatgaataccctgatgaatttgaaatttttatcgtgatgtttattgtcccaataattatgaattgtttacaattaatacttattgataattttattagaaatcaaatgtggattaacattaataaacgaatgagaatagaatttcctaattttagtgatgaaacagaaagtgttcaacaacaagatattatccaagcacaaagagaagaggaagaggaagaagaacaaaggaaatacctgttaatgaatgatagtactgaaggtggtaacaacaatcatagtagcagtagtagtaatgatactttacttggagaatctcacaataaaaacaattatggctcttataatgatgtatag

SEQ ID NO: 2074 - DNA, 1002 bp, Candida albicans
gggttgttctcgggaagaaccatatccatacctaaattattcttggaggggaaggctaaggaccaggggaacaggaacttgttttacggttatttcaagagaaattcttcacgtaaatcaaccacctttaggtatgaaatatttgataatgatttagtggattcaactaaggataaatctattttagtatttgatattgttaataattttgaattgaaacgaacattaagattaattaatgataaaattaatgaaagtcttttagtggaatcatttattaaatatcgtaatttaataattgtttggtctaatgataaatcattacgtgcttttcattatcaaaatggtaaagaagttggtgtagcatgggggcatctggaatcagtattggaattatatttatttaatgatcatgaaataatttcaattgggaatgatgcatgtttattttattgggaagtaattgaaaatttgaaatcatcgtcatcgtcatcttcaagttcaagttcttctggttcatctgctggatcagttatttctcaggacaataatggtaaggaaattcctgaaaaacaaatttcagctccattatataccaaagtgacaagaaaaatcttaccaacagccccaattaaaccaatagagaaagaaggacaaatcactcctacaaagattaatccaacaacaacaacaaccaatagtcctatacctaaacttacagcagcaactttgaaaagattagaggccaaacaaaatggtgctgggcataccatttctccgtctcgttcaattagtcccattagatctaactcatttccaaattcaaactcaaattcgaattcaaactcatactcagcatcaacgtattctgctccagttaaattatcagttcgaactctgaatttttcgaaattacaatcaccatcaaagactcctgtgattaatactactttcccaaaacgattaatttctccaacaagaactgataacattaaaacttaa

SEQ ID NO: 2075 - DNA, 933 bp, Candida albicans
gtcctggggggggggctgtaccatggtaatggggagtattggcttggcatgaatttattccagcaaatagaattgtgggaaaatttccatcgtgggaaacacatttggagtggtgatgtcgataatgtcgaattgaatattgctgtaaccggtggggcagacggcaaagtcagagtccacgacttaacccagcaagaccgccaaaagttctccctcgccgaaatatcatccaacatcagtctcaacaagtcggattttattagagactattttgaattgccagaatttcttgtcttgttaatgtcaaatggttatttgcttatacgtaaggacaacacatttaccagtttgggctattttgaagagtttgatgggtttggaattgtcagtggatttgcagatcttggcgtggtgctagtctgtgctagagatggaagaatcttgtctattgatgggagtgctactccaacatggatcaccaacccatgcaacaacaaaatagttaacatgttgctagacacaaactgtggcagacactttgtattgcttgaaagcccaaacccaaatgttccatttacactccacgaattgacgtataccaccagcttgcaaatctccaaaacatgggacattcccaaaccggaactgagatttagtgtaactgcaatgacaatagatacagtccaccaaaaactcatattggcatcgaaaaaagttactattggtgtattcgatttagagacacttgcggcaactgtgtttagaaaagtatcaccaggtgattcggtttcgtcgttgtcgattattaacacaacaccaaaaagtctccaagtattggtagttgctagagatgggttctataccattgccgacatatcaggcacctctgcatcaaacatcttacaacagatcttcaccacgggtagagatcca

SEQ ID NO: 2076 - DNA, 828 bp, Candida albicans
  unsure (36): Identity of nucleotide sequences at the above locations are unknown.
tacccattgccgacaaattcgggcacgtctgcatcngacctttttaccaacaggacaaaatcaaccagaggggtaattgaaggtgggtttatgaacaacaacgacttgatattgtacgggtttaagtcgtcgtactttttagtgtggattgaaactaaacagatggaaatcatgaatgaacagtgtgggggcagcggacacagacattacaaattttatcacgacgccgccgaatactttaaatttatttacactttgaaaaacgagttatgtatacgtacccaccacgtacgattcagcaacacgtttgggttgattcagaatggtactcacggccgtgagatacgtgatgtggcaatttccagcgaccataaactagtggcaacatcgtctgaggattcgtccatttgtctcagtaaattgtctgacgatggcaaactcgtcaatgtttggaacatgaccaaccacgtctcgggaatgcaaaaaatcaaattcctcagcaaagactttattgccagttctgccgctaacgaagagtttattgtatggaaattgagctggtcgcaagacctcccgatgctaatggagtataaccgattaaaccctaccaaagagataccagatttgcgtgtgatggatttcagctctataaagagtgatacggggttcaccattgccacagtttattccgactccaacattaagatatggcagtttgatcttgattctgggttgcacttgctcaagtcttggttttactctacatgctgtatattgaattgtcaattcctaaacaaccactacttacttattagtattcttcaccgg

SEQ ID NO: 2077 - DNA, 1455 bp, Candida albicans
agacagcaacagcaccaacaacagcaaggattacctggtatggttggtgcccctggacaagaagctggtaactcaaggacagtttatcttggtaatttacctaatgatcttgaacctcatgaattacttgattatgttcgttcaggaataattgaaaatgttcgaattattcctgggaaaaattgttgttttatcagttttttggatactaatgctgccttattgatgcatagtgagtttattttgaaaaagatcaacatcaaaggttataatattcgtgttggatgggggaaaaataccactattcaaccaggagttttacaagcagttactaatgatggagccacgagaaatgtttatttgggtaatttatctccgctggatatatctgaagaagaaattattaatgatttgagtatttatggtccaattgaatgtattaaaactattccagaaaagggtattgcatttgttcattttcttagtattgcctcggctattcgttgtgttaataatttacaatcagaaaaatatcctaaagtatattatggtaaagatcgttgtgcatttattactaaaactcaacaacataatgctgctcaatatttaggtttggctcctggtatggaacatattgttactgctgctgatcgagaatttatttctctggcattagtacaacaatcagctgctgcagcacagattgctactcaagcaggtggagctaataatttggggaatcgtacagtttatttgggtaatttacatcaagattcttcaattgaagaaatttgtaatgttgttcgtggtggattattacaaagtgttcgatttttaaaggaacgtcacgtttgttttattacatttattgatccaatcgctgctgcccaatttttcgccatgtgtcaattacatggattaacaattcataatcgtcgtattaaagttggttggggtaaacattctggtccattatccaatgccttatcgttggcagtgtccaatggagcttcaagaaatatttatattggtaatattgttgattttgaatatttcaacccagctaaattaagagaagatttcactaaatttggagatattgaacaaatcaattatttagaagagaaaaattgtgcattcattaatttcattaatattgctaatgctattaaggcaattgatggaattaaatcatttgaagattacaaaaatttgaaaatcaattttggtaaagatagatgtggtaatttacctcgtcaattccaaaatcaattacctttgtcaacttcattatcatcttcatctccttcaccaacaaaaaaccaatcttctgctggtgttacaccagcatttgctaatgatcatgacgatgatcataataatccatctttactgaccccacaaaccgaaatctcactgggattcaccttcatcaacgaccgatttttaatctga

SEQ ID NO: 2078 - DNA, 624 bp, Candida albicans
  unsure (35): Identity of nucleotide sequences at the above locations are unknown.
tcccccgagataatgcggatcggcccgtccctagngaaagatactgtcagagaacttttacaatggtttaaaaaatatattgatacaactcaaagtaatgatcataaattgcaacttgatattaaacgatttaatcctactaaaatcacaaaatttattgttcaagatttacttactgttcatgatgatattagttggtggtatcatagaattcaatttggaatttgggatttaaattttttgaaatatttgaatcaaagtgattatttccaagataaatttggtaaagttaataaatttggttatgatcaatttgatatttttaatattagtgttaattggagagattcaattcattatatcaactacaatttctatttggatgaatcatcaccagttgatagagtgaaaattaaattgacaggagtttcattgatttatataagtacgtggtcagtggggttccttactaaatttgtgccattattacgtattcaaaatttaaaattatattcatggacagttaataataaattacaatattcatatttaaataaagttggtaaattggctaatttggttgaatatggggttatttccgattatcctgatgttatggcttaa

SEQ ID NO: 2079 - DNA, 681 bp, Candida albicans
  unsure (649): Identity of nucleotide sequences at the above locations are unknown.
acatgtcttgaccgcttggtgaaaaccataagaaatcggtcttatgatgaacttgatattgaattgaaatttaaggcattgaatattttgattgatttggtcattagtagtcctttggtaagaaatcatattgatagttgtcttgaaaatctgacactgttaagaagaaacagattagataatttaaaagaatacaaaattgtgttggaactggctcaaaaggcccatcaatacataactaccaaacttgcaaccacaaaaaatgtttcacagttagatcaatcatcaccagagcaacaacaacaatcacaacaacagcaaccacagcaaacagaacagatatcagaaataaagaaagggttagatctcaataaacttgaattatctgaatctgaacgtttacttgctgaacaagataatgaattcaaagaacaatgtaatattagaaaagacgcaattatcaagttgaatcaattgaaagaagctaaacgagaaattgaacaaaaattgactgaattagattgtcaaagaatgaaattattagggaaagatcgactttacaatagatattggtggtttgaaaataatggattgccaaatttgcattctggtgggaacaataatgatgaagatgatgatgatgatgaanaccatgaccatcatcagaaagatgaaagttga

SEQ ID NO: 2080 - DNA, 3561 bp, Candida albicans
  unsure (3495): Identity of nucleotide sequences at the above locations are unknown.
gatgtgaaacataaaactatttttttttttattttcattaataaactccctctttaccctccaatctgccacaccatcatggaacaacaacaacaatctaataaagcccatagaggtggcactaagaaaccaggagctaaaaagaaattacatcaagatggacaaaacaaaaaggcttttgccgtatcagcaccaagaaaattggaacgtatggccagaagatcccatgatgtcaatgaaaaaaaattacatgtaccaatggttgaccgtacccctgatgatgatccaccaccagttattatagctgttgtgggaccaccaggcacggggaagtcaacattaataaaatcattaattagaagattaacgaaaacaacgttaacggaaatcaatggacccataactgttgttagtgggaaaagaagacgattaacatttattgaagttaataatgatttaaattctatgattgatattgctaaagtagccgatttagtattattattgattgatgggaattatggattagaaatggaaactatggaatttttaaatattgctcaacatcatggtatgcccagagttttaggtgttgatactcatttagatttatttaaatctcaactgacattacgtactagtaaaaaaagattgaaacatagattttggactgaagtttatcaaggagccaaattattttatttatcaggagtcattaatggtcgttacccagatcgagaaattttaaatttatcaagatttatatcagtgatgaaatttagaccattaaaatggagaaatgaacatccttatttattagctgatagaattactgatttgactcatccacaaaaaatcgctgaaaattctaaatgtgatcgtaaagtggcaatttatggttatttacatggtactccattacccgttgaaaatgctcatatacatatagctggtgttggtgatcattatgtacattcagtggaaaaattacctgatccatgtccaactccttattatgaacaaaaattagaagaattggaaagagaaagagtgaaaaatgctgcagcatcaggtgaaccattagctaaaactactagaagaaggaaaagattagaagataaacaaaaaatcatttatgctccaatgtctgatgttggtggagttttagttgataaagatgccgtttatatagatgttggtggtaaagaaatttataaaactggtactggtacttctgaacttaaaggtgaaggtgaaaaacttgttaatgatttacaagaaatatctcaaaccatgactgaaagattagaagatggacctggtttacaattattttcaagttccaaagcattaaatcaagttgatgaagatgataacaatgaagaagaagatgatgatgatgacgaggaaggacttttatctgatgaagaaaccattgttgatactggtcgttcatctttaagaaaagctagagtttatgggaaatctgttagtgaagatgatgaatttgatgaacttgaatctgatgaagaacaggatggagatcaatttagtgatgatgaagatgacgcggaaaataacttaaagagtagaggtatggttgaagtcaattttggtagtaacaacaaatacaaagaaaatgatttggaatatgtggaagactcctcattatcatcagatgaagattattataaaaaatctgctgccaagttgactggatcagttagaagaaaatgggatatcataaaattgatttattttaaggatattgatgttaaagaggtgataaaaaaatggagaaataatgatgttcaagatgacgacgacgacgatgatgtagaagaagaagaagacattgtacaagataatcaagatttttttgttaaaaagaaagttcaagatgataaagaagatttagatacttctttaccacgtttccctacacttgaagtattaaaagcaaaattcaatcctaacactatagatgaaaataatagtgatgatgaatatgaaaatggttacaatattttaaaatcacgattattagttgcaccaaaagtgactgatgaaactgaagaaggaaaagaaataaaagaaaatgatgatgatgatgaattatatggtgattttgaagatttagaagctactgaaaatcaagatcaagaagaggagcaaaacaagagtacaaaaacagcagaagatgaggacgattttgctgattttgatgctgaagaagaaaaggaagaagaagaagacgatgataacgtagatgaagaatcaatgactactgaagaaaaaagacaattaaatgcagctaaaaaagccaaattaaaaatgcagtttgaagaagaagaagatagagaatttggagctagtgaccctgaagatgaatcagaaacctggtatgaatatcaaaaaaataaaatggccaaacaattagaaatcaataaagttcaatatgaagaaatgacaccagaaatgagaatcaaaattgaaggtcctcgagctggatcatatgttaaaattgtatttgataatattccatgtgaattcattgataattttgatccagcatatcctttagtattaggtggattattaaccactgaatctagatttgggataatgaatgcgagaataagacgtcatagatggcataagaaaatattgaaatcacaagatccattgattttatcattaggttggcgtcgattccaaacattaccaatttataccactagtgattctcgaactagaaatagaatgttgaaatatactccagaacatgcttattgttttgcttcattctacggtccccttgtggcacctaataccacttttgtggggtttaatattgttgatagtaaatctactactggtgcatttagagtggctgctagtgggattattgaagatattaattctagtgttgaaattgtcaaaaaattgaaattggtagggtatccatataaaatattccgtaatactgcatttatcaaagatatgttttctaattctttagaagttgctaaatttgaaggtgcacaaattagaactgtgtcaggaattagaggagaaatcaaacgtgcattatcaaaacctgatggctattttagagccacttttgaagataaaattcttatgtcagatacaatatttttgaaaacttggtatcctgtcaaagtgaaaaaattttataaccctgtcacgtcattattattaggtcaacattcagaatggaaaggtatgagattaactggacaagttagagctgatgaaaatattgcaactccattaaatgttgattctcaatataaaaaagtcgaaagagtggaaagaagatttaatccattgaaagtacctaaatcaattcaagccgaattaccatttaaatctcaaattcatactatgaaaccacaaaagaaaaagacttatatgagtaaacgtgccgttgtattaggaggaaaagaacagaaggctcgtgatttgatgcanaaaataaatagtattatacacgacaaagaaccaagagacaagcccagaaagatgagaaatttatag

SEQ ID NO: 2081 - DNA, 1467 bp, Candida albicans
  unsure (52): Identity of nucleotide sequences at the above locations are unknown.
agaattgttgccactggatacacttggtttgtgttaattggatatttattantggtattattggtattggtgaaatcagtgattatattattaactcgtgccaaaaaaattaatccaagaacttttaattccttccgtggaagtttccccaatttaattaaaggatctcttttgagatatattgccattggatcgactcaattgataatattttccttatgggaattcactcaaaatgattcaccggctatggttgttttagcagtgttatttgtattattattattgggggtgttgggatggtcatatttcaatgttatgaaaattggaagacaatccattagaacttataataatcccgcagcattattatatggtgataataaagtattacaaaaatgggggttctgttatacaatgtttcacgccaacaaatattggtttggtgttgtactcatgggatataatgttttcaaagcattatttattgctttttgtcaaaatgccggtaaagtttctgttttaccgatttttgttgctgatttagcttatacaatttatttgatttggacgggaccttatttgaataaaccaacaaatgttatcaattatatgatgtcaattgtcaccaccattaattcatttttatttttatttttctctgatttatttggtcaaccagctcctgtggcatctattatgggatgggtatttttcattttaaatgctgccttttcattgattttattgattttggtcattgtatttgtattattatcagtaatgtcgaagaatcctgatgctagatttgctcctgctaaagatgatagattttcattccaaagaaaatcttcaatcaaacacaagagtttaactgaaaaaactggatttagtaatacaaatggaggtcacggtggcgttggtggtggtgatgaagaattgacagcattaggagtagcagcacaagatcattcagctgattgggaatcacaaatgtacaaacttaatgatttatcattagatgaagaagatgattcaagaacaaatcaagattttgtcagaccagataaaactcgtgaactaacatcagattatgatgatgacactagtttcactaatgaagataatactcgtgttgtcaataatgaagaagataagaataaaaaattggctgaaaaatggaaatcaaaaatatctagaaaattgtcgaaaaagaaatcactaaaagataaaaacaataatactaccaccactactaataataacataactacagtaagaagattgagtgatacattgcttaatgatgaaagagattcaaatgagaaacgtgaagaaaatgatgaattgtcaccaataacacatccttataatcaatcaacatcatttaataatcataaacgtgaacattctacaacttcaactatatcaaataacaacccaacccacaccaaaggatttatataa

SEQ ID NO: 2082 - DNA, 642 bp, Candida albicans
catttggacactagaaaaatttattttccctccacttcccttttctatataatgcattatcatttttcatcagtgacttcaacaagtctaaatcgttatttattttatagatcttttacaaacacagtactgtattggtcttcatctcaatttcatattagactcaaattcactactcgatcaaattgtacgacgacaataacaacaacaacaacaacaactgcattattatcgcgtcatttttattccacattttcaatttttcaacgaccaatgtcaacttcaaacaacaaattgtccaaagaaatttcaccaccaccaccaccacctggccaagattctcatagtcatgtacatagtcatagtcatgattcagaacattcacattcgcattcgcattcaggagcaagtatgcttcatcatcacaaacattcaatgcatgaaccaaatgaacttttagctggaggtgcttctgcaattaaaactaatccagcagtgagaattacttggattggattgttagtcaatgtcacattggcgatttctaaaggtattggtggtgtttatttccattctcaagcacttgtggcggatgcaattcattacagtcgtcaaccacgggctggaaaagacccgcgctaa

SEQ ID NO: 2083 - DNA, 561 bp, Candida albicans
attgggaccttctacgccgtggtgaggactactaaaaccaaaagaaatgatggtaataccttattaggattgacatatttaattggatcaatgatattagatggattaactaattcaactcaagatcaattattcaaattacctttagaaaataaattaactagtgggaaattaatgtcattattaaatttattcatatttatttggacaagtttatatactattattttccataaatatgaaattgattataccattaatttcattaataattatccagaattattgattgatattataggatttgctatttgtggtgcaattggtcaagtatttatatttattattcttgaaaaattcgattcaatcattttaataactgctactgtaaccaggaaaatgttaagtatgatacttagtgtgattttatttggtcatcatttgagttgggaacaatgggttggtgttgggttagtatttggtggtattggtttagaagcttttattaaatttaaacaacaaagtcaacagaagatgaagattaaatcaaaagtagcatag

SEQ ID NO: 2084 - DNA, 630 bp, Candida albicans
  unsure (22),(23),(24): Identity of nucleotide sequences at the above locations are unknown.
tattttaacatttgttaccccnnnttgccgttatttgaaacaagaaacgttattattcacactggggtaactttgaatttattaacagtgattgctgccttgcaatattgtattgtgggattgattttttatcctaataccggggttattggcttatcaggtattgcctttctgttgatgagctatatggcgtaccatgaatccaaattcagaccaataatgcatacctttcatctaagcaacagtttggaaatcaaactctacactttatacgtaccattcgttgtggcaattgtatttatgattttgtttccttccagttcattaccgggccacttatttggaatcacgacaggttatttgctaagctatggctacattgataaattatacccaccatctaaagtgattaccactattgaaaacaaattaagctcgttgattaactttttagaattgatcgtcacattctataaggaagaagaaagtttggtaacaagaggaagtgttgggtataagccactttttaatcaggatattgaacatggtgcagctaatgccgcatcacatggttcaagtgcgtttgtcggtgaaactagagtattaggaacaagagagtcgactgtatag

SEQ ID NO: 2085 - DNA, 564 bp, Candida albicans
agcatttatcacaccacctttttttatcttttatcaaatatgacttactcagggttagttactccccattcaagaccaaccactccttcttttggattaaattccaatgctgcaacttcagctacaagcacgggaccttcaaattctagttctggatccactcccaaagtaattgttccatcgtatgaaaagccgatacatgaatccttatcacagatttacaaaactttattggaattgaagaacaatagaagcaaatacattaattcaaaacaaatatacaagatttatcatgagtttcttgatattttgaatgaattgaaagtgacgagaaaggatgaggaattgaaaggtatcacattaaatttgcccaatactaatgatttaattactgatgatatttttcaattattatcattatgttttgtgacttgtggtttgaccaaatttgccccagcaacatatagctctttgagtacagttatgaaattattgaatcatttgaaagaatgcaaagtgtacaccgtcgttcttcaccgccggactggccggatacgcgcttaa

SEQ ID NO: 2086 - DNA, 705 bp, Candida albicans
aaacagtatgcacaaactgatttatactcatatcaaaaacaattgaaaacatttgatgaacaaaggttgaatttggtcaaacaaacaaataaagatgacacaaaggcattcaaaaagtcgcaattattgatattatttcttttgagacgatgttatggattagtttataagttattggagagtagtgaacctgtcagtgaaagtataactcccattcataaccaattgcaaacggtaaagagatgtcttttagaattgaaacgtgttgatggattaaacaatttaaaggaattatacccgttccaattcaaattggcatcgttagataatcttcgtcaagatggtaagtttattgtggatggcagtatacccgagggtcaaggaacactaaatgctctgcttgctgaatgtttggatattgtgcaagaattgaagattgaattagaggaaatagaaattgagaatggtgatgaaggtgaagatgatttaaccggtggtagttttaccaactccaaaacaattggaaatggtgactatgagttgaccgatgatgatgttgaaatcaaaagaaatagatttcatgattttaatgaagctgattatgacttggatagtgaatcagattatgatgatgatgatgatgatgacgatgacaatgattatagtataagtgaatctgaatatgaaggaaatgattactattaa

SEQ ID NO: 2087 - DNA, 1248 bp, Candida albicans
tcgaataacaacagccaaaatcaactagacgaatttaaaaccgattcagtagattcattcactatagaagagcttgactgggtaaacacttatgtttatcacccagagttatccccactccaaaaaatcaagtatttttcaatgtcattttattcaaaatatatcaaaccaaacattggattgtctctattgttactatcacaatttttgaattcgattatggtgacaacttgtaagttattggtcaccgataagaacttcaacactccgatccatccggcacaaatattgtttgttagaatgttcatcacatatatttgttgtctattatacatggccatcacaagatctgttcccgatgcgccatttggtcccaaaccaattaggaagttattgttgttacgaggcttggtaggattttttggtgtttttggaatgtacttttcattacagtatttgagtctttctgatgccgtagcattgactttcttggtaccgatggtgacagcatttttggcatttgtgttattgcacgaaaaatattcaatactagaagcaatctgttcagtattctccttggctggggttgtattaattgccaaaccaacgtttattttcggtaatgaatcaaacaaagaaaccggtaatgacgagactatcgagagctcatctagtgaaaaaagaattttagcaacaattgtcggattgattggtgtctgtggtgcgtcatctgtttatatagtcttacggaaaattggtatgaatgctcatccattgttgtctgtctcatactttgcattgacctgttgtatagtcacgtttcttgctattttggtaattcctagtttgacatttgtattaccaacaaatgcttatcaatggacattgtttttcataattggcttttcggggtttttcatgcaattctctctaactgctggagttcaaagagttaaagctgcaagagcctccttgatggcttattcgggtatgattttcgctgtggtttgggatttgacgatatggcatcattttcctgggattttgagtttcttgggaattacattgattattggtaacgccataattatcttaaaattcaaaccgcagcaagaggagataactgataaacaaggtgatgatatcgaaagaaacggaaaatataaccgtgtcgatgattctattactatgcaagactttataataactgacgatgaggaggatgagaatgtccgtggtagaacttaa

SEQ ID NO: 2088 - DNA, 2913 bp, Candida albicans
tcccctataaataagcgcggatccgtccagtccgtgagtgaagacagcactgcactgaccactggaatgcatatatctaatattctagatgatcgattaccccaacccctgtccccagccccaccgtcacaccaacaacaatctggtacctctacttcaaggaaatacagtataaagccccatgcttcaccgcaatgcgctaacatggttcatcaaaacaccttaccgtcacaaacccaatcaaatgtacgtatgtctaccaacgggatactgcaaaatcagaaactgcttcagaatctttcaaactcaattcctgctgttcccacacaacagtcatctccaggatatcaaacaactatccaagcaaacaattttgttcatatccaaaacgaattgaacaactttaacaatttgaataacttaaacaacttgaatacgttgtataaatcatatggtacgacgattcctcagaatgatatattgtcgtggctattcaatgactcacctcaaggaaactctttggtgcagtcttccccagaaacacaacaatcaatgcccagaagatcttcacagccactcccttccttgcaagaacaagaagttcaaagccaagtcccattaacttcccaattccacccaattccatctccatatggagggtctcagttctcacccatggctgaccaaatccaatcagggctttcagtgcccgtttcctcggcattacctactggaatcccaaattacccgtttgatatgagcgcgttttcgaacggatatggtgctgatgctaatatatttctgactgatgacaaccctttggataatatattgtacaaaaattaccatacacttcaaaactcaaatcagttagttgataccagcaaagacgactcgttgcgcagcattggagtaagcatatcatcggcatctcctacaaatacagttgaatccagtaatgataacaccacagaaaatgcccaagaagaagaacatgtctttttcaatcaccgagagaagaatattcctaccaatagacactgctttattgaaccaagtatcttaaatcttatgctacaatcaatcggggtctctcgtcaagatttaccatttgacagtaattacccactagagcatagattttcattttacttatacctgtattggaaacatttccattcacaatttacgatattgcataaaccttcatttgatacaaaatcagcagaaccattattgttgatagcaatggtatcattaggcgcttgttatagtttcccggaaaatgcccttttattagcaaaagaatctaagaaatcagccgagtttaaatttgcgttacagttagcaaaaccactaaggttttccatatttgaacatgaggatttcaagtcaccagtcaaattatggattttacaaagtttaaacatgttagaatgggttgagaaaaactttttaaccagaagaatgcacgagcgtgctcacttacaccatggaacaacagcccaactactacgaagaagcccgttgttgggtgggaatccaactcatcgcaaaaagtctcatgctaatagtacttcctccagtgctggtgaagaaagcgagttagaagacaagaacaacactagtgatacaactgaccacgatttatttgaaaaatgggtagagtctgaaggtatgaaacgtataacttttatgaccttttatttggacatcattgattttatcaagtttagacataatcctcagattttattctatcagttacaattgttgaatttaccatgtgatgatgaacatctttgggagctgactgaggttaatggatcgtttaaaaaagtcgttcgaagacaacgcaaattacaagatagtaacattactacatctcttactacttccaataaaaagaaaaaggctaaaagtgataattttttggcagcattgaaaaaaattttgaaatctgataaattgattgaactcaagaataaatctattttttgtcaaaagatacttttggcagggctaatatcgttaatgcatcagatgcaacaaagtgaactacaaaacagttcttcattattgacaattcataattccaatagcaacagcaaaatttggaaagaaatgttaattagatcatttgataattggaatttcgaagtcatgcaaacttttaaacgttccaataatatgggaatttcaatgtatagtgtacccaacagtaatgttgccttccctatattctacttgacacaaataattggactaccagaaataaaccattatgacattgccatatttgcaggttcaccagcaaaccagagtgtggatgctacccttaaagatcattttatggtgcaacaaaaattaaataacatttggtccaaaaataataaaaatatagaaaacattcgtggtatcttttattgttactttttcctatggaccttgatgatagacgagaatggtaataaattagattggaatccaaactgtgattattatgatacggtcaatgcagtcagcactgctactttggttttatggagttattgtttcacagttggagggttagaaagcaataaatatactgatggaaattctgctatggacccaacaatttgtgctgaggatggatacgactatctatcaagaattatgtcgactttattggcatcacagcaatcagataaagtcaattttggtctggttgcaaaatattgtgaagtcttacaactgatccctaacaaacaaaacatcagtggcttgtgctttctaatggcaagaaaattaatgaccagtcaatgggaagtgcttagagagcacgcaaaattgatcttcaattgcggataccgatcgataggtaagagaagtgttttatgtcctgatctattcgacaacgagtttcaatag

SEQ ID NO: 2089 - DNA, 303 bp, Candida albicans
aaaatgccgccgcttgactcaccttcatccaacacagaaagcaccccaactagcaatgatgatcaagtaatttctaagaagagatcacaatccattagttccggtggtagaaagaaaaagcggtccttgggagtattcccttgcacacattgtgataaagttttcactcgatcggaccatttagccagacataatttaaatcatgaaaccaaagaagtttatgtttgcgactttgttatggattatcatggatcaaagtccaaatgtggcaagacttttgtaacgaaagatttaaagggatag

SEQ ID NO: 2090 - DNA, 471 bp, Candida albicans
tctactaaaaatttcggtgttttagatcaatttgaacaaagatccggtttaccaagatcatatgctgttcttggtgctggtggattatatttctttttaatcttgttgaatttcggtggtattggtcaacttttatccaatattgctggctttgtcattccaggttattattcacttgttgccttgaaaaccactactaaagatgatgacaccaaattattgacttattgggttgtatttgcatttattaatgtcattgaattctggtcaaacaccatcttatactatgtcccattctattaccttatcaaaactggattccttatctatctttcctcatttggtggttctactttggtttacaatagtgttatcaaaccactttctgataaatatgtcaaagttgaaaacccaattgctagcaaaattcaagaaaccgctgaaggtgtttctactggtgtccactattaa

SEQ ID NO: 2091 - DNA, 1737 bp, Candida albicans
cgacgtgatcttcagggcgtgtggaagacagaagaaatcgatccaaaacatattgatttaaaagtgatcaatcaacttgggattccccaaaattcaattgttgcagtggcttatgatccagtacaatctttattagcagtttcaaccaccagcaacgatgttcgagtatatggacagctaaatgtcgaagttgtatttgaattcaacattaaacaccctatcacgtttcttcgatttgttaagggagtatatcttgtctgtgcctcaccaggtgctggtttgaatatattatcattgcactccaaaaaagtgttaggaacaactctgtttcctggaacagttacagctatggaatcagacccttcattggattggttgattatgggattgtcaaatggtagtttaatgttttatgatgttgacagagtaaatttaacacctttcagaattgataatttgcagaagaaaataatgccaaaggagaaaatgtcaccagttttgtccattgaatggcatcctcgtgatattggtactttattgattgcataccagcaatctgcaattgtttactcacttgtatcaggcgaagtgaaaagtgtcttggtataccagttatcaaaagatcatagaggctttcaattggcgtctcatattgcaaacggggggaagaagaagatatttggtggttccaaggaggtaatccctaaactaaaggaagcccatttccatccaaatggattacacgccgtcacagtgcatgaagacaattcgatagtattctgggatatagcaagtggtacaattttagaagctagaaacgtttttgatgtgcacattcatcagccagggacgccattagaaattcccgaggtatttcaacccattgagaccgttcaatgggtttgtggtgaagatccagagaacacaaagttgattgtaagcggtggagattctaattccaagaatgccattcacgttttagattttggctatactttgaagtactcaattacatcgtatgaaaaacaagctgaattttacgcacaaccacaatcaggacaaagaatcattccagtaacattttatttgaataatacagaagtagaagaggtaataaaaaccattctaccaattactgaaaatgggtcgccttatttccatggtggtcatgatccttcttttttgttgttggtctcaaatttgggacgaatttattttgtttcatttgccgagcatgctggtggtcaaggatcatctgatttaggcacggttattttgcccacctctatatcatttattcacccacctttatgtgcctttgatgttgagcaagtgagaagaattgattggtatagtattatgtccagcagagcatcgacgggagcaacatccaaaacaaaggaaatgttttttggtggtgcatcggtaggcctcaacaatgtgctgaaaccaataggatatgatgattcttttaggaacatcttgattaccggtcatgaaagtggtttggtgagatttcttgatgttaccaaaggtgaacaacatgagttagaagggattgtgcaaattggtcttcgcgagactttatttgattacgggaatccaaagtcgttgagagtcatatttgtgtcatgtgcatttgagaaccgtgaattactagtagcattagcgacaggtgaggttgttgtttgcaagtttggcaaaaacaacagaaacgctgggttatcggccaactaa

SEQ ID NO: 2092 - DNA, 813 bp, Candida albicans
atacttctaagcatgtctgagatatcgtacttgagtataaataacgctcataacggaataataatcaaaatccccaaacccgtacgatttcatacattatcagaattcaaaaagtacatccaacaatcatatctgatagatagcgttgataatctatttcttttaactacatttggaattaaacttaactataatctaatcaatgagattggcgaagtgtttgtatacgataagagattatttacaaatatagtggatcaatcgctaatcgatcaatacacacaatcaactttccgtgttagtgaacccacacactcaccattgcttaaaagtaatgttggctttttgaaacagaatctatctagtaatttaaagattaatcaagggtgggctagaataatcacccaagatggtgaattaatggatcaatactgtcgagagttaattcaacaaataaatgtcattttcaaatgtttaaatacaatatttcaatttgccactaattttactaatgaaattgaaaagaatttcagcaactttttcaactatgtcaagctaataaactataaaaccttgcacaaatcatggataacaaactacaagaacttgaaaacttttcccacttttaagattgacaatgaaaatatcaaattaagtgatttcctagaagttgatagactacagtcatctgctgattatattgagaagtttttgccattgattgttaataaattaaatgaattaaaacaagttatagaaaccgtaaacgaggagaaattgactcttcaccacggggctggaaggacacgcgct

SEQ ID NO: 2093 - DNA, 345 bp, Candida albicans
ttacaagaggatagtatcaatgacaccagattctttttaaatgctatatcgaaaagatttagagatgtggaaggatttgccaaacgtcaagctaaagataataaattaaaggaacaagaacacagaaaattagttcatcgattaaatagcaaaataagtgtgaatggatttcaggaaaaagatttagtggtatttttaccaactagaatagatcgaccaaatgttgaaaacatacatagtaatgataaaattgaaccttgggctgctttcaatattggagcaccacaattttttttgaaaattgaattttcacctcgggatgggcgatcggcgattaagctgcac

SEQ ID NO: 2094 - DNA, 366 bp, Candida albicans
gtcactgttattacgttttgcttaattaatactaaccagaagtttatctgtagttacaaacatgttccagctaaaccaagaaaagattctactggtgtaatagctcaatcattaccaatggcagccatgtttatgagaaacaaagttttatcttggtcagcattatttttaaccgttcaatcctatttaaatgaaccaattaataaaccagatgccgatgatgggtctcaaccaccatttgtcaagattgttttcgctcttgtttcagttcttacttgctatatggatgtcttcttccctaatactaatcctgctttaagaatggcagctaaagtagcaacagaaacaccagctgctccaaaataa

SEQ ID NO: 2095 - DNA, 2175 bp, Candida albicans
gcacaatcccctctgagattgatttctggcaaatatgcatcggttgtgattccatccaccgagttgccagaactgcctacagttgcaatagctaattggatagataagttaacccaagtgtttaaggaaaaattcaccgaggcagcaaaagctaaaaatgttgaacaattgacgaaatttttccaattattcccactaatcaaccaggaagagataggtcttaactgttattccaaatttatttgtgaaatcatcaatgaaacatctaaaagtctaacagcagggttggagaatgcccatgatttgaaacccgctattttttctaatgttgtcatgcaattatttgagaacatttccatgatgttgtctcaacatggacctttaatcaaaaaatactatagtgctacatatccactggcattgtcatatgttattagcaaaatccaaagagaaatcgatttacaagttggaattattgctgacaccttttatgatttaagaagattagataaacattttcaagacatcaagctttacagttttcctgtattgacacgaagattggcagaattaaaagatcacccaaatcaagatcaggaatcaagaagaactagttttgatacatcagacgatttattaccaataagattaattggagatttaatacaagaattgtcttcaatttttgaaaactggacgttatactgccgatttataaccgtcaaatacttacaagaaccgaaacatagacaaaatgggaaagaagtagtgacaggaaaatcacctacggaagacaaagatgcattacttttacctgatttaattcgcaaatccacttttacaagaaaaattaatgaaaagcttttgccttcatttgaaacattgtacaagttttatttccgtcgttccatagaaaaatcaatcaccattgaagaattgccatcattagatgcatatttggtattaagtaacgagcctggagtacaccccgaacaagtacctatatcttctgttgttgaagatttgactttggtcctaaataacactttgcgtaacattattcaatctggtttacctacagcagtgaagagttttattaatgaaagtttcggcattgttcaacaagatttgttaaatggatttttcattaaaaacttgaatgacaatcaaccaagatataaccaaacattatcattgatagaccctgcaagtactattaaccgtactaatagtccaatcagtataagtgctactccagatgtgcatggaggtagtggtggattatcaactggtgcaggatttttgaagggagcgtcaagtgccttgggaagtgtcgttagtggttctggtgcaattgtaggcagtttacaaaccactcccaataatacaaaattgttaagtttcatcatttatttgaacaccgtggctatggcacaagaatatttcacaaaagtatttcagaatataaataaggacagttacttacaatcatattatcctttcggtaaagacaagagtaaaatctcaaatattttacaacaagattttttggacccatttactagtgtaagtaacaaaatcatttcagaaagtttgattaatttatacaatcaactgatcaagaacaaattgttattgcttgttaatgaattctttacagatattccaacagccaataatgaaaacaattatgtgatttattcaagcaataacataaatgacccaacaatcttaattaaattcacgtcaaactggcagtcattaatgaaaccatacctacaaacattacacaaaactctttggagtaaattgttgcgattagtcgtggttaatttaaccaatttgttagaaaagaagttgttcatgatattaaataaattgaaaattaatgaattgggagctataaagctagagaaagatgtttcgtatttaattaatgaaatttgccgtgataattactatttgcgtgaaaaattcgttagattgactcaaattgtattattggtaggtatggatgatgaagagtacgaagaaagcaaccaaccagtaactaaagctcgtgaaactgaagaggatggaggagaaggaagagatgattttgacgatgaaattggtggtataaattgggtattaaccccacaggaaagaatccaaatacgtaaatacagaatttag

SEQ ID NO: 2096 - DNA, 1329 bp, Candida albicans
  unsure (1283): Identity of nucleotide sequences at the above locations are unknown.
gacgcggttgcggttcttccacgccgtggcgaatactgtgaaatggatcaggtcgggaaacctaagataaaatttggaacacacatgtttacaatgaagtatcaattaatcttcaacccggtgacgatttcccatttgtacagacattcgacgagtgatgtaccaaagaaaaatagcacagttgcatttactggtttgagaggaagatttgacgtatgtgaaatagacttgcatcaaagaagagaatatgtcactcatgaaaacaagaaattaaatcgcaaaacaaaaatcagacatttgaaaatgaatcaagctgaagtgaatattgaaaatgccgacgcaagagttatttatgcgttattcaatgatacttctgtaactggtaaattgatgacgtatttgaatgctgattcactggattcatcaactgatggttcacaatctctggattatcgtggctcatcatatctgagatggcttgaaaatgtggagataagtgatggtgatttttcgtggtatgatccaaaagatttcattgagttagaagttagggaaccattgtccccataccctaaaacaaagatattgccatttttcgcgacaccaaagttcagttattatagggaatttacattgcaaaaggatggcccattcccatttggtagtgagaaaattcatgattgtattatgaatttggataaacctgctatagtacaaagtcgaattttactagaccgtcttcagaatttggaggatgagttagctcataatgaggaaatgttacgtcgatttaaaattcaaaatggtcctgagttccagcatgatattcgaatgacagagcaagagatttcaacgttgaaagaaaaagttgaagttgttcgtgctgcctataacggattcagtgatgatgaatttggtggtttgccgctgtcttctgcaaataatgttgctgatgatgatgatggttcaagttcattgctgagatcgagcactgggttatctgcatattcaagtcacgtaacacaggatcaaatgctgcaggcagctgcatttgtttcgattgccgaatttcacaaccgattcatcttacataacttgactttgaaatgggacgacaatatttctaaatattttatcagttacatgaaacgaatagccgagaggaaaagtcatatttactacatgaccaaatatgcggttgatttagttgagaaagttatgcaagaaaacgcaaaagaagggaacccaccctgcagccaagagaaaaggtgtttcaaaagtcntttaaacaagccgacaatatcgtggatagttttgaagatgatttag

SEQ ID NO: 2097 - DNA, 702 bp, Candida albicans
tatttgccaaaaatggatacatgtccggataaatacaactggccaccgtggtttgaatgtgaagtatgttatgatggttcatgggcacacgagtatttggtttctgaaaaaaatactatcgccataatacaaaagtccccaaatcagttgtttattagctcagagaaattggagcaaggaaatgaactagttgtttacctttccaaatatgtcattaacgcaacttctgcacaatattcgagtatttattatgtcataacagggttacttctttcaaacgatgacaaagagagtaattataatgctcgtttgcaacggttaatggacttggcggatgcatctgattatgaaggattagatgtccgtgtgcataacttacaacaaggtatacgagattaccgagagttattattcagttttgatcaaaaaggtgctgatttaaacgaggaacaaaagaaatatttgcatgttcttgaattggaaatggaaagactgaaattggaattgattcttattatgaatgcattgcaaaccagaattaaagcaacatcacagttaactagtaaatgccttcaaatattggctgatcaagtgatttggcatatgcttgacgatgacagggaaccatttattgattttgccttggctagcactaggtttattaagcatgaatcttcaccacgggcctggaaggatcagcaa

SEQ ID NO: 2098 - DNA, 693 bp, Candida albicans
cgcggttcttctaccccgtggcgaggttattataaacttccaccaaggactgtttatcgtgttcaattattatccatttttgtatcatctttcattcaattgggcattttaaatttccaaattaatggcatcaaagattattgcaagccagggaatactcaaaagtttacatgccctggcggtagaacattcttctcagcatcggtattatggggagttattggccccaaaaaagttttcaatggattatatccagtattagcatggtgtttcttgattggatttttattggctttcccttgtattgccattaagaagtatgcacctaggaaatatgttaaatactttgaaccttctattgttattggtggattcttgaagtatgcaccatataatttgtcgtactatattcctggtgtttatgtgtcgtatgcatttatgtcatacattaaaagaaaatacgaagcttggtggcagaaatatacttatgttctttcaactggtttgaatgctggtattgccttttcatcaatcattattttctttgctgtgatgtatcatgaaaaagatattaactggtggggtaatactgttatgtattcaggtgttgactatgctatgacaggttggttggatgccactgttgatgcaccagatggatattttggaccaagacgtggtaatttcccttga

SEQ ID NO: 2099 - DNA, 1041 bp, Candida albicans
cttcggttcttttccagcccggcggtggaagaaataagcaaatgttgggaagcacttcaatccttatacaagggtattagaaatttcaagagatctacttatgaaggttttgatgatcctcatagtgttatgatgagagcatatcctgaagttcctgaatgggcatatcttatcattcttgttatttcattggtattggctatattatgtgtcaaattatatcctgctgaaacaccagtttgggggattttctttgccttggcaatcaactttgtgtttttgattccattaacaactgtgcaatcaagaacgatgtttggatttggtcttaatgtgttagttgaattgattgttgggtatgctattccaggtaatggattggctttagcatttataaaagccttgggctataatattgatggacaagcacagaatttcattaatgatttgaaacaaggtcattacgctaaacttccaccaagagcaatgtacagatgtcaattattgtctgtatttattacttcattcattcaattgggtattcttaattaccaaattactgggattaaagattattgtgttcctggtaataaacaaaaatttacatgtcctggaactacgacattctataatgcttcagttttatggggggttattggacccaagaaagttttcaatggattatatccaattttagcttggtgtttcttgatcgggttcttgttggctttcccatgtattgctttcaagaaatgggctcctagaaaatactccaaatattttgaaccttcgattattattggtggatttttaggttatgctccttataatttgtcgtacaatactgggggtctttatgttggttatgcatttatgcattatgtcaaaagaaagtatgaagcttggtggcagaagtatgattatctcttagctacagggattgatgctggtattgccttttcatcaatcattattttctttgctgtgatgtatcatgaaaaacatatttcctggtggggtaacaatgttccatttgaatga

SEQ ID NO: 2100 - DNA, 516 bp, Candida albicans
agcagtagaaccttttattcggcatcggtgttgtggggggttattggtccaaaaagagttttcaatggtttatatccaattttgagatggtgctttttaattggattcttgattgcattcccatgtattgccatcaagaaatggggaccaagaaaatacgtcaaatactttgaaccatctattgttattggtggattcttgaattacgctccatataatttgtcatactatatccctggtctttatgtatcatttacatttatgtcatacattaaaagaaaatatgaagcatggtggcagaaatataattatattctttcaactggtttgaatgctggtattgctttttcatcaattatcattttctttgcagtaatgtatcatgaaaaagatattaactggtggggtaatactgttatgtattcaggtgttgactatgctatgacaggttggttgaatgccactgttgatgcaccagatggttattttggaccaagagttggtcacttcccttag

SEQ ID NO: 2101 - DNA, 1524 bp, Candida albicans
  unsure (1460),(1508),(1509),(1510),(1512),(1517): Identity of nucleotide sequences at the above locations are unknown.
acgggtgaagtggctagtacattaactgaatcccaaaaatggtttgttttgaaaagattacattttgatgctttagtgtcattagaagaattaccacctcaagctagttttatattcgaaaagattgaacagatgaccactgaagaggctgttgaaatattagaaaaaaacattgaagagcacgagaccgatgttaatattccagaaaatgatttagttctttggaaagagttagttgaaaattcacataagttcaccaaagttcaattacaagaaaaattgggtagtaactcatcgtcatcagtggaaggtgagaagacagctgacgtcgaaaaaggtcacgaaattgttgattgggatttgcaagttcgtttagaagcagtattagttgcttattggtctccatatcctgaggttagagcagttactttcccatatgatgatccgactattccagttgagacattcagagtatatttaattggtattatatggacagcaataggtgcagtgattaatcaattcttcacagaaagacaacctgctatcacacttgctatggcagtggttcaagtttttctttatccatccggtttgctttgtgaatggtttttacctaaatggaaattcaaaatttggaaatatactattgatttaaatccaggtccctatacttataaagagcaaatgttggccacaatcttttgtggtgttaccggtgggagtacctcttatgtctccagtaacattcttatgcaaaaatctgagattttttatgacaacaaatgggttgattttggataccaagttttgttaattttgtctacaaactttcttggtgttggttttgctggtataatgagaaaatttgccgtatacccaactaaagccgtatggccatccattttaccaggattagcattgaataaaactttattaaccccggctaaaaaagaagtaattaatggatggaaaatatctggttataattttttcttcatcacatttgttgcctcatttttgtacttctggatacctgattatttattccaagctttatcaactttcaattggatgacatggattaaacctgataaccaaaatcttgctgtaattactggttcagttggtggattaggtttgaaccccattaccactttcgattggaattatttcagttctatgcttcaaccacttcaagttccatttttttaccctcttaataacattattggtatgttttttgcattcttttgcattattggggtttggtattctaattataaatggacaggatatttgccaatcaacgataatggacttttcactaacactggagaacgatattccgttgctctggtggttaacaaagatagtttattcgataatgcaaaataccaggaaataggaccaccattttattctgcagctaatttagttgtgtatggtgccttttttgntatttatccgatccattttgtttatgagattgggatgcattatgaccnnntntgggntattgtc

SEQ ID NO: 2102 - DNA, 2088 bp, Candida albicans
ggttctcagcccgtggtgaagaatttacaagtacgtttagaatcggtattggttgcttactggtctccatatcctgaagttagagcagttactttcccatatgatgatccaactattcctgctgagacattcagagtatacttaattggtattatatggacagcaataggtgcagtgattaatcaattcttcacagaaagaatgccaagtattactcttgccatgtcggttgttcaagtgtttctttacccatcagggttactctgtgaatggattttaccaaaatggaaatttaaaatttggaaattgagtattgatttaaatccaggtccatatacatacaaagagcaaatgttggccactatcttttgtggcgtcactggtggtgggacttcttacgtagcttggaatattcttatgcaaaagtcaccagtattttatgacaacaaatgggttgattttggataccaagttttgttaattttatctacaaactttcttggtgttggtcttgctggtataatgagaaagtttgccgtgtatcctactaaagcagtgtggccatctatcttgcctgggttggcattgaacaaaacattgatgactcttgctagaaaagaaatcatcaatggctggaagatatccagttacaattttttctttattgcatttattggttcatttttgtacttctgggttccagattacttattccaagctttatcaacttttaattggatgacatggatcaaacctgataaccaaaaccttgcagtagtcactggttcagttggtgggttaggtttgaaccccattaccactttcgattggaattatttcagttttatgcttcaaccacttcaggtaccatttttcaatccagttaacaatattattggtatgagtattgcattcttttgtatccttggtgtttggtattcaaattatacatggactggttacttaccaattaatgacaatggactttacagtaatactggtgaaccttactcggttagactggttgttgatgccaatagtttgtttgatcaagcaaaatacaatgaaatgggtccaccattctataccgccgccaatttagttgtttatggtgccttttttgctatttaccctttccattttgtttatgagattggtatgaattatgaccaaatgtgggatgcatgtaaatcgttttggagagttatcaaagatttcaagaagtcaacatacgatggttttgatgatccacatagtactatgatgagagcctaccctgaagttccagaatgggcttatttaattattgttgtcatttctttggtattggccattttgtgtgtcaaagtttatccagctgagacaccagtgtggggtattttcttcgcattaggtattaactttgtgttcttaattcctttaaccactatttatgccagaactggatttgcatttggattaaatgttttggttgagttaattgttggttacgccattccaggtaacgggttagccttagcattcataaaggctttaggttataacattgatggtcaagcacaaaactttgttaatgatttgaaacaaggtcattatgctaaactcccaccaagagctgtgtacagagtccaacttttgtcaatctttattgcttcatttatccaattaggtatattgaacttccaagttaatggtggtattaaagattattgtgatcctaaaaacacacaaagattcacatgtccaaatggtagaactttctattctgcatctgtattatggggggttattggacctaagaaagtctttaatggtttgtatccaattttgagatggtgtttcttgattgggtttttaattgcatttccatgtattgccattaaaaaatggggaccaagaaaatacgtcaaatactttgaaccatctattgttattggtggattcttgaattacgctccatataatttgtcatactatatccctggtctttatgtatcatttacatttatgtcatacattaaaagaaaatatgaagcatggtggcagattcttcaccacggcccgctgccaggaccacgtaaagggcga

SEQ ID NO: 2103 - DNA, 1023 bp, Candida albicans
gttgctaataatatgtctacagagaaaccaattcctgctcttcctgttactagtatcaccagtcatgttgacgtggctgctcatgaagtgaaccttcaggcaataacatcaaaccctctttctattggcgaagttggtactacattgacaaatggtcaaaaggatttcatccttaaaagattacattatgattcgttggtttcttttgataaattgccacctcaagcaacatttatatttgagaaaattgaacatatttccattgaagaagctttagctatattggaaaaggctgttgttgaacatgaaaacgatgttaatattttagataacgatgaagagttgtggacaaagttgatcaactataagcaagggaaaatcccttcagatactgacttttctgaaaaagcacatccatctaatttcactgcaaaagacaaattgtcggcattcattcatgagaaaagggtatcagaagaaacctcatcattagacaacagtgcaagtgagaatctcaacgaaccttattataagattgttgattgggaattgcaagtcaaattagaagcagtattgattgcttattggtcaccatatccccaagttagaggtgtgactgacccttatgatgatccaacaatccccgttgaaactgttagagtttatattgtcgctattatttggactgctattggtgctgttattaaccaatttttttctgaaagacaacctagtattggacttggaatgtcggttgttcaagtgttcctttatccaactggtttaatatgtgaatggattttacccaaatggaaattcaaagtttggaaatacactattgatttaaaccctggtccatatacttttaaggaacagatgcttgctactattttctgtggtgtttcttctggtacttcgtatgtatcatctaacattttgatgcaaaaatcagaattattttatgataacaaccgggttgatttcgtttttcaaccgagccggcaggcagcaccatccggggta

SEQ ID NO: 2104 - DNA, 1407 bp, Candida albicans
atttgcctaatgtgcaatcaattggaagtcctttatcaattccagatcatgagattaatttacaacaagttattgataatccactttctattgggtgaagttgctactacattaactgaatcccaaaaatggtttgttttgaaaagattacattttgatgctttagtgtcattagatgaattaccacctcaagctagttttatatttgaaaaaattgaacaaatgaccactgaagaggcggttgaaatattagaaaaaaacattgaagagcacgagaccgatgttaatattccagaaaatgatttagttctttggaaagagttagttgaaaattcacataagttcaccaaagttcaattacaagaaaaattgggtagtaactcatcgtcatcagtggaaggtgagaagacagctgacgtcgaaaaaggtcacgaaattgttgattgggatttgcaagttcgtttagaagcagtattagttgcttattggtctccatatcctgaggttagagcagttactttcccatatgatgatccaactattcctgctgaaacttttagagtttatttaattgcaatcatctggaccgcaattggtgctgttatcaaccaattttttgttgaaagacaacctgctattactcttgccatgtcagttgtgcaagtgtttctttacccatcagggttactctgtgaatggattttaccaaaatggaaatttaaaatttggaaattgagtattgatttaaatccaggcccatatacatacaaagagcaaatgttggccactatcttttgtggtgttactggtggtggaacttcttatgtttccagtaatattcttatgcaaaaatccgaaatcttttacgacaataaatgggttgactttggatatcaagtattattaatcttatctaccaatttccttggtattggtcttgctggaataatgagaaaatttgccgtttacccaactaaagccgtatggccatccattttaccaggtttagcattgaataaaactttattaactccagctaaaaaagaagtaattaatggatggaaaatatctggttataattttttctttattgcatttgttgcctcatttctttatttctgggttccagattatttattccaagctttatcaacttttaattggatgacctggatcaaacctgataaccaaaaccttgcagtggttactggttcagttggtgggttaggattaaatccaattactactttcgattggaattatttcagttctatgcttcaaccacttcaagttccattcttttatccagttaataatattattggtatggctattgcattcttctgtatcatcggtgtttggtattctaattataaatggactggtcacttaccaattaatgacaat

SEQ ID NO: 2105 - DNA, 1023 bp, Candida albicans
ttcgcggcaccttccagccccgtggtgaagacacattgtaaaatgatggctcattatcctgatgtacccgattggtggtttataaccattttggtggtaagtaccctgtttgctataactgcaatatggttttacccggttgaaaccccaatatgggggatttttttcactattgccattaatttcatttttttaattcccttaacatcaattgcatccgtcacggggttttcatttggattaaatgttcttgttgaattaattgtcgggtatgctatacctaattctggaattgcattaattacattaaaagcctatggatataatattgatagtcaagcaagcaattatattactgatcaaaaattggctcattatgcgaaaatcccaccacgagcaatttttaaaggtcaattattatccactttattaaatattataatttcattaagtgttgctaattggcaattaaataatgtggaaaatatttgtgatcctcatcaaaaggataattttaaatgtcctggagctaatacatatttttattcaagtattcaatatggagaaattggtccagcaaaagtttttggaggattatatccaattttaaaatggtgtttccttttgggggtattattagttttcccctgtgtttggttgaaaagaaatggtccaacaaaaatattccaacgttattttcaaccaacaattattattggtgggatgttagattttgctccttataatttactgtattttactggtggcttatatatatcttatattttcatgttttatattaaaaaaaattatttactttggtgggaaaaatataattatatgttaactagtgctttatcaactggtgttgcttttagtgctttaataatttttttcaccgttcaatatcatcctcatccattacattggtgggggaattccattggtcaacaaagtattgaacgtggtgaaatttcaccaatttggaaaaatatcgatactgctcctgatggttatattggt

SEQ ID NO: 2106 - DNA, 615 bp, Candida albicans
atttttattaaaaaaaagaatgcctttagtggatatacggttacccaggtggttgtcccaggtgaaagaaatttttcctctttaatttgggtagccattgggctaggtatcttatttaccagcatagatttttttgccgttaggggactaacggtgtgtttcttgattcccattaataaatacccatttatgccagaacaagatttacccttattagtgaaatggattattggttatattatccgagaaaacgggttagctttagcattcataaaggctttaggttacaacattgatgcacaagcacaaaatttcctgaacgatttagaacaaggtcattatgctaaactcccaccaagagtagtttatcgagtacaaatattgtcagtatttgttgccttatttattcaattgggtatattgaaattccaaattaatggcatcaaagattattacaagccgggggatactcaaaagttcacatgccctggtggtagaaccttttattcagcatcggtgttatggggagttatttgcctcaaaagagttttcaatgggctatatccagtattggcatggtattttatgattgagtttttaattgcattcccatga

SEQ ID NO: 2107 - DNA, 972 bp, Candida albicans
ttatataaaatagttccctataatttttttaaatttattctttatattgctttcttttattacaattgggattcattaattcactcgcttcgataccatttcattttcatcaattacattcattctttaataccaacaatgattccagactcaattatatcaaaacaaggacctttgggacacgtctggttagcggcaaactatgacaaaaagttaacaaaacaacaattaatgaacacaagtattgtcaaatcaacagaatacatagccaatcatccagtaatcacaaatgtgtctgtatcccaagaactaccaagtgacttagactcgaccaatacaataacgcttcgattatctggtcaacttttattggggattgtgagaatatactctagaaagaccaaatatttattagacgacgtcaatgatatattatacaaattaaaagcttctttcaagttatcaagtggggtcaatttgggatctgataatatttccaatcaagtcaatttacctcctgaacaaaccattttacaaaatttaaatagtattatattgaaggaccaagttacctcagccaatttgttacagcaagatgatcttgatttatctgacatacacggcaccctgacaggatcaggattagatggcatgctaaatcacaatgctagccaaagtagtagcgaatattcagaatatgataactcaattgaatttcctagatatgaggaagaagctgcggcccctggccatactgaagactttgaattagactttgacttgaatttggatgacgataactcaatagagtacggccgtgatgcatcagtatccatcaacgatagggaaatatctataatctccgatgtacacaaagagcgaactaccggagacatatttgatctaaattttggacagccattagatgatttaaatgatgacgaggccgagaatgaagaggacagacaatag

SEQ ID NO: 2108 - DNA, 585 bp, Candida albicans
caaataaaaaaccggaactatggaactggaatgcaggaattaccatacagatgtgcagaattggttattccaagggccgccagcagcaccaaacataaggaagaggacaatcaacaaacgaatttccatttagatcaaagttttgataatgactcgatggactgtgattattcattacctgatttggatgaccaacattctgataatatcagggatgctggtattttagacgatgaagttgacgaagaagatgatactaattacacacacacggcaagagtcacggaacaaattggacaagagttgattgaactattcagatcatctaatactgttgaatttgaaaagttgattgagacagattcagaaatacatcacagaaatcctgataaattgccgttaggagttgtcagcaaaaacaaggatcgcatcaattctagaaaggaagctactaaatgcttttttgaattattagttctagcaactaataattgcatttctttaggtcaaatcccacaagaaacaacaattgctggagatatcagcatcacttcaagagacagattatttagtcagtttgtatag

SEQ ID NO: 2109 - DNA, 1425 bp, Candida albicans
aagaataattccgattatgacgttgtaccaattttacacatacgattagaaaatcatccaccaacaggtagagatccaatctatttgggacatttgttacgagtatttggagaaaaaatagaggaattcaataaattattaatcaaagaagaccctgattgcaagttaagaacaccgtttggtgatattgaacctttagggtttgaaagattcaaaatatgcgaattgattgccgaattattgcattgttcaaatatggcgttactaaatgaaaatagaggatttgatattgttaaagaaagagatgaattgagaataaaaatgaaagagtttgatcctattagtttcaaatataatgaaacaattgttctaccagacgatgataataataatgataatagcaataacaacaacaacaacaacactgcaagtaatgccaatgacactattgacgattttaatgctgatgacagtatcgatgaagaagaacctcacgcaaatgccaatttgacagaagaacaactcaggagtagtcctgttgttggtgatttcttgaaaattgctttgtttgatactcaaattatatctaacatcttgtccatgtttttccgttttccctggaataattttttgcataatgtagtctttgatattgtacaacaagttttgaatggatcgatggaaattggtttcaacaagtttttggctattgatttattcgctctgggggatataacgaacaaaatcattgaaggtcaaaagttgtgtgctgattatgaatccagtcataatggattgagattgggatttatgggtcatttgacattgattgctgaagaagtggtgaaatttgttcaattatatccatcaaatactttgagtgacttaattgatatcaaagtcgagagcgatgtatgggaagaatatgttaataatgtattgtatgacacaagagaaaaatataatgccattttagggggtggtgatgaagatgatgaagacgatgaagaagatgatgaaaacaccacttttgaagaaggtcttggggaaataatagaagaagtgaaaacaggtttagtatttgaagaaccacagaagaaaaaagactttttagatggcgatgaatcaggatctgacgatgacgaccatttctccaattatatgtcacagcaattgactaacccatcaactactccaaaccatgaacacgaagatgaacttgagacatcgagtgaggatgatgaagatgaagaagagtatatagatcctaatgatgatggaaggtcatacaagaaatcaaattctttgtacgattcaaaaggttcattgaagaaacctgaaaatgaagacgcaataagtgacgattccgaatgctccgaagaagaggaattcctggaccctttgcttccagaatccaccagttaa

SEQ ID NO: 2110 - DNA, 729 bp, Candida albicans
aaatcatacaattcatttttaatagtggagcttttcaaagaggatcaatgtaatttaactgatattgtggttagcagttacaaagaagacacaaatcctagacctggttatatgggccatttaattctaatcagtgaagaaattgtcaaatttacatctctttataaacctgatttgatatctccagtgatagtttctgcagtccaatcagaaaaatggacctggttcattaatgatgttcttttgaaaactagagaaatatataatgtggttttaggtgctgaggactctgatggaaataacgattatgggtttgatacttcatctgttggctatttggatatggatcaacccaaaaaaattatattgggagatgcatctaatcatgatgagtttataaatgataatctgggtaatcaaaataatggtggtgtctcagaactggaacaagaacaaacactgaatgatttgaatgaccttggtgatgattatgacatgaaccaattttttgtccctgatatcaatgtactgaaaatgtcacccagtggtgatttaacaaaacataatattgaagatgattgcgatgacgatctagatgaacaccatgatgattctagtgataaatatttggaaaatttatcagatagctcatctgaagatgaagatgaagacgaagacattggagaaactaacaaattaaaaagagtacccacacataatgatgattga

SEQ ID NO: 2111 - DNA, 1395 bp, Candida albicans
aaattatggtactcaaaaagtatgaagttgaatgaattatgtaaccgggtagatgaattttataatggagaactttgtcggaaagtttggcattgttggaggtcacaacaaaatgtctataatctcaaaatggaggttgctgacaaacgtctcctaaatcaatattatatcaaatggcggaaaaaagagaaggatatgaaagccaatcttactatagctgttgaatttgatcattttcatttattggataaaagctttaagatattgaaagggtacttcaacttggccaaaaacagtgatgtcctcgcaatgtctctatttaagtcatttgaggagaatcgcgacagccgtatcaagttgaagtattttcaatactggaatctaaaaatatctgatagagtacacggcttgactatgaaattagagaagtttcaccaagttaaggacaaatttgtattaggaaattattttgaaacatggtattataaacataatctcgttgaaaagtctaacaatttcgtttctgctaaagatttgcagttattggcgaaaacttttaccaatacatggctaaagaaattcttgctatacaagaaagcattcaaaattgaagaagagctaggcgctgatttaaaaaggaaaacttttgatagatggaaggaggctgtccaacttgaagtcaaggcaaaggagtttcacgagcgacatcttctagagactgcatttcatgaatggaagttgaaactgattttgataagtaacagggcttcatttgatcatattttggtacagcgttgctttcaaacttggtccgtggaaataaaatttcgagaactacagcaaaaacaagatactcgtttggtagtgaacatttttcaaaaatggagaaccaggcaactcgagctagcaaaacttgacgaaaagtctcaggcattttatgaatcaaatatgaaacatttggtagtgcaaaaatggaatgtcgaaaacagtaatattggactattagagaaacgagcagatcgatttttcattcgaagatttttcatccagaaatggcaatcaaaaatgacaaagtatgaggacatcactgtttatcacttggaagatgaaattgccacaaaattagcctacaaagtatggaggcagagatattttgaaaactacgaagaaaagttggataacttacttgaaacaatggataccagtgcagcagatactgtacgctgttcgcgatatttcggtctatggcgggccaaattgcagaccgtgaagcaaattgaagaacgcgtatctacgtctgtagcacctagtgttgcaatacattttaaaaactggcacgtcaagagccagcagaagcaagagttattcgatcttcaccacggtgctggaagatga

SEQ ID NO: 2112 - DNA, 876 bp, Candida albicans
aacaacatcccattattgctccaactatcaaacacacatatcgcaagcacattcgatactattactactattgttatgagattttcaacacttcattttgcctttttggcaacattatcgagcattttcactgtcgtggctgcttctgacactactacttgtagttcaagtaaacattgtcctgaagataaaccatgctgttctcaatttggtatctgtggtactggggcttattgtttaggcggttgtgatattagatattcttataatttgactgcttgtatgcctatgcctagaatgagtacattccaagaatcatttgattctaaagataaagttaaagaaattgaattacaatcggattatttaggtaattctactgaagctgactgggtttatactggttgggttgattattatgacaattctttattaattcaaatgccaaatcataccactggtaccgttgtttcatcgactaaatacttatggtacggtaaagttggggcaacattgaaaacatctcatgatggtggggttgttactgcttttattttgttttctgatgttcaagatgaaattgattatgaatttgttgggtataatttaactaatcctcaatcaaattattattctcaagggattttaaattataataattcgagaaattcttccgtaaataatacttttgaatattatcataattatgaaatggattggactgaacataaaattgaatggtacattgatggagaaaaagtccgtactttaaataaaaatgatacttggaatgaaactagtaatcgttatgattaccctcaaactccttcaagaattcaattttctttatggccccgtggtgattcttcaaatgct

SEQ ID NO: 2113 - DNA, 1335 bp, Candida albicans
  unsure (1220): Identity of nucleotide sequences at the above locations are unknown.
ttcaatcgagaattaaattcaacggaaatgttgacacaagaagaaatttataaaaccactagaagaaacgaaattacggtacaagaatggcaagggtttttcgattttagtggaagattattaattactgttgatgaagtgaaaagtcggatattccatggtggattaaatcaagatgtacgtaaagaagcgtggttgttcttgttaggggttttcccatgggattcaagtgaagatgaacgtgaagctttacgaaaatcatatgaaactcgatacgaagaacttaaattgaaatgggtaaatgatgatgtgaaaagaaacactgaattctggaaagatcaaaaattccgtattgaaaaagatattaatcggactgatcgtaatttagatttatttaagaatccgaaaaagagaaaggaaaataccgatggttcgacaacagaaacaactgccgccaccaacaccactgataatgtaacaaatagcgataccacccaaacaagggaatcaacaccagagactccagatgaggaagatattgatgatgaatttgatgtttccaatattagaaatccacatttatacaccatgagagaaattttgttaacatttaatgagtataatgagaatttagggtacgttcagggcatgactgatttgttatcaccattatatgtgattattcaagatgaagtattggtgttttgggcatttgccaatttcatggaacgtatggaacgtaattttgttcgagatcaaactggaatgaaaaaacaaatgaatacattgaataaattattacaattcatgttgcctaaattatataaacatttagaaatgtgtcaatcaaatgatttatttttctttttcaggatgttgttagtttggtttaaacgagaattacattgggatcaagtgttaactttatgggaaattttatggacagattattattcttcacaatttcatttattttttgctttgagtatattgagtgataatgaaagaattataattcaaaatttaaaacaatttgatgaagtgttgaaatatatgaatgatttgagtatgaaattgcatttgaatccacttttgattagaagtgaattgttgtttttgaagtttaaacgaatgttggatatcattgatcgtgatactagtttaaatgctttacgtcacgatgatccatatagaaatggaaatgctactggtacaggtantagtgaaaactccaataatggtgagattattggagatgaattgagagagttgttacgaaaagatttggttattcaaaaagaagttgaaagaccagaaggtgttggtggaggttaa

SEQ ID NO: 2114 - DNA, 699 bp, Candida albicans
cttcctgttgtacatagtgaaagcccacttgctggttcaatgctattagcaggtgttatacttaaattagctgtatatgctattattcgtttaattatacctactctatctgatgctactgttctatatacacctgtagtttatgttatatgtgctattactattatatatacttctattattactttacgtcaaactgatttaaaagttatagtagcttatagttctattagtcatatggcagtatgtatattaggtatattatctaattcattagcgggtattaatggtagtcttattttatcattagctcatggtttcgtatctcctgccctcttcatcattgtaggtggtatcctatatgatcgttatcatcatcgtcttatttattattatcaaggtttacttacttatatgcctatcttagctatatatttattaatcttatcatttagtaatataggtacaccattaactgttaactttataggagagttacttagtctaactggagctattggtagatcaactatattaggatgtatatctgcattctcagtattattatctgctgcatatatgttaaaagttactaatagattaactggtggtatacgtacaccttatactgcattaactagtgattgtacatatcgtgagagtttattaatgatagctttaattataccaacattatga

SEQ ID NO: 2115 - DNA, 459 bp, Candida albicans
tcaattaccataaaaatgaaattttctactattttagccattccatttgcaattgcctttgccaatgctgctgctgctcctgctgttactgctgccccagcccctgctgctgataatccttatactatttaccctcctgttcccaaaactgcttcaatcaacggtttcgctgatagaatctacgatcaaattccaaagtgtgctcaagaatgtgttaagcaaagtaccagctctactccttgtccatactgggataccggttgcttgtgtgttatccctaactttacaggtgctgttggtaattgtgttgcatccaaatgtcgtggtgctgatgttaccaacttcagaaagttggctgtcggtgcttgcgctgctgctggtgtttgggatccatactggattattccagcaagtgtctcaagtgctttggacgccgctgctaccgcaactggtaattag

SEQ ID NO: 2116 - DNA, 1356 bp, Candida albicans
agcttgggtacttgtgtttgttctgttgccggtgttaatgcaccttattggatgcttccagctagtgttaaaagtagcttaagtgttggtgttactgcagtaccaacctccgacagtgcatctgaaactgtttcccaagaaccatctgaaacttcatgtgaacagccatcagaaactgtttcacaacaacctgctgaaacttcatcagaagaatcttctacaatcacttcagccccatcaattcgtgaagataacccatacaccatctacccaagtgttgccaagactgcttctatcaatggttttgctgacagaatctacgaccaattgccagagtgtgccaagccatgtatgttccaaaacactggtgtgaccccatgtccatactgggatactgggtgcttgtgtattatgccaacatttgctggtgccattgggtcttgtattgctgagaagtgtaaaggccaagacgttgtttctgctacaagtttgggaacttccatttgttccgttgctggtgtgtgggatccatactggatggtgcctgcaaatgtccagagcagtttaagtgctgctgccactgctgttccatcatcctccgaacaatcagttgaaacatcttctgaatcagctgaatcttctcagtctgttgaatcttctcaacctgctgaaacctcatctgaacaaccatctgagacttcatctgaaacttcttcccaacaactttcaagtatcacttcagcaccagactcctccgctacaagcagctcctcaaccacatctacttttattagaactgcttccattaatggttttgctgataaactttacgaccaattaccagaatgtgctaaaccatgtatgttccaaaatactggcataacaccatgtccatactgggatgccggttgtttatgtgtcatgccacaatttgcaggtgctattggttcatgtgttgccgatagttgtaaaggtcaagatattgtttctgtcaccagcttgggtacttctgtttgttctgttgccggtgttaatgcaccttattggatgcttccagctagtgttaaaagtagcttaagtgttgctgctactgcagtaccaacctccgacagtgcatctgaaactgcttcccaagaaccatctgaaacttcatctgaacagccatcagaaactgcttcacaacaacctgctgaaacttcatcagaagaatcttctacaatcacttcagccccatcaactcctgaagataacccatacaccatctacccaagtgttgccaagactgcttctatcaatggttttgctgacagaatctacgaccaattgccagagtgtgccaagccatgtatgttccaa

SEQ ID NO: 2117 - DNA, 1434 bp, Candida albicans
aatcaggcaatggaaaactctaaattaatgattgctattgatttgcttgttgttgtttacatttatctcttggtgtctgtttcattttttcgcgtctattctatatatgttaaaataatgtggggcggaattaggggggagaactgtctgtgcccagagactacaaaaaccattttcgcgttctgtaaacattcaccaccaccattcattccacctactttcttcttcttttactctacaaaatcattaatgatgcaatatacaccagaagataggcaaaaagctattgatgaatatatatccaattcgggtttgctgtatcggcagttgagtgaaaaataccatgttccagttactacaattagagatggtgttcatggagctaaacaaccagcaatttgtcatgaaaatcaacaatgcttaaccaatgatcaagaagaaatactcgctgattggattatagagctcattgagcaagatgagccacctactcaccaattaatattggaaacagctaaagatcttgctagatgcaccgaaagagatcctcccacaaatgtggagtgggttcgaagattcttaaaacgcactaaacttgattgtttcgagaatgttcaacttcgtgtctttgctaagagaagggccattgaagaagaagtaatttgtgattggtttgatctttttaagaaaatttgtgagaaacggggaataaaaagagaaaacatttacagttttgatgaaatcagtattcaaatagggagaaataccaatgaatatgttaattttgctaatgacaagaaacggaattctgtaaccgagaattgcaacaaggaaatggctacggtaattgaagcagttagtgctaatggagttagtattcgaccagttgttattttcaaaagtgaatatcgtatgaccaacaaggttctttcaaatcagcgaccaaaatggttttatacaaattctaatagtggatggacaagtaattatattgctcttgcttggctcaaggaggtatttattccccagacacaaccagataatcctgatgaaatcagattgttaatatgtgatggaaacagctcacacgctgatgacttatttatgaaaacatgtatcgaaaataaaattgatgccctttatcttcctacttattctccatatcttacaaaactgatgggtctcatatgttttgacaaactaaagaaaacatacaaaaaattggtcagtgatcaacaacaaaagaatggaatatatgagataacaaaagatgagtttctcaagatttacgaaatggccagaaattatgagatgtcaaaacaaaatattgaaagtgcttgggaagtagcagggttatttccattctgtccaaataaagttttaagatcttcctcgtcttcactacgaaggtgccaaatcgccaataatttccat

SEQ ID NO: 2118 - DNA, 558 bp, Candida albicans
tctcctgttgctatattatttccacacaaccaggaatctctttctcgtcaagccttagatattacagagctgctcactcggtatacaaatgcggcagtttcagcccattcggcagctttccagctttctaagaaatattatgatgctaaacatctggatgttgaatatgagattggctctgaagtttttgttgataaccgttttctcaatagccatcctgatggccacgactcagtgcttgttcccaaattacggactaaattttctggacctttttcaatccttgctaaaagtgggttagtcaattatactttagaaatcccaccgtcctataaaggtgatcctacttttcacatttcccaactcaggttaaagaaaactgtcccctctaattatcttgtgactccctccgaaccagctgcttggaaacgttataaggatggatctattcttgtcgataccgttgctatcgcggaacatcgcaagattggtcgaaggtttcgattagctgcttgtcatgctcctaacatcaactcatccagacggcgaaattgttga

SEQ ID NO: 2119 - DNA, 1089 bp, Candida albicans
aaatcatttagactaagttcatactcttcttttttttttttccggcaagtatttataatgttgaaagagattgcatatacattatactcctatactgttgcacacccagtgcaaactcaagttattgtcttggttgctctacttgtctattatttggttgtttatcccgtgacctcccccttatggaaagtccctggaccgtatattcatcgaatcagttatatcccttgctacaacgcacagagaaacggcacttggatagctcgtgtgcacgagttgcataaaaagtatggtagtgtggttcttttatctccaaacgaggttagcgtcaatggtgatcccaaatttatcaatgatatttatgtgaagaatttccccaagtcaaagttctatgaaaatttccgaaaccatgggtttaaagacaatatttttgccagtttggagaacgatcgtcatcgcaagtataagaagttgatcaacaatttgtataacaaaactgcaattttctcaaaagagaatcatacaaggtcagtgttgctagagactgcagacaagttagttgaaactgtgggtaaagagtccccttctattgaagtatttacattgtttggtgcattagcaatggatgtggtttcaagatttgaacttggtaggactaatggtacaaacttgttagacggctttgccgatagaagaataattgtatcccacagagaggtctccagcatggggttctggacaacgttaatgcctaattttctttgggattacgctgccaccaaaacgattatgcaggcagctgatgatatttgcaacttccaattaaacctctataagtttgctgaaaagaatttgacgtcaaatgggaaaaatttgactacacttgaaacattaaagaaaaatggacttgaaggtgaatatgcttattcctttcttacagataatttattcgctggtcatgaaacgactgccgtacaattaacctatttatgctacgagttgtctcgtcctgcaaattacaagatgcaacaaaaattacgtgaggaattgaataaggcgttcccagatggggacatcgatttaaaaact

SEQ ID NO: 2120 - DNA, 747 bp, Candida albicans
actacctcacgcccggtggaaaattctctcctgggaaacttacgcgcaaaaataaaaaaatgtaaacaatcctttgaccacactcttctcctattcctcttcaatgtgccaccttacatgccaaaaacaaaagaagtaaagcaagaagttgatgaaactgccattcaaaatgctatccaagattttaaaagtgggaaatttaaaacaattgccgaaacagctcggtttcatggtcttgttcctaacacattgaggtttcgttataatggaggattaccaaggaaattagcccacacaaaagagcaactcctttctcctgagcaagaagatgaaatagttaactggattgttgattcagatgcagatgcagatggacatggacggagtcgtagtgacataatcgcatttgctgagctaatgttaggtactagtgaatcttcccctaaaatccatgagtcttggtacgatcgcttcaaatcaagacacgacgagatccatacagttgaaggaaggagtatatcaagtttgagagcaaaagcagttacgtatgaggagatactaaaatattatcgtgattacgacctgattgttagacaacataaaattcctcatgagaacatatttaattacgatgaatctgggttcattatgggtaagggtaaaagttcaagagtagctgtacccagctacaagaatagaacctatgtacaatccacagaggggagggatagctgtactgtttcttca

SEQ ID NO: 2121 - DNA, 1044 bp, Candida albicans
ggcagaactttagagggtatgttcaagttttccagaaggttagagatacaatgtacagtgattgaagtcgcaaatttttcatgggtacctttgatattaccaccattgtttgtatttaaaggtcggatttctggaaaaaaaattttgagtgatgacttacccaattggtactattcatctacaccaaatggacggatggatgatcgattagtgagctcctggttgtgtgatatatttttcccctttttaaacgaaaataatatatcccacgcaatcttattattaaggaataataatgactatattcatgaagtgccatttactagcaaatgcaaagaaaaaggtgttattccattgtttttacccagaaattgtacaacattgttacccccatttcatttgggagagttgggtccagttttacctctatatcaaacaaaattgaaaggattgaagacttttttacgttctcctacacctctcaaacaaaaattgttcttatctcgatatgatcaagttagaaaattggaaatgaccagagaaaaattggttcaagcttggaaagactgtggattaattgattttgatgttgataaaatgttgaaattgtcaccattaatgattgatgaaattgatacaattcctgaaatatataatgataaaaaatggtatgttgtggcaacctctagtttacagaattatgttcaaacagatctggaaagcagtgagtcggaaattggttgggaagatgatttagaagaaaattacagaactggacctgtgtttaaaactttagatcaattaagggaagaatggaaagcagagaaagaacaagcaaatcctaagaaagaagaagaaaatctgaatcaaaaaccagttgcaaaacaaaagcaaaaaccaaattcaacaaagaagcaaaagcagactcaaaagcaaaagcaaaccaaaaagattacaaagcccaaaacatcaaaaaggatgctggaaggtattagtaccagcaatataatcaacaaaccacgtcgtacaagaagtaaaaagtga

SEQ ID NO: 2122 - DNA, 1644 bp, Candida albicans
ttgctattgatttgcttgttgttgtctacatttatctctgggtgtctgttttatttttttgggttcgctctatatattaaaataatgtggggcagaattggggggggggggaagaactgtctgtacccagagactacaaaaaccattttcgcgttctgtaaacattcaccaccagtcattccaccttctgttttcttcttttactctacaaaatcattaatgatgcaatatacaccagaagataggcaaaaagctattgatgaatatatatccaattcgggtttgctgtatcggcagttgagtgaaaaataccatgttccagttactacaattagagatggtgttcatggagctaaacaaccagcaatttgtcatgaaaatcaacaatgcttaaccaatgatcaagaagaaatacttgctgattggattatagagctcattgagcaagatgagccacctactcaccaattaatattggaaacagctaaagatcttgctaggtgcaccgaaagagatcctcccacaaatgtggagtgggttcgaagattcttaaaacgcactaaacttgattgtttcgagaatgttcaacttcgtgtctttgctaagagaagggccattgaagaagaagtaatttgtgattggtttgatctttttaagaaaatttgtgagaaacggggaataaaaagagaaaacatttacagttttgatgaaatcagtattcaaatagggagaaataccaatgaatatgtcaattttgctaatgacaagaaacggaattctgtaaccgagaattgcaacaaggaaatggctacggtaattgaagcagttagtgctaatggagttagtattcgaccggttgttattttcaaaagtgaatatcgtatgaccaacagggttctttcaaatcagcgaccaaaatggttttatacaaattctaatagtggatggacaagtaattatattgctcttgcttggctcaaggaggtatttattccccagacacaaccagataatcctgatgaaatcagattgttaatatgtgatggaaacagctcacacgctgatgacttatttatgaaaacatgtatcgaaaataaaattaatgccctttatcttcctacttattcttcatatcttacaaaactgatgggtctcatatgttttgacaaactaaagaaaacatacaaaaaattggtcagtgatcaacaacaaaagaatggaatatatgagataacaaaagatgagtttctcaagatttacgaaatggccagaaattatgagatgtcaaaacaaaatattgaaagtgcttgggaagtagcagggttatttccattctgtccaaataaagttttaaaatcttcctcgactattgacaaggaaaattctgaagaaaatgcaatagaagagaaatcaagagtatccacagatgctaatgtaagtccaagaagtaaatttatgagacaatttaatttatcaccaagcaaatatcaaagtcctcgttataaaaacaaaaaaatgataggctataatgatgcttacaaggttattaaaggtctcgtaacacaacttgaaacgaaaaataaaaaaatcaagcaacttcgattagaattacaccatggcgttgatattgatattgataattaa

SEQ ID NO: 2123 - DNA, 183 bp, Candida albicans
  unsure (116): Identity of nucleotide sequences at the above locations are unknown.
aaatccaaactccagaggaataacattatggagttttatgaaaagattgttaaattaatacaattcccattaattaaagagaaaatggaatttcatgaagttagaatggtttctcntacaaaacccatgttttgtgtatcgtttgaactaccggaagaagtggcctttaaacaaagtaaatag

SEQ ID NO: 2124 - DNA, 231 bp, Candida albicans
atcatgttgggattaggaggatacttttatggaggtaaacaatgggaaaacaaagaagaaacccctatgcctaaagatgtccctgatgttgatgaagtaggagcaacatcagcaccattattatcagcatcatattatattggggataaatgtaaaccatttaatgaggactttttattatgtaaagaagaacacaatggaggtactcctagaatgtatgaaagaaggtag

SEQ ID NO: 2125 - DNA, 528 bp, Candida albicans
gagggatttgatattagatccaattatattttcaattctactatagatggcattgaagatgctgatcaaattttattggttggtactaatccaagatttgaagctgctgtattaaacactagaatcagaaaagtatggttaagatctaatttagaaatcagttctgtgggtcaagatttcaattctacatttgatgttaccaatttaggagaagatgccaaggcattagaatcagcattacaaggatccgttggtgaaaaattgggtcaagccaaaaaaccattgattattgttggatccggtgttgctgaatctaaagattctgaagccatatataaattagtcggtgaatttgcttctaaacatgaaaatttcaattctggtgaatggaatggtgttaatttattacatcgcgaagcttcaagggttgctgctttggatcttggatttaatacattggttgaagattctactaaagccaaatttatttatttgttaggagctgatgaaataaccaataaagatatt

SEQ ID NO: 2126 - DNA, 618 bp, Candida albicans
caaaaagctagagaagggttcaccgaaatgctattagaaaatcatccattagattgtcctgtttgtgatcaaggtggagaatgtgatttacaagaacaatcacaaagatatggttctgatcgtggtagattccatgaagtcgttggtaaaagagccgttgaaaataaagctattggtccattagtgaaaacttccatgaatagatgtattcattgtactagatgtgttagatttatgaatgatgttgctggtgctccagaatttggtactgcgggtagaggtaatgatatgcaaattggtacttatattgaaagaaatatcaattcagaaatgtcaggtaatattattgatttatgtcctgttggtgccttgacttcaaaaccttatgcttttagagctagaccttgggaattgaaaagaactgaaaccattgatgttttagacgctgttggttctaatattagagtcgatactagaggtattgaagtcatgagagttttaccaagattgaatgatgacgtcaatgaagaatggatctctgataaaaccagatttgcctgtgatggcttacagactgtcttctaccacagggactggccggatccgcatttaatgtgt

SEQ ID NO: 2127 - DNA, 807 bp, Candida albicans
gatgatttacatatctataaaaatcaaatgtctatgcataaggaattaaaaaagaagacaggtgtttatattataattaataaaattactcgtgcttattatattggttctgctataactaataaattatatgttagatatagtgaccatttactatattttagaggtagtaaaccattaaaggaatcagtcttagaatatggattgaagagttttatatttggtatattagaatataataataatattataactaagaaaaaccggaaggttttatgggagatagagaataaatatctatcactatatcaaccaatatataataaatatcctcaagcggatagtcctaaaggatataagcattcagaggaaagtatagctaaaatgaagctaaattttacttctgagcgtaaagagaaatatagtaagatgcttaaagtaaaaaatataattttaacctccgaagttaaattaaagttacgtaatttagctttaagtagatctaaagattatatatctgaggaaggtaaattaagacagagtttaagtaaacaagttgatgttaatttatatttagatgatactttattatgtacaattaaaggtataaataaagctgctcatttattatgttgtagttattcaactatacatcgtagtatagagaaaggttatatttatatacctgattctttcatacgttatttaactaatgattatattaataataataatgatattattagtaagattaataaagataataaagtaagtaaggtaaaatataaatcaggaaataaagattga

SEQ ID NO: 2128 - DNA, 1476 bp, Candida albicans
actgaaacgaaatcaaatcaaatcaaatcacacttcccaatatccacgcccacgcccacacccaacaccatggcatcacttaaatcatttattaaaagtgtcaggaaagccaaaaccattgctgatgaaagatcagtcgtgcaaaaggaatcggcagcaatcagaacatcattcagagaccctggtcttgatcaaaccactagacgtatcaacatttccaaacttttatacttgtatataatgggggagaaaacacatttgggtcaagttgaatgtctcaaattattagcatcaccaagatttgctgataaaagattaggttatttggcgtgtatgttaattttggatgaaaatcaagaagttttaactttattgaccaattcattagataatgacatgcaacatcctaattcttttatagttggattagctctttgttgtcttggtaatattgcttcaccagaattggctagagatttatataccaatgttgaaaccattattgattcgaaaaatgtttatttaaaaaagaaagcttgtatagtggccgctaaattaattgaaaaggaacccgaattggcggaatttttcattactaaaatcaattcattaattaatgaaaaacaaccaagtttattattgggtaccattagattaattcaagcgttatattttgcgtcagaagaatctcgatcaactttaattaaaaccattcctaaattagttgctgatttgaaaagaacaactacaagtggatatcaaccagattatgatgtcacggggactaccgatccatttttacaagttctgttattggaaacattaagaatattagggcgtgatgaacaatgtccaccccaatatttggaacaaataaatgatatattaactcaagtggcatctaatttagatagtgggaaaaatgctgctcatgccattttatatgaatgtgtgaaaactatatttgccattcaatcagatcaatctttaaaaatattgggggttaatattttggggaaatttttatcgacaaaagataataatactagatatgttgccttagatactttattgacggtggttaccattgaaccaatggcagtacaaagacatcgatcaaccattgttaattgtttatccgatggtgatatttctattcgaagaagagctttagaattatcatttggtattcttaatgaacaaaatattcgaatattagcaagagaaattttgacctttttggaaaaatgtcatgatcaagaattaaaatcttatgttacttctcaattaactattgctgctaacaaatatgctcctaatgataaatggcattttgatactttaattagaatgttaaaagttggtggtaatgccttaaccccagatataatttccaatattcttgcccttattttacaatgtaatgatttggaattgaaaaaacatgttgcatctaaattagtggcttcatgtata

SEQ ID NO: 2129 - DNA, 1275 bp, Candida albicans
attctgtcgtcttggtgtcttccacctatcaaactaggacattttcgaaatcaattgaattctttaactgcatcgaatattgcattgtgtatggggttgaatgagcttccaaaaaattgtttcgaaattcatttagatgaagaatccgaattgagaaacaatttaagggcattactaagtgtttactgcagctgtggatcattggaattatcagtgagaagattcaaagttgtgacatggactcaaagccatcaaattgccatgaatcgattattggaaacttcttccaatcaactaccaactctagaagacagatatatttgttattttgcagaattggtttttactggtcatgagatactagattttgtagaccagattaacttagccgtgaatagatcaagaatatcattgctgaatatcaaacgtgccctcagaaaatacgagcagagattatcacaaatattagatcaaagtggatttacatctacaaaacaagcattagctttacaaattcagtattttcatttattggttgtgatttatgacaatttagttagtggggtgtttaatcaatctgatgaaataacaccgaactatgcagacgaaataccaagttcaaatgaaaggcaattctgtttaaaaatgattataaaattaattacactgtgtgaaagtcttgttgatcaatttgtaaggctaaataacaacattattaatattccttcagtcttgtactatcgtcccatgcacgccttaatcttgctagtaagattaagactaattttgaaattccaaaattttaaagatcttgaaatagatgttgaatcatattttaccaaagtgtctagagtaatcaatgacaatttaatgaaaaactcattggtttgttccaaaatgaaggttgtgctaaacaaaattgagaaatggttaattttatcacaaaagtatatcaaatccgacagcgtggagaataatggccccatgaatttcgatgttgtaaagataatatttcaaaataaagacaaagaaatagagaatctagatgtacccaaatcacacaacgagtctcccataaaaacaaacactaccattgagtcacaagatccgtcacctgtaaattcagttgacaatccatttaccgcaaacaatgaatttaatggcataatcagcttagagcagatttttcagggaatagattcagacattctgcattatttaaatccattggaatctaattttgatttaagtaccgattttaatagattttcataa

SEQ ID NO: 2130 - DNA, 873 bp, Candida albicans
gtcaagttcatcgttagttcaactatggtaaatacacaagggttggcagtagggttagccgttgggatcccttcatttataatattggtagtagttgggatattctggtatcgtaatcaacagaaacagaaacatgaagatatgaatgataatgaaatcgacataggattacgagacgaccattcctttaatcagtttcaagaggaactccacaaacaatatgaaaagaataatgatgacgacgaaacccatatacgtgaagaaaaattaactcacgattcatcggaaaatagcaatgatggccaacaacattcaacgtcgactgcaagtagacaaaccccgacacctcatagtcagcactacaactcaaaccatggcgaccaaagacctcaaacaagttacgatttctatgaaacgtttattcctattttaccatcaaatcaacagagatcgccatcagtacaaggttctactgcggatatagcggacactcatcccaatgatactgataccgacttggaaaccactaccaacaacaataatggtaccggcaataatttagcaactgacagctcgtcttcgctaatcaactcccatttgcgcacatcatcaaatgatctaaatacgctagccaaacaactcaataatccggtattttttgagaaactacctagtagggccaccaaatatcaagttaaatctgtcaacaacaactatggtaacacaaatgctgttgggaagaataataactcgagtagcgatttaattaataattacttgattggtgaaacccacgctattaacgatcattttacgtatgaagcaccaaaagttgaagttactaatctaagccgacctgaagaaaagaattag

SEQ ID NO: 2131 - DNA, 834 bp, Candida albicans
acttacaccaacatggccagtcgtcaatctagattagaggcagaaaaattagccataattcaacaatccatgactcgaggtagatcaacatcaccgagaggtggatctcattctcgatcatcatcacttaaccgtgaagattttaataaagagttgaaatggtctattgtcaatcatgaccccctggagaggattatcaaatccgacaagcaacaaactgataatgatttctgggaaaacgaagtcagtgaagaggaacatataagtgatgacgacacaaatgagaaattccaatatgatgacacagggaatattttacccaactatgcttgtcaagatgaaaaaatcaatgaaatcagtcaaattttagagaattctaatttgaatgaccgtgccacaattaaaagattggaggaattaactgccagtgaaagagcctttgctgctgcccggaaagcaggaagcaagattgatcaagaaatattgaataaattggccagcgacaagcagaaattaactggaacaaacttgaatttagatgaaagtgatcaagacgcattagctagaagacaaaagttggaaaattatcaagcatacagaaagaaaatcattgatcaagaaaatggacttcgaaatgggtctgtttctccaacaagaccagaagaaggcgaaggttccagtgaagattttatggctccatatacatcagctgttgaagacaagttggatagtgagtttgcatcacaattgaatgaaactatcaaagaaggaccagttgattcaaataaatctcattcaaggtcttcaccaccggtggaaaacagcgtcagaacg

SEQ ID NO: 2132 - DNA, 564 bp, Candida albicans
gcaagtcgcaatcagtgttatgaatttcacaatatggatacttgcagtggtgtgtatcacatttatcatcgtctttgcaatcatcgtgacacttatcatcaccatccttacacttgtcatcacattttttgtctttgcatttgtcatggcatttattgtcatccttgcaatgatcatgtttttgcttgtcatcacattttttgtcattgcatttatcatggcacttatcgtcatccttgcatttgtcatggcacttattatcccatttatcatcgcatttcttatctttgcagtgatcgtctttgtgtttgtcatcacacttgtccttgcatttgtcatcccatttatcgtgacacttcttatctttgcatttatcgtcccatttgtcatctttccatttattgtcgtcaccaccagcaaaaacattggtacaatgtttacatttggagtaaggataggttccatcacatccatgatataattgaccatcttcaccttcataaactaaatccaaatcagtgtctttacagaacttctcgtctttgtgatatttccattctttaa

SEQ ID NO: 2133 - DNA, 282 bp, Candida albicans
aatataacttgttgtcatgtaaaaacaagacatttgagtcttttccaacactcgatactaaaaaacaaaaaagtgatatttgttgttccctttgttttgttggtcaattttatcatcaattatattcctgccatccaaagaactatgggcacatcacaagtccccgttgaatactactttattgcagttgggtttgggttagtggtattcacttatgatgaattaagaaaattgattgccagaaagtatccaaacagttttactgcaagaattgcttggtaa

SEQ ID NO: 2134 - DNA, 1104 bp, Candida albicans
atagtgttgcttttttcgtcgttattcattatggaaaaactactactagatcgactgttgggtagaataacaccttctcgattctctaatataattactgaaaatttctattctgagatttatcaactaggcaagcatgatgttttcccaagtaattgtcatgactatgcagctgtcaatagtctctccttagaaacaacagattatcaatatctattaagtggaagcaacgattcgtctatcaaactatgggatttaaaacaacaagaaactatacgtgaagaaaacgaaatagatgccaatctacatttacatccgtccacttttgataattttgattacgacaatcctgtatcgacttttgtcaatttagcaaccatcctaaaacgacatcatcacaaatttggaatatcgtgtattcaatggtggccgtatgacactggaatgtttgcaagctcgtcttttgatcacactgtgaaaatatgggacactaatgaactcaccccagtgcacacatttgatctactgaacaaagtttacgatatagatatatctgcagaaaatgctttgattgctacagcaaatgatcagccgttcattcgactattggatttaaattcaacttctagtgctcatacattactgggacataaaggtaaaactttagtagtgaaatggcatcccataaatctgaatatattggcatcgggtgggtacgacggggaagtgaaaatctgggatataagaagaagtcaaagctgtttgacccaattggacatgctgagaaccaatgattccagctatactaccaaactatccaaagcccatctgggcccagtcaatgggcttgtgtgggatcccctgggatcactattgtatactgttggtaatgatgataaaattagagtttgggatatggtcaatgtttccacaccaccaccaattaataaattaattaattttgggccattgatacgaaataaacatccacatacgatccttcttttgttgaatcctcaaggtgaaactgaaacccaatttttattattcccttcagaaagtggagatgttttcatatttagaacaattgatggcaagttgtaa

SEQ ID NO: 2135 - DNA, 477 bp, Candida albicans
tattattgggcaattctcattgtggcaattattatacggattttagagcaagtgaagagttacgatatagatgcatcacatcatggtattctttcgatattagttgttggaatagtgcttctattatgtctacagacccctgaagacaccctaatcgtgatgagaggtataggtattcaattgcaaagtaagaaaatgtggaggttccaatcatctgattcgtttatacctataaataacatgattgatttagttattcatgaaggattccacgattatgggcaggttatattttatttatgcgtcttgacaaaagcaaataacgataagaatccaatcacgattgtctttccagaattcttaccgcgtaaagatatatttttgacagtttggagactaagtagagaattactatttggaagcacaaaacgctattggagaagagtgcctggtcaaggtttaaaacaagttatttag

SEQ ID NO: 2136 - DNA, 939 bp, Candida albicans
acaatagcgcggatcctggtcggctctgtgagtgaagacaatgaagatgatgaaaataacgaaatagtgaatcctgatttgttacatcaagatttggatcaaaaattatatcaatcaattcaagaattccaaaagttgagtgttcaggaaaaagagaatttgaaagagttgaaaaaattagaacaaactaagacagaattggaaacccaactttctaattatgaacaagaacttaataatcttagggaaaatgggttaaattcgatttcaaaattgaagaacaaattacaattggaattgaatgagaaaaacaagaaattggaacaatctaaagcagcttatgatgttcaattagatcatattgataaattacggaatcttaatatatacactcgaatattccatatctcatgtgatagtcaagataaatttgctacaataaatggctttagattgggtcacaaaataatatggccagaaatcaatgccgcattaggtcaaatagtattattattggtattccttataaagcgattgaaattagatttgaaaaattataaattagtacctatgggatctcaatctcagataataaaattcagtgccaaggatgcagtagatggaactacccaatcaaaaactatattaaatttgtattcatccgatgagttctcattagggaaactattcaattttaataaattagatgtggctatgatagcacttttagatattgtttcacttatagaagccaaagtattatctattgatcaagaaatcgaattaccttataaaataaaaaatgatacaataggtggtaaaagcatcagagtcacatcaaactcggaatggacttcaagttgtaaatttttattgacaaatttgaattggattctaacttttgttagtgctcatacaaatagtgaagaaactttataa

SEQ ID NO: 2137 - DNA, 597 bp, Candida albicans
tacacttttactaataccaaacttgtgcattattattcatctttgaaaatgttcaatttttctgggtcaactaagaaaagagtagttaatctaggtaataaaaaactgggttataataataaaatcaattttttagaacaatcaagattacaacgacaagaaagagagtatcaaaaaaataaggagaaatcagctataatcattcagaatcatattagaaaatatcttgatttgaaaaagaattgttttgcaattataaatgattggttaaatttcccaattaataatgaacaagattttaatagttggattaatcaatttattaatttgagtaaatggtatttgttaaaacaagatgatgatttgatatatcaagtgattaaatcattagttgagcaactactggatagtatgtttgagatctataatactgatggagtgatacttgcattaaataaattgttatcaggtttaaaagacatcaatattttagatttaattgttcaagctttgcatattgtgatatcggaaaacgacaaatttaggggaagaacatggaatgatcaacaatttggtcaaagttttcaacaaatatga

SEQ ID NO: 2138 - DNA, 738 bp, Candida albicans
aaagttattagaagtatgggtacagcttgggaattaacacaggctctcaaagatcaaatattcaaatatgcttccttcaatcaaaccccggtgtcgttgagacagatggtccaatttggtcctgttccttccccaggttcaattttcttatcatcaagatttattgttgaagaattaccaatccgattagctaaaaaagtgaaagatttggagaatgcaccattaggattgaatgaaatgccatccacaattcaggtgaaaaattggtacgcccaatcctttcaagaattaacagaattacataaaccgaaaattagcgacgagttggcaaagctcttgtctaaaggtgccagcaaacattctctaccagaggattcgataaatgaaaaacctcataccaagcaagagattcatcgtatacccgacctgctagaagataacccagccatcaataatatttttagcgacgatgggatcgttgttcgacatcaccaccatcaccattccatttccagagcaagaccccgtttaaatgacaatacccaaacaagagttgaatcacctacatatggtatgtcgtactttaacccatgtccggggaacattgtgtggccaaaagaagtctatgactacaacaaattggttcgtgaaacattggaaataatcaagaaaagacacgatgctacagtggcaactatggcacaaggggttcaagaatggaaaaataaaaatcaaact

SEQ ID NO: 2139 - DNA, 1041 bp, Candida albicans
aacttaagcgcggactgccattcccgtggtgaagacgatgaacttaaagtttattgtgccaatcatgaacgaggttgtgattgggtggggacaagatgggaattagaacatcatgttaaagatatttgtcaatatactggggtgcgatgtaatggtttaagatcagatggatcaatttgtcaacttattattgaacgaagatttgaagataaagaaccgtctcaatgtgttcatttaaaatttgaatgtgaattttgtaaaaccaaaataacaaaaattactgaaacgaaacatcttgaacaagaatgtttatttaattacaaaacttgtgaattatgtgataatgatatgataccagagaaaaatatggcacgacaccaagagaattgtcgaaaaataggtagattcatatgtccagctcatgaaattggatgtaaatggattggaacaaatgaaacttcgttggaacttcatatagaaaataattgtcaactatatcatttcttacccacttttactacaatgaaagataaaatggattcattggttttggaaaatgaaacattacaaaagcaaataaataagatgttagattcaataattcaaggaaaaatcaccaatttaggatatagtgaatcaattgaagaaatcaataaatttgaatcaatagaagatcaagataaattagtgtatttaaattttgaaattgatcggttgaaatatgaaataaatgaaagaataatcccatttatgaataaatcaatagttaatgaacgagaaaatatgatgaataatttgatcaatgataatttcatgataagagaggatatgaatgtacaacgaatgatgattaatagtttaaggaaacaattgcaatttttgttgttttccaagaatagaaataccactctaagtggtggtgttggtggtactaataatatgtttccatctatgtttcctactgaagaactgggattaggtaacatatatgaaacggtttctcgaagtaattctgaagaaagattgaatttgaaattataa

SEQ ID NO: 2140 - DNA, 3573 bp, Candida albicans
tatcagatgcttcaacaatttacattgttattcctatatttgtcaattgcaagtgcaaagacaatcactggtgtttttgatagttttaattcattaacttggtccaatgctgctaattatgctttcaaagggccaggatacccaacttggaatgctgttttgggttggtccttagatggtaccagtgccaatccaggggatacattcacattgaatatgccatgtgtgtttagatatactacttcacaaacatctgttgatttaactgccgatggtgttaaatatgctacttgtcaattttattctggtgaagaattcacaactttttctacattaacatgtactgtgaacgacgctttgaaatcatccattaaggcatttggtacagttactttaccaattgcattcaatgttggtggaacaggttcatcaactgatgtggaagattctaaatgttttactgctggtaccaatacagtcacatttaatgatggtgataaagatatctcaattgatgttgagtttgaaaagtcaaccgttgatccaagtggatatttgtatgcttccagagttatgccaagtctcaataaggtcacaactctttttgtggcaccacaatgtgaaaatggttacacatctggtacaatggggttctccagtagtaacggtgacgttgctattgattgctcaaatattcatattggtatcacaaaaggattaaatgattggaattatccggtttcatctgaatcatttagttacactaaaacttgtacatctaatggaattcagattaaatatcaaaatgtacctgctggttatcgtccatttattgatgcttatatttctgctacagatgttaaccaatatactttagcatataccaatgattatacttgtgctggcagtcgtctgcaaagtaaacctttcactttaagatggactggatacaagaatagtgatgccggatctaacggtattgtcattgttgctacaactagaacagttacagacagtaccactgctgtcactactttaccattcaatccaagtgttgataaaaccaaaacaatcgaaattttgcaacctattccaaccactaccatcacaacttcatatgttggtgtgactacttcctatctgactaagactgcaccaattggtgaaacagctactgttattgttgatgtgccatatcatactaccacaactgttaccagtgaatggacaggaacaatcactaccactacaactcgtaccaatccaactgattatatagatactgtcgttgtgcaagttccactgccaaatccaactgtcactacaaccgagtattggtctcagtcatatgctactactactactgttactgctcctccaggtggtactgactcagtaattatcagagaacctccaaacccaacagttaccaccacggagtactggtctcaatcgtatgctacaagcagtacagttactgcaccaccaggaggtaccgatacggttatcattagagaaccaccaaatccaacagttacaacaaccgagtattggtctcagtcatatgctactactactacagttactgctcctccaggtggtactgactcagtgattatcagagaacctccaaatccgacagttaccactactgaatattggtctcaatccttcgctaccactactaccattaccgctcctccaggtgaaaccgataccgttcttatcagagagccaccaaaccacactgtgacaacaaccgagtactggtcccagtcatatgtcactacctcaactatcacagctccaccgggaggcactgacactgtgattattagagagccaccaaattatacggttaccacaactgaatactggtctcagtcgtacgcaactacaactactgtaactgctcctccaggaggtaccgatactgtgattattagggagccaccaaatccaactgtaaccactactgaatactggtctcaatcgtacgctaccaccaccactgttactggtccaccgggaggcactgataccgttatcattagagaacctccaaaccaaactgtcaccaccaccgagtattggtcacaatcttatgctacaactactacagtcaccgctcctccaggtggtactgacacggttattatcagagaaccaccaaatccaactgtcactacaaccgagtattggtcccaatcttatgctaccaccaccactgttactggtccaccgggaggcactgacactgtgattattagagaacctccaaacccgacagttacaacaactgagtactggtcacaatcttatgcaaccacaactaccgtgactgctcctccaggaggtaccgctactgttatcattagggagccaccaaatccaactgtaaccactaccgaatattggtctcagtcatatgcaaccacaactactgtgactggtccaccgggaggcactgataccgttatcattagagaaccaccaaatccaactgtaaccactaccgaatattggtctcagtcatatgctactactacaactgtgactgcaccaccaggaggtaccgctactgtgattattagagaaccaccaaattacacggttaccactactgaatattggtctcaatcatatgctactacaactactgtgactggtccaccgggaggcactgataccgttatcattagggagccaccaagtccaacagttacaacaaccgagtactggtcacaatcttacgcaaccacaactaccgtgactgctccaccaggaggtaccgctactgttatcatttgggagccaccaaatccaactgtaaccactaccgaatattggtctcaatcatatgctactaccactactgttactggtccaccgggaggcactgacactgtgattattagagaacctccaagtccaacagttaccaccaccgagtattggtcccagtcatatgctactacaactactgtgactgctcctccaggaggtactgctactgttatcataagagagccacctaattacacggttactacaactgaatactggtctcaatcatatgcaactaccactactgttactggtccaccgggaggcactgacactgtgattattagagaacctccaaacccaacagttacaacaactgagtactggtcacaatcttatgcaactactttgaccatcactgccccaccaggtggcaccaatagtgtcattatccgagtccattccagtactaatgatgaatcaagtgagtccacattttcaacattgtctgttccctcattttcaggttcaataagtgttgtttccacaatttctcgtccacattacgtgaactctacagttacccacttacctagttccctgtcaaaaccagtagatattccttctagtgatgctgtaacatctactaatgacaatagtttgacttctttgactggttctgaaaatggtaaaacaagcgtggcaatatctacaacattctgtgatgatgaaaatggttgtcaaatcttcaccaggcggctggaaggcacccgaacttgcgttcac

SEQ ID NO: 2141 - DNA, 2436 bp, Candida albicans
caatctacaattttcaacagtctaatacctatgaagaaactatatcttttatatttgttggccctgtttacaacggtcatatccaaagaagttactggtgttttcaaccaattcaattcattgatatggtcttacacatacagagctcgatacgaagaaatatctactcttaccgctaaagctcaattggaatgggctttggatggtactattgccagtcccggtgatacatttacattagtcatgccctgtgtatataaattcatgacgtacgaaacctcagtgcaattaactgccaactctattgcatatgccacatgtgactttgatgctggtgaagacactaaaagtttttcaagtttgaagtgtacggtgactgatgagttgacagaagataccagcgtttttggaagtgttattttgcctatcgctttcaatgttggaggttccggatctaaatctacgataacagactccaaatgtttttcaagtgggtacaacactgtcacgttttttgacggaaacaatcaactttctacaactgcaaattttcttccccgaagagaactagcgtttggtctagttgttagtcaaagactttccatgtcgctcgatacaatgactaattttgttatgtctacaccttgtttcatgggttaccagctgggtaagttaggttttacatctaatgatgatgattttgaaattgattgttcttctatacatgttggtataactaatgaaataaatgattggagtatgccagtatcttctgttcccttcgatcatactataagatgtacatcacgtgcactttacattgagtttaaaacaattcctgcaggttatcgaccttttgtggatgcgattgttcaaataccaacgacagaacctttttttgtaaaatatacaaatgagtttgcctgtgtgaatggcatatacacgtccatacctttcacaagtttcttttctcagccaattttatatgacgaggctttagctattggtgcagacctagttcgtaccacatccacagtgataggttccattaccagaactaccacattacccttcatttcccgactccagaaaaccaaaacaattctagtcttagagcccatacccaccactacggtaacaacttcacaccatggctttgatacttggtattatactaagaaagccaccattggtgacacagctactgttttcattgatgttccacaacatacagctactactttgaccacatattggcaagaatcaagtacagcgacaaccacttacttcgatgacatagacttggtcgatactgtcattgtgaaaattccatatcccaatccgactattataacaacacaattttggtcaggtaaatatttaactactgagacacacaaagaaccacctctcggtactgatagtgtgatcatcaaggaaccacacaaccctactgtgacaacgaccgagttttggtcagaatcatttgctactactgagacaatcaccaacaacccagaaggcactgatagtgtgatcatcaaggaaccacacaaccctactgtgactaccaccaagttttggtcagaatcatttgccactactgagacaatcaccaacaacccagaaggcatggatagtgtgatcatcaaggaaccacataatccaattgtgacaacaaccgagttttggtcagaatcatttgccactactgagaccatcaccaacggtccagaaggcactgatagtgtgatcatcaaggaaccacacaaccgtactgtgactaccaccaagttttggtcagaatcatttgctactactgagacagtcaccaacggtccagaaggcactgactcagtcattgttagggaaccacataatccaactgtgacaacaaccgagttttggtcagaatcatttgccactactgagaccatcaccaacggtccagaaggcactgatagtgtgatcatcaaggaaccacacaaccctactgtgactaccaccaagttttggtcagaatcatttgctactactgagacagtcaccaacggtccagaaggcactgatagtgtgatcatcaaggaaccacacaaccctactgtgactaccaccaagttttggtcagaatcatttgctactactgagacagtcaccaacggtccagaaggcactgatagtgtgatcatcaaggaaccacacaaccctactgtgacaacgaccgagttttggtcagaatcatttgctactactgagacaatcaccaacaacccagaaggcactgatagtgtgatcatcaaggaaccacacaaccctactgtgactaccaccaagttttggtcagaatcatttgctactactgagacaatcaccaacaacccagaaggcactgatagtgtgatcatcagtcttcaccgcggcgcgaggataagcata

SEQ ID NO: 2142 - DNA, 900 bp, Candida albicans
  unsure (866): Identity of nucleotide sequences at the above locations are unknown.
cgtcaagacttattccaagtattaacaaagcttcaatcacttatgtggcaaccacaatgtgcaaatggctacacatctggtgcaatggggttcatagttctcactggtgacactactattgactgttcaaatgttcatgttggtataacaaagggattaaatgattggaattttccggtatcttctgattcattaagttacaataaaacttgttcatctacaggtatttctatcacatatgaaatgttccccgctggttatcgtccattttttgacgtatatactctggtgtcagaccagaacagacaattaaaatatactaatgattatgcctgtgttggtagttccttacaaagtaagccgttcaatttaagattgagaggatacaataatagtgaagctaattctaacggttttgtcattgttgctacaacccggacagttactgacagtactactgctgtcactactttaccttttaatccaagtattgacaaaaccaaaacaatcgaaattttgcaacctattccaacaaccactatcacaacttcatatgttggtgtgagtacttcgtacctgactaaaactgcaccaattggtgaaacagctactgttattgttgatgtgccatatcatactaccacaactgttaccagtgaatggacaggaacaatcactaccactacaactcgtaccaatccaactgattctatagatactgtcgttgtgcaagttccactgccaaatccaactgttagtacaaccgagtattggtctcagtcatatgcaaccactactaccattaccgctcatccaggtggtaccgatactgtgattattagagagccaccaaaccacactgtcantataagctctggcccacgggtagacaatccgcgt

SEQ ID NO: 2143 - DNA, 864 bp, Candida albicans
acaaaaatgagttatgacaatcccaacaacagcgacagccatcttcgtcttcatgcttactacaacagccgtcgagacgattcagatggtgatgaactgtcgattgaatttcttaaccaaagaagcaacactccattaacacaaggaacttataattatcataatacttctactaattcacttaatttccaacaaccagaaccaatttatcgtaatcaaactcgtacatctttaagtgattcttattatgatcatcccatatttgacacttctcaaacacagatccaacctccacatgataatccattcactgaaagttatgaaatgacagatacttcatatcaaggtaatgatcatcattatcgtactggtcaacctaatcatctcatgaaccccacttataaccaagctttcattcctcatgtttatgatgaagaagataatgatgaacaagaatatgatcaacgtattcagtataatcaatttcaaggggatcattttgatttggcagcgattagttatgctgatgatgaaagtcaaagtcagttggactatgtccccactgaacgtgtcatacctgaaggagaggaagaagaagaggaaggtgagacgagttttgaaaaagaacctggtagtgaaaccatttctggcccatttggagaagaacgatcatttgaagaacctcctccacaacaagaagtccgttccaagaaactcactcgagccacaggtttaaatggacatttagttttggattgtcctgttgctgatgaattattatcgaaattccctgattataatcctgctgaaaaatctggtggtttatcaagtgttcaccacggggctggccggttccgcgcttag

SEQ ID NO: 2144 - DNA, 909 bp, Candida albicans
tttgacgtatcaacaagaatttatactcaagaaggtatagacaataataacgacacaaaattccttactaaagcaccttatccacatccagtgtttcctcaagatgaatgtgagaatgtgacagttacccatagagaaacaaaaactttaggtgacaaaatttccttccgtagtattcaattcatgcgtcaatgctttgatcttgtcacaggatatgcagttccaaaaacaaataaccctgaagaattcaaaggtactcgttgggaaatgactgaagggaaatggttaactcgttgtatatttttagaatccgttgctggtgtgcctggatctgttgcaggatttcttcgtcatttgcattcattaagaatgttaagaagagataaagcatggatcgaaactttacttgatgaagcctacaatgaaagaatgcatttattaacatttatcaagattggtaaaccaagttggttcacaagatcaatcatttatgttggtcaaggggttttcactaatgtgtttttcttattatatttgttgaatcctagatattgtcatagattcgttggttatttagaagaagaagccgtcagaacatatagtcatttattagatgaacttgctgttcctgggaaattaccagcttttgaaaccatgaaaatccctgaagtggcagttcaatattggccagaattaactccaaaatcaagttttaaagatttgattttaagaattagagctgatgaagctaaacatagagaagtcaatcatacttttgctaatttggaacaaaaaactgatcgtaatccatttgctttgaaaattgaaggtttaaataaacctcaacctaatcatggaataaatgtgatgagaccaactggttgggaaaaacaagatttacaattataa

SEQ ID NO: 2145 - DNA, 966 bp, Candida albicans
ttagtcatgattggtttatctacttatagaaatttgccaaccttattaacaacaacaacagttatttcaactgctttaagatctaagcaacttttgcgatttacaaccactactagcaccaagtctcgttcatcaacaagcactgctgccaccacagttggcaactccaatcccaaatcaccaatcgatgaagataatttagaaaagccaggaacaatccctaccaagcataaaccatttaatatccaaacagaagtatacaataaagctggtattgaagctaatgatgatgacaaattcttaactaaacctacttatcgtcacgaagattttactgaagcaggagtttatcgtgttcatgttactcatagaccaccacgtaccattggggataagatttcgtgttatggaactttgtttttccgtaaatgctttgatcttgttactggatatgctgttcctgatcctgataaacctgatcaatacaagggaacaagatgggaaatgaccgaggggaaatggatgactagatgcattttcttagaatccatagctggtgttcctggttccgttgctggatttgtgcgccatttgcattccttaagaatgttaacaagagataaagcttggattgaaacacttcacgacgaagcctacaatgaaagaatgcatttgttgacattcattaaaattggcaaacctagttggtttactagatcaattatttacattgggcaaggagtgtttacgaatatcttctttttggtgtatttaatgaatccaaggtattgccatcgttttgttggttatttagaagaagaagcagtgagaacttatactcatttaattgatgaattggacgatccaaataagttgccagatttccaaaaattaccaattccaaatattgctgttcaatattggccagaattgacacccgaatcaagcttcaaagatttaatttga

SEQ ID NO: 2146 - DNA, 675 bp, Candida albicans
tttaaacaagtgatgattggtaacatacgacaactatccagtagaataactggccaacaattcacaatatttactagatcgatttatctacacaaaggacccagagttgaaggtcttaagagagatcccgaagcagcattcattaatcccaagggaattaaatatggtttaaatgaaaccaatatcagtcatatcaaatcatttttaggtgataaatataatatacctgatgaaatagctttacaagtaataacccataaatcatttggtaatggtattaaaccatataatgaaaaattagctgccatggggagtaaattattatcattatattttgccaaatatgtaactaatcaaccttgtaaacatgataatggtgtggaggggaaaaacttggatgttttaggatcaccaatgtcaagagaattaccaagtttgaaaacagcggctatatttgctaaatcaaacaatattaatgaaataatgttttggcatactagaaattcaacattaggatttgaaagtagtggagaattgaaagtaagtggtgaattattattcagtttagttggtgctgtcaatttttatcatggtaaaaataaagctgaacaatttattactgagaaattagttgatcaatttgaaaaaatcagtgctcaaaatgtcagaaattga

SEQ ID NO: 2147 - DNA, 435 bp, Candida albicans
  unsure (104): Identity of nucleotide sequences at the above locations are unknown.
tatcctcccttcattctccgctgctcccaagaaaagggacaagaaatcagtcttggcacaatgtgtgaacaccaagataccgcaaccaacaacaacacaagtgnttcgccttcggcaacggcggctcctatgcctgcacatatctcgcaggagcagccttcgtcgcagcctgcagctacaaccccggctcctgtgtctacttcgacccctccagcctccgtgactgcgaccgcggctgctgcgaccgcagctgttagtgctccccaagccaacggaactcctccgagtgatgaacaactttcctgcttgtggcagggttgctctgagaaatgtccttctgcagaggcactttatgtaagtctttgtcatttctccatactttttttcgcatctcttcatcgtcttcaccacggggctggcaggatccgcgcttag

SEQ ID NO: 2148 - DNA, 603 bp, Candida albicans
ccatccgccatgtctacgttttttgatgaaatgagcaaatcgtttgctgacgtcaaggtcagtgacggtaagattgatactgctgactttttacaagcatctgagtcgttggttaagttgtttgatcttttagggtcgtctgcatttactgtggtcaagtcagatatgacgggaaacattacgaagatacgtaacaagttattagaagatccagccaactccgccactttacaggatttggtgcttactgaagccaagaccaagaccaaaactgccacgcaaggtttgttgtggttgtctcgtgggttgcaatttacagcacaagctatgagagagacagttgatgctcctggtaaggaattgaccgttacattcactgatgcatacaccaagacgttgtctaagttccatggtatgttggtcaagccagttttcaagttggcgatgaaggcgtgtccatatagaaaggacttttttgaaaagttgggtgctgatcaaactaaggttgctgagcaattacaaaagtggttagaggcattagaaggtattgttaagattattatggacttttttgcatctggaaactatggtaagggtttatag

SEQ ID NO: 2149 - DNA, 402 bp, Candida albicans
attactttgacacactccatactttcttcccgtatcatgacaacatcggttgataaattaaataagcttattgaagaagttaataatcaagatgaattacaattaattgaagaaataaatctatatattaaaaccctttatgaattacgacaagtgaaaattgatcaattatcgaatataatccatcaattaaatcaacaaatcatcactagtaataaagaaattaatcagttaaataaaatcaatgattataattatgaattaattaacgtcaataatttcaatttcgttagtcaacaactgtttcaatttacaaattttgatcgatcatcatcatcatcatcggaatccactaacaatatttttccaatgataaatattttcaacaggcggtggcaggac

SEQ ID NO: 2150 - DNA, 216 bp, Candida albicans
ctgcttgtggtagctgcaatgcccttaatcgatgaagtctctaaagtggaccaaatgactttagtgaaggaagaaacagatgaactatactttgtgaatgaactatactttgtgaatgaactatactctgtgaatgaactatactctgtgaatgaaacatcctctgtgaatgaaacatcctctgtgaatgaaatatcctcagttgatgagctataa

SEQ ID NO: 2151 - DNA, 282 bp, Candida albicans
gtgaaaacggagatcattgcgccacagttggaatcggaattcaatcaggtactcgttcgtcataatctacaagacacgatatacactgggcaagtatcgcatgttggtggtcacgcttatgctgggaatgtattgtactaccccaaagattgtcagacatcaaaagatttcatatggtacggtcgggtttttcccaaggatgtccaaggtattgttgaactgacaattataaataaggaaattatcaaagatttgtttcgtggagatatagaggcatactag

SEQ ID NO: 2152 - DNA, 342 bp, Candida albicans
  unsure (99),(266),(287): Identity of nucleotide sequences at the above locations are unknown.
attagtacattgccattcattaaagacgtttgtcttattttcaataccaagacaaggttcaagaaatcagttaatgaaattgttgttatggcagcaagnagaattccaatcaccaagtcaattaaaggtgggttgagtagattatatcctgaggacataatatatcaagtggttaagggtactgtatcagattcacaagttgatttaaacttgattgatgatgtgttagtcggaacggtcttgcaaactttagggggacagaaagntagtgccttgcccattaaaangattggattcccaattaagaccacggttggatacggtcaatcgtcaatgtgctag

SEQ ID NO: 2153 - DNA, 471 bp, Candida albicans
gcgcgacgtattcctttatccggcggtggccatatggcaatgaaggacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaa

SEQ ID NO: 2154 - DNA, 300 bp, Candida albicans
acagtgtcaacaatgtctgggttggcaaccaagttagttggcaatttaatttctggcaagtatttaacattttcatgttcggtgttaattatttctgtcaattttctaccttcaatttcttcttcgaaaacccacattttaacgtctctttggaaaatatttggtttttcagcacagttttcagcaactaattttgcaactgcagtaccccagttaccggaaccgacaatacaaactttaaatggagtttcaattggatatggggaagtagtcattatgaaattattttttatttgttga

SEQ ID NO: 2155 - DNA, 354 bp, Candida albicans
ttcatcaaaatcttacctactggtgttgatccggtaaatgatacttttttaatcaaaggatgttcagttaagtatttacccagaccagaagcatcagcagatggtaatacattaataactcctggtggaaatccggcctcctcagctaaaaatgccaaggcagtagccgacaatggtgtttctgaagctggcttgataactgcagtacaaccagtagcaattgctgcacctaatttacgtgtaatcatcgccaatgggaaattccaaggagtcaaaataccacaaactccaattggttgtttaaaggtcaagattctattagtcccattagcagaggggataatatcaccataa

SEQ ID NO: 2156 - DNA, 372 bp, Candida albicans
atggtcttgtccaaatcagcatcgttgaaaacaatgtttggagatttaccacccaattccaaagtaacttttttcaagtttgattcagcagccaatttcatgataattttaccggtggcagtagaaccagtgaaagcaactttttcaatctttggatgtttagcaatggcagcaccagcagtagcaccaaaaccagaaacaatgttgataacaccttttggcataccggcttcgactaacaattgggaaagatataaagcagataatggggtggattcagcagtcttcaaaacagtggtagaaccagtagcaagaactggtcccaatttccaagaagccatcaataatgggaaattccaaggaataatttga

SEQ ID NO: 2157 - DNA, 1761 bp, Candida albicans
cgtataggcggatccggcagctccgtggtgaagacatcaaatatgtcatctaatgaagaaataataaatttattaggtagattgaaccaaaacaaaaacaaaaacaaaacagatgatgatagtgctgataatgaaacaacattgaatcaacttgcaaatttaaccaaaaatggaatatccgaaccattaattatgattattcttgataaaatcttcaacgacactttaaagataactgataaaaataaattacttgatgaatgtttaatacctaatcatgatttatcaattgatgtatttttcaaaataataagtataattggtgttagtcgagtttattttaaaggtaatcggaaattcaaatcaaaacaattatctatctcattacaattaaaactacttcaatggatgattgataattttcaatttttagagaacacattttgtaaatcaggtagtattgttttaacattacttgtgaaatccttagattatgaattttcaagaggtccaatatctcaattaataattttagtattaaattcactggtactgaaaagtaatcagataatcacgttttataatcaggaaatttatcatactatcaatatccttaaatcaaatcatatacaaacagtggtcaatttatataataaattcccgttagatatttatttagaggaattattagcatactttagagtgattaatcctgatttagattatatgatatattcaccagaaaatttcccattattgaataaattaaattgtaatttaaatcaagtataccgatggaaagatagtgatgagctaaccgcaactactattactaccaccaccaccaccaccaaaagcaacaagagacagaaaactactattactagcaaacctgatacgataactcataatattgaagtattagaccaaataaataaaatcaatccttacaaattggtacgaaatgcatttgataacgacaaggaagcacaattacttacaatattatttcaaacggggaataatcgatttattaataaagttgataaatatataggtgccattttaacaactttcaccaatctggaaaaagaattacaaagttttttacaacaagtctcccatttatataaaattagtgatggaacaattattttacccctgatagaaaatttcatacttgataataataataataattcattactggttgggaaattttgtcaacaatttgattatcgttctaaattgataaaatatctacataatgttgaccctatgagattagtaacaatgattcatcacaacgcctcaattttaaaacaaatctattatgacaccaataatggatcatacgaaactaatagcaacttcaattacgaatcatgtcatgactatgtcaagaatatactatatttattaaatttatggatatttgaaaaccaagatgatataataatatcaagaataaacctattgcttcctgaattatatgaatttattaaatattgtaaacatatacaagaacaattgaccaatcaagtggttgaattctttataaatttaccatcttcattattcaatcaattggaacttaaaacaataataatcccaagatcgttaacatattcatgtttattaagttgtgaccccctagtggtatctaatattactcaacatatatcaaattgtaaatctcatgattatacaaattcaactcattatcgagatttacaaaattcttatattatggatacaatt

SEQ ID NO: 2158 - DNA, 555 bp, Candida albicans
ttgattgattggttggttggtagtataaacattttcattactctaatggcctcctcagtaaagttggctacggcacttaaacaacgtgctatattgacaaaagaattgtctgaattagatgataaaatacaatcttcattgattctgcaagttggtatgaaaaaaatcaatgatccagataaattgtatttagattatgttgctaaatctcaagaattggctaaattggtatcatcaataaattatactaataatataactccaattgaagttgatttgacaatgggaaagtatgataatactataaaaacgattaatgatgcattaatttgtcgagaccgaatatttaaaaaattacaatttgtgaaaaaaatatcaacagcaggtaaagaacaaccattagattccaaagatgaaattaaatttgtatcatttattgatgttgataaatatgatactttggcccaagaattaaatactcaatttgagaatttgaatttgaaattacaagaaataaattggcaagttgatcttgttgagatatacaaaggatag

SEQ ID NO: 2159 - DNA, 477 bp, Candida albicans
  unsure (463): Identity of nucleotide sequences at the above locations are unknown.
tttcatctacttttttatattttccaatattgtcctgctattatgattgctcctaatacaaatgcacctgttgttgctgaaatgagtgatgaaacaatcacagaaaataccatcgctgttaattcgcaacataagaatatgagattgttttttgtcttgaatacgttggtccaacacttgcatgattttgctagagaagttagattaacaacagaagaatgggaagaaggtatcaaatttttgactgaatgtggccacatcactacggatataagaaaagaatttgttttgttgtctgatgttttggggttttcggtattggtcgacagtatctcccatccaaagccagataatgccactctggggacgttattgggtccctttcatacacatgatgctgaagtcaaggagaaaggagaaaccattgtttcagaaggtaaaggtgagcctctattgattgaanggaaattgaactga

SEQ ID NO: 2160 - DNA, 990 bp, Candida albicans
gaattcagattaccaacacaatactgtattagtgtatttcatttttctttatctactcacaaacaaatcaaattcattatgtcacaagcttttactgaaagtgttaaaacctccttaggtcccaatgccactccaagagccaagaaattgattgcctcattggtgcaacatgttcatgattttgctagagagaatcatttaaccactgaagattggttatggggcgttgactttattaatagaattggtcaaatgtcagatagtagaagaaatgaaggaatcttggtatgcgacattataggtttagaaacattagttgatgctttgactaatgagagtgaacaatcaaatcatacctcgtcagctattcttggcccattttatttacccgattcccctgtttatccaaatggtggttcaattgtccaaaaagctattcctactgatgtcaagtgttttgtcagaggtaaagtcactgatactgaaggaaaaccattaggtggtgctcaacttgaagtttggcaatgtaacagtgccggattctatagtcaacaagctgatcacgatggaccagaatttaacttgagaggaacatttattaccgatgacgaaggaaattattcatttgaatgtttgagaccaaccctgtatccaatcccatatgacggtcctgctggagatttattgaagattatggacagacatccaaatagacctagccatattcattggcgtgtttcacacccagggtatcatactttgatcactcaaatatacgatgctgaatgcccttatacaaataatgactctgtttatgctgttaaagatgatattattgttcattttgaaaaagtcgacaataaagataaagatttagttggcaaggttgagtataagttagactatgatatttcattggccactgaatcaagtattcaggaagcaagagctgccgccaaggcaagacaagatgctgaaattaaattgtaa

SEQ ID NO: 2161 - DNA, 246 bp, Candida albicans
actgatggacttatgtcccatcaggctttgcagaactttcagcggtataccggcatacagcatgtgcatcgcataggaatggcggaacgtatgtggtgtgaccggaacagagaacgtcacaccgtcagcagcagcggcggcaaccgcctccccaatccaggtcctgaccgttctgtccgtcacttcccagatccgcgctttctctgtccttcctgtgcgacggttacgccgctccatgagcttatc

SEQ ID NO: 2162 - DNA, 390 bp, Candida albicans
gctaaattaactaaagagttgtattcatcattacttactaatttcaaacctttgaccttcagtttatcatgtaagtactcgtctgatggtgattccaatgaattcttcaaatttgctaaatctttactaggaattacttcatgctcatgtgttgcagacttctctttaataaattcaagacttggattttcaaattgtttcttggaaataacaatagaatcatacaattgtgctttttctgataagaactcagacgatggtttgtttactgttgcttccaattcctcaaatttagttttaggcattgtaactaaaccaagcttagttgctttggaatcaatttctcccttggttggctcattgatcaatgtttgcatgtatgtgaaattc

SEQ ID NO: 2163 - DNA, 687 bp, Candida albicans
caacatattatccttatcatgctagtaagatttgtcaattctattatattcaaggacattatccaaaaactaattttgaagtccccatttattctccgagcttatgttaatttttccaatcaacatgatagtttagaatttttgaattttttaaaagagaaaccatttgaaaacgaatttgattcaataattcctgtgattgaaaaggctttatttcataaaatggtcgatactagtgccaacacatcacaaaagacactaaaagaatcgaaaaagaatttgaaacgagatgatttagtgaataatgaaatttataagaaatttttgatgtttatcaacaatgaaattgatcaatttgatttaattaaaatcaacaagagtactaaaaagaaagaatctagtaaagctgttagtagtacttcaaaatcatctaaggagagaaagaaattgaaagccaagaagtcgtccaaagaaaaagcaacgacagtgtcaagggagaagagtaaggagaaagataaatgtaaggaaaagactaaagacaagggcaaagaaaagcctgaaaaactgaaaaatggagaagacgtatcaaaggataaactggtaaataaggatacaaaaggacaggaagatgtgaagttaagcaagaaactgaatggaagtaagcggacacatgttcaccatgggtga

SEQ ID NO: 2164 - DNA, 564 bp, Candida albicans
gcacaggagcttaaatcatccaatgaagcctatgataagatggttaaaaagtacgaagaaaagctaaaaacttcaaaattgaatcttcacgaaaacctaaattcgttcaccaaagaaaacgaaaagaaaattcaagacctattgaccactatattgaaatatgagaatctccttgaagagaaaaactcaaaaatattacagttgtcttcatcaaagccaatttccatacctattggcacaccaaggccaagcaccagcagcaacaagctgtcgagacatgactcgtatgatcctatatttagttcgtcggcttattcaccttcacaactactacaacaacaacaacaacaacagccatcgcctcaccatcatcattctggtaatgacattactgctatacagcattctactcctatgggacaactatcaagtagttatttcccaccacaacctatccgcaataattctgcacctattacaagtactccagctgcctcacagcaagcaattccaattataagaggcagaggtggttatcaaaagagatctaagaaattaatgtga

SEQ ID NO: 2165 - DNA, 612 bp, Candida albicans
caaatgtactcctcaaacccctttcccagcgaccttttcagcctatggaaccacaagacacgtgattctaagatgtctaataaaggtgaacaagaacacataaaaaacttgtacgcccctccactatcggcatattcttcagacttcccaggtgccagtttgtaccaattagaatatactataaacacaacaaccaatagctctcccttatttactaatactcctttgactcaactgaaacgcgcacaattagctaaaataagaaatactggttataccactattagaccgattggaattgtacaaactatggaagaaattgaattggaaaaagtgtattacagcctggatgaacaaacaatggaccccgcagcagcagccatagagaattccagcgatgctatagtaggcgctaacgctagcaccgtatcaatacaacaacagatacaacaaccagaaattgacttagatgcgcaggtatttaatgctgatgaaatatacgccggtacagacgatgaaagggattctttagacgaactggatgtgcaacgtatgcgtagacaagctggggtcactatggatgatgaagggttttatggcagcagaagttga

SEQ ID NO: 2166 - DNA, 2766 bp, Candida albicans
attatttcatccaatcttttgttcctgctttatataggcacaacagaaaatccatcgtatttagatattcaaagcaaatttgagagtgtcatatgctatgctttggaaatcttaatgggattagcaaatatcaaagatcacggtttggacacaaagatgttatggagatttataatttcattgttgatagtaactgatgataaccacgaacaattgtgttttattagctcatcaatattgattaaactgttgaagttagtgccgttattattaggatcaacttgcagagtaaccaatgattcacttgagacgttattgactgcgttattgaatcgtttatcgaagaaatgtgatacaattataaacacccacataactgtcttattcccgtcctcaagtgatcaaatactacaccaaatggcattcgaagattcttgtttgcccaatatcgatttaaataaatccattcttgagaaaacagttgactcacaactattgttagagtttataacttgtacagctcaaattttgagttttatgaaatccaatgactatgatattttaacggcattccaaagcaattatgttaagtctccaaatgaagataaggctagtaaaaagaaaaggaaaacttcgttttcaaacaaaacaagggagttcgcttttaatgtggtggcttcgccaactcccgtgatagtgttgtctgttaatgtgtacttagctttattgcttttggtaaagtacgataactgggcattgaatctagcttcattaaatttgattgcattttatttaaaaaatttgaaaccttcacaagatggagacaaagccttgatctttagaagttataagaaattattcccccgaattatttcaatgctagaattgaaaaatgattatactggatgcatgaacaaaaaaacgaaaaatccaacttcatctgcttctggtttaaattcaatggcctcttttgcaaataaaatcaagtcattaaatcagacggaattcagattacacgattatcagataccaatgtttttgctttcaccaactcgaatattgtcggatttgtgccttcaatatcctcgattgaacgatgatatacatgacactaacatagattataagttggttgaaaaattgcaaatctgctatcagtccagcaaactacttaaaatattaaagtctttgaaatcgagtagcaatcatgggaaaatgttagttgattttaccacaatgttgactatcgataaagatgaaaccgaagtgtctgacttgttattacttttgagtgtttatactgcaaatcgagaagaataccggactagagtagtaaacgtcccacaagagtataatattaatgtggcggagattatatttgaaattgtcgatgattattattttttgctcaaccagttacatttagcatatcgtttattgaatccaaagaaaagaagaaaccttaatggaacaacaagaacaactaaagaggtacccgatagtgatttgccatggtttggtagaaatctagggatcataagtacattacatgatgcttctatctttacaaattgtttttactttatccgttcagtatctcgatcagtggctacgttacgaactttttttgttgaatgcaattcatttaaaagtttttcaactactgatgatgcaactgataatgagcaacaaccaagtggtcaagctagtttacgaagtggtaatgttggtgagaatctggccaataatgctgactctttaacaataaggacaactgcaagtgcacctagagtgacatctggagccaacactaactccaactccaatgctgcagttacttcatcatcagcgggctctacatcagtcacgaatggaccaccaggggggtttatttttgatattttacaaatcattcacaaatatgagattttaatgcagatttttgaatttttttatggtgtgaataataccagtgacaattatgatcacacagaaatggatattgcaaagtgcaaaaaaatagttatgaccaacaaatccatctgtattggatcgcttgccaatttcatattagatttcagttcgtttagatataaaattattggtcatgagagttttttgtccagtttgttgactatttatcaaaattcatctacggataatgaaattgaagaatctattcctattactagttccaaaggacaatcgactttagaagaaatttatcaaaacaatgatattcaattgaaaattttacaagtcattaaaaatttcatgtataatgaagctactgaaaacaaaaaagaagttttagattgtttttcgttaaattttattttacaaaaggcaagttatggattgggcgataataatgaatctattagccaccacaagtctcgattagtagataatactcatatcacacaaatcaaattacaacaaaaaataactgcatttgaaattttaagaaatttcatttctggatcacctcatttcaacgcattattaatagatgcctatgaaaatgattttgttcaatttgaatatgcaaatggtaataccggaattccaaatacttggtttcaatttttgattcagaatgtgagtaatgtcaatatatttttacctgacttgaattataagcataatgctagtggccgtattagaaacccagaagctcaactcaaacttttttatgaaaatgatgaagttttaagtaaattaatccaagatgaaaagtatgtgagattgattcgagcaatcaat

SEQ ID NO: 2167 - DNA, 837 bp, Candida albicans
  unsure (23),(768): Identity of nucleotide sequences at the above locations are unknown.
agaagacgaagaggagtagatanatatataaatttttttgttatgcgaacctcggtagaaaaaatcgacaactctttctttctctccacaatggatcacaactacaaacttgctttaaagcaattcattaataagaactttgaggcgtcgttcaagttaacaagtgaattgtttcacatctgtttcaacgaatatgccaaccacaccatctcccaaaccttggttacaaaaataatcaacctatacttggtggaagtgggggtttgcttgaaggatggattgctaaaccaagtccagaccaacgctgcaatcaattccattaccagcaacgaggtcctcaaccagattcgttccgtgtttggcaacgacattccatgtgaaatattgtacaactaccacctagcccatattaccaacccgaaagtgttgattggcgatggatactttgaccagttacataaagattacttgggcgcaaacaacgacaagtacaagccaaagtttatgcagttggtggtgtttgagatcttgcccacatttggaaaataccaagaagcagaacgattgattactgaccctaaagatttggaaaaactacgcaaaatccaacacctgcatgaggaacagaaagcccatcaacggttggctaaacaaaatcaggaaaaagaaagggcagctgccctcgaacaggcgaaacagcagaccttgaaatacaaatcaattaaagagatccaaaacagctacgaagaggaacaccacgaagttcanatatcgcagttgtcgtacatctacaaccttgtcaaaacctacttgagagaaaattatttggctgtgttg

SEQ ID NO: 2168 - DNA, 372 bp, Candida albicans
ttatggttactggtggtagaaatttgggtagagttggtgttattgtccacagagaaaaacacgaaggaggtttcgatttggtccacatcaaagatgctttggaaaacactttcgttaccagattgtctaacgtttttgttattggtactgaagccggtaaaccatgggtctcattaccaaagggtaaaggtatcaaattgtctatttctgaagaaagagacagaagaagagctcaacaaggtttgtaagttttattcgcactacaaaaaaaaaaatagttttagtgaaaatagaaaaaccaacgtaaataaatgtacattaattgcatactctttcaataatgttgttaattcttgctgtggttttgtttag

SEQ ID NO: 2169 - DNA, 1914 bp, Candida albicans
tttcataacattagttttctcaatctcaaggttcaatttagagtaatttctatggtaatcgtaagtttcaacattgatactgatcttttcattaatttagcaaagcttccagccgaagtaattgctttaatttttagctttgtaccaaaatgtatgttgccagagttattgtattgctcaccaattaaaaaggtcgctgcatctgcaattttgtcatatgtagatgtctatgacgctattgagagacacaagtggagttatgagctaggtgttggatacccaaattgttcttgccgacagttcagaatcacacaagaaaatttgaaacaaggtattcgccaatggaaaatatttccaaaatccattgctttgaacaaggtggaccaacttgcaattgcattgaatgattcccgtgaattttttgtggatgctcaacttattaatgcttctttttcggaaattgggtatcacgattatgaaggagtatttcgggactttttaaaatccagatttaagtttagttgtttgaccttgtcgaatcatcggaatccacttactttacctcccattgccataaatgtcaagctaagtaaaattaaattgaatagttatgtgatccccggggtaaagaagttggaactcaatgttccagagaatcaagaggaaagactcacattttctgcagagttagaggatttaataatcaattctgatcggtcaattcaagtgactttacctccaaatttacagaaactagaggtatacgcatttctgaactcagtgcattttatatcagaagagatggttaatttggaatacttaacaattcagttgccaaatattcgaacttttaatgaaacaggaataattgctccaaatttaaaagaactaaatgtaagatgtgatcaattgtcaaatctcgaggagttgcgacaattccaacatttaaaagaattagaatttgaattttgtaattatccctttgggttgtttaatgaaggatctttccctgaattagaaaagtttcggtgtcgggaatgttcttgtctggcttcagaagattttgataactcattattaaccttccctccaaatttgaaaaagtttgaaatagaaatcttccgttttcaaaatgttaattttggtagtttggttcttccatccacattaacgcgtttaaagcttaaaaatttcccatttgattatgattatttggttgatagcttgcagtatattgacgttcatactgtgaaacttacactaaaaagtgactttagaattcctcatatggctaaagaatttatattggcagctgaatattttagtattgatagtattgattttatgtatcatttgccaagtaatcttatccatttgagcttgcatgccattgagctgggacagatgaagtctcttgcccaaatggttaaatggccgccgatgttgagaaaatttactctaataaattttaatattgatcatttcaaattgaagcaattgaacttgaaagagtctagactcacaaagattcacatttatcaaggtaatgtcaaaacattagatgcaggcttatttcccgttagtgtgaaagatctttctttgacagaaatggggatccagcagttgccggactcgtttgaaaatttggaaaacttacagaagttgtatttatggcaaaatcaattgagagacgtaacatctgttaaattacctatggcaacgttggaaactttagatctaagcatatgtaaccttcgttttatatctccatttttggtttccatgtttgaggaaaagaataaaaatgctaaattgagagtaatcgctaaagagaatgcgaatgttagtgttatagatatcaggagggcgttaaaggcaatcaaaaggactttcattagatctcgaacaatttga

SEQ ID NO: 2170 - DNA, 732 bp, Candida albicans
atcccaatcatgtctaacaatcctcatccccaggatgatgggtcacagctatatgataactttgaaatatcacctccttctattgtaatcaggaaagccgatactgatcaatctttaaataaaattatgctcaatcaagaatcacaagatatcaacaactactatactgaaaatgttaagaacgacaacaaccctaataatagctatcaagactacacattttcgggaaattcatcaaaccaacaacatcaacaacaacaacaacaacatttgtatgaggatttgcctactcaatttcattattccaataattcattttttgaacctccaccggcacctactgtggaattaactgatgacccattacctaatttcaattaccctccttcaaacatatatattaatgataacgcctccgacatatcattaaacacaaaggacttgcctcagtttaccactaacgaatttctttctccaacatcacaacttagtacgcccttttcacctggtcattattcacaactgctgcaagatttcttacaagtgaatcacactaatggtagtggtaacaacaacaataacaacaacaataacaatttattaaatcctcgttcaccatcacaatattcatcccattcattatactcagataattcatcacaacctgcatctccatttttagatgcagcttcccatgttagtaacaatagttttcttcctccagtgtcttga

SEQ ID NO: 2171 - DNA, 729 bp, Candida albicans
aagaaaaagaaagtccactcatcaaccagcaagtccttactgataaaacccgcatcaataatgtctaattattcaacagaagtagccaagctaatttcagaagggtccagggcttattcatcgaaggattttgatcttgcatctgaaaagtatggagaggcatgcgaagagtattccaaaagtcatcaaggtaatgaagatgcagatttattatttttatatggtaaagcagtctttcaaagtggtgtgagtaaatcagaagtgtttggtggaaagcctgctgaaccagaggtagaaactgaaaacagtgaatcaaaacaggaagagagtaaaccagaaactgataaaacagatgatactttccaattctatgcagacggagatggggaggaagaagatggtgaggaaaacgaagaaccaaatgaagatgaaaataacgacgaggatgcgaataaaagtgattttgaggttgcttgggaattattggatttggctagagccttgtttgaagagaaactcgagtctttggataagggggacttgaaaccaccatatttgacacaagacacagacgaaagtagtaatgattatatagtggtgttgaaaaaattatcagaaacttacgatatcctaggagaagtgtcattggaggcagaaaactttaatcaagctgctgatgatttgagaaaatgtttagatcttgtctcacgcgcctggaagatccgcagc

SEQ ID NO: 2172 - DNA, 642 bp, Candida albicans
ccaaatcctatattaatacacacagagtatacattactcccatttgttatggctgtggagctaattaattggcaattttgtcaaatatccaatcatgcagaatcaccattaattccaaaccaatggtacgacaccaagaattttacatcacatcaaatacacactgatcttttagaggcaaacattatacctgatccatttatcgatgataatgaaatccacgtacaatggattagtgaattaaattggcaatatcgatgtatatttgatgcaccaggaaactctaatagtaatgccagtttgatattagaaggtattgatacatttgccaatatcaaactaaacaacaagactattttaactaccgataattattttcataaacatgttatacccattataatgaatgataataatgagttagtaattacatttaatagtagtttaaggattggtcaagagttagaacaagaacatggtaaattaccagtttggaatggtgatagttcacgactctatgttcggaaaccacaatttcaatatggatgggattggggtcctaatttgaatacatgtggatttgaatctattaaattgattacagatgaagattatgttaaagattttctcatagggatataa

SEQ ID NO: 2173 - DNA, 408 bp, Candida albicans
aaaataaatagaagtcaatttgtagacataacaactgtttctagtgtcatcaaagccatgactgaaaatacaacaccttattacaagaaacaggcatcataccaagataaacggtataccataaacaagtccaatttaatcgaaccgattattcgacatcgaatacaagactccttattttacaaacaacatttatatttgagtaatgaggcaacaatactaccgattattatcgaacatgtacattacattggaggtacagattcttcaaaccgaccaagcacttttatatcgtgtttattcagattgttagaacttgaaccaagtaaagagataatcaaaacatatttgacccagcttgattttaatacttcaccacggggctggaaggtcccgcgcttagcataa

SEQ ID NO: 2174 - DNA, 609 bp, Candida albicans
aagatgtccaaaacaactgaaatattttgccgtcttccgaaatcagtagagttaattcaagatttcaaagatataactccatcaccaaaggcaaatgctgaatgccgtgcagccttatattctaaaaatggtgatttttttgcttatactcaaccacaagaagtagtcatattagacactactggtgaagcaaaagtgtatcatcgtattgaaatccctgaagtgtttgacatttatttttccccagaaggtacatatttatgtctttggtgtaaaccaattcaattaaataaagaaaatggtacttggaataataatttaaagattttcaatattaaaaccaaaacaattattgctgaatggagtgccaaacatcagaatgcttggaaaccacaatttacttctgaagaaaatctctttgctagaagtataaatcaaaaggaaattcattttttcgaacttgatccaacttctgattctactgtcaatataaatcaaccaagttttaaatataaagtcaatgatcctaaagctactttacaagctttccaaatatcaccaggtagaaatcctagtgttgcatttttcatcccaggaaaaatcaggtaa

SEQ ID NO: 2175 - DNA, 603 bp, Candida albicans
actcatcaattctatctcataatggatgcttggaatagtgcaacaacttttggagcagatggtctactgggatttagtagtcaactcccagacattttaaatttatctgatcctttattggccaagataatcacatccaaaaaggcattacagttattggaatcaaatatagtttctggagtttctgaagatggagaggaaagtaataccaacaatgaaaataaagctattatagaattgttaatgtcggcatgtgatggcgatgttgtcactttagagagcataactagatctaatccacaaattgtcaatcaactatttcctagtgatgaaaatggtgcaacagcattggtatatgctgtctgttttaataatcctgatattgtcgaatccttactagagaaccataaagctgaccctgatatccctgactcaattgtaaattatacacctattatgtgggcggttcatcttaattatttgaacattgtccaactattactagaccaccaagcagacctttttttgtcaccgaaagatgatgggacaaacgcaagcacattagtcttcaccacgagcctgccaggatccgcacttacgtag

SEQ ID NO: 2176 - DNA, 582 bp, Candida albicans
ttggcagatggttgcatgagtggaactgattctaatgtagttggaatagcaccttcagtcgtagagacgacagcactagattccggaatagtaatagcaccacttgagccagctggagcagtttcagcacctggagcaattggtgaggtttcactagccaaaacagaagattttggagaagaagaagcacctggaccagctggtgcagattcagtacctggagcaactggggaaggttcagtggcaggagctgatgattttggagcagctggtttagtttcagtaccagctggagtcatttcaggagcaggagcagattcagtagctgaaacatctgattttggaacagctggagaggtttcaccggcaggaatagatggttgtgaaccagctggagtcatttcaggaactggagctgattcagtagctggaacatctgattttggaacagctggagaggtttcaccggcaggcatggatggttctgaaccagcaggaattgtttccataggtggaatggaagcttctggagttgaatcagtacctggagtgttttcagtcaatggacagaatgtagtgtag

SEQ ID NO: 2177 - DNA, 309 bp, Candida albicans
agttataaccacactcacataggtatagcattttttttgtgtagaaggagaactaaaagaaatatggaaacaatatatgacgaaatagagattgaagatttcacatttgatccagttcaacaaatatttcaatatccatgtccctgtggtgatcgatttgccattagtttatatgatatgcaagaaggtgaagatatagctgtttgccctagttgttcattgatggttaaagtgatatttgaacctgaagatttggaagactatctgtcttccaccaggggactggacccggatccgacggttcgaagt

SEQ ID NO: 2178 - DNA, 492 bp, Candida albicans
gttagacgattgagttgtgattacgtaattatgaaaccaatggtgaccacactttataatggcaagctcccgttggcgttggctgaccctaatgggatattcacatggtgtccgcatttgaatttgatatttatagccatgaacaagatgtcgatctggtgttatcgaatgaatggcgagcgaatatattccatcaacaacaaatcgattgtcaaacatatagcgttttaccgcgagtacttttgtttgtcggggacagacaacttgatcaagatatatgattctaataatgggcagttggtgaaagtgttgccgcacgagtttgatggtgttgagtttgttgggtggaatgggactgagtatagagtgctggtgtccatgccgatggtttatgacctggttagtgagttggaatatttggtggtgaccgaacgcaaaaagaatggcaatacttttaaccattcgtttgaccgtgggactggggattgttag

SEQ ID NO: 2179 - DNA, 246 bp, Candida albicans
aagccttctatttctcctactaacgctctcaagtctgctttattcaacttccaatctttactacaagtgatactattattgatttgtacatgtacatatgtccattccacagctccagcaatattagacaatcgaaaatcaggtattcttagtgtgttttggaaatttgctagaattggtgaaagattaagtccttatgttgccttaggttgttttattatggctttcaatactttaagttcatag

SEQ ID NO: 2180 - DNA, 885 bp, Candida albicans
ggtcgcggttctccaggccgtggtgaagaattgatattaaaagctgattatctaatatttgaaagtccaaatttcatgtattccttgccaaagaatcttttacgattgcatttaattgctgacaaacaaggaaagatgagttcttttattcaaacaatcaaatggccattgatagtgagtgattttgcaataaagggtttcaatattgattacaagacattaaagttattgaatttaaaagaatctagactcagagaaattaacgtttatcaaggcaatgtaaaggtgttagatacagatttgtttcccattagtgttgaatatttcactttgctgcatatgggaatacacaaattacctgtttcattagaagaattgaaaaacttacaaaagttatctctatcaggtaatcagtttagaaaaataaactctgtcaagttgccaatatcgcccttgatagatatagatttaagtcaatgtaaccttggtttggtgtcaccatttttggtttcaatgttcgaggaaaagaatagaaatccaaagttaagagtaaacgctacggggaatttaaatatcaatattagtgatataaaaagagccttaaaaataattaaaggactttcattagaactcaacaaatttaatgaagcattgacggaaatatccaaacattcttctcgtttgcattgtataagtcaacttgtcgatccttactttgaggaatctacaactgaaaagatagtgggctctgattacgacccagaagatctttacaatggaagtgattttaatctggatgaagaggaaattgattacgtaattgctccagtaaccgaggacgaaagtgaagaagagagtgaagaagatattgaggaagataactaa

SEQ ID NO: 2181 - DNA, 636 bp, Candida albicans
gggattagtgctcatgttcgtcataacaaggatgacgttatgccaattgattctttgattttccaaaagattgttcagagatttgccccttataccattgccaatctttactatggacacactcataatgatcaaaaaattgttgcttactctgatgccaaatcaccaaaaccaaatcaaccaatcacctctgcttgggtcattcaatcacttactccatttggtaaccataacccagcatttagatactatgaagttgaagatgaaagtttcaacattatgaactctttcaattattacactaaattgaatgaaacctatgttaatggtggtgaagaaccagtttgggaatatgaatattctgctagagctgcttatgatccaaacaatgagtggccagttagtgccccacttaatgctactttctgggataaatttgctattagcaaaatgaaagatcccactaacatcaagtttaaccaaatgtataccgattaccagtacagatttagtccttacactcctaactgtactcatccatcgggtaagaacattactacttcatgttatgtcaacaattattgtaatgctgctaatctcgacattgtttccgtcgaggaatgtatgaagaaataa

SEQ ID NO: 2182 - DNA, 1335 bp, Candida albicans
acagtcatggataagactaacttgaaagaaccatcactatcagaagaatgtatgatttgtttagaatcaatatctccatttgataaagttggtaaagtcccttgttgtcccacaaaaatatatcatgatcaatgtattttacaatggtctcaaaaatcaaatggttgtccaacatgtagaaatcgtttccataaaattgaaatatcaatccataataaaataatcaatactgttgctatcaaagatagattattacctaatccagctataaatgatataccgtcacaatatattataaatgatagaatactatcagcaataacaacgaatagaactataggatcagcatcgatagaagaagaagcagaagaaatcattgaaggtgtttgttatatatgctcgattgattcaagaaatggaatcatttgtcaaaattgtgggtgtaatttccatttaaattgtcttggtgttatagaggtcgaagatttattcacttggtgttgtcccatttgtgattgtaatcaagaaacttggcttcctcgtcgacgatcaagaaggataacatctagattacaactggatcatcaagagtcacgtggtccaagaagaagaggaagaattactactaatggattagtaatacataatgataatgatgaattggatgttgattttttatatagtaatgatggtgatgattatgaatacaataatactggtgggagtgatagggtatcactggaaaatacattgcaaggacaatatcatgtacatctgcattataatccagtgataaatgggggtgtgatatcaagaagagagcaacttacaacagaagaagttcaatcatgggagatatttgatgaagctcggaaaaatagtgaaacggcaccactactaggaataagtcaagacaccactcctaatggtagtactagcaacaacacagtaatatctggaaatttgaacggaaggactgctactcaacaaaggcgaaaacggaaaaaagtgacaccaatagagagctctacttcaacttccaatggtatgggcacgatatcaagtaatggtaatagtagaatatcacaacttattgatcaagtgaaaacctcaaatgggaaattactgacaatttataatcaacaacaagtgcaactgcaactgcaactgcaactgcaaccacgtggagttttggtgacacctctggcatccactacttcttacccccaatcatcttcagattcaccaatgtcaatatctccagctgctaatagtcccatggaactggtttcttattcaagtgatgataatgattatactagaacgcaacaacac

SEQ ID NO: 2183 - DNA, 1182 bp, Candida albicans
aagtactttttcttgacaaattgtggttacccatttggtttattcaaggaggataactttcctatgttagagcgttttgaatatgatggaaacggttttatagatcttgaaaattttgaaactccattattaacctttcctccaaatttgaacgaattatcaatcagatgtcgtgattttataaatattgatttgagcactttaatgcttccacccacattgatacgattggaacttttggatctatcttttaatgatggttactttcatttaggagagaatttgcaatatgttcacattgagacatccacacttacatttgatagcagcttcagaattcctcatttggctggagaattaatattagaagctgattatttaacttttgagagcccggaatttatgtatcatttgccgaatagtctaacgcggttgcagttgattgcaaacaaacaggggaaaatgggtccttttatccgaaaaattaaatggcccttggtattaggtgattttgctttcaaaaattttagtatagattatcacacattggaattgttgaatttaaaagaatccagacttgaagtaatttatattcgtggaggtaatatcaagaagttaaatgtagatctatttccagttagtgttaaaaatttaactttaatggaaatgggaatccatgaactacctgcttcatttaaaagattgaataatttacgacagttgtcactaatgggaaatcaattgagaaatgtaaattctgtcaaattgccagtattatctttggaggttttaaacgtacgtcaatgtaaccttcgtttgatatcaccatttttggtttcaatgcttgaggagaagaatcagaacgcaaatctaagagtagaggctacaggaaacttgaatgtgaatattattgatgtgaggaaagtattgaaagcaatcaaaggactctcattagagctcaacagactcaatgattctctattgaaaatatctaatcattcttatcgtttggaagctgtatatcgtgattttgatccttatttcgaaaaatccaaatcttcagaaaatgaagaggtagtctccgattatgattcagacgatctttacaatggaagtgtgttttatctggatgaggaatatagtgatgatgaggatgataataacaagaggaaaaaaaactaa

SEQ ID NO: 2184 - DNA, 606 bp, Candida albicans
  unsure (38),(108): Identity of nucleotide sequences at the above locations are unknown.
gatggagttgatcaattaaaactggaaatgaaaggcanaccacaggttttctttaacggaaacaaagggcctcaacccaatttcaaatcaaaaaacaccagattcatnggggaaacagacataataaggtgggaattctccgagatcagggttaggaaagaattgaacttgccaggggacaaacaattactgtcacagcaaaaggggcaacttccaaatacaaagcaagctcttattccagcaattccacaacagccagctcaaagaacgattcaagacagattattggatatattaataggttcagataatagcgaatctgtcgaaaatagatatgctttgatttgtttccactgttttgctcacaacggactagcaccgccacatactgaagatccagcagatgttaagtttcaatgttggaaatgtggtgcaatgaatggtaaaggcatgttattcgaacagccagatatgaagtttgactcttcaaagaattcatcttctgagttgataaacttggaggttaaagaaaaagaaagtggaaatttagatcatccaggcacagagaatgaagaaaaggaagagagtacaaagaagttgcaataa

SEQ ID NO: 2185 - DNA, 366 bp, Candida albicans
ctacttagatcaaaaacaatatataaccccaaaatggatcaattaaacgttaaagaacaacaagaatttcaacaaattgttgaacaaaaacaaatgaaagatttcatgaatttatattccaatttagtttcaagatgttttgatgattgtgttaatgatttcacttctaatagtttaacttcaaaagaaacttcatgtattgccaaatgttctgaaaaattcttgaaacatagcgaacgtgttggtcaaagattccaagaacaaaagtatgttgatttactgagagtaacaaatggcaatatgcctttgatgatcattattatttatcatcagattatactaacaaataaactcatattattatag

SEQ ID NO: 2186 - DNA, 1503 bp, Candida albicans
ataatgccgccaccatttaccccaaatccccgtacaagtaatgtcctaccaacgaatcaagaacaatcagaagacataccatctctgtcttcttcaccgaatttttctagatacgaagaagccaacacactagattcaatgcaacggtttagaaatgcctcaaacaccaccaataacagtagtctgttttcaaggttaaactcaataaatttggtttctgattatatgtaccgaaatcttcatgctgaatataatgaccatgcaataaatgaaccagatgcacatttccgatcacgcatacttcgacatatcagtgacatgcatagattacaaaatcatttcaacgaactaataaacacacgagagcaaagaaatacattggatcatgaattggctataaatacaatccctgtgcaattgagaaatttatctagggaattgacaagaaatgacaatagagaagcatattacatcgaaacaacagatgaagatgatcaaagtttccaagaggatgatgatccaaatgtgatctattactcagacaaccacgatgaatctgatgtcattgaagttgacgatgatgagagtgcactcagtgatgatgcgtctgccgctcttcgacaagatgtacggaataacgagaggctaatagtaacatcagcacgaaacaatagtgccttgtatccatatagatcttctttactagggacaacaagcgcccttccattgagaagacaaaatgccattcgaatacgccaaccaccaaataaacagggagaagaacatgccaaatcaacaaacaaagatggaaacttgattactgaagtacttaacgaggaagcaaatgcgttgcgaacagatattagtaagttttatcaagcattacaagcactgggctgctttcaaggagagtctccgttgtttgagaaaaattatcatgatcacggtgccaatttcagaaaattatatctaaccggtccgaacggcgggagtgcgatgataacagaatatcggcttctgaatttagatcaacgtatggatgcatatttacagagtagaagaaaccgtctgctttggcaaaaaactactcttcctatcccgccacctcccacacttgacaaaaagagatctcgaggaatcgcaaaaaggacttccaaaaaacaaaaattgatccataatactgatgatgaagttgcaaaatatgttgatgatgcaccatctaattttccgaaaactaggtgtacatattcaaaaaccgaaaaggaagctataatgaatggtttaccaagcagtttgttggaatcaggttcaagttattctgttggcatttctgctgaaccattatacagatgtgatgtaaatttcactgatgttaataaaataattcatggtgtcttcagttttaccccagaagagaaattcccttttattgtcagtgctattaaaagctacacaattttacccaatttttctgtgggctttaatgaatatgcccccaaattt

SEQ ID NO: 2187 - DNA, 666 bp, Candida albicans
  unsure (41): Identity of nucleotide sequences at the above locations are unknown.
cacgtgacccatttttcaaatattataaattccactaaccntaaccctaaccctgcattggttatatttggaatttttttaattataagtgctacactattacaaggtattcaatttgttgttgaagaacatattcttgctaaaaatcctattattccattacaattaatttatattgaaggattttatggattatcattaatgataattatatccattttattaaattttataattggatcaattgaatcacccgaaaatttccaatcttcaccatttaatttatcattagcaatttatcaagttttccataacaaacggatattaatttcttcattattaattctgttatcaattgctattttcaattattgtggactctctataactcatagaatttccgcaacggcaagatcaacagtagatacttgtcgtacattaatagtttggattgttgctatgagtatgaaatgggaatcatttcaatcattacaattttgtgggtttgttgtgttggttttcggaactttatgttttaatggagttttaaacccagaaaattggggattcattccaagctggttgaaaaatgatgccaatgattcttctcatgaaagattgattgatgtggttgatgaaattgatgaaccaattgaaagaatgtaa

SEQ ID NO: 2188 - DNA, 492 bp, Candida albicans
gtaccagtgtcggaagatgtttataaaaatgaagatactgggaaatggatcattagtgtaagacataaaaatccaatcaccggtgctaatgaatggtatcaagaagaatttgatgctattgtaattgctaatggtcattatacaattccttctatcccagcattccctggtttagctgaatttaatgctaattatcctgatgttttaattcatgctaaatcagttcgtgaattagatgaatttaaagataaagatgtattatttgttggtggatctatttctaccgccaatatcattcaatatatcattcccgttgctaagtcagtaacaatttctaaacgtagtaagaatttagtgtttgattatattaatcgagcattagtgacaccagaaattgatcaaagaggtgaaatcgtcaaatttgatcctaaaaccggaaaagttcattttgtcgctaatgattatggtaatggtggtgaacccaaaaaattt

SEQ ID NO: 2189 - DNA, 2115 bp, Candida albicans
  unsure (1300): Identity of nucleotide sequences at the above locations are unknown.
gatccgttagtcgatgatatattgatttggccattatatttacaatttgccgacacaataggtggtattactgcggttaagatatatttaaaatataaacaatttttaccattgtcaatattacaggggaaagagaatgttaataaacaaagaaattatgggatgaatttacatgaaattatagataagttacgaaaatttggtgatgttgagaatgtaatgaaattctattatgaaattatcactaatcccaatgattatgccaaattaccccaaccaattgtttattatttattccaatatattgatttgttaattagaataaagaaatcatttgatgatgactattttgaaactttgttgacaaaatcattatatcaatatccagatcatttagggaaattatatatcaaggcaactaaatatttcaaatctcgtgggaacattgaaaaaactcgttactattacaatcaagggattaaaaaatgttgtactatcaaagattttactatgatatatgattcatatttacaatttgaagaaaatcaagtgacagaaataacagaaaaagttgatcctgaatcagatttgggatctttatatttagatgattttgaaaaattgattgatgatcggaaaattttacttaatgatatgaaattacgacaaaatatcaatgatttagatacttggtttgaaagatttgaaattattgaaacccaaactccggatgatttaaatttattaattcaaacattaacacaagcattaaaatcaattaatccattgaaagtggttacaacaaacaactccaaattaagcgggatatggttaaaatatgttgacatttattctagtcgaggagattttcaaactgccgatttaattttttcaaaatcggtattatcacaatatattgatcctgatgaattggcagaattatatatcaattggagtgaaatgattttaggaagtgataaattccctgaaaccaaagctattgaaattcttgatgatatattatatcgagaatattctgatattaattacaccgacaatagtaaaccagtacaacaaagaatcatcaaatctattaaattatggaatttttatattgatttattagaatcatttattgaatctgataatcaattgaaagaaattgaaaaagttactaatgcttatcaacatttaataaaattgaaaattgccacaccacgaatcatgataaatttcgctcaatttttagaatcttggaatcaatatgaacaatgtttcaatgtattacatcaagcattanagattttccaaaatgataatcaaattaaatttgacatttggaatgtgtatctcattaaagccattaaacatataccattaaccgaaagaattcgtgatttatttgaacaaagtataaatgaaatcgccgcatatttagtaaaaccaatattattattatattatcaatatgaattagatcaaggatatacttataatgccatcaagatattaattaaatcattaactgaaaaattcacaccagcacaaaaggatcataaattatcaacaacaaatccacaacaaagaaaagaaatcaatttactgaaatttgaaatatataaattgataatgattgaattaggagaaattcaagatattgaacaatttaataaaatagggacaatggccatgaatgatgaatatttatcaaattatcaattattcgatttaggtagtcgatttataaaattcgaaatatcaacagtcaccgccaccgccgccgccaccaccaatggtaatatcaccacaactagtgatagtcaatggggtaggattagagaattatttaaatttttatgtcaatctacattattagatgaaagttggaaaatgtgggaatcatttgaaatggaatatggtgatgaattgagttttaaagatatgttacgatttaaacgtatagtattgaattcaatagctaatgataaagccattagagaatcagctaatccaatggggttccttaaaagtatgtccataactaccacccccaataccaaaactgaatctgacgagaaaattgcaaatccagacataattgatatagatatgtaa

SEQ ID NO: 2190 - DNA, 744 bp, Candida albicans
acgcatttgtcaataaagcatgctagtttccttataattaatttaaatgctttctttcttcctcctaaattgacacatttggaactttggaatgtcaaattcagcaaagggtatttataccttagtaaaaatttagagtttatacgaatctgtgctccagtaataagattcctaggtaatttcaaaattcctccacaggcaaaacatgtacagatgaaagctaaatttttgagtatcaggaaaccggatttcatgtatcatttacccgatggattaaaaaacttacaattaatttccaatggatcagaaaaggtgctaccattaggtaaaaaaattcattggccaaaatcattaatagtgttctgtgtacataatttgggtttaaattttccttccttagaattatggaattttaataattccaatcttgaagaaattgacgttataggtgggtttcttgagaaattacatgctgatggattgcccactagtcttaaaatgttaactatgaagaatttaaggattgagaaattaggtggatcttttgaaaacttaaaaagtttggaaagattgagtcttcacttcaatgatatcaaatacatcactgatatggaatttccatcattgaaatttttagattcgggagacaggaaggttgatttggtgccaccagtttcaatatccttagttgatgcaaagaaaaaattacttaatttggaacacaatggtaacgaccaccagtag

SEQ ID NO: 2191 - DNA, 1569 bp, Candida albicans
tgctatgggagcaccagtgacagcagcaccagtggcagaaccagaacccaaagccaggttgatgcaccaattattatgaatcctgaccctaattggccagcaccattgactaaattttatattgattcaatggctagaattggtaatttgaaaaaagccaaacaacttactggaaaacaacagtggcccaatataattgatatggcagtgagacgaaatgtagtcgatagtaatgattgggcaaatcaacgagtccccatttgtagtggaggagggaagttggaattggaaattttccgtattaaaaagaaaccaaagaaatcaaattctactgaagatgatactaataaaaaatcaaaagaaaaaccactgaataccaataataattctttttatattgacgtgaatggagatgccccttatgatcctaccaaaaagcctaccacaagtaaaatactcaacaacagcagcagcagtagtaacaacaacaacaacaataagaaaactaagggcgataataaaaaattcaaggaaacagggaataattttcaaaagaatgaaaataagaaacgtcaattacaggaagaatatgattctgaagcacgtaagagagctcgatccgaaaggtttgctcaaattagtgaatttaaaccaatatctacctattatgaagatcaacgacgcaaggattctggtgcagtagtggggacaagtgaacaattggaaaagagttactttcgtttgacttctgcaccgaatccagctcaagttcgatcactcaaagttttacatgacagtttgaaatatgttgttcgcaaatatgaagagagtcacaactattcatatattattgatcaattaaaatcaattagacaagatttaacggtgcaacatataaaagatgaattcactgttcatgtttatgagaaaaatgctcgtatatcaatagaaaataatgatttaggtgaattcaatcaatgtcaagcacaattaaaatcgttatatcatcgtcttcgaataaacaaagaaaagtataaacatagatttatactatatgaggttgaaatgatgacctattcattcatatatatgattgtgacaaagaatcaaagtgaaattaataaattcagattacaatatttgaaatacaaacattttaaaaagcatgaatttgaaaaaccatatttcaaattaatgagtgcattatttaaatcttatttatgtactttacaaggagattttgaagtgttttttaaagaacttgaacaatttgcccacattaaagaaactaaaatatcatttaaatttataaatgatcatttattaggtaaagttagattggaatcactttatcaaattgcctatagttatcgtcgtttccttgtggttacagcgtcagaaaaattaagatttcctgatcctcaatcatgtcttatttatttgggagagctcggattagaaaaatgtttgatgaaaggaaatcatgaatttgatattccgaagacacaagtagcattgaaagaattgatagccaaaaaccacagggtagacatcaagggccaaatataa

SEQ ID NO: 2192 - DNA, 939 bp, Candida albicans
gttaaaattcatgaatttggtgtcaattccaatcgtgatgccagtgcattgattaaagccgaagacgatgctagaaacgccagaaaaggtatttggaacgattatgatcctgccagagttgaaaaagaattggcagaatcaactgctaaattggaatccgtcaaccttgctgcatctaaaccaaaattctttgatattgaagttgtcgacgttgaaccaaccactggtgttttatctttccatttgttagattctaccaccacccaaaattttgctcagttcaaacaagctttccaacaatttcatagtcaaatgccaagtgcatctcaatcttcttctaatgacttgccatttaatttggttaaacctcctaagaagaacgatttagtatctgccaaattctctgaaaatggtaaattctaccgagccaaagtgatcaatttcgataaatctactggtaaatacgaggtgaaacatttggattttggaaatattgataaagttccattaagctctttacgttctttaccagaaaaatttggattttcccagtatcctgtttttgcccatactacaactttacaaaatttgagattaccaccatctaagccaaccgactatttgactgatagtatttatgcattagaagatttggtttacgataagaaattggttatcagtgcattacctggagagtcagaagctgaatatgaaggtgtattatacgacgctgaacaaagtttgaaagactcttcatacactatcaataaacaacttgtccaagatggttgggctattgttgacaacaaggtagtgaaaccagcagtaaaagaatatgttgccgaattgatagctattcaacgtgaagccaaatccaaccatttaggttgttgggaatttggtgacgtttcattcgatgaagatagtttattagcataa

SEQ ID NO: 2193 - DNA, 663 bp, Candida albicans
tatcgtcaactttttgaatttcttaaatctgccagaaatggtattgtttatgggggtaaattaagatttctgcatgccctagtgataaacttattatatcgatcgggacccatagtgcttcgtttaaaatcagtattggaagccaccaaagaccatgctcaagtgttggctgcatttgctattatatataaggcatgtgtgatgatattgaaacaagatgcatttttgggtgataaaaaccttggattaatcaaatttatcgcagggagttttggatcatggattgtttattctcaacatttcaattttttccatggtggtataactcatcaaatcacattgtattgtttcagtagagtggttttagcattgagtaaaattcttttagataaatatttaaattgcttccaaccaggattcagaaattatcaaggagaattgatccattacaaagatttaaataatcaacaacaaaagaaattgaaaaatattgtttataataaactgtggaaatactttgccgtattgacatggggattagtgatgcttatatatgattatcaaccacaatacttgcaaagttctttgcgtcatagtatggcctacatttatgatgttgaaatggatacttggtctaattggcgagaattcttgggagtttag

SEQ ID NO: 2194 - DNA, 1554 bp, Candida albicans
aacaataaatcaaccattattggaattcagtattggtgggatataatgcccacggtatttgcttattgtgcccactggatgttgttaaacttcatactatattggggacaccagaagatcttggagttatattttttaaccatgaaagaattatatattcgaattgaagaattaaaagatacaaaaattattgatattagtttatcgtatcttgaaatttataatgaaactatacgtgatttattgaatcccatgactcaatgcaaaaatttagtaatacgagaagatgccaataataaaatatctgtatccaatttatctcgacatcgacctaattctgttgaagaagttatgcaattgattttagaaggtaataaaaatcgaacttgttcaccaacagaagcaaatgctacatttagtcgatctcatgccgttttacaaattaatgtcatacaaaaagatcgaactggtgatatcaccgaggaacacacttttgctactttatctattatagatttggctggtagtgaacgagctgcggccacgaaaaaccgtggcgcacgattaaatgaaggagccaatattaacaagtcattattagcattgggtaattgtattaatgccttgtgtgatccacgaagaagaaaccatgtcccttatagagattccaaattgacacgattattgaaattttcattgggtgggaattgtaaaacagtcatgattgtatgtgtatcaccttcttcacaacattatgatgagactttaaataccttgaaatatgctgatcgagctaaagagattaaaacaaaattaatcagaaatcaacataatttggatcgtcatgttgggtcttatttgaaaatgattactgaacaaaagcaagaaattgaagaattacgagctcgagaatctaaaatggtggaatcaacaatcaataaacgcaaagatttagaatccaaagttttcaaaattttatttgaaagtcttgaatcaactcgtaaagccattgctaaacaaaatcaggagaaatggaaaaaatatttcatattggcgaaaagaaaattattattatcacaaaagattgagactgaattggtattagaacaacgagatgatattgatataaattcattactgatagcatcgggtaatgaatcagaatcagttttcaaaatctatgatttatgtgaacaattaattctgaaaattgaatatcaattacctcaattagaatcacaatatagtcaaccaacagatttggattatatattggaagattcagccatgcaaacattgaaaagattacaagatgaagaaggatggactgaacatcatagtgctatatatcgtcaatcaattcagtctatgaaacgtgaagttcataccgatttgttattgtattcatcgatattgtatgataatttgattcatgatttaagtatatttttctatattcctcgagaaattggtaatttcattaataatatttccaatccaacatcattgaatgaagcgtcttcacccacggggatgggcggatccaagcttaac

SEQ ID NO: 2195 - DNA, 834 bp, Candida albicans
attggttcagatgcgttgacccaaaaagttcaagccagtgcacgatttaacatagttttaaaagatcaattgaaacttattgaaaagataaagctagaaaggggtcaaattgaacttggggtaaatgttgaagatttaagtgaggaagattatttaagaatcattgaacaagattatgaaatacaaaaaccatggtggttcacaaatgagtttttagatgttataagagctggagaaaccgacaaactagaggaacataacaaagatgacgatttagataaacagcttgaagcattaccatttgatttgaaacagtatcagttggcaaattctagatacaaacaatttataaattctttaacatctgctcgtgccagtaatgaaattgaagacgaagatgaagttgatggtttaataccgagatcagatgacaataattcagtcatcaatgtagttagaaaacaattgcaacatgaaaaaccaaacaaaaaatttcctagagttatgagtaacccagtattggaacgtttatctaatgacaccaagaaactagcacatgattatattagacatgaaaatgatcaaaatgacgatgatattgataagatactggatttggaaactttgaaaacattacatgacaaattggcgaatcaattaaacacagcatacaaaattaacaaagttttggctaatcaattgacttcaaatatcaaaatgaaaagaaagttgtgggtatatactcaattactaatggatgcaaatattcaagttggattgccaccagaagctacaagtgcacctcaacgtgttatgcatattgacggcaggtga

SEQ ID NO: 2196 - DNA, 843 bp, Candida albicans
ctcacaatgggttcgccaattatcatgttgatcaagttgttacttgaccctgatgtatccaaaaaagtcattttacaaatggcatggtcccaagttaaagcaattggaataggtaaagtaattgccgctttattgagtgctttaactgttggtgtgtcttcatttattcgtgtaccacaaatcaggaaattattaatcaattctgaacacgatagaattgctgttgccaatggtttatcattaacaagtttatcattggatactttaaactctttaattcatgtgactttcaactcacaaaatagaattccgtttattcagtatggcgaaagcttattattaggtattcaaaatgccattatcatcttattggttaagttttaccgtggacaagaaactgcaggtgttggcaaatggcagggattaaattgcgacgataaatttgcagctataaggggagcagtcaccaaaccattggtcatcatgattgcatcagccatctttttcaataaattagctccttcaagtttgatttcagcattggagattttaaacattccaattagtatagttgctaagttcccccaaattaaaaccaactacgagttgaaaacagctaaacatttgagtgacactgtcttgagagctaatgtcgttggatcattaattagagtttacacctcgtttactgactactcgactaagaaacaaagaaacaagaatactgtggatgaaaccattttattagcgggctattctacttctttgatattgaattctattttattgggtcaatctatagtgtacgataaattgggagacaagaaagtagaagacgaatag

SEQ ID NO: 2197 - DNA, 486 bp, Candida albicans
  unsure (453): Identity of nucleotide sequences at the above locations are unknown.
ggccggtgggggcttcacgcgtggcaggcggcaggccaggtgagcaggtccgcgggcgagccggggagaggggcgggcccgcgcgggggattgggggctccgcgggttcaggcccgggggcggggcccgggggccatgttggatatgggcggaagttttctttcagagaccgagggacgggaatccgttgccgcccccggccgggcggcacgaccccgatttgggtataggagagacgagcgtgggaactggcggacccccatacaagtaaaggcgggcggcatggggcacggcccacccggggaccccctggatgtggcacggcccccgcaaatcggccgcccgcctgccgcctcccgtaaccccgggcgcccgccagcggcgcagctcgcgccaattctcgtacggtttcacgccgggtgcggcgatggactgcggagccagccgggccgnttttcaacacgccaccggccggtcattagtgga

SEQ ID NO: 2198 - DNA, 972 bp, Candida albicans
gttggccaaaccacaagagcaatgttattactgaatttattcgacgtccaacaaactatacttctgcttataccagcgacaaattttgatgtgtccacaagtttcccagaacctgttttgtcgacaaccgatacttaccgaccagtcgtaatttggcatggtttaggtgacaactataacacgtccggtatacataaagtccatgaaatattagacagcatgtatccaggaatatttgtctatgcaatacgtttagatgataacccttcttccgatgaacaaaagtctttttttggggatgccaacaagcaaattgacgaggtgtgccaacaacttcgaaatatcactgaattactgcatgggtttgattctattgggttctctcaaggtggggtttttatgagaggtttgatagaaagatgccccttagaagtgaacaatttaataacttttggttctccgcatttgggagtactggaactacctctatgcaaagaccgttttgattggttatgcaaacggagaaatgcattattgaagaagcaagtttggcacgatagtgttcaaaagcgagttataccagcacagtattttagagatccagcaaacatagaccaatatttagagcattcaaattacttggcagatataaacaacgagcgggatgaaaagaatgcaacttacaaggaaaacttttcaaaattgaacaaattagtgttagtaagttttaccgaagatactactcttgtgcctaaagagagttcacagtttcatgattttgacccagagcacaagagaagtatcccctttctttatacggaattatacaagaacgactacattggattaaaaaccctttacgaaaagaattcagttgattttctatcgatcgaagcagaacatatgcatattgatgaggatttcataaaaaatattgctcaagagtatttaggtgggaaattatgtacgtaa

SEQ ID NO: 2199 - DNA, 228 bp, Candida albicans
ccaaagatgattgaaatacaagctaatgatagattaggtaaaaaaatcaaattgaaatgtcttgaaactgatacaattggagatgttaaaaaaatacttggattacaaattggtactccgctggaaaagattattttaaagaaagggtaccaagtttataaagatcatattactttagatgattatgaaatacatgatgggttcaattttgaattatattatggttaa

SEQ ID NO: 2200 - DNA, 888 bp, Candida albicans
  unsure (731): Identity of nucleotide sequences at the above locations are unknown.
gtgaggtttcacttactaactccagttaagagcttacaaaaacatgtctcttctatacaagaaaagcaaaacacggataagctttgtttgaaattagaagagctatcaaaacggatcgaggagcaagagagtgggtacaatgatgtggtgcttagaatgcttgaaactaatgtttacatgatgctagcaacaatacaaaccacggactacaatttattcaatcagctaacaatttactttaaaaagcttattacttatacattacaggaagattgtctctataccgttaatcaagttggagaaatttttggatgccatttgcatggttttaccaaatatcctcttttagtggcatttcaactcccatatattaacaggctaattgcaaatataatcagaatttgtaaaaaatatccaattatattacagatttggatattgccagatggtgattctaaacttgcaacattgtttcaatcattacccaacaacactagattgccaatgtatcagataattaaaaattttctagttgttgattctcctctagaccaaacagagaatgtggttgagctaatttctttaacaaaagtttcgaattgtctagacaactggtttttacagaataaagatttggtgaatttactaagtaataaatgctccaatagcatttttcaaatggaaaacctagattccaggtttcataatgttactgaatttgcaaagtattntaagatgtttgttctaattgttgaaaactgtacacctcaatttgcacaaacatattataattttttgaaaacacagttattaatttttttctacataatgagatacgtcatcaacatcaacttgctttttcggtcttacaaactattgctgagataa

SEQ ID NO: 2201 - DNA, 1017 bp, Candida albicans
gatttttcattaatgtctttactacaacgaccaattgatagaataacaaaatatcgactatttgttgagacaatttgcaaaaactgtatcaaattaggtcatagtacagctaatattcaaaacagttttgaaaaaatttgcaatcaattaaatcaaattaatcgaaacacagaagatagaaacatacataaagagctattcgagttgatagacttcagtacaattagatatcatgaaatgcaaattgatttccagttttttggtatcccgtatcttgttggtacttgttgggctgtttatgttgaaaacaaagtcccccgaggtcataatttacccattttattgttcaagagccacttgatattaattgagtactgtcattactctaaacggaaaaaattcgagctcaaattcgttgttccagttatcaagtgtcatctagatttggaatcaacaacttcttcctacggtctccatacaacttaccctcattgtattaaagtactgtttgagataggtctttgtcactatgaactactactttgttggcttaccaagactgattatgacatctggtgtgaggaattaacagtaatagtttgttttgtaaatggaaatgatgtattacagaaacagccaaccactgaagcaacccaatatttgtataaattacccactaacttgtctccctacgatatcaacacaacatccgaatcattcacgatgcgacaaggtaactgttattttaaacaatgcttactaataaaaattgtaattgataaggttctaatgaaattgttgcatacagagagttccaatagcattcatacgtctgtaaataacaaccatgaagacaagggatataaaattgtatttgaaaataaacaattatcgacaaacgagaggtttttcagagcatccataagcaaaggcttacacatatacttgattcaagagtcagaagctaaatttatagacttttttctcagttggcaaatcaagaaccaattgaaataa

SEQ ID NO: 2202 - DNA, 894 bp, Candida albicans
ttaagtttagctagagatttatttatttcattttttgtttttccattttttaatttcccactttcttttattatcacttactatatcattgctataatgcttttgaaccaatatactttcagtgctgagagatgcactactcctacatcgatttctcatcctcctttggcatgtcctacatctccaccaccaacaaattcattaaatagataccagcacaaaccagtcacattggctccaactgtcgatcatggttgtgagataaatggaaccaccatagattgtatacctaaagattccaagttctaccaactaatcatggatttgaaacaattattggctggtaaaggattaagcaatgaagatatcgatgtggaaaaagtcaaacaattaatggctgattatgattcaaatgaaatcgattggcaacatttggctcttcatgatccatcaagaaattattcgcgtaacggtattatcaatttgaatggtaatgccaatttgttaatattggtttggtctccaggtaaatcaagtgccattcatgatcatgctgatgctcattgttgtgtaaagatgcttgctggtgaattgatcgaacatttatatgatttcccagatcatgaaggggaagaattacaatgcagacaagaaactagtatgaagagaaacgatgttggttatatcaatgattccattggtttacataaaatgtcaaacccattgcaaaatcgagttagtgtttcgttacatttatacactcctccttatgcttctatgtatggatgctcaatgtatgaagcaagtagcggtagaaaacaccatgttgacatgtccaaatactacagttggcaaggacaattggttaatgagaaagaatctctgacttgttga

SEQ ID NO: 2203 - DNA, 546 bp, Candida albicans
tcacttttccttttcaacactcttcaacatttcccaatgattagacttatacgtcaactgtcaattcaaaaatttgttcgacctcaaccacaatcacaattattattgagatttaattctcaaaaaatcaattttcataaacctgataaagcttattctaatgaacgatctgatgctgctgatgctgctgccacaattttatcggaattacacgatgaaaaagtccatcctaataaagcaacttggttagatgcattaaaacaacgagaaaaatttcaagctgaaggtaaaactcttgatagttatagttatattgatcctataactactgctgttggtgaaaagactcgtagtgattcattttcatatttaattttaccattcaaagatgataaatggttatgtgatgcttatattaatgcttttggtagattacgtgtgggacaattatttcaagatttagatgccttggcggggagaattgcttatagacattgttcccccgcagaaccagttgatgctactggtcttaacgcccgggactga

SEQ ID NO: 2204 - DNA, 969 bp, Candida albicans
ccaaatatttcatttttgaacgcgcaaaaactacttgctccgaatttacaaagactaaccttgtcttcttgtgaaaagttgtttaattttgatggtttgcgaaaatttcaacatttaaaggaattaaaaatagaaaatagtaattatcccatggatttgtttaatgaaggttattttcctgagctagaaaagttgttgtattgtcattgtaagtttccagagttagaggatcctaacaactcattattaaccttttctccaaatttgaaagaattagaaataagtaattatcgttttcaaaaggacatgttaggcagtttggtattccctcctacattaacagttttacgtcttgatagcttaatatttaattatgattatttgggtgcaaacttagaatatatccatgttcgtacttcaaaaattacatgcaaaagtgactttagaatcccgcatatggctcaatattttatcttggatgccaattatttaattcttgaaagtttggattttatgtatcatttgccgactagtcttgcatacttgcatttgattgcccaagagctgggaaagatgaatcctgccacccaattgattgcatggccattaaagttgcgtgattttgctctcgaaaatttaaaaattgaccattatacattagagtcgttgaacttgaagcactctaggcttgaagtaattaaaattgataaaggaaatgtcaaaacattagaaactgatttatttcctgttactgttaaagatcttactttaaaagaaatgggaattgagaagttaccagattcgtttgaaaatttggaaaatctatgcgtattgtcttttgagggaaatcaattgagagaagtggatcctgtacaattgccaatggcaacattggaacttttgaatgtgtctaattccaaccttcgtttcatatctccattaatcgtcaccacggcctggaattccgcg

SEQ ID NO: 2205 - DNA, 780 bp, Candida albicans
agcaataataatgagaatgctcttaaagattgggtattaaaaatttggaaacatggattttgtttaattgataatgtccctgtcactcctgaagatactgagaaattatgtgaaaaattgaattatattagacctactcattatggaggattttgggattttacttctgatttagctaaagccgatactgcttatactaattttgatattagtagtcatactgatgggacttattggtcagatactcccggattacaattattccatttattatatcatgatggtactggtggtaccacttcattagttgatgcattcaaatgtgctgaaatattgaaacaaaaatacccggaaagttatgaaattttttgccgtatccctgtaccagctcattcagcaggtgaagaaaaagtttgtattcaacccgatgaatataatccaatttttaaattagatgatcaaggacaattattacaagtaagatggaatcaaagtgatcgttcaacaatggataattgggaaaatcctgaaactgatattcccagattttatcaagctatacgtaatcgggtagaaattattacttcaccagaaaatgaaatgtggtatcaaatgaaacctggtcaatgtttaatatttgataattggagagttttccatctgagaagtgaattcacggggaaaagaagattatgtggagcttattttgaaagagatgatttcgttagtagattgaaattactcgtattaggtagacaagcagttttagatgccatttaa

SEQ ID NO: 2206 - DNA, 2445 bp, Candida albicans
caattgatatataacggcaaattcaaagttagaaatacaatgtttaatatttattggatcttaacaatcagcatcacaatatacctaattgtgctttttttgataaatttgatacccaatgtatcaattaaatatgtggggtttttctctttaagaggtattaccatcaataccagaaaatcaaccatatatatcagcaaaatttctttacgatttaatttatttgaatcaaacaaggattcaggatttaaacttgtcaatatagaaatcgttgatgttcaagtaactataaaagaaacagcaggaccgggatcatcggcactgaaattgaagatcaaaaatgccattgaaaatatttccctttctgagaaattacattttaaagtaccaaattcactttatgaatatttattaaagacaagagtggccaatagaattaatatccatgtgtttcgttgtgccataactcaccaaaagattcttcaagatcattctatatttcttgactacaccagattcaatgtcaatgtggataaagacaacagtacgcgagtgacagtgattttatttaatggtctcatccaagacaaaatcgatcgactgaataagataaacttgtttagaaatatcgagttctacgtaaactgccaaaccgttacttcgtgtggaacaacaagatccaatgctgtatcgatctatttgtcagattttaaaacttcattgtctattgggagattgaacgtaccattagatctatttgtcaagtctcaatccaagaaagatgctggtaatgttgaggacgacttgaccaacactaaagtaattgatgttgccaagtataagaatttcattaaagagttcatgtcagtttattcaactaccgaaatcagattagaggatttgacattatctcataaatcaatgagaactaatttatccaattttgtgctaacacttgaaaaactcgaaaaagacaatggcgtgactaatcttaaatttatgtggtatctcacatcattcaaattctaccacatcgataccaaatgtcttgaattaccatcggcaacattcttttatgagctttgtcctatccaattcttaacggtagctcaatcattactccgccatgaaaagaatccatcagaaacaatcaattttgatttcaatttgaccatgtcaaatccagtgtttgacatttattatgatcaacaagatattgtttgggatataatacgtgataaaatgatgaaaaggagaatgaatactatgagaaaagctactggagttcaaaagaaggaagaatttttcaccaagatgtctattgcctccaaaatgctcaaggctgtttttagtaaacttgttgtggtggacacaaaacttaaccttcatttaccagagtttggtaaaactgaagttgggaagtttaaccgcttatctaaatccaattcaattatcactgtggctctcctggagttgattttgaaagtatttactagaaatatcaataaaggatcaaacaagttcactttgaacactttgtttaagatgaaaaatgtgaaatgtgagggccagggtaataagtttcattttactaaagtcaatcttttagccacctacaatatgttacaacaaaacgtgtcaatcaaactttcaagcaagagtctcgaattgctctctgctaacgatcttatctttcacattgtacgtctgtttaaaaatcgtcaacgaatttatttcaacaagaaatttgaagaatggaaaaagatggacgttaataatgtatgtccatggagtgagcaaatggacaataaatctggagctcctgtagcagatacaccagccaatcctgagtttataaaattatttgaagttcttccatcctttatatcgtcagtgaaaattgacatttctagcattgtaatggatatggtatgtaaggagggtttgccaagtcacaagctatatgatgaaaaattaggaaaagaaattgatttaaaagactttataagaggtatatctttcaaggtttttgatttttctgtcacgtacaaactcgcaagaaagcattttgaaaccagtgttgcccttttaaaagccttcacattgagtgaatacgcctccgagtacattgaggattttgataaggtcactgaagtacaagttagtgaatctgaaataagtgatttatccagtattaactcagcagagtctatacccttaaatgatgcctctccttcggaacttgatgagtctaatactaagaaaataaaaacagtcttaactgtacgggacatacttgtatccaatgcagggaaactggatgaaaaggatccagacagattaactttgtctataccagaggttgatggtcgagtggacatgtttcttgtctggtgctgtttctatgcaaagacaatgttggaaagattcaaacctactgtataa

SEQ ID NO: 2207 - DNA, 990 bp, Candida albicans
actcaaatcagattaatgaaagttattaatgtgcgactggaacagactggtgatttgccaattccattttatttccggttatattctattacatcggcttatttacaagaatgtgaaatgattaatccggcatttgcatttaatggtgctgggaatgtattgagtgaatggttcaataaccatgtcaattattttgttcatagagttcatgtcaactctgtgaaaagtatgataaatgaatgtatgaaggaaaattggaaagtcactgataaatcagatttatttgctcctgcgcaaactattatcaatgagtttatcggatatggggagtatattaccctgaacggatcatctgggttttctggagatacatggttgaaagattttgatttttatgaatcagatgatcaagaaaaggatacgactgaagataaaaatggtggtgaagcactgtctctgtctgggtctgggtccggttctgggtctgtatctactaaaaagcttactattggggaacaagagttcctggttcctagtttggtattaaaagccttgccacacattaaagattatcttgtgattagtaaagcattccccaattatacatcgactatagaaaataatttactcacatatttcaaggatatgaattctaaggcatcacaagctgttcttggggcaggagctaccaaaactgctgggttgaaacacataacagttacaaatatttgtgtatgttatttgtttcttgaagtcgttatgaaaattatggatatacttactgtttctgaagtggattttgatgatgttatgggtagttataaagaacatcaaaatcaattagttttaaaaattggtatgattgttcgagatcgtggtgcttcagagacagttggcaaaatattacatcgagttttaggtgatgaaagagcagaaaggattatgtctgaattgggtataggaacaccacaaccagtatctcaagaatag

SEQ ID NO: 2208 - DNA, 303 bp, Candida albicans
aggattctgcgattggaaaatttgaataaaaaattacaagcagatttgaattcaagtaaagatgtgattctgagtgaacatgggaaattgcaaaatgaaattatgaaattaaaagaattatgcagtgattacgaaagaaagcaaaaggattcacaacgcactattgattcattacaaattcaattgagaaaagatgaagattacaaatctagatatgaatcgaaaattgaagaagctagagagaaagttactttgttgaaaggcaaagttgagaagaaatcccaagaaattgatcaatattaa

SEQ ID NO: 2209 - DNA, 1293 bp, Candida albicans
acaactatcatggaaaactcaacaacaacagtaacacagcctgatgaatcatatcaaagaacaaaatggattgaaacaaaaaagaatatcaaacaattattacaacaattaactccatctaatattaaacagactgtactacaattatttcaaatcaatcttttacgatatcaaggattattcattcgagaaataatgaaacaacaaataagaatcactaccaacgccgagttatatggtagtttaataagtataataaattctaaaataccagaaattggagaattattaatcaatagacttgtattacaatttaaaaaaaattatcttcaaaataataaaaatttaatcaattcatcaattatatttatttgtcaattagttaatcaacaagtattaaatgaaatattaattcttcaaatcttacaaatgttattagaatttaatgtgccaaacaacaacaacaataataataataataataatattgaattggccataatggtgttaaaacaaacgggactgtatttatttaaacattcaaatacggcattaataatgatattgaatcgattaaaagatatacttcaagatggtgctaacgctaatgctaatggtggtaatggtggtgttggactaagttcatggaatcgaaaatccattgaatatatacttaaattagcgagaaatgattttaaaaatattccaattataaagaatggattagatttggtagaaacagaagataaagaaactcatgtgattacattagaagataaattatattctcgagatcatttaaatgtatttagtgtggatgaagaatatcttgatcatgaaaatgaatatattgaattaaagaaagaaattttaggagaaactgaccatgaaaatgaaatccaagttattgaaaccaccaagaattatgaacaaaaaataactgatatgtcacaatcagaattattacaatatcaaaaaactgtatatttaacaattatgtcatctatgtcatctgatgaagcagttcataaattactcaaactaaatttcaaatccaagatcaagaacaagaccaagaccaagaccaactctaatgataatgaaatattggcagatatggtaattaaatgttgttcacaagagaaaacctatctgaaatattatggtatcattggagaaaaattaatatcaagaaatgatcattggcataatcttttcatcaaattattcaaatattattatgatataattgaaaatttttcttcacacacggcggttagaaggagccatgct

SEQ ID NO: 2210 - DNA, 684 bp, Candida albicans
ttttcactccctaatcatcaaccagtatccaatatgtcagcaacgataattgataatggacaaccaaaggcaaagactccacttaaaaaggaagaacttgaacaaatagctcgtcaattaaagaaaaaattatctaaagctagtataactgctaaacaatcattatcaccaaccaatattaaaacatcaacaactatagcattacccaaatcatctcctttaaaaagttatattatgaagaataatagcaatgatcattcaccaacaaacaatattagtaacttatcttcatctccaattaatttgtattcaccaaatgggaaatcacctactcatataaggacaccagctgctgcgtttttatcttgttcaccattgaaaaatgtttctcatgctgatactagtgctgatgatatgctagatagtcccaccaaaagaagaaaaacttcacctcgtaaaatggtattacaagaaatcactcccgaaaaagtgaaaaaagaaagtactcttaaaccatcattagaattaacttctacccccactaaaaagaaacctgaatcaccatcaaaagataaaacaactactcctactatggccaaacgagaattatcctcacaatcatcaacttcttcttctgctcaaaatgctctcttaaagatcttcaccaggcgtggaaaacaagtc

SEQ ID NO: 2211 - DNA, 1410 bp, Candida albicans
gacgcggatcttctagcccgtggtgaagattctacattggcaacatcatattacggttactctgttcccgatttaaagtttaacagaagtagattaactgttgagaacaccaaagaacaaacaaaacacaatgaaaaggtctatgaagaggaagacgaagaagaagcaccaaaattaccacaacgacccataaaccatgaaacagctacaaagaacccaccaccattaccgaaaagaaaatataaagaagaaattgaagaaaagccacctgcgttaccagccagaaaaccagaacttgagaagattaatttgttgaaaccagttgcaagaaaatcgtcatttcctatgccactgaaacctacgcaactcaatttaaatgtcaacttgaatgcttcgaatgaatcatcaggtaagcatcgatcttttaaagatattgaagaattaataaaatctggtaacacagttaagaaaacggcaccaagaccccctgaaaaattgacaacagataaacctacggttacttcaccaaagacgccagtgaaaccaactaaagccgattggctcacatcattgtctacagcgaagaccactacatccaccccgcaagcggtttcacctgattcaaaaagaccggtaccgcctattatttcacataaaaattggatagatagtgctgttagtaaaaccgacaccaaacctccagtggaaaaacctagtaaaccatcatttttgaaaaaaaccactaaaccagaaatacccaagaaaccaaatttaccaaaggaaaacttgtttgaaaccgaagaagaagctgaattcaaattgaaatttaaagaactcaagtcagcatcagcatcagtatcaccagaaaaagtcgagaaaaagattactggtgttccacagaacaaggttatagtggaatttgaagcgaagttagcacaacttagatctcaatcgcccaccaggaaaccaattgaaagaacaaaagatgaacaagaatatctttccaaatttgaaaaagtaaaagctggtcccattccaccactaaggcccaaaagtatgacttttaacaatccaccaccagagtttcaaaaacgatttgaaaaaattgtgactaaagctccacccaaaccaatcaaaccatctaaagtatcattgagtacttatcaagaaaaagatactaaagaattgatgtcccagttaaagagacttggctcaccgaagaaagaggatcaagagaagccgaaagtggagcacaaaaaagaagaggatactaaagatattgtcactagtaatggtggcaatgaacaatccaaacgaagaacacggggaccaaaaaggagattaccaaagttgaaagaaataggtgatttaaaaccaacgagagtgattagtggagagttgtttatatag

SEQ ID NO: 2212 - DNA, 216 bp, Candida albicans
actgaaccaagtccaaacaaacaagcaaaccaaaaaaaagcagaagaaaatgaattgagaatttcagttggtaaaacaaaaaggaacaaagcttcttcttctgtaatactaatctttttttgcagaaagaaaaaccttctaggaattgttataagtttaagattaatagttgaaattatgatgtatgtatacagtgtgatagctttaattaattaa

SEQ ID NO: 2213 - DNA, 495 bp, Candida albicans
gacgatgatctgcttacggcgggttggatcacaaaatcagattcgcaacatagtcaccacaagaaaagagagaatgtatctccacggaagaccaagcacaaccatgacagtacaccaagagtgagacgtgactcccccactcatgaggacgatgaagacaatgaaagaggaccaatgactccggctgcaaaggcatttgctgcacgatttgataaacccacggataaaacagctggaaataaacacgaccataaccgttcaacagatggtaactcactagctgaaagactcgacaagttgagtgttagtaaacagaaaaaacctaaccatataccacacaacacaggcagtgttaaactggaaacaccaagacaagataaaagtgtggtggcctcagaagaggataaacaaaaggaggagaaagaaaaggaggaattgctcaagatgttggaggagttagagtcgcaacatttagactgggcaagcatggaatag

SEQ ID NO: 2214 - DNA, 351 bp, Candida albicans
  unsure (324): Identity of nucleotide sequences at the above locations are unknown.
atttgcggacaggtgattttattacggtctcccgagatttcctctgtgtttggagagatgattggaatttggtatttcagtatttggcaacagcaaaaatatccagaatcaattaggtttattgaatttggtcctggtaaaggtacgttgatccacgacatcatgaaaacattcaataagtttgtcgaaaaattgttacccagtgaccaaaagcgaccaaaaattgaaattgcattaattgaagcatcgcatgtattacgtaaagaacaatggaaattattatgtaatcccgaagatccaatggaaaccactggagaaagaaantattcattggcttcccagtgggggtga

SEQ ID NO: 2215 - DNA, 1425 bp, Candida albicans
tactatctcccaccagcaatgatagcacggcaatcttatagaaaactttttagaaatatttcaattacaagagcattttcaaactcgcatttgcgaatactggaaactaaaaaggaacctcaagccaattcttcatcgtctccacctccacataccgatgatttgtactttggaaagttcacgaaagaagagtacgaagatgccaaaaagataattcaagagcaaatatcaaaactagaagggcaaattaagggagattacaatgttcgtgagaatttaggaaagttttctcaattccctgagccagcgtcacaagattcaaaaccagtcaaagttgaaaaccttagtgatttctttcgccaaacaatcaaattaactggtcctattccattgagcacctacatgagacaatgtttaacacatccagagtttggctattatacaaccagagacccattaaatttgcggacaggtgattttattacgtctcccgagatttcctctgtgtttggagagatgattggaatttggtatttcagtatttggcagcagcaaaaatatccagaatcaattaggtttattgaatttggtcctggtaaaggtacgttgatccatgacatcatgaaaacattcaataagtttgtcgaaaaattgttacccagtgaccaaaagcgaccaaaaattgaaattgcattaattgaagcatcacatgtattacgtaaagaacaatggaaattattatgtaaccccgaagatcctatggaaaccactggagaaggatataatagatcagctacaaagtggaataatgatataatttggtttgatactgagaaagatatccagcaaggtgataagaatgtggcaaactttatagtagctcatgaattctttgatgctttacctataaaaagttttatccgtgaagagaagggatggagagagttagtggttgagcacacacccagtgtcaacaacactcaacccaaattggaagagtcgaccagtgccaggggagctaataaatttgagacggacgactcgttagatactgaattccatttgacgattgcaccaaaagaaacaccctcttcaatgatcccacaaatcagtaaaagatatcgagacttacctgtgggtactagaattgaaatttgtccggatgcagaactatatatcatgaaaatggcaaagttgttgagtgacagtaatgataaaggggcaatattagtaatagattatgggactgagaatgagattccagagaactccttacgtggaatctatcaacacaaatttgtttctccgttttggaaccctggtgaagttgatttatcaatcgacgtggactttcaagccttgaagcaattgactgaaggaatagttgatatttatggcccactcaagcaaggtgactggttgcac

SEQ ID NO: 2216 - DNA, 198 bp, Candida albicans
accaagagcaaaaaccctacaaagaagatttggttactaacattttacttatttctagatcctgaagatgatgaaacattaacagacaaaaccagagaccttggattggttgttgttcgatgcacaagtttattgactatatcaccggtggatggcagtgagatcattgacaatccatttattcaaccagaacaataa

SEQ ID NO: 2217 - DNA, 678 bp, Candida albicans
ataaaccattccatgtcatccttgtcattgcaagatgggagaactacaccaaccaaacaaatggacgaccacagtagaagaagtgctggaacaaccccacttgggaatttctccaaattgaaaacaagtcaaagttttgccaatgattcaatagagtatgatcaggaccatagttttaaccaaagctttgatgacagatattcgaaaccatttacaccgacaaagggaaatgttcgatcttctaaatacatgctgtctgccatgaatcacccaaaaaacaaattgacttatcaacagcaagaagagctattaagaaaaaaggaaaaggaaattgaatatttcagatccatgcaacaacagcaaaactatcaggtcaaaccaaaagtcaatgattccaaacggttatcatttcaacatacacatcatagtagtccagatgttgcatctaggctccatcaaatggattatacatcaccaacaagcataaaatcgccatcttatggtgacgtaccacattctcaaaatggcaaatatcagcatttgctaaacaattacgtcgctacctcggattttacgccaacaaaaaccagcaagagggccaccatggctttttatgaaccagagtttcttgatgaatttgacgagattgctaaagaagaaagcccagttggaaattga

SEQ ID NO: 2218 - DNA, 612 bp, Candida albicans
ctaaatattgtgatgacattgatttcacaacattcctcaagaaaattgcctcaaataagaaactttccaactgaaaccaagaaaacaacagataaaagtaaccctcaaccacaacagaatatcccacctcatactccaccagtttatcaaactcacgaacatcctcattcaaataaattgagtccctctggtgtcagtaccacagaagattctcatactcccaacagcatggattctaataacaatagtggagtatattcaacagaatttgaagatttgaaatttgtcaatagtgcagaaattgattcgatttggttacaaatgatgaatctgaaaagtcacaatcaaaatgatgggttcaattataatcctaccaatagtagtaatgcaccttatcatccaaactataataatggtggagataataacagagcgttttaccccaatccaaacacaatcaatgatgcgtttggatatcctttgcctaatcaattttttgaacaaaatttcaccaattttgcaaattttaatccaaacgctgacaataatgaggcggcgatgttctttgacatgtttgataatgtgcctctagacaaattctttaatcaataa

SEQ ID NO: 2219 - DNA, 273 bp, Candida albicans
  unsure (65),(123),(158): Identity of nucleotide sequences at the above locations are unknown.
gggtttttgaagacaccagactttttaaacatcgaagcacacccatttgacccttcgagtttccnagaacagatagaaagcgataataaagtacgacgtgagaaggggttgactgctaggganatcccccacgagcagatgaacgagaagtggttgancgaaaacgcgatccgatggaggttccataatgcgggcaatgacgatattgttcagcagtctaatggccatttttgtgggaagggagtgatgggattcggtttcgttaaaaagtgg

SEQ ID NO: 2220 - DNA, 1041 bp, Candida albicans
tttttttttctattcttttactttgccactgatattaattcctttacttttcctttacttttcttcttcctttattcttcctttcttatcttcacaatcatgccttctccaaatcataatcgtgaagttattattaaactctctatcactagaacccatacccctcctgattccaccaccaccacacctaccacttttattgaaaaaaccatttgtgttaaaagagaattattcactaaaatcaaatcgaaaccagctttaactgaattcttaaataaacaattacctggttatttatctaatgatgataattatcttgtttatactcgtaaatcgaaaagaaataaagattttgtttcattaattactcaagacgattttaaatcccttgccagaagcttgaaagttaagaatcatgtcaaattaaatgttattgatacatcaacacctcctaaagtgaataatactaaccaggacaacaaaaacaacgacaacaacatcaacaacaacaacaacaacaacaacaacaaccaacaatatggttatacttatactggtaccacatacaaatcaggcaaaccaccatcgattgattttggtaatttacgtgatgctttgattgatgctgcatatgatcattttaaagaaatctttaatgaattctcaaatggattgaaaaaggaaatggcttcaacaacaacaacaacaacaacaacaacagctactacctccaatactaaggaatcacctccagcccctatttcaactccagctggacctgttgttgaagaacctaaagctgagactaaaactgagactaaaactgaatcaaaggttgaacctgaagttgaacctgaagttgaaactgattcatctccaattcatcctaatatttgttgtgatgtctgtcatccttatgattttgtccctcttaaaggtattagatataattgtcttgtctgttcaaattttgatttatgttcaaaatgtgaagctaaacaacacattgaaaaacttcaatttggaacacattcatattta

SEQ ID NO: 2221 - DNA, 432 bp, Candida albicans
ctggttagatgtgtatccagtgtcatcactattgctattactattttttacgtcggggttcttttcagccataatctcattgttagatttcgtgatttcagattttgttacattgctttctgtatctggcactttattctcggcagcgatagtgcttctttcttgtgtatggtcatcttgtgtttcacttttgtttatctcctttgcttccttcttgtcaatctcatctactttattatcttgacttttggggtccgtgtttgtgctgtttgttgtatgaccgttttcaatcttctctgtagcattgtttccctcgccttggttatcctctggctttttctctttggttgtggtttcattttcatgttgttgtggttgtggttgtggttgcttgagatctccttgtttagcaatttcatgaaatgttcttga

SEQ ID NO: 2222 - DNA, 480 bp, Candida albicans
attacttatattagagataaacataaatcaatatttgaatattttataagagccaccgatatattaatcaatgatcatatcaaattgttattaaaagaaaatgatgattcaattaaagttaaatatactaaattaaatgataaattgaataaattgattaaagaaaatgaatcattgaaatcggaattagaatttatgaatcaacaacaacaacaacaaaatcaaaatcaaaatactaatgttgatggagatgattacggtaatactagtactaataacgatccattatctaaattaagaatgaatgatttaagaaataaatggaaagcagaaagagaacgaagaattttagaagatcaagaagccaaaaaaagatttaaagaactagaattggaaattcaacgattgaatgaagttattggtaataataataataataataataataataataaacaaactacaaatgataacaactaa

SEQ ID NO: 2223 - DNA, 279 bp, Candida albicans
aacctacatcaggctttggatttctcttgtgcggaaagtcacctgcaacattcaaatgataatcatgtggaccattaccaacatcatctatatgactgtcatattgatcatcattatcgccatttcttgccatatcgaaatctccttccaaatggaacacttcatcataatcattattcaaattcaaatgatccaaatcctcagttaatggttcaatggctggtgatttttgataagctggagatcttaaataaggcggaatatatttcccagaattag

SEQ ID NO: 2224 - DNA, 1431 bp, Candida albicans
tttgtaataattattcaatatcccattatggataactcgttggatcaaaaactattggcgttcatatcatcacagtcatcatccaaaccgttgtcaccaagcaaatcaaataaccttcccaaagctgatataaaatcactcgagtcattgtgtgtcacttcattggatactttattgaataatattggaggttctactactaataacagcattttgccattggactcgcttgatgctattgaagtacgattacgcgggttgtacttaatttatgctgatgacccacgcaagtcatttgatatactacggaaacatcaattatatattgttaaactatttaatattaaacaaattgactatgtttatcaaaatttaaatgttttattagctcaaattaataaagtatttaaaattgaattcacttcgaaaagcactatttttacaggaattgagtttactgatttcaataattggaatgatgatacaagttttttcaatgtaaacagaaaagatataacccaattgataattgcatttcattttttagttttacaatggatagcccaatatgtttccaagaatttaaaatcaatattaatgcaaaagaatcagtttattagtcttgacgaattttgcaatattccccaaatgtttttaaattctagcaattttagaaaatggcaattattaccaagtaatgaaaacattggcaaatataacaccaataatgttaaattgatttctggtttcataaaagtattccaaagtattaaagtgtcatcatcattatctaaatatgttggcttgactaattgtttgaaattgaaactatatgaattgacaaaagacgagtcattattagagtccattggattttcatctaatttgattccatttatcaatgatgctaatataaatatcaatgagtttattcgcaaacacgtaccaatagaatctgagggttccaatgaattgcagactcggttattgaaatcaccacaacttgtcactgacagtgattttcttcgaaatctacaaaatgattcacaattatcagtagataaatgtcaaataataatttcatcctttaatgggtttaaagacaatctcaagacactcctgaaccaacaattatcaattcttgatttaatcacaatacatttgaaggattcattagatgaatcagtggtccccatattgtctcaactgtttcaaatttatagtcatttcaaattgatgaaaagaatgagaaacatttccaatttgttgttcaatttggggaataaagtgcacaatgagatatatcgcaacttggcaattgattacgagtgtgcaatattcgaaatttctcctaataatgacaatttcaaacagttgtttaataaattgaacagaaatcaagttactgggtcattattaagtaatgtttaa

SEQ ID NO: 2225 - DNA, 972 bp, Candida albicans
cacccaatatatatgaattatactattgttaaacctaaaaattttgataaattgattacatatactcataacattaattctattgaaaaaatatgttttagtagttcaaatcaatcagaaataacaaatgatttatttagaaaaatggtttatgggagttcaaattgttttgtttatgctattgctgatttgtttagagatgaaccagtttgttggatgacagtacctcaaccaatttcaaatcctgtattattattggatgttaacaatattggagatttatcaagattgccagtaaatcgaatcaaagaattgacaatcaattgttgcaattttcagaatttcaataaagatattcaacatctttcacaaaatgaaacaaatttaaagaaattaaaattgattgatcctcctcctcctccttcttgtttccaattagatcataaaccaatgaatatttctgaattatatcttgaatttaaaaattatagatttaatcgaaacgttttaaagaatttcaatttacgaaaaatcaagaaattgaatattttcaatcacaacaacaataagttaccatttgaagatttatctattaatgctcaagattttgaatgtttggagagtatcaatgtgaatttctctggtaccaaattcttacaattcattaaacaattaccaccaaatacattaaaagaaatcaggatatgtgatagttatcataaagttaaatattttcttgatacattattacaacataatgaatctttaatatcaataattgtatgtccatttcataaacgtggatattttattgattatattaatagtgataaatgttattttttgaaaagtttaaatgtgacacagttcccaaaattgaattatatcgttgagaaaagtgtcatgttggcagtggttagacaagatggtttaaaacctaaacttgaaccaattcgatttcatcccaattga

SEQ ID NO: 2226 - DNA, 912 bp, Candida albicans
  unsure (898): Identity of nucleotide sequences at the above locations are unknown.
tcaccgcttttagctttctttttgtcaacttccttagtatcgatgactggtggtagctggctaagttggaatgccaaaaaaaatgagtccattaatcaattgtcggaaagtaacgaagacgttatagatgaagatgaagaacatcctaatgatgaagagtcagaacatgatgatacagtccctgatgacaatggtgacgaagtagatgatcatgtcaaagaaaaaagaggactgggctgggcattttggggaaattctaatacgaatgtggagtccacgttgcaaaatgtaaaagacagcaaatcttctggtgcttcagaccaggataatgtggagagtactctgaaaaaggataaggcggtacatgtgggtaatacaatattgagttcgacttcgaaatttcttgtgaagtcagaatctactggaaaagctccccaaaacacggaacaaggtgatgatgctgtattgtataaacctcacgacaagactgcccaattcaatcaaatcaacactcacaaaaatgaagatttacgggaaaatttgatcgtgccagattggaacacttgtctaccacaaactgcaacgaatcctatatttaatacgtcaacaacttccaatcagggtaatgcaaatcaaactgtgcggactgacatcacaaactggaggcaatttttaggacagatttctagtaaattcggtttttctagtaatccaacactcccagaagaggaagaacagtcacaatcgccaggtattgaaagcaatatagaaagagatgttgggcttctttatgaaaaatcatataaacttaacggaaaatctttagctgtgtcacctgaaaataagcgggcatgtttacccaattccaatcaatcctactttttattgaccggacggnccgaaaatacaggt

SEQ ID NO: 2227 - DNA, 564 bp, Candida albicans
tattttaaaccctcctccattcgaaactattattataaagaaagaatgacatgtcaaacggggagaaaatgttcacttggaatagaagaacctattgatatctcctccaaaaacgtgccactcaatgcgtttttaatttacaccatgtcaagcactctaccagatcacaattcgactaattcatggaatgaatatcacaacaatttatccataacaaataacactcaggtaacgacaagttgtgctgataatgtgaaaacaaccagcaatgtccctcgatgtgcaactgacattaattccaaaatgacaacttctgaaatggaaactttacacagatgccggttttcagtgtgtgatttcaataatttggagaattatctatatcaatcagaaagagaggaatgcagcagagtaatagaacaactagaaacacacaacggcaaaagtattagcacttgttgtaattcaaatacggatattaatgctcaatgtaatcaaatgaaaaatcataaaagacggaaatcgattgcattgaaatttaagaagcctcaaacattattatga

SEQ ID NO: 2228 - DNA, 1005 bp, Candida albicans
ataattactactttatatatatcaatcatgtcaagtcatatattcaaagatattcaagataaagaaaatgagttaaagacttcaggaataaggcgtaagggaattataagtaatgaaaatgctggtccactcttgagtaaggattcgaatagtagacaggtacaacaaccacaacaaacacaacagcagcagcagcagctgaaatttaccaataaacgaattccacttggtggtaagaaccacaactcaaacaagttgcttttgaatagatcacaatcaagcttaaatacaaaaccaacaacacaaggtattacaaatgttaaaccaccaagtttgccaaagtcaaattcaagtttgggtttttctgttgtactggatcagcccacagaacagcaaaagcaacttcctcaaccatttgtggtacataatgagcaggtgttaccggttaaaagaaagctattacaggatacaaaagatgagctttcacaaaacagtaaaagagttaaacttgagaaaaaagagtcaaatgctaatacatttacggattcattaactaagccaactcaaaatgttttggctcatgttgatgatttgcaaactactatctcatcaaaaactgatcaactaaattcgtctaatttaactcataacgacattaaccggaataatgtcgatcctgtgaaacgcaatctgcgtttgaaagctattgatgatttagtagaatctcattggcaagacccaatagaaactattccagaaactgttggagcagagaacaataacggagagcagcttgaagaattggatataaagttcttttcgactccgaatgagagttttgatattggtgacttggatgaaaatcatttggcaaataatgaacaaaagttgtctttggaattggactttgaagatgaaagtaatgttggagaaataccaattattgaaggtattgatgaggaaattggtttaactagcgatgatttggataatttattaggataa

SEQ ID NO: 2229 - DNA, 1314 bp, Candida albicans
aaacaaattctactaaactacaaaatatatatcgactatcaaagcacaacacggtttataacatttttatcttttgttttactaatttttcaaatattaactagtgttattaagtatttgtcattaaaccatacacctcctgatagtattatcctttgtgtctgtgtgtgtgctattttttcgccatttttttttccttcatcttatgagaccattccgatttctcttcctgcaaaatctcaaaaatcaaaattgacaagttcaatgttaaatgttagaccacctaagctggatatgacatcgtcttcattaaagtctgccacaaggtttttttggacaagcactatacgatcgaaaaatcggaaacaagagaatatttcactagcagcagctctcaacttattagtcaaaccaacagaacccaccaaaacatacaaaccatcattatacgattccttgactaaaggatctgtcgaggagcaattcaataaagtgcctatacatgtaccaatagcgaacgatcatgtttctgacaagttcataagtaacattttgcacggtatcaaatcgtccaatgtaagcacaaatcatcgaggagttaattattctcaactttatgagatgaaccgtgttgatttgagtgcctttatagcaaatgttgatagccaggagattttattcgacatcatggaaacttttcaaaatcataacaagttaacacctcgtgttttgacagatataatattaaaccggagatttcatgatttggacaaatcacctatcgatttgatagatttgaaacaatcaaccaatttccaggatttggatgtctacaaaattcagattgtgttgctcaagaaatatcacgatttgaaacagccgctaaatatcgttaagaatttgaagcataattttgactccatatatctccctctaatagagacacgaaaattaacacctttctatgaaagaatcatatggcatttcacttttgattatttaaaccaattcaaggaaccacattacattgagacattgagcaatcttagaacaagctttctaatatgggaaacaacgaaaaaaagaaagagtacccagataagtcaagaaatattaaattttcataccaacttgaacgatttacaaaagttatttttggaaacagcaagtagtgtagaagatccaactcatatttcatctctacggaaattatcgatgaagtacaggatatatgaattgcacccagaggatgcaaagctggagagttttaaaaaagaatttggcgatttagttttaacgctaaataagatatag

SEQ ID NO: 2230 - DNA, 2718 bp, Candida albicans
aacagaatttcaactatcaagagaaatcaaatgtgttcgaaacttaagaatttctcagaagatgtgatcaatgagttgaataacttgtctgatcaaaatcaaaaatcaccaaaatctactactaattcagagtcattaaaccaattactgaaaagtgccaaagttttagccactgaaacacctgatgtatccaaattgacacaaccaagcgatgaagaaatttccaacaatgtttccacggaggatggctcggaaaaagctactctgcctccaataaacaacactacaacagatactactgataatggaacagcaacaacaacagcagcagcagcagcagcagcagccccacaatcagatttggatcaacttccggcacctatcaaatcaaaactaaagaaatttgccaaatatgaagaaaagtaccctattttactagatgcatataaaatcgagaagaagaagaatgaaataattaggatattcgaaaaagtattacaagaaaatacaccagtcagttcatcgtcagaaggtaaactattagttgagtatttgaatggtcttaatgagaagacaaaattactcaatggtgagattagaaagttgactaaagataataataccatgaacttcaaaatagttaaattagaggaaagtaataaagaacttaacaacgacgtcaaacgattagatacgatgcaaaaggaaaaagaagtcatggggaaaaagattgattcaatgagtgaagaattggaaataatcaataatcagaatgacaaattgacaaaagaccttaaagacaaagaggaaaaaatagagagcttgaagcttgagataactgatcgtgataacaagattaaagatcttgagtctaatacatctagtaacagcaaggaattaaatacagaattggaagagcccaaagaggtgccaacagaaaaggtcaatcaagataagtcttcttctggagaagaaaacactgataaagatagtagcgtgggtgatagcagcgacaattctgatgtgttgaatactgaaatttctcaattgaaatcccaattatctaccaaagaaaccgaggttgaagaattgactaacgaagtcagaacattaaagagtcaattgaacgataagaatgaggagatagaagatttacgagacctggttaaggaaataggcaatgagctagtaacctctaaggatgaaatcaagtctctaaagaattctcaaaaatccactgacaatgaagatagtaccaccaaagaagatactaatactcaaataaatgattgggaattgaaatacaattctcagttaaaagaaaataaagaattgaaagaagaattggacgtggctacaaaagaatctaaagaaaaagaaaaagaacgcaagaaatcagaagatcaattgagaaaacagatccaaactttgaaacaaaaactcgaatcaacagaaaacaaatttgaatccaagaccaaggatttaaagaacttgctggaagagaaagaaaaattagagaagcgaatctcagaattgtcaaagttcaaaagtaatgattcatctttgaaattagaaatttcttcattgaaatcctcattaaccaataaagataattccatcaacgaactaaagactcaagtcgatgagttacaacagtctaataaatcattgaactctaaagttgaagagttgtcaaaatctaataacgagttgcagtccaattctatggattttttgaaagacaaaaatgaattgttaaccaaacaagaagtattaatggaaaatacaaagtcattaaacctgcaagttacaaaattgcaacaagagaagcaagatgtaattactgagttggaaaagacgaaaaacaaactagacattgtgattgcagataaatcacaatcggcaaacgatatgttatcttacaaaaagcaacatgaagaattgatgatgaagtctaaagagtacagtttacgaattgaaagtttggaggatgatttgactgaagccagaaatttgttacaagagagaacccgcgagacttcaaatatgagaaggttattagttgacgccgaggaaatgttgaaacaacaaaagcaggattctaagcttgaaattgctagagcattggaggataaagcagagattgaaagaaataatgcgtctttaataaagaggaaacagagagaactagatgaattaaaagaatcagttcaagagtacaaattgaaagtggaaaaattggaaaacaaagttatgactctcgaaaaagaagaaaagagcaaggaaagtttaagcaccgataaccaaacccaaatgagtaaagagctatcatcgaccattgaaacgttgagaaccgcattgaataattccaccaataaaattagagatcttgaaaattataataataaccttaagaaattgagtgaagacaacacattaagatttgaacgtttatccaaaaactataaaattttgaatcaacagtatcagtacatgaaagaacgtaaaggttctgaatcatcaacaaagcaggataaaccagttgagactgcacctgaaagcaacgataaacaagcaacaaacgtggcttatttgaagaatgttttacttgggtttttccaacacaaagaacaacgagatcaattattacctgtgttaaaaacgttatttgaattcagcaaagaagatgaagaaaagttcttaatggcattgaaatga

SEQ ID NO: 2231 - DNA, 585 bp, Candida albicans
ccggtctcaggcatgaagattgccctcgagcgcaagcaaaggttcccggagctgttcagcggctacgatctggtcgcgcaggaagatctgggccgtccgttgtcagacctggcccccgaactgatctggttccgggagcagactgagtacctgaacctgactatccccttctttttccacgccggtgagaccctgggagacgggaactcgaccgactacaatttggtggacgccattctcttcaactcccgccgcatcggccatgggttctccttgtgcaagcacccaaccctcatcgacgaggtgattgaaaaggcggtcatggtcgaagtatgccccatctccaacgaagtgttgcgattggcgacggacatcctccatcaccctctcccggcgatgattgctcatggtgtgcccaccgccataagtaatgacgacccggccattctcggacaggacattgccggcctgagctatgatttctaccaggctatccagggattcgacaacctcggtctcgcgggactggtaggtctcctgtcaaatcgccttcgtccccaggctgagctaaccaatgcaccgtaa

SEQ ID NO: 2232 - DNA, 279 bp, Candida albicans
  unsure (9),(161): Identity of nucleotide sequences at the above locations are unknown.
aaaaaaaanaaaaaaagagatggagtttcgctcgttgcccaggctggagtgcaatggagcaatttcggctcaccacaacatccgcctcccgggttcaagcgattctcctgcttcagcctcccgagtagctgggattacgggcatgcaccaccacgcccggntaattttgtatttttaggagagacagggtttctccatgttagtcaggctggtcttgaactcccgacctcaggtgatccgccttcctcggcctcccaaaatgctggattacaggcgtga

SEQ ID NO: 2233 - DNA, 2046 bp, Candida albicans
  unsure (33): Identity of nucleotide sequences at the above locations are unknown.
cactatgactgtctaccgtctcgcgaatatatngaatttcagaagataattgatagtttatcggatgtgaatgatgatgataataataataatgttgaagaaaagtatgaatggaagtttaaatcttataaacaattgatgaaattgtattttgatcaacaaaattttcaattatttcttgaaactttgacacaattgatccagttgataccaaaattcaatcatgatggtcattataaaagttatattgaggaatcattttcaaaaatgattaatcgatattctattctggcaaatgtgacttttgttactcagttttacaatacattgttgaattatctcgatagtaactccaatagtagttgtcgattgtggtttaaaattaacataaatttacttaatcttcatcttgatcatcaaatttatgatgatatacctaatctattacagaaagtttattccaagttggacattatcagcaatggaggtaataatggttgtctggaaacaacgttgaactcttttaagttacaaactattgctattgagattgattatttgacgaaaataaatcaattcaatttgaatttaccaagaatgaatcaattatatcgtatgagttcaaaaattaccactgtggtcacccacccaagaatttgtgctatcattaatcaatgtcgtggtctaatacaattttatcgaggtaattatcatcgagcaaatattgaattttataaaagtttccaaaattatgatgaagcgggatcaactatgaaatataaattattgaaatattatgcattatgttcattattgattgaaagtgaattggatccatttcaaagtcaagaaactcaaatcatttctaaatcttcgaatcaatttaataaattgaaattgttaatcaaatattataatgacttggatttggaaaagtttgaaaacttagtattctcatcattagaattagactcgtcattgccatcatctagccaagaaattgatgaagaaagtattgagaatgatgatatctataaagttgctattcaagaaatattgtacaacttgaaatcaaaagttttactaaattatatcaaagcatactcagccattaaatttgaatttctttatcgcaaattaagaatagatgaaaatcaattacgttcaattcttttacaattatcaatggccgggaaactcaaagattcacaaattgattatgtaaataaagttattttcacccagattagtatcaataatagtaagagcagcaacagcgacaacaaaagtagagcatgctttcctcagttatcacagaaagatatatattataatgtcaagtattatgaagttgtatcctttggacaatctgatgcaactaatggtagcagtgtcgttagcaatgctggtaacaatagtaatgactatagaactgatgataatatggatattgatgacaataatttcaattttcatattgtgccaactgaaaacacgaatactgattattttcgaaaatatttctttgtcattgatcgaccactcaaaatacaagattggtttataccaattgaatcatggtatttgtttttggtttcatccattcctcatacatataaacaagaaatcagtcaaaaggaacaagtcatgcatgaacaaaaacaagtggaaattgttaattcaaatggtataaccccatcagcaccaggggcaacgataacaacttcaactatgtccagagcagatattgaactatcgaattttaatactgggttattgaattctgttgtaaacatagacagtaataataattttggtaatggtgttgatgatgaacaatatgaatatgatcaatcagtccaacaattgaataaagttgatttattaaatgattggtatgctcaagctcgtgagtactataatctgttgattgataatagtgatagcaatattgacaacagcagtaataatactaaagggaaaggtggtagtaatactatcagaagtaatagtattgttgagaatgatatgactatctccatctaa

SEQ ID NO: 2234 - DNA, 1035 bp, Candida albicans
  unsure (30): Identity of nucleotide sequences at the above locations are unknown.
caaaattcttcccaacaaaaacatttaggnaaagaactcccaatttattggaaaatgggaacacccggtggtgggaaatcccggtatccaaaaaaggatattttttatcccaaggtgaatcgtaccaaaggtaacccaaaaagcaagtctcgtggtattgggagatttttagagatgttttctaatgatcgagaaatcatatctcctaaattggacaaagaaggttcaactcttcaaaatgaatccatacaagtgggttattatatttctcaagataagcatggagacgttagagcatcaccaaacaatcaccttcctgataatgaacataatgatagtgattttgaatttgataattttgattggccactggatgatgttgtaacggctagcacagtggtaacttattcacaagcacaacagcaaaaactgctgccactgcgtaatgcaaatagtcacaatgatgaaatatctactgataatgaaattaataaatcaaagaatgtgagtaatctttctaaacgagtaaacactaatgatatggctgacagtttagaaaaacttcatctttctgaaactaataataaaagacttccagaaactaatacggttgaggttgatgaattgactaaattgaaacctatcattaatgaagggaattcaggtatacacagtcaatcaccaacaaaaccattatccgaattacatgatcagattgatttaacaagatcaggatcatctcataatattattgaagctcaagaacaaaaagtggataatgaaagacaacaagatcaagatattgaacctttcacgcaagaaactgaattattaatgtttcgtttaccatcagaattacaaacaccaatttctagagatattttattgaaattgacaaaacgaaagaatccaaataacgagaaaagtaatgataatggcgatgttgaggtgggtgatgagatacgtgttgttgatactgtgattaatcgagcttctggtgtatcaacatcacccaaacgaagtgcactcggttaa

SEQ ID NO: 2235 - DNA, 648 bp, Candida albicans
acgttgattatcacccgggggggcgatagtgaatatgtgaaactgggtgtgattgatggtatttctttatctgaagttggtaaagaatccattcaggctgctttgaaagtatttccaatatcatgtgttgaattagaattgtcattgttttcacaagaagttattaccactggtatattggaagaattgtcaaagcacaacttgccactcattgcttattcaccattgtgtcgtggtcttttaacagattatgcagttgagaattcagatacatttttggcatcaatcccacaaggtgatattagacatcatttggacaaatttcaaccagacacttttaacaaaaacttgcccgctttaaaggaattatacaagtttgctcatgaagttaaaaacacaactttggaatctttggcattatcatggattgttacagtttcggaagcaagaaatttccgaggcattgaaaaagtgaccagaattttaccaattccttctggatcaactaaaaagagagttgagtcaaattttggaagtttaatagagttgactgatgatgatttacaatcaatcgatgaaatttttgccaaatatccaattagtgggttgagatacaatcaatttctcgaaggaactcttttccaatag

SEQ ID NO: 2236 - DNA, 558 bp, Candida albicans
ccgttacaaatggagatttcaaagatcacgtcaccagaagattgggaatattttgctaaaggagctgccaatattttgttcaagtatactggtaataacgattatttgaagcgcaaattattaagattaagattactcaaacaagaagaagaatacatatccacatgcgaattatatgactttatcgaattaagatgtaaagatttatttcctaatcaaattattgatattcaattaactgttttggattcaaatttcactaacaagttgaatagtcaaggaaataagttgatgttgaatgaaagatatgggttattgttacctaacatattggatggcgactatagaaagatttcattactgcaaaaatgtcaactatattttaatgacaacgatcaagacatcaattcagtgatttttgaaatcaagccaaaatggttatacgataattacaccgataattactgtcgaacttgttctctaaaccaattgaagaaagtccaagacatttttgccccttggatttattatataccgagactattgaacaaggtttaa

SEQ ID NO: 2237 - DNA, 1200 bp, Candida albicans
atttctatggggcaaacaaggttcatctccccaaatttcattgatcaatttaaagtagatgatggggtttgtgattatgatgtttgttgggatggatctgatgaacaaggtatttgggaagataaatgtgaattcattcttggtcaatatgaacaatacaaaacccaacttgaaagtttcatcaatgatgcattgaaaaagaaacagtcgttaatcgaattagctcaaggaaaaagaaaacaattagtgaatgaattacggaaattggaagctgtattacccctgaagaaatcacatttgtatgaattggaagtccaattagagaatagcaacgagcaagaaacttcagtgtttgatgtcttaggagaccatattagtgatcttgctacaaaattagaagcacataaaagggatttattaaaacaagaaagtagaattcaatctttagaaaaacttttagcgaaattatctcaggaatataatccaaatttcaatgatccagcagtcaaagaatctattcacaaatatcaggagtatctttcgaataaagacgaggacgttgtggaggacatcaaagaaaccaatgctatacttctggagttatcagaaaaagccaaaagtttagtcggtaacactgatagcacacctttacaacctacaattagaaacatgcttcatcattattttcagcttttcacaaacacgtttttgacaaaacctcaactacaagtcaaaacaactttgtccaatgaccaattaataaatctgattgacaaacaaaagcaagaaatcagcaagattgaatccaaaattgatgatattaagaaaaatttaagtaacgactatgggtcggacgacattttaagagcatttgatctgactacaattaacaaaaaattgggaggttacacctacagaattaatcttttacactctgtggcccaggatgacgtattgattggaaattacaaaaaatacgagaatggaaagatttactttgacagaggagccaagtgttggaatggtccgcaaagatcagcaataattgaatttgaatgtgggaagggaccagacttggtttcagttagtgaaccagaaaagtgtagctacaagtttattatcaaaggagaagcatggtgccatccaatcactgaacaagaaatacaaaatagatttagaataaattatgatttactatag

SEQ ID NO: 2238 - DNA, 519 bp, Candida albicans
tcaaaagtaccagtaatagtgataacatcatcaaacacaaatccttgttcgttaacttcacttggaacagctttcttttcggtagtaccaatggcaaggatggcagattgtggtgggttgataatagatgtgaaagcagtaacagcatggttcatacccaagttggaaatacagatggtaccaccttggaattcttctggaagtaatttaccaaccttggctctcttacccaaatctttgacttggttagaaatttcagccaatcctttagattcagcattagtgacaattggagtgatcaatccagttggggtggcaacagcgacagaaacatcaacattcttgtattgtctgataacaccttgttcacctaaccaagcagcatttacttctggaattctgacacaggtcttagcaatagccttgattaataaatcgttgatagacaacttgtatctttcttcagcagtggcattcaatgaagcacgtaatttcaataatttagacacggaaatttga

SEQ ID NO: 2239 - DNA, 198 bp, Candida albicans
accaatacttcatccacaatgcatttgatgtacaccttagatgccgaaggcaaaagaatctacactttgaaaaagatatcagaagatggagaaatcaccaaatctgctcacccagctagattctccccagatgacaaatactccagacaaagagtgaccttgaaaaagaggttcggattgttaccaacccaaaactaa

SEQ ID NO: 2240 - DNA, 372 bp, Candida albicans
gaatactcaccacttcgtataataggagataaaccctttgatagctctagactaggctcgaatagattatggcactcatctcagctaggaaacagttttggtggcatcaatcagataatcagtgagaatactctactacattcgcgcgattttaaatggtctaataaaaaaccaacgaaagaaaaaaaattcaatcacatcccaaacaacacttacatcgttttgtttctgatgcaaaaaaataacaacacatataaacacatgctctcagcaggattcgaacctacgatctcctcattactagtgaggtgccttaccaacttggccataagagctttacatgttgacacaaaaggtgctgaatttttttaa

SEQ ID NO: 2241 - DNA, 402 bp, Candida albicans
gaatactcaccactttgtataataggagataaaccctttgatagctctagactaggctcgaatagattatggcactcatctcagctaggaaacagttttggcggcatcaatcagataatcagtgagaatactctactacattcgcgcgattttaaatggtctaataaaaaaccaacgaaagaaaaaaaattcaatcacatcccaaacaacacttacatcgttttgtttctgatgcaaaaaaataacaaaacatataaacacatgctctcagcaggattcgaacctacgatctcctcattactagtgaggtgccttaccaacttggccataagagctgaagaaatatgcaaatgttgtaattgctctcagcaggattcgaacctacgatctcctcattactag

SEQ ID NO: 2242 - DNA, 636 bp, Candida albicans
aagataaagctgaacgtcagttatgtgaacttactttatatgaagcttatattaaacaacacattgccaaaggtattgtcattggtcaaggtgaaactgaatctggatttgaaactgtatcgatatggtcacaccctaaatcggaagaaggagggattagattcgtacacaaatttaatggaggctggatacggtaaagtttggaatgtttatggtgaagaaggaaggaaagaagtgttttacggaatgttaccacttttacatgatctgtgtgaacgaattattaacagtgattctcgattcaaaaataaaaacgtctatacattggtttatgttggctcttctaaacaaggtaaaggtaaagggaatttaaggaaattatttgaatatatgtttgaaacatatattgataatgatgaaaacagtatcgcatatttggagagtagttccccagcaaatatcccaatttataacagatttggtttccatgttactgaagatatagttttaggagaaaaatgtgaaggtgctattagaggtagagattatgctgtgatgaatgttatgatccgaggtactaaaggacatgattggacaaaagatgaaaacacttttaattctaaagggaaattataa

SEQ ID NO: 2243 - DNA, 1386 bp, Candida albicans
gggagatctttcttggttgaattggtaataaaaagcattggacagaacaagaaaaaagaacagagccaactcttatcactttatctcttgccgcggttaaacaatgcgtggagatataaatcaaagcaaattattgccgtgttgcacattataggggccagctttgtgtgcttactatttgttatcaacacatatctccattctaagtttacaagtataaattcttaccgtaaatcccccctaggtaaccaaccattaacacaacaaaaactaaacaaaatcaatcttattagaatcatgttgttgtgtcataccaaagccattccagagctggaagttattgttcctgttccaagttcaaacagttctttaggttcgaaaaaagctcgatcaaatagtttagagtcagttgcatctaatcctaaacgtactcgtgctctaatttatgaaaatacagataaacccaaattagtttcttcagtttcaattagatccagtttttccattcctaatcaattggatatttctattgatgttgcaactttgaaagattatagacgtgttgcaaaaacattattgatggcatttgaagatgatccatttactaatttcatccttaatacaacaaaatacaccaaatcaaatacttcagaaagtacttataagaaaaagaaattagatttgatgttatcgtattttgaatacactgcttatgattgtttgtctactgaaggtactgtgtttgtcatcaaggacaataattttgaaaaatcattgtctgattttgatatcaagaacttagataaatttccatttttaggtgttgctttatggaatcaaatatatggagccaaaattagtgattcgagttcagggtcagactccgattacgacgatgaagattattttgcacctgaatcaaattccatcttcaataaatccgtggtgaaatttaatctaaaagctgttaaaggtcgttgtcgtttcaaagttttcaaagataaattgccatatttaataaaagttcgtaatgaaatattaataaaagagttgttatgtcgtgaagatgacgatcatcatttcccgtgtgatttggatatttggtaccttggtgatattgcaactttaccatccatgagaggtaaaggtttgggtcgaattttaatggaatatgccaaaacccaattcttacaggataatcctaaaagttatatgtatttagaaagttccaatcctgtgaatcgaaagttctatctaaaaatgggttatactttaatgaaaagttattcaattagagataataagtatgttgacctggaaaagatattacatctggatcccaaaaacaaagctgtgaatatggatgcattaatgtatttcccatga

SEQ ID NO: 2244 - DNA, 1176 bp, Candida albicans
  unsure (19): Identity of nucleotide sequences at the above locations are unknown.
atgcaagtcggatcgccancgcgtggtgaagacttgagacttgaagaagaaaccaaggaacttggtttatggaacatgtttttgtcaaagcattataaggaaggtccacaatatacaaacttagagtatggattgatggccagatacttgggtcgttcatacacagcaccagaggctaccaacacagctgctccagataccggtaatatggaattgtttgccaaatatggaaccacttatcagaaagatagatacttgaaacccttgttaaatggggaaattagatcagcattcttgatgacagaaaaaggtgtttcatcatctaatgctctcaatatttctacaagtgctgtcaagaattcgaatggaaattacgtgctcaatggtgtcaaatggtttgcttcaggtgcaggagatccaagatgttccgtctggttggtgatgtgcaagacagacaacaacaagcaaaatccatatcaaaaccacacagttttgatcatcgatgccaaaaaggctttggctactggaaaagccaaattgatcagaccattgcaggtcattggttttgatgatgctcctcatggacattgtgagattcaatttcaagattacgaagttcctgccgatgaaatgcctaatgttgttatggctggtgttggtagaggatttgagttgattcaatccagattgggtccaggtagaatccaccattgtatgagagctattggtgctggtgaatttgcattattgagaattgctcacagagcaaatcacagattgatttttggtaaacctatgaaccagagggaaggattcttatccagatacggacaaagcaaaatcgacattgaaagatgtttattgttggtgttgaatgctgctcacaaaattgatatttccaatgccaaagaagcacaaaaggaaattgctatggctaagattgagaccccgagaactatctctgatattctcgattggggtattcaagtttatggtgctgagggtatgtcacaagataccgagttggccagaatgtatgctcatcacagaacattgagaatagctgatggacctgatgaagctcatttggcccaattggctagaaatgaagctaaaaagtttgcaaaagttgacgactttttcgccaacatggaaactcaacgtagcaaattataa

SEQ ID NO: 2245 - DNA, 1269 bp, Candida albicans
gtgtttcaatggttaaagtcaattattccagaggcgtttgaacaaaaaccagaatccaatactgagatatttaaagagcttttgccatatgtaattatacacgttgcacaagcaatgagggaaagacaggatgaatacgtacaaacaaagtttcatacccttattctgagtttaaacaatatgcttgttaaatttctaatagatcgtgatttaccttcttcaatcgattcgattcaacagcctgagaatattccagattctgtgattcatcattctcaagaaatcttgaaaactggaggtgttgattttattgacaaagcttttaaagagttggacaaattaaaacttgagtgtaatcatttgttgcaagagtgtgaaacacgaattgatttggataggagtgaagatgacatgcttagaagaaaacaaggttcaacaagatggactcgtaaatctactgatgatgcagcacaagagttaattaagaaagtagataaaatgaaacaatatttgttacaggctaacaacggagatggttttgttttgaaaaagttttacgacatcaaaccagccttggatgtctattctagtggatacaaagctttatcacaatatattccaaattctcaatatattgaattaccggaacagttactgatagtgatcagtgatttaagaagctgtttagcccgagcaaatacacttgaatctgaaagaaaagagtttttacaaacattggaaatcaggagtcgagacaacagcatattacctaaactaattacggagtataactcaaatcgttccaagtatcaaactgaaaacggagaatttaatttcaatgcgtttgaaagtgtctacgagaaacatatgaaactatttgattctgatattaagtatattgcaagaaccagagactcgcagatgacattagaacatgaaatcgattcaattaatcaaaaatttgtacaagaatttaaatcgttacaaaattcttctaatgaaaaacgtcaacaagtacttcagtatttggaaacagcatatgagaaatttttggaaatcattaacaacttaactgaaggatctaagttttatactgatttcattgaaaaaggaagtgcagttttgcaagaatgtgaggaatatttgtatagacgaagagttgagagtcgagacttagaattagctattactaactcgtgccaacaacaacaacaagtgcaagaacaaaatgaacaattaagtgttcccagaaactatagtaacgaatag

SEQ ID NO: 2246 - DNA, 1086 bp, Candida albicans
accaatccaatgaatacaaacttattatttataccattaaaacaatccagtgtattggatttaggtgatgaattgagacaagttatcaccaataactacttccaaccggcgtcatctttcaattccgatttgatttacataactcaattgcgcaatcaagttgcccagatcaagaatgtcaatgatgaactcgggaaaaccagtcaagatgattcaattttactagaatatttacaagttttaaatactttacagaataagttttctgatgattgtgttgaatttgcttggtttgacactttggcttatggtcctcaaggaccttatcgatatcgttcattaaagattgagaaacttaatgtcatttatcaaattggatccttatattctcaaatagccatttctgaactgagacatactgatataggacttaaaagagcatgtcattatttccaattatcagctgggtgttttatgtttattaataattttttaattgagacaataaaaaataaaaatgatcccttggtgttactgattcccctaagtatgcaactgtctactattcaatgcctagaatacttgatgttagcacaggcacaagaaactatttggcaaaaagctattaataacaactctatgaaagattctgttgttgcaagattatcgatccaaacatctgaatattactccaaagccttagatttcggtaattcatcagacctcattaaattggaatggataaatcatatgaaggtgaagaaattacattttttggcagcagcccatttaagatcaagtactattgcagctgactcatttcaatatggagaacaagtagcccatttacgcgtggcatcccaggctgttgatcaagcattgaaaagtaaaaagtatgttaatagtctagtattagaagacttgcagggtttagcagatgtcataaaagttagactaaggacagctgaaaaagataatgatttggtgtatttaaaaatcgtgcctcaagagaaggaattgaaaactattattggtgtttcgaatggtaaagtcaattattccttcttcagcacggactggaaggac

SEQ ID NO: 2247 - DNA, 297 bp, Candida albicans
ttatttagtactagtcataaggatataggtatattataccttatctatggtatggttagtgctatggtagctacaggtatgtcagttataattagattagaattatctggacctggtccaatgttcctacacggtaataaccaagtatttaacgtgttagtaactggacatgctatagctatgatcttcttattcgtaatgcctatccttatcggtagttttggtaattacttcttacctataatgataggtgcagtagatatggcctttgctcgtctgaataacatcagtttctga

SEQ ID NO: 2248 - DNA, 972 bp, Candida albicans
gaaaaacaactaaatccagtcttggcaaaggttattgagaaaactcaaacaggcttccttaaagaaagatccattagtaatagcatatacctcctcgatatggttcttacaagatatcagacttctaaaactgcagatgcagaatcagcagggtttattaatcttgacttcagaaaagcttttgattcagtacatcatgattttatattgaaagttttacaacaagtaggattcgggcctaaggcgacgaatttcttgatggcaataactgcaaagcaaaaagcaaaagtcagtattaataatattgaaggcccatgcttcccacttaaacgtggggttagacaaggcaatcctatttcacctttaatctttattttaatcttagagacctttctcgctagattgagtaaggaaattgagggaataggagtggtgaatgaagtttcgctggttgcatacactgcatatgcagatgatgtgatcatctttttcaagaacaagaatgatcaagaaagaattcaacaacttttagaagactttggaagggaatcaggcctttatcttaacaataataaaacagaggtttgttatttcaatgacattccggagatttcctttttaccatatgtttcaaagaagctacaattagaaaaattaacatatctaggagtaccgatgaaaaaagcagatgaagagttcgatccttggacactgtttgttctaaacctcaacgctcaaattcgaatgacaccgatactggatcttccatatcagttgattatgaaattgatgaatatctttattttttctaaattatactatagagatttacattcaccgattctgacgacagcagtgtcgagtattataacaacagttcaacaaagacttccattatacttcaagcttcagagattgcaaacccctaaccatttgggtcttcaccacgggcgtggcaggtccgccattgaa

SEQ ID NO: 2249 - DNA, 702 bp, Candida albicans
ttgctgttccttgattttgaattgaattttttttttatttttcatttcattctttctacaatttattttaatttatcaatctacttaaacaaacaaaacaacttaattacttataatatgtccgcaagatcaatagctaaaatcgttactgctagacaacaagctgaaggtgttggtgctagagtaagaagatcaattggtgttattaatcaaaaatcattcaacccatttttaatgtttgatcatttttccagctctggtactaatgggttccctgaacatccacatagaggtcaagaaaccattactttggtattacacggagctatggcccatgaagatttcactggatcaaagggtatcttgtatgctggtgatttacaattcatgactgctggtaaaggtattgtccattcagaaatgccagttgccaatgaggatggatctccaactgtcggattacaattgtgggttgatttaccagatgcattgaaggatactgaaccaagatatagagatttgagagaatgggagatcccacaagtagtcactgatgatggtaaagtcaccatcaaggttatttcgggaagatcacatggtattgaatcaatcaaagaaatggcttatactccaatcaactattactattataaagttaaagctggaggtaaatttcaacaaagaattaccaccaggatttaa

SEQ ID NO: 2250 - DNA, 252 bp, Candida albicans
agcacattggttggtggcaaaaaattggatcaaaaagtcgttcattacggaccatttgttgctgattgtgaagaaaatattgaacatgctataatagattatcaatatgctcaaaatggatttgaaaatagaaaaacatggaaaactttgattagtgacggggtgacaaaagatatgattgaaggtccattggatggtaatcttgataaaagagaagcaaccaagaaatcatatttggaatccaaacaataa

SEQ ID NO: 2251 - DNA, 588 bp, Candida albicans
ataagattcaattatcccaagtttttgaaaatcgaattcttttttttctctttacttcatcaagtttattatattattaaacaaaaaaccaatcaacaattacaaatgtcagtaagatcaattgctaaagtcgttaccccaaatccaccaagaccaggatctccagtgaaaatcagaaactcaattggatcatcaaatcaatttaatccatttttattatttgatcatttcacaattccatcaactggtggtttcccagctcatccccatcgtggccaagaaacaattaccttagtgttaaaaggtggtgttgctcatgaagatttcactggttcaaaaggtgttttatatccaggtgatctacaatttatgactgctggtaaaggtgttgttcattcggaaatgccagtacctaatgaagatggttcacctagtgttggtttacaattatgggttgatttacctaatgatatgaaagatgtgaaaccaagatatatagatttgagagaatgggagattccacaggtggttgcagacgatggaaaagttattgtcaaagttatttctggaaaatcacatggtgtatag

SEQ ID NO: 2252 - DNA, 804 bp, Candida albicans
ctatatagactgtatccacaaataatgtcacttagatccatagctaaaatcgtcacttcaaaacaaaaaactgaaggttcaggagcaattgtacatcgatcaatgggtatttatggacaacggaaatataatccattcttattatttgaccattttataggtgcaaacaaccatggatttccagcccatcctcatcaagggcacgaaacaatcacttatgttttaaatggagcagttgctcatgaagattttactggggccaagggaatgctttataaaggggatttgcaatttatgactgctggtaaagggataatgcattctgaaatgccagtatcaaaagacgacgagtcacccaccgtgggactacaattatgggttgatttacctgaagataaacgaaatatagaacctaattatcgagatttaagagaatgggaaatacctgaagttatcgttgatgatggtaaagttacagttaaagttatttctggtaaaagtcatggaatagaatcaatcaaacaattggcatacattcccattgattacttccactacaagataaaacctggaggtcaattcaaacaagaattgagatctgattttaattattttttgtatgtgatcagaggaactacacttgaattaaatgacaatacaacagctgaacaatatcaaaatgtatattttgaagaaactggagattttgttattggtaaaaatgtcagtacaaagcctgacgaggaagtagagtttgccataattggtggtcttcaaaacgccgtggcaggacaattgttatga

SEQ ID NO: 2253 - DNA, 1146 bp, Candida albicans
atggttatttccccattgattctgaaaattcaatttttgattttattcattctattttatccattaagagttttatcaattaataataccaacaaagaaagttcagatatgtctactagatcaattgcaaagatagttaccgctaacgaacaagccgaaggtgctggtgctagagtcagaagatcaattgggatcatgaatcaaagaaattttgatccattcttaatgtttgatcatttttccagtgctggtactaatgggttcccagaacatccacatagaggtcaagaaactatcacattagtattgaatggtgctatggctcatgaagatttcactggatcaaagggtattttgtatgctggtgacttacaattcatgactgctggtaaaggtgttgtgcattctgagatgccagttgccaatgctgacggttctccaactgttgggttgcaattgtgggtcgatttgccaaataatatgaaaggtgtcaaaccaagatacagagatttaagagaatgggaaatcccagaagttgttacagatgacggtaaagttactatcaaggtcatatctggtagatcacacggagttgaatcagtcaaagaattggcttacacccctatcaattactattactacaaggtcaaagctggtggtgaatttaaacaagaattacaaccaggattcaactatttcttgtatgtgttgaacggaagaaatcttgtgttgaatgaagacaccaaagttgacagataccaaaacgtctttttcggcgacaaaggtgatttcatcactggtaagaatgctgctacaaaagataataacgaaaccgaagtacaattcatattagttggaggtaagaaattagaacaagaagttgtccaatatggtccatttgttgccagttcaagagataatatccaaaaggctttccaagattatcaatatggaagaaacggatttgaaaacattaaaacttggcaaacattgatcagtggtggtgttaccaaagaaatgattgaaggaccattgaatggtaatcttgaaaaaagagctgctaagaaaaaggcattcttggaaaagcaacaaaagaaagctgcccctgttgctgctcaacctgaacttgtaaaagacgagctttag

SEQ ID NO: 2254 - DNA, 1587 bp, Candida albicans
atattcaaagagaaagaatgctttctattgatacattacctactcctttctcttccattacaaaaagaagaacaaccaaaggtagaagaagaaaagtttgatactattactactaccccagttgttgctgcttcaccagttattggatttgataattctaaaccaaaacaaattttggataaatttaattcaattgaaattgatttaaattcaaataataaatataaaggttttagaagatcagtcgatgttgctaaagcaccaattcatgttccaattccacaatcaccttcattccaaaagactcattctaatatgtcttcaagtttgaaaaacattttggcttcaactgatgatgataataataataacaacaacaataacaataccaataactttgattctggttttcaaacaccaagaagattatcatttgatccaagaagaaaaaattcttctaatccaaccacaccaaaactatcaagttcaagttcatgttcaactttttctaaaactgaaactaccaccacaccatttgaatcaccaagattatctgctgttgctaatggaaaatttgtttcacaacaacaacaaaaagatcaaggtttagaagatgttgaaactgataatgaagaattttctactcctagagcaagtagaagaggatcattttctgaaagttatccggttggttcattattacacaagcttaagaaattccaagatccagaagaacaacaagaacatcaagaagaaacaactgaagatgctatatctaataaatcagaagattctattgatgctgccccatttgatccaagaatgagaagaagaagaaataaagaattaaatcataaattgattccatctcctgaatctagtgaagttgatgaacaagaggaagaagaaatgcttatgaataaattatctccagctactgaaaccacccataaggactcgaaacaatctgtcccggaaagatcattatctagaggtggattaactggtggtacttttgattatcaatcatttggattgaaaggattagcaccaattgttgaagatgatgatgcttcatctaaatatgaatctgatggtgaatcctctaataatagtcccgttaaagctgttaagaataaattgacaactactaaatcaagtggtcaaggttcaactgaagatggtgaaactaattcaagaacttcatcattatcattgaataattccgattataaatcatctatatcatctggtactgctgatgctgatcattatgctatcaaaggtgctggtgttcgttctcattcaagaaatttgtcaactgctagtagtggaaatgattttgattttactgcaccagtttcaaaatcaagattcagaaatgccccacagcaacaaagttcattgtattctcttggtagaggtccatcagcttcaacttcttcaattaattccactagtcgagcatcattgggttttatgagatcatcatttgtgttgaaaaaggaaatgcaaactcaaggttataatgaaccagaaaatgtttgtatgtctatgccagttacaccaagaatgagtaataaacct

SEQ ID NO: 2255 - DNA, 2334 bp, Candida albicans
atatcgcgtaccaactcaagagcaaactcgttgaactcagggacaaattatcggtttggatttttgacacgcgctgcacacatcaatttgtccaagatagatgaagacttgcagaattttgaatacgactatcaagtcgataacccagcattagataacccagaaacgaagttgatgttgaatttacctgataattcggaacaacaagcaccaaaggaattgggatcaccatttttagcatcggatcaccctattactgcagtgagatcagactcactcaacagtcaaggtcagccaaaaccattgagatcaattttgaaaaactcccaagtaccaattattgtcgagaaaccagcctcaccctcaaaactgccactggtggcagcagcagcggcagcttctgttacgagctcaccgcgaggtgatatacggcaacaagttgttgaatcagatgacagtttcaaaagtccgatctcaagggctccaattagtccagtatctttacagtcaccaaacaaatcaaggttttctcgcgtgcccggatcacctaatcaacgaattggaggatcacctccaagttccattagatttaatgaaaaggttcaaactattccagtatataatgaagacagtgatactagagttcgtgctcagcgtgtaaaagtttctacgccatctgctccagctaaaacaaaacaacaaactgatgccgatttgtatgctgcagcaatgaaagctgccatgaagaaagtttacggtgacagggatccgaaccaacaagcagctgcacaagagtctgttccaacctcaaaagtcgcacctgaagaacctaagaaaatgaaacttggttttattgcattgagccctcgtgataagagtcaccatgaaagaaaatcttcattcaattcagaaactgaaaatgttgcaaaaacaagcgaggagagtgccgactctgatgctacacctgcaaaggcgattaaaggatcactggcacaagaagttcctccagactatgaatatgttaaccaccatcgtgaatttgttactcattctttaagaggagacaataaaggctcaactcgaaaagaccgtgtcaaagaggaaaaacggaaagctaaagaagctactaaggagcaagcacaagaagaaaagagaaaggcaaaagagcaagctgaagaagaaaagataagagcaaaagaagctgcaattgaagaagaaaggttagctaaggaaaaagcagctgaggataaaagagttgccaaagaacaagcggatgaagaaaaacgcaaagctaaggagttgaagaaggagaaaaagaagtttggatttttcagcagtataaaacgaagaacaagtacagcatctgcatattcatctggaagtggatcaatcgttcgtggtacaaacagggggcagcatgacgaagaccatgctttgtctgatgatatttcaactactgaggcatactcttctcacgtgaacgattctagcttgaacccagttttgaattcggtcacatcagtatctgatgatttgacagaagtccaacctccgaagattgagaaacgaccagaaatctcgaagaaagaagatatcccttcaaacacggaaaaattgaacaaacttgcagaaaccaaagaagtggagcttgaaaaacttcttgaagatgaccttgcacctgaagctgatgtcacacagaaagatactgctgacgtacttgttgagaaaccggataatacagaagacaattttggtagtgttgtcattgatgatgaattgtaccaagtgtcgattccaagaaatgcacgtttttctgatggccatgaaatggaaccaagtgaaggaatgtacttgactgaaaaatctcataatgaagcttatccactgcctaatattgtgggtagttctccagttattaatacaagcagtaacgacaaattaccgctgccaatagacgaacaacatacagaagatgcaaatgaggttttccatagtcctgaaactccaagcgaggtcaaagctgacattcctgtacccgagcttggttctataattgatgaagaggatgaatttgaagatgttatagttcctgaagataaggagtcagtgtatgaaaattccgaaccagaagtcattgacgaagaggcgcctcatctcgaatctgtggaaacggatcgttctccagcgcatattgattctgatccaaacgtggaaaacagttatagcaaacaagtttctgagccaattaataataccccaactgtggaagcaagtccaggagctgattacgaactagcacttatgaatcaacaaacagataccgagagagaacaa

SEQ ID NO: 2256 - DNA, 711 bp, Candida albicans
ctgtttagtcttaatcgcaagtctgccatacaagaaattgagcatcagtttgattcaactattattccatacaaatccaccatcaatgaatggataaactgcagtccaaaccaattgatcagcagcattattgagaaaggtgctaatggacaaactgtttatgaaatttatcatagttttacaacaaagttagctggactagaatgcaaacagagtcagaaagaacgagtccacaacaaattcgttgaggattcaatttatgtcttgattaccaaccgttactttctagcaattgcaaatgggtttattaacgatccaattgatattccaatggtgaccactcctcaagatgttggtgtgattatgaccccaactgagattgccgagattttaagactagacaaaattgattaccaagcatacttgttggcattgcttcgtttggtcgatactattgttgagtacacaactaccacagtaataaatgaatcggttgcttctactggatctaagtcatcaaactactcgattgctataatcaatctgaagatcgtgtccaaactccagaatggattccaattattggacttgaaaaacgatgttttacgaaaaagatacgacagtttaaaatacaactctcaaagactaaataaaattgtatacgatttatcccttagaaacttaattactaccaagggtgaagtcaattga

SEQ ID NO: 2257 - DNA, 2883 bp, Candida albicans
aaattttcaaaccaagacaaaccaaaccaaatcaaaaaaaatatgaaattattatcaaaattcattgttactgctttgggtcttacttcaattgtcaatgccgctccaacaagtagtagtagtgcagaagaagcccaaaaaactgttcctgttgaacttagtatcggtgtcaaacaacttcctaacattcacaatgattcagctgtcgatgctaatgctgttgctaaaggttattctttggtaaatgtttctttaactgctagaggtttaactggtattttgaaacttaaagaagctacaaacatttatggttacgactttgaatacttgaatttgtcagttgaataccaaagtgatacaagattaaatgttcatatagaacctactgatttgactgatgtttttgttttgccagaagaacttgttgttaaaccaaaacttgaaggtgatgctaaaacttttaattttgaaaactccgacttggtttttgaatatgatgaagaagattttggatttgaagttttaagaagctctactcgtgaagtattgttctccactaaaggtaatccattggttttctccaatcaattcattcaattcaatactactttaccaaaaggtcactcaattactggattaggcgaatccattcatggatctttgaatgaaccaggtgttgtcaaaacattgtatgccaatgatattgctgatccaattgacggtaacatttatggtgttcatccagtgtactatgatcaaagatatgatacaaacacaacacatggtgtttattggagaacttcagctattcaagaagttgtcgttggtgagacttctctcacatggcgtgctctttctggtgtaattgatctttatttcttcagtggtccagatccaaaagatgttatccaacaatatgtttctgaaattggtttacctgctatgcaaccatactgggcattgggttaccatcaatgtagatggggttacgacactgttgaatcacttgaaactgttgttgaaaatttcaaaaagtttgatattccattggaaaccatttggtcagatattgattacatggatggatacaaagatttcactaatgatccatacagattcccaacagataaatttagaaaatttttagatgatcttcacaataacagtcaacattatgttcctatatttgatgctgcaatttatgttcctaacccaaacaatgccaccgatgatgattatgaaccattccacttgggtaatgaatcagacgtgttcttgaaaaatccagatggatcattatatattggtgcagtatggccaggatacactgtattcccagactttttagccaacaatactcaagaatattggaacaaaatgtttaaagattggtatgagagaattccatttgatggtatttggacagatatgaatgaagtcagttccttctgtgttggttcatgtggtactgatagatatttcgataacccagttcatccaccatttgaagttggatattctggttctgattatccattaggttttgataaatcaaatgcatctgaatggaaatcaatttctgaagcagcagcagctactaaaacaaccaccacaacatcatcttcagcttcgacatcaattgatggcaagaacactttagctccaggtaaaggtaatatcaattatccaccatatgcaattaacaatgaccaaggtgatcatgatcttgccacacacgcaatttctccaaatgctactcatgccgatgggactgttgaatacaatatacattatatatatggtctcattcaagaacgtgccatttacgaagcattattggaaattcatcctaacaagagaccatttattattggacgttcatcatttgctggatctggtaaatacatgggtcattggggaagtgataactatgctgactattatatgatgtacttttctattcctcaagctttatcaatgggtctttctggtatcccattctttggtgtggatgcatgtgggttcaatggtaacactgatatggagttatgttctagatggatgcaattggcttcattcttcccattctacagaaaccacaatgttttgggtgctattccacaagagccatatgtttgggaagctgttatgaaagcaaccaagacatccattaatgtcagatactctttgttgccatactattacactttgttacacgaatcacatgttactggtatcccaattatgcgtgcattcaactggcaattcccttacagcaaagaattggccggcgttgatactcaatttttcgttggtgatgcattattggttacaccagttttagaaccaggtgtcaaccatactaaaggtattttcccaggtgagaatgctgtgtactatgatttctacactcataagaaacaaaaattcactgctggcaagaacgaaactttggctgctcctttgggtcacattccattacacattaaaggtggtaacatcattccaactcaagaaccaggttacactaccactgagtcaagaaaaaacccatttggattgttggttgccttggatgctgaaggtactgcttctggtaaattgtatctcgatgatggtgaatccgtagatgttgaagaagcattatatgttgactttgttgcatccaagaataaattggtggcatctgttttcggtgaatatgaagttcgtcaaccattggccaatgttacaattttgggagttgattctgaacctaagaaggttttgtttaacaacgaaacagtaagccacaactacgaaaatggtgctgtgtatcttactgatttagaaaaattcaccaaagaaggtgcctttgctgaagaatttagtattcaatggtaa

SEQ ID NO: 2258 - DNA, 1476 bp, Candida albicans
tacaacatggctattacaaacttgctagaaagccaggatgcacattcagaagctagcttacatgcggtttcaaaaacaaaaattttatttatagtaatattatttattgtatcattaacactgtttgtttttcaaactgaattcacatcacaagcatacaagttgaaatttctggaaccggtagtgttactagctgtcactcatggttcctggtggctcttatggcccattcaaattatttttgtgtcactttggagaacgacactgaagatgaagaaaacagataaagaggcaactataagcaatagtgttggatcaggtattcaatatcaacgtttaaactctaactcaggattgttggaaaatgaaggtgactcaactcaacaacaaaaccaattgcaggttcccttgcaccagatcaactactttacctactttaaaaaatgcatagtcaaacaatttcataacgtttatcacacgtcgattttgatctaccagtcaaatgtcaaaggagatagatcaacgacttacttgaatcaactcattgacgagaatccgcacatttccaattctagttccattcgtgaatgtattaaaacatttattgctactccttccattagatatgtcattatcaaagcatttatcattacagtggtattgacccttgctgggtttacgtggtacggtgcaatgtctatgacatatccttcagatgttacggctatttacaattgttccgcattcacagcgtatgcgtttgctataccattattaaatgagaaattttcatggttaaaggcaagttctgtcatcatagctctttctggggtgtttattgttgcatattccggagatgatagcaaagatcaaccaaaagaagaaaacccttatcccttacgattctggggaaatttacttatattaacaggagcggtactttatggttattatgaggttttatataagaaatacctttgcataccagaacatttatcgaaaatcactacaccaagacgtcaactgacatttgcaaattttgtcatggggttctttgggatatatactttgaccattctcgttacaattttaatctttgcagaggtattccacattcatcattttaatttattcgactatggcgacaacactaccaccatttggctatacatttctggatccatagtgagcaatttattatttagtgcgtcatttttatctttgatggcattgacaagtccagttttgtcatctgttagttctttattgactatctttttgattgggttggtggaatggtgggttttcggaaacaagttggggttccaacaattagtgggagacttgcttgtgattgtaggatttgttatgttaacaatagcatcatggaaggaaatcagtgaaggtaatgaggatgatgaagtggatgcggttagtacttactcatttgcattaagtacagaagagaaccgataa

SEQ ID NO: 2259 - DNA, 876 bp, Candida albicans
cgcggatttccacccgtggtgaagacaccaccaccatccctgattttgtttttaacttctgaaggttcatattccgtgaatgttcaacatagtgcaccacttttaagaaatggtatcccagaatcataccttgccaataataatttcgatgtttcattaaatgttttacaacaattacataaattgaagaaaaatcataaaccagatacagcaaaagttattaatgattatttattacatatccccaaggaaagttttaaatatgatcccgattcaattatatttgattacactaaacgtttagataaaggagaaaaattgactatcaaagaactaaaatatttacaaagtttagaatattctaaagataaagtagctcatggaggtccaccaaaatattttgctgaatcaagattaattggtaccactgtgggagatcattatgattggagatttttcaatggtgttcaatttggaactgtagatcaatcattaaccttgcatcgattaattcgtacttggttatcattcactagaaaaagtggtatcacaacatggatagctcatggttcattattatcatggtattggaatggtatggcattcccctgggataatgatattgatgttcaagtaccaattatggatttacataaattatctttacaattcaatcaaactatagttgtggaagatccagaagatggatttggacgttatttcttagatattggatcatttataacattaagagaaaaaggtaatggtaataataatattgatgccagatttattgatattgatactggattatatattgatataactgcattagcattatccaatagtgaaaccccaaaaagtgatttatcataa

SEQ ID NO: 2260 - DNA, 1230 bp, Candida albicans
gaaaatggactcaatcaaactgatttgagtcgattgaatttttatcaacaagctaatgcattagttgataaaactgatagacatttcaaatatgcttgggtatttactgatattattcaaggttatacccatcatattgcttatccatttttcaatcgttacattagtgatagagaacgacaatcagtattacatcatatgatccgtgtatggtttcaattaatggaaacctatggatataccagttggatcaattatgggaatttattaggatggaaattcaatggattgaatatgccgtgggatactgatattgatgtacaaatgccaattgttgaattagacagattagcaatgaatttgaatcaaacattaattattgaaaatccaagatttggtaatgctagatattggttagaaatatctcctagttatatacgtcaagggaatgggaaaaatcatattgatgctagatttatcgatattcatagtggattatacattgatatcactggattatctactgaagaaatgatacccgaaccagcaacaacaacagcgacaacaacaaaaggggaagtaaaccaatctaatgaggatgaaaatgatgttgcagcctcttcttcttcaattgctgtgcattgtaagaattggaattggcataaattgaatgaattattacctttaaaacaagcatttttcgaaggttcatcagtttatattcctaataatgtatcaaccatcttgttgaacaaatatggcgatgatgccttgagtgattataaatttcataatcatatttattatccagatatttccatgtggataaataatgatatttgtcaattacaaagaaatactggggtgattggtggtataaatcttggtgtcaatattaaaaattggaacccaactactaatactaataataataacaatgaaggagaagaaaaatcgcctatagaatcttcatgtgatttaaaatatattcaagatgaatataatattattaaagaatcagtaatgagacatcaatatttggaaaatttgaatcttgaagataaacaacatcaacatgaacaacaacaacgccaaaaagaagaaatgattagtaggttgaataatttacctatttttagaaaagatccttgggattattattatgatataaatcataatttagtcactaatgatcgatggtatgttaaaattgaagaaattgctgtataa

SEQ ID NO: 2261 - DNA, 909 bp, Candida albicans
tcttccttttcacagaaaattgaaattcaaatgccaatcaaagagttgttgcgtctagctttaacttataatcaaacaatggttgttgaagatgtcactgaaggatttgggaaatattttattgattgttcaacatttgtgcattatcgtggatcagcaaaactggggaatcacattgatgccaagtttatcgatgttgatacgggcttgtcggtcgaaattggaggtgtagctatttcacatgaaacagcacccaaaagatatactaatattgtaaccgaggctcaacataatggtcaacttagacaagtttacaacacacgtcgtcctcgtttttacactagcgatgaaatatctccgttaagaaagtccatgtttgcaggaacgcctgtttatgtgcctaataatatctctgcaattttgaatcaggaataccacaaaaaactcattccgttcaatgcatatggttattattttgttacacaacttaatctatggatacatcactcaaaattaaagtttttgtttgaaaaattcgaaaatacttctttgctgttagaaaacggtcaaactgatgcaacagaactttgtgaattagtagccactattgacgaagagcaaatagtagagttgttgacgcgtcacgatgatattttattggaatattatttgagtagcgatcttggtgatttacacaaaaaggaattgatttgtttatttgaggatgtgaataaaatcgacaatgccagaatatgtgacaaaacgaccaagattggagaaagcaaacacagagttgaactagctaatgatcctgaatatcgtgaacttgtcaccagttttacatttcaaaacttcaagcggatatctttatatgattacgaccagcttgcaagatccaaagcttcataa

SEQ ID NO: 2262 - DNA, 924 bp, Candida albicans
tatttgaaccaatcagtgattgttgattttggtcatgatatcaataatattcgattaggtagatatttcttggactgttccagtcttatgtcacaaagagttcgtggtaatgggaacaataacatagatgcacgtatcatagatatggataccgggttgtacattgatattacaggattagcattgagcaataccatggcaccagcaagatataatcacttattacactcaagtcctaataatggtgaattggctcgagaaaatagtcgtgatgcaactattagtgaattggcaagaaatgaattcttacaagtttataattgtcgaaataatcatttcagtcgattagaagaattgtcgcccattagattgagtttggtcgaaggggaatttggttatatcccaaatgaatttgaatctattttgaaaatagaatataatgaaaaatcaatcaataataaagactataatgggtttgtattcttacccaagttacgaatttgggtgaaaaagaaaccaattgttaattttgttgctgcaaaggaagaaaaagaacaacagcaaaaaccaaaccaatcttccaagaaaactgctgatgttattactattgatttaactgatgaagaatattcccagtatttattggaaaatcagtcagagttgatcagttatttgattaccagtaatgtcactttattccaccaggatgaattagttcattactttaatgggaggtcggccaaatcattgtttttcactgacgaggaatcacaacaggtacaggaagaactgcaatcgcaattgattttgaaaaaagggctaatacaagatttgagtcaagatttattcaaattcaattcatttcaatcaaatcctaattatgctgttttcacaacggcctggaaaatccgcagattgcgttac

SEQ ID NO: 2263 - DNA, 1005 bp, Candida albicans
tatgtcaccattggaagatcaatttttccaacgatgaaaatgatattgaaaactatcaaaaggaggaaattgatttgtaaagatttggatgccaataaaaagaaacctcgaattaatcagaaaaatatgttatttccaacgaaggaatattgtattgatgatgacgaaattgacaatatactaaatgatcaagaacagttatcaagctatgattcatatgttgttgaacaattaaaaaaaatcaagcagcaaaattcaccaatgtcattagggtttcatattttcgagttcccaggaagaaatgctaaaaaatatcgccctatattaggcaaagcttatgtttatgagtttatgaaaaacccttcaacattaacaatgttattaccaaccactaatcaagaacaacaaggttttcaaatgatgtatcaaatgcctgttaatcaacaaaatcgaaataaaatatcaaattccaatcaaatatttaaactgggggttacaattgatttaaaacaagaattaaataaattgataaccagtaataaaccacaaaaattaactagtttgacttatgaaaaacatttatcacacgatatgtttgtcgataactcgcctgcgataatcatgtcaatacaacaacaactacaaacacaaccactcaatcaaactgatactaattatttaaattcattgaaattttccttgctttatgaaaaccctggtaaatatttccatgaagccaatattcttactcgagaagcgaattttgctcttgggggtcattatgattggagattcatgaatgggataatcaataacactccacaattgagtgtatcaatcaatcaattgatcaaatcatggttccgattgactaatcaatttggattgaacacttggattgcccatggttcattgttatcatggtactggaatggattacaattcccctgggatagtgacattgatgttctaatgcctattctggatttactcttattatcttga

SEQ ID NO: 2264 - DNA, 2043 bp, Candida albicans
tcaacaccatacactcataccacgatatactacaaaatgccaagactaaagcgagcattattatcaccaaaattgtttgttaaatctatactattgttcaccatcgtttatacaatatacctatccacttcaaccactacatcagtgtatctaagcaccactcaatccaaactaaatatatatacaaaccaactatatcaaaagattaatcttcaattcaatcaatggtattataatatcttagtttatgattataatttgttttctgattcaaatttccaacaacaattaacaataattaaatccgagaaattacaagatgaaaatcataaaatagatctttggaatctcgacgatagttttaatttacccgtatcagtgaaagtaccaaattatttattatctccctcatcgtcgtcgtcatcaagtactgacaagaaacctttgattcaaccatttgatcctcgattaacattatcagtatactataattatatcgaaacaaataaagacaacggtaatgatttaaaattaccattccattggtctgattgggttgatttctccaagttgcacaagtatattctcaacccatcaaaaactgacctttgttccagtttatttgatatatccaacaatgacaaattaaataaagattctgaaatcaaaagtgttgatcaatattgtcaatttataggtaacgctaataatggaaatgaaaataaagctacaaacatgttgggatataagatttttgctccagcacaagctcaaacaggtgctaatcatgaattaattggtaaatcatacctttacactcaagcaccatcaccgaaaagattgatttttttaacaaataccaatggaaattaccaatttgatgttgataactataatgtgaacaatattagcaattcaattttatataatgagaaattgacatcaaacttagcatcaaaagttaacaaggaaaatgaacaatcatcaactttaaatgtattgtcaagttatatttccttgattaagaattctccaccctcattattaccaacaaaacaacaaaacaatcccaaggacaatgaaattgatagccatataattgagattcctgaagaatatttcattaatgatccacaatcaatcattaaccaacttgaatcatcaaattcacaattatcaaactctgaaaaagactttttgagttcaataaaatatagtgttgattgtaaagatccaccaaaatatttttatgaagccaaatatgtcaaggcaatgaaagaaaattggagtggtgaacattatgattggagattttacaatggtcttacaattcacaatgctcaacagcaatcaattatattacatagattattaaagaactatttaaaattcactcaatcaaataatttaattacctggattgctcatggttcattattgtcatggtattggaatgggattaatttcccctgggacactgatattgatgttcaaatgccaattcatgaattatatcaattagcaagattttataatcagtctttagtggtggagaatgctgggactaaacgtcttggtaatagtgataaaaccgaagaatttgaatttgatggtatgggacgttattttattgatgtgggatcttcagttactcatcgtaccaaggggaatggtaataacaacattgatgctcgttttattgatattgatactggtttatacattgatatcactgggttagccttgaccaatgaagaatctccagatagatataatgatttcttgactattgatcaaaatactgacgcggggaaacaaaaatttgatcagttgaaacaaaaccaaaaagatggtgataaaaataataactactcgctcaagaatcaacaattaaaactttataattgtcgaaataaccattttagttcttataatgaattatcaccattaattcaaaccgtggtggaaaatcaaccaggttatatcccgaaaaatttcatgtatattctcaatgatgaatataatttgaaatctctagctaac

SEQ ID NO: 2265 - DNA, 2310 bp, Candida albicans
aggttccattttataaccatgtcgctcgttaaatcaataacatcggcgaaactgtcgaacaaattgattaaagtgatattattcacgttagtgtttataaatttgatatatttcacttcagtcattcataacaataacaaagaaagaatttctctgattacttcgaagttgacctcttctactagtggcaacaacaataaacaacaagaacaacatttaacagatgctgataatgacaagctactgtcttcttcaaaccaacaacagcaagatgcacacgaaactgttcttgaagagcaagaaaaggaacagcagacacaacaacaacaatcactttcagatgacgatatccagttcaaaaaattagtcgatgctaaattgaattcagtcaaaaagaatcaaggcaaatattatatgaccaataccgatttgctggaaactaaaatcaaagtcccaatcaaacaatttttgaaaaaatacgaaagtgcagaatcatggattaataaaaatgaattatattacgatccaagattcacattatcaatatacttgaatgaattgtatatgcaatatcaagaaatgagtgatgaacaattaattgatggtaatgataatcaacatttaattggtgggaaaatcaattccaatgaattaccggacattagtttaccatttaattgggttgattggattgatttgactatgctaaacaaagaattctcaaaaccaatgtatcaaagacttaaatgtcaagatattcaagcaaatagtcattcaaatccagatacatcttatttctgtactgataatgaagatattagtgaagaaactttccaagagtttttcaaaatgggatataaatacaagacccaattcccagggtttataatcaatgatcatgaaagacatgaacattattgtgataatgattatcgtgtaatgcaagccaaagcatataccatgacacatttattgaacccactaaaagttatcattttaggtgctgataaaaaggatggtaatggtggtacatttgaatttagtgttgataattcaaagactcgtttaacaagcagtaaattaattgatagatatatggaatcacacggttattacactcgtaaacaagattcaaatattgatactgttcgtaatgggaaacgattctttttcgattcttcagaagatcaaaatgaagttcctgatattattgaaatggattatttatcaacttggaatcaattaaatgaaaaagttgttcctaaatatttatcacccaatgaaactggatacaccaatttcttgcatatgagagataaaaatagtatagctttaaaagaatcaaaatttatggaaccaccttcaattgcatcccaaattgaacaatatactgggaaaccagaaaatgaattgtctccacaagaaaaattgtatttagaaggattacaagaatgttctaaatatactgatgaaaatgaagttagatatttccgtatggcagtaattaaccctggtgacccaagaaaccgtgaaaatgaatgggggtggcattatgattggcgattctttaatggtgctttaaattatgaaaaacctgattggaatcaacaagaattgactcatcgtactaatatcattttagatagattattacgtaattggtccaaatttgctatggaaaaggggatcattacctggattatgcatggtccattattgtcttggtattggaatgggttattgttcccatatgataatgatattgatatccaaatgcctattgatgaattagttaatttggctaaaaactataatcaaacattaatagttgaaaatccaagtgaaggatacgggaaatatttaattgaagtcaacacttatttccataatcgtggaatttcagctgaacaaaaccatattgatgcaagattccatgatgttgattcagggatttatattgatataactgcattgagtagctctaatgcagaagtccctaaagaatacaagcaagaaaaaaccattcaattgattgatgacttaaccaaaacaaattcaaataaggaaggtgctggcaacaatgggaaacaagtgaactccgaaaaccaattgattttcaatgatagacgtaaacatttctataaaatagaccaaatttctcccttgaaattctccatgatgcaaggaatcccagtaatggtacctaatggaatcaccaatcgtttacaatttgaatattccaaagggttaaaatctttagaatttgacaattggttttacatcaaacagtcttcacctacggcagcttga

SEQ ID NO: 2266 - DNA, 258 bp, Candida albicans
cagcgtggttccttccagcccgccggtgaagagtttgttatgatgtttatccctcatcaacaaaattcaatgatggaaaatgtttatagttttttgggtgctttgatattttccatttatattattattgatactcaacatattatgaaaactttacatttagatgatgaaattattggttgtatttcattgtatcttgatatcattaatttgtttttattcattttaagaatcttaaataataatcgtgatgattag

SEQ ID NO: 2267 - DNA, 783 bp, Candida albicans
ctcctcgtgatgaagaccatgtgtaatagacccgagcattatccaccacaacacattaaccaacctcaccaagacccaaatttaaatcaccaacctttcaattattcacaccagtataatgggttgccaccaataggaatgatgatgcaactgaatactcactaccaacctcaagctcaaccacaggtaccgcaaccgacggccatacctcatagtcaacttcctgttcatcttcaacaacaacaacaacagcagccaccattagtacaacaacaccattacattcatcaacaaccagtattccaccaatcgaatcatatggtgacacatgaccataaaccaagtaccagctccagccataaacgaggaccatggtcacgcgaggaagatgaaaaattgcttgagctaattaagattcatggtgcttcaaattgggttaagatatccagcagcctcgagacccgtactgccaagcaatgtcgtgaaaggtatcaccagaatttgaagccatctttaaatagatctccaattacaccagaagaaagtgccaagatcgagagattggttgccattcatggtaagaaatgggctgagatttctcgtcatttaaaaggtcgttccgataatgccattaaaaattggtggaatggtggtgctaatagaagaagaagagcaaacttggccactacaactctgaacatcaatgggaataatcccatgcgggaagaacttcagagaaagtccccaacccccggaaactgctactatcaattccgaagctga

SEQ ID NO: 2268 - DNA, 432 bp, Candida albicans
tcggatatcatcacaacaactcaatcaataatggcaccaccagtccctgtttatagtatatcagaagtgcgaaaacaatataaagatcaattagacaatcctgagaaatataaatgccaattaaaatctataactcaacatgaatgtacatttagaccaaccactattagaaatgataatgtacaatcagaaattatatgtttaccatttaaacgaatttttcaacgatgtttagtgccaattataactaaaaataccgatggtaaaaaattaagacttgaaaaatggataaatattgaaattactgatgaacaaactaatcatgatttagtggatcccgatagtaaatatggtaaagatgttcaagattttttaaatgctgaacgagagtttaagaaatttatggaaattgaatcagatggtaatttatag

SEQ ID NO: 2269 - DNA, 819 bp, Candida albicans
catcaatactttccatacctattagcaccaaagggttcattagaccgacagttcccgtatcaagatggatttttccctgttgtactttattttttaacttcacttttgaataatttggtgtggcagtttgacataacagtcccaatgcatatcatattccgatctagtgggacagtagtcaccatgttggttggatattttttcggtaataaaagatacagtaagcatcagatagtttcttcaattttcatgactttgggtacaattatggcaacactaccagaaggaaattccctactgatcgaaatcaacattaaatttttaaccgggatattgattttgacaattgcaagtgtaatttcggcatttatgggattgtatagtgaattgatttataaacagtacgggaatcaatggcatgaaagtttattttacaatcattttttggcattgcccttgtttgtatttgtgtctccaaccatttatagagagtttggtgttgtcttacagagtaaacaagttacactaggtgcatttaagtttcctagacagttattaagtttgactgtaaatgtgttgacacagtttatatgcaccaagggagtgaacatgcttgctggggaaacaagtgcgttgacagtcactgtcgtattattagtgagaaagtttgttagtttgatccttagcgtgatattctatggcagctacatgtcgacgctggggatgatcggctcaattattgtgtttggcagtgcagcatattacagcattagtgggatttctgatagaaaaattatagaattaaagaaagaaacataa

SEQ ID NO: 2270 - DNA, 798 bp, Candida albicans
aattgcagcacaatagtttcgcgtatggtcggtcaccttaatattgatgatttagaaattgcagaagacttacaaggtggtgaaattaatttgagtattctattgggaaacgagaagctacttaacatgatcaaggattcatatcaggcggacgaatatttgttgaaagtgattaaatatttgaaggaggaggaagaagttccatccgaaatgaagtctgctatcaagaagtataagatgcacgatgatttgttgttgtataagtcgtttgctacttttaaacctgtggttggtagtgaagctgctaaagaaatcattcccacatttcatcgtcaaggtcatgttggtatcacgaagatctactgggctatccagccttacgtttttgtgccaaagttgctaaccatgataacagaaatcgtcaatgcttgtgatacttgtcaaagaactaagtcgatttcacgttatatgggtggtcttatgatgccgtcggaagttccccgtgactgttttagtcatattcatgttgattttattactggtttacctgttacggttgaaggatatgatgctataatggttgtggttgatgctctaacaaagtatacaatctgctgtccttgtaagaaaacttatagtgctatggatgttgctaagatgttgatgaatgaagttttcagtgtgtttgggttgccacataagataatttcggataaggatattcgatttatgaatctggtatttgactacatttatgaatattaccaaatccaaatggctactacatctaccaactaa

SEQ ID NO: 2271 - DNA, 3369 bp, Candida albicans
agacaaagagaggaagaaggtgatgttaaggatatcaaaacagttgttggtgaagaaaaagaagaattgcaccaggttgaagattgcgttttaaaagatcaagaagaattacgaaacgtcgaaaagaaagttttgaaagaagaagaagaattgcaaaaagtggaagagtcaatggaaaaggaaaaacaagagttataccaggttgaagactttattttgcaaagagatgagacggtaaagaaacttggagaaagcaatcaatctcaacaggaaccatatacaactgcaacttctggttctgatcagagattcagatctcaacaacctaacattggaaataccttagcgcaggatctagcattaattccaaacttagatccggaaatttgcagaattgcaatcaaatatccaaaattatttgaaacaaaattacgaccaccaccaccaagagactttcaatataaaattcaactcacagaccacactcaaatttattcaaaaccatataaatgcaatcaagaagaacaagctctcatcaaggatttcatcaatgaaaaattagaagcaggcgttttggtaccagctccaattgatgcttggttacacccaatatttccaatcagaaaaaccaatgccaaccaatcctccaccaaaatagcagttgatttaagacgtctcaataaggtcacagtacgaatgtacacttatccaacagacacaaaagacctcttatcctcactaacagattcccactattttagcgctttagacttaaagaatgcgttctatcaggtaagcatacacaaggatagtataaaatattttgggatttcaacatccgaggggaattattgctttacaactttaccgtttggagcaatcaattccccaaccatctttactaactttgtgagacagattttagaggggatcccatgtatatttatatacatggatgatatcctcatccatactaaaaccttacatgaccacatgtcattactcaggagaatcatggagaaactaaatgagcatcagtttcaaatgaattataacaagatgcaattattaacaacaaaaatcaatttcttagggtacagcattcaagcgaacaaaatatcaccagatatttccaaaattcaagcaatacaaaattgggaattgcccacgaccactactcaaatcagagcatttgtcaatttcagcaaccactttcgcatcttcatcccagaaatagcaaaatttactaatccattaaatgaattattgaagaacaacaatggtaaaaacataaagattgaacacacccaagcatccattgatggttacaaggcattaaaagccgccatcattggattgccgacgcttcaactttacaatccaaaactaccaaccatcattttcacagatgctagccacatggtagtaggaggatatttatgtcaaccaacattcagaaatgacaaagaagtccttgtcccaattgcattttcatcacataaattaacggaaacacaaagcagatatgctgctatggaaaaggaacttttggcaattattgtgatattggaaaaatttagatatcactgcagcaatacggtagagatctatacagattatcaaagtttggcatcatatttagataagaaaactactccaccaccgagaattgctaggtttttagatctaattggatcattttccccaaaagtgtactatttaagtggaaagaaaaatttcgttgctgatatcattacaagatatcaaactcaaaatattaaggaattggtagatgaagacaagatactaggacagacttttacagtcaagagaaatttgaaacaacaactattaccaagattggaagcaattgaattggaaaatcttaatgaatcacaggttcacaaaatccaaacttcattagaacaacaacaacaacatgatttggaagacaatgatgaagagttacctctccaactgtttaaattaatgaatgatgagttatttgtaatcattaacaaccaacttttaaaataccttccaagactggaatacaatgatatttgtcaaacaatccatgacaaacaccatccatcaactagagtaacagactacttatgcacactcgcatattggcatcctgatcatctattaattgctacaaacataacgagaaagtgtcactattgtcaactaaacacgtcaattcgtgaggccattagaccataccgaccacttgaaccactcaaggcatttagcagatggggaatggactactctggaccatactttaacacagtccaacacaggtacatattagtagccgtggaatatgtcactggtttaactattgcagtaccaacattgcataaagacgcagataacgcaatcagtcttttacaatcaatcattctgatcatgtcagcacctacagaattagttacagatcacagtaaagaattttcatcacaagctttggctaccctatgtgaccagaataacatacaacaccatattacctccgcccaccacccacgtgggaatggtcgggttgagaaggtgaaccacctattgaagaaaatattgaaagcattaactaacgatacgatgcaagactgggatttaaaactatatgacgctttaagaatctacaatgctacacctacaatttttaactacactccactttatcttgcacttggaattgaaccacaccataatttaaatcaattacaaaaagatttaattgaaaacttgcaaaaagaattgcccccagaggtccaatccacagaagaacacgaagaaaacccaaatgatgaacaacaagaagagggcagagaacaacaaatttcaagagaagaacaacaggacggcagagatcttgtacacttaagaatttacgaattggaagcaattaagaaagctcgcaagttacacacaaatttgaaaacacgaagaaacgcagtccaaaatatgttaaaggaaccatatggcattccagcaccttttacaaaaggacaatgggtatacagaattagagctaaagcacgaaaatatgaaccaaatttcgatggtccatatcaagttcaagaagtattaggtaaaggtgcttataaattgagagacatcactggaagagaaaaaggaatctacaatcaggatcaattgaagttagcatattcagcagacaacgacccaatacaggtttttagttctttcaataaagaatatgatcgagtacaacaaaaattgttagacaaaattcaatcggaaagagatcatcaattaaattgtttgtcagtccaacatttacacagacaaagaaggttactcgatatatccagctgtcttgagcaaattctgcaataa

SEQ ID NO: 2272 - DNA, 312 bp, Candida albicans
ccaccagtaggtatccctactatatcaccagctgaattaccattacttaacactattatattattagcttcaggtgttactgtaacttatgctcatcatgcattaattaatggtaatagaactaatacattatatggatttacttatacaactatattaattgcattatttgtatatttccaatacttagagtattcatatgctggatttacacttagtgatggggtatatggatctacattctttagtttaactggattacatggtttacatatgataatgttaactataatgttaatgatatgtacttga

SEQ ID NO: 2273 - DNA, 519 bp, Candida albicans
caactaataacaacaatgtttaaacaaattataacatcttcatctactaaatcaacaagattgtttaccagctccactttaaaatatttatcaactagttcatcacttttaaaaccaacattagctgctgctgctgctgctgcttccatcaccaccaccaccactgataattctagtgaatatttaactactggaggatcaactcattcaattcctgctaaaggttttagactttctcaacctaaaacatgggaagaatccaatgaaagtgcattatctaaagccaccaaatttttatttttaagtgaaattgctcgaggaatgtatatttgtttagaaatgtattttagagctccatataccatttattatccatttgaaaaaggtccaatttctccaagatttagaggtgaacatgcattaagaagatatccaagtggtgaagaaagatgtattgcatgtaaattatgtgaagctatatgtcggtcttcacccacgggccctggaaaatccgcaaat

SEQ ID NO: 2274 - DNA, 393 bp, Candida albicans
ttaataggttatattgaaactcaaggtaaggtatctataataaataaaactaataaattagtacatagatttagtataagtacaaagagggatccaattatattaaatgctctaaagcgaatatttcatattagtgcttcggtgaagtatgggaacggcctatactccctcgataccactaacaataggagcattcataatataattgagtattttattactagagatcatactatattattcttaggtatgattaatttagaattttcaatatggaaaaggtcatattataaatataagaataaacctctggccctcgctaaagctcaatcccttatcttgaaaattcataacgctaaaccccacttatgtggggttgacccttatgtataa

SEQ ID NO: 2275 - DNA, 1176 bp, Candida albicans
acaatgtccaaaatagagccagtcactgaaaaagaagaagaatacgtttccgaatgggatagaagaagatatgttcccaaagcaggtgaacctgaattacctccccaattatcagaattctctaacaagaccacagacgaggttattgaggaattgaatagattgccattttttatgacaaagttagatgaaactgatggagatggcggagaaaatgtaaacttggaagcacttaaaagtttggcatatgaaggtgatcctgacgaaattgcctcaaatttcaaaaatcaggggaataattgttacaaatttaaaaaatacaaagatgcaattatattttatacgaaaggtcttgaagtaaactgtgacgtggacgcaatcaattcagcattatacttgaatcgtgctgcttgtaacttggagttgaaaaattaccgtcggtgcattgaagattgtaagaaagtattaatgcttgatgagaagaatattaaggcttgtttccgttcaggaaaggcattctttgcaattgaaaaatacgatgaagcaatcaaagtgcttgaatacggtctaaatatagaaccagaaaacaaagatttacagaaattattacagcaagttcaaaagaggcaagaaactttagctcaaataaaagctaaaaaggcacaagaagaggaacaagagcggttgaaaaatatcgtgttggagaattctataaaattaagacacattgaaatagtgaagtcctcatctcctccagaagtcttgaagactgccaagatacgattggaagaccccaaagattatcagtcacaattaatattccctgctatgatactataccccaccaccgatgaatttgactttattgcagaaataagcgaattaactactcctttggaattgctagagatggtattaaatctacctatggaatggtttgatgatccaaaacacaacgatttcaatgtcaaaaaattggaatgctttatggaaactgaatctggtgggttgattaaagtgggcaagaaaattgaagttaacaatgctttgatgaatgaaaaacctaaggcaccattgtttgataacgctttaagactttatgtcgttccaaaattagacgtcgccaaatggacatctgaatggaataaagaaaccgccttggcagctcgtaaatag

SEQ ID NO: 2276 - DNA, 3033 bp, Candida albicans
ttttatcataatatgtcatcctcaaattcatctggtggaggaggaccaccttcatcacgatataataacgactatctagattatggcaaacaacgaaggaaaaatttttattcgtcaaacttaacgtcatcaacatccccaacaacgtcgtcaaccaacctaaattcaaatacacatatatcatctaacaccgtgccaggactatcgcgacgagacttcaaaaataatggttcgggctcaagttctataccacatctgaaggattcaaattcaataccgacaacctcaagaaatggttcatattcatcatcttcacattatagtaactatggaaattatcatgattattattctggacatggacgtaacgatacatggagaaaatcaagtagtggagctggagactcccgtttgactgcatctaattcctctaatgcaccaggagcaggatcaggtccaggtccaggttcaggttcttcctcttcatcatcatcgtcatcgtcatcttatcaacaatacagaccaaatggagattatcgaataaaagatcgttatgattcatacactggtcatgatggatccatcaatacaagtaaatggaaaatgagtcgaagttctgtgggttcacgatattctgcaaaagatagaatgcgtggcaaacaatcgtcgtttacttctggaagtaacagtatacctttaggatcttcttcattagttaatagtactaattatcgaagtacgagtggtggtggtagtggcggagattcatattatggaagtggtagaagtaatgggtacagttcgtcgatgaattcaatgtattccaacccaaaagctgtggacagatattcatctttactgaaaaatggaggttattcaaaaccaagagattataaatatagatacgtgaataaggattataaccgaagtactttgattacacctgttgataaggaattaaagaaagaatatgaagacagagagtcacctacaccaagagatgaggatgaagaagaggaagaagaagatgaggaggaggccgaggaagaacaagaagagactaacgatagtatacaaactattgaaaccaaggaaatagctgagaataaattggaatcagataaaactgaaatagttaaacctgtgttggagaatggattggaatcaaaagaagttaaagccaaaactgaacctgaaactaaagcagagataaagcctgaaacgaaacccatagaacaattgaatgagtcagtggaaaagccaactttagaggtaacggttgggtataaaccaacaccagaaatgattgagaaagcaacattagaagcagcaacgcaactttgcaggtatccattaacaaagatagaatacgagttcgaagagttgaagaaaaagtttacacaagaaactaaacatcacgaaagtggtgccaattatttgaagtattcacttgctcgaccgattgttgattttaatgaattcccctttttttcaaacaattatcaaagtttcattaagtcaaaagatagtctaattgaatcatttcaaaagaagcataatgtaattaataaaaagaaaaagagtttgtggaaagattataaacagggattagaagtatgggagactgaacaattaaaaatggatcaacaactacgtgttttacacccaccaaacgacgaaatgaggcgtgagatagattcaagtgataatcggaagcaataccaacagcaacaacagcagctacaacagcagcagcagcagcagcagcaacagaatcaacaacaacaacaatttaatgattctaattcaggagataacattcatttttctactcgtcgtaatagaagacatggtgacttggtgactacagaggccgaatttcaagaaattttattatcattgggtcaagaggatgatgagaatccattagttaaagctgaaagagttgccgccaagattccagatatgatcttggaccctgttaaacgtgataaagtattatttatggactcaaacaatattgtaagagataaaaatgaatgggcacaacgcgtaaaacatgactttatgaataatttttctgaaagagaacatgaattgttttgtgaagggttttgtttacatcctaaacgttttggtgctattgccagacatatgggtggtttgagaagtgcatctgaatgtgttgttcattattatatgacaaagaaaaaagttaattacaaggaattattaattaagtcgagaaagaaatcaaaacctcggagaaagcagaaagccgctgcgtccaaaaaagaagctgtaccggtaagtaccactgttgagtctggtgaaaccgaaatagaattacctccatctagtattgttccagtggaacagttagtttcagaagaattgtacactgaaacaggtcgtagaaagcgtgctgcagctcctgtttttgatgggaaagaaaaggaaaaagagaaaaagatacaaagaaaagatggaacaaatattgttgttgttaatgagccaacttctgtcaatacagctggtggtactgctattgctactgccaccaccgccaataccaccaccacgactactacacctactattgataatacaccaactgcaacaactgtgataactacccctaatcttgctcctaatgttaatcctgctcttgctcatgtgaataatacaaatattataaatgattcgaattcagctgttactatgaatattcccgttgctggtagcgccgtaagttctagtgaaatccctgttccaactacaaccactgaggaaaacaaagataacaaacgtaaagtgatttcaagttattggagtattactgaagctaatgcatttcctaaattattagaagaatttggaatgaattggggattgatttcagataaattggccacaaaatcaacaaccatggttcgtaattatttccaacgtaatgcagaaaaaaatggttgggatgctattgttgctaatcagaaaagttcgaaaatgtcaatcatgagtttgttaaattag

SEQ ID NO: 2277 - DNA, 1536 bp, Candida albicans
ttaagatcaatcatgccaatagattactccaagtgggataagatagaaatttctgatgattctgatgtggaagtgcatccaaatgtcgataaacaatcatttatcagatggaagcaacgtgatattcatgaaaaaagaatgcaaagaaacattgaaatcaagagtattttgatccaattgaccatgtatgctaagcttaacgaaagggtcgactatttgttggaaaagttaacatccactgaattattggatagtgaaaaagtcatgtcaaagttgaattcagaatttgatcctcaagaaaaattcgattatgataaattgattaaagacaagggtctgaccttgagaaaaggattgaaagatttgaaattcgatagagaagagattgaaaatactccttgctataatgaaatgattgaagatttgtttgttcaaatcaaggatgatcatccagagacaaaaaccgatggcgacaaattgattgaatacttaaaagaacatagaaacaggatcgacgatgttttgtctaaacagactataaaattggatgatttattgtaccagaaagctcaattgatagtaagtgatgatttgcatacggggtttgatagatcatttttaaataaagataaaccagaggaaaaagaagaaaatctagataaaccaaaagctccagaagctaaaaagacaactgttactacaactgaaaccatcaatctgccaaaaccagttgaagaaaacactgataaagaaatcttggatgaattggaaatcttgcctgccactaaagaatttgccaaaatacccagtgacaatctttcaaaagcagctgaattcttgattaaacatccttcaatatgtactgagcaacaaaaagacgctttaataatgacggcatttgaccttcaattggaaaacaaatctgatgaagctaaacatattgtccaccaatcattattattacaatacgttggccaattatcaggtaacggtaaagcagcaccagctaatgtgataaacgctatcaagttattcttctcgaagattgccgcagaatcatcaccagcaaagcatgcatttttagaggatgtaaaccaaacattcaaccacattaagggtagatgtgagatcatcaaagaagagcaaagacaaaatgcagcaaataaggaaggaacgggcgaagaagaagaagaagcattgattcaattgaaagctttagatgataatactgaactactggtcaatattcctcaagaaggtaccaaagaatatgaaatattcactactaaattaccaatagaattccagaatgcaatcaaaacagaatccattgatgaagttaataaagagtttgccaagttaaaaattgaagatgctgaaagaatattggaaattttcaatgaatgtggtgttatcggtatcagtggctatatagaagatgaaaaggaatttgaagaattgaaaaaagaatatgcacatgaaactgccaatcaagaagaagaccagtctgcttcagttgaagatacagttgattaa

SEQ ID NO: 2278 - DNA, 327 bp, Candida albicans
tatgccattaaaataattaaaacatccaaaacggtaattacaaccccatataataaaggaatcccaaataaaatctccaacgaaatcgcggttccaacaacctcggccaaatcggtggctataatggcgatttcagcacagaaatacatgaaaaggttcaactttgggtttaaatgtaatcggcacatttctgctaaatctaaacctgtgatggtccccaatttgacacacaaggcttgcaaaatgatagcaaacaaattggccatgaaaataatgaaacataatttatattggtacatcgatcctgatgatactgatgtcagatag

SEQ ID NO: 2279 - DNA, 243 bp, Candida albicans
atgactctaccaccaattaataaactcattgaattacttatagcggaaatcaatgatccaatttcgaatattataatccccgcaactaatgtccacttacgaccaaatgctatacttatattaccatatgaaggaacaagacatgccatgggtaacatgaaacctgatgttaaccaaccaattttttcaaatgcattgaatttattccccacagtagttaaaattgtcgaaacaatggtttga

SEQ ID NO: 2280 - DNA, 1035 bp, Candida albicans
agattcaatttattgttacaagtgacaatggggtcatcaattgaacggaatattggtattataaaatatgccattatttatatttcaagtggtattggtgggtttttattgggtgccaattttactcctcaagggattgcttcaactggagccctgggagctttatttggaatagttgccactaatataatccttttcatatatacgggtaagaaaaatactaatatgtatggtacaaaacattatgcccttttcatctgtataatgattggagaaattgttatatcacttgttttaggattattaccgggattagataattttagtcatattggaggatttgccatggggatattatcatcaattgtggtattaaaagatccattttgggtatttattgatggaatcattacttatccgaaaaaccctagtacttggcaacaatttttaaataattggaatccaatgtattcaattgaagataaaataagatcaagatttttcatttggtgtggagttagaatcatcgcccttattttaatgattatttatttggtattactttgtaagaattttttcaataatgatattaatacagggaacaattgcaaatggtgtaaatatttcaattgtatacccgttaaaggttggtgtgatattggtcaagttagtgtgacatcaactacaacaacatctgactctaattccaattccaattccaattccaatccaactaccactgctagttcaagttcatctagtgtcccaacaacgaggtattcaacaatgacttatacaacttcaatgccttcaagtgttgaaaatcctaaatcaaatactaattctgaaggtactaatggtggattaagaaaaagatttgccagtagttttactggtggtaatagtggtggtacagctaatatcgctgcacgtgctggtggtgatattcaacaacaatatggaattggtagtggattatatgtgatagtgatctttttcacaatttcatttttgaaaaagaagaaaattatataa

SEQ ID NO: 2281 - DNA, 594 bp, Candida albicans
caattgtcatggacaccagattttaacaaagtttataaagatggattagctgatgaaaatcatactgatagtggagttttattggaagaaggaatcagtgtcactcctgtacaagctgcatttcgagtaattgagccattaaaaggtgaaataaaattaacggatgacgaagaagaagaagaagaagaagaagaagaaaaggtagctaatggaaatactcttttagtgacaataccaaaagaatcatacatttatgatcgtatgactgaaccatttaaaaaattgggatataaaattacttccgataaaagtattattaattctaacatttcaacttcaattttccattatggtgaatatgaagatattgatttagattcaattagtaacgagaattatttcattccatcatatatttatcgtaaagcacttattcgtaaacattatcttgccaataccgttcatcattatgtcaccaaaaatcctaaatcaattttaaaatctgctgtaccggaaagttatcaattggaagttgattatgcggaatttttagatgattcattagagtcttcaccacgcggtggaaggaccgca

SEQ ID NO: 2282 - DNA, 819 bp, Candida albicans
aatttgcccttcgaaatttgttctttttttatactgatgtttaatagatcaattcgtatatctagaagcccactattacgatctaggactatactaccaagaacatttgttactaatacacatagattatcttacaggctcaaacaacgaaacccttctacaattttcaagcaatcagcaatgactttaattactatttcccaatccttagacgaagcttacaccaagcacaaagttatccctgaagttgttgatcaatttgacactcaaggtttgttgtcaattgaatatggcccaactgaattggtcactttgggtaacaccctttctgttgaaggtacccaagaagttccaaaaatccaattgactcttaactcaccaactgaagatggtaagattgaatcaattagtgaaaatgacaaattcattcttgtcatgacagatccagatgccccttctaacagtgaccacaagtggtcagaatatttgcattggttagtgacagacttgaaattgccacacaccaagaatgaagatggcgagccagaaatcagtcattttattgacgtcaaagaaggaagagaattggttccatacatgggtccaggaccaccaccaaagaacggaaaacatcgttatgtgtttttattgtacaaacaagatccaaatgctggtgaattgactgctccaaaaggtaggcccaaaatggggttactggattaccaagccgtggtgtccaaggattgggttgaaaagaatgcgacaaactcaaaattgttaagtgtcaactttttctttgctcaaaacgaagacaattaa

SEQ ID NO: 2283 - DNA, 474 bp, Candida albicans
gaaattcattactcaacttatataaaactgattcaattacttttgatgtcatctgatccattaacttcaaacgcacgtccagcaaccgactcattgatcaccgtcagaatcataaaatctttcccatatagaaacgtgaaaaattacattatcaaagatatcgatttaaaatcaaccactccaaaacaactattagaaaaattgcatgaaattataaatactacaggtgctttgagaccatatagaaatgttgaatataactcgataaagatttacacaaaagcccatggatcaaaatctatgaatttggttattaattttgacaatgatgaggattgggttttagtgaatccaagtaataacggagataaacaaagtttgtgggatttagatataaggaatgaaacagaattaagtttatttaattgggatgattatgttgcatataaagagaaccccgttgagaaatggtaa

SEQ ID NO: 2284 - DNA, 1950 bp, Candida albicans
agtttacattgtcatatttattggcatcacccatcaccttattcacttgttcattcgttcattcgttcattcgtttaccaatacctaattctgagggagctttgtttttttttaccaagaatgttttctatcccagtatcatcaaaaactgttcgtcttatacttgtgtcattacttctaataacactaataaatatattggctgctttccaacggtcaactttatcatcatggtttccttcatcacgtcatattattaataaattcactgatttacgattagcattatcatctcaagaatcggtattaagggatgaagaaggagaaatttattcacttgttgggtatcatcatgattttgattcaaatttagttgttgttcaaaaacaatatttacttgaaaaaactccaaatgaagatacaactgaacatttttggaattttttgcaatcaaattttgaaaccaaatctgaatatgatttaaatttaattgatggatataattataaaaaattaattaaacatctaaatgaacaaaatgaattacaattgagtcattcatttgttgaacaatataaaatggaaaatcaatttattcaatcttttcaaaattttttcgttcaattaattgataccattgaagattgtaaaccagatttagatccaataaataatgataatcattatcctaatggtgataaaatcgtgaaatattatgaattaagaaataaaatcccactggaaaatatgaaacagtttaatattgaacgattaattcatcgtaatggaagaataccgatttatggtggacatttacgtgaacaatataaagatgaattaattagaaataaagaattcttatcaatgtatttaacattaagtgattcggaaatatcagcattgaaaaaatcccatacaaaatttttggaaacgatgatggaaaattggccagaaaatttatttaaatttaataaatttaataatttcatgaaaggtgatggtattgtttatttaggtggtgggaaatataatcaattagtacttttatcaattaaaatacttcgagaaaatgggtcacgattaccagtagaagtaatcatcccatacaagaacgattatgatattcaattttgtgatcgagttttaccaactttaaatgggaaatgtaaattaatgacagattatttacctcaaacatttgttgataaaattagtggattccaattgaaaaatattgcccttttgatatcatcattcgaaaggattttataccttgatgctgataatatccccattagaaatcctgatgttttatttactaatgcaccatttacaactaaacatctcgttgtatggccagatttatggagacggtctacatcaccacattattatactattgctggcattgaagttgattctaattttaaagtaagaaattcttatgttgatggagatgaacgaggtaaatatactgattcaatgtattattcttatcatgattgtaaaggatcaatccctgaagctagttctgaaactggacaattattaatcaataaaaaaattcatttccaaacattaatattagcaatgtactataattattatggaccagattattattatccccttttcagtcaaggagcagctggagaaggtgataaagaaacatttattgctgctgcccataaattagatttaccttattatcaagtgggtgaattcaatagagaatttggtcctattaatgataatacccgaaaacatgaattttatggaatgggacaatatgatcctattatagattattatatgtcaacaataacaacaactcaaaaagataccaaaaagaaaatcaattataattcaccattaccagaaaaatatgccgccaatgatgaagatgatacttgttccaattatgatttccatttattccaatcatcatca

SEQ ID NO: 2285 - DNA, 582 bp, Candida albicans
gacgaactttgcaacatcaagtgtatcaaaaaaattaaattcaaacccattagtactttaaatatgcccattacatcacttgaatcgtatttatttgaacgtaaatttgctaatgcaagctcgattgagattttacagaatgccgttattgggatcgacgtcgaacattatttgagtcgaatttacacttttaagaaagaacaatttttaccagctattggcggagctccttcttcattaagagattatattaaatcggatttgaaggttttccaagaatttaatattaaacctatttttgtcatatccgggttacacactcaattggaacaaaagtacaaaaataatttgatagaatttgatacccaacatgttgaaaatacctggaataaagtcaatagcaaggatccctatggacatggttttcatcatcagcactctcattcccatagtgccaatattgatggtttccgtaatttgaatgaaccattaccgatttattctatgattaactatataatcaaattctttttggaattcgatattgattatatgagcctgaccacgggcaagaatccgccc

SEQ ID NO: 2286 - DNA, 1011 bp, Candida albicans
atttttccattttggggcgttaatggagaatatacttcaactaaaactgttggaacaagaagtgatattatttcaactatcttattgagggcgttgtatctttacggaattgtcaacgataaatcagagttatcgagtattggtaaaatattggttgagtttgccaaaagcgttaacagcgatataagccaagaagattttgaacatataatattgcttgtattgttattggattcaaaagcattaaagttaaatgaaccaagcaaagaatatactgatgtttcaaactattacaagaaaagtatggttgatcaacaacagcaacagcagcagcaacaacagcagcagcaacaacaacaatattctaatcaattcagcaaacaaggtcttgcagatgatatagttaaaaagatcacgttgatttcaaggatattctcgtttaagaaactcaatgtctcgccaataaattaccaaggtccgatttctagaagtttattgaactttagaagccatgttgaatttatcaactacaatttgattaacactttgcagttggtccttgttgatttcatagtccgacaagaacaaaatagtatcaaaacagattatgaaaccaaagacgattggtacaaattgatcgatcaattaccattttataaaagtttgaataacacattaatgggtgtaattagtgagatttattttgaaatggcaattaaacaaaaacaaggacagccgcaattaaccaaggaagaaataattaaaaattgtcaaaatcacttggccgatcatattttctcggtgaatattccatcatttaacattaatgtcaatggtattaactcgacttctaagacacaattgaacaacgatttcaaacaaggagtagagtggtggaagaaattcataatattggttgatattataaataagattgataagaaattggttgataatagtttgtatcaagaaatcaagcaggcagatgagtttttaaaagagtttgtatag

SEQ ID NO: 2287 - DNA, 1017 bp, Candida albicans
tgcaaatgcggatccgtccagggcgtgttgaaaacactgtcgccgctgtttgccataacgggccaatcaccaaatatgaggtcaataaatgggaaaagaataacacgagagacattgagcgaatatagtgaagagaatgagactgaccttacatcggaattttcagatcaggagtttgagtgggacggattcaataagaaccagagtatataccaacaaatgaatcaacgattaatagccacaaaggttgccaagcaacgggaggcggaacgagagcaaagagaattgatgcagaaacgacataaagattatgacccgaatcaaacgttgcggttaaaagatttcaacaagttgaccaatgaaaacttgactcttttggaccagttggatgatgagaaaaccgtgaattacgaatatgtcagagatgacgtcgaggattttgcccaagggtttgataaagattttgagactaaattgcgaatacaaccgtcaatgcccacacttcgaagtaatgcgcccacactaaagaagtataaatcttatggagagttcaaatgtgacaatcgagtgaaacagaagttggatagaattccgtcattctataacaagaatcagctacttagcaaattcaaggaaaccaaatcttatcatcctcaccacaagaagatggggactgtaaggtgtttaaataacaatagcgaggtgcccgttacatatccgtccattagtaatatgaaactaaacaaagaaaaaaataggtgggaaggaaatgatatagacttgattcgatttgaaaagccgtctttgattactcacaaagaaaacaaaactaagaaacgacaaggaaatatggtctacgacgaacagaacctacgatggattaacatcgaaagcgaacatgatgtgtttgacgatatacccgatttagctgtgatgcagctacagtcaccatttaagggattgagccagttttacccaacgcaccacttccaccactgcaacagccactgcccctag

SEQ ID NO: 2288 - DNA, 1680 bp, Candida albicans
atacagatctataaatatcagccaataatttcttgttcaaatgtaattcttgaaatatttatcaatcaaacaaacaaaaacaaaaacaaaaacaaaaactttaaaacattcctaacaatcaaacaagacaccgatatgacagttaaacattctgaaactgatgtattaatcattggtgctggtccagccggattaatgtgtgctacatggttatcaagatgtggcattccatttcgaatcattgataaacgttcaaatgaaattttcactggtcaagctgatggattacaatgtcgttcattagaaattttccaatcattttccgaactgagttttgattttgctagtttaaatcaaagttggaaaatggctaatcatatgattgaaatgtgtttttggtcacctaattctaatggacaattggaaagaaattctcgtgttgctgatactatccccgggatttcaagatttactcaatcagtgattcatcaaggtaatattgaaaaatggtttgttgattctattgattatttttcagaagggaaaattcaaattgaaagaccactcttgccagtttcaatcaacgtcaaagaagaaaatgagggtaagtccaatattgatgattatcctgttgaagtgaaagttgtcaaggtatcatcggaagaagccagaccagaacagtatggtaataaaaacgttgctaatggacttttccgtcaatttgatggtgatcaagataaatcttataaagaaaaacctgccagtgaagaagaagaagaagatggagaggttgaagaagaagattgtgaaatcattcatacaaaatatgttgttggttgtgatggtgctcatagttgggttagaaaacaattagatattgatatggaaggagaacaaactgattttgtttggggggttttagatatggttccaattactaatttcccagatattagaaatcgttgtgctattcatctgaaagattctggatccgttatggttatcccacgtgaaaatgatttagttcggttttatattcaattaaaagaagttgaaagagatcctgccactaaaactgataataaaaaatttactgggaatgtggatgatactcaagccaaaactaaaggtagaattgatcgttccaaaatcactcctgaattaattcttaaacaagctcaaaaaatttttgaaccttatacccttgaaatgactgatttaagttggtatacgggttatcaaattggacaaagagttagtccccaattttcaaaatttaataatcgtgtttttattgctggtgatgcttgtcatactcattctccaaaagctggtcaaggaatgaatgtttctatgcaagatacttataatcttggattcaaattggctttggtttgtaaaggattagctaaacaagaaatattatctacttatcaactggaaagattaaaagttgctcgtgatttgattgcttttgatcataaattatctcgtttgtttagtggtaaaccaatgattcctaattctgatattttagatggggttgatatggatgaattccatcaagtttatcttgaaagtaataaatttgcttcaggaacaattgttgattatgaagattcattattgatcaataaactgaaactgaaccacgataagaatgaagaaggtgaaggttga

SEQ ID NO: 2289 - DNA, 795 bp, Candida albicans
actcactccggaaaaaacgaaaaaaaaaagaacctcctactccaaccaaactatatcgttattatttcaagaaaaaataaatttatatccttccttcaccataataccaaaactaaaatgtcatttgaaatcacaattcttgggtcgtcaggaggtccattagagggaagcacttgttcaattcttctaaaacccgcaaacatctcttatcacgacattatcaatgacaatctacctgatcaagtattatgtatcgatgctggatcaggtatggggaaactaaccgagattattcatcaggaaacaacgactaagacttcatattgtaattttcttcaatattatcctgattgtgaaactgtgtcctattattatcatcctaatgtaaccataactaccccattttccaactttcaaccaggtagaccgattctacatacccagaatattttcaataacctacaaaattaccttatttcccattctcatttggatcatgtttgttcagtagtgataaattctgctggatttaataaaaatatgctgaataaaattttatatggatctcattacacgataaacgcaatgcaacaacatttattcaacgggaaaatttggcccaatatgcctagtttcaaaatcgtcaatttaaactatttggaaagcaatagaagtgaaagaataggaatatatacagtgaaaatgtttgatttgagtcatggagagttcaacaaattgactgaagacaaggaagacgcacaacaccatagcaatagtaacagtaacagtaataac

SEQ ID NO: 2290 - DNA, 1182 bp, Candida albicans
caaacaatgtttttaaagaatattttcattgctcttgctattgctttattagttgatgcttctccagctaaaagatccccaggttttgtcactttagactttgatgtcattaaaactcctgttaatgctactggtcaaaaaggtaaagttaaaagacaagccattccagttactttaaataatgaacacgttagttatgctgctgacatcactattggttccaataaacaaaagtttaatgttattgttgatactggatcttctgatttatgggttcctgatgcttctgttacttgtgataaacctcgtcctggtcaatcagcagatttctgtaaagggaaaggtatttacactccaaaatcttctaccacttctcaaaatttgggtactccattctatattggttatggtgatggtagttcctctcaaggcactttgtataaagatactgttggttttggtggtgcttcaatcacaaagcaagtctttgccgatatcaccaagacttctattcctcaagggattttaggtattggttataaaaccaatgaggctgctggtgattatgataatgttccagttactttgaagaaacaaggagttattgccaagaatgcttattcactttatctcaactctcccaatgctgccactggacaaatcatttttggtggggttgacaaagctaaatacagtggttcattgattgctgttcctgtcacttctgatagagaattaagaatcactttgaattctctcaaagctgttggcaaaaatatcaatggtaatatcgatgttcttttagattctggtaccacaattacttatcttcaacaagatgttgctcaagatattattgatgccttccaagctgaattgaaactggatggtcaaggtcatactttctatgttactgattgtcaaacttctggaactgttgatttcaattttgacaacaacgccaagatttctgttccagcttctgagtttactgctccgttgagctacgctaacggtcaaccttatccaaaatgtcaacttcttttaggtattagtgatgctaatattcttggtgataactttttgagatcagcttaccttgtttatgatttggatgatgataaaatttctttagctcaagttaaatacacttctgcttcaaacattgctgctcttacctag

SEQ ID NO: 2291 - DNA, 1149 bp, Candida albicans
ttggctccttcctgcccggcggtgaagacacttttaaatggtacacctatcaactcaatcaaaatcaagaaaaataagccaattaccaaaaagtatttacaatttgttgagaagttattcgaacaggaaccagaaattgctagaaattttgagaacggatttgatatcattaaagtgcgtcagttatttttgcaatcattaaacgaaactaatggtatgaatttgttgagtattgatagtgaattaagtgaccaattgaaaaatctagcattagctaatggtaacgaggggttgagtaccactaccaaatacatatttgttcctatcgccactattggttgcgggaagactaccgttttcaacacactaaacaaccttttcccacaatggacgcatattcaaaatgataacatttcgaaaaaggcaaaattaaaaatctgtgatttgactttattggcattagaggatgacgaccaaagtgtggttttgtttgatagaaacaattcggcatctcgtgaacgtagacaaatcttcactactattgatcaaaaaagagatgaacatttggatgatacagtggatttgaaatatattgctatcaattttatccctgaagatttatctgaagaagaactttgggatatcacttataatagagttattcaaagaggagataatcaccaatcgatcaaatcaaaactggatgagaatttggtggaaagtgtcatgaaaggttttattcaaagatatcagccaataaatacttcaagatcccctgatgatcagtttgatcatgtcatacatttaaaattgtcaaaagatgagaattcgctgaagtcgtctttggagaatgttagaatcataattgatgatttggtgcaaaatttccccgatttgattaaagaaaaaccagctgatgaattaatcaatgagtgcttccaaaaagctcttgattataaacccacgtttgttaaaaacatgactgctaatactattaagaaagaccccacatattatggtattgctatgcattattcttcaattctagagaatttagaaatcgtttcccataatgaacattttcaaaatataagatcacacattcaaacggatgcttttcaccgccggaagagatccaagttggttaac

SEQ ID NO: 2292 - DNA, 1794 bp, Candida albicans
ccaacacttctgactacaataataatagtcaacaacaaagtggttcctcaacatcatcagaggaaaaggtcactgtcggtggatgttgccccacaacaatacttggcttctgattctacatttatgtcgcctagaagagctcctcaaccaccatctggtgagagcccaattgatacaagttataaatttggtgctggaagcgaatacgatagaccaccttcacactatggcatgtacatgacacgtactaacgcttcaagtcatgccttgggaagttcatcaccaggaatcaactcacgaccagcttcatcaatttatgatctgttttccaatcataatagaaatggatcatcaacttcaaaacaacaccacaagagaaattcatcagtaaccaacaataacaataacaataacggtaacagcaaccacaagcatcatcacagacgtcattcttcggtattctcatacctttcgtctggtaatgatgattcggcaaaaccaacaccaaaattattgagtagtaagttccaaagtaacaatttgtacaagggtggtgatgatggtcatggagatttcacttcttcaagcaataacaacaacaataacagtaagttagtgtcgccagcccagatcaagagagaaaccactagtggtcaatcgtctcttcatgaatcaggatccaaatcgaaaggaaaatcacaaatttttgatttatccaattcaccagttgatattgatgatgccaagttttctccaaaaaaactgaattccgtatcagttcgcaccaagtcaatggatgcaattggtggtaatggagacgatagacgtgttgctagtgattctacaggattgagtcaatcaaaacctaataattcatcaagacttaaaggcattcgtgccacgtcaactcaaagtttccgaagtttaacagggtcgaagaaactgaaaacatcagcatttcaagaaggtatacgtgagattactcctgatgaagccattaaaactgccagtcatagtggttatatgtctaaacgttcaaataacaatttagcgtggagaacaagatatttcacattacacggtaccagattatcatatttccaatctttgaaagataaaaaggaaaaaggtttgattgatattactgctcataaagtgatacctattgatagtgctagtgatgatactgataaagctgatagatatgctgcgatgtatgcctcgacaacatttgctggtaattattgttttaaattggttccaccggctccagggtttaaaaaggggttaacgtttacgcaaccgaaaactcattattttgctgttgaaacagaagaagaaatgagagcttgggtcaaagcattaatgcaagccactattgatattgatgattctgttcctgttgtgagtagttgttctaccccaactgtcagtttgaataaagctcaagaattgttagctaaagccagagaagaaaccaaattacgagatgaacaactaaaagctaatggctacattagaagtttagaagatatcaatgatacttcatttctggcatctttggattatcctaatatgagtggagatattggttttggtagtacttctccagtagcagcaacttcagcacctaaattgactctcgatactaattttaataggaaaagttctggaactatgggaacaacggggacaataaggtactccagggaacctcacgttggtacggtgcccaccaacccccccaaattccccgaatcactccgtcaaaatggtgggtttgcgtccccccca

SEQ ID NO: 2293 - DNA, 576 bp, Candida albicans
attctgttacttcaagataacttctattacacaacatcaacacagattacaaacattactaattataaaatggccatccgaaatagtcacaaagaatcagcatcagaatcagagtctaataccaatacccacacaagacataccgctggctcatcatcgaattcaaagatatcacaaaaggcaaggaaccaattggcacttcaacaacaacaacaatatttagccaaacacataaattcaaatggaccccaagataagcctaagctacaaccattagattttaccacgtacagcgatactgcattgttgaaatattcagaacgttacggatttcataatttctctcgaattgattctttaaattccgatattttgaacagtgagattggaaagaagacatatagtaaacgaagtaaaaagaatcaaaaggatacaggtagaatcagcaagttagaaattgctaatcatgtgaaaaatcacttttctagtttacctgctaaggagaatgatataataactggttttttgtacaaggtgaagcaccaagataaagagtttaaattcacgtttcaatag

SEQ ID NO: 2294 - DNA, 1041 bp, Candida albicans
aaaaaatatacgcaaaaaaaatcaacactctatcttctctctctttccacctccatactattcactataatgaatgacacatttctaaacctaagcgatagccattgccattttaacccggaatgtactgctagtgacacagagaaatttgcagaaagactcaacgagcaatcaaaacagatcccagacaactactttcatctaatgactactcaacatttggatcttgaatttatggatacattactaaccaggttagagaatccaagagtattagttccatattttggtgtacacccttggttttctcatttgttttatattgaaggtacccccaccaaggaggaacattacaagaatgttttgaaaccagaaccttccaatgaattattggctacattacctgatcccattagtctacacaaacacaaagatagatttctagagatcattaacaaacataaccttgaaatatatggaattggcgaaattgggttggataaactattcagagttcctaataacggctactgtggtaatttgaatttcccactgtcgacagaaaataaattatctgcttgtagagttgatattaatcatcaattggatgtttttaaatttcaactaacattagctgaacaattaaagaaacaagtgtctttgcattgtgttaaagctcatggcttattgtttgatcaagtgaaaaagttttccaatattacagtcatccttcattcgtataccggatcaattgaacaagcacaggtgtggataaaatcgttaccccagaacagactctacttttcattttcaaattggatcaacggagaaaaaatagaggctctaaaagcacttgtaacggcacttcgaccaacgcaaatattgattgaatcagatattgacgttgacagaagtttcattgagcagaggcaaacaaaacactttgaccaccttgatggcatttacaaaaagattcatgagcacatttttatagattcattacaaattcacaacaacatgctaaattctataggcatatag

SEQ ID NO: 2295 - DNA, 264 bp, Candida albicans
agcaccaccagcatgggaaccaccgttcaaaacgttttggaatggaactggcaaaacgaatttacctttcttggcattggaaatgttggcaatgtgtttgtacaatggaatgccttgagcagcagcggcagcattggcagcagccaaagaaacacccaagatagcattggcacccaatttggatttgtttggagtaccgtccaaggacaacaagaattcatcaatcttagcttggtcgacaacatcgatcttggcttttattaa

SEQ ID NO: 2296 - DNA, 1248 bp, Candida albicans
  unsure (1015),(1122),(1123),(1148),(1212),(1226): Identity of nucleotide sequences at the above locations are unknown.
aaatctatcatgttaaaatcaattaaacgttctgattcatatttacttgaaagttcatctagcaacaattcaacttcaaacattataacaacttctacaaacaatactcaaaattcattattaaaaagaaccactaaacccaatgtttcttctactagggctccaagtttcacgttttctcgacttttgtcagaagatacttttaattataacactaatagtaacagcaataatactaatattcataaccctaataataataatagcaagtattccacaattcatggcatctcttcttcaagcagaagaaataattttttaaaagtatgttcttggccatttaccaaaattgaaagtttccatgatagtataacgaaaaatgataatgacaatgatgttgataatgataatattgttgaatttgctgatgatcaatcaacacttggtaatgatgatggtaataccaagcatttaaccattgctgattatagtaatattaaaagaaaaaatttcggtggattaatcagtgacagtaatggtagtggcaacggaatccatgggtataattatacgttaggtggccctaataatggtagtagtggtcccctcactgggatcaatccaagtttagaaaacattaatcatgttgctaatgaaaaattccataaagtgtttaatcgagtgaaacgaccaccagttgaacaaaacaataaaaggagatgtgtgttattatccaatctcaatgagtcaatgggattgaacagtgttttacaacaagtatgtggaggtccattggaaaagttgacggtattatcaaatggcaaaattgaattattcttcatatttcctgaacatgcaaaacaattttatacatatggtaaagccacggggttattaatggtaaatggagtgaaattaaaagttgaatggttgaatgatgagaataatttagttaattctacattatcaagttcattaatgagtgatattttacataatggatgtagaagatgtntgattatttctaaaaatattcctggtaaaagaattagaaatggtgataaaatgttttatccagaaactgaatatcactattcaacaaacttaaattttgaagaaatnnaaaatgatttcaataaatttggtanagttcttgatatgggttctgtcattagtaaaaagttatgctttagtattatcctatatgacatnagatgtgcgatatnagcaaaacaaaattggaattga

SEQ ID NO: 2297 - DNA, 3216 bp, Candida albicans
aattcgggtcccgacaatgatctgttgccggctgtcggcaactcttatgatcgttcgttcagtacattgaaagaaaatgcaatcatgattagtccagattttcttgactttattaacaaagacaccatggatctccaacagtacccaactgtctaccaaacattcttagatcgtcttatttgtgccacaattgacccacatatcaaacaatctttaaaatatcggaagttatcaggaaagaaaatgcttagtgaaattatctctcaatttggttctatgactattaaagacaaggttaactactccataattatggctaccaaaattcattctgatgtcaccactcatttagacaaaatgaatttactggctcaattttacgcatttcttatgcgtcaacctcaggaccttaaacctgcccttttacttattgcgggtatcaatgactcacgtttcaatgaaacatactttcacgataacaaagaattaacgatctctaagttggaacggtatatcattaatcaaaactccaaaattactccgtcggtaccaacaccttctccacgtgacgctgttacgggtttactggttacccagcctacgtccgctctgggacaaagtgaagtgtttaatacacaatgttttaattgctttgggttgggccacactgcacgtcgctgtgcctctccgaaacgtcttggccaaataaacaaccttagatctaaattacttgcgtttgaaactcgatccaaatccagaaagcgttttccacctcaacctcctcctacgaatcggtcggcaaactcaacaataataactaatccctcacctactgacgataccatctcgtccaccactgaagattcttttccacgggacgtctttggatgggcggcatcatctgaccaaatcaaatcaaaggacaacctttctttattttttgacacaggtgcctcggcacatcttatcaataatctcaatctacttcatgattacaaaccctctaaagaaaacaaacatgtgatcactgcgaacggtgataaaattcctatcttaggaactggaactgtgaaactccaacatggtcaacacaagatatcacttcgcaattgccaatattctccacatctacacatcaatcttatctcacccagactcttacttgatgattccactagcatgactatcacccaatccgggatttatcactccaaaattggacaaattgggtattattcgactgaagatggtaatctaatcaagtgtatgttccgtcccattaccattcctcatctttcgttatattctcaatatgtcgaaatgggtcttcaatctaacaatgtactacgtaacattccagctttcacggtccatattcctcaactacatgactcccttggacacacatctactcaacaagtttcaaatgtcatgaaacgtttcaatgtcactactgacaacattggtacggactgcgaaacttgtcggcttggaaaagccattactcagattcccaagatctcaacccataccatctctagtcattgcttagaactacttcacgttgatgttcatggaccaatatccgttcctagtatatttcaagaacgttattttcttgtgatccttgatgactactcaaaatacttgacagttcaaccactatgcaacaaatctgatgctactgccgaaattatcgaattcatcaatcattgggaaaagttctttctgggaaatggcaattaccatacgaaaattctccggtcggataatggaggggaattcttaaacaaaacattgactacctatcttgattcaaaatatattactcaccaaacctccaatgcctatgaacatcatgagaatggcgctgcagaacgagctattagatcggttaaagacatggctcgagtaatattgcttcaatccaaattaccagtgccgttttggtccctagcaacccgatgtgctgcgtttgttatgaatcgtcttcctcataaaacaataaatggtaagattccttatgaagtatggactaaacaacttgtcaatctcaaaatgatgaaaccgtttggctctcaagtatatgtgaaaattcctattggagtcaaaagtttttctgcacaagcactttctggaatcatggtgggatatgccactaataagaaaggctaccttgtatatgatcccacacaaaatcgaatattcacatcctcacaaataatatgtcatccgagcatttatccagcagccaaccttacgtttaacgaacccttaattatctcatcgaaagtcacggctgctcatcttcacccccttaccatttccaatttagttattccacctaccaatgctgtatctgagacacctcttgcaaattgtgtgctctcctcaaattcgtcagtatgtcccaaactttgccaattacaaactgtcttggcacatggggaggataaagtatatgcactgattataccaatatcgatcggcaatatgagacgcacaagaacaaatgaaaacaaaatatgccagctagatgaatcgaacaataccaccataccagatagtgtaattttatcggctaacaatgtgttattaaacttagaatcgagatcttccattcccaaaagttataaggaagctataacatctaatgaaaaatccaaatgggctgatgctatggatagcgagtttaattcattacaatccaacaacacgtggtcacttgaaccactaccggagggacgcaaagctattggtgtcaaatgggtttatacaatcaaggacaccggtcgctacaaggctcgccttgtggcacttggttatcgacaacaggctggtgtggactttctcgaaacgtatgctcccgtgattcgtggagaatcaatcaaactaatctttgcactcgcgtcaaaatccaaactaaagattcattccatagatgttaccacagctttcctcaacggggaaatactggaactcatatttgtgaaacaacctccgggatatgaagataagaagcgtcctaatcatgtttgtaagctcaatcgcagcttatatgggcttaagcagctgccactaatgtggaacattaaattaaatgatgtacttataaaggaaggtttccgtcgacttggtggtgacttagggatatacattagtaaggacaaaagaacaatatcttcacccaggggccggacggaccgcgataaagtt

SEQ ID NO: 2298 - DNA, 897 bp, Candida albicans
ctagctaactccttgcaaattgaaacatttttccaagcagatgagtttttccaagctttggaaccagcacatcattttgtttatggatacggttacttgacctgggaatggaaacaacaattgagatcagctatacatcctttgatctatgtgttggggtataaattagtaggtgataacacaaccctagtgtgtatatctcctaaagtaataaatgcattgattgctgcgattggagagtataatctatacaagtttattattgtctacgatagtgaaaaattggcttggatcactttaatgttatcgttgttcaatccgtttaattggtatgttattacaaggtcattttcaaataatttggaaatggttttcaccgtgttggcattacggttttggccatggaacaagaaaattaacgggagttggtatatcagtctaggttttggatttgttagttgtattatacgtccaacaaatattttaatttggatccccttaggtatttggttattaattagtataagaataactcttaagtgggttgcattgtcatttttagaagtggtactaatactattgataaatactgcacttgattattacttttatcaaaaattgactttcccgttgtacaattttcttgagtttaatgttttcaaaaacttgtcaattttctatggaactgccccatggtatttttacattttccaagccatccctttgatgttgatgttatacttgccattaatgatatacggcttgaagaaaaatatacttttacttactgggttattttatattattggattctcattaatacagcataaggagttccgattcatctatcctattcatccaattttgctttattttacagccagaggatatgtctaa

SEQ ID NO: 2299 - DNA, 747 bp, Candida albicans
tttttgtttattaaaaaacctccccataatttgtttaaaggaatgtgtgacaaaggtataaattgcaaatatgatcatgataaggaaaaaatcagaatttgtcatctatttttattgggcaaatgttattcgaaaaactgtttattatcccattctccaaatgacaataatacgccgcagtgtcgttatttcttagataagtcatgtcaaaaccccaattgcaagtatcggcatttcaaaccggcccattataatgaccccaattatgaaatttggacttgtcggccatttgcaattggtgggttttgcctgagaggtaagaaatgtccgtttcttcatttgttaaattgtccagattttgaagaagacaattactgtgttatgggtagagagtgtccactcacccaccagtttacgctcaaaacacaagatctgattgccacaaagtcaaataagtatatacgagatgaaactgtggttacagaggagtccacgccaacaccagtgaaaacgattgttaatagttatactgttgatcctaaattattgtttgttgtcgatgagactggaaattaccaattctatatagacaacaatggtggtgacaaaagtcaatttgatctgaatttggggtctctgaatgaatttttgattgagttgtctagttcatcggaagaaagtgatttagaggattcgcaagaggaagatgatgaaattgaagagaatgaagattatgtagttctatag

SEQ ID NO: 2300 - DNA, 453 bp, Candida albicans
ttcaaaatggaacaaccagaggccacaaagttaggagccgaagttgttgttggtattcatggtgatgcggaggtcaatcaatacaaggggctaaactacccaataatgaatctttgggaaagatcgttatatgtttggcaaggcagatatgttgatggaataatattaggcgcaccatatgtcccaacaccagagttctttggcaaattgggcaagtctaaggttgttaaagtgtaccacggtccaactgagatagatagaggcgttaatgataaaatcgatctgtgtgtgtacgagacaataggtagacataagtatgacgacatggatactgagtttattgtcaacagagtgttggccgacaagcaggcttatgaagaaagacaaaaaagaaagggttggaaagcagagattgaaaagaaattgcaacaatccgaacagtcacaacaatga

SEQ ID NO: 2301 - DNA, 801 bp, Candida albicans
ttaacaatgtcgtttccacggacacattcaccaagaccatctggttcacgagaacaggaagatctcacactgatgattaaagcttttagagattcaatggaagctaagcttgacttgcattcgcagaagcttactgctttggtagcaaacattcccagaacggacgaagggtttgaagatttatcacaaaggatcactgttcttaaaaatcatcaaaaagcatttttgcccaaacaagaaaaagaaatcggaagtcttctccacagacaaagagaggaagaaggtgatattaaggatttcaaaacagtcgttggtgaagaaaaagaagaattgcaccaggttgaagattgcgttttaaaagatcaagaagaattacgaaacgtcgaaaagaaagttttgaaagaagaagaagatttgcaaaaggtggaagagtcaatggaaaaggaaaaacgagagttacaccaggttgaagactttattttgcaaagagatgagacggtaaagaaacttggagaaagcaatcaatctcaacaggaaccatatacaactgcaacttctggttcggatcagagattcagatctcaacaacctaacattggaaataccttagcgcaggatctagcattaattccaaaattagatctggaaatttgcaaaattgcagtcaaatatccaaaattgtttgaaacaaaattacgaccaccaccacccagagactttcaatataaaattcaactcacagaccacactcaaatttattccaaacgtcttcacctcgggatggacggaccgcgcttagta

SEQ ID NO: 2302 - DNA, 1740 bp, Candida albicans
  unsure (1658): Identity of nucleotide sequences at the above locations are unknown.
attcaattgaaatttttcactctctttttgatttccttcattttctttctaaatcatcatattttaatacgaagcctccccccctcccccattccatatatgtcagtgtttgtagcaaaagttaagaatgttttgagtggagactctgttgttttaacaccatcaaaaacttctcaattcccacctccagaaagactcctcactttagaacacgttagaccaattgatgaattcgaatcaaaagaatatttacgtcaattattaattggtaaagagatcaaattcaaagtctcggccaagattgccaatagagaatttggtgatatttcatctccaatttttaaatctttgattgaatatttattagctcaaggttatgttaaattaagagacaatgtcaatgctgatactgatgataacatttatgaattaaaagaaattgaaaatggggcaagaataaaacaaactggattatggtccgacaaagtcaaaccagtggaaactgtcccacttactcaagacgtcatttcaaaatcccagaaaacccccgtgaaagtcattgtcgaaaaagttatcagtggagatagagttgttggacgtttaattttaaacaaaaaacaacagacacaatccactactttattattagctggtttgaaaaccccaagaactgacgacaccacacagcctccacacattgtgaaagttgcccaacaagccaaacagtttgttgaagacaagttattaactaccaaagcagaattaacttgttcaattattggagaaagtcaaactggcgttccaattgccattataaatcatccttctggtaacaatatccatgaaaaattattggaattgggttatgctgaagtggttgattggcaatccactttagtagggtcaagcaccatgagtgttttgagaaaggcagaacagactgcaaaggcattaggaaaagggatctatgccaatgccactatcaccagaaaatccgtaccaggaacttcgggatccaaattgaaaccaggaaacacaattgaaaatgtcactattgccaaagtcatcaatgctgatactttgttgattagattaccacattcggatgaagaagttaccgttcaattggcatcaattagagcgccaaaaccaaacgatacaactgttaccacggattcggctaaacaacaagcattggttgcaactgccagagaattcgttagaaaccaagtgattggtaaacaaggtacattgtatattgatgggtacagagacgctaacaaagaactaggtttagaagccagattattagttagttttaaatttggaaacacagatctttcagaattgattgtgagcaatgggtttggcactgttatcaaacacaataaggctactcaacatgaacgttcaatgaattgggataaattgattgaattggaagaagaagctaaaaaatcatccaaaaaaggtatttatggagacttgaacaaagttcttactgttggtactagaataatcgatgcttctgaaaatttcactaaagctaaaacttttttcaatggatttaaacaaaatggaagaatcagtgggtattacgttgaatttattccttcaatcagtcgtgttaaattgtttaacccaaaggaaagattganattgactttaattttgggtggattgtccaacaacaagagcgaatccttgaatgacgaaagtgtccaatatttgaacaaaaga

SEQ ID NO: 2303 - DNA, 393 bp, Candida albicans
  unsure (235),(340),(351),(367): Identity of nucleotide sequences at the above locations are unknown.
ttttatctttttatttttgtttgttcccataattgtgtcatgcctgacaatatagaagatcgatccgagataccttctgatgcaaaggaaattgtgactacaaatgaaattgaagcaacagattcagaacgtacaacaaatgtcgataatgaactccgtcaagatgaatccaatgaacaaacaggagatgactcaaatgacaaccttgcatccaaacgtcaattaatcaatgatntattacacaatgatcattttgaagaaagaactgaacgttacatcatccctcaaaatttcttacatgaaattttgaatttgccaatcgaatattttagtgaattanaagatcaactnggtcctattgaatttnactccatacttaatgaaacaaggtaa

SEQ ID NO: 2304 - DNA, 342 bp, Candida albicans
gcgataatgacgatgagtagttctgctgatgaaatagaatacttggctactgaaatcataactaattccaaacctgtttcatatcacaagttttctcgtcaactcaacatccatgtatctaaagccaaagctacattacttgaatattatcaaaaaaacaaaaatgatctaacagcaacgtttattgtgactggcagaaatgacaatgggaaattaatcaaactatcaaatgaagatgatttggagtcagatttgaaaaagttcaccacagttcattgtgttcatgtgtattccgttcacaagaaactgattcagttttctaataatgagcttgcattataa

SEQ ID NO: 2305 - DNA, 753 bp, Candida albicans
  unsure (2),(3),(36): Identity of nucleotide sequences at the above locations are unknown.
gnnaaacataggacagttttattattgatagattanacagcaatgagaagcattaaatcagtcttagttggagatggtggagtaggtaaaacttgtttattgatatcctatactaccaatactttcccaaatgattatattccaactgttttcgataattattcagcctcagttatgattgatggcgaaccaatcaaattaggattatgggataccgctggtcaatcagaatatgatagattaagaccgttatcgtatccacaaacagaaatatttttatgttgtttctccgtgataagtcctgactcgttccaaaatgtcaaatctaaatggatacctgaaatattgcatcattgtccaaaggatattttaattttattgattggtaccaaggtcgatttacgagacgatttgcatgtattggacgagttgacagccaggaatttgagtcccgtcacttttgaccagggaaacaagttggctagagagattggtgccataaaatatatggaatgttctgctgctactcaagtcggtgtcaaggaaatatttgattacgcaataagggcagtgttagacccaccaaacgctaacaaaggtgaatatgttacaaatgacagtgtgccaggaatgggtgtcaacaattccagtggtagtaagaaacataacgaaaagaatgggtctggaacagcaactgctggtactggtaagaaaagaaaaattaagagagctaaaaaatgtactatattataa

SEQ ID NO: 2306 - DNA, 1455 bp, Candida albicans
gtgattatggatacacaggttgatcgacacgtattaccacaatctgcctcatcaaagaattcacaatttcaacaccaacaacaaggtcaagatttaggtcaaggtcaaggtcaagttcattctacagttaatgttaatttagaacatacacaaaaggattcttcgattttcaaagattatgaggaccataattcaagtttaatatttggaggaaatataataaatgatgatactgaattgttaccgacaatagaagatgaaacaattggtgataaaacaattgaagatataactgaagctgatgatgacacgatcagtccatttctgaaaaaacttcaagaaatgattaatcaagaaggacaaaataatgggatacgaacacattctgaatatttgaaatcatattcatgtgaatcttctaaagatggtggcgggaatgggaatgatgatacacaagtattaatacagagacattaccatagtgatgataattataatattgaatcttttaatgatacaattcagaaacagagaagtaattctaaacttttcatacaagacaatatagatactcaagatgatcaaatgggagatacacaaattataagaaaacctttgcccgatactcaaataatagggaaagcattgtctgatacgcaagtaattaataacgcgttacctgatactcaagtaataggaaaggttctacccgatactcaaattatacaaaaagtactaccggacactcaagtcataaaaaaggcattacctgatacacagataatacaaaaagcattacctgacactcaagtgatacccaaacgtctacctgatacacaagtgatacccaaacttttacctgacacacaagtgatacagaaaaacaacatccctgatacacaagtgatacaattgccagaaactcaatctcaaagcttattatattatgattcacaaaaagttctacattcatcacctgcagaccaatcacagatagcctcgaaatcaccttcacataataataaaaataaaaagacttttaaatcccaaacacaagtgttgaatacccaagatttatctgatatatctactagtgaagacacattacaagaacataccactcaaagtgtaattgaaatacaaactgatagtgatgataatgatgatgatgatgatgatgatgacaacgaggatgagaaaattgaatctaattattatgatgattcattgactgctcatcaatttaaacgtaaattgctgttaagtccacaaaagataaaacgaagaaatacagaattgataccatcaagaacaaataaaagtagtctatcaacaacactgttgtcatcgtcattattatcaaataataataataataataataatagggatttccttaaaactcctgggttcagacaatattcagttcgtcttcaccacgcggctggaaaatcc

SEQ ID NO: 2307 - DNA, 1254 bp, Candida albicans
tggaaatttattgatgatttggttgcaatagtgtttataaactacttcactttattcaattatcaacgacaagaactaggtattgccctagacccagactttgccttgataaatcatagttgtattccaaattgttgtcaaattaccaacgattgcaatgaatttcaaattgtcagtacattaccaataaataacggagaagaattaactgtcacatatgtctcattgggaatgccacgagaaattagacagtttgaattattttcccaattttacttccgatgtctgtgtagtctatgtgtgcttgactatgatccatttttctgtattcaatgtaataaatgtggcaataaagtgaaatccccatctttcaaactaattttaacatcaccaaatttgattatgaggcaacatttgtgtaccatatgtttgaataatttgaatcaatcaatctaccccaaaaatatcaaaataaggaatttttttatgtctttggtaatattttctagtaatggtctatcattcaacgatcaagattattaccggtatttgagtaaagaatttgtcagttatattgaaagattcacgctgcaggaattaattagaatgctagtagatggtatacaccaatttgaaatcccagaaatacgcacgaaccttgttaaggagctaatggatgtcgtgattcaagacaaggctttccccatgtattctttcccttttagtattattattcgggaactagacttggctgatagtggtaggcgtatcaaatcactgaaagacgcaattgatagattaagaatcaaacaacagaggctttttggtgtggatattccttcagacttgtcatcaatgctagcatttgataattgcttgtttctagatatggcagatcttctatttgacattataaggtttatcatcaactcagatcttaatcctcaaactgattcaatcttaggtttattcaacgggaacagcttgggcgtattttgccaatgtgccttctatttttacaagcaagtaaagtcaattttcagtgaagaggaaatagaagataagttgattgaaatcatggagatttatgattcttgggtgttgaaccataaactcacattatcggaatgtttaaaagccttatttgagcttgcaaatctaaataacattgttgtaaacgacaataaaatgtctgtgaaaaatgccatgggtgatattgttgatttcagaatggatagggatgattttatatga

SEQ ID NO: 2308 - DNA, 555 bp, Candida albicans
ttattcagagtacttaatctattctattttgctcttttcaactatcccactaacttttttgtcaatatgaaaacaattgaaagtaatataatcattaatgctaaacctgcaaaagtccgatcattctttttaaattatcaaaattaccccagctggaacccatttctttttaagtttgcaaagtatacaaataaagaagatcctgaattgaaagtcggagatgaactacaaattgatttaaaattaaaaggttttaatcataccagtaccatgtacccaaaagttttgcaaaataatgaagatggattagtttggcttggacaattgttaagtacatgggtatttgggggcactcatagtttcaaatatgaattgattgatggtgacaagacgttgtttactcagaaagaagagtttactggtattttagtatatgtgttttatttatttggattattcaaaaagactcaagaatcattcattaatttatatgaagttttgaaagatcaagttgagaataattgttcttcacccactggggctggaaggatccgc

SEQ ID NO: 2309 - DNA, 330 bp, Candida albicans
  unsure (277): Identity of nucleotide sequences at the above locations are unknown.
aaggtacacgaaaaaacattagtatataggaagagaaaaaaaaaaaaaaatgaacaacaaaaaaagaatctcgtttactctctccacgtcatgagcgattcaacgttatctaagatcagtgaattgatcaaattggaagatgatttggccaagataggcagtattagacagcaatttcttaaggagaagtcgtctgttgatgtgaagttgtcgtcgacgacgcaggtgcagattgattcgattatgaagaatttagcgaatttacacaacaccatgngagagactcgattcaataaaggggagtattggggaggtgcaccaagtgcatga

SEQ ID NO: 2310 - DNA, 1308 bp, Candida albicans
gctaaaatagttatattatcaccaaaaaaagagctgcaaatcattcagctaatgtcaaatttttataaaaaatggaaacttcaagatgctttccagatacgcaacaaccttcaaccaacaaattttcactctaccaaatctgcaaagaaaaggttagatagaatctatattgactccaggattcgaagaaagctactaaactgccgacttctagaagagtttaaacaaatctcgacacatagaattattgctatgtctttacaaattcaaaaagaacctatcctaaaggttggtaacccacgttacctgatacctcaatggatgagtcaagatgaaaatataattaaagatttaaataacaatgaacaaagtagtctcactcctttttctaattggaatggaattattaaccggataaaagaaaaggtgatattttatgaaaaataccaacgatatatcagagcatacattccacatgccggaaattttcctgatgaaaagatgcttaaattcagatttaggccctcgtttaacttttccattattacagaaatgcagactgaatctggtaatacagtgcaagacacagaaataatgataaatttagcgacaaaattctatcaagatttgttcctggtagaagatcgacatttggaatcatttacctttgtggaccagtttgacaaaaagatagatgaaactgacaaagttttgttggaaaaagctttcattgaagacaatgtatatgaccattcactaatgatcaataagaaaaatgcagtgggaactgatggcatttcttaccaaaatctcattgaattatggcccagtttaagtgaaagcctcatcagagcaggaaataatattttgaaatatggaacattgccacaacaaatgagtgaagtgattattacattaatacccaagaaactgaagacacctataattgaaaactttcgacctatcagtgtaatcagctgtgccgtacgattgttatcatcagtaatagaaaaacaactaaacccagtcttggcaaaggttattgagaatactcaaacaggcttccttaaaaaaagatccattagtaatagcatataccttctcgatatggttcttacaagatatcaaacttctaaaactgcagaagcagaatcagcagggcttgttaatcttgacttcagaaaagcttttgattcagtacatcatgattttgtattgctagttttacgccaagtaggattagagcctaaggcgacgaacttctttgatggcaacaaccacaaaacaaaaagcaaaagtaaatactaa

SEQ ID NO: 2311 - DNA, 885 bp, Candida albicans
aaaaaaaaaaccaacaactctttctttctctccacaatggatcacaactacaaacttgctttaaagcaattcattaataagaactttgaggcgtcgttcaagttgacaagtgaattgtttcactcctgtttcaacgaatatgccaaccacaccatctcccaaaccttgctcacaaaaataatcaacctatacttggtggaagtgggggtttgcttaaaggatggattgctaaaccaagtccagaccaacgctgcaatcaattccattaccagcaacgaggtcctcaaccagatacgttcggtgtttggcaacgacattccatgtgaaatattgtacaactaccacctagcacacattaccaacccaaaagtgttgattggcgatggatactttgaccagttacataaagattacctgtgcccaaacaacgacaagtacaagccaaagtttatgcacttggtggtgtttgagatcttgcccacatttggaaaatacaaagaagcagaacgattgattactgaccctaaagatttggaaaaactacgcaaaatccaacacctgcatgaggaacagaaggcccagcaacggttggctaaacaaaaccaggaaaaagaaagggcagctgccctcgaacaggcgaaacagcagaccttgaaatacaaatcaattaaagagatccaaaacagctacgaagaggaacaccacgaagttcaaatatcgcagttgtcgtacatctacaaccttgtcaaaacctacttgagagaaaattatttggctgtgttggtggtgttgattctcggtgtcagcgccaacaggtaccgcacacacctaaaagaaaaaattgtcgagaccataaaaatggcatttaaatttagttacatatag

SEQ ID NO: 2312 - DNA, 885 bp, Candida albicans
  unsure (800),(813): Identity of nucleotide sequences at the above locations are unknown.
atgggggtcaaggaaaaaagtgaaattatggaagttttggaatttaatggtgaacagccgacttcaaggaaacagtttccattagaaatttcagtattagtattcagtaagtattacaatgagataatagaaagtgattctacttttgcaaatttggtagttaattcgttactttcaaacataaataaattaccaacaacaacagtaattcaattgattgactacacacaagacaaaaaggtggccgatttgagtgtaatcttgaaaagcttgcaaactagagttcaattcaacgactttattgaagaatacttattccatttaaaagaaaatggcaaattcaatttgaaaacatttgaggagctaattacattggacgaaatacatgataatttgattacatacttagacgagtacatccaactcctttttgaagataatattcctgaggtgcattgctatgctaatttagagtataacttggataggattcaaatgttgttgaataatttgattgaaaaggtggattttgaagatatttccgttgaatcattaataaaactatttaaattaaactgggaaattttgtctgttaataaatgtgaggcatcggcaaggaatggggacagaattttgaattatttgcaggataaaggagagtctgttaaaagtttcatttttaaacagaatctagatgatgaatctttacttgaaataatattggtgtcaggttggagctatcccagtaaggctttggctaaagaagtttcaaactttgttattgcagacgatgtaaagtnttctccctatatnagatttcaactggacgtttatcgtttagctcatttcaaaattcccgtgaccaagatttatttgatcaattaa

SEQ ID NO: 2313 - DNA, 759 bp, Candida albicans
gcttcggtccttccagcgcccgtgggtgaagacgcttattttcaaataccattggatcccaaactggggaaatatactagctttatgctgccaatcggtcaaatggaattttcggttttgcctcaaggctattgtaattccgtactgattttcactaacatccttcataaagtactcaaaccactagctgaaaaagttgtcatcttcgttgatgatgtttgtattttaggtccaaatattcaagagtattcaacactcacagtttcagaacaacaaaaactgcatcgacaacatcttgatttagtgcttcaggtattaaacttactcaaacaagctggtttaaaaattaatccatccaaattaacaattggcgtaaattctgccacatttcttggttatcacatacaacccggatcagttactataatacgtgaaaaatccaactacatatccgaactaccgcttccaactacggtcaaatcattacaacgagcattaggaatctttaattactacagcaagctcattcctgcatattctgtattgtcagctactttatacgatatgctcaaaggtcattctaccacgaaaaacaaaaaacaaaaaagttcaacacaacaatctacccgtttatcctggacagaagagaacattcaacggttcaatcatcttaaacaactattgtcatcacccccaattttagttcccattaactacacagactttttatctatttgtactgacgcaagtatagaggct

SEQ ID NO: 2314 - DNA, 1245 bp, Candida albicans
attatgattttattttcattttcaaataaatctacacataatacccactattacatcaaagataacataactacaatgcacaaagattctttagttgttactcctttagctgacgctccatttggctgttcaattgaattaccaagctattgtcaaaacgatccttctcttttgaatgatgaagattttgccaagcttgatgatgctgttcaaaggcattgtgttgttcttattcctgaccaagtagaattgtctccaaaatctcaatacaatttaacaaaacgatttgatccaacaatcccagagccaaaagatacaagcggtggttatggtcatggtaaagagtttagacatgatcagtctgttttgaagaaagatggttgctctgtgaaatctcaaccacaagtccaaattttgggtcaaggaaccttctctccagatgaaccaggtaatgaaaacggggaaacaattaatttgactcatccttctcatactacattccaccatacacctttgactgaagatcaaattaaaaacaaagaccaaaccagattttatagatggcatattgatagtgccttgtacgatttgtctcctccaaaagttactactttgttaggtattagaatccctcctacagaataccaaaaagttgtttatgaagatgatggaagcgaattgaagcttgccaggggtgcaacttgttttttcagtggggctcaagctttcaagaatttgagtgaagaagataaagaatttgctttaaacaccactgttgaatatgccccacatccgtatatatttatatcctctgctaaggcaacttgggatggtttgacaatggtatcagaggggaaagagcgtgatttcaaagatttgccagaatgggaagagtccaatgtcaagaaattgccaatggtatggacaaatccagtaaccaaggaacatcatttacaagtgcatggatgctgtttatataaattgcacaccaagaaagctgatggatcaatagaaactttagaattgaaagaagctagagaaaaagctcataagtttttgagaccagcaatcgctcctgaacaaatttatgcccatgcttggaaacaaggtgatttagttatttttggaaatagacaagttacccattcagttgtttctgaactagcacatttgggagaagctggtaaaagattgatgcaccaatgtaatattgccagtggcaaagatcctataactgttatttag

SEQ ID NO: 2315 - DNA, 1002 bp, Candida albicans
acgtggatcttccacccgtggcgaatatttggtattttcgtgttgtctacccaagcacacactgtgccaggtcttgattcattgctgctccaagcttccttggccaagagaggccatttgattgactccatctacaatgaattgtctgatgctgaaactgattttattggtacacacttgaaaaacttgaccaactacaatgctactaaatgtgatcaatgtaaattcagaatcaggtatggtagatcattgattgaagaatacccagataagtcacatttagttagtttgttattattcaaacactgtttagttatcaacaacaacactgaatccaaatgtgacaatgttgactttttcgtcagtactgattccaaaaatttccaaaaattcaacgataactttgattctggtattaagcaagttggatctgtcaatttttttgataatgatttcttacacatgctcaagaactttaatgtatccagtgatttggatttagaatattattgttacttcaagggtaaaggtgcttgcaaaatgcctgccactaaagatgtggaagaattgtggggtatttccaaatggtggcccgaaaagaaaccagaacattattctgaacctaaatacaaaaacaatagtgaagtgtttaatgttctccatttctctgacattcatattcaattgagatacaatgttggtgcagaggcaaactgtaccaatttaccatgtggtgcaccagactcatacaacaaacagcttttaccgagcagttacaatttttcaagttactatcaacactttagtcctaatgtggccaaaatggaattttcgttctatccagatgctcattatgacgaaaatagtcagtatattaagggtgattattatgatctcccattataccgtggatggaactttaaaaatgcacctgctactagttttggtgggtaccttactgattctcctgctgtacttatgaacagttcatcgatcagcatg

SEQ ID NO: 2316 - DNA, 1143 bp, Candida albicans
accatgcaagccaatttcttgttagctttcatttgctttgctgctgctgctgttattgctcaagttgttcctaatgttgaacaacttaaagctcaatcactccaaaaaagagacgaagaccttatggaacctgttttcaaaaacttacctagcaaagattatgattacattatgtaccagttgaaacaattgcaaattgctaaaggtaatgtttccaagtgtgaccaatgtaaaaacaaaatgagatttgttaaaaagttgattgatgaaaaaccagagaaagctcatttaactactttgatgatgtacaaggactgtgttttgagtactactccatatatgtactgtacaattggtaactttttcgtcaccaccaaggcttacactgacaaaaaatttgaccaaaaatttgaatctggtatcgatggttacgaagttgtcgactttcttgacaatgatttcttggattttttgggaagattcaacacttcgggtgaattgaatcttgaatattactgtcatgcacaaatgagaagttgcgaccttccagaccttgaagctgttgttgattctttcaacattgaaagttggtggccagaaaaaaaaccacaacattactccgaaccaaagtacaacaagactaatagagaaagattcaatgtcttgcatatgagtgatgcccatatccaatttacttatgaacaaggtactgaagccaagtgttcacaattagtttgtggtcttactaagtcttttaacaaaaaattagttgaacaaaactataatttcaccagtgcctttgctgccgacaatccaaacaagagtcctaaagactttaaattctctttctaccctgatgcccattatgatggacaaaaatacgtcaaaggtgaatattatgatttcccaaaatcgcgtggttggaactttaactttcaacctgctactgtcttcggtgcttatttgagtgacactccagaaatcttggtcaacaattctttgattgaaatggctaaaatgcacaaggacaaaaactttgagtttgctctttataacggagataccgctgaacatgatttgcaaagtgttactgttgacttggttcaaagtgacgagatccgtactgtgctcaccacgcgatag

SEQ ID NO: 2317 - DNA, 765 bp, Candida albicans
  unsure (661): Identity of nucleotide sequences at the above locations are unknown.
actaatctttttgtgacaagtgattcctatttttttgaaataacttccctcaaggttatgtttatggataatcaacagcagacattagtaacaccaagagctcacacgtattatcctaaaatgcatacaacgcccaagcagcatacgagatcagcatcatctagccagagaacaaatttggcaccaccagcctcgaacagatcatattcacaaaaccatttactacccaaccaaccaactactagggagccacaagagaattcaatgttaacttcagataacaaaatatgccagtggtattgctgttcttgcggccaatcttacggttcagtgctctacaaggatgattaccgagaggtcagacccaatggccaaccaccccagaaacgcgcaagaagtttggactcgtcgaattatattcttgatagcttaaagtactacagtcaggtagtttacagagatcataaacatgtcatatcgaatgcgtcattttcggccggttctagtgtaaatagcaatgccgacacaaattactttgattgcaaaacagcaactactgacactgaagagtcacacagcccaactataactccgaacacacccatgttgtcgccattacatctcaaccttaatcacaacagctttattgattaccgagaanagattatattgaatatacctacaatgttcacttgccatcgctgtaatcacatgatgtgcccctattgtctcaaattgagattaaaagaattagatacaagctaa

SEQ ID NO: 2318 - DNA, 765 bp, Candida albicans
agatcccgcaacgtcattggtttcaatcccacgttctacgagtttatcttgcaggttgatgccgatacagtcgtcgctcctgattcagcaacacggatggtggctgcgttcttgaatgatactcgtcttattggtgtctgtggtgaaactgctctgaccaatgctaagacttctgcggtgactatgattcaagtttatgagtactacatatctcacaacctcacgaaagctttcgagagtcttttcgggtccgttacgtgtttgcctggatgtttcacgatgtatcgaattcgctctgcagaaacggccaagccattgttcgtcagcaaggaggtcgtggacgcttacgctgagattcgtgttgatacacttcacatgaagaatctgcttcatctgggtgaggatcggtacctgactacacttctcctcaagcaccactccaagtacaagacgaagtacatctcgagcgccaaagcctggaccattgctcctgaaagttggacagtcttcctttcacaacgtcgtcggtggatcaactccactgtccataatcttatcgagctgattccaatgcaacagctttgtggattctgttgcttcagtatgagattcgtggtgttcgttgacttgctcagtactgtgattcaacctgtcactcttgcctacataatctacctcatctactggctggtcaaggacacatcgacgatcccctacacttcattgattctgtcttcaccacgaggctggcaggccccgcgctaa

SEQ ID NO: 2319 - DNA, 411 bp, Candida albicans
gaattttttcaatcacaaattggtggtgtgcaaactgtggccttgagttataatgaaaaaggtcaattcaaaggttttgctactattgttttcaaatccagtaaatttgcaactgctgcagttgataaatacaatggtgcttccattgatggaggtgctgccaaattaagattagaattaattattgatactagtaagaaaccattggttgccagaattgctccaaatgcaaaggctgctgccgctgctaaaaccgctggtggtaagaagattgctgctgctaaaaatgctcttaataaaaagaaggctggtcctggcaacaaaaacaacaataagcaaaagaaaccaaaacaaaagaagaagactattgaagaattagaccaagaaatggctgattatttcgaaaattag

SEQ ID NO: 2320 - DNA, 594 bp, Candida albicans
acgcggatctctacccgtggtgaagactatgatgatggaatagcacaatattatcctacggaaacccggactcaacaattccctcaaagtaataatggccataataggagccgaagatcttcaaaaagtgatttgtatattaatgagagtggttggatggaacccaatctcaatagtcaaactcacaattataacaataacaattataagaaaatcccaaaatctcgctccacctacagtatcaatagtgctacaactgacttatatcaaatttataaaaatattcccttgagaaatagtgaaatcgatagacgtgatgaagattcaaaatcaatcaagtcgatgtcgaggttaccttcagctagaactttatctatataccagtctgatatgaataggcgaagacaaagtgcttattttgcatcaactgcaaaaacaaatcctaaattgaatagtgatgtcaagttaaattcgcaagagatctatcggatgttgagttcaaagcctgataagccggttttgaaaacccccatgaatgaccatgcagtgaaaaacagtggttttgcagctagaattattttggcctgggggggt

SEQ ID NO: 2321 - DNA, 420 bp, Candida albicans
agagtcacttcaagatgtgttgacactagaaccactggttattcattattatcagtgttgcaattgccacaggttaaccttattgctagtggttcttctgctcgtcatataaatttgcatgatccaagagtaactaccaccagtgatcaaacaattagcaagttagtgggacatacaaactttgtcgttggcttgactgcttctcctcataatcagaatatgtttgcttcatcctctcatgatggtactgtcaaagtttgggacgttagagcggagaaatctttgtacacaataacaagacaagatgggtcaaccaatgctaaaatatttgatgtttgctgggatgatcgtatcggtattataagcggaggtgaagacaaaaagcttcaaatcaacaaaggatccgatatagccaaatag

SEQ ID NO: 2322 - DNA, 486 bp, Candida albicans
aaaatgtcatcaacaggggagaataaaaaccaaataaagataaagttcttcacaaatgaagaagacgagtcattacaagttgctgatactcctctctatgtgcctgtcactcttaaaagatttgggttatcagaagtggttaatcatcttttgggaaactttaaaggtgaagatgaaacaaaagctcctatcccatttgacttccttatagatggtgtgttattacgtacttcaattgaagattacttgacgaaaaatgggttatctaatgaagcgtttcttacattggaatataccagagcaattttaccaccttcatttttggcttcttttaataatgatgactggatatcttctatagattcaattaatcctaccagcaaaaatatcccatcttctcaattatctatatcacagccaaaaattttgtcagggtcttaccaaggggattcttcgtacccaataacaatgtcccgggacagttga

SEQ ID NO: 2323 - DNA, 612 bp, Candida albicans
acatgtcataaatccttctccttcaaatctaaacagtttattcagtattgttgtttttccatcattatcatccactattctctctcgacaatgacaattagtcctaataaaagacaaaaacgtgattcttcatcacctaaaaaacacctcatcctcaatgcatttgatatgatgtgtccatcacttcaaactgcaggattatggagtcatcctgaagataaatctcgagattataataccattgaatattggactaatttagctaaattattggaaaagggaaaattcaatgctcttttcattgctgatgttttaggtggttatgatgtttataatggacctcgtaatttaactgctgctgctaaatctggagctcaatggccaattaatgatcctcatgcaattgttcctgctatggctgccgttacagaatatttatcatttgctattacttcaagtactgttaatgaatcaccttatcattttagtcgtcgattaaccacgttagatcatttaaccaaaaggtacattcggttggaaatatgttttcctcatattttggaatcctgcaccaaaaaatttactccaatggcggtccatttacctgaaacc

SEQ ID NO: 2324 - DNA, 1095 bp, Candida albicans
ttcatcctttgcaattacaagccgaagggattggaaaacttcaaaggggcatacatgcactcggctctttgggatcattctgttgacttcaaagggaaaaaagtcattgtgattggtaatgggtgtagtgctaatcaaactgttcctgcgttactcaacaaccctgattacagtgtcggttcattgacacaaataatgagatcacagcattacattttgaaacccctccctagaatactttacatactttaccgtttattgtcattcaactttattgcattatactttgttcgtttaattgttgtttttggtgctgaaatgagggtaccattgttcaaaggtgatgggtttatctccaaaattgttcgttggataaacacaactgcttccgttagctatatgaaaggtaatgctcctgagaaattccatgatatgattattcctaattacaaaattggatgtaaaagattaatttttgactataattatattccatcgttaaatgacccaagagttgacatcaagaatcaaggaattgatagagttgttgaaaatggaatattattgaaaaatggagaacacattgaagctgatattattgttgcatgtactgggtataatttgagcaaaagttactttaattttgaaattgttggtcgaaatggagcaaatatctctgaagaatggaagaaagatggtccaagtgcttatagaacgcttttagtcaaacaaagtcctaatctttggacaattgggggtaccaattcagctactggacatgcatctgttgtcatggcaattgagaatggtgttgattatttcctcaagactgccaaaccaatcattgaaggaaaagctaaatcagttagagttaccgacgaagcttacgacaactggcttacaactattcaaaaagaattgaaaaaatctgtctttggtactccattcggaggttgtgtttcctggtattctgatgcaaaggtcaattcaactgtctacccttggagtcaatttcattattggtggattacacatttcccaaattataaagatttagtatatgagccattaaacgaagacaaaaagaggagatga

SEQ ID NO: 2325 - DNA, 1116 bp, Candida albicans
cacattacaatacaacactatttaatgtcgaatcaaaaacttgctcatgctgtactgggtgcagttggtggtgcttttactcttggtataacttatcctttaattaccttatcaacaattgcccaaactgctgccaaaaagaaggaagcagaagaagcaagcaccaccgaggatggtaaaaaacctcaaccgaccgtcagtttaacaactttggaaaaaatcgctcatgttatccaaaataatgctgcttatattgctgctaaagaaattcttaaagaaaaaggtccattgggattatattctgggttggaaagtgcattatatgggatcactttaaccaattttatttattattatttctatgaattgacttccaatgtatttttgagagccaatgggaaaaaacgtaatggattaagtactatccaatcaataataactggtgctattgctggtgcattcacttgtgttggatctaatcctttttgggttgccaataccagaatgatgaccgaaaagaagaaggaaaaaactgctactgctggtgatgctgccgatgccaaagaagagaatgataattcttccaattctacttttaaggcattggttaatattgttgaacaagatggtgttggtgctttatttgctggtgtgttaccagctttggtgtcggtcattaacccaattattcaatacactatttttgaacaaattaagaatataattattgctaaagatggtcctaaagcattcactgctgttaaagcttttttcattggtgcctttggtaaattgattgctacttcattgacttatccttacataactttgaaatcaagaatgcatatcaagagaaagaaattgaatatcgataatcaacaacaagatgaagaaaaacaattatccatgattcaagaaattagaaaaattgtcaaagaagaaggattggaaggattatatgctggattagctgttaaattgacccaatctattgccactgcagcatttttgttttatttcaaagaagaattgttttctggtagtgtcaaattgattgaaattttacgtgtgtttagtttcaagaagtcactcaagtctccagttgttcaagtttaa

SEQ ID NO: 2326 - DNA, 855 bp, Candida albicans
aaatatttttgttgcattatgaatgatatagacaatatagccgaaattaaaaagaaactttggaatggttctattaacgtaaaaatactactaaacattgaagatcaaattattgaatatcttttgactattccaagaaactcatattttccaacagttttcccacaactaatacgatatttccaaaactttatcacgactattgaattgagcaaggttcctatttggttagaattcgaggaagtcccactcaaatggaatttaccagttggggttttgtacgattatctatatttgccagctcttttaaatgaccatgacttgggttgctggacgatatctatgaaatacgaacccgtatatccgatagagtacataattccatttaatgaaaaactagcgggggatggacaaattgattatatgaaaacaatgaatcgtattctaatgaatcaattgaaacaatcatgttttgtacttaatggcactgccaaaccaataatgcaattgagtgaagccaacacaaatcaattatggaaatcactaatatcaaggaatttgggtgattttaatgttttaactaaaaagattattaaaaccatcgatatgataccggtgaaaatatatattgccggatctcccattgtggtgcaagcacctatatcgaaagatctaacgttacaggaaatattgtcattgcatacccctaatttatcatcttctacttcttcaatgtctcatccttatattcaaagtattgatgtaacttcattaatgaatcaactgatacgagaaatttggcaattattcaaacatttagataattttttatatattactctaattatcctctaa

SEQ ID NO: 2327 - DNA, 1404 bp, Candida albicans
gataaaaaaatggcaattttttcttcattggcggggtttttcaatagaaataaaagaaagatcttcattactagtgctgttacagtgtctatatacctattaatcaatgaatttgtcattaaaaaattcagaaattatcaaaatgcattgagacaacaattgttgttcaaacaacaaataaagcaacgattcattcaaacacaacaagattgttattacaccatattggcattattaccagtattagctgcccccataattgactcattgccagttgaattaattacccaagcattaaggttgaaaaagaacaattccctgcaacaggtaaccagtggcagcaatagtgaattgactgctgataatttgaaccttttggacaataacaacaacccagaactgaaattgtctatttatatgagcaaaagcaaaactgaattatggaatttattgaaaatcaaaacaattactagaacattaaccttatcatacacagtttctgggttatttttgattacaagattacaattgaacatcttggccagaagatcttatttggagagtgctatttcaaatggctggtgtcaaatccaacaaataatgacattgatccacatggaaaattatataattgagcaaagttacctttcattaagttggtggttattaaataaaggatggtcaaatttgagttccataattgaagcattagtggttaaaaaatttgaaaaaatcactccaaaaacagagttatcaattaatgagtttgagtttgatttaattgaaataataaatgaaatcaactcaaacaataaggaatacattttagccaatcttttccctatcaattattctgatttattggaaactatattaaacaccaactccgatttgatccaccatttggattcaccagagtcaaatttaatcaaactaatcaatgaaactaatgcaattatgttagacaacaacttgtattttttcgatttattaaatgcattaatcatgaatacggtatctacattgacagctaatctttcattcagtttaggagccaataatagcttgaacaatagcttattaatggcctcctccggtaatttggctgcccatggagagaacccaaaagtagtggatatcactcataacgatcaatcatttaaattggccagctttttggcacaactttcggttcagaacaatataatgatagataatgacaacttgaaaactgaggatatactgccaaagcatgagagtgatcttgaagaaatcctcaatagtttgaatggaggtaccaatgaattaccaactgaatcatatggaaatgtgtatattaataatttgaaccagttagaggaattagatgattttagtgctggcatatattccaattttgaataa

SEQ ID NO: 2328 - DNA, 375 bp, Candida albicans
caactggacgcttattttaccttgatatacttatacgatactaaaatggcaattttttcttcattggcggggtttttcaatagaaataaaagaaagatcttcattactagtgctgtcacagtgtctatctatctattaatcaatgagtttgtcattaaaaaattcagaaattatcaaaatgcattgagacaagaattgttgttcaaacaacaaataaagcaaagattcattcaaacacaacaagattgttattacaccatattggcattattaccagtattagctgcccccataattgactcattgccagttgaattaattacccaagcattaaggttggaacagaacaattcctttcaaagtgtccacaacggc

SEQ ID NO: 2329 - DNA, 1218 bp, Candida albicans
ctctcatataaaccccaacattcttacaatttccactttagcaaactctatatcattcagtataccccagccgaccgtattatatcaattgtaatgtcaaacttatatcaaagcttgggtcctcaaggtagagcattattatcacagaatggtcctggaataccttcaaccttgctgggcaccccaaataccaatctgtcaccacaagaactagattttcttattaatgaattaagaaaccctaaaccagatactacaatcaataaggtattaggatatttatataattacattccttatatcagacatgaacataatttacgacttgttatagcaagttttttaaattgccctgtttgttttggtggtagtggtactagtatcagtagtagttttgaatttgagaagaattatttaattattgaagtagtcaagttaattattgataaaaaattgaaaatttcaatgccagtaatatcaatcaaacaattttataccataattttaaaagaattacaaaattttcaacattacaatccaataatgaatagttggaaaattttacccattatcacaggaatattattatctaatgaattgcgtgatcaattgtatactgaggtcaatttcgttgaatataaatggttttttgctaatttagataaagaaatatatcaattgtttaacaatgcattaccttatagtttgtctcaaagtcttgataataatatcaattatttgagtttgatgagtttagccttagtatttaagaacagtgagaggcatcacaaagattccagtgatacagttgttcataccaagaatatcagtaatatatttatgatacagaaattgactgaaatgatatttcttgatcgtaaagtatcaatgttggtgtatcagaaatttttccaattgaatccccataatgaaaacattgaatcagttatactgaatgacattatgaataaaccagtggtcatacatttgaataaactttcatttttacttgagcattatttttcagcattagattttactcagttagaagaccaagttgttggacaaagtttaattataataaccaatttcaacaaacacttgaatcatgaaacaaaaaattatacacttttcaataatttctataacacacctgacgcaagaacaggtaataatccattgacacagttttcaccaccggcctggaaggacaacgca

SEQ ID NO: 2330 - DNA, 198 bp, Candida albicans
tataacgaagaaggcaatgaaaatgactttttccggaaaatattcaaagatgttgacgaagattctagaagagcgatgatgaagagttatgttcaatcgaatggaactgttttgactacaagttgggatgaagctaaagataaagaatttgaggttttaccaccagatgggatggaagtcaagaaatgggatacgtaa

SEQ ID NO: 2331 - DNA, 1284 bp, Candida albicans
ctggtcggcgatgccgaggtgaagactcggtacttgttacaattaaacaataattttgatgaactcaatttattattacgaagttttattgaatggtattttttaacttattggcaaggaacattcacagaaaacttttatggattgaaaagagttagtcaaactcctctttctcaaggggagtataattctagtcgtttgactcaattggtaccatctatgattgaagaaagaagaaaattatctaaattacagaaattagtgtcattatttgaagttactggggtatcatttgtgtctgaaaaactaaattattgttacgaagtatggtataccaaatatgtgaccaatcaattgaatacaagcgatactttaaccacacaagaaaatgtcaaaataaaaataaaacgtaaatttgttgagatatatccatatttacaaagtgcttatagagcagcaaattttatcactacattgttatacttgagtgggtcttcaaaatcaccaaccttgttgacttatttgtttagaatcaacttttctcgtttaaaccaatatgattattccaagaatgaacctaaacaaccgttaaatgattctaaaaaaccaaatagaatacacccaccaacagcaatagagtatattttgatgttgttgagtaataatgtgaccaaaccttcttggaaggcaataaaatttgtgttggggacgtttttcccagtagccattttcacattgaaattccttgaatggtggaataattccgatttttcatcgaaactttctaaaaatttaggtaatgttttggattttactttgccaccaccatcatcattaacttctgcacttagatcttataaaaatgaagagaagaaagacagcggaacagaaataaaacaacaaaagaaaaagcagtacaaatcaggtaaagtatgtccattgtgtaagaaggagttgaccaatccagctataattgaaacaggatacgtttttgactatacttgtatttataattatttggagaaatcacatataattgtatcgaagaaacttcaaaccaaacagaaagatgaagaagacgacaatatttattctgaggatgagagtgaagatgaaaatattgaaaacgaaaagaaagaagaagcaaaagaaaaagagaatgttgttattgatattaacaaaggtggcagatgtccaataactggacgtagattgttaggatgcaaatggaatcccatcaaagaagaatgggagattgaagggattagaagacttatattttag

SEQ ID NO: 2332 - DNA, 354 bp, Candida albicans
tgtttgttaattagtttaagtagtgaatctgtttgcgacataattcactgtaagacattaaagctttttgatctgcgacaatttttcatcaattttcaacaatggcaaagaaaaattgaaagtaaagcaactggaaaaaaatgtgaagaaaaaaaaaatgatggaaaatattcattactccataccaatttttatattacaactactacaataatgtttggcttaggtggtactactcctcaaatttcatctcaacaaaaacttcaagctgctgaagctgaattagatatggttactggcatgttcaatgctttagtttcccaatgtcacaccagatgtatcaacaaatcatat

SEQ ID NO: 2333 - DNA, 480 bp, Candida albicans
aagaataagcaacaacaaactcacaaattcttcttattagaaagattattcaatcactctttttcacatcattatcctaaaatcatgcctcgccagcaaataaaaaagcaagaagtagatgaggttgcaatgcaagcagccattgacgatattaaaagtggtaaaatatcttcttttcgaaaggcatcccaaaagtatggtctttgtgcgacaacattaaggaatcgaatgaatggagttccatcaaggagcattgcccatgcaaatgaacaactcttcagtccattacaagaagattcaattgctcaatggattcttgattctgaacgtgaaggaaccccgagaactcgtaaagatgtgattgaatttgctggattaatagctgcgcaagaagataagccaacaatacatgtcagtgataattggtttgaaaagttaaaaagagaactccggaaattcatacagtcgataaaaaattag

SEQ ID NO: 2334 - DNA, 798 bp, Candida albicans
atgacaccagaaatagaaggaaattgggatatagtgataacatcactccaggatatatgtaactcaaatgaatctttgacgtttgataatatttacaatacgacgccagacgaattgaagcaattatctaaagaagatttaaacaaacttgaacaagagattatagatcaccaatcgaatatcggtactgcaaaacgattaatccccacttcttctgaaaatataacaaaattgattgaaatcattactcctgaaactaaagcaaaacaagcagctcaaaaacaaacaccaacgaaaaagaaacccaatgctgataccaaaagaatcgagaaacgcaatagttcgaaatccaaacaaaccaaaaaagttggtcgttcctattggacatcaaaatataatccactggaacctatatatataggactggaagtggcatataaattaagaaaccgccactctaatgaatggatccaatgtactgtggagaaaataataggtgatggaatcaagtttgaaattaaagatcttgaaccagatgaaaacaataaccctggacaagttttcaaagcaaattacaaagaaatattattaatcccgcccgaagggtcagacttaatcaattacacgtacgggtgtaaagtgttggcaagatatcccgacacttcaacgttttatcctgccatagtagttggtcataaaaaagatggtagagtacgtttgaaatttgatggagaagaggaagtcaacaaagaaaccgaagttgaaagaaagctagtgttgcccacaccagagaaatag

SEQ ID NO: 2335 - DNA, 594 bp, Candida albicans
tcgactattactaaatccataacacttcaacaaaaagtcgatcttgttacagttgaagccatgacattagctcatcaagttgcattaggacaaaaaaacaaatatgatttaattgatgaaggaatcaatagatattcattcagagataaagataatttacctgattggtttattgatgatgaaaaaaaacattccaaattaattaaacccatcactaaagaagcagcaattgccattaaagaaaaacaaaaacaattaaatgctcgaccaattaaaaaagttttagaagctcaaagtcgtaaaaaattacgagcccttaaaagattagaaaaaattaaaaagaaatctgatttaattaatgaagattcagggaaatctgaaagagataaagctgatgaaatttcaaaattaatgaaaaaattgaataaaaaacaaaaacaaaaacctaaaactaccgtggtggtggctcgtggatctaatagaggacttagtggtagacctaaaggagttaaaggtaaatataaaatggttgatggtgttatgaagaatgaacaacgtgcattaaagagaatagccaaaaagtacaagaagtag

SEQ ID NO: 2336 - DNA, 2436 bp, Candida albicans
atgactgaccaagattttaattttgcaacaaccatattaacgtccaagactccccaacaggcggcagcaattatccctaacgtaataactggctccactggattgaacaaggatttaattacatggtttaaacattatagctcaacattggaaaattatacacaggggttacagcaattgattgatgaggccaccaagatagctgagcgtagcagtattggcttcaataactttccccgtaactggaactgcttggtgaatgctgttaagaccgaacacgataacaacgaagctgtcaataaacatttgcgacaggaaatcatcaatccattaagagagttgatagaaaaagatgttcgtatttctgaattaatgattaatggacaagagttgcaagaaataagcggtaacttgaatagagaaggagagatacagtggaactacaaagcaccacaaagttttcaaaatttggaggactttaaaaaaattgaaattcaagtgatgtttgatataattttgaatttcttccaattaaataatggtaaattaaccaaggacttgaaaaataatgagaactccactaattatcttttgggaagcttcaaattggatgcagaaatgcaaaaccaattgaactatttggttaacacacaatttgcaactccacagagaggattacagcagcaaggtcaacatcttgctcctgctgccgtgccaaacaataaacaaagaagaaatagctcatttgccaaactggaaaaattggcatctccaaagaaaccttcaaaactaaagtccaaagttggttcaatttttggcagaaaaaagaagaaggaaaaattcactggagctgattcaattgctgaagatgaatcattatctgaggtttctttgccacctacaagaactaggaattcatcggtgttgtctcgcagtaactcaactagaagatcttttattgaccgcttccatagagatgagtctagcactggcattagcagacaacatgagcagcaccagcagcctttgagtgatcctttgcctcacgcagagaagcctcaaccggaaattccccaatcaccagaagctccacaggccaaatcactagagcctgtatcagaagtacaaaaagaactgttcccacctatgcaaaacgggtccgaaaggaaaggtgaaaatcagcagtcgagagttgatgtaccctctcaaaccttgtcaccagttactcctactcacgatggatttggtggttctgttaaaccattaccagaacctgttgattctccaaatgtgattaaatacaatgactcggacgactcttctacagaagaacgtagaggctcgttacttgaaaaacacaatttagaagtacaacctgtatcttccccattcactactcaaccgccagcacctgtgccacaagaatccagatctagacaaagcagtgatggcatttactcgtttgaagcgggtgatgattccaacccaatctcggctactccaagatccgagcaaaatgtgtttggacagatgccagacccaaatttgtctcctgaaaagactcttgctccaccaccaccaccttcgagaaaagttttgcaccatgaagaaccaactgtaagggattcagctcttttccacaatttacctgctgcctcccattctggaagagattcggtaatggctccattagcaagtcaagacacgggtcattcgttgttgaaaaatgatttcaaacacgaaaacttggcatccaccctcggattgagctcttctattgctgaagtcatcaatgccagctttaaggatggacagttgattaaatcacaagtagttggtgaagtggccttcaattataatggtaatgcttccgatccacttgtggtcactattcctaatagtttcgataaagtactcgtgaacaagacttttattgaggatttaggtctaagcaagtataaagtgaacccaacttcaattacgtctaaaactcttggtgggttgaaatatcttttgaaaccaacacaggtaccagtgataattcaacaaatatggaaatttgaacctcatcagtcaagtttgatggttagcattcgttcaactacacctttggtattggaaaattttgttgtctctgtagctttgaatcaagacattgaagcaacatctgcttcctcaaagcctcaaggtgcgtttaataaagagaaaaacagaataacatggagatatccacagtccctcgcattgaatggtgaagagcgtttgatagctatatttatgactaatggattgggttccgaacatgagtctggtgtgcagattaaatttcaagttaaggatccacaagtcaagtactgtagtatttacagtgagaatggcgaagagattcctacgtttagaaatttggttagcggtagttatagtggtcatctttaa

SEQ ID NO: 2337 - DNA, 2277 bp, Candida albicans
tcattgattccttgtatcatgtctaataagaatcgtaatagaaatagtttattatcatctcataatcgatctagtcatacaaattccactagtaaagatgaactactaaaattgaaatatctgatggaaactcccaatttacccatatatccattaaatgattcatcaataataaattccaaaacaaacgacaatttgaaaaattccccttatcaaaaaccaaaatcacaatcacaaccacaggcacagggccaatcccagtctcaaccagagaactctttggtgtatcctgatttcatgccttggaaagatcatactcaattaccacaagatgaaactgaaattgaacatcaaaaattaagtaatgtatcttatttgaacaaaggttattttgaacctccacaagtggccaatgaatattattctgctcgtaatttgattcaagctacagtatttttatcaactgataattgtacgaatgttataaatgaattatctattcatctttccaatgcttataaatctagaaatgaaataattaataagattaaatttgattctaataaattcaaattgcctactagagttacattaactctgtcaaagaaagaaatttggttgaatgaattaagtaacccaaatgtatcaatgacaaaattgggtgaaaaaattcctcatggaattagaaataaagtattgattgattgtatatgtactaagaaaatccccataaatcgatcaatttggtttacaaaatgtgtattatatggagaattacttgcattaagaagaaaacatcaaaatcgattatcaacaatccccaacaataatagtaacactggtggcggcggtggtggtggtggtagtggtaattcattgacaggtatgatggattataataccgcagaaaaatttgaaattcattggcttcaagaatggactcaacaagtatcggattatatttataaattttctcgagaaatgaataatattgctaatttagatgggaaaaatcaatatatggggaaattatcttatttgttaaattatatccaatcattatatgttgaatcattacttgataaatcattatttctttcattgataatgaagtttttgaaagatggactttgtctacaatcaaaatatattaatggattgatatattctagtatggaggaaaactcggacgactataatgatgatgatgacgatgacgatgatgaagaagatgcaaataatgctgagaatcctgagagcactagcaagtctaagaaaagaaatttagcttggatggatgaaattgatatgaattatggacaacgattggtatctctcacattaatcaaaatgttttggaatgatattttgaaatttgattatttatcgaaggagttgagtgaattgttgtggttgaattatttcttcattaataaattgttgttgttctcggtcaacaatgacaatggtaattcaaccgcagttatacccgatggattacaatccaagattcttaaggtaatatctgattgtgtgagatacttgtttgaatataattgtaatattttcattatacctaatcattggactctcattgaaccatcgttaatgaggattttgttactggattccaaggcaaaatcggaaaaggaacaagaagaaattcaaaaacaattggaattggttaaatatcgtaatgaaagtttaattttgaatttgaaaagtgaactcaataattctaacaacaccaacaatagctccaatttgggaacttccaaaaggtccgttagatcaggatcattctccaattatactacaacccccatcaaaccaatatcaaatacaaccatagaacaagattattcattcatcaatagaaactctgatgatgtattgaacattgttgaaaaattggataacttaaagcttaataaagaatttgcaagttttttgaaaccaacgaaaaaatgcaatgccaattggaaacttaatttgaaagttttgttgttttggtgtgtctcaccatggagaaatagcaccaattcaaatgaagatattttattcatttgcaatttcttgaagaataccgtggttaaatctttgcctaaatccttacgaactgaattcgataatgaattgctagaaattatttaccacattgctgaagataacaatagtgaagaaggggataatttacaatttacaagctctagattatacgttttgataaatgagttatatcaatcgaaattcttcactcggaaaagccaggaacgc

SEQ ID NO: 2338 - DNA, 582 bp, Candida albicans
ccaaaaagcgtgtcaacagaaaatcaaaagctgatttccaacattctcttcattcagaaagaggaaaacaaaccatcagaaatttcacaatacgttcaccgtagtaatgattacactgctcgaaactattggtatgggtacgctcgtcattgcgattcaaccacttcgaccacatcctcgcaaagtgattcgttcaattcgcagcaaataccgcagcagccacaacaacaacagcagcagcagccacagcaacaaaacaatagcaacaattatttgtactatcaaggtttccagcaacccattactaatgctacgactgttagtggggcaacgccagctacttctacacttacgcccgctggaactgcgtctgcatctcttctgcaccaacctcaaattcagaatcccgcatctgcctgtacagtgcctcagcaaagaatggtaatgggcaatatgggctattatcagcaacaaggggctcctcaatattttcctgcacctcaacagtctctcttaggaatcaatgacgttgattcaagaaaccaaattgacgataacaaaccaacccaaccaggcatttaa

SEQ ID NO: 2339 - DNA, 1377 bp, Candida albicans
tccgttgcttctattttttttttccccacattcaatcaccaacgatttaaacctcaaaattataactggcctttctttcactctcatatatatatccttttttctttcttgtttgatttgtatcctttatacatattcaatctaacacctcaaattccacaagtcatgtctgctccagaacttactgatattagatctcctttagatataaacaaattaaaagatttgcttgcctcagccacaacctcacaatctagtaaagtggttttgggtcataaagcaacagttccgactacttttagtgaaatcaaacaatttacatttggtcaatccaatccaacatattttctttctactccagaagggaaaaactatgttttacgtaggaaaccatctcctaattccaaattgatttccaaactggctcatgccgtggaaagagaatttttcattttgaatgctatcaatattttgaattctgaatcggacaaccttactgtaccagtccctaaagttcatttgttatgtgaagatgaatcacagattggttatgtgttttatattatggattatgtaaatggtattcaaattaagaatccaagtatgcctggtattgaagaatccgatcaaaaacaatattggaaatccattattgaaacaattgctgccattcatttattaaatgtcgagaaattaatctcattattaccaaaatctcatttcccccaatttcaaaatatcgagaaattaaagagtacctcttattttgctcgtcaaattaaaaccttgaataatattcacaatttacaaagtcaacatgtaccaccaattcctgattttgataaaattaccggttggttacaaaaatatgctccacaagatccagataaattgactttgattcacggagatttgaaaatcgataatatactatttgatccaaagtcgaaaaccgtttgtggtgtcttggattgggaattgactactgttggtaatccacttttcgatttggctaatttcttacaagcattccaattacctaacaaattgaatcgtatgttatactatcctcaaaaaaccgaaatgggtgctgaaaataaaaactcaacagcatttttatacgagaaattgcacgaatatgaaaaattggtgacttggtccaagactgattcgaaaaataatccatctgaattatggccaattggtcatacatttgggttgttacgtctttcagttattagtcaagggatcgccatgagagtgaaattgggtaatgcctcgagtgctaatgccaaaggttatgcttccatgtatccatatttgagtgaattagctatggaaaatgttaacaagacaaagaaaacttcagttttatag

SEQ ID NO: 2340 - DNA, 453 bp, Candida albicans
atgtcttcatcttattatttctccattattggaactaaagataatcctttgtatgaattagaattttcttcgtttaaaagtgccaacatttccacaactgataatgtgccaggaaaatcgcaattcccccaatcaacgaaagaattactcccgtttattgccaactcatctttagatcttattgatgaccaagcattcaccactaatgtattgaacttgggcaaaatagatcaattctatggcttatctataaatgcatatgttctacaaagtcaagttaaatttattctttgttacaactcaaaggaggaaagcacaatcaaacagtttttccaagaagttaatgagttatatacaaagtgtttaatgaaccctttctacaatgtcgatgatgcgattgtatcaccagatttcgatttgaaaatcaaacagttggctagaaagtatttataa

SEQ ID NO: 2341 - DNA, 732 bp, Candida albicans
tctatcattattcatagtcctcatatgttgtctcatttcaaaactgttttcacttcttcctcctcgtcttcctccacagaaccaaaactagctccaaagggtaaaaaagtcacgggcaaccataaagatttaattccatatgtgaaaaatgatatttccattactaaatcacaactcaaaaagtatagcactaaaaaacaactgatcaccaaagtcttacaaccaatggacaattattataacttcgagaagcaaaaattagaacaaaaatatagttataacaatctgaatgaattttatggtgaattatttaatctatacagaaaacaacttgatgaatgtagtgaattattagaattagctcaaaataattatactcattcattatatcaacatagtttggagaatcgtaaatcatcaaatgcttcaagaagtaattcagtattttcaagaaattctttaccaaccacaacttcctctactgaagactgcacatcacttgaaaaagaaattccagatcatttattagatccaatatcatttgaaatgtttaccaatccagtgattacaccaagtggtataacttatgaaaaaactcatattttagaacatttaaaaagacgtggcaaatttgatcctatcacaagacaagaattgactgaagatcagttataccctaatcttacaataaaagaagcagtagatgcatatagagcatcaagtctgtcataa

SEQ ID NO: 2342 - DNA, 1482 bp, Candida albicans
aacaaaacatggatattttctgaagatgccgtgatcaataattcaccgactcgacatcaaaaactaacaattagtcaagagttgaaaaataaggaatcgatgcatgattttttaattcgattaggacaaaaattaaaagttgatggtagaacaattttagcagcaacaatatatttacatcgattttatatgcgagtgccgatttctcaatcaaaatattatgttgtttcagctgccctcaccatttcatgtaaattgaatgataattatcgaactcctgataaagtggcattactttcgtgtaatgtcaaactaccaccaaatgctaaacccatcgatgaacaaagtgaaatgtattggcgatggaaagatcaattattatttcgagaagaattgatgttacgaaaattgaattttgatttgaatttgactctaccttatgaaataagagatcatatttttaaaaattttatgcttttggatcaagaagacgaactggtgaaattatttagtactcataaattagatattttgaaaatgacaacatctttaattgaatctttatctagtttaccagttattttgtgttacgaaatgaatataatgtttggaacatgtttaattataacaattctagaaggtaagaaaatcattgatgaaaaattgaatattccaactgcatttctatacagatttttggatactgattcagaaacttgtttgaaatgctttcattttatcaaaaacttattgaaattttctcaagatgatcctcatattatcagtaataaagcaagtgcgaaacgattgttagatataagatcaagaacatttcatgaaattgctaaacaaggagatctcaagcaaccacaaccacaaccacaacaacatgaaaatgaaaccacaaccaaagagaaaaagccagaggataaccaaggcgagggaaacaatgctacagagaagattgaaaacggtcatacaacaaacagcacaaacacggaccccaaaagtcaagataataaagtagatgagattgacaagaaggaagcaaaggagataaacaaaagtgaaacacaagatgaccatacacaagaaagaagcactatcgctgccgagaataaagtgccagatacagaaagcaatgtaacaaaatctgaaatcacgaaatctaacaatgagattatggctgaaaagaaccccgacgtaaaaaatagtaatagcaatagtgatgacactggatacacatctaaccagttagaacaaggaaaagataccaaaaatgaagaattagaaaagacacttgattctgaaaagatttctacaccaaacaatggtaccactaccaacaagcctgctgctgatttacatgattcaaccaacggcacaaacgaaaattctattggagaaaaaagagttcttgaacaagattcaaatgacactaatgtagactcaccaagtagtaaaatagcaaaagttgaatag

SEQ ID NO: 2343 - DNA, 534 bp, Candida albicans
atgcggaccttctacgcccgtggtgaagacgctgcttggtttagatattttgaatttgtcggacttagtttctttttctattggttcttttacttgttggtgtttaaaaccattgaaggtggttggaataggtttaattatgttatggtgagtcatataacaacaatgttggtccatgtacaaattacattatcacatttcgccatgtcgacagctgatttgggagtcagtgaatcattcccttcaagacaagttagaacaactatggacgttgattgtcctgaatggttagactttttacatggaggattacaatttcaagctattcatcatttgtttcccagattaccacgccataacttaagaaaggcacaaccattcgtcattaaattctgtgaagaagttggattaagttattcaatttatggttttggtgaaggtaatgaaattgttataagtagattggcagacattggtaaacaatgttcaatattcttagatgcaacaaagcactatgaaggggatttatattag

SEQ ID NO: 2344 - DNA, 735 bp, Candida albicans
caaaatttgttagcaaaaaaatttttgccatcttttttccgcgtttccattagtatggactttcaaagaatcataatcacattaataccaaaacatgggaatagtataaaggaaatcaacaatgtccgtcccatttcactcatcaattgtgcattacgtcttataagcagtgtggtaaatagacgtatccaaaaggcaatgataaattcaaaaatatggcacaacaatcaacatggttttattccagcgagaactatacaagatgtcacacaaaaattagccaccacaatcgatgccatcaggcgtgataccagtagcaaccatgcggttattttaatcgatttccgtaaagcttttgacaacatcaactgtttatacttgttactaacattaacaaaactcaacgtcgatgacgataccatacgatactgtatggcagtcatggcggaccatttcggacaaatacaactaaacaaccggctttcgagtctgttcaaattgggaaagggagtacgtcaggagaaccctctatcgcctgcacttttcaacataggattggaacctcttctccataaaattgatcaaacattaacagcagtgaaattagaaaatgggtattctgtaaatgtgttggcatatgcagatgatataacaattttcgtcgacaatgaagggggggctaacttgttgagaaaattttacacgactttgaaaaaatttctggtttacaaataa

SEQ ID NO: 2345 - DNA, 1149 bp, Candida albicans
atatcccatacacagaagacagattacaagattcccaaaggtgatccattcatagtgttaaaagagcttaccagtcatgttagagttattcccaaaaccatcaatctaacaaatgaagctatgtcactgaaagatttagataatcagattttatttgaaaattttatacagagaatagaggagaagattaaaactggtagagagttgatcaaacaagttgcaaatgccaccactttaaataattatcataatgtgataccagatatagaatcagatgttgcaaaaagagaccagttatacaaaccaaatagacgacgcgatatcaagcaggtttccagttctataaaacagtatgagtcgttcacgttgattaacaaaagatcatttactggtacaaatacaatttcaggggctttatatttgtccacgcccaaagtcaattacatcatagactatattccacctaaaaagtatagaacacaatctgatgtgaattcatcttggaaacttgttatacctttgaagatctcaatcaagccatttgagacccctatgaagagtcagaacctcccaaccatcaaatcaattagtgctgatatggttgtggtcactataaaatctcccaaatatccaatcccaatagagtttgatcatggtatgctttataataatgatacaggtcaaccatttgatgaaacactgttcaagaataacattgttgagccatttaaagagtatgctttagaattgtatcagctttcccaagaacttggagaaaataatttcaatattgaaagacaattaagtgaagatattaaatccatgtgtcaattacaatgtaaaatttcagaattacacgtggccaacttgaaaataaatggacattcatggaataaaaaaacgactaattggtctatttctagcaaagaagcaaatgcatctgtagatgtcactatcaaattagaatatttatctcatcaactattaaaatctttacctgaatcattgaaatcttataatagattcaattttatacctgatttccaaagttgttacatgagtagattataccatatcaatctcaatattgtgttatcatgtggcaccaaatgtcaactaagaatcccccttagagttcaaaagagatga

SEQ ID NO: 2346 - DNA, 219 bp, Candida albicans
ttcatattaatgcaactggggattcttatcgccattgaagatcaagttcataaatcattatatcaatttaatataaaaagtctcatccttaaagaaactgttttaggatggtttggaagttctaatcaaatcgatgatattactagtttaatccatgatttttattcaaaggggattgatagagcattccacattccatgccatatatttaaatgttga

SEQ ID NO: 2347 - DNA, 1299 bp, Candida albicans
  unsure (83): Identity of nucleotide sequences at the above locations are unknown.
attgcatttgcttactcacaccaatttggaatcatgacccaattgaaaaaacttcaattatactatgatgtacacggatctantacattgtcacatgcgtacaagtatttttctttggcaatctcaaagttgatgtatactagacgtagctcgaatgttgccagttgtgttgttaaatctcatgtacaaaccagatacaagattttggatattaatgggtataaggaaatgctgttggcagacttgatcaaatcaatttcatccttgcctagtgatgataagcgactcaaaaatcttttgttaagaaattatcttcaattcaatttgatttatttgacggttcagagtggaatcgaaattgttgatgatttagtcggttgtgttttgagacaagaaaggtttgttgaaaaaatgaatacaacgctcaattggctacgttcaccattcatttatcaaacattatcagaatctgcaaacaggtatgtaaatttttttcacatgttgacgtccagtgacttgaaacgaatgcttgtccctactttagatatcgatcttatgtggcacactcatcaattatggaattatggttatttcaaagattgtttggaatcaccgtgtcatacggggattgatcatgatgatagtgttgatgaaaataaatgggacggtggttatgaatacacatgtaaaatgtatcgcaagttattcaaacaggaatattcagtttgctattgtcatccttgtgttgtgcgacgcatggctgctgctagcaaattctcaatattattgaaatctggtaataaacaatcacaaccagaggaaccagcaatcattaacaatccattattcagtaaagatgaagggttttcacatatcagtacccataattctattaaattgccaacatcacgagcggaactgaaacgaaaaaaatctattacagcttcaatgttggaaaaagatagaaacaactcccattactattattatcataattcttcgatgtttgttatggcacctggtgctccagtagattcagcaaattctgaattgtattctaatacgttgtgctgttctattgctaactctacaagttcatgcggcaaatgtggtgggaaatgcataggcggtagcggttgtggtaatggttgtggtagtactggaggttgtgttagttgtggtggcagtagtagtggaggaggtggtggtggttgtggtagtagcagtggaggaggtggtggtggttgtggcggtggaggaggtggttgtggcggcggaggaggaggtggtggtatttga

SEQ ID NO: 2348 - DNA, 948 bp, Candida albicans
  unsure (7): Identity of nucleotide sequences at the above locations are unknown.
gacgaantacgcaaacttcaattgtaccacgatcttcacaactcaaggcccctcccaaatacttataaatacttttcaccagtcctttgcaatccaaaacaatcaagagatcctggcgtagctagtaacaaggttaaacaggctgttatgaaacgttggagctcttccaaacctgtttatgcgatcacaaaagatgtcgatggagggttgggtgattatgcacagtcgaatcttatctgttatacagtgccccgtggtatggtgattggtgaggatctagttggctgtgtattgcgacaggaaatatttaccatgaaaatgaacagcatggattggttgcactcacctattgtgctacagagcgtatctgagtcgttgatcagatatagacggtttttcctgatgatgactgataataatctaacacatatggtagttcccacattggatattgacttgatgtggcatacccatcagctatggatgtatggatatttcaaagactgtttgtcttcatcgtgccatgccgtcatcgaccatgacgataaagtcgaggcaggagaattagatgatggttttctgtttgcttccaaggaatataagaaaaggtataatgaagactattcaatctgctattgccgttattgctcgagccacagaccagaagtgaagcttctgttttggaagtcgtctttgaaatcacgaaagaaattggaaagagaaaagttttcattagttactcatccgttgttcagtttaaatgaagggttgtgtcatataagcacacataactcaatagttttgccccatgatgctgctataagtataagattggaaagtgatctaccatggaccaaaaaacatttccatttacaagacccagcaaattatgttgttgcaccactggtaccagcaggggccttaatcttttgtaaaattccgatgtag

SEQ ID NO: 2349 - DNA, 912 bp, Candida albicans
cgatttgttgaaaaaatgaataaattagattggttacattcacctttgatatttaaaagtaaacaagaagctgttttgagtaactcacgattctttgaaatgttaactgatgcaaacttacgacaaatgttggtacatactttaaacatagatttggcatggcatactcatcaattgaccatgtatggctattttcgagattgtcgagggtcagcagtacacactgtgattgatcatgatgataaagtagacgaagggagattagatgatggattttcattcacagcaaaaagatataaacagttgtataaagaagaatactcggtatgtttttgtttatactgtacttcaaaacggtccgatagtcttagtaaattcagccagtttttcaaaacaaaaaagcaaacgaaaaaggaagaatattttcgacaatcacatccattgttcagcaggggtgaaggtttttcacacattagtgcccacaactcggtgagattaccaacagaattggctagttcaagaagagaaaagacaccggctccatgggctgataatacgtatttactttatactactcctttgctttttgttgttcctccaattgctccaataactgaaggtcaatgtgacttttacggtaatggcttgtgcacatcggcaaccacactgtgttccagtattggtggtacatgttgtaacattgctccttgttcaggtaatggtggtgctgcatgttttggtactggactaaaccccagtaattatggccacgcaagaattggtggtagtgttgttgaaataggtggtgtatgtggtgccgacaataattccacttctgcgggttgtgtcggtgctagtggatgtagtggtggagctgctgggaattgtactggcggaggaagcgggttttga

SEQ ID NO: 2350 - DNA, 2043 bp, Candida albicans
tataaaccacaattcactatggagaggctgaataaatttattgacatcctttcaaattcaaacccacacaccaccccgttagatttcctgagttatagatatatcgacacaccattagatccattaccaattgacactaaaacagttcaaccaccacaattcatacccacaatcaatgaagcaattgttcatttaaaattattaaaggctttccaagtcatgaaaaataaagtattaattgattatgaaacagatgaagaagaatattgtgagaaacgttggcaaagttttataactttagctgttagaagattcattatatttgtttcggcaatacgtgtaaatgctcctggtggtcaactgggtcctggaacagaatcacaaatattcaataatgctaacataaaacaagattcttttgtaaagtttatgaatgatttaatgccaccattagatgtaattatggtatggcattcatttttattgaatccaaaaactttctatgatacttgtttaagaactaatgttttgaggtttgctaatttccccttacctttatataaattaaatcaattcattgataattatacttttgaatttaatgttaaccccaccccacaggaaaattatttaaatttaattaaatcatttactaatgatgaaagagattatcaatatgacatcgctaccaaattttccttatataaacaaacagtgagattttattgtcctgggtgtacaaaagtgttaactgattgggtaagaataagtgatgaaaatcaaatggggttagctgatagaaatttaagtgttagaaaattaagatcacgatcattcgtggtggaagaattacccccatcaacatgtccttgtattaacatttatatgataactcatgaatcacttcgaatactccatttgattattgatgcaagaagaaaatatcctttactccctgggactttcaaatatttctccctggttatttgtaatccaaaatattcagcacgatcaccaacaactcttagtgaagacatttgtctagcagtacagaaaagttatctggcaacaaaggatttaacgactataataaatgatatccctaaagaatatgccaatgaaactactcgaagaagggtcattttaagaaattatcttcaatttaattatattagtgctacggtggaaaatggaatcgaagttggggaagatttggttgggtgtgtattgagacaagaaaggtttcttgaaaagattaacaaaatggattggttacattctccattaattcatgaaagtttactggagtcattaatacgttataaaagattctttttgatgttgacagctgaccggtatagattgaacatattggtccctactttagacattgatttattgtggcatacttatcaattgtcaatgtatggatatttccgtgattgtcgaacatcaccttgtcattatgttattgatcatgatgataaaattgatgagaatagattagatgatgcgtttgcacgtactgctagacgatatcgacaattattcaaagacaactattctatttgctattgccaatattgtacaaactatcgaaccaaatacgccaataatgggctcctaaccttatttcagacgaaaaagaaattggaaactaaagaaaatgctataagaaacaatccattgtttgacggagagaaacaaggtggtgtgactcacattagtgttcacaattcaattcaaatgccaacaaagaaggccacaaagagacgtcagaaaaaccccgtgccttgggagaataataggatagatggtggtcattatgtggttgtacctgatgctcctatcacgactgaccattgtcaattctatggcacagggttatgtaactctgtgaatgctcaatgtgttagtgattcaggtaaatgttgttcgtttgctagttgtacatcatttggaggttcagcttgtgtaactgatagtggtctggcttgtggaggagatggtcgagacggcggtggttgtggtggtgattactaa

SEQ ID NO: 2351 - DNA, 1992 bp, Candida albicans
attgatataagcatggatccaccgagatataatcaggcattagattatattgctattcttgagcaatctgaccccactgcttttcaaagttataattattccattcaacacgaatacccttcaattcaacgagacaaggtcacccaaatcaactccaaaggtttaccaacgattgctgatgttgtggcccatttgaaattattgaaagcttttggtgcattgaaggcaaaagttcttggtactaccagtgtaatcaaagatcttaacccagctcaacacaaatactggcaagtgtttcttaccaacgcagtaaggcgatttattatatttgtttcagcgttgaggaaccattgttgcggtacagtgtcgactgttgtcagagaagatactttttttaaggtcataaagaataaaaagttcgaaagtatgatgagtcagatcatgcctcctttggatgtgattatggtatggcatgcatttttattgaatccgaaaactttctacgattcatttaccagaactgattttattgtgtttgccaaatatccattaccgttggatagaatccatggctgtattgacaatactacttttgaatttaatgtaccagagatttatcgagaaaattactcaagtttgttgcaacctttcaccaatgatcccaatgatttgatttttgatcccattgacgacttactggctgttaggattactgataagaaagtcaaaatttattgtccacggtgtcaaaaaccattaacgttgtatctggtaccacttctgacaacactggaaactggatttgctgatccaggatttgaagcatactcgatagaagacattgacgagcaaatcagaaacaacccacatttccaggtagaatgcatttgcttgcttacgccagtttggaatcatgaccaattgagaaaacttcaattataccatgatgttcatggtgatactgagttgtcacatgcgtataagtatttttcttcgatcatttcaagggtaatttctattagacgtagtccttaccttgcaagttcgagtgttaaatcttatgtgaaaaatagatggaataacttgcagcttaatatgtataaggaaatgctgttggtaaacttgatcaaatcaatttcatccttgcctagtgatgataagcgactcaaaaatcttttgttaagaaattatcttcaattcaatttgatttattttacagttcgtgggggtattgaaattggtgaagatttggtggggtgtgtgttacgacaagaacgatttgttgaaaaaatgaatacaacgctcaattggctacattcaccattcatttatcaaacattatcagaatctttaacgaggtatggaaattttttccacatgttgacatctagtgacttgaaacgaatgcttgtccctactttagatatcgatcttatgtggcacactcatcaattatggaattatggttatttcaaagattgtttggaatcaccgtgtcatacggggattgaccatgatgatactgtcgatgaaaataaattagacgatggttatgagtttactcgcaaattgtatcgcaagttgttcaatcaagagtattcaatttgctattgtcattcttgtattatgcgtcgatctgccaccaccaacaaattctcattttggatgaaatctggtagtaaacaaatgagattagaggagaaaacgattgttaagaatccattattcagtaaagatgaagggttttcacatatcagtacccataattctattaaattgccaacatcacaagcacaaatgaaaagaagaaaatcaattactgcatcttcgttggaaaaagataggaacaattcccattattattaccttcctaattcttccttgtttgttatattacctggcgttccagtagattcagggatgtatgcattgtatgctaataatctctgctgttctattgttattcgccacggggctggaagatccgcgtac

SEQ ID NO: 2352 - DNA, 1788 bp, Candida albicans
cttaggaccttcgactcgtctggtagaaaaaaaaccgttgttattcaaggtaaagcttacgatgaaccttccatgtttaaccttgccaatacaaaaaattcccaattggttgctacaattaatcaattgctaccacctttggacgtcattatggtctggcatgcgtttttgttaaattcaaaatcattttatgacacctttgtgagatgcaacttattagactttgctaatgtcccgttgccattgcataatattgtcgcttgcatagatgatttcagttttgaatttaaagtgtctcagcaattcaagcgcaactatttggatttaattaaaaagtatacttcatattcattggatttgcaatatgacataaatgaaatcaacctgtatggtgatgagaagttgttcatttactgtccaaactgttatgaaaagctttctgagggtatttcttggataaacaatgagaatactggattttcaaattcagatttgaatgcaacaaatattaactttgcgctgtcttctgagtgctactgtacaagttttccaatcattacccatgaagaattaaggaagcttcaattatttgctgacgccacaaaggctggtactttacaaggtgtgtataagcatttttcgaaggtcatttctgctcctgggcttgttgaccgagacccactgaatttgagtattgagatggcactccgaattcaggaaatatgggaagaccacaaatttgaagatctcccaaccatggtcaaatctattatttcacaactcaaaaatccattgactggagttttgcttatggaatatttaaacaaccaaacaattagcatgactgtccctggtggaattgaaattggctatgatttggttgctgcggtcatgcaacaagaaagattcataaacaggatgaataacattaactggttacagtctccatttattaaacaaatttcaactgattcttgttcgaggtatgctaatttttttacaatgctgtctgatcctcgtttgaatcaaggaatattgattcccacattagatatcgatttggtttggagaactcataggttgcatttatccggctatttctttgattgtcgtagttctgcttgtcattcaatcattgatgattcacttcatgaaggaagattggacaatagcttcaaaacaactgctgatgcttatcagtcccgatttggggaatcctataacgtctgctactgtcagcaatgtttaatttcaaaatctgacgctgcagaagtaccagcagccaatgagcatgttgttgaatccaattttgagataaaatcattatttgactttgatgcttcatcatcatttgttggtgcaacatctgccaaatctggtaaaaataaggttgcaaaaaaaagacctaggtccaaatcgagttcaagtttgagtacaagtttgagttttgattcaaacagttacttcacacttgatactataatgaacgatccgttaactccaattgaagaaaagttggaggatttgatttctcctgtttcctgcagtgggctctcctcgcccagtttgatgccacttagtttatatcattcgatttcaagctctgatttttcactttttgatgctggtactacagttggtgaagattcaagttgttcattaaatgatttcgatgttggtgttgatgatcaggcaattacctttgatgatatacgaaacgaactattggattcaactttgtcaacattttttggaactgttccagagggacaatttaactttatttag

SEQ ID NO: 2353 - DNA, 2127 bp, Candida albicans
caaattttttgcaaaatggtattaaaagatgataacccaccaccaccttatcatttaatttctaaagaagataatcaaaacaacaacaacaacgatagcaataacgacgatgacatagaggacacgtctgaaccagtatcacaacccaaacttgaagatttccgaagttttaaatactcaattgagtcgattttcctaaaatttgacaaaactaaagttcaagatcctaaattcattcccactactactgaagctttagcccatttgaaattattaaaagcgtttgcagtcatgaaaagcaaagttgttagagatgcagatgctcccaaagactttcaaatcaatcaatggaaatcatttatcacaatggccgtgagacgattcattatctttgtatcagcattgaaaactttatacattggcaacaacggaaagacaactcatagatcttttgaagagttgaataaaaaagaagaatttgaaaatgttatggcacacttgttacccccattagacgtaatcatggtatggcatgcatttttattgaatccaaaatcattttacgatacattttctagaaattcatttattgattttgccaaatatcccttaccattggatagaattgacttctatatcaataacgaaacttttgagtacaaggtctccgaaacttatcaaacaaattatattgatttattgaaaaggtttaccaataatggtagtgatttgatatatcatatgaataattttataatgtatgaacaatatgtcattattaattgtccaacttgcaaaattgctatatctgatcctattccattagttactgatggaaataaaggatttgctgattctgaatttatggctaagaaaaaatatcaacaaaagtctattgattctacagattgttattgttctcatatcgaatatcttacccatgatcaactaagaaaacttcaattatttcacgatatacatgcttctgaaccattaccaggtataaacaaacatttttccaattttttaagtcatccgagattttcaaatagaaatacatcaataatcaattatactataaaagatgaagctaaaaaattttgggacaattccagcattagtgtttcgacagtaatggtaagtgtgatcagtgcaactactaaaagcagcgatattaagaaagctattctacgtgattacttacaattcaatctcattcatttgactgtacctaataataccatttcaattggtgaagatcttgtcggttgtgtattacgacaagaatcttttgtcaaaaaaatgaacacaatcaattgggtacattcaactacagctcaagaaaaattggaaacctcattggtaagatatcaaaggtttttccggatgttaactgataaaaatttgaaaagaatgttagtcccgactttagatatcgatttaatgtggcacacgcaccagctatggatgtatggttatttccatgattgtttaaactcaccatgccattctgcaattgatcataatgacaaaatagaagaagcaaaacttgataatggatttgaatatacttctaaagcttataaaaaaaaattcaaggaagattattcgatttgttattgtcaatattgttctgaattgcgcgctactaaaagggaaaaaattaaaagctttttcaaatcaagtagatctgacgacaagaaattatacagcacgtttaaatcagcttcaagtgaaaaccctttggtattagagtctccatcacatattagcacacacaattctattcaattaccaacacacacggcagaaacacgtagattaaaaaaaccagtgccatggagtactgctaacagcaattcccagttttatgttgtgtctccaatagctcctgtagctgaggcccattcgcaattttatggaaatggtttatgttgttctgtgactgcttcatgtgcaagtggtgcaacatgttgtcaaattgcaagtgggggttgtggaagcagcggtggaggatgcagcagtggaggatgcggagcaactgcatttggtgggggtgggtgtggaggtggtggaggtggggggtgcggtggaggaggatgtggtggtggaggtggtagcaactaa

SEQ ID NO: 2354 - DNA, 1059 bp, Candida albicans
cgaattgagaaaacaacactatttgcagatgcatcaaaagaaaaatcaccgctaacatatcttcacaatagtccgccaaagatacgtgaagatcttgaaaaaacaagtgagtctttccaaaaactttttatacagatatggagaagtattcaagccaaaaaccttaatgatattatcctcattttggaacaaaaatgtattacagagttattgccacaagcattcttattgaacacttaccgggacctcgatttgatcagtatgactgtccctggagatattcaaattggtaaaaatttagttgagttggttttaaagcaagagagttttggtatcaaaataaacaacttaaattggctatattcaagtaacattagtaatattgtttctgaagctacttcaagatacagtaatttttttgcaattgttacagatccaaagttgtcccaaaacttaaagtcaacattagatattgatttggtgtggcatacccatcaactatgtgcttttggctactttcatgattgcttaaattctccaagtcattgtattattgatcaaagtgataaaataagtaatcgactaatggatggtagtgaaacttttactgaaaatttgtatagagcactttacggtcaagaatattttatttgctattgccataattgttcatctgtccgatatggggtatcaaatcatgtttttgattccacaatcaatgcaaacttgtgcttagaaaacaaaattctcgggattgatttgaatatggtatatacttcgccccaaagtaatagcattgtgggaattacacctcagtcacaacagtatccatgcatttgtcataataccaatgatttcttaactaactctgtcacagaagagaccttagatggagaattcatggaaaatgaccagaagatagtgaacagtaacgactttccgaatgaaaatatcgattctttgatttactcgaacatgccagaaatgaataatgcatttctatacggaccgagtgagtgttcaaacaacgagtttctaagactgtggtgcatgatttga

SEQ ID NO: 2355 - DNA, 1260 bp, Candida albicans
tgcggaccttccagccgcgtggtgaagacagaagtgacttcagggttggaggatttacatttaccacctaaccagaataaaaattacggtagtgggaatattgtcaatcaaagtgtcaatatgccgccacaacaaccaccgggatccaatatgcaactacaatctatatcaccgcgtgatcaagcacaatttaatcaacagaatattcaactgcagagaccaatatctccaagaccaccaaatcaacgtctgaataatctgctgtcgtcacaaagactgtttcaacaaatccaacaacaacagcaacaacagcaccaaaatcaacaacaattctcgccatctataaaatatgcatctgacggttattcaaattctccatattcacctatggactcaaacaatctttatcaacaagatcaattcaaggcttcaccaacattaaatgcaactccagtcaagtctccaccagttgatgctccatatccagtttatgatgctcctagtccacctccagtatttgcctctaaagaaagtattgtgatttctccaccatcagtgccgttatcagctacatcttcagtaaccaatttgaatttgaatcaagctgatatttatcattctcaatcggaaaacaatttggcggttcatactggtaataaatttggtcataatcgatcggtatcttcaacatcatcatttttctctgatcgtagtgataatgcttcaatgattgatttcaatcaaaatatgattcaactgtatttgggagcaaattccagtcatttattacctagaattaaaacattggaattgtatcggaaaaatgctaaaaaatctaccgatcctaacgttttatttcaatatgctcaatatatgttacaaacagcattattattagaatcagaattacaaaatatggtcaataatggcaatggtaatggcaacggaagtcaaaatggtaatatagcagggattaataatgctacatcttcttcacaatcttctggttcacaaaatggaactaattctccatttaccagatcaattgaaaattcaccaagaaaaggtccattggataatactactactactactactaatggaactaaagataaacataccaagagtaaatctatagatttcaataatattgaattggaaggtaatgaaaagaaattgaaaaaggcattattaaaagaagctgtcaaatatttgaaacgactttgtcttcacccaccggggctggaaggaaccgcgatt

SEQ ID NO: 2356 - DNA, 699 bp, Candida albicans
  unsure (691): Identity of nucleotide sequences at the above locations are unknown.
acgtcattaactgtactaacaatgttgcttaatctggttataattgttgttatcatccttattgggtaccttacagtttcacatttttggtttaatccaagtcattcctccgtaatagacaacataccaccagtggcatctaatttcaaatgggaaactcaacaaccattaccaatcagaccatttgtaaacaagaaaaacttcaatccaagtatggccattaaagacatttcagacactcctcaagattggttacttattgaaaacacttattacaacaatgtaagacaacgacaaaaacatattgcattagaaccagaaatcttgacatttattcacaacaataacagaactaaacaagcagttggtgaattctatgatatggttactcaattcttattactgcgttatccaatgtattttaaatatgatttctggtcaggaattgttaccaacactatcaccaatgataaattccccaaatattccaaatcattaattcccaattatcaatcaatggtagaaatattgggtcgtaacattgaagaagatttcttaatcctaatcaaaaacaatccacatgataaagaagaagaatatattatgagagcatcattgaatggattccccgctggatttgatccaagagttaatttcaatcaaccaatcttcaccacggggctggcagganccgcgatt

SEQ ID NO: 2357 - DNA, 690 bp, Candida albicans
gatcataatatggaagaagataatcaacaggatcagaataaccagtatgtaatttatcaccccttcattctggaggaatgccatttttatttcattatttcttgtactaactcatttattagagtcgccttaaaaattggtttaattggggattcccagattggcaagacatcactaatggtgaagtatgtggaaggttcatttgacgaagactatattcaaacattaggggttaactttatggataaaaagatacaaattagacacacaactataacgttctcgatatgggatttaggaggacaaaaggagtttatcaatatgctaccattggtctcaaatgatgcagtggcaatattattcatgtttgatctaacaagaaagtctacgctaaattcaataaaggaatggtacagacaggtgagaggattcaataagacggcaattccctttttagtggggacgaagtatgatcagtttattgatttatcatttcaagatcaaatagagattacacaacaagcaaagaaattcggaagtgcgatgaaagctccagtcatattttgttcaactagccattctattaacgtgcaaaaaatcttcaaaattatattatctaaagcgtttgacttaaagttaaaccttgatgaaattgttaacgtgggggaacccatattgatatataagtag

SEQ ID NO: 2358 - DNA, 522 bp, Candida albicans
tcaatttttggagtgataattcaatattattcttttcaatttttccaacttgaaaaagtatctactcaaatggaatacgtcacacacctaccaaaagaagattcttcaattgcaactacatctagatatggcttgcaatttacatacccagtgaaatattatgatttccatgtttactattatgcacacaacgaagaatcagacaaagaagccaaatcattgttgaacaaattgctaaacgatttcccagaagactctgccaatggatctataattgtgaaaagattacctgatacaaaagttattggaccacacgctactcaattctgggaggctgatgttttgagacccgaagtgttcatcaaagttttgagttggttccaattgaatcatggaaacttatcggttttaattcatcctcaaacgggcgatgatgtgaaggatcacacatcgagtgctttatggttaggtgagaaactcccattgttgcttaatgtttttggagaaccagatggtaagata

SEQ ID NO: 2359 - DNA, 381 bp, Candida albicans
aacatgggagaagatcacgaattttacggtggcatcaagtcatatgatgtgcatacatattatggtaatgagaaggaagaaaagttggcttttgctttaagggagaaagtattaaaggattttgccaaagaaattgagaatggagagataagagtttacaagttttgggaaaaaccaattggtccacatccaattagaatgtgggaattggatttcaaagatcctgaaattttcaaagttgttgttccttatttccagttgaaccatggaccattatctgttttaattcatccacggaccgaccagggtgatctcaaggatcacacggaacatgccttatggttaggtcacaaagtccgtttggataccagcttgctttga

SEQ ID NO: 2360 - DNA, 1215 bp, Candida albicans
ctcccaactatgacctgcctgccggcgtggttgaggacaaagaaagaaaagagaaaggtacaagccccatctccaaacgttcaccatcaccaaaaaaaaagagaacaacacaaaaaatcaacgatgtctagaaaagtttcaataagttcacttaccttatctgaaccaatgacaaaaccagcaagagtacaagtaaaccctgaagatattgacgatcttgataagacccaacaagtgaataatcatcaatataacatatggtattccaaatcgttgtcggatgcaaacaataaatccaccactaaactgaaataccgtgttcgaatatccaccgaccaaggttttacaaaagcaaacaagaatactcatatatgtttatttttcagtcgaggatgttgttatttaggttcaaaatgtcaatatttccatcgtttaccaaaagaatctgacaattttaaaccaacacaagattgttttggtcgagataaaactgccaactatcgagatgacatggatggtgtgggatcattgaataaagtaaattgtacactatacgtaggtggcatacatatcaaaccgaatactgagcaattattggttaaaaattttcaagaatttggtactgttgagaaagtcagagtgttgcagggtaaaggttgtgcatttgttactatgaaaactgaaaaccaagcacaatttgctaaagaagcaatgcaaagtcaatccttagtggaaggtagcaacgaagtgttgtatgtgagatgggctaatgaagataaaaaccctgcagctcagaagcaagagaagaaaagacaacaagaattggcctatgatacagttaaacaattactagaacaggaatcaaacaaaaaaccaagattggaaaatggagctgtgaatagaattgaaaccataaacattgatgatgaactggaagatgaaggtgctgttgaagatgatgaagcagacgatgatattgaggaaacgagggtcaattctctttcagcgggggtaaagaaaaatgtatcaactcatcaagctaatgggacacctgaatcaagctctacttcagatgaaaatgatcacaatacaatactccgaaactccctcttgaaagatatttctagattgaaaaagaaaatggtatataaaagagaagagccttatttgaccaacctactagtcgactactctagtgatgaagatgatgattga

SEQ ID NO: 2361 - DNA, 816 bp, Candida albicans
acgacaacgcacattattgcgccgttctacaccgacgcgttttaccagttgatcaataagagcatttccagtttattgcttaaaatgtcgattgattataagccgtgctggcgggaattttttaatttggattgggggcagttggattcggtgaacgatatttcgtcgtacatgaacgatttgaagagcaagaccgcagagaacttgagggtgattcttccgctcattatcagggatagctatgtgcgtaattttaacgacaagttggtcgagatgttggtgaccactatagctaacaacctcaagtttgtcaagccaatgactgcgacgagtgttgagcagatacttatggatgtttcgtcgttgaaggaggatgcgttgaggtttccgttgttttcggttaaagatgtctccaagtcgtaccagaagtttgttaaccaccagtttggggatttgcagagcttgcttaagttgttgatggtgccgtcaattcccgttgaaaatcttattgagagctattttgcgttgattggcgacaagtcggttagcaattttgtcaaggtattgaaattgaagggggtcgagaaggcgcagcaccataagtatgttgacaactttaagttgcaattgagtgtagatgatgggtcggttacaagctgtttgttgttgcagaatttggaggaggaggaagaggcgtcacgtgccgcgaccccggatgtgaagttgaatgaaaaatttgatgtgagcaagataaacgagaattttaaaaattttggtaaatttttccgtaaagatataggtaatgaaagtagttaa

SEQ ID NO: 2362 - DNA, 606 bp, Candida albicans
atctcatttccaagggtgatttcagactatcaacaggaggttaatttcttccagtttatcaacccgaaggtcaaaccaaaaatgtttttattgtgtatggatttctctcctgaatccatttttgcattagagtggagtttgggaacagttttagttgatggctcagttttgtttatagtgtgtgtcattgaagatggggacaccaatcatcacttaaaaggaaacacatccaatgaaacttctcgtgaacaaacacgattgaacatgttaaacaaagccaaacaacaggtattgaatttgttgaaattaaccaaattgcaaatacatattgtgattgaaattattcaccacccaatcccaagacatttgattttagaattcattgataatttgcaacctactttggttattgttgggtctaaaggtcaaagtgccatcaaaggtgtgttattgggttcattatcaaattatttggtgacaaaactgacagttcctgttatggtagtacgtgagaagttgaagaaaatcaatcgtttcaaatctggatcgtcagtgttttcaaataacgttaaaccattaacattgtctgaagctagagttgattag

SEQ ID NO: 2363 - DNA, 702 bp, Candida albicans
gaggctcgatattcaagcggccctggtagaagaccaagagctgttgagcctcatttccatactgaaccaagacacgatatactactagctaaatttagatacttgttgctaaaagttgctcggttgtcgaccttgttagttccattgaaattcgaattgcctatttccgggtattggcccgagtccaagtatttgagattacaggggttgattacagatgttactcaactttacttaatgctattggtggcatttaacgaactcgaagaccctgtacattggctaccgacaattttccggagaattgggttttgttatgctgagttagaagcagatatttttgctactgttcacatggcagctgatgcattgagaaccaaggaagcattgcctaaaatcaccgatgctaatatatcagtcaagcatatggaactcttacgaaaacaatgggggcttgaaaaaatatcattaagtgaacgattttatagtaaagtgaaaaaaaaatgtacccaagaaactggtcatgatgaaattacaaaggagttggattacgataaatttttcagtaatgatgggaaattaaacattgtttcattgttggtggcacatatgatatacaacagattagacgagatcatcattgttgtcaaggggttagttggggagatttacgatttggatgaaaatgttttgattgcataa

SEQ ID NO: 2364 - DNA, 3447 bp, Candida albicans
ataagtttcagaccattcttcaaaaattttctgaaaataaccgtttatatatatatatataggtggttatgtagtcccttgcttggacttttactattttctttaattatcgttgtttctacaatgccacctgaagaattacatgacagcgatttactgtcagttgcatcctcaactacaccctcaacggttcaacaatctttagagaatgaaaatattcctgttcagttagatgagctgaaaattgtcggagataatactgaaaactatattgtgaatgcatacttccctgaaggtgacgagcgtaatctcgcctatacaattgtgaaagaagaacctgaaataaaacctagcttgtggaacaagtttgtggattttgtttggcctgattacattctcaaacatttagattatccttccttcaaaattacatttcgtagctggtgccaattgtgggtatgcacagtgttaacaattatcccagcaacaagtcattggatgggcggtgctgcatacttgataattgttttagggtttatcaccgtttctggggggacctctatcgccatgaatacactttccagtattgcggggtttattggtgttattattgcattccttcatcatgtgattacaacaaaaattataaaccacatccatcatggtatcacacctgaaacacttaccaaaaacttgatagatgaaggtctttgtcactttgattccggtttagaacaatgtatccaagatcaaattttcactggtagatacatcaccactactggttcagctgtcaccattctttcaataatcacatgcacattcattgtcggtaacatgagagaacatatgcatccattgtgggcattggtctatgtctctggtcagattgcaatttgtatatttgcctgttacggccattttctgccgttgtttgatcctttggaaattggttatgtcgttatcaaaccttttgcattagggttcattgcaaagatagtttcagccttgcttgtgtatccaaccacatcaaactggaccttcttcaatggttacactaaaatcttgaaaggattgaaatcgtctctggaaaagaatgccaaattctttaaaaccatgaaaccttcagcatccaattttggaaactataaaatgtttaaaaaagagatactcaagcttcgtgggtctatggcacccttggaaatagttgcatcgacaatctggttagaatactcgtatgggagatttgatgttggtgatgtgggagagtttagatcccttttaaagaatttatttacctcatcatcaacttatacttatttttatcaattgttggaagaacgaactcattttgttagaaacgaatttgctcttgtaagaaagaggtctaatgcttcttctcaatttgcccgaaaaccagcatttgataaaaccgacctttcctacacagatgtggcagaatacgagttgagacagagactgaaaatcatgaaaagtagaataatacttcaaggggaagaagacagtagacttacaactatagtgattgatgagatggcgaccagaatctctcagtattttgcaggattattggataatgctgataccggcattgaagttatagctgagtggttggaagccgccaatgatttcagaatattttcctgggttcctggtcaatggagcaaacatgtgtcgttgcaagaacgattgaatgcaaaagtcaaggtagtgaagctggaattggaaattgaactagccaagtttgataatgtggaaacccttaaaaagattatgattgatacttcaaaacccgagaaagaagttttatttttgattagtcagggtgtttttttcttgcagattgtcaaacatcaatgtgagaacattctcaaagtattagactattgtcttgaacttgacgaaagaaggccaacacctaaatttatcacctatttctcaaagacaaagtactcggaaccaaagcatttgtctaataagattgatgtgacaaatcctggactggaaaatattgtacggaaaagaaatgccgatactttgcctccgatcaacttgttccagtatattgggtacctattcaccaaattgtacaagtaccttatcagcaacgaattctggttttggataaaagtgggtggaatcatcactatcggggcaataccttattttgtaaggccacttgcaaacttgtactacagaaacaggatgatttggttggttattgtgattgcggtatccattagtgaaaatactggatcatcagtttatgttgtcttcgcaagattgtgctactctttctttggtgctgtggtgggtatggttgcttggtacatttcatgtggcaatggacaaggtaattattatgggtacggggcagttacggcggttcttttcatgtatttcatatattttcgccacttttccgttcaccaaacgctattacctcaaatattgtactcggtcactgcagttttggtcttgggcacttcctgggttgacgcaaaatacaacaagttagctaatgttgatgttggttataaaccagcgtatttgagattcataggtgttgccattgggttatgtcttggtatgttggccgtgttgcttccaaaacctatttcatcaaaagcaattgttcgtaatgttttggcaaagaccatatctgagactggtaacatacattgtgatgtagcaaattttgctttggcccgtcttgaaacccctgactacaatataaagggcaggcaagatgccgttttaagcaactatagttctttgttaatgagaatggcagggttgtcaaagctcatgtcattgaagcttgaagttccgatagcaggatactggccggaaagcaaatacaaacgattgctgggtttggtaactgacgttattcagctctaccttatgttgtcgagtgctcttcaagggttggatggccctgagaaatggttgccggtggttataaagagagttggattctgttttccagacttgcaagcagaagtatttgctactattcatatggcatccgatgctttaagaacaaagcaagctttacctaaaatcacagaggccaatatctcacttaagcatatggaattgttaagacaacaatgggggttgagaaggatttctttaagtgagagattctactgtgatagtgccatcaataataacaacgagaacactctgaaagaattagatcactacaaacttttcagtaacgatggtcagttgaatattatgtccttgctagtagctcacatgatttacaatcgtttggatgagatcatgattttagtcaaaggattagttggagaaatctatgacttgaatgaaaggatattggttgacgaagatgactactttgaattcaaacaagatttggaattctctgatgataaagaaaatagtgcattctaa

SEQ ID NO: 2365 - DNA, 813 bp, Candida albicans
aatttacaacatccacagccaattcatcatgtttcctcacatcaaccaccaccaggtgctgctgggggacaattcaattttttgaatgatccagctgctgctttggcatcacaatttgcacgttcgggatttgaacaatcaaatcaatatcttcaagaaaattttggcagtttacaaggtgatattaagtattatttccaagttagcaattcctatgtatttaagaaaatcattttgattttgatgccttataatcataaagattggaatagagtgtccactaaagagacagggacaaatcaattcttgcctcctaacttagacatcaatgcacccgatttatacttgccattaatgtcgtttgtcacatatatattattatgggctgctttccaaggtataaatggagatttccatcctcaattgtttggatatttggcgtcacaaactattgcattttccgtattagatgttgttatctttaaaactgggttgtacttattaaattgcccacaatcaaaaatctatgatataataagtttttctggatacaaatatgtttcaatcattgttttgttgattttaaaataccttgtggggaactatttaggatcattctactatattgttgttttattattgattgccaacttgtcaattttcttaatgagatctttacgatttcttatattgccccaaagcacgtcgatgaataacaccattacttccaagcaaagaaaaatcagaatccaattcttatttgtttactctgttattattcaaggattgatcatactttatatgagtaaataa

SEQ ID NO: 2366 - DNA, 1746 bp, Candida albicans
agacaaaccgcgtctacaagacaagacacaatgaacggaagtactggagagatcaaaaaagatagtttgatgatgatttataacattttcaataaaaaatggataggtccacctgattttgcattggaaaattgtcctagttcccgatcaagacatgcttgctgcttgtcccgtgatggatcaaaactatatattagtggtgggttggtcaaatctacccctttaaatgatttgtactgttacgacttgactttgggcatttggctgggaccgattgagtttgtttatagatttgatcatacaattatgatttacgaagagcggattttctcatttggtggattagataaggatatgaaccacgtcaaatcaataacttattattctttgaaaacgaaaacaatgggagaaatatatttaaatttagatatcaccaatgtgcccccaacaggattttatgatctagctattttaagtagcaaaatcaatccgtccacaagtttgtttgtcaaattaccattgtggaattatcctaacaacggactcagtatttcttgttttgatcttggaaattttgaagctcaaaacttattttcacaaaataatctaagtcattattttacggacaaaaatatgaacgactatatttggaaaacagcgtttactaatcatgaaggtaagttgtacttgttgggagcactaaagagaaagaaaaggaatagccacccttttggggcttgtttgaacactagcagtgatatgaacgagaatattatgacagaagatgatgatgaggggcatgaacatgagtctgacattgatggcaatggaaggagaagagacacagggggagggggaaggggagaagaagaggaagacgacgaagacgaagaacaggaatcgactcgactaaactatgtattacaaattgaaatgcaaaagtttggcatcccatcccaactcgaaaatccattatcattggattaccatcgactacttttgagttctgcattcaccgatttcgaaattattgcattgctgagtattgaagacaaggataaagtagaagcccaactagaatatcaaacggaatctatcagagttcacaagacagttcttgtagcccgttggcctcattttcaaagaatgatactgacaggaatgaatgaggcattagaaaacaaattgtttcttcccgagccaattaatcgaatcaaagctttgatttattacttgtatgttggaaccattgactttgatgaaaaatacattggcgagcttacgttggttgattattcaggcttacttgttttgacaaatttatatgaattgaaagaacttggatatttattgttacagaaattattcaaattatttatccagtttgataataacttttctgacgatgaaacatccatttctacattattgacaatctggagagacttggctttttcgaacgaatcaatttttatagtgacagtattggagttgattaaacgaaaatgggcaattataaccagatcaaagacttttctttctcttagcaaagaggagattgttagattatgccaagactcaacggatgactcacctttatccaaaagtcctaaccacaatcgttcgttagacacattagacaccaacttgattccagaaaccccaacaagaaatacaaactctccatttgtgattgattcacccgcaaaccattcaaacctgctttcaacaagcgtttttgactag

SEQ ID NO: 2367 - DNA, 870 bp, Candida albicans
ttaggcggatcttgccccccgtgggcaagacggttaaaaagtatatcaagaagcccatcaaacggtacagaaatggagaattcaaatgaaacaaccaacgaaaaagattcgaatgcagagacattgccaccgatgtcttctggattatcagaaacagcaacaccaaagaataatgatgctggagaagacatttccgatagcgaaattagctctatggataacgagctaatggattttttaactgagcattcagtattggtgactccaggccgacctttaataccaaatcaaccagaaacagcacctacaaccgaaaagaaccaggaaaagaaaccttccggaaaactatcatctgtgctgcccaaaaagcaaccaaactcttccatcccagacagtccatctgtagatgagacatataagatactaccgagaaatgtttccccaattgtgagaaacgagctacattctattgaagatgaatttgcccctgtagatcggatggtgttttccctaagggatcctttgggaggtggccgaataaatctaccagttaagtcaacctcatgcatacattttcaatgctttgattatgaaaacttttgtctatttaataagattagtactgctactaaagagataaccagaagaaatcttgtacaactgaatcgtgcatatcttgcccgaatccaacagcaagtcaatcaacaaccaacagtgagtagctcatttccattttcgtcacaaaactcacaattcccaaacccaaccagtaatcccaatgtgtcgaataagctacctgttgcccttacaggaaacaacggaactcataactacttggtaccaccaacattcattccaatttccccttaa

SEQ ID NO: 2368 - DNA, 987 bp, Candida albicans
ttgcactcagctgatcgttatttggtgaattccaaaccaaagtatacccattgtcctgccactgactgtaccagtttagcagaaatattggaagacttcaagtgtttttcgtctcgactattcaccgagaaatcttctgataggaatgtggatttgtctcgagtgcctattattggttgcagtgagcatcacgagttttgcttcaattgcaagtatgaaaaccatttaccgtgtccatgctgggtaagcaaaaggtggatcaagaaatgcaatgacgattctgaaactgctcattggattgatgcaaacacccatagctgtcctaaatgctactcttctattgagaaaaatggagggtgcaatcatatgacgtgtcaaaaatgcaaatacgaattctgttgggtgtgtttaaaggattggtctgatcatagaaataactattcttgtaatcgtttccgagactcgagggttgaagatcaaattaggaagaatagaagtagacaaacattggaaagatatttgcatttctacaagcgatacttcatccatgaaaactcaatgaaaggcgatcaaagaattttgaaaaaaattgatgatgtgactcgtctttacatggaagatagacgtgaaaatggcctgacttatttatcatggaatgatattcaatttttgcccgatgcaatgaaatctttgcaaaatggtagaaagactttaaaatggacgtatgcctttgcttactatttatccaagtccaatttctcagatatttttgagtttaaccaagattttttgaatagaactgttgaagatttatccgagatttttgaaaagattatggacaagagaaacaaaaacaaggtcggcacaattttgaagaacaaagcaaagatcattaatttgagtgaattagtcaacgccagacgaactactttaattgaaagcgctgaagagaacttacagaagggtttgttgagttttcaaccgtag

SEQ ID NO: 2369 - DNA, 1881 bp, Candida albicans
aagaatataactattcaaaccattaccatgacacgtgcaaaaaacaatgctgatttttttaccaagttagcaaaactaccacccaaagttattactataattattgatgaattaccaaaatgcatattagctgaattattgtatttcccatccattagagaagttgttgcttctacaatcttgtcaaatgtaaatattactgagggtcttcaaagacatgggtggaattatgaaccagatgttggttatgctgactgcaattgtgtctcgttcaacattgaattcggtaatttgaagaaaggtataaatcaatggaatatatatccaaaagtttttcatatgaaaggtttatctcaatttgtggatgttttgttaacttgcccagaacttttaactaaggcttcaagcgtcaatagtactttctccgggttagaagatacagaggtagaaattttggagaaattgttgatggattccaatattaaatttgattatttgagtctatcggagtttccagatccaatcacattatcacccattgtcaaaaatattctgttattgaataccacattgattagttatgtgattcctggcgtaaaaaaattggacattgtcttctctaatggtaacgaagaaggtcaaaattatgtttttgcttctgatttggaggaattgacaataaaggatgatcggtttacccaattgaatttgcctccaaatttacggaaactatctatcgaatcatctttgggctcggtaaatatcatatctaaagaattggtaaatctagagtatttgcagcttaaggaattgaaaattgcatcttttgacgaaactggaataactgccccaaatttgaaaacattaaacttagaaaattgtcaaaacattaccgattttattggtttgagaagatttcaaaaattaaagtacatatctttgaagggttgtgttttcccagctggtttacttgaggaaggtttgtttccagagttggagatttttgaatattcagggaaagattttgagccagaaagcgaatacgatggaccattaccattacctgcaaatttaaaacatgtatcaataaagtgggctagttctgttataattgatttaaatacttttgttcttccatctagattaaaacatttggaactttgggatattaggtttagtcaagggcatttacagtttaatgaagatttagaatatgtacggattcgtacacgagcaataagatttccaggagatttcaggattcctccattggtgaaacattttcaaataaaagctactcatttgtgtttttacaaaccagattttatgtatcatttgcccgatggattaaacaacttacaattagtatgccctgacttaggaagaatggatggattagataaaatagttcaatggccagaatcattaaaagtgttccgtatgcattatttgggtttaaattctcactcattgcagctatggaattttaaggaatccaatcttgaagagattgatttcagaggtggggctcttggtcaattaaacgctgatgcactaccaaccagtcttaaagtgttaaccatgaagaacttacgtattgaagaattagttggttcttttggaaatttaaagaaactagagaaattgattctcggatgcaatgatataaaatatgtcagttttttggaatttccatcattgaaatttttagatttaggatactgtaagtttgatttgataccaccagtgacagtgatgtttcttaatcagaaattaaaagaacttaaattgtattcaaaaacgatggatgttaccgtcctgaaacaagatatatgtcttgatcggaatttcaaacgggtgaaaagagatcttatggattag

SEQ ID NO: 2370 - DNA, 870 bp, Candida albicans
  unsure (769): Identity of nucleotide sequences at the above locations are unknown.
ttctacttaacagatgcaaatcaaatgtttgttttccttgctttgatcactttgactacttgtctacaaatacctctcaatccaacaattgacgatttctataatccaccaaaagatctcgaaacaagccaattgggtgatgttttaaaatggaggaaaatgccattcccggtaactagcatgtttgtaaatcttccaatttctaatgcatggcaaatatcagttagatcgcaagatacattaaacaattctcttgctattgttgcaacaattttagaacctcctaatggtgataaaaacaagttgatatctcatcaagcttttgaaaactcgccattattactgtgttccccatcatattccatgcaagttccatcattcgagacatttcagattcaagcagatttgatttttatttctggtttactaagccaaggttggtatgtggtggtaccagattatgaaggaccaaattcagttttccctgtgggacgacaatctgcttattctgtattggatagtataagaggcacaatcaagttcttcaattcaactggaaactcaactgtgaaaacagcattattggggtattcatatggtgcagttgcttctctttgggcatcaattgtacagcccaactatgctccagagcttgaattggtgggagcagccgttggatgcactatacctaatatcaccgcatttattgaaaaagtagatgaaggtccatattcaggaataattgttatatatttcagtggactagcanatgagtatcgccatttcagggacagattgatacattttggtgcattacaaccacttggatgtttatttcccatttgcagaaattctttttccaaaaaatga

SEQ ID NO: 2371 - DNA, 858 bp, Candida albicans
caaatgttgtttttattattcttattaattactcccatttacgctggtcttattttccctaccaaaccatcaagcgatcccttctataatcctcctaaaggttttgaaaaggctgctgttggtgatattttgcaatccagggaaaccccaaagtctataactggtagatttgctcccctcaagatccaaaactcatggcaacttttagttagatccgaagattcattcggtaatccaaatgctattgtcactactgttattgaaccagtcaacgctgatccatccaagattgcttcctaccaggtttttgaagatgcagctaaagctgattgtgctccttcctatgctcttcaatttggttctgatttgactactttcgttactcaagctgaaatgtacttgatggcaccattgttagatcaaggatattatgttgtgtctccagattatgaaggtcctaagctgactttcactattggtaaacagtctggtcaagctgtgttgaactctattcgtgcaaccttaaaatctagtaaaatcaccaacattaaagaagatgctaaagttgtcatgtggggttattctggtggttcgttagcctctggatgggcagctgctttacaaccaagctacgcacctgaattgagtagcagcttgttggggtgctgccttaggtggaattggtacccaaatttactgctaccgcacaagcagctgatggtactgtatgtgcaagaattgtggcaaatgccttgggttggtggtgctaatgaatatccggaatcccaatcaatttggccgattgataccgacaaaaaatccgtgtttgatgaatttgataatccttgtctaagctga

SEQ ID NO: 2372 - DNA, 1272 bp, Candida albicans
gttccaatatgtttacttatccaatcaagaaaaatgttgtatttaatacttttcctcattgcccccatatatgctggccttattttccctaccaaaccatcaagcgatcccttctataaccccccgaaaggttttgaaaatgctgccgttggtgatattttgcaatccagggcaacacccaaatctatcactggtgggttcacccctctcaagatccagaactcatggcaacttttagttagatctgaggattcatttggtaatccaaatgtcattgtcactactgttattgaaccagtcaacgctgatccatccaagattgcttcctaccaggtttttgaagatgcagctaaagctgattgtgctccttcctatgctcttcaatttggttctgatttgactactttcgttactcaagctgaaatgtacttgatggcaccattgttagatcaaggatattatgttgtgtctcctgattatgaaggacctaaactgacattcactattggtaaacaatcaggtcaagctgtgctaaactctattcgtgcagcattaaaatctggtaaaatcaccaacattaaagacgatgctaaagttgtcatgtggggatattttggtgggtcattagcctctggatgggcagctgctttacaaccaagctacgcacctgaattaggtggtaacttattgggtgctgccttaggtggatttgttaccaatattacaactaccgcacaagccactgacggtactgtttttgcaggaattgtggcaaacgctttgggtggtgttgctaatgagtatccggaattcaaatcaattttacagagtgatacagacaaaaaatcagtgtttgatgaatttgatggtcactgcttgattgacggtgtgctcaactatatcggtactctgttcttaactggtgatcataagattttcaaaactggttgggatattttaaagaacccaaaaattggtaaagttgttgaagacaatggattagtttatcagaagcagttggttccaaaaatacccgtgtttatttaccacggttcaattgatcaaatcgtccctattgtcgataccaaaaaaacttatcaaaattggtgtgatgctggtatttcctctttggaatttgctgaagatgctagtaatggtcacctcactgaagctattatgggtgcccctgctgctttgacttggattattgatagatttgatggtaaacaaactgtttctggttgtcaacatattcaaagattcagtaacctt

SEQ ID NO: 2373 - DNA, 1404 bp, Candida albicans
attattttacaaatgagagatttaattttatttttgagtttgttgcatacaatatttgcatcacttttcagtttaaagccacccagccaagatgatttttacaaagcacctgctggttttaaagctgccaaaccaggggatattttgaaaacaagaaaatcacctaataagccaagtagcttatatgcacctgttgacgttcaaaattcatggcagctcttggtcaggtcggaagattcttttggtaacccaaatgcttttgtcacaaccatcattcaacccaagaatgccgatccatcgaaggtcgtgtcgtatcagaattgggaagatgcttccaacattaattgctccccatcatatggtctgcaacttggggctccattaagcacaatacttacccaattggatatgacatttatagttcctccattgaagagtggttattatgttgttcttccagattatgaaggtcccaaatctacatttggcgtaggaagacaatcaggaaaagctacattggattccatcaaagctgtcttgaaaactaaagatttttctggtattaatgatgacgcgaaagttgttttatgggggtattctggaggatcgtttgccagtggttgggctgcagttttgcaaccagaatatgccccagaattgaaagataatttgattggcgctgccttaggtggatttgccgctaaccttactggtattgctgaatcagttgatggtgaagtcttttctgggtttataccacttgcattgaacggtatagcaaatgagtatcctgattttaaaaagagattatacgaagaagttaaacctggtgccaaagctgatttacaaaaaggtgcagagaattgtttggctgcatcacttatcagttatccaatgtatcaatatttcacaggtccaagaagagtgtttgaaaaaggatggtcattgttggaagataaaaccattggcaaaactttagaagacaacttgcttattgccttgagtaaagaacatatgccccagatccctatttttgtttatcatgggacaattgataaaatcattcctatcaaggattcgattaagatatataagaattggtgtgattggggaattggatcatttgagttttctgaagataaactgaatggtcatacaacggaaacagttgttggagcaccagcagctttaacgtggatagatgcaagatttgcaggaaagcctgcagttgaagggtgtctgttcaccaccagggcatcgaatttcttgtaccccaacatttcggaatctgctgcactgtacttcaaaggaatatatcaaacgatcttgagatcgaaattgggctcaggtgttacttctgatgatgtttctgtaaatggtttacgtagcttgtatcatacctag

SEQ ID NO: 2374 - DNA, 687 bp, Candida albicans
  unsure (655): Identity of nucleotide sequences at the above locations are unknown.
tcaaacaatccatttccatcaacttcacccctccttccaccatcaccaacaataatgagaggtattgctgttttccttgctttaatatcattaatatttgcctcccccttgactgtaaagtcaccccttgtggacgacttctatactgctcctgatgggtatgagtcagctaaattgggagaaatcttaaagttgagaaaaactcccagtaaactcagtagtatgttttttgaaatcgatattaagaactcctggcagcttttagttagatctgaagattcatttggaaatgcaacagcaattgttaccacagttatcgaaccatacaacgctgacccatccaaagtcctttcttatcaaacttttgaagattctgcaaatattgaatgttcaccttcttacggtatgcaatatggtgccccttggtcaactgtggctactcaaattgatatggctttaatggtacctatgttgaagcaaggttattacgttgtcagtcctgattatgaaggaccaaaatccacatttactgttggtagacaatctgggaaagccactttagattccattagagctattctaaaatccaacaaattcactgggatcaagagtgatgcaaaagtcgccatgtggggatactctggtggttcattancttctgggctgggctgctgcattacaacctaa

SEQ ID NO: 2375 - DNA, 798 bp, Candida albicans
  unsure (72): Identity of nucleotide sequences at the above locations are unknown.
aatccaacaaattcactgggatcaagagtgatgcaaaagtcgccatgtggggatactctggtggttcattancttctgggctgggctgctgcattacaacctaagtatgccccagagttgaaggaaaatttaataggtgctgctgttggtggatttgctactaatattactgctgtggctgaagctgttgatggaactgtgttttctggatttataccacttgctttgaatgggttggcaaacgaatatcccgatttcaaaaagagattgtatggtgaagttaagctcagtgctagatctactatggaaaaaggatcacaaaattgcttggctgcttcgcttgttggttatccgatgagtcaatactttactgggcaaaacagggcttttgaaaaagggtggggacttttacaagatgaagtttttaacaaaaccattgaagacaacttgttgttaaaattggacaaaacctatttaccccaagtccctgttttgatttatcatggaaccatagatgagattattcccattaaagatgccaatgctcaatatcagatttggtgtgacaggggaatccagtcactagaatttgctgaagatttgctggcaggtcatttagcagaaacatttactggggcccctgctgctttgtcatggattgacgcaagattttctggcaaacctgctgttaatggatgtcaacgtacaatcaggtcttcaaacgtgttatacccgggtatttcaattacaattcgaatttactttgagggtatttctaaaacaatttttcggggttaa

SEQ ID NO: 2376 - DNA, 1386 bp, Candida albicans
caaatgttgtttttattgttcttattaattactcccatttacgctggtcttattttcctaaccaaaccatccaacgatcccttctataatcctcctaaaggttttgaaaaggctgctgttggtgatattttgcaatccagggaaaccccaaagtctataactggtagatttgctcccctcgagatccaaaactcatggcaacttttagttagatccgaagattcattcggtaatccaaatgctattgtcactactgttattcaaccatttaatgctgacccttccaaagttgcttcttatcaagtatttgaggattctgctaaaggtgattgtgctccttcctatgctcttcaatttggttctgatttaagtactttggctacccaagctgaaacattcttgttagcaccgttgttggaacaggggtattatgttgtgtctcctgattatgaaggacctaaactgacattcactattggtaaacaatcaggtcaagctgtgctaaactctattcgtgcagcattaaaatctggtaaaatcaccaacattaaagacgatgctaaagttgtcatgtggggatattctggtgggtcattagcctctggatgggcagctgctttacaaccaagctacgcacctgaattaggtggtaacttattgggtgctgccttaggtggatttgttaccaacattactgctaccgcacaagcagctgatggtactgtatttgcaggaattgtggcaaatgccttgggtggtgttgctaatgagtatccggaattcaaatcaattttgcagagtgatacagacaaaaaatcagtgtttgatgaatttgatagtcattgtttagctgatggtgtgatcgattatatcaatactctgttcttaactggtgacaataagattttcaaaactggttgggatattttgaaaagctcaacaattgctaaaatcgttaaagataatggattagtttatcaaaaacaattagtaccaaaaatccctatatttgtttatcatggttcaattgatcaaattgtccctattgttaatgttaaaaaaacttatcaaaattggtgcgaaggtggtatttcatctttggaatttgctgaagatggtactaatggtcatcttactgaaaccgttgtgggtgctcctgctgccttgacttggatcattgatagatttaatggtaaacaaactgtttctggttgtcaacatgataaaagattaagtaactttcaatatccaaatatttcttcttcaattcttaagtatttcaaagttgctttggacaccatgatgctgaatggtcttggttctgatattcaaaaagataaaattaccccagacgaccttagaaagtttttattaggaggctggtaa

SEQ ID NO: 2377 - DNA, 1266 bp, Candida albicans
tctttaagcttattcatttttgtccacatcagtaagaaaatgttgtttttgttgtttttgttagttgctcccatctacgctggtcttattttaccaactaaaccatcaaatgatccattttacaatgcccccgcagggtttgaaaaagctgctgttggtgacatcttacagtctagaaaaacacccaaacccatcactggtgttttcgtcccagttaagattcaaaactcctggcaacttttagtcaggtctgaagattcattcggtaatccaaatgtgattgtcactactgttatggagccattcaatgctgacccttccaaactcgcttcatatcaagtctttgaagattccgctaaagctgattgtgccccctcctatgctcttcaatttggttctgatgtgactactatagccacccaagttgaaacgtatttattggcaccattattggaccaagggtactatgttgtttccccagactatgaaggtcctaaactgacattcactgttggtaaacaatccggtcaagccgtgttaaactccatccgtgcagcattaaagtctgggaaaatcactaatcttgctgaggatgctaaagttgttatgtggggatactctggtggctcattggcctcaggctgggccgctgctttgcaaccaaactatgcaccagaattgggtggtaacttattgggtgctgctttaggtggatttgttactaatattactgctacagcagaagccactgacggtactgtctttgcagggattatggcaaatgccttgggtggtgttgcaaatgagtaccccgaattcaaacaaatcttgcaaaacgacaccgacaaacagtctgtgtttgatcaatttgataatcattgcttggctgatggtgtgatcaattatattggtaagcactttttatctggcaccaacaaaatcttcaaatccggctggaatattttaaagaacccaacaatttctaaaattgttgaggataatggtttggtttatcagaaacagctagttccaaaaatccccatcttgatctatcatggtgctattgaccaaattgtccctattgtcaacgtaaaaaaaacttatcaaaattggtgtgatgctggtattgcttcattggaattttctgaagatgcgactaatggtcacatcactgaaaccattgttggcgctcctgttgctttgacttggatcattaatagattccatggaaaatctgccccacaggggccaagatccgcgcatggt

SEQ ID NO: 2378 - DNA, 816 bp, Candida albicans
  unsure (350): Identity of nucleotide sequences at the above locations are unknown.
atttatagattgggttgttgcaatacaaccttaagtatgctccccggattggaaggtaaaattggatgggagctgcccaagagtgggttgttcaataatataaagcccactgccggagccaaccggatggtacatcataggggggattgtttcccaaagccattgagtgggttagctaatgagtatcccgaattcaaagaaatactttaccaaaaagtctccaaagatgataatgacaatttgcgtcaaggtactgaacattgtattggaggtactattctttactttgctgaagaccaatacttcactggcgatgatagagctttccctggaggttatggattacttanagaagaggtggtgaacaagactattctggaaaacaatttgatgcaaatggataaagattatttaccagatattccaatttttgtataccatggtgcattggattccattgttccaatcagtaacgtccatgtcacttataaaaattggtgtgattgggggatcaactcatttgaattttctgaggatttattaaatggccatatcaccgaaactattgttggggccccggcagctataacatggttagaagcaagatttgacggtgaaccagtcgtcaagggatgcaaaaagacttccagaatcaccaacttttcttatccaaacatttctgattctactagtagtatcttcgaagggattctcaattctgttactggttccgaattgggtccaggtgtcacctctgataacataacgttggatggattaaccggattcttggggaactttattgatttaaaatag

SEQ ID NO: 2379 - DNA, 882 bp, Candida albicans
gctattttgaaatcaggatctttctctggtatcaatgaagatgctaaagttgccttatggggatactctggtggatctttggctactggttgggctgctgctttgcaaccagtctatgctccagagttgcaaaagaatattgttggtgctgctgttggtgggtttgctgctaacatcactgctattgctgaatctgttgatggtactattttcgctggtttgatcactcttgcattgaatggtttagctaatgaatacccagacttgaaaacagcattctacgaagaactttccgactttgctgttccagaattcaaagccggtgctgaaaattgtttggctgaaaatatcttccattacccattacatcaatatttcactggtccaaagagagcttttgaaaaaggttggggattgcttaaagaggatattttcaacaaatctatccaagacaatttgttaattggtttgaataagacttacttgcctcaagtccctgttttgatttatcatggaactgttgatgaaattatcccaattaaagatccacatgctcaataccaactttggtgtgactggggtattgaatctcttgagtttgctgaagatttgctgactggtcatttggctgagacatttactggggctcctgctgccttggcctggattgatgcaagatttgatggtaaaactccaatccaaggatgtctgcacacaaccagattgacaaatcttttgtatccaaatacttctgattctactcacctgtacttccttggtatttaccaagcagttttcggtaccccattaggaccaggtatcaatggtgataacattactattaatagtggattacttggtcttgtaagcagtattatttaa

SEQ ID NO: 2380 - DNA, 1314 bp, Candida albicans
ggttatgaatcagcaaaattaggagaaatcttaaagttgagaaaaacgccaggcaaaataagcagtttgtttatccctgtggaggttaagaactcctggcagcttttagttagatccgaagattcatttggaaatgcagcagcaattgttaccactgttatcgaacctttcaacgccgacccttccaaagttgtatcttatcaaagttgggaagatgcagctaacattgaatgctcaccttcttacggtatgcaatttggggctccattgtcatcagtacaaacccaagtggatatgattttcatagttccattgttggataaaggttgttttgttgttcttccagattatgaaggtcccaaatctacatttggtgtaggaagacaatcaggaaaagctacattggattccatcaaagctgtcttgaaaactaaagacttttctggtattaatgatgatgcccaagttgctatgtgggggtattccggaggtacaatagctgctggctgggctgctactttgcagcccaaatatgcacaagagttgaagaaaaatttgattggtgcagctcttggtgggtttgtcattaatattactgctaccgctgaagcaaccgatggtacattgtttgctggattaatcccaaacgcactaaatggattagccaatgaatttcctgattttaaaaagagaatgtatgaagttgttgaaaaaagatatgaaggagctttacaacaggggactcaacactgtttaggaggggctattcttcattttgcctttgatcaggttttcactggtgaccatagatactttgaacagggttatggattgctcgaagaggaagtattcaaccgaaccattctggggaacagtttgttatacatggatcaagagtatttaccggatattccaatatttgtatatcacggctcgttggatggcattgttccaattcctgatgtacatggtgtttacaagaattggtgtgattggggcatcgactcatttgagtttgccgaagattcattgaatggccatctcaccgagattgttgttggagctcccgcagctataacatggttagatgcaagatttgatggccaaccagttgtggagggatgcaagaaaactactagaatcactaatttttcttatccaaacatttccgattcaactagaaatttcttcaaaggtattcttgattcacttactgcctcacaattgggacctggtgtcacatctgataatgtgaccttaagtggattaactggattcatggggggactttctaagttcaaaaagtcagtttag

SEQ ID NO: 2381 - DNA, 801 bp, Candida albicans
atgtttacttatccaatcaagaaaatgttatatttaatacttttccttatcgctcccatctatgctggggttttacttccaacaaaaccttcaattgatcctttctacaatgctcctgaaggtttcaaaaatgctactgttggagatatcttacaatttagaaaaactccaaaatcaatcactggtgggtttgttccgctcaatgtccaaaattcatggcaatttttagttagatccgaggattcatttggtaatccaaatgtcattgtcactactgttattgaaccagtcaacgctgatccatccaagattgcttcctaccaggtttctgaaaacgctgctagagctgattgtgccccatcgtatgcccttcaatttggctctgatgtaagtactttagccacccaggctgaaacgtatttattggcaccattgttggacaaaggatattatgttgtgtctcctgattatgaaggacctaaactgacattcactgtcggtaaacaatctggccaagctgtgttgaactccattcgcgcaagtttgaagtcaggaaaaatcactaatattgctgaagatgccaaagttttaatgtgggggtattctggtggatcattaacttcgggatgggcagctgctttacaaccagactatgcacctgaattgagtataaatttgttgggtgttgctttaggtggatttattactaacgtcaccgctacagtagaagctactgatgatactatctttgctggaattgcagctaatgttttgggtggtatcgcaaacgaatatccatag

SEQ ID NO: 2382 - DNA, 585 bp, Candida albicans
ttcaaatcaatcttgcaaaatgataccaataaactgtcgatattcaataaaatcaacaatcactgcttgacagatagctttataaagtatgtgggagctagatttttaactggtgacaacaaggttttcaaatctggttggaacatcttcaaaaacttggtagtgtctaagatcgttaaagataacggattggtgtatcaaaaacaattaattcctacaatacctgtgttcatctaccacggttcaatggatcaaatttctccaattttgaatccaaagaaaacttatcaaaattggtgtgatgctggtatttcctctatagaatttgctgaagatttgacaaatggacactttactgaatccattgttggtgctcctgctgctttgacttggattatcgacagattttctaacaaaccacccgtagatggctgtcaacatgttgtgagaactaccaactatgaatacccaaacgtttcctcttcaatacttgactattttaaggcagcaatggatgtcgttgcacaacaagggcttggtcctaatattcaaaaggatcaacttgaaattaaaagtaatttataa

SEQ ID NO: 2383 - DNA, 609 bp, Candida albicans
  unsure (562): Identity of nucleotide sequences at the above locations are unknown.
tattattgctctttcttattcctcactactatcaacaaatcatcggttgctgcaatatatatttcctcaatgaaaggtttggttttcttacttggtttattaccaacaatctatgcttctttagtacacattactcctgctagtgaagatgacttttataatcctcctgctggtttcgaatctgccaagaatggtgatattttgaaattgagaaattcccctaacagacttgctagtttctatttccctattgatgtcaagaatgcttggcaactcttggtcaaatctgaagattcctttggtaacccaaatgcttttgttactacgcttattgaaccttataatgctgatccatcaaaagttgtgtcttatcaaacttgggaagatgcttccaacattaactgttccccatcctacggtgctcaatttggttctccattgagtactattactacccaaattgacatgactttgattgttcctcctttaagaaatggttactacgtcgtcactccagattatgaaggtccaaaggctacatttgctgtgggaagacaatcangacaagcaactttggattcagttagagctatcttgaaatcacgatct

SEQ ID NO: 2384 - DNA, 573 bp, Candida albicans
cagaactcacaacaacaacaacaacaacaacaacaaacagattcacaaacgataccaagtcctgcattgtcacaaactagtgacttatctaattttggacctacagaagcagcaattaaagcaacggaagtattagaacaaaatatgaatttattagttgatagtgctgataaatcaattgttgatgtattccaacaagaaattgcagaaagatttttccaaattattgttaaatcattaaaattgaaaacaatttccgttatgggggctacaagattaattagtgatttgaatttatattttaaatttattaataataatgtcaaatccaataaacgattagtgttacctttatatcaagcattaatcaagattggtaatatctatttaattagtggtgatgattccaaatcaattgggaaattagttagtgatttatcgaaatttaatggaattttcagtcaagaagaaatttatgaatttgttcaaagaagacaagattggccaattattaaaaaacatgttgaaaaagttatgtatgggtttggatttggtgattgtacgatcatgtaa

SEQ ID NO: 2385 - DNA, 747 bp, Candida albicans
cttcacatacaattccatgaactcttcaatatgattggaatgaatagattgatattttctaaagcttttacgagttcttgtaaaagtgtgggaaaagtaccttttacaaaatctataactagagccaatacccgctatttcaaaccaacatcgatactacaacaaattagattcaattctaaactgtcaacggcaccaaacatagaagccaattctaatggctcaacaaattctcaatcggatacaaaaaaaccacgacccaaattaactagtgaaatcttcaagcttttaagattagcaaagccggaatcgaaattgattttttttgccttgatatgtttagtaacaacttcagctacaaccatgactttacctttaatgattgggaaaattatagacacaacaaaaaaagacgacgatgatgacaaaggcaaagacaacgacgataaagatgacacacaaccaagcgataaattaatatttggtcttcctcaaccacagttttattcggcattaggggtgttattcatagttagtgccagtactaattttggtaggatatatttattaaggtctgtaggggaaagattagtggcacgattgagatcacgtttatttctgaagattttagctcaggatgcttatttttttgacttaggaccctcgaaaactggtatgaaaacggccgatctgatatcatctttctacgcgccagacgcaggaacatgggaatgggccccccccccc

SEQ ID NO: 2386 - DNA, 1524 bp, Candida albicans
  unsure (284): Identity of nucleotide sequences at the above locations are unknown.
ttgctacaaccaaacatcatgacatacagtatacgaactgtgacaaactatttaaacagtttggcaccacgatttcttttgctgaagggagacattgaaattttggaaagtccgataaccttttataaaaccttactatttaagatcagtaattcaaaacaccggatatttttatcgtcattatatatcggcaaaactcaacacgaattaataccatgtattgatgatgcaatggctaagaatgccgacttgaaagtttatgtattgactgatgccttacgagnaacaagagaagctccagataattgttcggcattgcttttggccagtttgcaaaaaaaatatggccaacgaattgatatccgcatgtttcatactccacacctttcagggatcacaaagtttttagctccaaaaagaataaatgaagggtttggtcttcagcatatgaagttatatggattcgatgaccaaattatactaagtggggcaaacttgtctgaagattatttcaccaaccgtcaagatcgttattacctctttaacaacaagcctttaactgattattactttaagatccacaccgccatatcttcactttcttacagaattatgcatactgacaagttgaaacaaggattcaaactaacttggccaacttccaatgctacttgcgaacctcatttgaatatcgagcgattcattagcgactcttcctacctattgacaccattattaaagcagcaacaattgaatgcttttgaggaatttgatgaaaatgaggaatatgatactatagtttatccagtttctcaatttacaccattgttccctcacaatcaagatcagctgactgaaaaaccagcaattttgcgattgttatcgtatgcagactctctcaagacaaaatggtggttcactgccggatatttcaatatgctaccagaataccaacagcggttgttgaatggtaaatctcaagggacagttatcacggcatctccaaaagccaactcgttttataaatcacctggtgtttcttattacttaccacaagcatatcttttatttgctaagcaatttttacaaaaagtgagagatctaggaaaatctgctcttataactgtttatgaatggcaaaagggaatagtgaacactccaggtggatggtcgtatcatgcaaaggggttatggataaccgcccctggggaagatgaaccaagtattaccgtcattggatcttctaattataccaagcgtgcatactcgtgcgatttggaaagcaatgccattattatcaccaaagataaagacttgaaaatgaaaatgaaacacgaaattgataatttgatggaaaatgtgcatgaattgaaattagaagatttcagtccaaaattagaatcacaagttaatggagatgcagagacagaatcagtggatgaacctaaatattcagtagaagaagatagaaagattagttacggggttcatttggctgttaagttgcttggtggaagactctag

SEQ ID NO: 2387 - DNA, 186 bp, Candida albicans
tatatttatcaaacaatgtctgcattcagatcaattcaacgttcaaccaacgtagccaagagcactttcaaaaacagcatcagaacatatgcttctgctgaaccagtatgtattcacttttttgaggatccgggcaatgtccttgggattttgtcatgcagacacggcgctggaagatccaagctc

SEQ ID NO: 2388 - DNA, 426 bp, Candida albicans
tcaagaccaatgtcatataaacggaaaagctataacccgtcaccattatcttcacccaaatccaacacatcgctacgacatgacataaccgtaacatcatcagagtacaacaattcagacgaatatgaagtagaggacaatgtccccaccatttttttaaatcagttggcaacattcccattgttcaagaatgccccaaccagtttccacaagcaagtagcagctaatttacgattaatacattaccgaccacaagagtttataataaaaaagggagatctttcgaggtcaatgtattggatattgaaaggaacagttagtgtcacatctacagatggtgaagaagtttatgccgagttaaatcaaaggcgatttctttgggagaaattggaatattgtacaatcgaacaagaaaagttacgttaa

SEQ ID NO: 2389 - DNA, 1107 bp, Candida albicans
caacaattccaatttatatcaatggcactggttgttgtattaggagctggagtcattgggttgacaacagccttggaattaaagcgctctaatgctaaacttgatataactatagtagcagaccatttaccaggtgacattgatcacacatacacttcaccatttgcgggggccaattggcattcatttgcaactcctgaagataaacgtttacaggagattgataaacctggctacaaaaagtttttacagcttgctgcagctgatcctagatctggtatttgggcagtagataatctttcaatgtatacagattatgaagtaacttcaaataacggtaactatagaaagttcgttccctggttcaaggattttgttgatggatttgagattgtcgataaactgaaattacctgaagggatagcttttgctcacaaattcaaaggtgttgttatatctgttcacacatatttgaattatcttgtccaacaaaacaaggagattggaaatgttattaaaagaattcctcaaatccaccacattgaggatgctcgaaagtttcatagttctggtaagaaagccgactacgtcatcaatgcggctggcttgaatgcatctaaaataaagggtgttgaagataaaaagttcaatttccctgtgcggggccaagttttgcttgtcaaaaacaatgctaaaatacagttgggtgttgaagggtttcctggtttgcccaatgaaatgttgtacatcatgcctagaaaagaaggaggcacgattataggtggttgctttttagaagggaatacttcagtttcagaagataaagaattgactgcgagaatcataaaaagagccatcaaatatgcaccagaattggttgacccaaattacaaaaacaaccccagtaaaatcgagattgttaaagtaaatgtggggttcagaccatttagagaagatggtgcaagagtagaagtggacaaaaaatataaatggttaattcacaattatggtgctggtgctggaggatatcaaggaagctttggtttgagtaagttagtcgttgacattatggaaaaagaattgagtaaattcaaatcaaaattataa

SEQ ID NO: 2390 - DNA, 198 bp, Candida albicans
acacggaccgtgggcaagagcattcccggcgacaagaacggccggacacccgctcaagggaaggagattctcgaaaacatcggtcggcgcttcaaggaggtgctacgcctgaaggaagctgatgtcgttgagttctcggggcacacggacagcgcacacagcggtagcactagagccaaggccaagtacaccgtttaa

SEQ ID NO: 2391 - DNA, 867 bp, Candida albicans
tatcatcatatgagagcattaaacattatccccgtgtttttcttggtgggttcagtcttgttactaatcctcactatcatcaatggtgccggaacatcttcagtgttggggaaattctattggtcagaaaccgatacatccggccttactggggttccatacaataaaacaagatggacgttttatagaatgtgtggtgttgatcataataagaatgctcattgtggtaaatcacaggctgcatttccttattctccagaagataattttggtcgaaatagtggtattcctcaaaatttcattgatgatagagatacctattattatttatcccgagttggatgggcatttatacttgttggattattctttggtgttacggcaatggttgctgcaccattgaatttttgttattttgtcgctggaattgttggtctgaccacggcatttgtttctcttttattcacaattacggctgcttgttgtattacagctgctcatactaaaggtcggagagaatggaatcgagccgggttccccactgttcttggagccaaggcatttggtattttgtggactgcagttgcctgtttgttgatttcatttgttagtttagtggtcttgacttgtctttctcgaacatctacacgaagaagaaacagaggtgttggtgtcaccaatggatctgaagtgacaccaagaggtgaacaagagacttatgctaaagaaagttcaggagaaatccctcgtggtgaatacgaatcaggaaatcaccctgttactggtcctggagaaggcgaaagactctctaatgcatcaaaattcagattttttagagtgaaaagagccaaatcagaagatgtttaa

SEQ ID NO: 2392 - DNA, 702 bp, Candida albicans
catttgcttctcaatatgaaattgttacaatatatcattgtttttatcattacttccttgaatgggtccttggtcgttgcttcagtaggttctccattcactctttacaagggctccaaacctttttacagctgtaataatcaaatttccgacactgtttcgttctgtatcgaagcaactgattatcaatgtctttgcaccaataaaaattatttagccacagttgcaggttgtctccaaactgttgggccatcaccttctgctgtcaatgggcttgttactttttgtggtacccgtgatgtttattttgatagctacaattggtttaatgattcacttcaattgtatttacaacaagctaaatcgaagaaccagattcaaaacttcaataaatctttgccccttgaaactccgtttattttgaatcaaactgctgttatgctttaccaacaaacctacaatatgtattatgccaatttggataactccttatactatggtgccgcatgtttgggatattggttgttgatgcttttacttatcggattagttaattggacaaaggttttatttccaaatcttgtcaagaagttgacatctcctatcgttaacaaatggagaaagtatatctcggcaccagcaacttttaaaaaggaaaaaaggcggaagaacaacgattattcaagattgtttctcatttaa

SEQ ID NO: 2393 - DNA, 813 bp, Candida albicans
catcttgtttttttttgttttgcaactaacttgtcgattttattgtacaattttcaacaccaagaagagtttcctaaatcaatgaagttttttcagttaataactttcttgctaacatttgctttaattgaggcttctggccgtaaaccgagaaagtactccaaattggatactgccatgcaagcatgtaacgtttatattggtaaatatggtactgtgtgtgcatccagtgggaaaaaaaagtcgatcaattggaagtgttactgtaatcaagaccctggttttggaacaatatccgattgtttagttcgtggttataataatgatacctcaattattgacaagtttgttgacaaatgtaatatgactgaatcaaaattctatgaaaaatacgacagaatccagaaagagtttaaaaccaatggtactcattatgccaataaaacgtcaaagaccaaaacaagttctgctagcaaaaccctgtctacgaaagcatcaggaactgtaagtgtatcctccagcacaggtaaagctagtctgagcacccaaaaggtttcaccaacaccattattgatcaattacaaaacgttcacaccatacaagaatgcatatgccatgtcgtataataactataacatttccatctactatggtgctggtttactaggatattgggctggtatttttgttattgccatattagcaaacttgtttagaaaaatgttccctcgcttaaccaactactgtactggtgcagtttcacatgctttcaggaaagtttttcacacacagacggtggaaggtcacgcattt

SEQ ID NO: 2394 - DNA, 2166 bp, Candida albicans
aaatatggtactgtgtgtacttcaactggtaaaagatcaactaattggaattgttattgtaaaacggatgctgggtttggaacaatctcagattgtttagtccgaggtttcaataacaacacaaatattattagtaaatttacagaatcctgtaatatgacagaatctaagtttcatgctaaatatgataaaattcaggctgaattcaaaactaatggtactgaatatgctaagatgactaccaagtcatccagtggtagtaagacttctgctagtgcaagtaaatcctccaagtcaacaggtctgtccaatgcctcgaagtcgtccacaaatgctcatggcagtaacagcagtactagcagtactagcagtagtagttccaaaagtggtaaaggcaacagcggtacatccacaacagaaactataaccactccattgttaattgattataaaaaattcactccttacaaggatgcttaccaaatgtctaataataatttcaatctttcaataaactacggttcagggttacttggttattgggcagggattttagcgattgcaatatttgctaacatgattaaaaaaatgttccctagtttgacaaattatttatctggttcaatttccaacttattcaggaaacatcttttcttacctgccacgttccgtaaaaagaaagcacaagaattttctattggagtttatggattttttgatggcttgattccaaccagattagaaacaataattgttgttatttttgttgtcttgacgggtctcttcagtgccttacatattcatcacgtcaaagataatccacaatatgctactaagaatgctgaattgggtcatttgattgccgacaggactggtattttaggaacatttttgattccgttgttgatcttgtttggtggtcgtaacaacttcttacaatggctaactggttgggattttgctacttttatcatgtatcacagatggatttcccgtgttgatgttttattgatcatcgttcatgcaatcactttttccgtgtctgacaaagccactggtaaatataatactcgtatgaaacgtgactttatgatttggggtacagtttctacaataggtggaggatttattctttttcaggccatgttatttttcagaagaaaatgttatgaagtcttctttttgatccatattgttttggttgttttctttgttgttgggggatactatcatttggaaagtcaaggatatggcgatttcatgtgggccgccattgctgtttgggcttttgatcgtgtcgtcagattagggagaattttctttttcggtgccagaaaagcaaccgtctctattaagggtgacgatactttgaagatcgaggttcccaaacctaaatattggaagtcggtagcaggtggacatgcttttattcatttcttgaaaccaaccttgtttttacaaagtcatccatttacatttaccaccacagagtcaaatgataaaatagtgttatacgctaagatcaaaaatggtattactagtaatattgctaaatatttgtcacctttacctggaaatacagctacaattagagtcttagtggaaggtccgtatggtgaacctagcagtgctggacgtaactgtaagaatgtggtttttgttgctgggggtaatggtattccaggtatttattccgaatgtgttgatttagccaaaaaatcaaagaaccagtccatcaagttgatttggattataagacactggaaatctttaagttggttcactgaggaattggaatacttgaaaaaaacaaacgtgcaaagtaccatttatgttactcaacctcaagattgctcaggattagaatgctttgaacacgatgttagttttgaaaagaaatccgacgaaaaggactcagtagaatcatctcaatattcactcatttctaatattaagcaagggttatctcatgttgaattcattgaagggcgtccagatatttctacgcaagttgaacaagaggttaaacaagctgatggtgcaattggatttgtcacatgtggacaccctgcaatggttgatgagttgagatttgcagtcacccagaatttgaatgtatcaaaacacagagtggaatatcacgaacaattacagacatgggcataa

SEQ ID NO: 2395 - DNA, 1368 bp, Candida albicans
tcccaccaatattgcttacttaaggatggcggaaattgggcccattgtgattggcagaacagaaacccgttattttattcagcatttcttgaattcccattattaaattttaatttggtggtagaaacaaatttcttaccaatggtggactggctgggattttgcaaattttatcaggtttcacagagggtttctcgtagagatgggttgttaatcatgttccaagccattacatttaccgtttggaacaaagccactggtaaatataatactggtatgaaacgtgattttatgatttggggtgttgtcgctaccatttgtgctggtttcatattgtttcaggcaatgttattcttcagaagaagatgctatgaagttttcttctgcattcatattgtcttagttgttttttttgttgttggtgggttccatcatttagacgaccaagggtatggtgactttatgtgggctgctattgcagtctgggtatttgatcgagctgttcgtttgggcagaatatttttctttggagccagaaaggctactgtttccattaaaggtggagaaacattgaagatagaagttcccaaaccaaaatattggaaatcgattgctggtggacatgcattcatccaatttttaagaccaacagtatttttacaaagtcacccattcacttttactactactgaatcagaagataaaattgtattctatgcaaaaatcaagaatggtatcactgaaaacatttccaaatacttgtcacgtttgccaggcaacacagctaccatcagggtgttggtagaaggtccatatggcgagccaagtggagctggtcgtaattgcaaaaacgtcgttttcattgctggtggtaatggtattccaggtatttactctgaatgtgttgatttagccaagaaatcaaagaaccagtcaatcaagttggtttggattataagacactggaagtctttgagttggtttacagaagagttagagtacttgaagaaaacaagtgttcaaaccacagtatatgtcactcaacctcaagattacaatggcatgaaatcttttgaacaagactcaaattctgaaaagaaatcagatgagaaagattcagttgaatcacctcaaaactcttttgtttcaaaaatcaaacaagacttgtcacatgttgagtttatcgaaggacgtccaaacattgttgaacaagttgaacaagaaatcaaggaaacagacggtgcacttgggttcgttacgtgtggacatcctgccatggttgatgaattgaggtctgctgtaaccaagaacttgaatgcatcgaaacatagagttgaattccatgaacaattacaaacatgggcttaa

SEQ ID NO: 2396 - DNA, 513 bp, Candida albicans
agacaatgtattgacgttgatagaagagcaccagaaaacaaaacaattaaattagtttgggtcgtaagaaattggaaatcagtgacttggtttgctgatgaattgaaaaggttggaaagtacacgagtacaggccatggtatttgtaaccagaccggatgatttgagtgggtttgattcgtctagtaacaaggcccttaaacaaccatatcagtatgaaaaggaatcagttgaaaaaatagaaacaaaatcagtcgatttatcgatttattcacatccaaactcaatagtcgagaacttgcgacaggaattgtcacacgttgaattcattgaaggcaaacctagtatggatgctatggtgcaatacgaaacagaaaaagctgatatgtcgttggcttttataacttgtggacacccgatgatggttgatgaattgagagttgcagtaaagaaaaacttggacaacactccgcatagagtagatttttttgaacaactacaaggttggtcttag

SEQ ID NO: 2397 - DNA, 501 bp, Candida albicans
gtggaaacatttattaatcaaatatctaaagtggaatacttggatttatttgtttcttgtttacatgaagaagatgtaaccgttactaaatatagagaaacaataaatgatgctgctgctgctgctggtggtggtgatattaccaaagaaaaagaaatcaaacgtgaaggtgaaactcttcaaccagcattcaggaagaaattccatcacaagaaggaaaaagttttcaccaatttcaatgattccaaagttaatcgaatttgtgaagccatattaaatgtattattaaaaccagaatattttgataaatatttacaaacgattcttactgcttatgcttgtgagaaaccagcaaacttgactcaagcactcacattaattggtaaaatggataatcaagaacaaagagaaactgcagtgactcatttatgtttcttacaagatgtaaataaattatataaaacatgtttgggcctatatgattcttcacaaccggcctga

SEQ ID NO: 2398 - DNA, 264 bp, Candida albicans
ttagagagattagatcaaacccaatcagatgcgcttaaattaattgaaggacttttaagaagacatatgaaagaacaagcttatcaaatacaaaagaattggtgtgaattgattgattttatcaaagaaaatatcgatgaaattcataatatgagtgaaaaagatcgtgaaagaatcgatgataatggtgaaatctatttgattgatgaaattccaaaacctaaagtatcagaattccctaaattcaatatattagattattaa

SEQ ID NO: 2399 - DNA, 1302 bp, Candida albicans
gtataccccgctatcaatcaatcaatagatatgagaaatttgatagttctaaatagaggacttgtatcacctgagtctagaacatatccagatctacacattatagattctgttttcgatgtaatatctgattccattacatttgtcttatcatcagaagaatcacaaatcattgaagttcaacaattccataaaacagggaatatttctgtattagcaagtttcccaatcaattctaaattaataaattttattcattttgttgattcaaatcaattaatatttgttttctccaatggtgatattgtcacagcaacctataataataataataataataataatagtaatgataccaatggaattgatattgatgaaacaattattgaaattgttggatctattgatgttgggatatctgctgctctgtggtctattgatgaagaaacattagccattataactaatgaaaacaaattattattactttctcgagtttttgaaccaatttgtgaaaaattactcgattctagtgatataaaaatcactgattctaaacatgtttccgttggttggggtaaaaaagaaactcaatttaaaggtaaaggttttaaagcattagaaagagaaagagaagcattgaaacatgctggattagatgataatgctactcaattacgtgatccaactgttaatgaaattgaaaaagggacattatctccatttgataatcaatctgtacaaatcagttggagaggtgattgtgattttttttcagttagtactgttgaaccagtcattgttgaagatactggagaaatgtatgaaagaagagtcattcgagtgtttaatagagaaggtgaattagatagtgtcaatgaggccgttgatggattggaacataacttaagttggaaacctcaaggttctttaattgcatcaactcaaagacatatagacgaagaagaagaagaagaaaacggtgaagaacaagtacttgatttagtattttatgaaagaaatggattaagacatggtcaatttaatactcgtttaaaccccgaaaccgaaactattgaaagtcttacttggtcttccgatagtgaaattttattatttcaattacatgatagaattcaattatggaccaccaagaattatcattggtatttaaaacaagaattatttgctaaagatattatttttgctaaatttcatcctgaaaaaccattaaattttatgattggaacccccacagggattcaaattgttgatttaacttataaaattgttacgggtcca

SEQ ID NO: 2400 - DNA, 501 bp, Candida albicans
gaaaataatgtggaaacatttattaatcaaatatctaaagtggaatacttggatttatttgtttcttgtttacatgaagaagatgcaaccgttactaaatatagagaaacaataaatgatgctgctgctgctgctggtggtggtattaccaaagaagaagaaatcaaacgtgaaggtgaaactcttcaaccagcattcaggaagaaattccatcacataaaggaaaaagttttcaccaatttcaatgattccaaagttaatcgaatttgtgaagccatattaaatgtattattaaaaccagaatattttgataaatatttacaaacgattcttactgcttatgcttgtgagaaaccagcaaatttgactcaagcactcacattaattggtaaaatggataatcaagaacaaagagaaactgcagtgactcatttatgtttcttacaagatgtaaataaattatatattcttcagccacggaggctgccagattccgcgctt

SEQ ID NO: 2401 - DNA, 912 bp, Candida albicans
agattttattcactgatgattctaccgtttaaaatcactccattttcaaatgtaatgttcccaccacccattattttcggagaatttgatattaatggtaatatcaatgatttgcaattcagtaaatctaatgaaaaatatgctgtactttcaagtgaaggagatatttatttcagtgaattatcattaaacgatatgaaacaaggtaacacccttcaaatcaaccataaatattctaaagataaatatataactgattctaatgaggtggctaaacaaattgcttttcttaaagatctgtttgttgctgttgctatagattctccattgggttcacgaataacattatttgaagtcgatgatataaataatccatttgttaatgaatcagttaataccactaccaaaactgttttattaaaatctagagcagattttaatactgtgattattgaatttgttgataacagagtcgtggaattggattctacccttgattgtaaagaaattgtcaaattccctcaattatgtcgtgatattgaagtttcttttaaagaagatactcaacaatatgaagcttttgggatttctcgaaatgggaaattattttgtaatgaaaaccatgttgttagtggtgtcacatcattaaaaattactgaatctcatttattattcactaccgtacaatcaaaattatgttttattcatttaaattcaagtcaagaaaattatgaaatttttctgaatttaaccaatgaaaatattgttgatgaaagaattagacaagtggaaagaggatctatattaatcaatgtaatgccaacgaaatattctgtagttttggaagcccctagaggtaatttggaaactatattttttcaaccactggggctggaacgacccgcgattgcg

SEQ ID NO: 2402 - DNA, 402 bp, Candida albicans
  unsure (364): Identity of nucleotide sequences at the above locations are unknown.
aaattcaggaccactatacactttatgattcaattagaagaaagagaaattcctgtaataccaggtaataaactagatgaggaagaaaccaaggaattacgattgatggtggctgagttattaggaagaagaaatactgggttcccaggttcacaaccagtttcatttgaaagaaggcatttagaagagacattgatgcaaaaggattattttgtatgtgaaaaaactgatggattaagatgtttattatttttaatcaatgaccctgataaaggtgaacgagtatttttggttactcgagagaataattattattttatccccaatatccatttcccattatctgttaatgaaacttctgaanaaccccaatatcatcatggaaactttattaaatggtga

SEQ ID NO: 2403 - DNA, 807 bp, Candida albicans
cctgatatagtcaactcccctgaattcccctttaaagttggattcaaaacaatgctaacttcttaccatgctgatgatgttttgagtaagatggataaattgtttcatgcttcagatggattaatttatacttgtgccgaaacaccttatgtatttggaactgaccaaacattgctaaaatggaaacccgctgaagagaacactgttgattttcaattagagtttgttttcaatgaggtgcaagatccagacttggacgaaagagacccaacatcaacttatctagactacgatgctaaaccgaatttaataaaattgagagtatggcaaggtagcaatgtacatactgattttgccaagttagatctatcagatgatgattgggaaagattgaaggcactagagcaaccattacaaggcaggattgctgaatgtcgccaatctacaactaagaagggatattgggaaatggttcgattcagaaacgataaaagtaatggaaatcatatcagtgtggtggaaaagattttggtatccatcaaggatggtgtcaaagagaaagaagtcattgagtggtgtcccaaaatatcaagggcttggaagaagagagagaacgatagaaggcagaagcatttcaatggagttgctcgtccagcttctgtactgcacgaagaaccattacggaagaaaatcaaaacggaatctaatggtaatggacatcaaacgcctccaagacaagaacaacaacaacaactgcaacaaatacttaatgacatacccacttatgaagatagtgacgacgaataa

SEQ ID NO: 2404 - DNA, 213 bp, Candida albicans
tatcaaactagacaacacatcaatcattcacacatccccaaaaacctaatgcaatacccctatttaatatcaagaactttagatccaatagttggtgtcggaataggtattttatcatattattcctatgaacagagggttggccgcaaaccaggacattcattaaatgagttggtactgaaaaagttttacaattggaaaaataagaattga

SEQ ID NO: 2405 - DNA, 195 bp, Candida albicans
tatcattatcccttttttcattcccttttgattaataaaacaaattatatcatgtacggaggtccacaaccaactgaagaacaaaagaaacttcaagaacaatacgcttatgatacattaaagtttgctggtttagttgctggtgctttatggattagtcctatcattgttaatttcattagaaaacaattataa

SEQ ID NO: 2406 - DNA, 459 bp, Candida albicans
ttgaaaactactagattaccattattgattagtgatgttaatgatgaagaaattgctgaattaccaacatttagcgatgattgggaaaatgctaaattaatccaagattatcatttaaatgctaatactagaaagggtggatcatcaacgaaatttcaaccaccaatttttataacaattggagtcattgggaaaaatttaattttggatccatcatttgaagaagaacaagttttagaaaatgggttaattataagtttttataataataaagtcattacaccaatatcaaatactaattttgctgtcaattccaataattcaaattttaaaggattggatcaatcattattgattcaatcattaacattatgcaataaatattgcccgaatattataagagcattagatagtttaatagaagaagataatgatgataatgatggttctatattttaa

SEQ ID NO: 2407 - DNA, 333 bp, Candida albicans
  unsure (316): Identity of nucleotide sequences at the above locations are unknown.
aaaaaaaaagcgatgggattcaattacatcaaacttacttatagacatctcctcctaccccccaccgtatacacctatactatggttcaactatcaccagcagaaaagtcatatttatatgattcattaactcaacaaccaataataagacctgatttacgatcaattcatcaatatcgtcctttagttgccaaaacttcatttttaccaggatctaatggatcagctcgtgttacaactgaatatggtagtgaatgtattgttaatgtcaaatcaaaagtagtattgattctggaagatgaaaaagaccgcttcnactatgtcataatctaa

SEQ ID NO: 2408 - DNA, 354 bp, Candida albicans
  unsure (14),(338): Identity of nucleotide sequences at the above locations are unknown.
aaaagaccgcttcnactatgtcataatctaattgaggtggatattgatattgtgggacatcgtgatgattcacattatgtcgccaatttaaaattccaattaaccaatttaatacaacaaaatctcccatttgaagttttgaaattgacaagtaaatatacatctaaactatatatcgactgtattataataagtcattcatgtaatccaataagtttgaattccataaccaattatttaacattgaagactactagaattacattattgaataatgaagttaatgaagaacaaattgctgaaattccaccatttaacgaagaatgggagaaagctcnaattatcccagaataa

SEQ ID NO: 2409 - DNA, 1269 bp, Candida albicans
cccccgagattggtccttctggccgcgtgtgtgagacaaactactaaaccggaaaacctgagttcaagcaaggtagggttttcactcaatataatcgagccatctgttcttttacttgcagatgatacccgagaaaatactgaagcagttgtgttcaaagttggacaaattttagttactcaacagaatgtaatctcgttagctgcaaataacattggaatgtatttgatggatatgaacgagcaggatacttctcggtatagaattatcgatgatttttccatatcttttgcacatgattcccgtggttctaccgccaccaagttcttgacaaacattcaagcatccatagatccattaattgtaagagtttcgttgagagatattagacttgcattgggtatattcaatagagccaatgagctatacatgaagcaccaaggtgttgtagaggatacatcgaattcagaagagtttcagttttcaaagaatttcaaaaagaggctttcacaatacgctccgagtgtactttcaacatattccgatgattctgattatgaggctcctcgaattccagaaggtgttgctattgtgaaaggtgaagagatgaatgccaattttggtggtttgagatttgttttgattggtgatgtatcagaattgcctgtccttgatatgaaaatcaaaccttttgaagcacgagcaattaactggtccacggatcttaatgctgaggtacatattgagcattatataaatatattcaattatgcacgatcatcttgggagccattggttgaaagttggccaatagcagtttacatgtcaaaatcccgacacccaaagcctcaattattagtagaggtgatttctagacaggtagctcaagtgacgcttacatccaaagcagtagcattgctatctcaagtatccgatttgattacttccagagaaaaattaaaaccaagaggtgaagattacccatacgtgatagtgaatgagactggtttagatttggaagtttggaatgatgcaaatgaattcgaaaccaaaactggaatcaaatcatgggattctaaaccttggagctttgaggactggagatccatccgtgaaaacttggatgcggatgatgctagtacattgggaatcagatttgttgatagtgagtaccagaatattgtcagagtatcagcgtctagtgttggagaggagttgtatattacgcaaccgttttcactcacggaggctggcaggatccgcgcttaa

SEQ ID NO: 2410 - DNA, 939 bp, Candida albicans
cgatcggccgactttttggggaatccagtgggtttgtttaatttgctttcttcgggtgtcattgatatattttatgaaccttaccaaggatttgttttgaatgaccgtccgcaagagttagggattggtattgctaagggtggattgagttttgttaagaagtctgtttttggattttccgattctatttcgaaggtaactggatctattgctaaagggttgtcggtagccactatggataaactgttccaagaacgccgtcgtttgaatacaaggagaaacagaccaaaacacgcattgtatgggttcgctactggtgctaattcttttttcgattcgttgtcttcaggtgttacgggagtggccacagctcctattgaaggggcaaatagtgatggcgctgcaggatttttcaaggggctaggcaaaggaattattggattgcccacaaaaaccgccattgggttttttgatttggcatcaaatgtcagtgagggaattcgtaataccacgactgttttcgatagtgaggggttagataaggttcgattgccacgatatgtaaaccctaatggggttgtcaagccatattcacaaagagaagcacaaggtcaattttggcttaataatgtggatggtggtgtctactataatcaaaagtatttggcacatttgcttttaccaggcgaagagattgcggttttgatttccttcaaattgataattttgtttgatataaattcattattgtcgaaatgggtaattaagtttgagcaaatcaagtcgatttcagttgaacctacaggattgacaattcagttgaaagctaaaaagggtccattcatacctattccagatagaactagcagaaatttcttatatcagaaaattggtattgctgttcaagaatttaacaagcattgtcaagttactctctaa

SEQ ID NO: 2411 - DNA, 1959 bp, Candida albicans
agatcttccagtatgtttaatgcatttggtaacaacaggggtattgaggatgttgatattgaagattctacccaaccgatcagtaagcctaatgctccaacaaataaagatcagcatcaatttgagtttgatttgaatgttaagttggtgcagatttcgctctctagatgcatagatgcggtaacattgcaaacggagccattggcggaaattgttggtgagtccatggcattgaatttctacaaaacccttgccgacatgtatttaacattaagtgtttttgacatcagcttattggatcacattgaaaaatcaggagtgccagagtttcaaaagttagtatcgtcaaatagtgaaggtgaaaagaagaacttgcttgaaatgaaatactcacgaaagcaaaggttggttatgtttaaaaataaagagatcgaggtattcgaccaagatgtcgatatgcaaattgctgttgtcaaattcgtggttacaagaaaatcttacttgagcttgttgaattttgtgttaaatacttttactgatccaaacgcaccagcaacaccagctgacgagttaataaatgccagttcaagcgaagatacttcaccacagaaaattaatgtcaatgttgcattagaaagtataattatcgttcttaatgaagatggcatcaaattggcgacattacagttgagctcggctgaagtgaaagtgttcttgttaccggatacaatggatatacaaggtaaacttggagcatttgcattgcatgatgaagtaaaccaaggctctcccagagattcgttgattagaaatcttattcacattgatggtgacaatttggctcagttttcttataaggcttacgataatgtcactcaaaataaaccatcagttgtggaatttgaaacaggtgctatcacaataaattttatcgaggcatcattcaatagaatattggcgtatttaagtcagttccttaaaatgaaggcaatctatgatagtgcacgtcaagctgccatcaatcagtctgcccaattacctgctcaattattgtttaatgttttaatccatgcacctacaatcgtttttccatttgtaaatcataatactaacaagttagtggccaatttgggagagatttatgcccataatcaatacaaagattcaagtaatacgatacaagttggtattcgtaatgttaatgttatgtcacatttggagtttgaaaatgatataaaacaagatctgcatatggtagatgatttggatatttcctttgatatagcatattcagagaaatacgttaaagacgtaccaacgtttgtggtacgtggcaagatgcccgagttagatttgcatctaactgaaattcaattaaaaatgttgacacagctctctgattctgtgaacagagcctttacgtttgatgactcagattctaatttacaggatgttgaagaagatgctgtttatgcgaacgaagttctcagacacaacactcaaatgatacatgctgaatcaccccaacagccagaagcaatagtttctcctgataccgaggataccgatatccctggaaatcataaaatggttgacttaaagtttgacgttcctcgagtagctttgactatttacaatggaacttcgagtactgctacgttgaaagattactcattgtcttcttttacaatgaacaaatttatttgcgaatttgatatgttgcacgatgggcactttaatgccaatgttaaaatcaagtcatttgttgtcaaagataccagagttaatacagatagcaaattccctgtgatcattcctagcgttgatggtgttgataaccaattcacgttgttagttacgaccgaaggtcctgcagaaagtaggaatataactgctatgttaacaatcgagaaaccccaaacaatattagcactcgactactcgttcgtcttcacctag

SEQ ID NO: 2412 - DNA, 660 bp, Candida albicans
aagtcgtatattatgcgacctcccgtctgtggagttcataatagattatcggttgatattatgctaagagaggataatgtcaaagttattagattgagatcaacagttatgatagagaatgacgctgatatacctatcattattgacatcagcgatacaagaggggataaagaattgtgcattgggtctaaggaaacgaagtctttacctattgatttggtttatggagggaaattgaagattaaaccagagaccaatatttcatacggttggtctgaagagcaactatactggaaggatgctatgaaaggttgtattgcactaagttgtcgtgcaacaagtaaagacgataagtctgtttattattttcaagcagaggcagtatatgacaaagaggaacctttggccaatgtgtacccacatatgaaattagtggtgtctgcaccattagaaattgagaacttgcttccatttgatttcaagtatagattatatgataaacatgcaaggaaagattggacaggcagagtagagaaaggtgtcaagagttatgttcatgttgttaatttggagagcttactacttcttagtgttgaacccgtgaacaccagctttaagaaatcggaatttgctgtaataaatcatccccaagaagagtga

SEQ ID NO: 2413 - DNA, 1464 bp, Candida albicans
atcatccccaagaagagtgaatttgaaagaggaaatacatttacattacaagatgttaacaacaggatactccagttgaggatatattaccctagaaaaaagtcagatagtacaagtttaaaagttgtgatttattccccatatattattttgaatcgatcgaatttgaatttagctatcagcgagcgaggtaacactattgaactgcttggtaggtctgatgaagaacgcaagattacacctgttatgttttcatttgagaagcatggtgacaccaagaatcgagcaatcataagagccgaagattcgatttggtctcagcctatgagttttgatgctcttgggcaatcgaatgaagtcaaattacagattacggggaaacaaatggaaattgatcttggtgtcacagtttcagaaggagaaggcaaatacaatttaactaaggttataagcattactccgagatatatctttgtcaataagctagaagaagagttgcagattgtggaagttggcaccacaaaacatttgtctataaagtctggtggatcgttgcccctttatggtttgcgcatgctagagaaaaagaatttgatgatgaagttcccacaagcatcaggatcaatgtcttggtcacagccattctgtattaatgatgttggacaaatgtttgtgaaagtacttaaaaaggatgtgggacaagtattggtgaaagccacgataatgctagaagatgcaaccgtgtttattcatatagaaaatggtaatgatcaatggccattttctattcgaaactttactaatgaagagttctatatttaccagaacgatccaaatattaatgccaatggtgaagttgtaaaaagtgaaacaccatataaaccaatctattacaaggttccaccaaaaagtgtaatgccgtatgcatatgattatccgaatgctattatcaaggaaataatcattagatcacatggacgagagcgtgcggtaagtttggcagaaattggtaacttgaagccctttagacttcctgctacaaatgacaaggaacagagaattgttgacctcaatgttgttgctgatggacctacacaatccttggttatttcaaattatgacccatccagtagtctataccagataaaaggtggttcgacttcgtcgagctcagtggcaaatagtcacactggtcaatttgaagcggtagaaaatgatgaaaattaccacaccaaaatcgttacaaagtttgacggatttggggtgtctttgatcaatacaagagatcaagaattgtgttatataactttgaaaggattagagtttagatataatgagtctaatttgtatcaaaatattagtgcaaaattgaaatggattcagattgataatcaactttatgggaggcataatcccaatttaatttatacccaagtgtcattccgaaaaccgggaaaaagttga

SEQ ID NO: 2414 - DNA, 2394 bp, Candida albicans
aatatgtttgagtcactcgtagcaaacttggtaaatcgtttcttgggatcttatttggaaaatttcgacacaaaccagttaaacattggaatatggagtggagatgttaaattgagaaatttgcgtctaaggaaagagagtcttgataaattcaaattaccagtagatgttaaatttggtcaattggggcaattgactttacaaattccatggtcaaacttaaaagggaaaccagttagagttattatcgaagatgtctatttattggtatcacctaaaattattcaagattatgatttagaagaggaggaattgagactgcaagcggtaaaaaaggaaaaattggctcagttagaaacatttttggatgcaaaatcacaagagttgggtaccgatttagagaatgaaacctttgttgaatccttagtaaccaaaatagtggataacctccaagtcactataaagaacatacatttaaagtatgaggatgattctgttttaaccgagactccatattcgataggatttactttggatgaattgtcagcagtttcaacagacgaggattgggtaccttcctttatcaatattacccaatcgcttacaaggaaattattgactttgaagaacctttcttgttacatggatactcaggggactgagttgtattcaaatctcaatcgtgaagaaatgcatgatgctttccaaaaaacgttgactgacatagaatatttattaaaacccgtcaccggtaatggtaagttgacagttaataagactggaacaaccgcatctatcccgcatattgatacagacttattttttgaggaatttggagttgaattgaattcccaacaatatcaaaatttgttgtggactgcatccaaatttcactggtttatgaaaactgaaaaatttagaaaatttcgtcctaaaattgcacccagtgaatctccaaaggaatggtttcaatatacagccaaggctgtgttagatgaaatacacgaaagaaattataagtggagttgggcatactttgagaaaagacgagaccagagaaaggaatatatcaaattatggaaattaaaattagaaaacaaaatgtcgcctgagcaacaaaaatcacttgatgatttggaatgggacttaccttatgaagatataaaactatatcgttcattcactagaaatgaattgaagaaagaaaagaagaatatttctaccttgtacgacactgagagtaaatctgccaatgatgcccaatctactggtggcggtggctggctttcaagctggtggggtgggtccaaacagctgaatgagagcaaagaaaaactgaataacgaatcccaatctagtgaaaaaattgatctttctttgagtgatgaacaacggaaagcactttatgatgctattgattatgatgagaatgccgatgcagtaacagtggatattcccggagaatgggtgaagatgcaagtcacaatgcatttaaacaagggggggtttactatcaagcgcaacaagacaactactttaggcgaaattgtttttgaaggctgtaaaacacagttttatgagcgcccagattcatttctcgctagtttccagatggaggagtttagaattgaagacaacaccgatacatctctatacaaacatatagttagtgtcaagcaagatgaagaaaaccaccaaggtgatagctttgaaaagccctttttgcagttatcgtttgaaaacaatccattggatcaagaagcagactcaattcttgttggaaaattgaaatcgatgactatttattacaaccccaagttcatagaagaaattatcaaatttttcacgccacctaaaattcatttagataccgtgggagcaattatgaatgcagcggagtcaactgtcgaaggattgactactcagactagaatggggttagaatatgcattggaagagcacaaaacaataaatgtcaagttggatttacaaacacctttgataattctaccacttgatcctgctagtgtgaagtccccagtagctattcttgatgcagggcatataagtgtaatcagcgatttagttgataaatcaaaaattaaagaatacaaggagaaacagcaatactctgctgaggattgggagagtttgaaaaacttgatgtatgatcaattccatgtgaatcttgaagacgcaagatttttagtgggacacaatatcaaaaccacaatggagcagttgtattccaccgatagatcaacatatgttttagatacattcaatttgggtttacttttaggtatttctattattccagatgcccaaaacttggctagaataagaatacgtggcttttcaccacgagtgtgccggaccgcactatttaagtga

SEQ ID NO: 2415 - DNA, 1368 bp, Candida albicans
atcatcatatcgaaatctcaccaaacactaaaaccaccaatggtcactaccaccaccactaccactttaaatgtcaataagactttaaaggcaattgatttaattgaaacttccattaaaaatcacattctgacaattgatcatgaatattgtttaccaaatgatgaagattcattttttgtatgtgatttaggagaaatcattaattcagttaatcaatggcaacaaattttaccaatggttcaaccttattatgctgttaaatgtaattcaaatccacaaattttaactacattaagtgaattgggagttaattttgattgtgcttctaaaaatgaaattgatttagttttatcattaggaattcatcaagcccatgaaagaatcatttatgctaatccatgtaaaacaaactcatttattagacatgctgctgatgaaaatgtcaatttaactacagttgataatgttcatgaattatataaattggcaaaatttcatcctcattgtaaaattttaattagattgattactgatgattcaacggctcaatgtcaattaagtactaaatttggttgtgatttacatactgccattggagaaattttacccaaagctaaggaattgggtttacaagttcatggagttgcctttcatgttggatcgggtgctaaagattttagtagtatttatcaagccattaaagattcaagaattttatttgatgaaatgttatcaatgggattcacacctaaattattagatattggtggagggtttgaaagagaaacttttccacaactgtcacaaatggttaaatttgcattggaaaaattcttcccaatagaattttctcaatcaaatgaaatcaaatttattgctgaaccaggtagatttatggttgctaatgcatttactttgattactcatataattgctagacgtgatttaccaacgggtggtaacaacaataacaatgatatgactccatcggctatgttatatattaatgatggtgtttatggtaatttgaattgtattttatttgatcatcaaacccccaaagtttatgttttaactaatgaaaatcagttgttttataaacaagaaatgatgagatctttactggttaacaacaacaacaacaacaacaacaaaaccgatgggtttaagttttcaatttggggtccaacttgtgatggattagattgtgttagttcattagctaaattatccaaaaatgttcaagttggtgattggttatttttcgaaaatgttggtgcttatactagttgtgcaagtactaaattcaatggattaagtagtggagaaactaaaactctttatgttaattccaatgaagaataa

SEQ ID NO: 2416 - DNA, 771 bp, Candida albicans
gatatggcggtgattaatcaaccaaatagtcagatcagacttacaaatgtttccttagtccgaatgaaaaagggaaagaaaagatttgagattgcatgttatcaaaataaagttcaagattggagactgaaagtggaaaaggatattgacgaagtgttacaaatcccacaagttttcataaatgtttccaaaggtcaagttgctaataatgacgatttacaaaaatgttttggcaccactaatcaagatgaaattatagctgaaatcttaaacaaaggagaaattcagttgaatgaaaaggaaagaaatgcaaatttacaacaaaagcaaaatgaattcttaaatataatttccactaaatgtataaatccaagatctaaaaagagatatcctccaagcatgattgaaaaggtattgaatgaagtcaaatttcatttgaatcctactaaaccaaccaaaattcaagcattggatgccatcaaattattagttgaaaaacaaatcatacctattgccagagctcaaatgaaagtgagaattacgttatctaaaaaagcatacttaaagacttttcaagatgaaataaaacctgttattgatcaaattgtggaggaagataacaatgggaaacaatatgagattgttggtattatagatcctataaattatagagtcttggtcacattaattgaaaatacagatggaagcaacaaagtcgctaaaggagaagggtctatagaagtattagatatgtctgccataaaggaataa

SEQ ID NO: 2417 - DNA, 492 bp, Candida albicans
gacagatatttaacacagccaggttggaacattgaatatccgacaaatccaattttaaaacaagtttatattgatattatggagaaagatggattaaatccatttaaaatgattagaaaacaaaaagaattttctttaactggtacttatagaaaattaatggcaaaagctaataatttatcatttgaactcatcaaatataaaactgaggaaggcgaagatggtgaaacaggagatggagaaaaaccattgattagaactgatttagaattattaaatttgaaaaaagaacaagaaaagaaatcatcgcaaaaatctgtcactactccaatagagttaccggatagaattattaacgacgataaggaagggggtaataaattggcagtggttttaagaatgcaattaggtgttagttcatatgctacaatggcattaagagaattcatgagaattgatacttcaagatatcgtgatggtttatgtaaatag

SEQ ID NO: 2418 - DNA, 819 bp, Candida albicans
  unsure (786): Identity of nucleotide sequences at the above locations are unknown.
ataatctttctttatatatgtatgataagacattggttacgtacaattacacgaatcatgtctgaatcacttaaaagatcatttccacaagatcaagaaatattggcaactcaaaccaatttaatcaatgatggcagtggtagtagtagtaatgttgctaaaaaattgaaaccaactcttatgggaatcagtgaaaccaaagctggtattactcaatttattaatcctaatataactgggttttctggattattaaaaacattacattctgatttccaagtcaatgaaattgacccattaggtaatgtaattcatttaattgatgatggtattgatgttggaccatcaaaaagagaattgaaattacaagaacgagctaaatttcgtcaagaaattgaaggtaaaactgaagaagaaatcgctgaaataaaagctgccaaacaacaagaaaaagaacaacaacaaagatcgaaagaggctgacgacaatggtggtgatggtggtgaatcaaataaacatccaaaaatatctgatgaagatcgtgaagaattattgaaatttattactgttgaagaattgaaacaagttgaacaattatttcataatgggaaaaattttgaaactgaaactaaatttgatgataaagaacaacgaaccaaattacatcaattatttagaaaggtttttcaaaataaattagaaactattacatcactggaaaacacttttaaaattgccatatcatcaagaaatcgtaatggtggtagtagacaagacccaacggtnttctttacaaggcgcacgacccgagaaatggat

SEQ ID NO: 2419 - DNA, 513 bp, Candida albicans
ccctcccagttaaataagcgcggatccgtctatcccgtggtgaagactcctgataaaccatatttacatttcacggtttataaacaaaatcgtgacacaatggaagttgctaataatattgggaaattattaagaattaatcataaatttataaattatgctggtactaaagatcgtcgtggtgccacatgtcaaagatttagcatcaatcatggtaaagtattacgagtcaatgcattaaataaactgaaaaggaatggattcacattagggtcatttagttatgaggatcatccattaaaattaggtgatttaaaaggtaatgaattcacgattgttattagagatataaaacctcatcatcaacaacaacaacaagagcaacagccccaggatcaatcacaatccattgaatcaattgttacttcatgttttgaaagtttacaaaaaaatggatttataaattattttggaatgcaaagatttggttcatttagtatatcaactcatgaa

SEQ ID NO: 2420 - DNA, 936 bp, Candida albicans
ttctctctcaatcaacaactaatcatgcaatccgaattatactcctcaacgtacggtaaaggtaatgtcaaatttttaaaggtcaaaaaagatccatcaaacccaactgtgcaagatgttcttgaagctaatgtccaggttttgttgagaggtaaatttgatgaatcgtacaccaaagccgacaactcgtcgattgttcctactgatacggtcaaaaacacgattttggttgaagccaaaaccactgatgtttggccaattgaaaggtttgctgctcatttagctaaacatttcaccactaaatacggacatgttgatgggattgaagttaccattattcaagccaaatggtcaaagattaagttagaaggtaaggaacatgctcattcattcaagcacgaagggccagaaactagacgtacttatttgaactacgacaagcacaccaagaaattacaattgtcgtcctcaatcaaggacttgacggtgttgaaatcaactgggtccatgttttatgggtataatgtgtgtgactacaccactttgcaacctaccaaagatagaatcttgtcgactgatgttgatgcttcgtggacatttgatccaacacagatcgctactttagacgacatattatcgcaaccaaaattgtttgacaccacatataatactgctagagatgtcacattagaattgttctgtaaagaaaattctccttcggtccaatccaccatgtacaacatgtctcacaagattttggacaccgtaaagcaagttggtactgttagctatgttttaccaaataaacattacatcttgttcaatttggaatggaaaggcattaaacactacgaagaattgttctacccagcacctgatccaaatggtttgattaaaagtactgttggtaaaaaaggtgacaaacccaacttttag

SEQ ID NO: 2421 - DNA, 1842 bp, Candida albicans
agacaaaatgctctaacgaaagataattcatcattaaatggtaaatttaggaaactttcatttttaagtactggtaataattcaattacatctaaaagaaaagaaagtataagttcacatctgcctagtgcagttgaatcaccaacagggacagggacagggacaggcccaacaacaaggtctaggtcgaggtcaggatctaaagttgatggatcttatttcccagattattctgataaaaccacctcaccatcgaaactaacactccagaaacaactttcttcttcttcttcttcttcttcactgttgttgccaccatttaatgtaattattgatttatctgtttataatactcctcaaggaattgaaaagaatttttttgcacctaattatcaagttttccgatataatagttttcttgatgtattaagtgaatatcatcaaggtgatgccattaatgtatctactattagatatcatttattattaaaatttattattaaacaaaaaaatgctcgagatttcattagaaatggtaatagtattaatacatcgagtagttatcatttaacaatgacagaaagtgttttttcatatcaattatatggaccattaagatatttaattagatatttaataaagcaaaaattccaagaacaaaatcataacaatagtatgctgccagataatcgagaacaattttataatcatgaagaattgatacaaatgaattttattaattttataagatatattatgcaattacctgatatacctgatccatcaattctaaatgaaactgaacaaaaaatttatgaatttaaagaaatttttgaaaaaacggcaacagcattatatgtattgaaaaaagataaattattacaaccaacaacgacaacaacaacaacaacaacaacagaaacatccgtggaatcaaaagatgaatcatttcaacaacaagattctcaagttcgaatcaaattattagtggaaacgatcacgaaaatttgttatgaatatattttattagaaaaatatcgattagatataatttcaaaatttcatgataatcatttaattgataaagatattcttaatgatttatatgataaatatgagaataatgtgaaattgaaaaatagtgaaaatgtcaaagtatttctatataatacatctaatctgattcaatttggttggtattttgctcttactatcccatttgtacgagtcattgaatctcatgtttataatgaagatcctcatcttacaaaggactaccaaacatatcaagaggcagaaatttccaccaccacctccaccaccgcaaccaccaccccaaaaacaaatttccaacaatctgatgaagaattatttgagaatcatattaaaaaattatcatttacatcatataatgaatataaatcattatctatggaaaaattagtgagattaaatcgaattattgataatcaatctaataaatatagtaaaatcaatcgaagagaaattcctgatcctgcatcgaatttttcaacaaaaccaatgaattttgaatattataatcaatcaatgttaaccattgaatcaaatacttttgatatgattcatactcctgatttaatcattcaaaccactccacaaaattataaaactttaatcagtgaatttcatcgaattttaaaaccaggtgggatattgaatttagattgtgttaattttggtggtaataattttgaggatttttcattgaaatataaagaaaaaggtcaatttccgaaaatattaaatactgaagattatggaatttgtaaacattttaatagtatttcaaaattttcttga

SEQ ID NO: 2422 - DNA, 432 bp, Candida albicans
ctacttttctacatcagtttccaacggcatacacatgtatggttttccatgaaagatattttagttattcacattggagcaggtaaacatgatcccaataagctgaaaaagtataaaacactactacgaaatgcattatcaaagacatcaatagtagaagcaagtgatgtgattgaatcatccccactaactaatacaggctatggatcatcattaaatctattgggcaaagtagaatgcgatgcaagctttataactaatgacaagataggtgcagttgttaatatgtcctgtaagaatcctacccagggagtagtatcgtgggtatcaaaatctagatacatggtaggattcagaggaaaccgacttaacttcgccagtgatgtgaatatatccactattgaaaaactggttcccacatatagtggatga

SEQ ID NO: 2423 - DNA, 600 bp, Candida albicans
tcgactgacacagtcattacaatggttttcaaattcactatagataatgtacttaacaaatacattcctcgcaacagactttcaagacttcctcgtcctatagctcgtttactaggtgcacataaagataaacccgcagccgactatttcatttggttggaaattcttattggaacatttgccggtgtagcacttttggaaggggtatttaagagtcccaatatatttagagaccgacaccatgctccaatgatacttgcttcatatggtgcttcggcaattttatgttttaatgcatcgcaagtacccttagcacaaccacgaaatgtactagttggccattttattgcctcggtgattgggctctgcatccaaaagttgtttagtttaagcaaaaccggacaggatcattactgggcaagtggtgcactaagtgtcgctgtttcaagtgttgcaatgtcgattggaaactgcatacacccgcccgcaggcgcatcagctcttttgcccagcatcgatgagcaggttcgtgagatgagctggtggtttctacccagttcagttaggtcttcacgccgggctggaaggtacgcgattgcg

SEQ ID NO: 2424 - DNA, 1134 bp, Candida albicans
acatctattagggctttagtcatagagcctctcgtttgtgaatcaagaacattaaatctcatgattggtagaagttccagagatgcaagtcaccataataaaaagttcagaaaactgccaattacaggaactacttcaaattcttcacagttgagcattttgaaaacaccacagctaaatttaatagccatttcatctaaggatttgttgttaacacccattatactgaccaaatcacactttattgatgcttattctaaaggcaaatggaatttgtccaaagtcccatgtcctccgtgcatgttaaataacggttatatgaaacctccagaaagttataatgaaccgtcaaggttaaatgctgtatcacagtttattgaattaccacattggcatgaaatgacaatttttaaacgatcactttcaaagttgcggaaaacatttcaggtaccaggggttgctttgtcaatgattgacaactacaagtgccactttaaaattgaaaccatgttaaatactagctacgtgccaagatgcatcgcaattgactcacatgccatactctcacaggggtattttttattattggatgccacaaaggattggaggactcgagccaatccattggtaactagttctccttatatccgtttttggtgtggagttcccttgatcacatccacccaagaggtggttggagttttatcaatatttgacaggttttcaaaagacaactttaacgaagagaactgttccgtattagaatctgcaagtaaagaaatcatgagtttgttagaaacccctttgtcagaaataatgttcaaattcagtggatactctgcaagaactaataatacagattttgtgtatgtgaatgaagacttgaaagacttgcaaaagcaaattggcagagcaactagcagtaaatcttctttggtatttgagaaagacggttcaggggggaggtactcacaaaataataattatcggtttataaagtatggtcccagtagtattaaactgggtatcacctcaaatgaacttgagaatgaagagctttcgaatgcacttatcaaagaaagagatttgtggcaattcttattttcagtgggatccatgaagaaagcacgttcg

SEQ ID NO: 2425 - DNA, 585 bp, Candida albicans
atatcgctgctaaaaatgtcttggttcggtttttttgatcctgattttgatgatttcttcggtagacctagaaaatatgccactgaaattccaccaaactttaatccaagaaaaattgctcaaggtgacaatggtaaaggacaacaggtctctcgttatggtgctggtgctggacaccctcacagagcattggcaagaagagatgatttctttgatgacttttggaagaattttagttctggtaaatactttgttggtttcgatgacaatgtaaagactactgaagaatccgacaaatacgtggtttcctatgatcaggagaatttgagtcctgatgaagttaatgttgattttgataaacaagagaatgaattgattatcactgttactcaagagacagaaaaagatggtactaagaaaagtagcactttccacagtaacttgaagtttgaaaagccagtcaactttgatgacatcagtgcggaaattggtgagcaaggtgtccaagtgaccttaccaaaagtacatgccgatcatgaaaagattgtcaacattcctatttccaaagcagctgcaaaaaagtaa

SEQ ID NO: 2426 - DNA, 753 bp, Candida albicans
tctatcgttactactactaccattatcacatatcacatatccttaaccatggcttcatttttaaagatttctactttgattgcaattgtttctactttacaaaccactttagctgctccaccagcttgtttattagcttgtgttgctaaagttgaaaaaggttctaaatgttcaggtttaaatgatttaagttgtatttgtactactaagaattctgacgttgaaaaatgtttgaaagagatttgtccaaatggtgatgctgatactgccatttctgcttttaagagttcttgttctggttatagttctcaatcttcatcatctgaatctgaatctgaatcggcttcaagtgaagaatcttctgcttccgcttctgcttctgcttcttcatctgctggtaaatcttcaaatgttgaagcttctactactaaagaatctagttcagccaaggcttcttcttccgctgccggctcatctgaagctgtttcttctgctactgaaactgcttctactgaagaatcatcttctgctgctgcttctgcttctgcttctgcttctgccactaaagaatcttcttctgaagctgctagttccacttcatctaccttaaaagaatctaaaacttctactactgctgctgcttcatcttctgaatctactactgcaactggtgttttgactcaatctgcaggttctgctgctaaggttggtcttggtgctttagttggtttagttggtgctgttttattgtaa

SEQ ID NO: 2427 - DNA, 288 bp, Candida albicans
tgccatttaaaaaagaaggaccaccaccgaaaaaatcttccaccattaccaagattaaaagttcgtaaaccagtgattggtaaatctacaaatcaatgttttgtatttatgtcatcattattgaattgttgggcatctaatggtgaaggaaatcaaatatgtaatggatttgaaaccgatttaaaacaatgtatggaaacttttaaaccacaacaagaatctttatcaacgataaattatcatgctcaaagattatatcctaaattaagaggcaaagttcatgattaa

SEQ ID NO: 2428 - DNA, 1209 bp, Candida albicans
ctcgtaattaattgcaaaattataaaaaaacaaatcttgtgcaagacactactcttcgctttttatctaaaacacacaacccttttgataattccgttccataatgatttattatatataaaccccccattggggttttacttaattctttactgttattctttgtttaacttaatgaccaaaatgtcaaatccactcaaagtaatagatatttcagaagactcaatcacaactgcaagagagttgcttgatgcagcaacttctcaagggtttttatttcttgaaggacatgatttcactcaagaagaagttgacaaattatttgaattatcgaaatcattttttgaattaccaaacaattataaatcaaaatatccagttgattcttcaaatcatggatatgtaatgatggggaaagaaaatcttgatcctaatggtcaaaagcaaggtgacccaaaggaagcattaaatattgccaatttgaattttgaaactggtaaatctttaaatattattcctgattggatttcggaaaaccaagaaagagatgagttgatttcaaacacaattcttagattatatcgattatctattaagattcttcgtatgcttgctcgagctttagaaatcgaggatgatgaaacccacagaataaaaggtgaaaattggtttgcttcaaaatatgccagtgattctgaatctggatctacatttagacttcttcattatccatgtcaaacatcattaaatccagaaagtgtgataagagccggtgcccatactgattatggttcaatgacacttttattccaaaaagagaatcaagaaggtttggaaattttttctcctatatcaaagaaatgggaacaagtcccattcataccttcaactattgaaaaaatggcacctccattagtggtcaatattggtgatttgttaagttattggacggcagggttattgaataaaactattcatcgagtcaaattccctgctaaagcacaagaattgggacaagatagatattcaatagtatttttcagccatcctagtgataatgctttactagaacctgtacctagtgaaattattagaaaaattgagggaagaggtgctaacaaagaaacaacatacatcacagctaagcaacatttacaaaagagattagctgctacatatggatggaatcttaacgacgggctcgaagga

SEQ ID NO: 2429 - DNA, 834 bp, Candida albicans
atcgtggttccttccggcgcccgtggtgaagacgatatcggcgtaacaaaactgcaggatacagaagaagtcattgaaaattcgccagtggaccctcaattgaaagaacaacaggaatctacaaccaagatgctgttgtctgaaagagatttggtagatgagatagatgagctttttactaactccacgaaaactgtcactgaaaataatcaaccaagtgaaactaacaaaagagcctacgaatccgtggagaccccacaggaactaacaccaaatgataaacgccaaaaactagatgcaaatacagaaacctcagtgccaactgaacttgaatctgtaaataaccataacgagcaactgcagcctatagagccaacccaagaaagacaaccctctacaaccgaaacaacttactccatatcagtacccgtttctactgcaaatgaggtcgaaagagcgtcttccctgattaatgaacaagaagatctagaaatgattgccaaacaataccaacaagctacaaatcttgaaatagagcgagccatggagggtcatggtgatggaggacaacacttttcaactcaagaaaatggtcagccttctgggtcgctgctaatatcttccattgttccttctgattctgaattgctcaacaccaatcaggcatatgctgcgtatacttcactatcttctcaattggaacagcatactctggctagtgctatgctttcttctgccacactttctgctttgcctttgtcgattattgctccagtatatttaccaccaagaatccaattgttaataaataccttgcccacgttgggaaatttt

SEQ ID NO: 2430 - DNA, 777 bp, Candida albicans
gcggcaaacttagtgatgattatagtttggttgatattatcactatttacttcattatgtctctcagtgctgccagacccaaatccaagcaaaatagataggcccattttaaaaatcagtacaagaactcacgataagattatcataatcaataacctacaagagattgccaacaatatatcggttggaatgacgagttatgaaaagttcaaccggttatcatccaatgaaatgagagaatgtgttgaaggctcgtgcatcaagttttatattcgagaaatcaaatgcacagatagaacttttattgccagtgaatgtcgaactaatcttaatgcacgatttcaatcaatcttgcaaccaacgacaaatatccacaatttgatattgagagatgaagactctttggacacccaattgaaaactaacttggtggaccatttcagttctttccgtcaattcaaagagtttaagtttaatgattttaacaataatttgaattacgatttacaatgtcttgtagattatcaactgttgatgcaagttcattttaaacaaactgtagttgaggttaatttgatgggaacaacagaagtagcagatgcttgccaatttgataaaatcaaccccaattttgatggactgagactggtgtatacaacaacatatttacctgtaaacggtacgttctattgccaaaagggtaaatcacagacgtgtaatagaacaatagcggaatccaagaattcaaggtataaattgcccgatatctgcggatag

SEQ ID NO: 2431 - DNA, 552 bp, Candida albicans
aaagaattggtggtggcaactgatcaaagaaaaaaaaatgacaccgttgactcacactttctttttctattcattaaatcaataatattatcgatcatgtcttcagattgggattcagttactattatcggacaaaaggccagagttggcggtggtggtccaagagaaaatgttgctaagacttcttcacaattaaatgctgccagaagagctggtttggttgttggtaccgaaaagaaatacggaactgccaacaccaagtcaaatccagaaggacaaagattaactaaattggatgcaactgatgatgttgttgctgttaagaaagtagatgtcagtgttggtaaagcgattcaacaagctagacaagaaaagaaattgactcaaaaagagttggccactaaggtgaatgaaaaaccaaacgttatcaatgattacgaagccggaagagctattccaaaccaacaattattggccaagttagaaagagccttgggtgttaagttaagaggtaagaatattggtgaacctttgtttgctaagaaaaaataa

SEQ ID NO: 2432 - DNA, 1167 bp, Candida albicans
ctttaccttcaattttgcggagaattttcgataaatacagatatggtatccgtaaatattatttctgaagaattggtaaatctagaatatctagagctcaagaatcttagaatcccctttattaacgaaattgggatagttgctcccaatttgaaaacattagacttagaagaatgtcgaaacacaatcaatctttacggcttgagagaatttcagaagttaaagcatttatctttgaagcaatgtgcttacccaattggtttgtttgaagaaaatttctttcctgagttagaaagttttgaattctcaggtaaaaattcttttgaaagagaaaatgcttaccggggatcattgaagtttcctgcaaatttaaaacgtttatcaataaaatgggccaaccatataacaattgatttgagaacttttattcttcctcctcaattgaaacatctagaacttttagatgtcaatttcagtaacgagcctttaaaatttagtgaaaaattagaatatgtacgaatctgtactccagtattcatcttcccaggaaattttaggatacctccattgatgaaacattttcaaattcaggctaatcgtttggcttttccttcatcacaatttatgtatagtttaccagatggattagaacttttacaattattgtcttccgaaaagggaaagttgtcacaactaacccagaaagttaactggccgaaatcattaaaagtttttggtatacgtcgtttgaggttacactcacactcattagaattatggaattttcacgaatctaatttagaagaaattgatattcagggtggaactcttgatcaattaaacgctgatgcattaccaactagcctcgtagtgttaacgttgcagaatttgcagatgcaaaagctacgtggatcttttgaaaacttgaaaaatttgcaagaattaactctcgtgcacaataatcttgaaaacaagacacatatgaagtttccatcattgaaattcttagatttaggatactgcaagtttgatttgataccaccagtatcagtttccttaattaaagaaagaagaagtttacttacattggagtcagcttctatagatgttgttattctgcaagaagatacatgtattactcaaaaacccaaacgaataaagatataa

SEQ ID NO: 2433 - DNA, 426 bp, Candida albicans
aaggcaaaaccaaatctagacaaggagatgaacagattattcggaacgaaaagcactgcgcccaaaccatctttgaatgatgcaatcaagggaattgatgaaagagtggggtctttggatgttaaattaagcaaaatcaactcggaattatccacataccaacaaaagataagcagaatgagagacggacccgggaagtcggcactaaaacaaaaagcaatcaagttactaagacagaggaagcagatagaagctcaaaaggatcagttagagaatcaatcttggaatatgacacaagcttccatgacaacagataacttacaaaataccatggtcacaataaatgcaatgaaaacagccaataaactgttgaaacaaacttctggaagtcttcaccacggagctgccgatccgccttatttcccc

SEQ ID NO: 2434 - DNA, 765 bp, Candida albicans
caagagtctaacatcaaacttattgatatttataagggccgaatttgggaattaagtgctgatgcactccctgttagtgttgtccaattgaagttaattagaatggggattgaaacattgcctgagtcatttgaaaaatttgaaaatttgaaatgtttagatttaagcagaaatcctttgaagaggttaagatctgttagattgcccttaccatctttcaaacagttaattgtgaatcgatgcgaccttcatttgatatcaccatttttgacttcaatgttagagaaagaaaatcgaaaagccgaattcgctatcatggcaacaaataattggtatttgaatacatatgatgtattgaaaatgatgaaaaaattgaaacatttcactatttaccttagtacatttaatgaaaaatttgccaagctgcacaagcattccaggcgtattgcttatgaaattaaacatacggctgaaaattcagaagagactgagttttctggtgcaggagaatatgctgatgaagagctttattgtgagtatgatgatttcgatgatttcgatgatgatgatgatgatgatgatgacaataagggggctatgataaggaggcaattgaatgattgttggaaggtcaatgactcaggtgatgaaataactcatctggataacccggacaacttatacggcatggacgataaaaaggagggtgacgatgatgaagatgatgattatgacggggattatgaagatgaagtaatggagtga

SEQ ID NO: 2435 - DNA, 2475 bp, Candida albicans
  unsure (23): Identity of nucleotide sequences at the above locations are unknown.
accggaggaaccaggaggaaccnggaccaggaaggggaattttcggaattaaaattgttatttaaaggaaattcaaatattgtgcccagtatttatgaacaaattagtagatttagagaagttattggtttacattatattgacagactttcaaatgaaattgtttcttgtggtggtgtttcgaaatttaatggtatactattagatgatattatacctaaagaagcaaagaaagaagaatcaactgaaaaagcacaacaagaagaagaagaattatctattctgaaagaagaagtatcgaaaatttctgattttgctaaacaattcatttctgattcatttgatgggaatgatttcactaaacttactaaatttgatgatattaatggtaaagttaaaattcctatcaaatcattaactatttctcaatggtcaccagttccacctttccagcaagcaaaaggtgatttattatatttatctttacaaactttagaacatgaaacattcaatattacttgtcatttttcaggttttttcgttaataaatcatcaaccattaatttcaacccaacgattaaaattaatgaaaaaggtaaatttaataaatcatatttattatatgatttagtatgtcaattatcaccacttttcagtaaaaccattgctgaaaatgaaatcaatttatctgattcaaccaaatacccagaaacttatttattaccaggaaattctttccctgcttatccatggttagtcaatgaaaaagatcttcaaaacgtccctgatttatctagatctcaattatcatctttaattaatggtgttgatggagccgattatattaaagattggaataatgatattcaatcaattaaagaattaccaacaactaccgttcaagaacgtataattagagaaaaattaattcaaaaatcattatttgaatttaataaaactgctactgaaaccgctataaatatcattaaggggaatattcctcctttaaatcctgatgaaagttcagataaatttatttatttaagaaatgggattttttattcaagtggtacttcaacagttaatggatttgaaaatactggtggtgaagaagcttcaagatatgttgcatctaaagatttaaccggaataaaattgattaatcgtcatgatattagaggtatttctagtttggttacttgtattgtcgattatatgggtaaaagagttgtttgtcaagctccagttccaggtattttagatactccagtaatcacatcaccaacaaccgatgctgaaggtaaaaatgaagctgaagaaccagaatcagaaccagtagaaaaagttgtttatgggttatcaagtgatggctcaaggattcttgaagataaatcatttgaagaaccattaaaacaaattggtgattttttccatttaaaacctcataaagttcaattatcatcatcatcttctggtgatgatgttaaaacagaatcaaatttagttgtttcaaaagatactaaagggttaaaaggaaccgatggaagaaaatatgtcattgatttatatcgtaccacacctcgtgatattgaatttattgaacaacatttcaaattagatgatgaccaccaagaaacttcttatcctcatggtgaagcattgattagacatgaagcagtgaatgaatggtggagacgtaaagttgccgtattatttaaaaaagaaactgaacaattggaaaaagaaggtaaattattggataaaaaccaagaccaagaccaagaaaataaaccacaaattgctattcctactgatcaagttgttttcaatcctgatgcattttcttctgataatgaaaatgaaattgaacaagatcgtgaagaagttagagaaatttctaaatttattaaagaaaaattaattgaagaatttttggatgaaattaaagatcaagttattccttttgatggtcaacaattgactgatgttttacatagaagtggtattaatatgagatatttgggttatgttgctgaacggttggttgttaaaaaggaaaaacatttagttgatcttgaagaacttattaaagaaaatgaagcaaaagcagaaaagaaacgtgaagaagaaaaagaaaaagaagaaaaggaagccactgaatctgaagataagaaggaaaagaaggaagataaggaggatgccgaaaaagaagaagctgaagctgaagaagaagttccaactaaagctacttatcaattaactttggcaaactattctactcttcatagaattatcattcaagaaatgatttcaagatctgttaaacatattttaagaaatttaaccaaatcacttccaagttatttgatttccactgcaattgctcatttccataattgtttatttggaggtgcaattaatccaactccaaaagttgatttgtattcaaccacggccgctggacatacgcacgct

SEQ ID NO: 2436 - DNA, 1236 bp, Candida albicans
  unsure (1201): Identity of nucleotide sequences at the above locations are unknown.
agaattaaagagaggagaaaggaccataaaaagaaagaggaaaatttatcacccaatacagaacaaattactggcattatgtctgcaatgaattatccagatttcttgaattccagcaatcagaacggaggctcaccagcaatgtcgaagggtaatgaccttcgatcacaagatacgcgcgagagcaaacagcaagatttgtacccgtcaggcaataattatatcctgaatgttgcaaccaacaaggactatccacctcagcaacaacaacaacaacaacaacaacaacaattcaacaaccttttattaaaaaaattatcagcattagatgatgctctgccgttggatgtgtccagtttttatactaacgcctccttaaacaaagactcgttcaatttgccagctgagttacaaggcggtgtgtcgaatatctcgtctagtagaccaagttacgccgctgaatcctttactagaaataatttttatcatcaaccaagcttgaatccacaatctcctcaactaggagctcaatcatcgaactttttcaacaatagaaaagacttgtcttcgatagctatgttcaataattatgctaataatcactaccaacacaatggggacgggaactttgatataaatgactcgttttccaacttgaatttaaatgctaaatttaacgatttccaatccaggaggcccagtcagttagtggatttttcattcagcccctttggtgatactagacaacaacaacaacaacagcaacagcaatcacaatcgcaatcgcaatcgcaatcgcaatcacatgtaccaaatcaaaacctacaacaactgcaaccacatttgacaaatgcgggcaatagtgcaccttttattgcctatcagaacaaacaaactatgaatagtgcgcaaaatcaatccatgggtcagggaaatcctatcaaattggaaaacggattaatgttacgagatcaatacattgtggcttctcctgaattgaaaagtttgtatatgaaaaccatcaagtatttccaagatcagagcatcactgctgacattttatctaaattgaataacttgttaactaatccagttataataaagttgattacatttattaagaatttgaataacctcacatttaaccataaaatcctttgtcttgttatcaacaaaaaccgaaagtttgatttattgtctnaccctcataattctaatatatttttacaaaagaat

SEQ ID NO: 2437 - DNA, 609 bp, Candida albicans
ttctttttttttttctttagttacgtcctttcaagtattgtaactgccacggaccagacgaatgttgaacttttgaaaataagattagaaaatatggcatcagtgatatacgatgagcacaaggggtactgtgtaaccaatgaaccaataaataaagtgaatgagaatgaaggtataataaataatggattacagacattgccatgggatttgtatttacccgaggaaaccgatgacctactgctggcatctgataacacatcaacttcaactcccaaaccactaaccaagcaggaaaagagagaggctaaacaattgaaaaagatcaatgcctctcgaagaaggaaactaaagagagaacaagagttggacaataaaggagaatccaaatttcctgatttcaagccttacttggccaaacaagaattgaaagcattatttagctcgattgtgaaaagtacatgtcagaattcgaaggcagatgctaaaatattacaatatcattccattgcattgtataaatctgatttagagcatattttacctggagaatggcttaatgacaataacatctcattgatttatgcactcatcctccaatttttataa

SEQ ID NO: 2438 - DNA, 747 bp, Candida albicans
attgttacaattgaatacttcaacgagatgactttaccaattcaggatttagaacctgattattatatttccgtcaattatcctaccaccgataatggatcaccaaccccacaagctgaaaaatcattgaaaacattaattgatttattatacgataaagggtttgccgcccaaattagacctggtgatttagaccatttgttagtctttgttaaattgtcttcatacaagttttctgaagaagctgaaaaagatttaattaaaaattatgaatttggtgtcacgggtaaagatgacgtgttagcttctaaacttagaattatttatcaatacttaacttatccacaatcagttggtggatgtggtattactcctaattctggggattggaaatttgtcaccagtattgttccaattactaatgcctttaatgaaaccactttagttgaagatttaaaaattaatgttactcaaccaaatttatcaattgccactatcaaaaagacatatggagttgaagttgctctttattttgaatatataaaacattacactttttggttattattgctttctattattggtcttgtatctcattttagagaagataaacgattcctgttaacttttgccttttatcaatttgcctttggggggttttattccttgcatcatggcataacaagagaacaacatttggttaatgtatggggtgttcaaaatagtcatttaattggaagaacataa

SEQ ID NO: 2439 - DNA, 1620 bp, Candida albicans
tttaaaatcaatcaatgtatattatatgctcaattcttttatttcattgtcacaaatcaagttatacaattggtattgaaatatattctcccattgggtttaagatttgtatttaattttattgaaactaaaattcataacaaacctcaattacaaactaaatatgataaccctgatgaatctatttggttacataatgtcagattatcgttgaaacttcctgaatataatgttgatgatgattttataggattagttttacaatttggatatttgataatgtttggtccaatttggccattggcaccattggtttgtattattttcaatttaatttttttcaaattggataattttaaattattgaatggtaaatattttaaaccaccatttccaataatagttgattctattcatccatggaatttagccctttccttgttagcatggattggatcaattatttcccccgtggtcacggcattttaccgtcatggtactgctccaccaaaatctatgggtcaatttgcccttgataaagctagtgttcatgtttcatcctcagttttcttggttttattaatgtttgtttcagaacatggatttttgattttgagttatcttttatttgaattctcttctttgttcaagagtcaagttgaatgggaaaatgattttgttgataatgatattaaattgagacatgattattattctgggaaagtaaaaccaacttataaagtccactcggatgagttgtgggagaagtttaccccacaatcaactttgaatttcactgttcctaaaccaaccgcagaaactgatgataaagttgaaaaaattgcttctaccgaagatgcttatctgacttctgcagaaaaatctactactactgctacttctcgttctgataagagtaaaattcttgctgaaaaggaagctattttgaaacaaaaggaagctgagttggccgaattagaaaagaaaaagaccaaactaaatgattttaaagatccaactgattctgtcattaaaaccaaatcaaatgccaatggtaaagctgtgttaagtacaattgacaataacaaacatgttagtgatattgatccagatgccgccgccgcagcagcaactgcaacatctactgctaatgattctggtgcaaacacatcaacatcaacatcaacatcagcagccacagatactactaacactgccccatctcattctggtccaactcctgtcacttcttctgaaaaatcaaacaacaacaacaacagtaagccaagtgatagtaccaaatctactttatcaaatgatgaaacaagaaaaacacttgatcctaaaggcgttggaagcactacaacaggcggtaaagacacagtttcatcagacaaagcatctctgccaattgaagataaagaaagttcaccatccctagctggaagttcaacatcaacaccaagtggaactgataaaaaaacatctcctaaaaaattagttaccaatgctgtcaataaagttgaaaataatgatgatttcaaaaaattcattaatgaggctgaaaaggaagctaaaaaatccaagtctggattgaaaaaattatttaacaagaagtag

SEQ ID NO: 2440 - DNA, 993 bp, Candida albicans
caaaaaaccaccatctctcaaatcacacaattaatatttatatactttttttttttttcacattttggaagtttcaacttattgatgataaatccaagacgatttctaacaatcatgacaagaacaaaattttggaaaccaagatattatgatattggagtcaatttttccgattcaatgtttcaaggatattataatggatcaacaacatcaaaacatccttgtgatattcaatcagttattgaacgagcccatttatttcatgttgataaaatgttaattactgccctgacaattaaagaaagtgaagatcattttgaattgtgtgaaaaatattcaaatcaatttgattcaactgctggtgtacatccatgttctgttgcttcagagttttataaattgaacgatgaaatcaaacaaggtgatgatggagaaaacagtagtagtagtagtagccgatacaccgatgaattacgtgatgatgttgataccaaattggaaaaattgaaaaatattattataaaagggtataaattaggtcatatcaaagcatttggtgaaattggattagattatgatcgattacattatagttcaaaacatcaacaatgtgaaatgttgattaaacaacttgatcttttacatgatttacaaacagaattaaacattcaatttttaccattatttttacatatgagatccgcatgcgatgattttatcaaaattctcaaaccctatattgaaaagggaataattaatcctgtcaatttttttttttattcattcacaggaacagaacaagaattaaatcaattattagaattgggaatttatattggtgtatatggttgttctttgaaaacggaagagaatttacaagttgtgaaaaaaatccctattaataaattattaattgaaactgatgctccatggtgtgaaattagaaaaagtcatgctggttataaattttataaaaaatacaatttatcctaa

SEQ ID NO: 2441 - DNA, 663 bp, Candida albicans
agatcagggtttgcaaataatccatttgaagatgacttgttcaatatgttttttggtggtggtggcggtccacgtggaagtcctttcgcatcagggccaacattcacatttggagggaacgggttcacattccaatcatatggaaacgggggcgctgatccgttcatgagatatagaacaactacaagaagaccaagagcacagtcaccaaatggaagagaacaaactggacctaatggagaagagcaaccatccttgtttgaggcattgaaaggtatattgcctattttgatgcttttaattgtaccaatattatcagccatattttccggtgacacatctccagggtattcctttgttccatctcaaaaatataacatacagaggaatacaccaaaatacaatataccattctatgtcactgacaaattccaggaaaagcatgggtcgaagtccaaaagacaattaagaaattacgattccaaagtagagaacttgtttatatccgacaaacgagccaagtgttccaaagaacaaatacacaaagatcagttgattgaggatgcatatggctggtttagtgttgatagtgagaaattacagcgggcagaaaatttcccaacaccaaattgtgacatattgaaaggtttaaatttactttag

SEQ ID NO: 2442 - DNA, 372 bp, Candida albicans
aaagatgacacaattaaattcatatttgcttatattgacaaaaacaaattacatatcacccaaataaaacctttgcaaaattatatttggttaattaaaaaactaattcacagacattatatattaacttcgattatacccaaaaacataagaacaccaattacaaatggaaaagaaaaattagacaaattatttccactcactcgaccagacatctgcttcgcgatcaaatatattagtcaccatcaactaaaaccatcggacaaagtattcaaccaattagaaaggatattaagatacctcaaaggaacggcagacaaacccatcaaatattacaccaacaacaagaagaaatggagtattggaatatga

SEQ ID NO: 2443 - DNA, 1485 bp, Candida albicans
tattaccttgtgacattcgtcttcaacgtgatattcctttgtgacaatcgtcctcaacttgatcagcgtgatgacaatcttcgtattccaaacattccaaccgattggattccatatattccgattgattggatcccagatattccagataagccaccaactccagttagtactccagacattcctgctacaactactacttctgaatcatcatcttcttcttcttcttcatcatcatctactactccaaaaacttctgcttcaactacacctgaatcttctgttccagctaccactccaaacacttctgttccaacaacttcttcagaatcaactactccagctactagcccagaaagttctgttccagttacttctggatcatctattttagctaccacttcagaatcatcatctgctccagctactactccaaatacatctgttccaaccactactactgaagccaaatcatcaagtactccattaactactactactgaacatgatacaactgttgtcactgttacttcatgttctaacagtgtttgtaccgaaagtgaagttactactggtgttattgtcatcacatctaaagatactatttacaccacttactgtccattgactgaaactactccagtttctactgctccagccactgaaacaccaactggtacagtatccacttttactgaacaatcaactactgttattactgttacttcatgttctgaaagctcttgtaccgaatctgaagttactactggtgttgttgttgttacttctgaggaaactgtctacactacattctgtccattgactgaaaacactccaggtactgattcaactccagaagcttccattccacctatggaaacaattcctgctggttcagaaccatccatgcctgccggtgaaacctctccagctgttccaaaatcagatgttccagctactgaatcagctccagttcctgaaatgactccagctggttcacaaccatctattcctgccggtgaaacctctccagctgttccaaaatcagatgtttcagctactgaatctgctcctgctcctgaaatgactccagctggtactgaaactaaaccagctgctccaaaatcatcagctcctgccactgaaccttccccagttgctccaggtactgaatctgcaccagctggtccaggtgcttcttcttctccaaaatcttctgttttggctagtgaaacctcaccaattgctccaggtgctgaaactgctccagctggctcaagtggtgctattactattccggaatctagtgctgtcgtctctacgactgaaggtgctattccaactacattagaatcagttccactcatgcaaccatctgccaattactcaagtgtcgctcctatttctacatttgaaggtgctggtaacaacatgagattgactttcggtgctgctattattggtattgctgcattcttgatctaa

SEQ ID NO: 2444 - DNA, 1083 bp, Candida albicans
atggtttcccaacaggtctttaattggcttttcaatgtaattcaaccactgtatgaacataagaaagaagtgtatgctcatgttttccaatttttacaactacatttgaagaaaaatcttaactttaaaattagaacgcaaatctacacctcgagtgggtcaggagagcctaatctattgataaacttgtttggcacaattcagatcaatgaacaaattggcacaccaattgaaatctgggtaccttttgcatatccttatgttgattatgagaacaaaggtgcacccatagtttatattgttcctgaccacagtaaaggttggtatttgaaaccaaataataatgttgatacacaagggatgttttaccacccctatttgacgaggtggcacagagaatgcttgcgatcgaatccagattctctaaacatgttcagtttggtagaattggcaaatgtgatttaccgaagcgttactacggattccccaatagcctccaagcctccaggcattactaatactccccagaagcccgcaaaagtgccacttgattttaatagcatttcaacagaacagccattgaatttgcatcaattgaatacagagcaaccggcagtaatacccgtacagaccactggtcctccattacctgcaaaacccccaaaagcacagaatgatattcatagttccacaccattgaagtatcaagcgccgttgccattgccacatgaagctgagaaatttaattatccgcaagaaagaacgtcatctccattgcctccattaggattcataaatcaacagcctagtcgttcccctgcaattgcttctgccgttccccataccatgacaccgccacagccatcaccaccagttgatttaattgatggtgaaaatccattgtctgaaacaaatactggtgtcactaacttgacgcatgaactatattctaaaattaatcatttcttaagtgaagaagagaaaaccatcaaagatgtgaacgagaaaaccatgaaaattaaagtattatacgagcagttgaatcattattacagtctggcccttaaaaactcaagttttttg

SEQ ID NO: 2445 - DNA, 1314 bp, Candida albicans
agaaaaataatatatcagatattacagtacttatctcataatactttgattgaactaatctccgttccatttttaaatcaatatgttacaagttatttacatcccgtttgtttgattgatagtaaagcaaaagaagttagacataatcctaaagtaaaagtattcaaaactataacagcatttacgaaatttcaaaaattacacaattattctcctcaacgattggttcttagtaataatattgggacaaataaagttggagcaagtactgattggtattcaccttataagcttgagatagttaataatttagagttaattactgctagaaacgttgttaaagtgacattattttcaagtttctccctaccaatacgagcaatcccttctcacgtaactgaattgagtatatttggagacaaattaaacttggtacactcaaacattcaaactttggaaatcaatcaatttgatttgagatatatggaattacttactgaaagtattaaagaattgaaattgctagagtttaaactaccgtcttcattcccctcactgagtgtaaaattccccatcaatttaacacatttaacaataacagaaggacaacacagtctaagtctgataaatttacaatcgttattgtttttaaaactgctaaactataagggaaatttaaaattaaatactccacaaatgacatcaatgcaagatttgcaattgccagaatccattgaacgagtatgtttaaaatgtttaaaccttgttagtttacaaagtatttcaaacttgaaatgtttaacacatttagaaatcattgattttcctaaattgtttacattttttgacactaaattccccagtgggttaaagacgttgatatacaaatttgatactgttgttccgaacttgtcatattttcaaaatcaaatggttttaaattttgattcgtcacgattggtcagagaaacaacaacaggcaatatgattttccttaaaattgacgaaagatttgaaatccccaaccaattaaaagtgttgattcttgaaaatatcccctatgtgaaagtttccaaatctattaacatccctactactttgaacgaattgataattagaaaaataccaggagttgtccctgccaacaactttaacattgtaccactcaacacagctttatatagacttaccctaagcaatatgatgcttgattcattagaaggaatgaaattccctgaaaaattgagtttcttggatttatcaccttatccattacaacatattcatggaactaatctacataatttaaaataa

SEQ ID NO: 2446 - DNA, 546 bp, Candida albicans
accatgacccaaaacgtgtattcagttattttgcctgcatattacgaaaagagatatttaccaattttaatctacttgttgaacaagacatttactgccaacaaattggattgggaagtaattattgttgacgataattcaccagatggaactcaagaaattgccaaaaaattaattgatatatttggaccagaacacattcaattaagaccaagagctggtaaattacgtttgggtactgcctatgtccatggattacaatttgttactggtaatttcgtaataatcatggatgctgatttcagtcatcatccagaagccatacctgaattcattgccaaacaaaaatcacaagattatgacattgtcaccggtaccagatatgctggtgatggtggtgtctttggatgggatttcaaaagaaaattgatttctagaggagccaactttttggctagtgttgtattgagacctcatgttagtgatttaactggttcattcagattataccagactgacgtgttgaaaaaaatccatgacgtcact

SEQ ID NO: 2447 - DNA, 720 bp, Candida albicans
tcaaagacaacactgtttcaacttggaaaggactactcctactattcatcagaaatcagagacatccacccaagttccgctaaaggttctgctgaatctgcctcctccatttccagaaccacttgtccaaccaacaccaacaattgggaagcatttacaaacttgccaccaaccccagacaaagaagtgtgtgaatgtatgagtgcctcattgaaatgtgttgttgacgacaaggttgattcagacgactactcagacttgttttcctacatttgtgctaagattgactgtgatggtattaatgctaacggaaccacaggtgaatatggtgcttactccccatgccacagcaaggataaattgagttttgtcatgaacttgtattacgaacaaaacaaggaaagcaaatctgcttgtgactttggtggttctgcttcattacaaagtgccaagactgctagcagctgttctgcttacttgtcctctgctggctcttcaggattaggtaccgtatctggtaccgtcagaaccgacacttctcaatcgacttctgactctggatctggatcttcttcctcctcctcctcttcttcttccagctcgtcatctggttcaagtggtagtaaatctgctgccagcattgtttctgtcaacttgttgactaagattgccactatcggtatttctatcgttgttggtttcggtttaattaccatgtaa

SEQ ID NO: 2448 - DNA, 348 bp, Candida albicans
cttctgggttccttcagcccctgcaaggtttgggactctgtccacaggtccagacccagtacttattatgaactgttgggggtgcatcctggtgccagcactgaggaagttaaacgagctttcttctccaagtccaaagaggtactccgtacccctgaggtggggagggggagcaggaactttgagccagtgggggtgtgcttcaaattcccaggagtagaccagcatctctggcgggtgccacattttttcagccctcatagggagtggcaggtgctcaatggtaggggaaaggctgtgggcaggagccaggggtcctgtctgatgggctgggcttggttttcttga

SEQ ID NO: 2449 - DNA, 627 bp, Candida albicans
cccaatattaatcatgataatgtgtttcgagttgattccacaacttatattatgggtaaaggtaatagttcagaaatggttatacctggtgatgacaacaaggtctatgttcaatcatttgaaggttatgatagttgtacagtgattgaagccgttagtatgacaggtaatatttcgcccatagggattgttttcagtggagcggatttaagaacaaaatggattaatgatggttcgccacattggtattatactgcaactactagtggatctgtatcttgtcaaattatgtacagttggttgaatgaagttttcactccatatctagagcaaaagaaatctgaagacgagaaatgtttacttattatggacaaagattatggtactactaatacaagatttcagaattcttgtgaactgagtggtgttgttcccttatatttacccccttgttgtcctcacttattgtccccagttgatattcaaacgcttccgagaatagtatcaccagagtataaatcaaaattacaagaattggataaaaaatttggatttgcaccagttaaacagagatttttcttatcaggatatttcaaagcaagacaacaattgaatatgactccataa

SEQ ID NO: 2450 - DNA, 717 bp, Candida albicans
  unsure (701): Identity of nucleotide sequences at the above locations are unknown.
caagcagagaaatttttcaagaatttcaagcagttgataaatgaaaacaatattaatcatgataatgtgtttcgagttgattccacaacctatattatgggtaaaggtaatagttcagaaatggttatacctggtgatgacaacaaggtctatgttcaatcatttgaaggctatgatagttgtacagtgattgaggctgtgagtatgacaggtaatgtctcgcccatagggattgttttcagtggagcggatttgaaaacaaaatggattaatgatggtttgccacattggtattatactgcaactactagtggatctgtatcttgtcaaattatgtacagttggttgaatgaagttttcactccatatctagagcaaaagaaatctgaagacgagaaatgtttacttattatggacaaagattatggtactactaatacaagatttcagaattcttgtgaactgagtggtgttgttcccttatatttacccccttgttgtcctcacttattgtccccagttgatattcaaacgcttccgagaatagtatcaccagagtataaatcaaaattacaagaattggataaaaaatttggatttgcaccagttaaacagagatttttcttatcaggatatttcaaggcaagacaacaattgaatatgactccagaagaaattgttgatcgttgggcttttaccgnggatgtatccgaataa

SEQ ID NO: 2451 - DNA, 1635 bp, Candida albicans
ccaatactctttccattttgtttcaataatacttcaatatggcaattaaacggaaaaaaaaagcaagtggtcgatgaagtggctatggcaaaagccataagtgatataaaaaatggattattgttgtcttatagaaaagcagcaaagaaatataacctttgtcatgaaaccataaggaaacgtatgaatggagtactacccaaacaaatagcccatagagggaaacaactcttcacccctcaacaagagaaggagatagtcaaatggattattgagtctgatgaagcaggaaatggacgtagccgtcatgatatcgttgaatatgcagagctatttttactgttggacagacaactggctagtatcggtggttcttggtttgaacgctttaaaaaaaggcataaggagatccatgttgttcaaggaagaaaaatatcaagtttgagagtaaaggcagcaactcccgatcagataaaagaatattttcataaatatgacctgattgtcagacaacatcaaattcccaacgaaaacatatttaattatgatgaatctgggtttattatgggtcagggtaagagttcaagagtggctgtacctagctataaaaatagaacttacgttaagtctactgagggcagagatagttgcactgttatcgaagcaatcaacatgagtggagaaaaattaattccggggataatttttaaaggacaaactctaagaaccggctggtttaatgatgatgcttcagactactactactcagtctccaaatgtggatatacttcttattggttgtcttggcgttggttggaggaggtttttattccccaagtgaaagaaaaaactaatcaaggaaaagttttgctaataatggatgggcatggaagccacaaaactaagaagttcagagaaacctgtgaggacaataatatcattccattgtatttaccgcctcattcaacccatttgttacagcctttggaccttggaatctttggaccaataaaatatggatacaaagtaaaattgtcaaaattggcccatgcccttgggacagatccagttaagcagcagttatttttactgaactactatgaagcaagacaggaaaagttaaccaaagaaagaatcattcgatcctgggaaactgctggccttaatccatttgatgttgacaaagtgttaaattcgtcccaaatgattgcggcgaaaatcaataaagagatagatgattatgaaaataatagagacgaacatactcaacaggatgatgttgaaattggactatatttaaggggaacgccagatgaagagcttattgacaagttgacgaaaaaaattgattttcttgaattggaaaatacacaattaaaaacggatgttgcacatttgcaagcagaacttaccagcgctaaattagagattgacaactataaagaagctctaaagaataagaaaccaccaggaagaagttctgccattcctatggatgaaaatcaaggcttcaagcgagcagcgccctatgccaaagaatatcgtcaaaacccaccaaagaagaacaaacgaaaagctttaacggatatgacaaattgtactaatggtagtaatagttatatcagaagtttgtag

SEQ ID NO: 2452 - DNA, 915 bp, Candida albicans
tatctatctatcacaatgtctaaagtctcaattactatcatcggtttgaatggtttcttaggtaaaccagttcttgaagctatcaattctggtatttttgacgataaaatcaatttcccaattaaagctattacaagaaaagaaccggaaactaaaaatgacaaaattgaatacgttgtttctgaaatcaatgaagaatcaattaaatcaaccttgagccaaaaattatccggtactgatgttattattgaattaattggtccaaatccagaggctttcgctaatatcgaaaaattaattgatgcaattaaaccaaaattattcattccatcacaatttggtactgatattcctaaagttgatgaatatgctccagggtttttaggaatcaaaactcaacattcagaaaatgtcagaaaattaggagttaaagttgttgatattataacttcgttatttgctgttccaggagcttttctttatgaatgggttggttcaactggtatcaatgctgatgacaaaactgttaaacttattggtgacattaatcaacaatttgatatttctaaattagaagatgttggtaaagctgtactttctattgctactaatcctaatccaagagaattaccagataccattagaattggttctgatagaattactgtcaaagatgtcattgatagatattctaaagatcataatgttgaattgaaagttgtttctgaacaatctgcagaagatgccaagaaagagtttactgaatctttgaaagctggttttgatggtgagaaattcttatggtatttacaagttattgctgctcaaggtttagataaaggtttactctccagtaaattggacaacgaattggtcaacccaggtgagtctttatggaaatggggcaagtactaa

SEQ ID NO: 2453 - DNA, 192 bp, Candida albicans
atgtcgtataacgataataataatcattattacgaccctaatcaacagggcggtatgccacctcatcaaggaggagaagggtattaccaacaacagtatgatgatatgggtcaacaaccacaccaacaagattattacgatccaaatgctcaatatcaacaacaaccatatgacatggatggatatcaagac

SEQ ID NO: 2454 - DNA, 2079 bp, Candida albicans
  unsure (6),(52),(56),(131): Identity of nucleotide sequences at the above locations are unknown.
aaccgnacattcttccttcccccaaagccactcaaaaagggaaaacaagatnaganagctccttccaagaaaacaccagtcaaccccaagttaagagatattagtggacaaattaaagaaaccattattcnatccaccacagatttgaatgaagcctatagtattttagaagaagggattacgtttttaagagaaattcaaaaatcagagaatattactgatcgacaaattttcaaggaattttatcctttggctaccgaattgtttaatttagctcaaaagcccgaaacaacaattgaccattcgttaaatgatataattgatatgtttgttaagaataagattgctcattcaatgcactttattcaattagctgcaaatgctctcaaacaaaacagtgaagcttatgatgaagtattgcagtattggttcaagagttttgaatataccaaatcgcatgattttttgtatgtcaataacttcaatggaatcaaaaccaaaattgaatatcaaccttacgatttcaccaatttggccatatatgcttatgttcaatcatgtattgctcaaaaagttacatactcgccagtcgatgctgccaagttttcccctagtggcaaaataccaccattttatcatatcaagaaaactttagaagtgttggatatccacgacggtaaaaagttccgtgaatattgtaatttattggaaactgattcccaagaaagattcaatccaaatggggctagttcaatcaagaaaattgaaaacaccccagataaaaagcaactcgataaattctatcaaaatgtggttgatatttgtaacaagcgtaatatcaaagttgatgaaaaagtcattgttgcattgatgcaaagatactttcaatttgatgaatacaatgaagttttcagtttatgtgaaacaattatgaattctggcgttaaaccatcgattgatgcttggaatatagttattaaagcaatgacaaacccttcaagaatagctagttttggaggcaaagccaagcaacaagaacttgtacaaaattttgaaagaactttacaaaccatagtgtcgtcaggagtacaatttaatggtgaaactgttggtgccatcgtcagtgggtatgccaattttggacaattcgacaaagctcaagagtatattgataaatacgctaaaggtgtcaaggacaacggagctgtaatcagtttatgtaatgatgggattttgagagggttggtttacaatgggaaaattgaagaggccgaatccaaattgaaacagtttatggaaactcacactcaatacaaacctcatacccacgttatgaatgactttctcaattattatgccaagaagaaaaactataaggccattaatggtatcaccaattttatgagaaaacacaacattgctgaaaatgtgtcaatcaaaaccactatgattaatgcctattttgagagtttgcatgccattggtaagactccagatctttccagctttttagccaaaatggaatcatcggaaaatgccggtaaacgtggattcaacgaacaaatgcattcgactttattaaaggggttgattcaaggggccaatattgaagctgctagacaacttttcgatatattaaagtcaagatatcctcgttctgcatggttgaataccaatatgatggttggtgaactcactttgggaaatgttaaacttggagaagatatcttcaattattacatcaaagaaatcagaaatgaaccaattatttggaatacatttattcataatttattagctcgtgatgaaaaattagctgacttttattttgaaaaaatgaagcaagattctcaagttcaacctaatttttacacctattatttcatgttacaacattatagaagaaaggctaagaaggatagattacagcaattggttaacgaattggctgaagtcgattggacttcatatggaacttcattacctgatttcattaaaagattgaccaattatttggatgtacctgcttcgttgttgtccaaacttgacaaacagcaggcaactgtagataaacaataa

SEQ ID NO: 2455 - DNA, 642 bp, Candida albicans
  unsure (96): Identity of nucleotide sequences at the above locations are unknown.
aatatattgttcaatttacaagatgtgtcacttggtgaggaattacacaatttcaaatcatttgttacaggatttgatagtgaaatgataggaganacaatctccaatagtgatttaatcagatctatccataattctttcctggctccacattcatttgttgacgaagacaaacctccaccacctccagatagagatgacaaagatgatggattatttcattttgtagggtacattttcaaacaggggaaaatctatgaattggatgggttgaaacaatatccaatttctcatggtgaatgtagtggacaagatgaatttattcaaaaactacctacaattgtacaagagcgtatatcaaagtatggtaacgagttgaggttctcgttgttggcagtcaccaataacaaattggaacaagcacaagctatgggcgaccaagaggaaattgcaagtcaattacataaacgtgaactttggaaaaaagaaaacgaattgcgtaaacacgattacactgggttgatagtccagttattgaagaatataagcaaagaaaaaagcgataaagaatgggaagactttttacagaaaggaagaaataagacgcaacaactcattgcccaatcaataaagaaaacataa

SEQ ID NO: 2456 - DNA, 282 bp, Candida albicans
ggagttttcactgaattagtggaaaaattaggtgtcgaaaacatcgaaatcaacgacttatattcgattgattcagatacacttagggctttacaaccgatacatggacttatttttcttttcaagtatagtaaattggatagagaatttgccacttctaatcaacccataacaggagagtacgaaggcaattatttagacaaaggcatattttttgctcaccaaacaatccaaaatgcatgtgccacgcatcttcaccacggggctggaaggtcccgcgat

SEQ ID NO: 2457 - DNA, 504 bp, Candida albicans
caatttagtggtgttacagatagattcaatttggaacgaatcaagtcagatttttcttcagttcaatcaactatttcaaaactaagaccaccacaagagtttttcgattttagaagattatctaaaccagcaaactttggagaaattcaacaaagagtaggatacaatttaggttatttttcggccaattacattacaatcgttttaggattaagtatctatgctttaatcacaaactttttattattatttgttactattttcgttcttgggggtatttatggtattaataaattgaatggtgaagatttggtgttacccgttggaagatttaatacttcacaattatacactggtttattgattgttgctgttccattaggatttttggctagtcctatttcaactatgatgtggttgattggttctagtggtgtcactgttggtgcccatgctgctttaatggaaaaaccaattgaaaccgttttcgaagaagaagtgtag

SEQ ID NO: 2458 - DNA, 537 bp, Candida albicans
attatggaattgttcaccaagacatggagttccttcaccgggggatttattccatataagttaaaagataaaatagttgaccctttggcgcataccacatcattggatcgtaactcgatttggacattacatgatggaattaatccaaaagataactcaccagtatcagtatttgaattcaatttgaaagacccagctaatcaacaacgtattggtttagccagaaatgcatttaaaaaattgaaattaattaaattccccggagtaatttccatagttgattttatcgacaatgattattcgttgtatataatcacagaacctgttaaacctttactgatttaccttgaagaaactggacttaaaggtgattccttagttgctggtatttattcagttgcccaaagtatttcctttataaatgaggcagccaattccttgtatggtgggttaaactatttttcttcccgtatatgttactttgtcaggcgactggaagttaatggggttcgaattgcttaccaatttaacatctga

SEQ ID NO: 2459 - DNA, 591 bp, Candida albicans
gtcaagataaagtcatcaaacatttttcttgtggatggagcatccacaaagttgaatctcaagaatgtcaagttggtggaaataaacaataatggtgtggttgctgtgctgtctgggaccaaaatcatgttttccaattacaaaacaattgaattaaactgtgaagctgcacagataatatgtcatccatcactagatttttttgttgtgttggcagcaaagaaatggtttgtgataagtactgattccatagtggcttcccgtaacggtgtcttatctttaggggcacttcattatgatggtgagatcttggccactaaaaatgatgataaaattaagttatatagtatagtttctggggatgaattaggaacgtttactgcaactcatgaaaatattgctaaattagaatttgctaccaatgggtattggctacttgctttgtcgacaggtgacaataccagttccattcaaatttttgacttgagaaagggaattgaagttcaaaatctacaatttaacgaagtggcaaccaaaaaaatcggtaatattatgttttatagcttacacagttttttcaaatatttgtaa

SEQ ID NO: 2460 - DNA, 705 bp, Candida albicans
aatcgctcactcgaaaaccctaaaaaaaagcagacaaccctactcatggatatcgaaactgccgcttgcttttcaatagcatttatagccacaccgatcctcatagtattggtaagattgctattcattcttccatcattaagacttccaacctccgtaaagaaaaagaaaaagctcattcaggaatgccaactttcaatcttgcttggttcaggtggccatactggggagatgatgagaattatatctaaacttgacatgggaaaagtttctcgtacatggatatacacttcgggcgacaatgcgtccttagcaaaggcacaggattatgaaaggaaatcgggtacatccctgcagtacataccaatcccaagagcacggacagtgggccaatcatatatactgagcattccaaccaccatatactcattcttgttttctgcaattgcgatgctcaaacacagaccagcagtgatacttttgaacggcccaggtacttgtgttcccgtggcatacattttgtttctctataaactccttggattatgcaatacaaagataatttatattgaaagtttagctagagtgaacaagttgagtctcagtggattactattattaccgatcagcgatcgatttattgtccagtgggaaagtttatatcaacagtatagccgtgtcgagtattatggtatattgatatag

SEQ ID NO: 2461 - DNA, 669 bp, Candida albicans
aaatggcatttaaatttagttacatatagtctgtatagcaaaatgacacacccacaaggaatgtggattataggatacggatccttaatctttaaaccaccaccacacgtatcgtacaaagtcacaggctacttaaaagggtttattcgccgattctggcaaagctcaatagaccatcgaggaacacccgagtatcccggcagagtggtaaccctcctttccatagacgatctaacctcccccaaatttcacgacgagttctataatgtgtcgtcgcctgacgacttgcgtgtttatggagtggcatactacatcgagccacagcacgtcgaacaagtcaaacagtacctcgacatcagagaacaaaacgggtacaccgcccacaaagtgccattctacgtgggagaagagttcattgagagcgatatctacattggaacaatcgacaacgaagcatttgtggggccagaatcgttagaagacaccgcccatgtcatacgcactgctgtcggtcccagtggcaaaaacatagactacctcgccaacctcgtccactcaatcaaagactttggtattagagaccactatttagaacacctatacaccctagctagctcaaatcccgatagttcaacgctgccgactctaaaaccagcgccaactgattaa

SEQ ID NO: 2462 - DNA, 2202 bp, Candida albicans
gaaatagcccgagaggactcgaagagtttaccaaacagtgaccaagatatttgccaaataattaagtgcaagtaccactattcaatcagcattgatggagttgtgccagcagatcatggtaccgcaagactcgacgagttaaataaaaatgactgcaaagaattggcactgtttgttttgccattatgtttcctgaaaggaggaagcactctaaacaatgttcccaagcatgatatcaaattgttgattgacgaaatatatgatgtgattggtgatccagactttgatctgaatgaggctctagggcgcaacaaagccacgctaaactattttcttgacaatacacgattaactaaaagattatttcaagaggcatttcatggtttggtaagattggaattgggagaagctgaggaggataaacaattcaatgggttgtattatattgaagggttgttgttgttttcgtcatataagctaagaaagaaaaacatgcaaagtaaagctgttgagttggaaagcgccatttcactatttgaaaatgatattatatgtggtagcaacaggtttgagagttggtttcttttgggacaatcttatgggtatcttgtggaagatgatttgatatggacagcagataaattgacggcttcagatcggaaaattactacagccaacttgcaaagaaagtcattgatatgctatttaatggcaattaacaaatcacttgatgaatccattaaagacgtgatcaaaccggtagtgggtaatttaatgtccttgtttgccaaggagatgtttagtgctgtttgtgaaccgatgagtatgcacgcttttaaagtgcagtcacacccgagatttattaatcgtgttaacggtgctttatttgagccagtttcacagtttcctgctgttgataaaactgtttgtttgaaaataatacaacaatcgttacaattatcaatcaaatccagttgtcgtgagtggtctgattattattatttggccaaagttcaaagaaagttggacaaacctgcaggtttggttatggaaacaatggcttcagcgtgtcggagtgcatttaaaaacaaacatgcggacaatattattgagcctcattataatttggtttcctttgcattgaaatatgtgaaaagtaataggcttgattcgaaggatgccttgaaatacttgatcgaagatccgttgattaagcttgaagtaggggaagaaactgatttcataaaactaatcataaaggcactcaacaaaattgatctgtcagataagaaaaactggcaacacaaagcaaagtatagactagcccgtttgatgcaagaagagtatcatgatgtgaaaggagcaatagatcaaatgtcaagctttatttcgttgaaaactccaaataaagcacttgtactgatatggaaaccggaaccagaaagaccaggaaaacactttttgtatacgttccagtacattcatttttacattgagctacttaaggagattgatgacctcgatagtttagttgcaatgttgccgaaattgcgtcgttcgaattcagtgatgataaatttatcgattgcttgggaaatattatgttcatcggtttgtaaaatcatcagagagtcttatggtattggtgacaattttgaatttaccgagaacttgatcaacactttgccatatcagacgttcgcggctaatgtcaaattgttgccagatatgatgcgtcgccaaagtgtaccagaaaatttaaagtcagtcttgtgttttttgttcacagttaatgatatcaaaaaattgaataacgggtatggcccgacttcttttattgatgacacacttgtgacgttatattttatgatttatttgaactatttcgaaaaatcgtctactgaggtcaccactgactcgccaggtttgaaaaagaaaattgccaagcgtgatatcttcccattaaccaacgacattttgaaggcttttaaaaaggacatcgaggacgttaccaaacagaaatcgtataatgagttgataaccgcccaaaagttgaaacaaggattaaatgaagataaactgctagaaaatgtgccagcatcggctaatgttaatgagatcattgttattgatgatgatgatgacgacaatttgtcacaagagccggctacaaaaaagagtaaaactgaatcaaatagttag

SEQ ID NO: 2463 - DNA, 738 bp, Candida albicans
gtatggtatccttatataatccatgcaaggtttagaaatcagttaatcagatctaaaagagttcaaaagttgcttaagaagttgattccagatcaagttaaaaaaatatataaaaaatttaagaagaatacggataggcaatctgctgatgaacaattggtatacattctcaagtatttaattaaatggtttcgaaaaaatttcaaacatgattcaaatgggttgagggttttaggttattcgtttgatcctggtaaattccctaataatgcaaagaatatctcaaatgaatccgatttattggcagtaattaaaaagtttcaacataatcgagataccggggcgcaaatattcacagcaattttgagtgctttaggttttgaaagtcgtttggtcttttccattcccctattgtcaattaaaaataccaatactcaaccaaaattgaaccatgaaatcttaaaagtaaataaagacaatgatttgttatatccttatttttggacagaattaatcaacccattggatccgtctgaaatcatagtcatggaaacccaatgcttttatgaagaagataaaaggctacttataatcaaacgtcatggtggcacattatcacaaagctttactgatcaattttaccccaatacaaatcaactttgcccaaatgtcaatgcattatgtgttgagtttaaactcggaagaactaaatattggatgtcagctcgcaatatttga

SEQ ID NO: 2464 - DNA, 336 bp, Candida albicans
atcaaattttctttaaagcattttttctttttatttgctagtttattccttccagtttctacaatatcaattcaatcttctacctcgttcttccttgatgttaaccccaacttgatgcgagtatctaatccacaactgtcaaaaaccctatttgtgaataacttttggggtaactccccagagaaaagttttgaaatcgtcacaactagaattaaagattcattaaatacattaaatgaaataatcaacttttatcaagagaaaatcaatatcgaaaaagaatacaccaaaaaactagagaagcttcagagcaaatgtatattatggacccaatga

SEQ ID NO: 2465 - DNA, 204 bp, Candida albicans
acacaaataaagcctatcatgagcatactttcagagaacaatcctacacaaacatcaataacagatccaaatgagtcttctcatctacacaacccagagttaaactctggaacgagggttgcttctggacctggacctggacctgaagttgaatcaacaccactagcacccccaactgacgtcatgaatactacatcgtcttaa

SEQ ID NO: 2466 - DNA, 519 bp, Candida albicans
tcacaatcattaaaaccttatcttacggccgttcgagcatcacttaccgctgctatatgtttagaagatttttcttctcaattaattgaaagacataatcgaccagaaatagaggttgattccaaatcatgccataatcccgaattaattttaaatcccatgattattgctcgtaatgaaaatgaaaaaattttaattgaatcaagtataaattcaattcgaattctgattaaaattaaacaagctgatgaaattgaaaatattttagttcataaatttactagatttttaactagtagagcagaaaatttttttatattaagaagaactccgataaagggatatgatatatcatttttaattacaaattttcatactgaacaaatggttaaagataaattagttgattttattattgaatttatggaagatgttgataaagaaattagtgaaatgaaattatttttgaatgcaagagctagaattgttgctgaatcatttttgattccctttgattaa

SEQ ID NO: 2467 - DNA, 285 bp, Candida albicans
caaaagtttaaccccggtacaaaacatagaatgtctgaagtgaatgaaacatgcaaacctcaagcatgtgctattcaaaactgtttagagaagaatggatataatgaatccaggtgcactaagtgtatcgatgatttgtataaatgctgcaaagaattctacgagcgtcaaggtccagatgcatcaagtgtctgctgtcccaaatttaaattgcttcaattaaaattgaaacagaggtcattaggtgaaattgatgcaaaggttttagagacaagacgaggataa

SEQ ID NO: 2468 - DNA, 354 bp, Candida albicans
ttcccgtcgcacaagcttggttccttcctgcccggcggtgtaagacatatgataatcctgccgagacacgaattgtacaataacctcgtcaatgctgagccagaaaacactcgaagaagttcaataaccagcttgaatgcggaattcagaaataccaaagcacataacgcattgtgcagtgttggaggctcgttgataagtggagtcacgttgacaaaattgatcggtatttcagttttagcctttacaagatctcagatctttgaagtttattatttcagaatgtggctctctttagttgtgattagttttgtccacgcatttgttttgttaccggtgttattaagcttttaa

SEQ ID NO: 2469 - DNA, 399 bp, Candida albicans
atctataccattaggatgattttcaaactaccgttaatccttttgagattgtatatcacatcatttataatttggattttccaaacaactattcttccacaaacattaactaaattaaccaatgtttcaatcaagactcaaactttccaacattattatccatatacttcattagtcaacactcctaaaaattccaattccataaacactataactaattcaaatataacatatataatagctcaccctgatgatgaagtaatgtttttcgctccatccataattgaattgaaaaaaccaaaatataataatcaaatcaatttaatttgtttttctaaaggaaattatattaaatcaatggatgaaatacgttcaatcggaattgattcaatcgagtag

SEQ ID NO: 2470 - DNA, 960 bp, Candida albicans
aatttttacttggtggtaatcatgactttcaaacaagatgctagagccgcgttcagaggcttatctattacagataaattgttaccattattaattgttcttgcaatagttattggtgtgataatatcggtatatgtacctgggagcagtgaagcatttaatggtactaaggtcgttggtgtgtctgtacccttagcaatagggttaataattatgatgattcctccattatgtaaagtggaatgggagcatttccataagtttttcaacaaaagtacctatctcagacctattttgatttcgcttgttttgaactggattatatgccccttcattatgcttggattggcttgggtggttttattcaactatgatgagtatagaactggtataattatgattggaattgcgagatgtattgccatggtattgttgtggaatgacattgccttgggtgataacacgctttgtgctgttattgtttttattaacagtttgttgcaggttgttttgtatgccccttatcaattgtttttctgttatgtgatatcgggtgatcctattccaattgactctggtgtttcatattcgatagttgcaaagagtgtcgctttcttcttaggtgtaccacttggtcttggtgtggttgtcagatttgcattattatactttaaggtttacgataagttgattagatttatcagtccttgggctttaattggattgttgtacactattattgttattttcattgataaaggtaaagagtttattgaagaagttggaactgccttcctttgttttattcctttgactttatactttttaattgcttggtttacgacgttttttgttttaaggtggtcatcaaaggcaccaaaattggaggatgaagatactagattattatgtggatgtgaagaaaaaatcgaaaagtcttcaccacgggtggaagaccgc

SEQ ID NO: 2471 - DNA, 1653 bp, Candida albicans
aaaacctgcatacagcaccaattacttttatcaacaagtgaaaaaaaaaaaaagaaaacactagccaacaacaacaacaagaactcagcgacgcagaaaaaaaaaatagaaccgacgtttgaaatattcaacgaccatttagaaatttttcactccatcaaatcaaatccaacaatgcaagaaccaactgacatctcgtattacattgggaaagaatctgccgaatctttaaatttgttggatgttccggttggaggtggacaaattgtttccatcgatttgcgaaatgaattatcggatgacccatctgaattaattcagtttttaactgatcaacaaactgagaaacagtactggattatagcagcaagtgggtatgcaaaattggggaaattgaaagagctgttggaattcatcaatgcagctttaaaattggattattttaatgaaaatgataaaaagtcctttgaaagtttcattatttggctcttagtgaaaaatgtttatttggggattgacaaggataacaacttgaatcttgctaaaaaagaaatatcaaaattaaattttaaaatccaaactgacagtgaaacaagtacactgattagtacatcaaatttactaagtctggcaattttgtacttgtacgaatcgaaagatgatgatgccatagacatatttgaccgtattttaagaattgatccaaacaactgttttgcattattagggaaagctcaatcagtattgaataaaacgaaaaactattcgcatgcattgaaattgtatcagcaagttttgattttgaatccgttaatgaagccagacccaagattaggtattggattgtgtttttggtttttaaaagacgataaaatggcaatacaggcatgggaaagaagcttacaattagaccctaccaatgtgaaactgagaatattcttaaacctagcaaaatttcataccacatttactaattcattgagtgatgaagaatttttggacaactataaaaattgtttgcaagagttaagcaagctcaagagtttgaatgctaatgatactacagtgactttagcattgtgttcatatttattctctaaaggtgactacaacacagtgataaagattgtggaaaaaattgtcaagggtatcacaggatctgacaatctcaaaaagtttagtacattttccagaatcaccaaatatgaatcgaatgccttatctcagtgtgctacatggttagcaagaatagagtttgcaagagggaattttacacaatcttcaaagtactttcaagaagcgataaagttaaatgaaacaaatattgtagccaaattgggattgggtcagtcgcaatacaatcgtggctcaattgaagaggccagcttaacttttgagagtattttacgaagcaacgtcaaatgccttgaagttaactattctttaggtgtcttgtattccaagcaaaactcaagaagtaaaaaagagttggctatccaggtgttagaaaggtacatacgattatcaaacaaccgtggcttatcctcgaatgaagaagagtttgtgttgaacaaagaaccagtagctttgaacgcatacttgattttaatccaattgtacgagttttcaacgcgacggtcgaaggacatagta

SEQ ID NO: 2472 - DNA, 1278 bp, Candida albicans
ttcaatatgcgcggagctgacaccttcctgatgaagaataacatgtactgtatcatggccagagatactaagggggcagacgagaaaaagaagaaatattatctcagagccattgagcttttcaccaaagtgttgtccttggactccaaaaatgtttacgctgcacaaggtttggcgattacttatattgaaaataagcaattaaacaaaggtttggatattttgagaaaaattagagattctttaaacgatatttcagtttacttaaatttaggtcacgtattgtgtgatttaaagcaatttggtaaggccatagaaaattatgaattggctttgacaagatacactgatgggaaagatgccaagattttgtcgttcttaggacgtgtatggtacttgagagggaacgctgaactgagtttgccgtacttgaagaaagccttggggtatgcacaagctgcattagatgcagctagatctacatcaactgcggcacttgcattcaacatttcgtttgtgcagtttcagattgctgattttataaccaaacagccagttaatgagagaaatatagaggatattgagagtgcaattgaaggtttgaataaagccatagatattctaacacaattagcatcggatgaagaaaaacacccaccttatccaagagaagagttgagaggtagagcaaacttgggtactagtaccttgttgtccagattagccaatgcgttggaagaaactaaagaaaacaatgctgaaatagaagaaaagatccaaaaggctaaacagatcagattggatgaagaacaagccaggttgaaggaagaagaggaaagattgaataagttgaaggagaaagagttggagatgagcaaacaaagaatgctcttacaagaacaagcacaaaaatgggctgaagaaaacagtgctagtgttggcgtcagcgataatgaggaagatgacgataaattattcgacgaagaatctgctcaaaaagaaaacaagagaaagaaaggaggtagtagtaagggaaagaaaggcaaaggcaggaaaaagaaaggaaatatcattgatgatagtgaagaagagccagagaaaaatataactgatgactctgaagacgaagcaaacggaaactctaacggcaaaagaaaagcagctgatgatgctggtggtaagaaaaagaagaaaccactttcatcagagtttatacaagatagtgaagaagagttggaagacgatgacttgtttggtgataatgatgatgatgagtag

SEQ ID NO: 2473 - DNA, 210 bp, Candida albicans
  unsure (176): Identity of nucleotide sequences at the above locations are unknown.
tttctttgtaattttttttttctcccacatatacacacatacaaaccgatttttataagaaagagttataccatgtcagttcctacgtttgatgatttatcattttattccaatgatcaagaattaactaaatccagatacttgaaattagttgagattttccaactccatatgtnttcgcggccggactggccagatccgcactatagt

SEQ ID NO: 2474 - DNA, 444 bp, Candida albicans
aacttaaccaacgtgccagacacgtatatcaagaggagtttgcgagtattagagacttggaaattgttatcgacgacacagaccagcagcaacagcaaagacgatgacgaatcatttttggtcaagtttggggaattgatgaaccaatcgcaatcagatcttgataaattgaatgaatcatcaaatgacaaattgaatgagatttgttcaattgcattacaaaatggttcttatggatcaagaatcaccggtgctggttggggtggttcaattgttcatttgacaacattagataaatcgaaacaattgatccaaggattgattaaaaactattatcaattggaatttcctaatattaaattggatgaattgttgaatgatgctattattgatagtaaaccatctatgggtagttgtattgtaacgactaaattcttacaataa

SEQ ID NO: 2475 - DNA, 513 bp, Candida albicans
ttccaatccaatttccctaatgcatcaattgatttctttgctagatctcctggacgtgttaacttaattggtgatcatattgattacaatttcttccctgttttacccatggctataagcaacgatgttatagttgcagtgaatgtcaatgatgaaccagaaatagtgattacaaacactgattccaagaattttgccaaggaaactataccattgaccaacaacaacgatggttttgagattgattcacagcatcatagttgggcaaattatttcaaatgtgcattaattgtcgccaacaactatttaactgaacaaaacttaaaaggccaattgaaaggtatgaaattgacttttgatggtaatgtacctacaggaggagggttatcttcatcagctgcattttgtgttgcttctacattagctatacttcatgccaatggagttaaagatataagcaaagctgatttcacaagaatcacatcttcaacgcctagaagaccaagtcgtcaa

SEQ ID NO: 2476 - DNA, 261 bp, Candida albicans
  unsure (224): Identity of nucleotide sequences at the above locations are unknown.
gatatcctccccgcccccactgatatgtcacgagaagctttaatcaatagaataaccaatgaaaccaagattcaaattgcccttaatttagatggtggtaaacttgaattaaaagaatcgatattccccaatcaatcaataataattgatgaacatcatgctaaacaagtatctggttcacaatatataaatgttcaaaccggtataggatttggtcgatcgtnttcaccatccggcgtagacggtccaatcttaattgtg

SEQ ID NO: 2477 - DNA, 465 bp, Candida albicans
  unsure (1): Identity of nucleotide sequences at the above locations are unknown.
natggcaattcaatcacgcccagcaattcgatcaatagtggtacaacaaagttaaccttaccaccacgacgagtttgggttaagaaaccgcaaacaaacaacccaaccacggtactttgttatgtgaatgatataattgatgatttaaaagtagcagtggtgaacaaatatccaaataccattggcaggtacgaggatgctgccgatttgcttgttaagatagatttgaacaacatcagagtgccagtttcccccagtgttaatcgagtgtcgcaaagaactccatttgataattgtataattttggaaccagatcagaacgtttggcaaatactagacaattattttcctaatggaatggccatgcacgatgccttgataattgagacaccaacattcaaaccagaccatcaaatgctaacaccaataacagccaatatgaacaataatagtaacactttttag

SEQ ID NO: 2478 - DNA, 1158 bp, Candida albicans
ttacagattctttacttaataatgctacggcatttggtatttattttgattgcaatacttttattgacattccctcctaaaatcgaatctttattcaaatcttttatcatcaataaaccaactaaaacaacatgttatcaatataccattcgtgaacaacttaaatcaatacttgaatcagatatccatgagacaaatttttgtattgaaaaaccttccacatcacccccaaaaacaaattctacattgttaatgttatgtcaaaattccgatatattttccgtattagaaaccattcaaaacattcaggatcgattcaatgataaatacaattatgattacacgtttttaaatgacgttcccttcaactatgagtttatttatttagtatcatcaattatccctcatgggaaaatcaattttggtcttataccaattgaacattggtcatatccatcacatataaatatatcattagctactgaaatcagacaaaattatgctaatgtcccttatggagattcagaaagttatcgacacatgtgtcgattttattctgggttttttcataaacatgaattggtcaaacaatatcaatattattggagaatagaacctggcattaaaatatattgtgatattgattatgatgtgtttgaatatatgataattaatgataaaaaatatggatttgtgatttcattatttgaatactcggaaactattcctacgttatggaatcatgttgttcaatatataaatgataatgaaatcaaatcagaattgttaccacttttgactaataaatataattggtataatttatgccatttttggtcgaattttgaaattgcaaatcttgatatatttaataatgatgattatgaaaattttttccaatatttggacaatttaggagggttttattatgaacgatggggtgatgctccaatacattccattgctatagcattgttcttacaaaaaaaggatattcattggtttgaaaatataggctactatcatgttccatatctacaatgtcctcaagatattgacttgtacgtcaagaataagtgtacttgtaaccccgatgaagattttacatggagtgaccttagttgtactaaccatttcttgaacattctacataattga

SEQ ID NO: 2479 - DNA, 297 bp, Candida albicans
catacccatagtatccaaatgtctaagtttgttattccaactgccttaaaagaattaagatttcatttatcacaaacaggagaagcttcaatacctgtgagaaactttttaactaaaaactatccaagtttgaagactcaactgaattacaaattaccaattttgattagagaaagttatggtatcccacctacattaactgctagatttgaaagaggtgaagaagtgaaaacaagtttagaaggtttggatgaagctggtgttgaaaaggcattaaatgaattattaaaaagatag

SEQ ID NO: 2480 - DNA, 525 bp, Candida albicans
ggtattttttatttcaaaactatgaatgaagagttaattaatagtgctgtttcatttttaaaagatcctcaagttggtggatctccattaactaaaaaagtagagtttttggaatctaaaggattaaaccaagaagaaattgaagaagccttaaaacgagctaatgataatagtacaacaacctcttcctcttcctcatctgtggcaagttctaatctgtctaatacaacttcttcaccatcatatcaatcacaacaacaacaacaacaacaagtttattcacaacctcctattgattattataatgttgttccaccaccagtaccagaaaaatcatggaaggattattttataatggccacggctactgctggagtcacttatggattatatcaagtcgtcactcgttatttaatcccatcaataattccaccatctcaatcatcaatagataaagataaagaaaccattaatgaagaatttatgaaaattgataaaatattagatcaattaacttttgaacaa

SEQ ID NO: 2481 - DNA, 825 bp, Candida albicans
ttagaagctagtcattcggtattgttattttattttgccaataatagtaaagtcaatttagatgatgttatgcgatatgttgaattggtgcttgagcaatttccgcaaagaatatctgcaactcaattgagtattgccattgaaaccattggtaagaaaattttatccaatccaattagttacaataattataacagcagagggaacactattttcattaattcggcagagaagtttttcatatttttattgaacaaatattctagaattgaacccggtgttccaattaaacccaaatcaattacgtcagtattatcctcaggttcaggggaggcgaatgtgtcatttacatcagcacaaccagtcaatgagattgaagcacatgctactttgaatacattagaacaagaggggaaattagccaatgatgttattgatgagaataaagctaaggcaccatcaaagaaaatcataaaaaaatatttacctgatcttgttggtaaaaccaagaccaattctgacaaccatccatttgaattttttgatactcgattaacaccagaaacagcaagagaagcaactatagtttcattaattaatttggttccatactttccattatcagtatttattccgtggttaaaccaagtttgggatttaattgtgcgaagtgattcaaaggaacaacaatttttattcaatatgttatggaaagttattagtgagagtttagatataaatcgaggagatttagccattagatggtggtatgaagagaaacaatttactttcttcaccgaccggggctggcaggaaacgcgctac

SEQ ID NO: 2482 - DNA, 681 bp, Candida albicans
tcacaaactttctctcgaaatatgaattatttattgttttgtttattttttgctttttccgttgctgcaccagttacggttaccagatttgttgatgcttcacctacaggttacgattggcgggccgactgggttaaaggttttccgattgatctgtcgtgtaatgccacacaatataatcaattatctactgggttgcaagaagctcaattattagctgaacatgccagggaccacacattgagattcggtagcaaatcgccatttttcagaaaatactttggaaatgagactgcaagtgctgaggttgttggtcattttgacaatgttgtcggtgctgacaaatcatccattttgtttctttgtgatgacttagatgataagtgcaaaaatgatggctgggctggttattggagaggttccaaccatagcgatcaaactattatttgtgacttatcttttgttaccagaagatacttaacccaactatgctccagtggatataccgtctcgaaatctaagacaaacattttttgggcaggtgacttgttacacagattctggcacttgaaatcgattggtcaacttgttattgaacattacgctgacacttctgaggaagtacttgaattggctgtgttcacaacacgggccagagaaggtccgtcaattccgcgcccc

SEQ ID NO: 2483 - DNA, 360 bp, Candida albicans
tcaggtatttcattaatgtccagtgttgcttccaaaaagataataacatttgaagggcacaggaatttcagattaagattggtgctagccacattatctggaaaacctatcaaaattactaaaattcgttctcaagacttgaacccaggtttgaaagatcatgaagtttcttttcttagattactagaagccgtaaccaatggatcccatattgaaatttcatataccggtacaacaatcatttatagacctgggattataataggtggagatcttacccacaattgtcctgatacaaaatctattggatatttcattgaaccaatgttaatgttcccgcttttttcgaaaggtcgttaa

SEQ ID NO: 2484 - DNA, 711 bp, Candida albicans
atgggggttattaccagtttaatggaaaagtttggtgtgagagaagtttcgttacatattttgaagagaggatcagcccccttgggtggaggagaagtgcatttgttatgtagctctttgattccacaaccattgactattcacgcgttggacattcccaagttctctgccattagaggagttgcttattgtacaagagtttccccatcgattgttaatagaatgattgattcagcaagagcagtattgaagccaacaggatgcgaggttaatatcaccgctgatgtctggagaggagaaaattcaggaaaatcaccagggtttggcatcaccttagtcgctgagctgaagcgtggatggagaattgttaccgagaatgttggttcggctgggagtttacctgaagattctggtgagttaacagcttaccagttactcgaagaaatatcaaatagtggagttgttggaagataccagttgccattagcacttgtgtatatgactattggaaaagaagacattggtcgtttgaaaatccaaaaaagtgagatcgacgagaatttggtgtccgtgctcagagatattcaagaagtttttggcacagaagctttcttcaaagatgatgcagaagagcttgatagtgatgataaattcatgacagtttctatcaagggagtagggttcaccaatgtttctaaaaaaatagcttga

SEQ ID NO: 2485 - DNA, 1662 bp, Candida albicans
gaaaaatttggaaaaagaaaagtaagaagaaagaaaaaaaaaagaccagataaaatttcactttttcaattcaaacctaatcacaaccaaaccttctttatctcttcaaatatgcctggattagattatcttctttttgaagaagctactggatatggtatattcaaagtattaattcaacaagatgacattgcatcaagactgaaagaagtccaagaagccgccaatgatttatccaaattttccaaaatggtggaattagtatcatttgctccatttaaaggtgcagctcaagctttagaaaatgctaatgatatttccgaagggttagtctcaccatatttacaatctattttagaattaaatttacctaaaacatcttctaaaaaaagaattgctcttggtgtttctgataaaaatttgggtccttcaatcaaagaagttttcccaaatgttgatgttttatctaatgaaattgttcaagatttccttagaggtatcagagtccatggtgctaaattattcaaagatttacaagaaggtgatattgaaagagctcaattaggtttaggtcatgccttttctagagctaaagttaagttttccgtacagaaaaatgataaccatatcattcaagctattgctttgttggatcaattagataaagatatcaacacttttgccatgagagttaaagaatggtatggatggcatttccctgaattggccaagattgttcctgacaattatagttatgccaaattggccttgtccatcaaagacaaggcttcattgactgacgattcattgcatgatgttgctgccattttgaatgatgattcaggattagctcaaagagtcattgataatgctaaaatctccatgggtcaagatatcagtgaacaagacatggataatgttataacttttgctcaaagagtagtaaatctttatgaatacagacaacaattgtacaaatatcttactgataagatgcacactgttgctcctaacttgtcaactttgattggtgaagttgttggtgctagattgatttcccatgctggttctttgactaatttatccaaacaagctgcttctactgttcaaatattgggtgctgaaaaggctttgttcagagccttgaaaactaagggtaacacaccaaaatatggtttgatttatcattcatcttttattggtaaagctagtgccaaaaacaagggtagaatttctagatatttggctaacaaatgttctattgcttctagaattgataattattccgaagaaccaactactgcttttggtgaaattttgaagaaacaagttgaagatagattgaaattttacgacactggttcagctccaatgaagaattccgatgctattaaagctgctttggctttgaatggacaagatcttgctggtgctgaagaacaaaaagatgttgacatggtcagtgatgaagagcaagtgaagaaggaaaagaaagaaaagaaagaaaagaaagaaaagaaggataaaaaggaaaagaaggaaaagaaagataaaaaggaaaagaaagataaaaaggaaaagaaagataagaaagataagaagagaaaatcagatgatggagaagaaactccaaagaaaaagaagaagaagtctaaggattag

SEQ ID NO: 2486 - DNA, 1806 bp, Candida albicans
aaacttaaacttttaatacaacttacaatggaaagagatttgacttataatgccccgaaaataaagtttaccgatactgaaggacaagaagaacatttttatttcaatcggagtaacaattcaaccaatgatttaaccagtcatgactcttcatcaactcaactacaagatgccaattccagaagacaagccccaccaccaccaccacataatccattttctgacaattcccatgaaaatagtactgaatcattatatcaatcagaaacaagatttcatcaaccactacttcataatgatagtaataatagcaatagcagtataggcaataatagacaacgtattccatcacaacaacatgatacactgtcattatattcagcatcaccaatatcaacatcacctttagtttctaattttcaatcatatctggacaaccaagacgaaatgactcgaggtaagtataaccagaatacaaatcggtcaagttcaaattatattcaacacagtccaacatcagcagggtacgatagatatccgcttaaaactcaatccagtattggtggatcaatgctgagaattggtttatcatcatcatcgccatcacaacaacaacaacaacacatgtatgataacaattcatctaatcgatctctgtattcacctgattccgccactgatttaatggtttatgaaaatggagaatttagtccatttggaggatatccagcaagtttattccccttaagtattgatgaaaaagaacccgatgattatttacataatcctgatcctgttcaagatgccgaatatgataaaaatcggtttttatatgacttaaaaaccatggataagaaatctatgaatggattaattgcatttattgtaatgtttttaattgctattgctatatttataattttaccagttttcacatatactggatataaccccaaggcgaaaaattttgaaaattatgaggttttaactagatatctgtatccaagattaagtgctatccgaacttcattaattgatcctgatactcctgaagatgccttattttggaaatctaaaaatggtgaagaatggccattggtgtttagtgatgaatttaatgccgaaggtagaacattttatgaaggtgatgatcaatttttcactgcaccagatttacattatgatgccactaaagatttagaatggtatgatcccgatgctgtaactacggctaatggaacattaactttacgtatggatgcttttaaaaatcatggattattttatcgatcagggatgattcaaagttggaatcaaatgtgttttactcaggggaaattggaatttctggcaaaattacccgggtatggtaatatcactggattttggcctgggttatggtcaatgggaaatttaggtcgtccagggtatcttgccctgactgaaggtgtttggccatatacttatgattcatgtgatgctggtattacacctaatcaatcttctccagatgggatttcttatttaccaggtcaaagattaaataaatgtacttgtccaggtgaagctcatcctaatcgtggtgttggtagaggtgcccctgaaattgatgcattggaaggggaaattcatggtgttataggtagagtttctcaatcattacaagttgctccttatgatatttggtatatgcccaattatgattttcttgaaattcataatagttcaataacattaatgaatacttatcgctggtggacgctctccaaacttgccctcggagggcaataccggattatcctggaa

SEQ ID NO: 2487 - DNA, 465 bp, Candida albicans
atcaattgtttaattatttttttaaagtttgctatcaaaaaaaaatactataaatatcatcaaataccccccaacatttctttcattccttttatttcttttttattaaattcaatattatcaaaaaaattttcaaacacaattacaatacaaatcattatgagtgaagaaatcatttcatttacaaatcctgctttaggtccattaccaacaaaagctccacaattaccatcaaatgttcttgatttgttttctttaaaaggtaaagtcgcttccgtgacgggatcatctggaggaattggttgggctgtcgccgaagcatttgctcaagctggtgctgatgttgccatctggtataattcgaaaccagcagatgccaaagctgaatatttaactgaaaaatatggtgtcagagccaaagcttatagttttcaaacacgaacggggcccaggatcagtagtaaa

SEQ ID NO: 2488 - DNA, 336 bp, Candida albicans
actaacgcggtctgccactcccgtggtgaataccctcaattacaagctccttataatgctgctaaagctgcatgtactcatttagccaaatcattgagtgtggaatgggctagttttggtgctagagtaaattcaatttctccagggtatatattgactgatattgctgattttgctgatccagaaatgaaaaagaaatggtggcaattgacacctttgggaagagaaggattaccacaagaattagtgggggcatatttatacttggcctcaaatgcatcaacttatactactggttcaaatattgctgttgatgggggttatacatgtccataa

SEQ ID NO: 2489 - DNA, 873 bp, Candida albicans
  unsure (260),(361),(379): Identity of nucleotide sequences at the above locations are unknown.
tttgccattcttaattattctgtcatgactttcacctcctttatcaaaccagaatcagacccaaatatcatcgttccaaccaagccattcaatttatctccgaatattgttgaaaggttctcacttaaagacaaagtcacagtcattactggtggagcaggtgctattggaagtgctattgctgaaggttatgcacaagctggaggtcatgttatcatattagaacatgcatcatctgacaatgggttgaccaaaagatnatcatcagcgtatggagtcaagtccaagtttttccaaatcgatgtcacaaattctcaacaagtccaacaagtaattattgaaattgacgaagaagttggtnacatcgacgtgtttgttngcaatgcagggattgcatggtatactggatccattttgaatgaagactcaaccccagaaaattggagacgtgtttttgatgtaaacgtgaacggtgtcttctactgtgctaaatatgctggagaaattttcaaaagaaatggcagcggatcctttattatcactgcatcaatgtctgctcatattaacaatgtaccaaactatcaaacatgttataactccgccaaggccgctgtaatgcacatggctaagggtttggctgttgaatttgctggttttgctaaagtcaattctgtatcccctggttatacaaacaccctattatcggaaccaataccaaaaccacaaagggcaaaatggtggggtttaactccgatgggaagagaagctgaaaccgatgaactagtcggagcatacctttatttggccagtgatgcatcttcgttcacaaatggttcagatatcagagtagatggtggatactgttgtgtataa

SEQ ID NO: 2490 - DNA, 927 bp, Candida albicans
atgtttaagactatattttcaattacttcgaaacttcgaattttaccaatcaatcgacattttactactacaattactataagaatgagcaaagaaacaacttcatataccaatgctaaattaggtccattaccaaccaaagcagcaaccattcctgataatattttagatgcattttcattaaaaggtaaagttgcttctgtaactggttcctctggaggaattggttgggcagtagctgaagggtatgcacaagctggtgctgatgttgccatctggtataattctcatcctgctgatgataaagctgaatatttaaccaagacttatggggttaaatccaaagcatacaaatgtaatgttactgatttccaagatgttgaaaaagttgtcaaacaaattgaactggatttcggtaccattgatatctttgttgccaatgctggtgttgcctggaccgaagggcccgaaatcgatgtcaagggagtcgacaaatggaacaaagttgttgatgttgatttaaacagtgtttattattgtgctcatgttgttggtccaattttcagaaaaaagggtaaagggtcattcattttcactgccagtatgtcggcttcaattgttaatgtcccacaattacaagcagcttacaacgctgctaaagctggggtcaaacatttgtccaaatcattgagtgttgaatgggcaccatttgctagagtcaattctgtttctccaggttacatcgctactcatcttagtgaatttgctgatccggatgtcaagagtaaatggttgcaacttacaccacttggtagagaagccaaaccaagagagcttgttggtgcctacttgtatttggcttccgatgctgcatcttatacaactggtgctgatcttgctgttgatggtggttacacagttgtttaa

SEQ ID NO: 2491 - DNA, 480 bp, Candida albicans
ccaagatataaaaaaatgcttttaatttaccatcataaccaagatcaatatgttgaattatcgaaacgaagtactggttcaggtgggattgctgggattgtaattttcattttcattgtcatagtcatatttatttcgttgctcagttatggaaataaaaagtcaaagagaagaaaccaaaagaataccacccccgcaaatattacattaggttcacttaatttggaatctcaaaatgtacatcaaggggttgctcgtatacagcaacaacaacaacaacaacaactacaacaacaacaacagaatctgggaataacgacaagtcctgaacatgattatgtgccgccatatacacaaacacccaatgataatgatttaggtagatttgataaacaagggaatttccatttactgaataggccagaaggtgtacaaccacctttgccaccaccgcctgtttacctaaaccctactatctag

SEQ ID NO: 2492 - DNA, 1026 bp, Candida albicans
aatcgcggttccttccagcccccgtgggtgaagacacgaatcgaacaaattgatctgaatacagttgaaattactgaaatcccagtcaaaacttggactaacaatgtcaaagaatttttgctcagtgggtttgggaatgaaaagacccagccatggattaaagatatggaagagcaccatactacatctatcaggtttgttatcaaattgactgatgcggaaatgcaaaagtcgttgcgtattggtcttttggagaggttcaagttggtttcttcattgagtttggccaatatggttgcctttgatcctatgggtagaatcaaaaaatataatgatgttttagaaataattaaagatttctattatgttcgattagaatactatcaaaagagaaaagattatatgactgacaatttacaaaatcaattgttaatgttgagtgaacaggcgagatttatcaagatgataattgagaaacaattgagtgttgctaacaagaaaaagaaacaattggttgcgttgctagaagaacataattttacgaaattcagtaaagatgggaaaccaatcaaatccagtgaagaattattgactggtgaagatgccgatgaggaagaggaaacacaagaacaagaaggtgacgaagacgtcggtaatacctctgtagctaatattcaagaaggagagcccgaacaagcagcccatgttccagaaacaatttattcatcctatgattatttgttgggtatggcaatttggtctttaacttatgaacgttttatgagaataatgcaacaacgtgatcaaaaggaagcagaattgaatgcattattgtcgaaatcagcaaaggatctttggaaccaagatttagatgaatttttggctgaatttgacaagtttttacttcgtgacgaacaagaaagagaatctttggcttctaacgggaagaaaaaatcgacgaagagaagagccaaggctactgctaccaaagaccagccaaataatacaaaagtcaaagttgaacca

SEQ ID NO: 2493 - DNA, 504 bp, Candida albicans
aaaatctgccatttgaaaaaagcgcaccccctgttcaaaaaaaccaacgaaaaaacaacacaacttcttccatccccaccagcaatgtccatgtatccccaacgcacccagcaccaacaacgtttgacagagttgttggatgcaatcaaaactgaattcgactacgcctcaaacgaagcaagcagtttcaaaaaggtccaagaagattatgactcaaagtaccaacaacaagctgccgaaatgcaacaaatccgccaaacagtgtatgaattggagttggcccatagaaaaatcaaagaggcatacgaggaagagatattgaggttaaagaacgagttggacactagagacaggcaaatgaagaatggcttccaacaacaacagcaacagcaacaacagcaacaacaacagcaacagcagcaacaacaacagattgtggcaccacctgccgccccacctgctccaccaaccctgtcatacttgcccacgcgtggaaaatccgaa

SEQ ID NO: 2494 - DNA, 486 bp, Candida albicans
gagtcacccatcaaacaagaacagacagctgccaaacaagaaaaacatggccttgatgaaaatcatcctgttctcactgatgaacagattcaaaaggattttgatttattttaccaagatatatttgttcatgttgccaaactaggacaaatcaacgatatggcagtttgtgaaaatgaaaaccatctttctggccatgtttacatcaagttcaatgattataatgatgcaattgcggcaaatttgcaattgaatcaggaatggtataatggaaaaccagtttacagtgaattatcacctgtaaatattcttgctgatgcacattgtaaatcttgggatcatggacattgtgaccgtggagcaaaatgtaattatttgcatgttaaacaaccaacccaaggaatcaaaaaatctctatgggattcacaaacaaagacatacacattaaagaaattggaaatgtcgaagtcttcaccacgggactag

SEQ ID NO: 2495 - DNA, 573 bp, Candida albicans
tcaaacaacctacgaagaactataagtatgaacaggtcctcatattcatcacagtcagacaatcgatactcacgaaatccagctgtattatgctcattttattcaaaaatcggtgcttgtcgacatggtgagaaatgttcgaaaaaacatttgaaaccaatttcttcaagaactatactactcgccaacctttaccagaatccaacattgaatgatgacgattatggacacgcaaatggcattggtagtgaaacttctcagataatagacaatgaaagtgtgattaagaatagtgatactgtaggtactgtatcgcaaatagatgactcgccgcattctaatagtggagaagttaccaaggacgaaacagttgaaacacaagaggtagagactgagaattcggagaatattgctgaaaccggtgatgtcaagatagatcataatgaagatcagaagcaaatcgaagatgtgaaagaatcggacaaggtagatacttctgaagaagtccaacaagatgataaacttcacaaagaagacacactagagaaagaatcagtatacaccgccgggggc

SEQ ID NO: 2496 - DNA, 606 bp, Candida albicans
tttaccatctattccccacagaatcaatcaaacacaattgcactaatatttattatgagtacaactgagcaatcattacagtcaaagacagctgttttatgttctttttatacgaaaattggttcttgtcgtcatggtgaagaatgcagcaaaaaacatttgaaaccaacaattacaaaaactatattactccccaacctttatcaaaatcctcgatttgatctagtagagtatttgagtcggaacaggaaacaacaccgggtcaagaaaaggaaaactggagacaaaaatagtgatgacattgcagagatcaatttagaaacaaaagatgatgttaaggataatgaggataaggctaatgttgatggagaaaataaagaacacgatgaaactaaggaaatagagtccgaagatgtaataagtaaagataaagaggaggtcattgtggatagatcgggaattgctcaacaagacaaacaaaaggagtcaaataaagagggcaagcaagaaggtgaatctgaaaaggaagaacctaacaaggaaagtacggaagaagaactaccccctcaagatgcaacacaagaagtgccgaaccacaatcaataa

SEQ ID NO: 2497 - DNA, 198 bp, Candida albicans
ctatccgctctagtgagatgcattttgagtatctttgaagctagtactgataccatgttctcagttatcgtgaagcatcaaggcaaacgtcatgaagtcgagctcgatccatctgcaaatggcgaaacgctgaaatatcaaatgtactccttgactggacttgaatcttcaccacgaggctggcaggatccgcgctaa

SEQ ID NO: 2498 - DNA, 870 bp, Candida albicans
caaaaaaccatggcttacgttttaactgaaacagcagcaggatatgccttattgaaggcagcagataaaaaaatccacaaatcttcttctttagttgaagacttgaacacagccgaaaaagttgctgaacaattcaaaattcaccgttttgaaaaatttcagtcagcagcaaatgcattagaagaggctaatgccattattgaaggtaaagtttcagaaaatttacaaaaattattagaagatgccaaatcagataaaaaggctactttgattgtctcagaagccaaattgggtaatgctatcaataaattgggtttgaactttcaagttgtaagcgatgctgcatctttggatttacaaagagccatcaaacaatttttgccagaattattacctggtttggatgattcagcattaaaacaaatgtctttgggtttagctcactctatgggtcgtcataaattaaaattctctgccgataaggtagacaccatgattattcaagctatagccttattggatgatttagataaagagttaaatacctatgccatgagatgtaaggaatggtacggttggcatttcccagaattggccaaaatgattactgattctgttgcatacgctagaattattttgaccatgggtgttagatctaatgcttctgaaaccgacttatctgaaatcttaccagaagaagttgaagaacaagtcaaagctgctgctgaagtgtctatggggactgaaatcactgaagatgatttgaataacataaaggcattggccgagcaaattgttgattttgctgcttacagagaacaattatccaattacttgtcttctcgaatgaaagctatcgcaccaaattag

SEQ ID NO: 2499 - DNA, 690 bp, Candida albicans
actgctatggttggagaattagtcggtgctagattgattgctcacgcaggttcattgacatcattagctaaagccccagcttcaactgtgcaaattttgggtgccgaaaaggctttgttcagagctttgaaaaccaaacacgacacaccaaaatatggtataatctaccatgcttcattggttggtcaagccagtggtaaaaacaaaggtagaattgctagaacattagctgctaaggctgctgtgtcattgagatacgattgttttgacgaagaaagagacgaatcagatgactttggtttagaaaacagagctaaggttgaaggtagattgagtcaattggagggacgtgatatgagaaccacctctaaagttgtgagagaacaaccaaaagtggaaataaccgaagcccgtgcttataatgcagatgccgattctactgctgctgcagctgctgctgccccaactgctgattcagacgacgaagagtccgagacagaagaagttgaagaaaagaaatctaagaaagataaaaagaaggataagaaagaaaagaaggataagaagaaggacaagaagagaaagagagatgacgataaagaagataaagaatcttctaaaaaactgaagaaggacaaaaaggaaaagaaagagaaaaaggaaaagaaagcaaagaaggaaaagaagtaa

SEQ ID NO: 2500 - DNA, 1296 bp, Candida albicans
aaagtaattcgtagcaaacaaaaaaggaaagttcctttttttcaaccaaaatcaccggttatgataattccagagaaaggaacattggacgaacctgaagttggatcagaatccaagaaaccaaacaattcgactcatgtaaagggggtagcagccatcaaagcagaatatttggtacctacatcttcattaactgttgttgaatacgatgatgatgaagctgaaggtggagatagagaaggtgaatccaagccaagaaataagaagaaacaaaagggacaaaaccacaaacgtgatttgaaacaaaagaaggatattattaaattatgtccatctttgattgatccagaagatgatagaatttgtcaagtaggtgcagacaaatgccgctttcatcatgatattgcttcatacttggaatctaaaccacaagacattgacggtatatgtccagtttttgaagctcttggttattgtccaaccgggataaaatgtaggtggttgaaatcacattacaacccagaaacctccaagttgatcaaagatggagacaaaatggaaactgctaaaaccactaactatgaagtcaatcatatcgataaagatcaaaagatggaaatgcagaagaagaaatattttttcaagatttcacagccagtaattaaatacttggattctcgaattcaaaacgaagcaaatttggccaaacaaaaggaagaacgtaaagataatgaagctagttatgtggaagcacctttcacgattgcagaaaaaaagaagctttatttacgtaatgccaaaattgtttctccattaacaacagttggtaatttgccttaccgtcgtttaatgaaaactttaggtgccgacgttacctattctgaaatggcactttcagttccgttgatccaaggacataatcctgagtgggcgttaccaaaagcacatgtaagtgagtatccagggtttggtgttcaaattgctagttccaaacattgggctgctgctaaagctgccgaggcaatctatagaaatacaactcatgtatcggaattgaatttgaactgtggttgtccaattgatatgttgtataagcaaggacaacgttctgcattattggatcaaccatcaaaattgttgcgtattttaagtggtatgaatgcttcgtcaggggatattccactcacagttaaaataagaagtgggattaaagaacgcaaaaacactgctgttgatttagtatcaaaagtattggaagaaagaaacgctgctgctataacattacacggtcgttct

SEQ ID NO: 2501 - DNA, 294 bp, Candida albicans
taccaactaccaaaaatgcctagcaagcaattacgagatccaaaatatagaccgacagaagtgatcaaacaatgtcaagaaaaaggccgaccagcatatattgcaggacctatggttcgttactcaaagcttccatttcgtgagttgtgtcgcttttatgatgtggacattgtatatacaccaatgattttggcacgagaatttgttcgtaacgaggttgcaaggtccactgattttacaacaaatgattcagacaaatgtgtgattgtaacaggtgggggtacaaaatgttga

SEQ ID NO: 2502 - DNA, 765 bp, Candida albicans
caggtgggggtacaaaatgttgacgaattcatgaagtttattgaaatgatccatcctattgttgatggtataggtatcaactgtggatgccccatcaaggaacaagtcagagaaggcattggtgcaactatcatgtcagaccccgacttagttgctgaggtaatcaaaactgccacagacaagtatggagactcgatatgtattgatacgaaaattagaattcacagagatataaaccaaacgatagactttgtcaataaggtggtggaagcgggcacagacacgttaacgtttcacgggagaacgaaaaacacgagatcaagtgtacccgtaaacttggatgccattaaaataattagagaaaatgtaacgactataccggttattgccaatggggactgcttcactttgacagatttccaaaaaattgtcgactacacaggtgtagacggtgttatgtctgcgcgaggggtgttggctaatcctgctctatttactggtttggataaaaccccctggagtgctgttgagatgtttttgcatttggtgacagcatatggtttgccgtacaaacttgcacaataccatttagccaaattaatggaagacgttataccgagaaaatatgtgaaagcaataaatgagaaaaagaatatggtcgacataatagattacttggatgaacattttgatctaaaacgaaaaggcgataaaggctttgcaaccagaatagaaccgccttggaaaatcgagttaaaagtataa

SEQ ID NO: 2503 - DNA, 834 bp, Candida albicans
tcctctacgcgtggtggacacaacatgatgatagcaacaagaagacaaagtttacaattaacgaaaagatacatttcaaatcatgccaccaaaaacaagagatttatacagaccattccaatatctaccaatactgggtccaattcattcttatcaaaattacatcaatctgaaagtaatgacgcaccaacatccaaatgggcaagacatacattaagtttccctaaaaccgaaacatcaaacactactccacaaccgccagttagaaaatcaagaacatcacgttttgctaataaatcacaattagctaacgaaaccaaaccattcaactcttccataactccaacaccacaatcaaatataattgaaataacatcagaccctgaaattcaaaaagcatccaataaaataactacatcaaccgcatcagtgccgaccgacagtaacaaatctcaatccacagctgctccatcagtgacgcctaaaaagaaaagagtattaagaccaagaaaagctttgattacattaacatctagcgcggtacaacatctccaaggattattagatcaacctgatccaaaattgattcgtataggagtgagaaacagaggatgttcaggattgacttataatcttgaatacgttgataaaccaggtaaatttgatgaattggtggaacaagatggagtcaaagtattaatagattcaaaagcattattttcaattgttggttcggaaatggattggttggatgataaattaagttcgagatttatatttaaaaatccaaattcaaaaggaacttgtggatgtggtgaatcattcatggtataa

SEQ ID NO: 2504 - DNA, 861 bp, Candida albicans
acactccgtacgaatcctccctcctccctccctccttccccgcccatagacatgactaaatcaacggaagcaactttaattaataatttacgacattatattgctcaaaattatcatcattcatcattatcaatatggcataaattacctatatcacgacgttcagccgttttcattctattatttatgggtaatttaggtgaattacgagttttattaacgaaaagatcatctaaactacgtaatttcccgggtcatgtggcattacctggaggtaaagctgatagtggattagaactggaatggcaagtttcccgacgagaaatgcatgaagaaattggattaagtgataatgatgaagatttaaaaaatttaggaatatcaattgaacatttaactcaattaccaagttatttatcaagaactttttcatgtgttaaaccatgtgttggatttatgcataatttgaatggaactgataatgatattgcttcaaaattaaatattgttttgaatccaggtgaaagttcaagtgttttttcatgtcctctaaaagattttttacatcctactattgatatcccagctttagaagcattagaaagaacttcttataaagtaaaatggggtggtattccttgggatttacgttcttatacttttttacaaaataatattaatgaactagaatggttcaaaaatattaaagatttactggcatcagaagaagaatccgaattagatttaaaattgggtgatgaattagattcccgtgataaagcaagtgtaactccacccaattgttactccctacaagatcctttaagtcctgctgctgctgccacaactattaccaattaa

SEQ ID NO: 2505 - DNA, 1200 bp, Candida albicans
aaattgaaaatcctacaccactttcacttctcatcaaacactagatacttacttctaccaactatgtcaacgtcagcgtcatcttcatatttagatgatgaaacaacttgggactcgtttaatttagatccacgtttattacaggctattgatcaattggggttttctaatcccacgttgattcaaagtagtgccatcccattggcattagaagaaaaaagagatattatcgctaaagcctctaccggttcaggtaaaactgccgcctattgtattccaatagtgaataatttgttaaccgatgactctgctcaaggcataaaaagtatcatattagtaccaactagagagttgtctaatcaggttttccaatttgttgaaaaattattgacatttagtactaacaagattaacgtcttgaacttgtcctccagttatagtgaccaagttttaaattcgttgttagttaataaaccagaaataattatttccacgccagcaaaattgattcaaattctagagaaaaatgaaaagaatattgacttgagtacagtgaaaaacttgactattgatgaagttgatttggtgttatcgtttggatatttggatgatttgaagaaattggagagttatttaccagtgaaaaagaatttgcaaacatttttaatgtcagctactgtgaatgatgatttagatgatttgaagcaaagatactgtactaaaccagctatattgaaattaaatgaagactcagccaatcaaaataatttggttcaatattatgccaaaacaacagaatttgataagttcttattagcatatgtgattttcaaattgaatttgattaaaggtaaaaccattgcctttgtaaataacattgatagaggatacagattgaaattgtttttggaacaatttggaattagatgctgcattttgaatagtgagttgcccataaattcgagactacacattgttgaggagtttaataaaaatgtttaccacttgcttatagcaacagatgagacgaacgagttaaatgaagagcaagatgatgatgaagatggtgatgaagatactaaggataaaagcaacgctgacactacacccgaaaaaatcgaaaaagtcaaaattcaaacaagaacaaagaatatggtgtttcccgtggtgtggatttcagaaacgtcgcttgtgtgttga

SEQ ID NO: 2506 - DNA, 525 bp, Candida albicans
aaagctggtatggcactttcatttgtgttgccgttgtctgaatttggtaagcataaaacagcatctttagcaagtgcaaagaaagatgaaaaggtcttgggccgtatagtcaaacaacaatccaaaaacggatttgaaatcaaaccttaccaatttgatatgaaacaagttgaagggttccgttatcgtgctgacgatgcattcagagctgtaacccaaactgctgtgagagaggccagagttaaagaattgaaaaatgagttgatcaattcggaaaagttgaagagattctttgaagaaaacccgcaagatttggcaagtttgagacatgataaagagttgcacccagctagaatccaatcccaattgaaaaatgttccgcaatatcttttacctgaaagtgctcgacaggatgtaaaaaatattggatttgtccctttccataaaaacaagatacataagcatataaagggtaagggtaaaggtaggaaaaaagttgatccactaaaatcatttagaaagtag

SEQ ID NO: 2507 - DNA, 1158 bp, Candida albicans
cagggccaaaaaaaaaatttgatagtttttgaaaaaaaaaaatatgaagacaatcaaatcgataaaccgcaaacacaatactaccaaactagccgtccgctgaatatttcatacattatggccaaaggaaagaataaaactaacgacgaaagatcttccaaatcccgtacatcaaatggccacaagtcaaaacagcatcatatacgtaaaggaagacaagagatttcggcgtcatcaaccacgtctaaaccgtcaacttcctttcctgctaaattagcaatgtgggattttgatcattgtgaccccaaaagatgtagtggtaagaaattagaacgattagggttgatcaagaatcttagagttggacaaaagttccagggaatagtcgtcagtcctaatggtaaatctatcgtatgccctaatgataaagagattgtcgaaaccaatggggctgcagttgtcgaatgttcatgggcaagactagatgaaatcccattcaataagataggtggaaaaaacgaaagattattaccttatttagtggcagcaaatcctgttaactatggtcgtccgtggagattaaactgtgtcgaggctttagctgcatgttttgcaatagtgggacatacagattgggcggaattattattactgaatttctcttggggtttgacgttcctaaaaatcaatgaagagttgatagagttgtatcagcagtgtaccgactcggagagtattaccaaggcacaggagcagtggttagaaaaaatagaacaggaggccaaagaaagaaagaaccaagcacataacgaagatgtgtggatgatggggaatgtcaacagacaagaagataatactgagcatgacagtgatagtaacgaggaagacgcagttgatagtgaaagtgatatagaatacgacaatttgggtaatataatacaaaaaaagaaatatgattcacttggcaacgagatgatagaaagcaaagtcaagtacgactcgttggggaatatcatttcaggcgaagaaagatctagcgaggaagacaacgacgaagtcagtaccaataaggaagacaacaatactgtctacgacaatttaggaaatgttgtcacaaacgagagcatcaccaaacacatgaattctttgagtatataa

SEQ ID NO: 2508 - DNA, 2331 bp, Candida albicans
  unsure (1064): Identity of nucleotide sequences at the above locations are unknown.
tacactaagaagttttggccatcttttttgtactattttacacgacacatctcaaatttgaaaaaaatacagaaaacattttttttttttttccacatttttctccatatattgaaccaagtgtatttctctgaacatacacaaataattaacacagaagtaatgggatttggacaaattttactttttgcatgctcaatactatacttgagtaccggtggaagatggacggttgtagcacttgtatttgttttatatattttatacaacaaagatcaacaacaacaacaacaaccaccacaaccacaacaacaacaacaacaacaacaacaacaacaacaacaacaacaacaacaacaacaacaacaacttaaaccatctgttcctccactagcaaaaccaaagaaagaatcacctatttatgcggttgattttactttcagttcaaaagcattcactccatcaactacgacaacttttcctatacgaagagtgatagctcctcgaccaaaaagatcacctaaaattttcacagcatcaaaacctattgttcagcaacaacaacaacaacaacaacgtcagccagtattgacgaaaaccaccgtcgaattgaaaaaatgtcaaatatatattttttataccaccttaactggatcatcacaaagaatagctaaatccttatatgaaaaattacagaatcttgaaaaccttgaacttgaacctaaattattaagtcttgatgatgatgttgatgatttagaagaatatttcttaaacgcaccaacccaaaatgataataattgtatttatttattggtattaccatcatatgaaaccgattcacccattgattattttttagaacatttaatcgatactgctcaagatttccgtattgataaatatccattaaggaaattaattggatttagtgtattaggtcttggagattctgaatcttgttctcatgataataaattttgttatcaagcgaaattagctgataaatggttaggtaaattgggtgcaagaagattatatcccttgggtgaaatatgtatganatatgagggggaaccaaaagctcaagaatggatacaaaattttgcttcattgatagttaataatgataatgaaccattttatattgatgacaataataatgatgatgatatagatgatagtgatgccgaggaaagtgaggggagtgatgatgctgatactttggttgatgtggaagatatgggagatattattcgtaaatcagggaaagctactactattggtggtggtggtatagaaactaaagaaatggtagctaaagattctccaacttttaaatcattaacaaaacaaggatatactatagttggatcacattctggagttaaaatatgtcgttggactaaaagtgcccttagaggaagaggatcatgttataaatttgccttttatggtattaaatctcatttatgtatggaaactactccatctttggcatgctctaataaatgtgttttttgttggagacatggtaccaaccccgtggctaaactgaattggagatgggaagttgatccaccagaaaaagtcatggcgggtgccttggaaggtcattatcaaaaaattaaacaattaagaggtgtaccaggaattcaaatggatagatttgaagaagcttttaaagttcgtcattgtgctttatctttggttggtgaaccgattttttatccttatattaatgaatttgttgggatgttacatgaacaacatatttcatcatttttagtatgtaatgctcaacatccagattcattagcaaaattgactaaagttacacaattatatgttagtattgatgctccaactaaaaaagatttgaaaaaagttgatcgtcctttaaatagtgatttttgggaaagattaatgtcatgtttagatatattacgtactattcaatctcatcaacgtacagttttccgattaactttagttaaaggatttaatatggaagatattgaaagttatgctgatatggtagaaagagctaaaccatcacaaattgaaattaagggggcaacattttgtggatcttcaaatgggaatggtaatccattaacaatgcaaaacattccattttatgaagaatgtaaaaattttgttgaaaatttaaataaagaattacaatcaagaggtttagattatgatattgctgctgaacatgctcattcatgttgtatattagttgctgataaaaaattcatgattaatggtaaatggcatactcatattgaatatccaaaattttttgaattacttgaaagtgggtaa

SEQ ID NO: 2509 - DNA, 600 bp, Candida albicans
ttcaatactttcataaaaactcacatactaccttgtatgagacggattatggcacccattgaacagaaaagaaacttggctggcaattactccatacctgactctttaaataaggagctacagaaggagtttgcagaagatgtatctactccaatggataaattacaagatgacatcattaatcaaaacaactacaacaagaaacgatttcagaggtctattgtgttggacttggacgagcaaaaaagttataaacaaatcatgaatgaaagaaacttggaaagggaggaactccgagtagaaaagcttattaaagagaaagacgatggaacaactcaaaccgttgaaaacccccaagagaggttactaccccgtaaaagaaagaaaagatgggacatgacaccagaagaatacaagaagcaaaaagagtgtgaaaacaataaagaattggtcaaaaaatctacatcctcacttattgcagaattggtagagggaaaagttcctgtagtaagagggattccattaacagactcgatattagaaaagatcttgccacctggatatttcttcacacacgggcgctggaaggatccgaactaa

SEQ ID NO: 2510 - DNA, 1074 bp, Candida albicans
  unsure (580): Identity of nucleotide sequences at the above locations are unknown.
ccgcggacgcggatgacgcggaccttcgagcccgtggccaagatgcctcgtccgttatcatcatcaaatgatattaaaatcattcatatgaaaagagttgctgcaccaccaagacgaattgaaagtggctcggtaccaattaaaaatatcaccaacagcaataacaataatgacaacaacggcagaggcaataacaattcacagcaggaaaaactaggccgagcaacatctttaaaaagatcaataagtaaaatcgttaaacgaagcttgtcaactaacgatgcaaacaacaaggagagagaagaaattccgaatcagagtccagcagttaagttagaaacaaatacccctaagcatcaaccacaaagacatcaatcattacaagagcatttgagaaatcagcagctgatgaaaactcctaagcgagaagacttgatgctgtcgaagccgcctaatacacaacgtccgttacctcaaccaagtattaaaccaacaattgctcgatatcgatcagtcaatggtaaaaaggcatccattaaaaaagttgacaattcagctattcaatatcagttggattgtntaatgcagtttcgtaaacgattatttcaaattggtcctcaattattggattttttgaacttacaattaaattattgtaaatcatgggaatcgttaattgacgaacagcagcaacaacaaaatagaaatacctttgcaactaatgacccatatatcaaatcgatttatcaatctttccatgaaaaattgttgaatcaaattgaattcactaaactgacaattattttacatattgctgataggttgattattcccatcgatgagtgtcttaaactatgtgatcaaggtaaaggtgatccaattaatgttaataaatttatggaattaattgttgctcaatataacaaattgtatagacaatggttggaaggaataattggacccaatagtattaaggaataccaagatttatgtaacaaaattggtaaacccaatggagaagatatcattcagtattataatcagttgactaggttgaaaagtttggttatgtga

SEQ ID NO: 2511 - DNA, 1053 bp, Candida albicans
aacacaagcctaattcaagataatatgagaattccattgattaaccgaaactcaattgaaggctgtaaggattacaagcctccatcatcttttccaattggtccatttaaaaaatggcatcataatccaataatgaaaccagatccaaatgttgaatgggaaagtagttatttatataatgctactgcgatcgtgatagatgataaagttttcatgttatatagagcccaaaataaggacaaactttcttctgttggtattgcatggtccgaagatggtattaattttgttaaacataaaaagccggtcatcaccgctactgaatcgtatgaacaaggaggtgggtgtgaggatccccggattgtaagagatcccgtgtccaaattatttgtggtcacctacacatcttatgatcgaatcactgcaagattatgtgttgcgacgctggaagatttgtttcattggaccaaacatggacctattgtcccgccatattggcaagatatcgccgttgccagtaatggaacaaatatgattagaaacaactggctgaaatcaggggctatattcactgaaaaggcacctgatgggaaatactatatgatttggggagattcagaattacaccttgcagaatcagtcgatttagtgaactggaatcttacaaataattctgccaattggaatacctgggcaaaggcaattttcactcgtgaaaataaacttcttgaaagtggtcctgcaccagtgaaaatggccgggaatgccaatcaatggatatttgtttataatgcggctaccacaggtggtggtgaccttccaaaaaatgcctacaccgtcaatcaaatgttgattgattataatgatattcgtaaaggaccagttgcaagattagaacaacctgttttgaaaccagagctggcaaatgaaagagaaggtcaagtaaaccaagtggttttctgtgaaggtttggtccaatttaaaggtcaatggtttttgtatttcggtcaaggtgactctgagttgggggttgctattgccccagtaaattga

SEQ ID NO: 2512 - DNA, 1710 bp, Candida albicans
caaaccatctacattatgggtaagaagaaacaggagatgtctcaagtgtacaatggatccaaaaacgagtttatatttggcgagcaaggaggaaaaggaagaaatctatcttcgtttttaaggaatttatcgttaacaggatcttcttcgagtgtcgattcccatagagattcatacgaagaagtaaacagtaatatatatgggagtcttagttatagcaagaacaacagatcttctggcaatttaaactcaggatcaatttttcaacctcgaccagcatcaagtgggaacaggacagtttctcttggacacattggcagacatcaatcacccaagagtcagcatcgcaggtcccattcaaatacacgttatgctgatttggacgatgactgggacgcaggacttgatgaagtcgtcgtcaagcctaacccgccaccgatgttagattctttgtaccccgatttgacagttcaacttccgctgcaagtgccagagaaaagccaacacaaggagtccatggatgatatagatttagaggccaaagcagagataagcaagcttaaccagctcaatagcaaatatgccaagttcaggaagatccttgcgtctgacaccattataaacttgcaggatttgagaaagctagcatggaatgggataccaaatgagttgcgagcattgtcttggctattgctacttggatatcttcctacaaataagtctcgccaaagctccactttgaaaaggaaacgacaggagtacttggatggattgggtagtgttacaatagagtttcatgaggatccgccagacaacaattcaaatgtgtctttatccaatgttaaccgagataagcaattgtaccaccaaataaaaatagatgtgaaacgaacaaacccaacaataaagctttattcttatccggcaactcaagtatcactacgcaaaatattatatttgtgggcagtgcgacatccagccagtgggtatgtccaagggataaacgatttgtctaccccattttatcagatattcttgaataattacatttggcagctacaaagaaagaaacaaggtgaagtcgaggacgaggatttgtttattcctggatacatggctggcactgatgaggaagacccagaagagcagaagttgctcaacgatccccaattgatgcaatacagtttggagaattttaatactgaatggctctctgcgagagtcatgtctattatcgaggcagatacgtactggtgtttgtcaaggttgttagagaatataacagataactatattcaccaacaacctggtattataagacaagttaatgaattgaaaaacttgatttccaaaattgatgtggagctattgaatcattttgagcgagaaggtattgagtttattcagttttcgttcagatggatgaattgtttgttaatgcgtgagttaccgatgcaactcattattagaatgtgggacacttatcttagtgaaactccgttgggatttaatacgtttcatacttatgtttgtgctgctttcttgattaaattcagtagtgaattgaaggaaaaggatttccaggagattatactatttcttcagaatcctcctacaagtagttggacagagaaggatgtcgagttgatgttgagtgaagcttacatttggcaaagtttatacaaaaacgcatctgctcatttgagatga

SEQ ID NO: 2513 - DNA, 630 bp, Candida albicans
ctcccacgttactatgtcctgccgcggcgtgttgaaaacgacattgagaaggccatagtgcaacataagcttaaaatgagatttgatagtgatttattaaattggactaattatgttaaattgtttgatctgcaaaatagtcaagtgttaaataacgatgaacctgttgcaatcaatattttgccagaggaaaatttatcggataatgagatttctgacaacaatgggagagagacgatgaatgaaaatactaattctgatgctgatgaaaatttggtgatagacaaccaacttgaagtagaacctaccgaaaacatcccaaaagaggacaacaaagaacctgatgattacgaattgacacaacttcatcaattcgatgaatctttaatgagaaatttgacacaaattcaagctacaaaaactgcaaatttcttgggtgtagaagatttgtcttatcttgatgacttttcatttacatcttcgcaaagccaatctgatttcaagaattttcaaataacagataacacatatgaagttcccattcctgaccaattgaaaccggaaaacattgatcagactttcccagctggcagggttgctaaaggtgaattattcagatccattctatga

SEQ ID NO: 2514 - DNA, 744 bp, Candida albicans
accatgcaatcactgttgttattgttgctcattgtcagtattgcgtctatggagagcaccccaattgaaggtgtttcttatcaagatgattcaactttacttgcaccacaatttttttattttgataatttgcaaactttgcaaccaaaattatcgcaaatttttgcaacgtcaattccaacacagattattcaattattagacacaacccattatttaatccccgacgataatgaatcgagctccgaaaaccactttaacaatactatcccattgaattggattgagttttatacagaaaatgtcagttatgaaatgaatcgccaagcagagattattgttatgactcatgaaaccgtagacaacaaatacgctcatggagatttagcttatacttggtcaatgcttaagaagcttgctgtagaatacaatatggcattgtctttatatgctggattttattatatggttggattattaactggagctcgtatatcaccagagtttgatattacgtcaagtttatcaataatgtatgcctgtccggtagccaatggtaaaactgttcaactaaaagtgtatcccacattagcaaaattaactccatactatcgtaaactcaaatggaattcaaaattacaaaaattcattgttaagaataaattcaccaaacataagaagatcaaattattggcattaactggattggaagatgttgaatgtgcatatgttcacaatgaatga

SEQ ID NO: 2515 - DNA, 414 bp, Candida albicans
attttttttcacaactttgaaccatcaattaacttcccgatgtcttcaacaaatagtatctatgatccaattaaatttgtcaagttggactttacagaatttgacaatatatgttcaataatatccaatatgtgtcactcagtcaacacttggctacaagttaacgacatagaagttgttacctacctacatatctgtttggaagcgtatatcgtcatcaatcaacagaacctacgaaatcgtgctggtagatacgacccagcaatagattttttaccatcacttgttcatattttcaaattgccaacatattttaaaagcgtgatacgagaaatggctcggccaatgtatgatcaaaatggaacgacatatataccagatatacagtcagctggccaccacggagagggagtg

SEQ ID NO: 2516 - DNA, 1737 bp, Candida albicans
tactacgtgttcgtcacctttttaccatacccaaatacaatcttccataaaatgacaagcaacaagaagttgttgaagcatattcgcaccacaaatgcattatcttcgattccgccagtcttagatattttagacagaaatgacacttcgaaactaattgttaaatacacgtatgaaatacctgtggtgcttcttcgtatttctgatttaggaagtgcccaaggaataatagtattcactgactttagtgaaatcaaaacaaatacttgtatgaaatatggtcgagtaccatattcaatagctaaggaggactatagcgttggtggtgttataattcctaaagacaggttattcaattcgtcaatcagacgtgatcaatatgatacattggctaaaatgatagagaggtccgtgcagggggacccggaagacgatgggtttcttatagcaaagctcaattttgatttgaaaataaaaaactgcaagtatttagaaggatacttcaatcacgccgaaattgcaacaaagaagaatctacatgatttgtttgaaaaggacttgcaatatgagtttctggaaatgttgcgtagaatgaaagggttttgcgaacctgatgtttataacgaacttcgagtcaagtatgacttttcttcattcgagatttttcgtaagaataggaatcgaggtgatattgaattggacagtcaattacctgatcaaaaacgtcgtaactttggtggtggaattgcagctaatatgttgtcaaacaagattgtaaaagatagccaaagaatgaattttgatacacaagcaacccaaatccataaaacagactttttacaagggcccatcatagaagaagaggttagcaatcaaccattaaatttagattcccaactacccacagtgacaaatgctgtgccacctgatccaacggactcttatgtttccaatgctttcgaagcactcaataacaccagtagtcgtcaaacagggtctaatctattgtttcatcgccctgtgtctacaaggtcttccacaacaaatcagaacacgagtaatgagggtaaaagcaagggcatttcgcaaatggtcatcccttgcactcctattcaaagctcaaatgaaaccaatttagaagcaccaagttttgcctctgttgatacagcggccatgagtcaggatttgggatcccaactggaaatggtagagccgaaaattgaaccaagtaatggcctcaatttaacaagtataacagttctacctgattgggataatgtaactaagaagtatttggacagacatgaaaatgctaagatcagaatcaagagcatatatgcagctcgaaacaaaatgaaatcttttcaagagaatgttccttatactttggaaaaaatcaaagtcaaagggatgtttccttttcatccaattatcatcaaaccctatgcacgaacatggaaaatagctccattcaaaattattgccgaagatgttgaagacaaaaatttaacattggcaattgaaattagtaacgacgacgaaatctgcaaatttttcaatataaatgaaattgaggatgtcgttcgaaaaggacaaagaatcaaggctcaattgcaacggttactaaaccagaagaaggaggtatcgctaaatatcaaaaggaaaatcaggacacttcccaacaactttaagtatacttattggaccattgactctccaattaaccaaattatatag

SEQ ID NO: 2517 - DNA, 3786 bp, Candida albicans
taccccagccagggtttccagcagaaaggggaaaaattgcatgtggcacatagacgttctccatccgaattaaccaacttgatggttgagcaatataacttgcaacgtcaattggaagaagtgcaagctcaacagaaacttttggaagagaagcaaaaacagcaacaacaacaattcacatacccttcagctcaagggagttcagagttagctccacctccaatatcatctgggtatggaggtaataggtcatcccactccagatcatcgtcaatcaatacccatagacgtactggatctgggtctggaggaactgctcatgggcattcaagaagacactctttggggttgaatgaagccatcaaggcagcagcaaatcaaaagcaaagcaacagaaacagcttaagcccaacaattccaaatgaagccaagactgacctgtctgacgacattgggtcttttaagtttccaccatccggtggggaccaaggagatacctctggtcaatcatcatcatcacacaatcgttcaagatcattagcatatgggcaacaatctttcaagttcccaccaacaccagatcaatcaaacgataccagaggtaatagtttgttacctccaaacccaaattttagtgttactcagtcacccgatcgtggccataatcgcagatcatctcatttccggacaggatctcgtggtagtggaagcaacaccaatactgatgggataaactccaactggagagcccaacagcaatctccacagcaacaacaaagacagggtggtttattggaaccacctcaagtcgggttcacccctggccataaaccacgcaatagctcatatggtggtggttcttctgtgtcctcattacaacagtttcttccaaataatggtggatcaaacaattctggccaacaaggtggccaccaaggaggaggtaataacggaagaaaaaccctttttgctccttacttgccacaatcttctttgcccgaattaattaatgaaggacgcttggttactggtactttgagagttaacaaaaagaatagatccgatgcatatgtttctactgatggtttgctcgatgccgacatttttatttgtggctcaaaggatcgtaatcgtgctttggaaggtgatttagttgccgttgaattgttgatagtcgatgaagtgtgggagtccaagaaggaaaaagaagagaagaaaagaagaaaggacaacactttgcattcaagaccattaacagatgatatacacaatgatgcaacttctgcaccaaacacagctgaaggatcagtaactggcacttcaaaagaagatggcgctggctctaacgaggaggaaactggtgggcttgccagaagaggttccttgaaacaaagaccaaccatgaagaaaaatgatgatgttgaggttgaaggtcaatcattgttgttggttgaagaagaggaaattaatgatgagattaaacctctctatgccggacatgttgtagctgttgtcgatagaatccctggccagttgtttgctggtactttgggtcttttaagaccagcacaagcagcacaagcagcaagagataagaaaaatggtaaggagtataccgttcaaaaccctaaagctccaaagattgtttggttcaaaccaactgataagaaagtacctttgattgcgattccaactgaacaggcaccaaaggattttgttgaaaaccacgaaaagtatgctgatcgattatttgtagcatccatcaagagatggccaatcacttcattacatccctttggtacgttggtaagcaacttaggaccaattgattccccagaaactgaaattgattctattttgagggacaacaactttttatgtgacgaatatcctgatgacgataatgacgacattgtgtctgttaatgcttacgatttaccttcgattgaacccgagtttgagaacacgcaaagagaggaatatttgaatgactatattattgcatttactcagaatggcgagtttgttgaccatgccttgcacgttaaaagaatctcaaataccaaaattgaattggggttccatgttgccgatattgcctattttattaaaccagggtcttcattagatcgtaaatcaaagaaaagatcatcttctgttttcctccctcaaaaaacagtcaacttgtttccaaaacaagttaacaaaatcgtctctttcaaggaaaatgagaaaaacttagctgtttcagttgtttttgaaattgatactagtaattttgaagtcgaagatttgtacatccatgaatctgtaattgttcctaaacagttggttacttacgatgcatttgatactattttactgggtcaatccgttgatagcatttcttcagcaacttcagattatgtaaagacttttagcttgattgcaaaagagttccgtcgccaccgtttatcaaaccgctcactcggaatcacccctaacttgacattgttagaccaattggatgacgaaaaagttcgattagatttgaacatattcaaggattctttagcatttgatgtgatttcagaaatctcacacaaagtgaattctgcaattgctgcaaaagttcatgctggcttgggagatcaagcaattttgcgtcgtcatccattgcctacattacaaaaaatggaaacatttgtaaggaaagcaactagtttgggattcaagattgacaccacaacttcgtctactttgcaaaactctatcttgaaaattgatgatccagttaaaagaaaatgtgttgaaactttgctttacaaatgtatgtcgaggggtagatattatgttgcaggaaagcaagatactgatagttatgcccattattatttcaacttacctttatacacgcatttcacagcaccattgagacgttatgccgatttaattgttcatagacaattaaaagctgtcttgaacaaacaagttgaagataaagatttggactcattgaaggctatcacggattattgtaacttcaagaaggattgtgctgctaatgcccaagagcaagctatacacttgttgttatcccaaacaatcaatgaaatgagtgaaaccgctggtcaattgttgtgcatgggaacagtagtccaagtgtacgagtcatcgtttgatgtatttattccagagtttggagttgaaaaaagagtccatggtgaccagttgcctttggtcaaagctgaatttgacaaaaatgaaagaatcttggaactttggtgggaaaagggtgttgattctgctacatatatcccccctgacgaaaaatcatcattatcgtacagaaactccattaagaataaatacagaacttctgctttacaagcagccaagatccaaagcaaaacagctttggaaaagtctaccactccagcggattcagttgcagagaaattagctaagttgaatttggaacctcccaagttggtagtaccatccttgaaaagtaatgaattgcatgaagtggaaaaagatgaaacaaaatcaatgccttcatccccaactcaatctgaaattcctaagaatgtcagaactaattcatcatctcgtatttcttctagtggcaacacttttagcttggaaccttatttgcaaaataccatcactagaattgagggtgattcatacattcaagtgatcaaggaattgacacaagttcctgttttgttaagagctgaaattggtatggctttgccatgtttgacagtaagagttttgaacccatttgctgaagaacagtaa

SEQ ID NO: 2518 - DNA, 942 bp, Candida albicans
atatattggcatggttaccatatgggattattcatttcagttttcccatttgtacttgctgctattatatttttatttgggccaccgacggcattaagatcatttgggtttgcctttggttatatgaacttgcttggagtcttgattcaaatggcattcccagctgctcctccatggtacaaaaacttgcacggattagaaccagctaattattcaatgcacgggtctcctggtggacttggaaggatagataaattgttaggtgttgatatgtataccaccggattttccaattcatcaatcatttttggggcattcccatcgttacattcaggatgttgtatcatggaagtgttatttttgtgttggttgtttccacgattcaagtttgtgtgggttacatacgcatcttggctttggtggagcacgatgtatttgactcatcactactttgtcgatttgattggtggagccatgttatctttgactgtttttgaattcaccaaatataaatatttgccaaaaaacaaagaaggccttttctgtcgttggtcatacactgaaattgaaaaaatcgatatccaagaaattgaccctttatcatacaattatatccctatcaacagcaatgataatgaaagcagattgtatacgagagtgtaccaagagtctcaggttagtcccccactgagagctgaaacacctgaagcatttgagatgtcaaatttttctaggtccagacaaagctcaaagactcaggttccattgagtaatcttactaacaatgatcaagtgcctggaattaacgaagaggatgaagaagaagaaggcgatgaaatttcgtcgagtactccttcggtgtttgaagacgaaccacagggtagcacatatgctgcatcctcagctacatcagtagatgatttggattccaaaagaaattag

SEQ ID NO: 2519 - DNA, 621 bp, Candida albicans
atccggcggttgaagactgaggaacaacaagcacagcaacagcaacaaaccccactttatggtcaacaggggtccccgcaagttcaaactcaaccgcagtttcaagcagactattcgtatgccaattaccaacctcaagctcaattttacgacccatatcaaagacaagtaattatgcaacaagccaattttgcttcaccatcgcaatatccaattcagcagccatattcatttgccaatggtatgaccaacatggcccaattccacccacagacgttgacatcgcattccgactttgatcaacaacaaatgcagcaatcaacccagccatcgcagcaagtacaagtacaggtgcagatacaaccacaatcaaatctgaacctgttccctgctgagcagaaacgtggaagaaggtttagaaggagattcaatcaaattgagagaaaatatccttgttcgtttcctggatgtcaaaagagttatggttctttgaatcatttaaacacccatatgttaaccaaaaagcgtgtcaacagaaaatcaaaagctgatttccaacattctcttcattcagaaagaggaaaacaaaccatcagaaatttcacaatacgttcaccgtag

SEQ ID NO: 2520 - DNA, 1212 bp, Candida albicans
aaccaagtagaattgaaacaccagctcataatgcacggcacaaatgatgcagaattgcattctatagttcagaatttacagaagaatttaggttctatcaatttgccaatacgtcaatctcccaatactgatatgaatgctacttccattgacacgagagcttccacaccttcaacaatcaatttaccagaacaggagaaaacaccatctccagttcaacatttaaggcaagccacaccttcagaatctactgtacaatcaaatagtccaaaaacctccactttgatagataatacgccactggctataaatccagtgatacaaactagtttatcaccaatcaaacgatgcagacattgtaaacaaccaaaaccaagtgatatgcctctcgagtgctcatcttactcaacatgtccacgatgtattattaagagtagattgcaaaaaaataacttgcaaaatttatccaagtttatgaaattatatggattttatcaaatgacccaagaatatgataaacatgaaaaattaattaaacttgcaatggaacaagattcttacttggcagatctcggttcacgaaaatttgattatccgacggagttagagaaattgagagcagttgtaagcagccaaattcaaccacctgaatcacaacagagtgcgaatataaatttcaattcacccgtcagttcgcccgtcaattcgccagtcatctcagcaaccacttcgaatagacgaggttcgacagatttagaggatgttgaaactaataatggaattatgatactggctgatagaccacaacggagagaagaaactccccaacaggaagattcttccaatatagtaaactcacctcattcagaaaattcacccattcaggaagacattgtgaaccaagagaatgcatctattcaagaagattcgtatcaccaaaatgaaaaccaaagcgaccagcataatggtactgataagaatacctcttcaaacgagaatatcgatattgttgacgaagtcgtaaatactgtggaaaaacatgccgaaggtgatataaagatagaaaaaaatgcttatgaaaatgatactggtcatagtaatgagaacaaccctgagataagtgacgagcaagaagagagtggcaatataatagggggtagtaataacaatgagaatgttgatatgaatatagatattgataccaacgacaat

SEQ ID NO: 2521 - DNA, 3183 bp, Candida albicans
atcgcgggaccttccaggccctgtggtggaagaaaatcatcttcaccatcatcttattctccaattaaatctgatctacctaatatttatagtcatctacgatctaatgatagtgaatcgccgccacaaccatcgccgaaacaacaatcttctttatcatcatcatcatcatcatcgtcatcttcaaatactaaatcttccacaactaagaatatttttaaaaaattattacgaattaataaatcatcagataatattgatgaatcaagatcaattgtactgaataatggtggttctccaatgagtgatagtactactgtgacatcaactttgtcaactgataccgctcctaaacgagggaaatcaattcaacgaagtcaaattttacaccatactgattcagattctttatatttagaaaatcaaattgaattacgtccagaaatttctaaatctattggtaatattaaaatcccgagtattttcactaatgatggtatgccattattaaaaatatctcataaatcaaagaaaagaattttattttggattgacccttcatgtttcaaattttcttggagaatggctaattcaacaaccaccaccacgtcagccaccacatcggccacaacttctggattaccccaaggaattactaatactaccgcattatctaattcagcaatcatatccacaccagcaatagcaacatcagctattcatcgattatcaataaccaacagaacgactcatgaatttgttcttgatgatattaaatcaatatatatacaaaatgaaggtagtggatatcgtgaagaattaaatatatctcaaaaacttgaaaaaaattggatcatcattatatatcttaatcataaaaaaaatagtctaaaatcattacatttaatcactgataatgatcatgattttaaaaaattgattctggcaatttataatttaaaacaattacgttcacaattggcaaaagaatttttaattgatttgaatgaattacatgaaaattatgttaatatgttattaaataaagaattactagctggtgataatggtaatgttgatggcaatgaagtcgatattcagaaatctcataaacatgttagagagtttcttagttttaatgatattttaaaatattccaaacgattaaatattaatgttaataccaatcatttacaacaaattttcgatcaagtactactactactgtcagcaacaacagaaaagcctgttagcacccccttgtttgaaaaggggttaaattttgaacaatttaaacaatttgtttcaatacttaaagatcggaaagatttacaagaaatttgggattcattagctcaaggtaaagaagttttacaatttgatgaaattaaaaatttcattattaatattcaaaaagaaaatttcagtgatgatgatgataatagtactattaatttaatttttcaaaaatattgtagtaatgataatggatggaataaagaaagtttaaatgaatatttattatctagttattcaactccatatcgtgaaatcacccaaacccaaactaactattatgattatccattaaatgaatattttatttcatcatctcataatacttatttaactggtcgacaagttgctggtgattcatcagtagaagggtatatacgaacattacaacgtgggtgtcgatgtgttgaaattgatatttggaatggtgatagtaacaccaccaccaccaccgtcattggtacaaaagatgatgatgataagaatgaatatgaaccaatagttaatcatggaagaacgtttactaaaccaataagctttgctaatgttataagagcaattaaaaaatttgctttcattgtatcaccttggccattaatacttagtttggaaattcattgttcaccggaatgtcaaattaaagtagttaatattttaaaagatattcttggagaaaatatgattattgctcctattgatattgattcggtgatattaccatcaccagccgaattgaaacataaatttataattaaagtgaaaaagacaacttcatttcaaaatttaatagaaactgaaaatggtagtttcacaacaagtactactaccaccaccaccaccactactactactactactactgcaacttcattaagtgaagataatgaaaataataaatctaatagtagttctacatcatcattcattataagacgaaggaaaaataaatcaccaaaaatcatcaatgaattaagtaatcttggaatctatactcaagggataaaatttcgtaatttttcattaccagaatctaaaacctttaatcattgtttttcattaggtgaaaaatcaattaatcgaatgattaaagatgatgataaaaaaatttctttagataaacataatcgtcgttatttaatgagagtttatccactgggaacaagattaaaatcttcaaattttaatccattaccttattggtctcatggtgtacaaatggtagccaccaattggcaaacttatgatttaggtcaacaattgaatgaagcattatttgaaaataaaatatttcaaggatatgtattaaaaccaagtgtattaaggaaaccaactttaaaatcaagcagtagcaatgtcgatacaagaacgtcattaactactactaattctaaaactattcgatttaattttgaaattataagtggtcatcaattacccaaatttcctaaagatgattataaagatcaagccattaatccatatatatcatttgaaataattggtgctcaagatgttcaatgggataataatgacagctcaccaattgcaccaaccaccagttcttctccctttattagaacaacgaaaataattcgtgaaaatggatttaatccaaattttaatactaaatttagtggttcaatcatcactactactaatgatttaatatttataaaatttgttgtttatgcatcaacttctttaaattatcctgattatggggaaaatttccctattgctatattagtcactaaattaaattatttaaaacaaggttatagatatatttatctaaatgatttattaggtgaacaattggtttattgttcaatatttataaaaattgaatatgatgaagatttattaaatgagttcataaataaataa

SEQ ID NO: 2522 - DNA, 216 bp, Candida albicans
gtacttactatggacaaaataagggcagtaattagtggaggtgagaaacctcccgttgacactgacaacgatcacaacacagactttgaggctgacagaaaaatgccagatttggatattgtagtttccaaatcacaagaatttgacccagtcacctcccacttggttaatgatattatggaagatgaatatgctgctgtcgttttcaccgacggg

SEQ ID NO: 2523 - DNA, 2301 bp, Candida albicans
actaaaagtcccttccatgtaattattatttgtgatatcaaaacaatcacaatcataatgtccaaagaggctgaatttgttaaaacaatttccaaggaaggtgatccacaggtggatgttcttgaaagagacgctgagtctaattctgaaaatgctttagaacctgatgttgaagagctaccaaaggtggtcagagagattgttccattggaagatgatcctaccattccggtgcttactttccgctactttatactatcaataattttcatcatacctggggcatttattgatacgatgaattctttccgtacaacgtcagcagcatattcaattttttttgttcaaatcgcatcacattggtgtggcaaatggctagctagaattcttcctaaaaagcaagttggttttggaagattgtcgttcaatttaaacccggggccctggtctatcaaggaaacggctttgattacaatcaccgcaaatagtggtgcaacggggagcatgggtaccaatcctttggcgttggcagaacttttctatggtgaaactgtcaaccctgctgttgccattttcttcatgtggatgattgtgtttattggttactcatttgctggtattgccagaaatttcttattgtatgaccctcaattcacatggccacaagctttgatgcaaacaacattatttcaaacccaaagtaaaagtgacaaagatgccaagcaagcatcaaagcaaatgaaagtgtttttctttgtcttgattggtttatgtatatggcagtttttcccggaatatatattccccatgatttcttcgttggcttttctttgttgggttgcgccagaaaactatacagccaatttcattggatctggtcttggtggaatggggtttcttaatctttcccttgattggtcaaatatcacctcgagtattatgttgtatccgtactgggtgcaagtagtacaattcgctgcgtttgttcttggggcatggatattgatcccagctgccaaatggggggatctttcaagttatccttacgggttaatgtcaaacagtttgtttttaggtaacggtaccaagtacccaactaccgagttgctcacgccaaatttaagattgaacgaaacccgatacgaagaacttgggccagtgcatcttggtgcccaacgtgcttggaatatgtttttcgattatgctgcctatgttagtggattcatgtgggttgttgcttttggttataaaagcttgtcagggtcgctcaaaagattggtgaagtcaagaaaacaaaaggggtccataaatttgcaatacactgataggttgaataaacttcaagcagcctatgaagaagttccattgtattggtatgctattcttttcttatgtgcatttgtcactcttttagtgatatttgcaacggactcgttattcatgccgtggtggtgtcttcttgttggagttgcctttggtgctgtgattgttactcctttagtttggttgtatgctctatccaacttccagttgcccattggtaccttcaatgaattattatatggttatatgattcagaacaaaacgtcaagacatccagctggagctatggtgtatggtgcagttggtggggatttgttttacagagcccagtatattcttaatgatcaaaagattgcccattacatgcacatttctcaaagagcagtatttttctcgcagatatttggagaattaattggtgtacccatcaactatgccgccttaaggtgggtgatcctgtccaaaagagatttcttggatggcacaaaagtcgacaagcttcaccaatggactggccagaccattgtcagttacaacactaacgctgtgcagtatgtgattttgggaccagatagattattcaaaaactatccagtattgccatatggattcttgcttggtgctggtgctctactagtattatatcttcttcaccgattgtttcccaaatcgaaattgaagttccatttgtggaacaccactgtattcttttctactatgagtaccttctatggtaacctttcaacgggatatttttccagattcattggagggaccataacaatgttttgggcattcagatacaagcacagtttatggaaaaagtataattatttgttggcagctgctttggacactggccttaatttgagtatcttacttattttcttgttcttctcggcaggtaaaacagtcaatttccccgaatggtggggcaacaatggcaagagtgtggagagatgttttgccatgagttga

SEQ ID NO: 2524 - DNA, 1161 bp, Candida albicans
  unsure (140),(146),(162): Identity of nucleotide sequences at the above locations are unknown.
atatcaaaagtactcccccttgtttttatccaccacctttgccatttcttaatgggtttatcatttgcttccattctagccactataacacacaccatttgcttccatggacgtgaccttatcgcgtcgttgaaggccanagaaanaccagatgttcatatnagattaatgaaagcatacaaaccagtgcctgaatggtggtacataatggtcttcttggtctttttcggtatgtccatagccaccgtacgtgcttggcctactgaaatgccagtatgggggttagtttttgctcttatcatcgctatcatatttttattacccgttgctatcatttatgcaaaaacgaatattgctgttggtttgaacgttgtgacagagttcatcgtcggttatgtactccccgggcgtccaatagccatgatgctttttaaaacattcggatacatcactaataaccaagctgttacttttgtgcaggatatgaaacttgggcactacatgaaaatagatccgcgcactttgttttgggcgcagtttgctgctaccatatggggatcgttagttcagatcgcagttttggagtgggcctatggtgcaatcgacaatttgtgtgctgctgaccaaaaaaatcattacacatgtccaaacggtaaagttttcttcaatgcttcgatcatttggggtgtcattggaccccaacgtcaattctcacatgggcagatttattatgggttacttttctttttcatcattggtgctgtgacccctgtcatcaattggttgatcttgaaaaaatggccaaactctccagtcaagtatttgcattggccagtgttcttttctgggacagggtacattcctccagccactccatataactatacctcctactgtgctgtgggcttgttctttggatggtggattaaaaagaagtggttccactggtggtctaaatacaactattccttgtctgcgggcttggatattggtttggcatggtgctcgttgatcattttcttgtgcttgagtttaacaaacaccgacttcccatcgtggtggggaaacgatgtgatcaacaccactctcgacactcaggttgtcaccaatatcagacacatattgaaagagggagaggcatttgggccatcttcctggtaa

SEQ ID NO: 2525 - DNA, 2106 bp, Candida albicans
atcctcaaaagaatgacaagtatttatacatcatatttgaaaaaccatagacgtgcgccacctccaccaaatggggcagctggctctggctcaggttctagttctggttctggctcaggttctggttctggttcgggttctggcagtttgactaatattgttaccagttctaatagtcttggcgtaacagcaaatcaaaccaaacccattcaattaaatataaattctaccaaacgtcaatcaggttgggttcatgttaaagatgatggtattttcacatcatttagatggaacaaaaggtttatggtcattaatgataaaactttaaacttttataaacaagaaccatattctagtgatggtaattccaattctaatacccctgatttatcattcccactatatttaattaataatattaatttgaaaccaaactccgggtatagcaaaacttcacaatcatttgaaattgttcccaaaaacaataataaatcaattttgatttctgttaaaaccaataatgattatttggattggctagatgcattcaccacaaaatgtcctttagtacaaattggtgaaaataatagtggtgtatcaagtagtcaccctcatttacaaattcaacatttaaccaatggttctttaaacggcaattcatcttcatcaccaacatctggattatcatcttcttcagtgctaactggaggtaattctggcgtttctggtcctattaatttcactcataaagtacacgtgggatttgatcctgccagtggtaattttactggattaccagacacttggaaaagtttattacaacattcgaaaatcactaatgaggattggaaaaaagatcctgttgctgttattgaagttttagaattttattccgatataaatggaggtaattctgctgctggaactccaattggatcacccatgatcaattccaaaaccaacaataataataatgaccctaacaattactcatcagccaaaaacaatgtccaagaggcaaatttacaagaatgggtaaaacctccagcaaaatctactgtctcacaattcaaacctagtcgagctgcaccaaaaccaccaactccatatcatttgacacaactaaatggctcttcccaccaacatacatcatcatcaggctcattacctagttctggtaataataataataataacagcactaacaataataatactaaaaacgtttcaccattgaataatttgatgaataaatctgaacttattcctgctagaagagctccaccacctccaacaagtggcacatcttcagatacatattctaataagaatcatcaagatagatctggatatgaacaacaacgtcaacaacgtactgactcatcacaacaacaacaacaacaacaaaagcaacatcaatatcaacagaaatcccaacaacaacaacaacaaccacaacaaccattatctctgcatcaaggtgggacttcgcatattccgaaacaagtacctcctacattaccatcatctggaccacccactcaggctgcttcaggaaaatcaatgccatctaaaattcatcctgatcttaagattcaacaaggcacaaataattatattaagagtagcggtactgatgctaatcaagtcgatggtgatgctaaacaatttattaaaccatttaatttacaactgaaaaagagtcagcaacaattggcatcaaaacaaccgtcaccaccttcatctcaacaacagcaacaaaaacctatgacatcacatggattaatgggtacatcacattcagttactaaaccattgaatccagtcaatgatccaatcaaaccattaaatttgaaatcatctaaatccaaagaagcattaaatgaaactctgggggtgctgaaaacaccatcacctacagataaatcaaataaaccaactgcacctgctagtggtcctgcagtgaccaaaacagctaaacaactcaagaaggaacgagaaagattgaatgatttacaaatcattgctaaattgaaaacagtggttaataatcaagatcctaaaccattatttagaattgttgaaaaaagctggtccaagtgctaa

SEQ ID NO: 2526 - DNA, 483 bp, Candida albicans
  unsure (442): Identity of nucleotide sequences at the above locations are unknown.
ctattacgcaaatgctataatcaatcaagtatattctcccattcctccatatccacaaaaaaacaaccccatcactcatttttttttactttttgtcaaatgtcaagaatttataatgattcattcatatattgttctgagatccccattgatttaaatagaattgatactaatttcctatatccgctactggaactatatttttgtccaatatgccaatatcctaaagctccttatcaaacatcattcaaaattgattataaattttgtagtaattgtttgaccgattatacgaaaaataatgatttgaaattaaccaaatgtatcaagaattgttttatttgtcctgaatgtactatcctgaatttaaatattaaagtgtttgatcatgataataatggtaacgcatctgaattcaaatgttggtatggtcaatatattnttaaaaccacagtgatatataaaccccaaccgttattataa

SEQ ID NO: 2527 - DNA, 489 bp, Candida albicans
  unsure (34): Identity of nucleotide sequences at the above locations are unknown.
ttaattgcgggtctggccgctcccgtaggtgaanaccgaggagcgaaagccaatggtagtagtagtagtagtactacgaataatgatttatggcaattacaaatcattttatcggatggagtatgtgaagatcatgaaactatattaagaatggtaagaaaagctagagaagagaaaatcatgatggtatttgttattattgatggtattactaccaccaccaccaccacaacttccggtacttccggtactactactggtaaacatgaatcaattatggatatgcaacaagtgagttatgttactgatgataatactggtggaatggttttgaaagttgataaatatataaattctttcccatatgaattttatgttgtcgttaaaaatattcaaaaattaccagaaatgttggcattgatattaagacaatatttttcagaaatatcatcaatatacaggtcatgtgtgagagatttttttaattag

SEQ ID NO: 2528 - DNA, 648 bp, Candida albicans
acgtacatagtctcattaccattctacaaaccaaccatgaaattatttgaccaatttaaagatgcaatattggatgaacaaaaagaagatattgcattgaccacatcttatatcaataattaccctcccaaaaaactagcgcaacttggattgggaataatcaatttacaaattgtcaatattcgaacaggattaggtgggaagactatattagaactacagtttgattcagccttttctgatggagaaattaacacttcgacattacgcacgggggatatagtaaaattggctaaaatgacatcgtcagcattgagcaacaagtcagagaaaaagaagccatcaaagaatcacaaggaagagtcccaaacccaagaccagtcagatgttggtattgaagcagttgtaataaaagtttccacacaaacgatatcaatctctgtcgatgaatcaactgatgattccaaaattttacagtattacaataataccaatgatctggcaagaatgtggttggtcaaattaaccaattctataacatataaacgaatgattaccaccatggacaaagttcttgcaatgaaggaaagtgataaaaatgatattcacacgattcgttttcacttcggagtgcacgacccgcgctaa

SEQ ID NO: 2529 - DNA, 600 bp, Candida albicans
atatcccgtgttaatttgtacgtatcacctaaacttgtgcatttacgttgctttttaagttttcttgatgttgtactaaccgaattgttttacccagtatttgtcctctcacttatcggtgcctgttacttgggctttgcactgatccatttaccttacgataagctaattcacttttcaacattttgccttttaaccttggagtttttctttgtgtttgatacacagtacaagtctttaaaagtgttgagaaacatcacattaattatctgtacatttggcggaagtgtgggtctggaaataatacagaacctagtcaacccaaaaagagtatttgacgtttatgatatagtggccaatatcctagggagtcttttaggattggggattagtgttggttatgtcacttggagtaaaaacagggccagacataaaaggagtagttacagacaattaaacacacatatcattgaagcatcagaagatgacggcgaggaaagcacagaccagaactccctagatattcgagagagagctgatactcaatcatttacaaatgaagattacgttaacattcaattagaagatgtaaaacactag

SEQ ID NO: 2530 - DNA, 1086 bp, Candida albicans
tcacaattatgtcgcacaagtaccgattcggttgattcaatggtttctgcggtaagcaatataacagaatcatctgttgtcaactccaccactccggagtcttcaataaatatgactaaaccacctccaattagtacctcaaataaaataaaacaccaccctcctaaagatgataaacctttgccaataacaccaaatcgtgatgaacacaaaactgaagacaaagggactagcacttcatccaagggagaaccatcatctgtaacgaatacaaattctcaaaaaacagaatcagctaataaagaagctaaaaatggcagtgaatcaccaagcgaggatgatactgaatacagattaattgctaagagattgtttgatgaagaatttgtttcgatcaagcctcaagagtacactcaatttttagcagctggtgatcgtgactccactaaaattagaaattactacatgaatttatttacatggccaccaaaccttttaaagtccacaagaatgctttgctcgaagttatatttgaaaggagaatctcaagaaattgaccgtattttgtcgtcattcaccaaatcatatttgaagcaacatcccaagaatgtgttttgcaccaagaattttgaacaaatttatatcatcatatattctttaatattgttaaatacggcattacacaatctggaattgaacaaaaagtctcgtatcagtcaatctgatttcattagaaatacttttactacatttgtccaacaaaatgaaaaattgctgaagtctttgagtgtgaagcaaaaaattgctattgaaaatgaattgtcaaatttttatgaggatttatctaagaatgaattgcatttgaaaactgctgatgaagctggctcttcatcaattagtcaatctcaacatcatcacagtcatcacaatcatcatcaccaccaccaccatcataatgaccatggccatcacaacaatactcttggcaataggttgtccaaggccagtcaagattcagcagcaacagaaacgactaatgcgagcacacatagtccgttttcacacacgccggcgaaggaccaagta

SEQ ID NO: 2531 - DNA, 1554 bp, Candida albicans
aaggtcatgtcatatagtgaaaatcctggctccatcccaaaatcaaaaagtgctgctccttcttcaagtgaaacaaagatgctctttggaacaaaattagatcatgagatttatccaccttggaaagatttttacatttcttataaccatttaaagaaattattgaaagaaggagtaatccttaagaataattggaccgataaagatgaacagaattttgttagtgctttagatgaaaacttggaaaaagtttttggtttccaacacaagaagtttgatgaattaaatgatggattgaacgatttacagcaacaaactgaaagaactgatacatttaatctggagtcattcctgaaaaaattggacaaaattttggacgaagcacagaatttggaacatttccaaagattgaactatactggttttattaaaattgtcgagaaacacgacagaatacacccagaatattcagttaaaccattgttaaatgttagattgaaaaagttgccattccactgtgaagattactctccgttgttgtacaaagtcgggactttatatcaatttttaagagataattatgaagtagaccaatgtttatcaaagttgtcttctttcaacgaaggtgccaccaatggtgagtttcaatcattcaaattttggatccatccagacaatttgatggaagtcaagactacaatcttgagacacttgccagttttaatctataactccactaacaatggtgatgacgatgacgatgacgacgatgatgatgatgaagatgacaataataaacacatcactggtggccaaactatcaattgtttatacttggataatgatcattttgatctttataaccataaattgaccaaattaaacaactcatctactgtcagaattagatgggtaggaaagttggctgataagccaaagatttcgatggaaagaaaactgtttgatgtaaattctaactttttcgttgacgacaaaattgaattaagacaaaagtatattaatcaatatgtcattcagaaagaaattccaaaaaagttggtcaaattgaatgatgctaattctgttaaaaagttgttagattttattaaagaatataatttgcaacccattttaaggacaacatacaatcgtactgcattccaaattcctggggacgatagaatcagaatcattatagactcgaacttaactttcataagagaagattcatttgattcacaattgccaatcagagaccctcaacaatggcatcgtttggatttggataattccaaatccccgcaacaattcttgagaaaaggtgagtttgttaaattcccattttcaactatggaaatcaaaattaaaaaatcatcggccaagaattttaagaaattacaatgggtaaatgagttaattaactcatcttatttggttaaagagattccaaactttgccaagtttattcacggggttgcttcattatttttggaagacgacaaattggacaatattccgatgtggttcaatgaattggaaggtgatattaatgac

SEQ ID NO: 2532 - DNA, 633 bp, Candida albicans
tatttattctctgatttgtggagatttaaacaacaacaacagaaacatatcactatgccaggattatttgatttagaaagtcatttggtattctaccgctcatatcatttcaatcataccaatgtcacaattcatttgatttgtatccccattattttattatccacaattgcatttttaactcccgtgacaatcaattttggtggactcattaataattcaaattataatttagggtcattattggcttggagttatggaatttattatattttattagattggcaaattggtttgcctgccgctggtgttttattcagttttgctcattatatcaaacaatattatttgacattgtcggaaactagtgttcctacaagtaatgaatttgtgaaaattgcggttgcattacatgtattctcttggttcgctcaattttatggacatggagtacatgaaaaaagagctcctgctttattagataatcttttacaagcacttgtattggccccatttttcgtggcttttgaaattgccttctttttggggtatcgtaaagatttaaagaaaaacatggacaatcgagctggtgttttgattagagattatatcaaacagaaaaagcaaacataa

SEQ ID NO: 2533 - DNA, 225 bp, Candida albicans
gatttattggagaagaagaatgtatccaaaaatatatcacatttgagaatattgaaaagtaataaacctaataaattcttagtattgataaaattcagagatgtgatgaaagcagcagaattccaatatcatttcaatggcaacccatttaattccaatggaaccagaaacttgtcacgtggtttatgtaaagaccgtacaagtgatgaattcccacaaggataa

SEQ ID NO: 2534 - DNA, 1305 bp, Candida albicans
ttaggaaatatcgaccagatattattgatttaccttcgacaaatggtggccatgccacgggggatggtcaaaaaatcgttcaaaaaaataaaggtcaagttttggatatggataaaatccaagttcatccaactggtcctcattagttataaagacaaagatattgttgaaaggaaaaaaactccacgattcttgtttcttggagctgaagcattaagaggtgaaggtgggattattttcaattctaaaggtgaaagatttgttgatgaattggggactcgtgattgggtttcgggagaaatggacaaacaaatcaaacaaggaaatttccctattcgattagttttaagtgaaaaagctggtgaaaatttgaaatttcatgtcaaacattatactcaaagaggattaatgagaactgtttctggtaaagaacttgttgaagaaatgggttgttctgaagacattgttaaacagcaacttgatacttataataaggctgcttcaggtgctattaaggatccatttggtaaaaaatatttcccagctacaccttttgaatattcaccagatgctaaatatcatgtgtcatttattactccggttcttcatttcacaatgggtggtgtgaagattaatgacaagacccaagttattgctgataatgatagtccatttgaaggattatacgctgctggtgaagttgccggtggtgttcatggccataatcgtttaggtggttcctcattattggcatgtgttgtttatggaagattagctgctgatcaagcttcaagttataaattccataaattgagttttggtgatggtgatagtattgcttctgctagtcaaagattaaaaatgattaatttacatattgatcctagcaatggtagaatttttatagatactaatggaaatggtggagaaggtaacactgcttcaacttcaactccagacaatggtggttcttcttcttctgctgccgctcctcctcctcctccacagaagaaagctcctaaacaacccaaaccattttcggttcctgataaagagttcactgctgaagaagttgctcaacataataaacctggtgactgttggtgtattatcaaaaatgtagtacttgatttaactccatttttgggtgatcaccctggtggtaaagaatcaattgccaattttgctggaagagatgctactgaaagttttgctatgttgcatgatgatgatttcattcctaaatatgttgctaattgtgtgttaggtagattgaaaggtaaaacatcagaattacaattataa

SEQ ID NO: 2535 - DNA, 666 bp, Candida albicans
ataaataattcagtaccaaaaatgtcagatactagtcctaagggaatattacgtaataagccagaaggttatgttgaggaaactgaattccctgataagttagatcgaaacgaggtgatcaaaaacaccagattgaatgcccaattggcatcagaaagttctaaaggtgatgaaatcagagcaaagattgctgagaaaaagaaagaacaaggtttgaattctgcagaactacctgaacatttgaaatgggatgaaataaatttatataaaaatgaacaagagaagactgctactatgaaaatcgatgaacccaaaacaccatatgaaggaggatttaaccctgaaggagagtattatagggatgatgatgacaacgaaggtaatggaaatggtgaagtggatgatattcctgcttttgaattaggggaaggagaatttgacaaattaccccatgaaactctgggttctctccatggtagtcgagtgattaaggatactaatcagcaggaaaaaggtgaagacaaagaagaagattctggagaaagagagttgacagcagaagagaaacataaaaggtttgaagagatgagaaaacaacattatcatatgaaagcgttaccattgaaacaaaaaatagaaataccggacgaagacgatgaagaatag

SEQ ID NO: 2536 - DNA, 984 bp, Candida albicans
acagtactactcccgatgaggatttgcttggattgggaacttcgggcacatcaaatggtagaaatgcccctgcccctggtttcttttcgtgattcaagccctttgaatcagtttgtttacactgattacactactgcaaaggaaaaagctacagctgcatataaatctggtgattataccactgcgttagaatcctacacgatttgtcttggctgtttgcctcctaatcatgaattgcggattgttattttatcaaacttggcttcagtcaacaagttgctggggcatttgaaggaaagtttggataatatcaaagatgcggaagcattgttcttgcctcaagagattttgagtgattatgaaattgcagacaagctgatcaagtattggtgtactaaattgttcatgataaaggcagaagtgttggaattgttagagaagtacagcgaggctttggaacagtaccttgttttaataagacagttgaattgcaacgataagaaagttatggacggtaagcgaagagtcgataaaatcgttaacccacaaaattacaaaccgcctaaaccaagtgtgtcgtcgcgtgcttctacaccttcgaataagactcctgcagttgaaacaaaacggccaactaagtcaggtgacgacgaagttgatgctttgactaaagacaagattgaagacaaaattagatcttgggcagacgccaaacagaacaatcttcgagccatgttgactaacttaaatgagattatacctccaaatatcagaatgagtgagaaattgcgtaatttaactaccaacgatttgatgctaccaaaacaagtaaagatccagtatatgaaggtcattagcagcattcatcctgacaaattagcatcccaaaccaaggacaatagggaactggggttgatatgtaatggagtctttatcactttgaataagcgctgggaggcatttaaacaggaagagaatatatag

SEQ ID NO: 2537 - DNA, 3195 bp, Candida albicans
tatttgttcctgttgtgttcaattatttatttttttcaaatgaagacaaccgaagaaaagacaaattttaggaatcaattcttgaaattaggccaggggcatataatatcaacagatgaaagtaatgatgtgttttggagtctgttttggctgatgccaacatgtgcaaatgatgtttatgaattaatcacggttgcggatatcaagaaagtaagacagcaaaatctaatgaatattatccaattaacacggaaattgtgtcataaagtaatttttattgccaaagagtctaaaaaatttggcaacaataagaaagaaacaatcgaattattaaactgtgttagattcttgatcaaagtattgccctttattttcgaattggcaatttatcctactgagttggaaagagagatattttggaataacgattttgatccaatgcaatttctacaaagactagaggcttcaaggaatgaagacgaaccagaggacaataataattgggaaagagtcttaagtccagatcaagcaacgaacagtatagctgtaaacttgatgtcaagtttggtggacttgctattcattagaaatttcaccgtggcatcgtcagtatcgaaatcttctgcaactggtaaagacaataaactattacatgtttgggaacctggtattggaagcacttcgaaatatcaacagccaaacgtgatgatagatagtaatcgaacggaaatattgaaactattgctaacactttgttccaattcattgtaccaacaagtttctagtgtgaccactcaaggatcaaaatttttaacccttttggttactgtaactccaaaaattgaattgttgactttagtttcttccctactaaacatagcatgcagatcatcaaaattaacaggttctgaaaacgggttagtatttgaaaaacaagaatatagtgagactcgtcatttatgtgtaacttactctattcagttacttactttaatggttgtctatccactaccgcaaaaatcagaactaaagtttttgagtgaaggaggtttatgttcaaaaccatacaatatggcgagagcctttatgggcaaaatacataaggagaacgagctattgtttattacatcatcgctaattgattttctaaaagtaccgctaattaacgcaaaagatcaagaaacagatactttttcattgctaaggcccggtagtaattataaacgcccgtcgctttggagcttggaagctgttatgctaatatgggagctacttcaatctaacagaaaatttgccgcgattgtgggtaaaaagtatatctcagaattgatgataattttgctatactatgtatttgcttatcacaatcagaaaactttcaaaaatttagttttcctttgtgcatatttacttttgtatttgtcctcagtacaacaagatcgatttttggaaccgttgtttgtgccattgaactcagctacatcgttattcgaattctacaattgtttgccatcaaattataagctatccataacgccaggtaatacgagagattttttggttactcacatatgtaccatgcttattaacaatcaagtaaacgtttcgctgtctaactacctcctgaactcactgtctttgtcagatttgcttataaaaactttgatagaaatattgtacaatttgattccaagagtatcgattgaagaaactacagggcttaaaactgacaagctgaaaaaacttaataacccaaacccaagaggaggtctttcataccaatcatcatcgctgattactcaactagttggcattttgtctaataaaaaatttttgttggaaaagtcatttcatcctgaccttgtggccctcttaatacgagcaatatgtgctgctgtgacaaaattcccagtaccatcaaggatgttattgttttgcatattaaagaatgaaaaagtgtatgacgaactttggaatacaatttttagctttagtggagtgtttttcagaggcaattcattgaccagaattgaagatgaatctgacgaactacaatcagagaatacagaggcagatgcaagcatagcaccctatgatagcaaaaaggacgagatattggagtcaactgtcaacccgatccctattccaattccaattcctactcctactaacaaatatgaagatgacggaacaattaaatctacgagtgcggaaacggaaaatattgaagcatccttgaggccaagcttgcctaccggtatgtctttcaaagctagagagaaattgaaaaaagatagtcctttgaataaaacgtgggcaggaaacgatgccttagctatattattgactatagtaattcctcacttgaaagtcgtcttgaatgaagtatggtctcgtgttgaaggctcaagtgttgacagctatgaattggtccagcgcatagaaaaggcggggttcagtaaagtttttgaaactaacaaatcgcaactttgttatgaccttttgccaaatacgcttttggatcagttgaaatttaactggagtcatttgtccttagggtggtacatttcattattatatgggcagatttataattctggtgctcaagtgcagaactattccgggaatagcattcgtagctataaaattgtcaaaactttttcaagtggaatgagtaaattaaccctgaactggactagttttttgaaacaagatccccaaagggagctgaattcttcagaagcagtagtaccaaacatagatgagaatttggtgtgggtgaataatgcattgtgtgatgtaaatacctggagtgggtctgaaatcaaactctttaatgttgaaactacagaagatgggttttttgccaatttgaattcaagaatcatgtctaattacactaaaaatgagaatgctgctcaaacttctgcgtacggctatgcggtgccatccactccaggtggtttaacagacatgtccagaagatttagtgattttagaatcaataatggaagcaacccgagtattcgatccattggtaactcaccagccccgtcagcgttatctactcctgttgaagaaaaagagttgtatttttcaaaaagaagttttaggaactcggttacaagtttgcactctttaaacaatttgaatagaagcaggagcaacactcctcgaaactcgattagccaatag

SEQ ID NO: 2538 - DNA, 1200 bp, Candida albicans
tcttttctaatgaaaacacatttacttgttgttccaagtaagaaaactgaagaggttaattgggtcaaaccacttaataattatttattatcaatatatggtaatactttgcaatatcaagacgacataaactcgttgaataaattgcgccaagatattcggggagtcaatgctgatgatacggggttaaagttatactatagttattatagtaaattagaattaatcgatttaagaattccatttcatgatttgaataaatccaaaaaattacaatttgaatggtttgattcattttcttcattaccatatactcaaaattccttagcttttgagaaggcaaatgtattatacaacattggtgccattttgagtaaatttgctcaattcaaatacaatgaactgcaacaactcaatggtcctgaaggtgaaacagcatttaaacaactgatttcaatgttacaacaatcaagtgggatttatcaatttattaatgaaaattttttgcatgctccaagtcaagatttggctcaatcaacaataaaatttttaagtaaattgatgatggcacaatctcaagagatttttacgttgaaagttattagtggtgatttaaatcaactgaagaattctttaattgctaaactttgtaaatcaacaagtgtgttgtatgaggattgttataatatgataaataaaaataagaaagaggggtttaaaataaccaatgaaagttatgatggtaatgattatgaagatgaccttgatgatgatgattgtgatgatttggaaggatttttggaaagacctgaagatactgaagattctgataatcggtatgttgctgctgaattagattcttcgtggatttccattatttatttcaaatatgaatattacaaatcgttggcttattatttcaatggtttacatttagatgcaaatagaaaatatggagatgcaattgcctatttaacgaaatctcaagaagtattaaatggagtccatagtagcactttgaaacaagtatcgaaaggtagtggtgatgtttatgagttattagataattacaagtatcaaaaggatgctgtcaccattagactcaatgatttgaataaggataatgatttgatctatcatgatattgttcctaacttggtgagtcttctccacaggagccgaactcgcgaatacgaggga

SEQ ID NO: 2539 - DNA, 693 bp, Candida albicans
atacatgaacaaaaatttatcaatagtttgataaaagttgttggtgaaaatgatgatgtacttagtttaacagtgatgtttaaagatttgactgattccaaagatatttataaatcgttaatcactgtaccaacggcaaattataccttgttgaataattcatttgagtttaatccattaattttagagaaaaagcaatggcctaatatccctaacaatgaagatttgcatgaatttaaattaccagttgtattacaagatattttaactgaaatgacaaatcaatatcagacattggatgtgaagtataagaatcgacaactcgattggactaattataaactacatcaaattacgatgtctgcacagtttgatcaaggtgaaaaagaaattaccgggaacttgttgcaaatagtattgttattattgttcacagcagaagatgacaatgggtatacaattgaacaattaagttcaatgacgggtattaataatactcaattcttgactaaaatcgttaactctattaccaatgataagtatgccattttgcgttatgatggtaatagatattactataattcaagtttcaaggataaatccacgagaattaaattaccaatgattaaagaattgtcaagatcagaacaacaacaacaacaacatgaaaaacaagtcaaatgtttgaaatga

SEQ ID NO: 2540 - DNA, 684 bp, Candida albicans
gtacggattgaaaacaccagaagcttgttaaagttataccgttccatttcaccagctgatttgaccttgggtctccgtcagttttccgaaaagtacaaactgcaaattatcaagatgagccaaattgatagtgatgcccaagtaaagttgaatatcttaggaatttgttgtgaattattaagattagggtttttagaagagaaagatacaaggcaggtaattgaaaatttccccttttctggtccttcaaagctacaaatagaaggagcaagatttgtcacaatcttaaatgaagagaacttgactggaataaacgacaagtataggttgtttatcgaaacttacaagccaaatcaatttgaaacagacttaccattctgtttagatatcaaaagtttgataaatttgttgaagtttgtcgctgacaaacctttacatttggtatttcaaaatatgagtagtcattacgagggtaattgggagatgttggtgaaatactttttactggatatctctctgataaaattttccaagaaagacgaagaggaagaagagtttgttgaaggtgaggaaattgaggagtttagacagtttatcgacttaaactctgacgagaggttgattttgctcaaatttattcaagggtttgttgagtatgtttacactaagaagaaccctgaataa

SEQ ID NO: 2541 - DNA, 234 bp, Candida albicans
agtcttattgtttgtgccagtatagtatcaacgacagggatgtttggtttgggtaaattattttatgtgattgtgcttgttattaatggaattgcagtgctaagtgaagatagatttttgaacagaatcggatggggatcaacaactggacaacaaaataatggcaatattcaagcgcaatttaatcagtttaacagtggcttggataacaccgatggctctgtgaagacctaa

SEQ ID NO: 2542 - DNA, 432 bp, Candida albicans
aagttactattgacaatgataccgaatcatatattgatactaggttctcctaatagtgggaaattgagaattgctaatttgatttcaaaaaacgaagaaataccaaatttagaggatgtcgaatcacatagtggattaatagtaaaaacgtcactacgaacaaaatattactttctcaaattaaacatattaatagacgagtattcagagtcaaaagaggccactgatgaaaagaaactttcagagctacataaatggtaccaagagtttaaatctgaagagtttggggagttgagggaggtattggatggtttgatgtttaccataaacatgaaaacagattcaatatcctttattggtgatgctttagaaataatagaactaatcaaaatatctttgggcgatgaagaaaacctccacgactggggatga

SEQ ID NO: 2543 - DNA, 834 bp, Candida albicans
cggcccgtcagtacgcaaagacagctggcacggtcatccacttccaattcttctattgctcatactgctaatgataacaacaacacaaacaaaggcaaccgttcagtatcacctcttgcttctaccgataatcatactcatgcaccagcagcagtgtccaccccagttaaagttttaccgcctgggttaaatcacgatacatccatgaattctaccttgaggtcagagtcatcatcaccattagttggtcatgccaaggttaataataaccatgagttacagattagcagatcacaactgccaatggtttctaatgagaataaggtatttagtgataccatttctcgaattgttaatgttgctcacagcagactaaatgacccattgcccttacagtcaataactgggctattagagacctccttgttaaactgtcccgattcgtatgatgctgaaaagccaagacagtataacccagttaacgtccacccgtcactgattgattatccacaagaaccaatgtatgagttgaatagtagtcattacatgaaaaagtttgataatgatactttgttcttttgcttttattatggcgatggcatagatagcatttcgaaatacaatgcagccaaagaattgtcgagacgtgggtgggtgtttaacactgaatttagtcaatggttttccaaagacagtaagaatggaggcaagaaccggtcaatgtctgtgatacaaagagaagaagaaaatggtaatattatcggagacaacagcaatggtaatgaggaattacgcgagaagattgatgataatggcggcattccaagtaattac

SEQ ID NO: 2544 - DNA, 282 bp, Candida albicans
gcattagaagcaggatatgaatcaaagaatttgaaaacattttcttcatcttggttattagctgatgatttacaaattaaaaaatcttgggctaatgctacaattaatagaattaaaagtgatgttgaaaaattaaatgttaatgacccaatgaagaataaacaaatgaatgaaaaatttattaaattatggcaagaatggctggaagatgaaacttcattatttactatgattcattttgaaattatttatcagaaacctactactactagacaagtataa

SEQ ID NO: 2545 - DNA, 1116 bp, Candida albicans
aaatcactcgataaggcattcgatgtactaaaccagttgattttaaatttgataatggccagtgattttctaaccaattggataaatcgtccattaatcaaaagtcttagtgaattagtcgccatttataaaaccaaagaaagcagaaacccagaagacttggactcatttattgaggatgatgccgatgcttttggtgggactacacaatctcaaaagagttgtttggaatctttagtaataaccttcagaaaagcttgtcaattatctcttggagataaaaatttagattcggaattgactaaacgaaatgatgtctattattttttagcaaattttgtgaaatattgctttaagttgggtaaattggatttggctaaatcggttattaaagctgtgaaaaatatcagtaatagattgccagcacttgatagtacagtgaaaaccaaaaaatatggtgttatttatttatattaccaagctttgatggcattagatgatggtgattatattgagagtgaagagaatctcgagcatgcaatgaaattaatggatgactatcaagatttaaaaagtaatcaacttggtcaaattttgttagtgttaatccccttaaagttacataatcatggccaattcccactgaaaaagatctggttaaaatacccggttttaagatctttatatcgtgacaactttttgaaagctatattggaaggtaacattgccaggttcaatcaatcttcagagaagtttcaaatcatattattgaaaaaacatttatatgttctaatagaaatgttgagacctttggtacatttgcagttgattaaaaaaacgtatcgtttgattatggaattgaactctgattcaaaatcaaaacacttggttcctattagtgcattccaattagcattagagtactcaactttcaataaagactatgaatgtgatttcaattttgctggagaccatttatatgctatcagtaagagtgaaactgagtgtattttggggtatttaatatcaaagggaagaataagggcataccttagtactcttaaggagggatatgttgtatttgccaaaacagatacttttcctaaaccacagtga

SEQ ID NO: 2546 - DNA, 699 bp, Candida albicans
cgtgggcacacccttattgtgtcggaatattgcagtaatatgcaaaatacaagcttaaaattcaatgagtttaatcttgatcaacaattgaaatatcgatattatgtagcccgatattatttgatcaaatatcaattaattgaaagtttcaatcatttacaatggtgtctagttaacacttcaagtttgaagaatcaaaaattaacccttgaattgttattacctgtaagtttgatacttgggaaaatacctaatttcaattatttatctcaacaaggatttaatttcccctttgtacaaatgtatcaaactttatccaaatccataagagcaggtgattattctaaattcaagcaagtaattgattcaaactatcattatttaaaggataagaatttattattattgatgaacaaagcggaaatacttatattaagaaatttgatcaagaaagtttggatcgtgcttgataaacccagcacaatgaattatttaaacataccaattgaaggacattataatgacgaattgtatttggagaatgtttttgtcacgttaattgattcaaatttaattaaagggaaactaactagtagtaagactgttgtattgagtaaaactgatacgttccccgatgttttcaatatttataaattgaaatatggcaataataatggtaattcaaatcaatgggtttaa

SEQ ID NO: 2547 - DNA, 1512 bp, Candida albicans
gaagatatgtcaaactccatttcagaagctgaatcaagaggccacaaatctcttgaaattgaagaatatcaaattgaagaatatcaaattgataatcacactaacgatgaatcatcagaaattttagatcctcatcaattaaataaagtttatcgtaaattagatttaagaatcattccagcattatggtgtctttattttttaacatcatttggttccaattgttatggattaacattaactatgaatagagctgaaggtcattcattagctcaacaattacatttaacttcaaaagatacttcaacagcactggcgttatattatgttggttatattatatttgatgtcccaatgaatttaatcatgactaaagtaagtcctcaaacttggttagcaagaattgtcatcactgtaggattagtttatacttgttatcatgttttacataatgctggtggggttattgctgttagatttattagtggtgttgttggtgctggtacttggccgggattaagttattatgtcagtttatggtatcctaatgatagactgacaagaagaattgggtattattttacggcagcacaaatttctgctgctgtggctgggttggtcagtgctggtttccaaaaaatggatggagttcatggatatacaggttggcaatggatgtatttagtttatggtgtcattaatatgactgttggtattgccttattgtggtggttacccgatagaccattcattggggttaaatcagaaagtaatcgattagtggaattttatagaaaattcactacaccacctcatccattaaatgaacaagaaaaagaattacatcgtaaagatttagaacatagatataaattattgaaatggacttggaaagatgtggttaatattattactgatttaagaatttggcctttaattattatgtattttggagttgttggaactggatttggtttagcagtttttggatctacgattattgccactaataatccaaatttaacttcaattcaagtatcattattatatgctccaatttggttatttgatttaggtggtattttaataatcactccatttgctgatcgattcaaaaaattccgtgctttaatattcagtggtgcttgtgttattattattgttggtatgatagtcacaacttttgctcatggttcatggaataaatatggtggattattaattgctggatttggattgggtcctacagttcctatttgtatgtcatggtcagctgaaattttccaaaaacgttatggtgatgttggtaatgctgttagtgctgctttggttagcggtttaggaaatttgggttctgttacttctacttatgcattatattctggttggccagaagataaagctagattatatcgaaactcaaacatgatgttggtacttatgttgggggtcagtataattgcttctggtgtttgtcaattgatcaaagataaagttagacaaccaaaataa

SEQ ID NO: 2548 - DNA, 558 bp, Candida albicans
tctatgtctgcggcggctgttgaaaacgaggttcttcgccgcaaagaagctcttaaagatgtcggtaaaattgctgatgttggtaagccagataaaatcactttggaattgccaccagcttctacagtttattttgttggtgacactccagaatctgatatcagatttgccaattctcatgatgcatcttggcattcaattttagttaaaactggggtttatcaagccggaactgaaccaaaatataaacctaaacatttgtgtaatgacgtgttggaagcagtcaaatatgccattgaaagagaacatgctatggaattggctgaatggaatgaaactgcacaagatgtcaatgaagatgataaaggttcaagattgaattttgctgatttggtcatgacaccaagtgacaagaaggaaaatgatacaactgaaaagaaaccttctggtgctagctctacttctaaatcaagtatagctgaagctgaagaagtcgaagtgcctgatattttagctgctcaaatagaaaaacttaaagatgttagtgtttccaaataa

SEQ ID NO: 2549 - DNA, 789 bp, Candida albicans
atcgtgattgaattgtatcaaaactctcatggcgaaaacgtagaccaagaccaagtatatcttccattgcgacaattaataaagaaaccacgaggagcatatgatatcttaacccaagcatataatcgggcccaatatataaagcaaaataaagtgattgccaagagagaacaagaagagtccaaagctcgacaattacattatgcactgattgattggcaagatttttcaatagttgctaaagttgattttaatgctatcgatgcggttaaagaattgagtatgccgttaaaacgagatgatttgataaaacgatcattggatgccagaagtaaagatattgaattaccaaaagtagcagtggcggcgacaacaacatcaccagtacaagttgaagtaattgataccaagaaccaaggtctgacccaagatcagactgataataatacatctactccatctgcaccaccaatcaagggaatgaaaattaaagctgctggaacttcacgattgaaaaaatcactggaagcaaacacttcaacgacgacgacaaatacgattaaatgccctattacaggtaaactaattccagaaaatgaatttgatacacatataaaaaccttgttacgtgatccaagatataaaaaagaacaagaaaattatatacggaagaatttcagttatgcatccaatattacaactgatcaagtatatgaaaacattaaacgatttgtgaagaaaagagctaatgttgaagatgaaaacccaaaaaagaaaaagaaagcttag

SEQ ID NO: 2550 - DNA, 690 bp, Candida albicans
  unsure (125): Identity of nucleotide sequences at the above locations are unknown.
ggattattgggcataataagtggtaaaggttcaatgatggaatcatcattattatttgcttatattgttaaatgtatttatgaaactttccccatattatctggagctgccaccaaagcattagntaatttattcaccttaaatactcaaaatgtgaaaaaagaaattccaaaaatacctccatcaattttaaatccaatttctgaagtcattccatttataacttcaactttaccttcatcatttaaaggagtttggaaatttttaatcatggctataaaaactttaactttaccattgttgttaaatttagcttatagaataggagtattttatgccgcaactaaaatcatccccagtttatatcaatcagcttcttatcctttaataacaccaccaaaaactcctcaaccaggttcacgtcaagtttcaactacttccttatcaaccttcacatcatcgacaacatcaaccgtattggatcaacattccaaattgaggacgaaaaattcgtttcgtcttaaacctccacatcatcaaccaccatcagtgattatacggctaatttatgcttattctccatgtttaataattgccgtttatactcatttaatgttatcttataatggagaattaggtaccgaattaaaactttggcccctttgtcttcaccttcggaaagtggccaga

SEQ ID NO: 2551 - DNA, 702 bp, Candida albicans
tgttggttcgttattaattcccaaaaaaaaaaaccaaataattcaatgtttcatttctttttggtagaggtgcgtggagaaaagacccagttttttctttcccgagtaagcaatatcaaaaaattatcagcactatccctaaatcaaaccatgccaaagaaaaatgtacaacgggatatactttccatgtttgggaataatgtctctaaggatagcaagataaagaaaccgagtgtatcccaaagtgtttccaccattacgtcgaaagaactcctagtacagaaactaagcaattcgaattccaattccacttttgagaacaattggactatagaagggactttcttgattcgaaatatctctttcaatcatacttcagtagagatagaatctctgatcaaaattgctgcatttgatctagatggcactttaatcagtacaaaatcaggtggtactttttcaaaaagtcccagtgattggaagtggtggaatgataaagtactagacaagttgaaagatctatatagagacaattatctaattgtcattttttctaatcaaggtggagtggtagcgactccttcaagtaaatcttacttgaatttcacgacaaaattgaatagcatcgttaaggaattaaaaggtcgtgatattttggatagaatactgatatatgcagcccctaagaaagcctctatctag

SEQ ID NO: 2552 - DNA, 684 bp, Candida albicans
aggctcctaggaccaaaactaagcaattcgaatttcaattccacttttgagaacaattggactatagaagggactttcttgattcgaaatatctctttcaatcatacttcagtagagatagaatctctgatcaaagttgcagcatttgatctagatggaactttaatcagtacaaagtctggtggtacgttttcaaaaagtcccagcgattggaagtggtggaatgataaagtactagacaagttgaaagatctatatagagacaattatctaattgtcatcttttctaatcaaggtggagtggtagcgattccattaagtaaatcttacttgaatttcacgacaaaattgaatagcatcgttaaggaattaaaaggtcgtgatattttggatagaatactgatatatgcagcccctaagaagccttctactaagaatagtaaaagcactaccaacactatcaatgaacagatgcatgcaaaaatgaggaaaccagaaactggtatgtgggatacatttctagtcgatctcaagaggtacggcattacactggatattaattataaagagagtttctttgttggagatgcagcaggccgaagcaaggattttctggatagtgatgcattattttctaaaaacataaatttaaaatttataaccccagaggaactatttacatga

SEQ ID NO: 2553 - DNA, 1338 bp, Candida albicans
  unsure (1264): Identity of nucleotide sequences at the above locations are unknown.
cgatcctcacttcttttctacatctattcgttgttttgtcatcataattatatttttatttatttagttttcacagtttgtttctattggtatacagtaaaatcttatttcaatttactaaatatgacgttggaaaaaaatagacatgccaacaagggaacaagttggacgtggatgatatataaatttgtggttggggttattacagttgccatcctagttttatttataacgcagaaactggtgtcacaagcacaagataagctacgagtagaacagcaagctatatttagtgatcaggataccctacagttaaaacatatattccaccatggtactggacctaagaattatagattacacagaagattagacattacatcggaatacttggctaaacatcagccatattttacaacactcactcaacaattactgaaaccagttttagaagaacacattgcatcagataatttagataaaatttatcaactatcagattggccagaaattcacaaaggcaaaaacccttttagtattgagttgccatttcaaaaagcagacattgaagcgacaagacttaaagaaagaaacacgttaaattttattgaatcgtatcttaattacgctagagatatcaagggggatgctcagattttaaaccggatcaatttagattggatacatgatgaaatcaaggtcccaaatgtcaccgatagagatactgttgttacgttagccaccatctcatcaaacgcgtatgtcagatatcctaaagatgacgatgagaaaagaaagtcagactggatagacttaggagattgggaccccaatagagaggatgatgatgttaattttggttgggacgacatcggattaagagggcatgtgtttgtcagtaaagataacaagacagtggttattggtataaagggtacttcaggagcaggattacctggtggtggcagtgacgagactggtggtaacgataagactaatgacaatttgttgttttcttgttgctgtgcaagaattagttatatgtggacaacggtgtgtgattgttatgaaaaaacatacacttgtaatcaagattgtttagaaaaggagttgagaaaggacgataaatattatcaagcagtcttggaattgtatcgtaatgtgactgatatctatcctccggaactgacagatatttgggtcactggccattcattaggaagtgccttggcatctttattgggcagaacattcgggttgccancagtggcatttgaagcaccaggagatatgttagcaaacaagaagattgcacttaccttctcctcctggaactcc

SEQ ID NO: 2554 - DNA, 819 bp, Candida albicans
ttttcagccatttttattgttttgtatgaagcttatatgtttgccctgattaatatccaccatgataagtttgcaaagggcaagtattcggagtactcgatttactttgcactttttatatttgcagggttcttccaagtgttgatgacattgatagcactatattgtcgacacctattgttattagtatttttgatggggttttactgttgcatgttgatatacactggtattcaatacaatgaagttagtgacaaaatatctgcagttttgtttggtaaatggaaaacagcaacattcgctatgaatattgcaactatatgtgttcttgctgcaaccttggtcctccaatctgtattgttgtattttggattgagaagatatgtaagctggtttactttcaaaaaaatcggagccagtttggaacttaaaagaatttacacgtatttccaaatacatcgttctatattgatgtttgattttttcttctttgctgggttcacaatccaattcttggttattatggtaaaagatagaaagtctgttgagtttattttaacagtaattgtgattccattaacaataattttgcttttcataagtgatatatcagcaaccagagaattcatttatggatccatatttgcaattgttttatttttgtgtggtattgcttatgtccttttcaaaataataagattgtacacgaaatacacttcagcttatgatttggcaattagacctggtgaatattttatgggaagaaaatcattgttgacatctggtataataactttagtattattggttgcaacaata

SEQ ID NO: 2555 - DNA, 312 bp, Candida albicans
gattcaaatcttaaagagttctctgtgctacccaggtcgtttccaatgcataagctaaagacatttttcacaatagaaattaaaaacaccgatgaacaagtcaaagatagccatttggtgtcacaattatacaaggttgggtcaactaatctacagtataaagtaatgactcttcagaatgagggatataaaattggttctagtaaacaaccttgtgcaatatgtaacaaacgattgggatacagtgttttcacaataaccaaagaccatgaagtagttcactatggatgtgctcaaagtcgaaaaaaataa

SEQ ID NO: 2556 - DNA, 2037 bp, Candida albicans
aatcctgccaatctaatttttctattcttttttttttccaagttgacttctttacaaccaaattcaccttccaaaaggaagagattttctactttaaaacgtttccttctgattaaaactatttctccttctacagaagaaccaacaaataccgacacatctgatcagtttcatattgatagtgccaacaccaccaccgattcttatatatcaataacaatggctccacctactagtttggattcaagacaaagacaatcgaaaagagatgatgcgattagaaaacgtattgaaaatgatttgagaaagaaaaaggcaagcacttctctcagtacaagaagaagtaggggtgcaccaggaacagttttatggttgaaaccaggtgaaccaattatttgtaaaccaacagccactgtttatgaagttgcccaattaatgacagcaagaagagaaaactgtgtattggttgtgaatgaaataggagaattattggggattttcacagctaaagatgttgcctttagaattgttggatctggtcttaatgccactcaagtgactatagacacaatcatgacaaaaaacccaatttgtgcctacgccgctgatccagctggcgatgctttaaatttgatggtggaaagagggttccgtcatttaccagtgttggatgaaaaactgcaaattgttggtgttcttgatatcacgaaatcttatgctcaacaaatggagaaattggaaagaatgcatagttcatcgaagaaattacacgaggcattagattcagttcataatgaaattggtgttggcgaacaaccacatcacgttttccaatattttgaaactttgaaaaacaaaatgaatggaccaacattagaagatgctttggatgccaacactgtacccacatatgtaaatgttaaagcatcggtgcatgaagccaccatgttaatgaaagaaaatagaactactgcagttttggttaaagatacaaacgaacaagttgcaggaatctttacatcgaaagatgtcgttttaagagttattgctgctggattagaccctaaaaaatgttctgttgttagagtcatgactccacaaccagatgttgcaccaatcggtttaccagttcaagatgccttacgtaaaatgtttgatggtcattatttgaatttaccagtagttgccaatgagggagatataattggagttgttgaagttttgaaattgacccacattactttgaatcaaataaaacagcttgaaactagtgaaacaagcaatggctcaactgcagttgactcaaccaatgaaggtccagcatggaacaagttttggacttctttggacaataccgatggtgatacagaatcagcacattcggattcattaatggaaacaagtcgtggtagtgctactgctcctgatatcacaccttctgaattccattcatttaatgttgacatcaaaccatcagattcagtatcccatgtcaacacttctcctctcaaggcttcttctttcaagatgacatcgtcaatgacggttgatgaaataccatttattttcaaattcaaatcaccaggaattgaaggtagagttcatcgtataactttaaaagccagtgatggaattatcaaattgagagaattgatgaatgaaaaattacacgacaaagatttcgcctttttgaatgtccctaaaccagacggaaattcctcaacgcaagaaacatatgctattagttatgttgacgatgaaggagatgtggtatcaattacttctgatagcgatttagctgaatgtatcagaatcaatttgaatttacaaaatgaaaaagctgatttataccttcataatcctcatgaaccagcaccaattgaaaatattaaactgattcacaagtctgctaaaaatcgtcatggtaatgccgataatggattgatttttggtatacctaatgaaattttaattcctagtgctctagctgttttaggagcatctattattgtggggttcacccttagtagaaagtaa

SEQ ID NO: 2557 - DNA, 2607 bp, Candida albicans
tattacaattctctaatatcacaaacttctggtaaaacccatttcgatcaactagtaatggccagatttaacaatgaagaaattttgaactcagtaggattaccgagtcaattattacaacaaatcagaaataaagaaaacaagggtgattatgacgatgatgaaagtgaagatagatttaccaaatttgaaaatatccgaggaacgaaacggaaatcagaacctataagtcgaaaagaccaaagaaaagtagaaagggaattgaagaaaccacagagaataaagaaagatactcatcctcaaaaggttcaacctaagaaacaaaatgagaagacagcggatccacttgcgttattggcagccaaaaagaacaaaagtaagtccaaaaaagcagaagaggataacccgttggtggcattacgaaagttgaaagaaaataaaaacagcaaaaagacttcaaaggcaaaagaagacttcaaaattgtaaaggaagatgaattattggaagatgaagtatctgatttaggttatagtgaagatgaccttggcagcgagaataaagaagattttgatgaagatgaaaatattgatatagacccaatggaagctttgcgtgctttgaaggagaagaaaaaaggagtaaacaaggcatcttctgatataagaatagtaaaagaagatgacttggaacaagaagatgatgatatatcggatttcgaagagctagaagaagagaatgaccccttggaagccttgcgtttattgaaaagtaaaaagaacaaaccaactaaaacttccgaaataagaatcgtgaaggaggatgatttagagcaagaaaatgacgatgatgtatctgatttggatagtgatgaaaatgttgatgatcaaaacgaagagggagaagattttgaaggttttgaagaggaaaattttgatgaatcagattttcacttatcagaggaggaagacccattggcaaaattgaaagctatcaaagaggccaaaaagaatgggaaatctgagaaaaccaagaaaaagcaggaaaaagaagtgtatccaattgatcctcatttccaagagcaattccgcaaagatgatgaagacattgaatattatgcgaaaaaattgggtctcaaaaatgggaaaaaggccaaactttctaaaactgacgataatgatattattggcgggcttttggacggcttagatttagatttcgagtccgaaatggaaaacataagtgatacgtccgatgaacatatttctgaagaggatgaagaagatgacgagtatttcagtgatgatgtggacgattcggaaaaaatgaaagaaaacccatatgtagcacatggactggaagaaacaaaatcctccgaggaactggggctagctccacaaagatatattccaccagcattgcggaaaaaaatggctttagaagctggcgaaagtgtctcagaggaaacgctcaaattaaggaaatctattaaaggtcccctcaataagttgtccgaagctaatattagttccattgtcagtgaaataaatgcgttatacttgtcacatcccagacagacattgaatgaggaaattacgaatattattcttgatagtattgtgcaacagggaagacttttagatacgtttgtttatcttcatgcaactgttgttgtggcactttataggttgcaaggagttgaattcggtgcacattttattcaaactatcgtggagaaatttgaaacttctaaaaccgaatcttcaaaaacaaaagaagcatcaaatataatttcattgttgtcttcagtatatttatttcaattagtgtcgtctaaattgttatatgatttaatcaaagaattgatcaataatcttgacgaaaataatgctgatttattgttaaggttgattcgtaattcggggaatcaaatgcgttctgatgatccctcagcattgaaggagattgtattgttaataaatgggaaagcctcgacattaccaaaggacgctgttaacacaagaacccaatttttaattgaaacaatttcgtcgttaaaaaataataaattgaaaatagtaaatgaagcaaaccatcagttgtctattaaattgaaaaagtttttgggtggaatcaatgaaaataaatcaggcgatccaattcaagtttcattagaggatattcaaaacgttgccactaggggtaaatggtggttagttgggtcagcttggaaaggtcacgagacagacaaaccaaaagatgttgatgttgtggctatgagtgatattttggataatgctgaaccaaactggatggaattggccaaatcacaaagaatgaacactgatattcgtcgtgcaatatttgtctccattatgtcagccaatgattatattgatgctgtcacaaagttagataaactagcattgaaaagaaatcaagaaagagaaatacctaaagtgttaattcattgtgctactatggaaccttcttggaacccttattatggggttttgggtaacaaattatgtgattcacattcattcagaaaaaactttccaatttatgttgtgggatttgatcaaagaattggatggtggcagtgctga

SEQ ID NO: 2558 - DNA, 396 bp, Candida albicans
gctacaatgtttggatctaaagataaagaacctactgagattttcaagaacaacgaaaaattgagtatcaaagacctccctattttcactcgttcccaattagcccaatataatggaaccgataaaccagaattgtatgttggtataagaggatatatatacgacgttacttctaattccaacagctatggtcctggaaaggcttatcataaattggttggcaaagatgttagcagattgttagggttaaataagttgaaattgttagaggatagtgatgaatatacttggtatactgatgatttggatgaaaagcagcaaggtataattgatgattgggtcaagttttttaaaatgagatacaatatcgtcggtgtaattgttgatcataattga

SEQ ID NO: 2559 - DNA, 1449 bp, Candida albicans
caccgttccgacacaccaccaacaatgtcatcttcacagttttacaataaaggagttgatgaatccgtagtatctagacaagagattgaagagtttactaaaagaaatgaatttttccttaaaccaagcagcaggaaatatgccaaacaatatttttccatgtaccaataccgtttaaagaacttaagagatcgagttcataagactgccatggaaaaatggggtcacggaaccaagaaaataaatgggaataccattgaaaagcaagataaaatattagatattgctagtgggaaattatgttgggtaatcggaaccgtgttttgcgatgccaaatacaaacttgatatcttgaatgatgttgaaaaaggtacagatgacgttttaccattggagcctgtaacttatgtgaacgaggatgaacaaccaattgtaatgcttgaagacgagtcaggaagagctattttgaataacgataactttttggcaaagaatttattggtcactggctgtatagtggccgtattgggtattgaaatacaatcagggatatttgaaataatggatattgcatatccagattgtgcaccacagaaacctttaccacttggagaaaacaaaagagggaaaatagccttagtgtcgggattaaatatcggggacgtaggtcattacgatttgaaattggaatttttgaagcagtaccttttaggagaactcggaaatgccgaagataaattggatggcagcctaatctcccagttgataattgctggcgactctattatgcctatacagaatttaagagcagagatggatttgaaaaactttgtcactacaaataattatggatcaaagaatatttccaagtataatgttgagagttttaagaaacttgacgaattcttaaccgacattcttgtgagtttaccagtcgctgtaatgccaggaaagaatgatccagcagaaatatgtttgcctcagcagccattacacaggtcgcttttcaaaaacaactcgtcacttctcgatgggaatcgattgacgagattgacaaatcctcaatggattgatgcacaaactgtcaagatactaggaacaagtggccaaaatgtggatgatatccagaaatacattgtacctaaaaaagatcaccaatttacctcaattgaaattatggaaaacaatatcaagtggcaaaactttgtccctacagcaccagatactttatattgctacccgtatgaaaattatgatccattcattttctctgatgatttaccacacgtgtattttgttggtaaccagcaacaatttgacagcaaactctttgaacacgatggtgttaatgttagactaatatccatcccaaagtttaaagaatctggtcaatttgttttacttgatttggataccttggagactgaagtagtcaccatagagatttag

SEQ ID NO: 2560 - DNA, 627 bp, Candida albicans
ccacgggtttactttcaaaaacaatttttaatcttagctatcagaatcacttctctaacaaagtctatcactatgtctatttccggtgctgtattaaaacctgattttttgaaaataatacaatctcaatcaaatgaactcccatttgaagtcagttctgacgggttagaagttttaaaatataaatccaaaacatcaagacaatcattagagataacatcatcatcaaccacaaatcctaatcctaatgagagaaaagtgtcgattcaagcacaagatggcttcatatatctaacaacaaaaagattagtatttataactgctactcaaggagatattcaatcatttgtaattgatttaaatttagcacctttactacaattatcacataaagtacaagcaccttggattggatcaaattattgggaattcatgtttcgtagttcttcacaagatggtattgccactgatggactaccgaaaaatcaatattttgtgggcaaattaagatttcatgatggtggtttatttgaattttgtgagattttgaataaaacccttaatgatgctgttaataatagagatatcgatgatactttaccttcttacaatgaagttcaacaatga

SEQ ID NO: 2561 - DNA, 432 bp, Candida albicans
aaagatctatttgtttacgtactaatgctattttctttttttataggaggtaatttccgtacttggaccccaacaccacctgaaagaggatcattcccattagatcatgatggtgaatgtaaagaatatatgacgaaatatttaacttgtatgaaatttactgagaataaaaatgctcctaattgtcgaatattagctaaacaatatttaaaatgtcgaatggataatcaattaatggaaaaatctgattgggattctttaggattagttaatttacctggtgaaaatgatgttgaattagatcatcatcatcattatcatcttaataacaataatactaaggcagatggtaaaagtggtagtagtaatagcaatcagaatttggctaatactactaacaataatactgggacaagttccggtacaaagtaa

SEQ ID NO: 2562 - DNA, 486 bp, Candida albicans
cctcctagtttccaaaaccgaataatggacaacttacaacaacaagaacaaaatacaatagcttacagttacttcgttgacgaatccggcaagctgcgagtcaagtcacaacacgtattgcttgttattattatactagtttgcctcttggtcttccattttaggcacaagataatcgaattacatgacagatatagaacaagatcaagaatcgatagcgggtattattcaaatttgcaatcatttgaagacgacgttgccagtggattgagtagttcgaattttgatctagaatccaacaacattgctacaaacgacaaccgagctggtttatcggaatcagcaaaattgcaaataaaaaagatcatggaagaaaaaggtgtcagctttgatgatgcacggttggaatatactcggaatgagcttagcaaaaacaatatagacgaaaacggggtacctagagaccccaaactagtgatgttctag

SEQ ID NO: 2563 - DNA, 2217 bp, Candida albicans
  unsure (462): Identity of nucleotide sequences at the above locations are unknown.
gtaagtcagaataatattagaatacccctattgccaccattccaccattccacacacacacacatacatacttactcgtataaaaatacatattcatccataatgacctcactacacgatacgacgacacccacaacaccagcacctcatcaacacaatgatagtgattccgatattaatgagatgtctcgcgatttagatgaaattggtttacttaatttaaataatttaacttcatatttttcaactgatcgctttttctcccaaatgcccacttttgaaatgaagaatttcccattagaattcactaaatatgtgaccaaatataagaattattatcaaaatcaatataaaaaatataataaaagttttggtactactgcaaaaaccgagagtaccgatactgatgaggtgaaagatatactgagtgaagatgatagtaatattttagattctataaanacagttttatcaacgagaattcaaatggataaatttttaaatgatttaaaattaggggttaatatcactactgctattgatcgactacaacctttgacagacgtcattaatgaaacgatttttttaccaaccgatgatttcagtgatattgaaaatgatgaaaatgaactggatattgaaatagaagaaatcactgaaccatcaggaattggagaaattgttaataaaagtcaaccattaataaatgaaattgttaaacctcgagtaggagaaatgagaaatgaaataaaaagaaacaacagaaggaaaaggaaaagaaaacaatataaaaatatttatagtaataatgatagtgttacatcacaaactagtgatattgatggattaactatttatgaggttagtgaattgactgaattgaattctttagatgattttgttaaacaagatcttttaagaagtaaaattaaaaaaattcataatttatctataagtcaagattcaaaaaataaattagtaacaaaattaatgatggggaattattataaatatgttgatgaaaaattgtccaataatgataaacaattattgcagccgttaagaaatcagaaattgatcatcaaagaagaaaaagaaaaagatgaagaaaaagacaatgatgaggaagacgaagaagatgattttgatgaagaattaccatcaaggctgtcattaggtccagtagatgaggcgattattgaaaatgacggtgaaaactttgaatcagaatctgaaggatccaacgatgaagaagaagacgatgaagaagacgatgaagaagacgatgaagaagacgatgaagtaatgttgacggaacaagatttacaaccaacatatcatgattcattacatactatatttggatgttctcattatcaaacaaattgtaaaattgaatgtccaacctgttttaaatggtatacatgtcgattttgtcatgattcccacactcttgatcataaattaataagaaatgaagttacacatatattatgtatgtattgtcatacaccacaaattcctgaatctaattattgtattaattgtgcacaagaattagccaattatttttgttctaaatgtattttatatgataatgatcaaactacagatatttatcattgtgataaatgtgggatttgtcgattaggtttaggtttagaaaaagattatttccattgtgatacttgtaatacttgtttatcgattgatttaaaaggtcatcataaatgtttatccgatgttactcattcaaattgttgtatatgtaatgaggatttattttccctgattcataaagtggtgtttatgaaatgtggtcattctattcatgaacaatgttatagtaaattcaccaaattttcatcaaaatgtccaatttgtaaaaaaaccattactaatgtcgagagtcaatatcgaatattagatgtcgaaattgctcaaagcccattacctgaaccctataataattggagatgtattatttcttgcaatgattgtggtggaaaaagtaataccatgtatcatgtattaggattgaaatgtaaatattgcaagagttataataccaatcaattgaaattaatcaaacccgaagaagaagaagaagaggaggaggaggaggaggaaggaagcaagaagaggagatattgggagagggtgaagaaagaaagaaaagtgacaaaaataacaattcagttactcaatttgatgtaa

SEQ ID NO: 2564 - DNA, 2082 bp, Candida albicans
gttgatcctcgccgccgtggtgaagaatctaaaagtgattggttccccattggaggtagtagaagtagtagttcgctgaaaaagggatcttccaattaccataagaaaacaacccctacttcatccacttctactaaatcaacgatagaaattttgaaaaatgaatttagaaatagttcaacctatacattattaagatggccaatattaatatttgtattcagttggattggtatattaggaatattttattttatgattagaatttatgttgctgtagtggaatatttatttacttggagaggtgaaaggaaacgattaagaaataaattacgaaattcaaaaacttatgaagaatggatcaataatgctttagaattggataaatttttaaaattagataaatggctggaaaatcccaaattttcttattatgattataaaactattaaattaaccattttaaaattacaaaaattacgacatcaaggaaaattaattgaattgatggtgattttacaaggttgtttaaaaaaaaattttgctggaattgaaaatcgtcaattatattctcatagatattatggtacgaaaaatttagttgaagaatattatcaagaagttgtcaaatgtcttgaattgataaatcaagacaataacaatggtgatgacaatgataatgatgataatgataatgagaaaattgatattgaaaaaaaatggaaatttttcaaaattgttctgaaaaattatggtaaatcagctttatgtcttagtggaggtgcatgttttgcttatactcattttggtattgctaaagcattacttgatcaaaatttattaccacaaatcatatcggggacttcgggtggtggattaattgcggcattattatgtactagaactaatgaagaattgaaaaaattattagtacctcaattagctagaaaaatcactgcatgtgaagatccttggtatatatggatcccgagatttttaaaaactggagcaagatttgatgctattgattgggctcgaaaatcaaattttttcactcatggttcaactacttttgaagaagcatttcaaagaactggtagaaaattaaatatttctactataccagctgatcctcattctccagttatattatgtaatgatattacatcacctcattgtattatttggtcaacattattagcatcactggcggttcctgggatattaaacccggtagtattaatgatgaaaaatcctataaatggaaaagttattccattttctttaggtagtaaatggcgtgatggatcattaagaacagatatccccattgaagcattaaatacttattataatgttaatttcaccattgtttctcaagttaatcctcatatttcattatttttctttgcaccaaagggaaccgttggtagacccgtcacttcatccacaaggaaaactcgatcaaaacaacaatatgcatcatttagaggaggatttattgctacagcattagaacaattattaagattagaaattaaaaaatggttacaaattattaaatcattagatttattacctcattttttacaacaagattggctgaatatttggttacaaaattttactggtactataaccatttggcccaaaaataaattaagtggtttttggtatatattgagtgatccaacagaatttagaatgaaagaaattattgaaaagggagaaaaatgtatgtttccaagattattatttataaaacatcgagcatcaattgaaaatgttattgaaaaggggaaaaaattgacattaacaaaatataaacaattaaaaagtgggggagttaattatgatgaagatgtcgatgtcgatatcgatgatgaggaagaagaaggagaatttgggggtgttgttagtgattatgatgctcaatcatttcaaaaagttgttggatggagtaatgaagataagaaattattagatgaacttgataatgaagatgaggaggaggaggatgaagaagaagaagaggttgatgttgatgatgatgatgatgatgatgatgatgacgattcttga

SEQ ID NO: 2565 - DNA, 1803 bp, Candida albicans
  unsure (1): Identity of nucleotide sequences at the above locations are unknown.
naaaaaggacccaatgtgttcgccaaagaaagtgaacaggtaaactcagatctattacaagttgcattgaactttcaaaatgatttgcgtaaggagatcaaatacaaattactgatagaacaaagaattcaattcaagaacattgaaattgccaaaactgccagtagcttgaataaaaccattttagaaaggaagaaaaaactacataaatgcatactgaattcgaaaaacgatcatattgattctaatatgattgattctgaagtaaaccaattacttaaaacagctagtgagacaagtcataaagtgaaaagtttgataagtaggttaactgatttggataagaaattgcgtggggagaacaaagataatttggttatggtgaggaaggaaatttatcccaacttgtatcgattaatgaataagcaggaaatacaagaagatgaggttcaggatgttgaaacacacgatgttacagcaccttacgagagctattttgactcgagtcttgtttccaccggcagaagaaacaattttatacaggattccttaaatgaaattaattcaagtgttgatactgacacttctggcgtacttaccacccaagaagggcagccagaaataatacccacaacaaactcactggttctattaaattcattacattcaatttcgaatttgaatcaagatgaggaagacaaggacaataactctaaagacatcactgaagaggaatatcttgatccagtacaattcgaatcatttatgaaatcgagtatagcaaagtatcgaaagtcacaaaacaaaaaacatcttgatccgttcaagaacatcactacgagtgaaaccaattcagagcccaaaaatcaagcatctaacccattaacattgttatattcacaacttatatccaatcccaagtacattgattcacaaagaaatggacaatatccattttccaatattgtaacgattaaatcatcagctactactaaactgactgaactgatttcacatcacaagaagttgcgtattaatggggcacctatcacttcagagagtctacgaaggaataaggagaaatgcaaatgttccatagctgatatggaagcttcgaacaaaacacttgaggatgcattattggaacagttgaatatcagtgaccatgacttggatggtgatgaggtttggaacagttcagaattaaactccgaggaagacgattataacgaggaaaataccgtggatgaacttctttcgtccgaatcatctgatctggactcatcgtctatagatgaatactctccaatcaattcgactaaccaatattataataacttcaagtcagatttaaaacagaagaaaagggataaactatccaaaagaaaaaccacaacaagtaagagaaagaataggcggtccatatcattagatacaagggagttatctcctactccaaaacatgtgccgtcgcatcgaattttgaaaccgaaaaggtcgattttgaaatctaactccaataacacccaaagattctcaaaggaaaattcaccattccgaaaagctggttttgttactgatcaattggatgatatactatctgaagaagtgagtgctttatcagaagtaaataatgcatatggttctaaaacagataacaagacaaccaatttaactgtccaaggaacaattattcctttcaaaaatacgaaccccaatgatgaagacagcgagcaggatactacgaaagagggtattaagcacatgaactcgttgtcacttctcagaacgtatgtgctgtga

SEQ ID NO: 2566 - DNA, 1308 bp, Candida albicans
  unsure (5),(8),(14),(15),(20),(1010): Identity of nucleotide sequences at the above locations are unknown.
gtttnttngggcanntggcnaattcgtaatgcacaagcattaggattacaccgaaaatttataaatgaatcatttagagatcacaattataggactcatcgaagaaggttatttaaatccttatatatgttagaccgtattaattctgtattacttggtcgtccattgatcattgatgattatgattgggatgatttcgatagtgaagatatttacgatcttgatgctgaaggaaacccaataaaagatccacgatttgaatgcataatacaagcgtgcaaaatatcaaaattagctgggaaggtgatacgaaactattatttagatggaataatcaatgcctataaagcagaaaaattggcaatagaattgaagttgtggtcactcagtttacctgaaccgcttcaaattgataaaatctttaggccagaaacagtcaataaaatgccattattaactatgcacttgtcacaattatattcaattgtattattatgtcgaccatttttcatgtttgttatattgaataaaaaacacaaaaagcattccaccaagaaagctaatggagaaaatttacaaaagagacccaaaacaagattagaaacgtcaatgtgtaatttttgcaaggcaaccaccaagtcatctactttgattattcagatggttgaaaattacataatctcaactaataggttgaagtcagcaagagcagaactgaatgggttgatacatacttgtttaatggctagtttaattgttggcttatcgattttatttcttgaaagtaatggatatagtattgatgatggatactcatcgagtcagttaatgaaatatttgaattcatcaaaacagattttcaaatttttcgatagactgaaaaatgcattatcaatgaaatttcataatataattgaacaaatgcaattagcattgatgaataaattcaatcttgattacaatggtgataaaattattaattctcaggagagtcaaaaccaaccaagacnacatggacatgatacattaccacaagcacaacaagcaacaccagcggtaccaccaccaccgccacatcaacaaacacaacctagtaacaacatgacagcaaatatgaacttcaattataataacaatgattacgccactatgaaagcggaaatgttaacaaaccaacaaacttcatctaatgaagattatgataaatttattgatacatttggtaatttgcccaactttgattcttctaatcataattatggctacaaatctaattcaagaaataattcccatcaatatcaaaactaa

SEQ ID NO: 2567 - DNA, 609 bp, Candida albicans
  unsure (609): Identity of nucleotide sequences at the above locations are unknown.
agacgacaatggtcaaatgaagtaggtggggttagatggaaagttgatggtgattatattgcatcgatttctactctagaagcagccttaagtgctgttaaattatatgaacagaataaagacgactctttattgtcatttgctaagaaatgtctttcatggttagatgataatttattagataaactggatggattttattatgatggattgaatgttaataataaaactaatattgataaagggaaattaacttatactgttggagtagcaatttcaacttattcttatctttacaagtacaccaatgatgaacaatatgttttgatagctactgccaaagctaatggaacattaacttcaaaaacatttttgaatcacaatggatattggaataatggattaagatatgttcatttattatttgatggatttagtgatttgataaccatttgtgataaacggggatttatagatagcgtttggaaacagggccaatatatttatgaaaatgatcaattgccacgagggaataatgttggtaattatcttgatttatcaaaaccaattgaatcacatttaacttcttcattccacaagatagaaaan

SEQ ID NO: 2568 - DNA, 471 bp, Candida albicans
gagggaaaacaaatatctgaagatttagcaaaagctggtattaatcgtggagtgtttttttatgatagagattttgataattcaaaacgttattggcgtgatagttcttatttcgttcaattattaattgaaggattggcagattatttattatatgttggtaatgatgtccccgatgaattagtgggtaaaattcaagaagaaattaaacgacatttaataattttttatgaatttatgaaagatcctaaagatggaatgtatattcaaagttttgagcctcataacacttatcgtgaagtttatgatcaaaaatataagaatttttttggtgatggtaaaggatgggggttaaaaggtgaagataaagatgaaaatggtaatccactgaaatgtttaatgggttatgctgctgctgcaagagtattcttccaaggtgctcgtgttgttcctcacatcgactcctattaa

SEQ ID NO: 2569 - DNA, 306 bp, Candida albicans
tgggttttcattgaagcttatgaattaactaataatacaaaatatttaactactgctaataaattaatggaattgattcaaggacaatggtcagataaagttggtggagttaaatggcaagttgatggagattatattgcatcgatttctaccgttgaagcagcattatgtgcggttcaattatatgaacagaataaagacgactctttattgtcatttgctaagaaatgtctttcatggttagatgataatttattagatccactggatggattttattatgatggattgaatgttaataattaa

SEQ ID NO: 2570 - DNA, 1371 bp, Candida albicans
ttgagggtgggtgttggcaccacagcaatgcacggttttggaatattggtgttgattctaccattgtgtttgagtgcaccagctaatgtgcgtacagttgttgttactgcgcccgtcgagatagtaacagtaacgcaagtgggaacacagatatacagtgccactagcttagaggccccaacatctagtttagctgaaagttttacctccagtgcaaagacaaccagtttagaatccagtgtatcaaccagtttatccaccagttcgtccagcagtgtgcctacccctggcaactcatactataataccatgtttaaagtctggcaaaggttttggggagacggaaagtggaatgataacgactccaactgtaatgacggctacacgttacctgttttgtggacaatggcagtgttgggagaggcgattgtcaaaaccggcgatgtttctggtgttgaagtgacattagatagaataatgcagtattatgattcagctaccaaagcgtttctggcgtcgccaaacgatggtgttgaggtttattccgacgacattgcgcagcttgcttgggtgtttattgatgcgtttaagatgactggccaacaaaagtatttggaccatgctaaagatattgtgttgtatatccagacgcaacagggtcctaatggtgggattatctggaagaaagataagaattatattgcgtcgatttcgacagtcgaagctgctttggctgcagttaggttgtacgatataacccgcgacaactcgttgcttgaatttgcaactgattgtatggattttatgtttaagaatttgcaggacccccaggacaagttattttttgatggaacagataagaacgatttgggtcaggtggataaggggaagttgacgtatacgattgggtgttctattagcacgcttgtgtatttgcacaaattcaggggtgaccaggatatgttggacaaggcgttagagttggcgctggcagccaccaaccctggtggtgcattctacgatgggaacgggaactggaacaataacttagagtatgttcatctcttgtttgcagggtttgcagatgcatttaggttgagtgacctgtttggacagtatagggatgaagtggttaagcaagggaattatatctaccagtacttgcaagaccccaaggacctgtcgttgtactttactctgattgcagcatctacacgttctacgtttgaccgctatagcaagctgtttagaggcagttttgatgacgatgactcagtgtactgtaacaacgatccatcgcaacatgccaagaagaagttgttagtaaatgctagtgctgtacaaattttatattttatggccaactactaa

SEQ ID NO: 2571 - DNA, 1623 bp, Candida albicans
atgatctttaaacgatacctattcaaaggaaaaccgaaaccaaaatttatagaaaaaactgaattccatcatgagtattccataagacccgatacatttgcatttaaagtaccatctacgacgaaaaaactcaatccattacaatcaatctatcgttatgcaacaaattttccatttgatcaaacaccagacacggtttataattcgtatcccatgacaaattcaacaaaactagctagacttagccatcgaccttctcgagtgaaaatgaccacaggtgatttcattgaagattcattatatcatccgaagtatgggtatttttcacaacaagtggaaatctttcaaccagaaaaaccgtttgattataataatattgaagatattgacgaatttatggatacctggcataaatcatatgaaagatacgacgtgataacacctccggcgttgccagcgcccaactcttcttcaaaatttgcttccatggcgcatgcaatccaacaacaagatagtcaagttgctcctaaatatagaaaatcgttacaattatggcatacaccgactgaattgtttcatccgtattatggagaagctttggcaagatacattcttgttaattataagctaaatgtttatccttataacgatttaataatctatgaaatgggcggtggtaacgggactttgatgtgtgatatattgaattacatacgaaaacatcaacctgaaatttacgaaaaaacgcaatataaaattattgaaatttcaagtcagttggccagtaagcaaatgaaaaatgcattggataacaaattgacttctcagggattagattcttctaaattggaaattttcaataaatcgatatttgaatggaaaaaagttgttgatgatccttgttttttcatagcattggaagtgtttgacaatttttctcatgacttaatacgatacgataacgactctggtaaaccatacgaagggaaagtggttattgatgaaaacggcgatttttttgagtttttcacacctgaattgagttattactccaatgcatatttgaatttaagagaaaatagtaaatattcggtcttgaaacaatcttcaagtgttggtgggtacttgtcagcgttgaaaagtttctatagtgatgatgttcacccattattacattcatcggccaaattgaaattgaaaaacacgatattgccatacgatagtaatttgacaccaggagaattcatccctactagattattacaatttttccagattttaaagcatcgattccctaaccactccttgatttcgtcagatttcaattatttgccaaaaaccattcctggttgtttcaatggtcctgtagtacagacagttttacagaatcgaatggtcgacgtatcaacttatatggttcaccaaggatactttgatatcatgtttgctactgactttaacatagcaagcgaaatgtacaaacaggtcacatcaagagttcctcgagtggaattgcaccatgatttcctcgaacagtgggctgacaccgacataaccactacaaaaacaggagagaatccaatgttggatttttatagaaatgttagttttatggtaagttaa

SEQ ID NO: 2572 - DNA, 660 bp, Candida albicans
ggcacgacaatgctgttccatagggctttagacactttcaattgtattaactcacagttgaatttgtttcaaatcggaatacaatgcacgtgtgctatcttgattttagtgttggttctctcagttacgaaagattcaatcaaacaggacaaagacgaatacaaaaggattgaacgtgtgggacgatttgtagctgctcatgcagcagtgtcactcttagagattgcacttgggttttctaccaattctgcagttttatatactattgccaatgtgaatggtttaatgtcggctttgcttactgtgattaaatatgtacctcagatttacaccacctttagacttaagcatccaggaacattgtcaattggaatgatgtgtatacaaacccctggtgggtttgttttcactgctacgctattctttacaaaggggtctcattggagctcatgggtatcgtatttggttgcagctttattacaggggacgttactatccctttgtatttattacgtgtactttcaaggtcgacatgttggtgaagaatctgctgaagagttggagcgagaggcaatagaaaggatcgtcagtgaaaacagacatgaagaattagatcataactcagaagttagggatccggaaagagaacaacttttatag

SEQ ID NO: 2573 - DNA, 867 bp, Candida albicans
acgtcgatgagtagtagtagcactaataacaccaataacaacaacacatcagcacttaaccttcaagctgaacttctagagtttcaaaatctgaaatatccaaccattcaagaaacaatcaccaataatgcttcaattttatataaacgaaagaaatttttccttattgaattacgagaatcaattcaatttcttgaatgttttttaattgtattaatatatctacgagatttatcatttttaaaattattaatccgttcaactattcatttatcaattataaatataaatcctccattactgtttaaattacaattacaattactggatgattataaaaaatcattagtgaaaatatcattacgaggattaattattggtaatttattttgtttattaactcatttaatctttggtatatatcgagaaagtcctagtggtgacggttatttacatggtggaataactatacaatttattggtgatcgattaccttattcacgatttgaattgattatattggatctattggttttttttatacaattggttttccatagtcttattggtgtcattgatgattctgaagtattacaagtgactccaacacaacacggtaacggcaacaatgatgcaagcatggtggaggaacaattagatggtacgtctggattagatagagttcatattgaggaagatggatataatgggaatgtctatttattgacaatagatatactaggtaatattaaaaaagtgtttgattatcaaatcaatttacaaccaccatcaggagggagatcagatctggaagcaaatcaaacacaaatgcctggtgcattccctggtgcaagtttttccctataa

SEQ ID NO: 2574 - DNA, 2388 bp, Candida albicans
  unsure (2034): Identity of nucleotide sequences at the above locations are unknown.
gttcctacagtgtataaataccattcaatagtccagttagattattttacctttgtttcggaattcccgtctgataagaatacgatacctattcttctaactatgttgtcagatttcaaacaacagcagcaacaaaagcatcattcacataatccaccaaatagtcatgacgatactcagactaaattgcaagttgccaaattgactcaagtgattcagaagtttttcaccaaggcagcacaaatcattctagaatcaagagcgtatccagaaactacaacgccttcattatatcccactaaggaagagtcaagtaaaataaataaatggtttaacctttacatgaccaatataccagatctgtgcaaagatgatttgaagttgtggaaaggagttgacttaaccagtattccaccaatgattatagaaacctatattgatttgagaagcttgccagccgatcaaactttagttttgatggatgatgaaagacatcgttggacagtggcaaaatcacgtggcaaaaagcaagaagtcgttctagagagatggttaattgaatttgaaccaaacactacagacgccaccgtgatggttgaagaactacctttgagctataaacaggcaatagtgctctttagaagcatatatgggtttacaagattgatgccagcattcaaagtgaaaaagaatttacagaacaaattgcccttgggaaataaaatattagatggtaatcaaccaattagctccaaaggtagaattggattatctaaacctattatcaataccagaactaatgagtctcatatgacacagaaatattttcaaccagtacatacaagtctcgggacattaaaaatatcggtagcttatagaatggaatccgatttttgtctacatgaaaatggagagttactactgtcccatttccataagcgtgatgaagaagaaccgaaaaagaaagtgtcatcttcagtttctcttctttcttcgggtacaagcttaaaagaaacctcaatttcaccaaggaatcacagccttcccatcggtatacagccatttaaagttggatcgatgagtacatcgccaccagtgcaatcaccatcaatttcacaaccaggaacagcaccaattcaaaatcaaccaagtgtcccgtcgtcttcattagaaagaagagtatcgatcactagtaacaaatcaacttctaatgcatcattagcggcatttttacgtaatgccagaagtagtactccgtcagcaaataatattcccataatcaatgcaaatcccatttctggtacgtctgttccacggtcttttagttcgtctacgggtcatgaggattccatttttgtcaatcctgatagtgctagtaacactcctcgatttgcatcgtcatttggttcacgcgcaagcagacggtatagtagtaccagtatcagacaacaaactccccaatccgatttaatgggtcaaaccaatagtgttgatgcggctttgagtggaatagatgctgatgatgacataagtgactttgtccgtatgattgatagtaaatcagatttgagattaggcggtggcggtggtggtggaaacagcagtgttcacaatatgagtatcaatgaatcatcatatcatggggatgcgttaaataaatgtcaatcattgcgcagtcagtatcaacaattgagtgatagtgtcagtgctagtttgattttgcaatcacgtcattctagtaggaaaagttctttgaattcacctgccggatcatttgatctgcatcatcaccaacatcaacaacaacaacaacaacaacagaatcaacaacaatctcaatcaccacacactaatacaacatcatctattcattctcacgcacattcttattcccattctcggatgaaggatgcaagacctagaagtgaagaccatcaacaaactaaattttccgcagcaagaagaagttcaaatatttcacccactacagcagtaccaagttcaattggtacaccatcactgataagttcaagnatacctcatgtaactacaattatctcatctagtgatgtgagcagcactggaggtaatcgtacgaaaagtgctgccacaacagccattgttagtggtatggccacttcgcttcccatatatgactatcgatcacctcgttaccagaatgtttttgatgacgatgacgaggatgataatgacgaagaagaaggcgatcgtgaaggtaatcaatcacacgagggcagaaatagtacagaaagtagtcaaaatcaatcaaaacgtataatgacacatattaaaaaagatgaagaggatagtgaagatgacgaagatttgttgtttactatgagtgatatgaattcaaggaatttttga

SEQ ID NO: 2575 - DNA, 1494 bp, Candida albicans
cactccataatgaagtttgccaagacattagagcgaaccttagaggaagacgagattccacaagaatgggtcgaggcagccattcaatataaagcattgaagaaatgtatcaataaggttgtaaacgaactagaatttttgggattacagaaaaacactttgaaaatattgttaaatgataaagtggtggaagtgaacgaacaggaaactaatcctagcaatcctattattgcagaatatatattaagcaagacctcaacagatgcccataacataaaaccaatgctaaagattactttggactattctagtgaagattatacgaaggatcacatagtagagttgggaaaggagttgaaacagaaaattgaggctttattgaatgatagtgatactgaatacgaagaagataagattattgaattgaaagaagatgacggaggtgatttgcaaattgtaaccagtagagaaggctcgttatcaccaccagcatcacgcatggcttctcctcctacttctccaactttaaaagttgttgatagtttaaacactaacattgatgaagcactattatcccctgatgatcaccataaaaagcacgaaatattcatcatgttaaattccgactccaagtttttcgagatgttaaacgatgagctcaacagtttagatacattaacgcaactggaggaatcaaagataattgaggaggttaaaaaaatagccaagtatgtcaatgaattaaagttaaaacagtcagaactatacaaatggagagagctattcaaagtgtatctcgattctgaagtttatttcaaatataatgaaactgctttaccctctcagcagaaaagtagcgaacaaatcaagctgaacttggatttatttgtaaccaacttgaataaatcaggtatcatgacccggtttaagaaaaagcaaagtttggaaacattcaatcaattcatggaaatgaactatcatttgttaaagatattgcaatttcaaacaatcaacaacgaagctttacgaaagattttgaaaaaattcgataagcagacttcattaggaattcaaaaaactttcccaaaattgatttctaacgatcatattttcatgagtgggtcttctttagctcaatcaatttgttatattattcaagaatcagtcattaaagtgataccacagttggatgattattcgtgtccgatctgtatgaacatagcgtataaaccaattcgtttgtcttgtggacatttgttttgtgttcgatgcttagtcaaaatgaaacaagatgataagacaagttgtcccttgtgtagaaaagaaaatgctatattgtatgctgatagttctaatttggacttggagtcaatggaattaatgaagaagtacttcccacgtgaggttaaagagaaattacgagagagggacaaagaaagatacaatgaattaagaaagaatgctaattcaggtgagaaatgtattgtcatgtag

SEQ ID NO: 2576 - DNA, 492 bp, Candida albicans
aatccttttgttgctgacattaataatccacaacaaaccaagtatacaatgtcgaatcaaccttcaagaacaatagtacaggaaaataacgttctacgtttgaagcccggatccgaaccaactccatcatcatcgaatcaacaaccaccacaacaagagcaacaacaagaaactacatcaacaaagaagaagaagaagaagaaggcaccaaaagtcagatggacagaaggcacagttgataacgagcatatgaacaagaagaaaaccaaaatatgttgtatattccatccacagcggtcatttgacgaagaggttgaagacgacaaacataatcatagttgttcgagttccgatgaaagtagtgattcctcagataacgaaggcgataaagatgaagacgagtctagacctagcaatggcatacccaaaccaaatgcttatgagtatcagccacattatgagaaccgatcaaaacttcctgaacaaggataa

SEQ ID NO: 2577 - DNA, 933 bp, Candida albicans
caaaagagtttcagtaaccaagatttaggagttcaaccagaacatttgggattaaaacatcatacaaattccgaaattgaagttagtggaagttggattgataaacaaatccatattttaggagccaaattccggttctctagtgctatgtgtcaaatagtgttacttgcctttgtggtgtttttgaccccaggtatgttcaatgccctttctgggattggtgcagctattagtgataaaaaaactgctgatcttgctaatacagcattatatgttacattttcaactgttgggtttttcgctggtactatttgtaatgttattggtgtcaaaatgtcgttggtgtttggtgggtttgggtatgctatttatgccggctcgttgttgtcattcaatcataatgaaaataaaggatttgttatatttgctggtgcatttttagggttctgtgcctctcttttatgggcagctcaaggaaccattataatgtcatatccaactgaacaaaccaaaggtagagccattatggtattttgggtcatcttcaatttgggtgcagtcattggttcaattatcccattagcagaaaacatgcacaaccaaggttcatctgctagtgatgggacttttattgcttttattatcttgatgatttgtggatcagtattggctaatttcatgttaccaatttctaaagtatggaaatcagatggtactagagtaatgactaaaactcacccttactggaaagacgaattgattggattaggtagaacattaattaaagaaccaaaaatcttgttaatgttccccatgtttttcgcttccaattggttttatacttatcaattcaataatgtcaattatggtcgtttcaatttaagaacaagatcgttaaattcattgttagatcggggaccacaaatgtttgta

SEQ ID NO: 2578 - DNA, 555 bp, Candida albicans
cttgatttcaagaaatttaaacgttcaactcgtgccaaaattggttgggctatattatttgtcactagtttagccatttggggtggtggtttaaaattccaaatgagtttcactcgtgaagaagtcgaatcaaaaccaccaaagatctctcaattggatttcaaagatggtgcttatatcggtccaatgttcctttacatattttacggtgtttttgatgctattttccaaacttatacaatttgggtattgggagccatgtccaataatccgaaaaagactgctctttacgctgggttttacaaaggtattcaatctgctggggctgctattgcttggagattggattctcttgaagttaaatatatgagcttgtttgcatcttcatggggattggtacaaggttctttagtattggctattccgttaatattttttatgattaaagaccatactgctttggaagatgataatatgggagaagttgtcgatgatgctgagttagatgtagtcgaatcaacaacagtacttgtcaccagccgtgaagatcatcgt

SEQ ID NO: 2579 - DNA, 234 bp, Candida albicans
ccaacattgtggttatatggtgataaagattggatgaatgatgaagctggattagaaatgactaatgagataaacgatttatcaatcaaggaaaattccgaaaaacttgccagtttccatatcatatcgaatgctggacaccatctttaccttgacaatccaccggaatttgctaaaactgtatttcaatttttaaagtttaagaaagcgaaagtatcaaggatgtatagatag

SEQ ID NO: 2580 - DNA, 639 bp, Candida albicans
agacaagagatcgaggtagacctcaccaagactataccttcgttacgtaacaaacaatttatcaaaaactataacatatcggacgaagaagagaagcatatgaagaaattgttttggcttaggaattccattttggaaaacttagtggggtcttggaaattgggcaggcgtcatggagtaattgatttacgtccaatcaggttgaccacaaaaatggcaaatatcttgtcctatgaaaacatccaggttcacaacactgtgcttacagatgatgatttgcaagtggattccattggaaaatcttataatttatcaactgaccaattttacgtgctcaaaacgactataatcaaccattcaaaaaagccaattaatggaatagtgcgtcaattaccatttccaatacataatactcctacaaagagtagtagtctgcgtcctcaactttctatcgataagaaaatgctcgtcaacggtactttacagaataaatttccagaaattgcacctggagatcaactagtattagaaaccagttttgtcattattcaaaacggtgagtttgaatggggtacagtagtagatttgttcagtgataaaataatttgtagagaacaactttacattacagcaaattaa

SEQ ID NO: 2581 - DNA, 1806 bp, Candida albicans
  unsure (1193),(1197): Identity of nucleotide sequences at the above locations are unknown.
agtatcttgttcaattgggaattttggcttagttgcaactatatgatgatcaattattgtgatcatgtacaaagcttgttacgaaattttgcatttttattcaatacttgggatttaatccctgacactttatcatcgtttgtcactatcaatgaaaatggtgataatgatgatgataagaaaaatacgaagcgactgacacaagaaagtttgaaatggataaccgaaacagaatgctctttcaaactcaattttgttaattttttaattagtgatgaagtttttgaaaggtttttcactcattggaatccaatggttagatcgtattatattaaactattaatatggagaatcattggtattaataattatcaatcgtcgaccctgatacaagtttcaagaaatgttcaattcaagttgaatcgtgcctttgagatgttgagtagatttactatgacatataatggaaaaatcgaattaaactacaaacctgataatccattggtcaataggaaatttggggttgtgccaataaatattaaagatgattatttatctattgatgaaagatcaaatgatatttatattccaacagcgacatcattaaaaccatcagagttgaaaaagacccatccatatgaagtatttgatgaggcaatctatacatgttccaactcagcactgactaatgggactcgatctgatcctactacaccaagaggtggtagtactgacttgttgcctaacaaacccaatggccgcattggtagtaacaattcattggttaattcacttggtagattattcaaaatcttatccactgatgataatgataacaccactaaagccactaccattactaacaacaaaagaaaactgcaattgaatgatattcaagagaatgtgacttctgatttaactgacatggcaacagtaaatcgagtgaaaagaaattcaatatcgttgacttccttgtccactacatattcattcaaatcaaggtcatcaagtcccagcgtgatgtcatatagatctactccaacatcattaactgaatcatcggcatctactgatgatgaatcggtgtattcgatggacactcttaaaacaaaatcttcatcagcatcaacggcttcatcatcatcatcatcagcattgtttccaaattcatataatataccaccaccagaatngtcnagattaccaccagaaatcattcgtccaatttataaatttgatgttatagtttgtcatgattctttgaatgaaaaatttgccatgattcatacaaagaatactttaatttctcgaggaattgttaataataacaataatgctggttctacgatgtatatgtctaaaagtcctgtgacaagttatttcccattatcaccacaaatcccatttatatcaatatttgtcaattcagatacttttaaaaatagaatttatatgaatgaagaagatggattgtttttagaaacagaatttgatacatattatcgggataataatatgaatgaaaataatgaaagtttccaaaatgccacttttgcacagatgatgaatttagggaaatcattaaatgaatttaatttaatggttgaagaattcaaacaatttttaagtaatcgagttgaaattgattctatgaattatagtgagactgatgaaaattcgatatttaaacagcaaccaccacaaatacaacaactgtatggtcattatattcaacaacaacgtggtaatgataattcagataaggttatcttcaccacccggctagaaggtcccgaacttggcgtt

SEQ ID NO: 2582 - DNA, 1590 bp, Candida albicans
cgtggaacaaatgccgacaatcaagagcttcaccaagcacccaatgattttcttcatgatatggatggtgactacattgcaccgccaaaacaagttcaagctggggttttgtcgtcgttgttaagattataccaaaatccgcaagaacaaaaatcggccagctcgttgagtagagtcagtactggtactagtggcacagcattatcatcatttgatgatagttacgattcagatgactataaggattccaagagttccctgaatgtcgacttgcaacacaaattaaaactgggaataaaaggtggttccaaggctatgttcaataaagcagctaataaactcaaacaccactcgcatactcgtacaaacacagttgaaactcaaggttcatcaaacctggaagagttttccaacgacaaggatgaattttctaatggctatgacgatgacaataaaatgaatgccaatttaccatcattccaaaatgcacgcccaaaaatgcccaagaaaaagacaacagaaccagtacaaaagttgaaaaaattgagacataaacaacgtgcggaaagattgagaatcactgttcatattgccgacatattgcaacgtcaacgatttattatgaatatgtgtcgtgcgttgatgttgtttggagcaccaacacatcgtttagaagagtatatggttatgacgtcaagagtgttggagattgacggacaatttatttatttccctggatgtatgttagtctcgtttggtgatgcagccacaagaacttctgaagtgcatttagtcaggtgtgcccaaggaatcaatttatccaagttggccgacactcataagatttataaagcggtgattcatgatttgattggggttgaagacgcttccaaaaagcttgatgacttattgaaaagcaaaagtagatacccaccatggttgtgtgttttgttttatgggttgggctcattagctgtgacaccatttgcatttgaaggtggatggttagacttacctatatcatttggtgttgggttatgtgttggatatttgcaattttatgtttcatctatatccaatttgtattcttcagtgtttgaagtttcagcagccattgtagtggctttcattgctcgaggaattggatcgatcaaaggtggagatttattttgtttcctggccattgctcaaggttcattggcgattatcttgcccggttacatcattttgtgtggatcgctagaattacagtcaagaaatttggtggcaggggcggttcgaatgttctatgccgttatttattcgttattcttagggtttggtattactttgggtgcagcattatatggatggattgatcacaatgccacttcggccaattcttgtgcactgggtcacgccattgacgagaagtggagaattttgtttgtcccgatgtttgccttatgtttagggttaatcaaccaagctcgatggagtcaggtaccaattatgattgttattgctggtattggttatatcgggtcattttttgccgggaagcatttttctacagtgactgtcttcaccacgggctggaaggaaccgcaa

SEQ ID NO: 2583 - DNA, 603 bp, Candida albicans
tttttttttttttgcttttctggaaatattcaaaggttagggttaagtatcaacaaaccacaaggattgtacaattacccccgtccaatttggattgataattccttttttttttccctatatcacaatatgtcatcaaaactccctagagcaactctagctcagaaattgcaaataatagattattatcataaatcagataggccacaactggaaacagtcgataaatttaagaatgaggtttcaatttcgacatcttcatttagtgaatggttaagaaatgaaccagaattaaggaaaagatacaatcaagcagatttcaagttctctaaaaacagcaaaagaaaagtgaaattcaaatatggagaaataaataaggcaatggataaattggtgactgggatgatagaaaggaacgaccctattactgaaccaatactaagacaacattgggcagtatatgcgcatcagtttggagttgatgatccaaagaggttacacagttttagtcatggttggcttagtcagtttaaaaaacgacatggaatcaatacgaagtcaaaaaatgttcctcatcttgaccaaggcgctggaaaatccgcg

SEQ ID NO: 2584 - DNA, 408 bp, Candida albicans
aatttcaatttgaacaacatgcccgcaaaaggtcctaatattataccaaaacaggcaccgtctcccattgcaatagcaggatcaccaccttcatcatctgcatcaacaccaagaagtgcagccagtccaccagtcagtgtgaatacaaaatcatctctcaacacaaacagcaatacgataatgccacgtcaagtgatgtcgatccaaacttcaaaagaatgggttcttccaccaagaccaaaacctggaagaaaaccaagtgttgatactccagcgtcgaaaagaaaagctcaaaatagagctgcacagagagcctttagagagagaagagcaaccagagtacaagaattggaacaaaaactaatggaatcttcaccacgggcgctggaaggacccacgctcggccac

SEQ ID NO: 2585 - DNA, 591 bp, Candida albicans
aaaaccttagatcgaaagcctgcgaagagagaagaggcaaatttgaaaaaaaaaaaaatagaattaaaagaaagtagcacgaagtcaacgacatcagaaccagcaacccaggcagcgctaaaacgaatatccaagaaagcgatgtcaaagagtagaactgttactggatccttggatcaaaaaatctacaatttaatccatgatttacttcaggagcagacagaagaaaacaagagagcagctaccgcagacgaagagcatgatccattttcgtgcatggcttcatctcataatctcactgtttcccaggtgttggcttacgtacagatgaaagattttcaattgaaaagaatgaagaagaattaccttgaaaagtcgatagcagccagtttaaaagtaattcgtcaagatgagacagaagagttcggagatcgtgagaatggcatcggagatgaatcagaagctgagaatgatagagagtgtgagaatgacttgatggaggtccaagacctgaatgcgataaacaagtccgttgtttctttatggaatcaggaaaagactgatggtgaatctgatggtggtaaacaatga

SEQ ID NO: 2586 - DNA, 819 bp, Candida albicans
cgttggtccttccatcccgcgtgtgtgaagacaattgccagtgaatccgttttgaccggaaccacttcagctgatgtatctggtgccactacgattggcagtgaatcaatttttactggtactactgaatcaacaggtacacctcttccaactgccagtggcacagaatcattagatactactgttgcaactggtacgtctgtgtctgaacaaagtggagttgaaactgcattgtctacacaaccaacaacaggtactgaagctacagttacaagtggtgtttctcaaagtgaacaaaccggaacttcagctgtcactggtgttacagaatcatctgaacaaatccaaagtggtgctactactcctgctactactactgcaagtgacgcaacagctgttaccaatgctagtgaagcttcagcagaatctcaagctacaactacagctgctagtgaagctactactggctcacaagtcacaactgctgctagtgaagctgccacagaatcacaagccacaacagctgctagcgaggctgccacagaatcacaagccacaacagctgctagtgaggctgccacagaatcacaagctactacacctgctagtgaacctgctactggttctcaagttacaagtgaagtaacccctgctacagttccttcatcggtgactgctgcacacactgctgccacttcaataattacatctccaccagcatcagctgagccatcaagtgaagttaccgcagttgctccttcaacagcaaccacatcaagtactaagaattggttgccatcactggtgggttattgctga

SEQ ID NO: 2587 - DNA, 291 bp, Candida albicans
ttgtctcctgtgaatgatatcaatgatgcttgttgtgaagaatatagggattatcacgattgccaacgtggtgcaatgtgtaattacatgcatgtaagactaccatcgagtgatattgaagagtcactatatgaatctcaggcaaaaagttacatgttgaagcaattggaagagctaaaaaaagagcttccgggtgatataagatcttcttcaagtaccaatgatgatgaaaccaatggaaacgaaaatggaatttcttcaactatggctgtgcttgaacagttgtcatga

SEQ ID NO: 2588 - DNA, 891 bp, Candida albicans
  unsure (858): Identity of nucleotide sequences at the above locations are unknown.
ttattattgaaattatacagttacaggaaacaaccaacattagcaatccaaatgcctactaaaagaactttgctgctgaatgaagtagaattattatatgtcaaatcaaaagtatgtttacatccatcaccatccaaaaaagataacattgctgggtttttaacactttcaagaccaccaagagcaacaaatttagaaatattattatcgtatgtcccagaatcacaattatccactgaagaattgaaaatttatcaacaagttgatgttgaagatttagatttgaatttaggttcagtcaataatattaatcatgatcatcataaacaaaacaaggcgtcaacttcaagaattgtttctaaacctagtcaatcggtattaactggttatgcatttaatgttcaattgtcatttatttattcaattcaatttagaactccatcgcatggatattggtatggatcaatcgtattaaatcttcaagatggggaaaaactaccaatattgtttttccatgataatgaaagtccgctgagtttaaaatctcaaaaattacagaatcaaagatttgatccatttggtaatgatggagaattatattggggtggattagattttttgaaagtattacaacaattaatcaatgttcaacgttcaacgattgaactatcggtgtatctagtcaatcctgaatcaaatgatttacggaattttgccccctttaaagaaaaacaaaaagtaccagaaccatctcaagaaccatttaaattacctgatgtcgccaaatttttcaatactgctaaatggaaggttttatcaacagtagatacattgtctgccaagactgagcatcaagtnttgttcacgagcgacatgttccgagtaacgtaa

SEQ ID NO: 2589 - DNA, 936 bp, Candida albicans
acacgtataaaaaccatggcatcaaaatacaccccagctacattgaacacagttcatatctcatcatccgttttgttgtcattattaagacacacttctgaacattacccacaattattttctggtgcattattaggatttgaagatgaaagtttaatagatgtgactcatggattcccatacccataccctgatcaatatgaaggtggatcctttagatcaagaattgggggtcattaccaaaaagatttgttagaaaatttcaaaaaattaggctatggtatcgaatttttgggatggtttcaatctacagtatcagggaactttgtcaccaaccaattaattgaaggtttggctcaacaacaattaatcaactccaatgcatttattttgattaacaacttatcaagtgttggacaagaagtatccatcaaggcattaagattatctactgggtttatgaatgcctatgtagatgggaaatggaaatcaaaggatttggaatccaacaaaatttcatatttgaatatttttgaagaattgaacttggaaatatctaaccaaaaattggtggatgtgtatttgtcaagcttatcattgaaaccatccactgaatccgaattagatgttctcaatcttttatcaaaccagaacgccactggtcaattgttagaatcattatctggacaagtcgactcattcaactacgatcaaaataatttcaactactaccaaagacaatatcaaaaggaacaatcaaagatacaacaatggaaacaacaaagaaaattggaaaacttggaaagagcaaagaaaggtgaaaaggaattagatacagaagaatggaaaactattttcaaattgccaaatgaaccttcaagatataataatatgttgtacagtaaagctattgattttttacctgatgatatttaa

SEQ ID NO: 2590 - DNA, 624 bp, Candida albicans
gttcccggacagttcgcggctccttccaggcccgtgtgtgaaaaaagaagtttggccagaacaacatcaaacacatcatttagagcaaatttggctgattccattggcagcacacaaatagccaccaactcaaaccactccaacaaacggtcatacataccattcagaagtagtaggcatggtaataaggctagagcagaagtattctccaccccaaaaatacctttatcagcaggatttgatgccaatgatcttgatcaaacaccctcttcaattcagtctacggcaatttcttcaccaacaataagtgttgcgcgcaatgatggagaccatgaacttgcttccaatgcaaatgaaaatgttaccagatttgaaggtatattgggtacaaagaaaaaatccaaaaagggtattagacaaaactctccgaacgagtcaactacaaatatatcaccggacttaacagcaaataacagttttagaaactctcatgtttcttcaattgcctctcccaagggagctgcagctgttattagttctccaatacaggttgtgggatcaaataccgctgttactccaaattctggcaaagaaaagaaaagaatatctcaaaagtttcgctaa

SEQ ID NO: 2591 - DNA, 693 bp, Candida albicans
tatattagattcttatctgtcatagaagatagaagttacaaccaacccacacatactatgttgccaataaaattactaatatttatattgggatatttattatcaccaactttacaacaatatcaacaaattcctcctcgagattatgaaaataaaaattattttttagttgaattaaatactactaattctcaaaaacctttaattgattttatatcccattataggggtcattataattttgaacatcaattatcatcattagataatcattatgttttcagtattgataaatctcatcctcataattcgtttttaggtaatcataattcaaatgaatataatttaatgaaacgacaattaggtcatgaacaagattatgatgaattgatttctcatgttgaatctattcatttattacccatgaaaaaactttctaaaagaatacctgtccccattgaaatggaagatgtggtgtttgataatcgtgatgatactggttctgataatcatgaggcaacagatgaagctcatcaaaaattgatagaaattgctaagaaattagatattcatgatccagaattcactactcaatggcatttaatcaatttaaaatatcctggtcatgatgttaatgtcactggtctttggttagaaaatattttatcttcaccacgggctgagatccacctt

SEQ ID NO: 2592 - DNA, 1155 bp, Candida albicans
tatattagattcttatctgtcatagaagatagaagttacaaccaacccacacatactatgttgccaataaaattactaatatttatattgggatatttattatcaccaactttacaacaatatcaacaaattcctcctcgagattatgaaaataaaaattattttttagttgaattaaatactactaattctcaaaaacctttaattgatttcatatcccattataggggtcattataattttgaacatcaattatcatcattagataatcattatgttttcagtattgataaatctcatcctcataattcgtttttaggtaatcataattcaaatgaatataatttaatgaaacgacaattaggtcatgaacaagattatgatgaattgatttcttatgttgaatctattcatttattacccatgaaaaaactttctaaaagaatacctgtccccattgaaatggaagatgtggtgtttgaaaatcgtgatgatactggttctgataatcatgaggcaacagatgaagctcatcaaaaattgatagaaattgctaagaaattagatattcatgatccagaattcactactcaatggcatttaatcaatttaaaatatcctggtcatgatgttaatgtcactggtctttggttagaagatattttaggtcaaggtatagtcacagcattagttgatgacggagttgatgcagaaagtgatgatattaaacaaaattttaactctgaagggtcatgggattttaataataaaggcaaatctcctttacctcgacttttcgatgattatcatggtactagatgtgctggagaaatagctgctgtgaaaaatgatgtttgtggtattggtgtagcatggaaatcgcaagttagtgggattagaatattatctggccctattacttcatctgatgaagctgaagctatggtatatggattagatactaatgatatttattcatgttcttggggccctactgataatggtaaagtcttatcagaaccagacgtaatagtgaaaaaagccatgattaaaggaattcaagaaggtcgtgataaaaagggagcaatctatgttttcgcttctggaaatggtggtagatttggtgattcttgtaatttgcgatggttatactaa

SEQ ID NO: 2593 - DNA, 528 bp, Candida albicans
gaatcatttgctagcaataccaccatcaccaacccacctgatggtacaaactcagtcattgttaaggaaccacacaacccaactgtgacaaccactgaattttggtctgaatcatttgctagcactaccactgtcactaacccacccgacggtactaatagtgtgatcatcaaagaaccatacaacccaactgttactacaactgaattttggtctgaatcatttgctagcactaccaccatcaccaacccacctgatggtacaaactcagtcattgttaaggaaccacacaacccaactgtgacaaccactgaattttggtctgaatcatttgctagcactaccaccatcactaacccacctgacggtacaaactcagtcattgttaaggaaccatacaacccaactgttactacaactgaattttggtctgaatcatttgctagcactaccaccatcactaacccacctgacggtacaaactcagtcattgttaaggtcttacacgacgagaaggaagtaagcgtc

SEQ ID NO: 2594 - DNA, 1710 bp, Candida albicans
aatctatgtgcgggctccgtccacattcccgagagtgaagagagcagtttcgattcatcttctagtttgaattctgactcatcatctctgccattcagtgacgaaagtgatatttcggcttcatctagtttttctacattagttgccccatctttttcattgagttcaagcagttcattatctttgatatatccacattatgtcaactcaacaacatatcatgcatcggaatccgaaagctcatctgtcgcttcaccatcaatggcaagtgagtcagctaatgatgacacacatactttgctggaatctactgacactacatccagtattggcacagattcttctactgtgacattttgtcgtcgtgataacggagatggctgtattgtaacagggataccatcgtctagtatagacagtgaacagactagtgatgtgacgacaacttctagctttgttgcttccagcacaccaacctcagcagaacagtctattactgacaatccaaatatcgactcactgcaaacaagtgctagttcttcaactaaatcatcagtttctgtgtcagatacagtagtaaattcaattttattatctgaaacgtcaaccttatcatctgatgacagtacttcttcggataccagcattagctcaacaacaaactctgatactggtaatattaatgctgggtcgctgcacacaagtactgcttccatcaaagaactgtcaattcagaaaactggagtaacgttaagttccagttatttgtcgacaaaattgagttctacatcagatattactattgaacttattactactgaacttattactactgaacttactactatcgaagataacgaaccaaacacttttacttcaactccgtcaagtcattctgaaatattttctagtgataatagtgttttatcaaaacaagttgatagagaaagtactattaaaacttctcctacaacggacgtcactacagtatcatctttatcagtacattcaacagaagcttctactgcaacactcggagaaaattcatttagcaatgttgccagtactccactgaatattgcaacatctttaagatcaacaagttcatcatcaaatcatgctaccgaatcaagtggaacggttaaaagtgaagcaagtgcagaaacaattccttctccacctacttcaactgacaacagactaagctattcaactgaagaagccaaaggtattacatatgctaattcaggttctacaaataacctcataaacgaatctcaagtggccgctccaactgattctacttcagtgttgattgaaaacccagtagtaacttcgacctttgatgataactcgtcagcagctgtggatcaaccaagtaaaactaagtcgattgaagaatctattatgaatcctgattcaaccaatgaaactaacaatggatttatcgctactttatcacaagctcaagtaccaagttcctcgattcattcagagttaatactgactacgacggctaaaacaactgatgcttcgatgaatggagacagtgctgcttcaaactcacagccaaccacattaattcaacaagtagcaacttcctcctacaatcaaccccttattaccacttatgccggatcttcatccgccactaaacatccttcctggttgcttaaatttattagcgttgcattattcttctttctatga

SEQ ID NO: 2595 - DNA, 690 bp, Candida albicans
caagatatcaccaaaacatttcaaatgcttttacaatttttgttgctaagcctctgtgtatcagttgctactgcaaaagttattacgggtgttttcaatagttttgattcgttgacatggacaagagctggtaattatgcttataagggcccaaatagaccaacttggaatgctgttttgggctggtctttagatggtactagtgcaaatccaggagacacattcacattgaatatgccatgtgtttttaaatttattaccgatcaaacatctgttgatttgactgctgaaggtgttaaatatgctacatgtcagttttattcaggtgaagaatttacaacattttcttcattaaaatgtactgtgagcaatactttaacatcatctattaaggctttgggtacggttactttaccaatttcatttaatgttggtggaacaggttcatcggttgatttggaaaattctcaatgttttaaggctggcaccaacacagttacttttaatgatggtgataaaaaaatctcaattgacgttgattttgagaaaacaaacgaagatgcaagtggatatttcatagcgtcaagacttattccaagtattaacaaagcttcaatcacttatgtggcaaccacaatgtgcaaatggctacacatctggtgcaatggggttcatagttctcactggtga

SEQ ID NO: 2596 - DNA, 2472 bp, Candida albicans
ccacacaaccctactgtgactaccaccaagttttggtcagaatcatttgctactactgagacagtcaccaacggtccagaaggcactgatagtgtgatcatcaaggaaccacacaatcctactgttaccaccaccgagttttggtcagagtcgtatgctactactgagaccatcaccaacggtccagaaggcactgatagtgtgatcatcaaggaaccacacaaccctactgtgactaccaccaagttttggtcagaatcatttgccactactgaaacgataactacagggccacttggcactgatagtatcgttatacatgatccattggaagaactgtcttctagtactgctattgagtcaagtgattctaatatttcaagctcagctcaagattcatccagtctggttgaacagtcatttacttctgctgacgagacttcaagtatagttgaattgtcatcaagctcagacattccatcaagctcaattgggttaacatctagtgagtcgtctactgtctcaagttatgatagctactcttcaagtactagcgaatcatctattgcttcaagttatgatagctattcgtcaagtagtattgagtcgtctacattatctagttccgatagatactcgtcaagtatctctgataccacaagcttttgggattcttcaagttccgatttagagtccactctgattacttggagttcctccatcgatgcacaatctagtcatttggtacaatcggtatcaaactccatcagcacaagtcaagagttatcatcaagctcaagtgaggagtccagtacgtctgccaccgatgctttagtttcaagtgatgcaagttctattttgagctctgatacttccagttattacccatctagcaccattctgccgagtgacgattttccacacactatagctggggagtcagatagccaatcaatctcatttataacatctactgttgagatttctagtgattcggtgtctcttacaagtgacccagcaagcagttttgattcatcttctagtttgaattctgattcatcatctctgccatccagtgaccaaagtgatattttgacttcatctagtttttctacattagttgtcccatctttttcattgagttcaagcagttcattatctttgacatatccacattatgtcaactcaacaacatatcatgcatcggaatccgaaagctcatctgtcgcttcaccatcaatggcaagtgagtcagctaatgatgacacacatactttgctggaatctactgacactacatccagtattggcacagattcttctactgtgacattttgtcgtcgtgataacggagatggctgtattgtaacagggatgccatcgtctagtatagacagtgaacagactagtgatgtgacgacaacttctagctttgttgcttccagcaccccaacctcagcagaacagtctattactgacaatccaaatatcgactcactgcaaacaagtgctagttcttcaactaaattatcagtttttgtgtcagatacagtagtaaattcaatttcattatctgaaacgtcaaccttatcatctgatgacagtacttcttcggataccagcattagctcaacaacaaactcagatactggcaatattaatgctgggtcgctgcacacaagtactgcttccatcaaagaactgtcaattcagaaaacgggagtaatgttaagttccagttatttgtcgacaaaattgagttctacgtcagatattactactgaacttattactactgaacttactactactgaacttactactatcgaagataacgaaccaaacacttttacttcaacaccgtcaagtcattctgaaatattttctagtgataatagtgttttatcaaaacaagttgatggagaaagtactgttgaaatccctcctgtgactgacaccaccacagtatcatctgtatcagtacattcaatagaagcttttacggcaacacttggagaaaattcattcagcaaagttgccagcgctccagtgaatactgaaacatctttaagatcaacaagttcatcatcaaatcatgctaccgaatcaagtggaacagttaaaagtgaagcaagtgcagaagcaattccttctccacctacttcaactgacaacagactaagctattcaactgaagaagccaaaggtagtacatacgctaattcaggttctacaaataacctcatgaccgaatctcaagtggctgctccaacagattctacttcagtgttgactgcaaacccagtggtaacttcgacgtttgatgataagtcgtcggcagctgtgaatcaaccaagcaaaactaagtcgattgaagaatctattggaagtcttgattcagtcaatgaaaccaataatggatttatcgctattctatcagtcttcaccacgggaatgcccggtccgccctag

SEQ ID NO: 2597 - DNA, 234 bp, Candida albicans
tcatttgccactactgagaccatcaccaacggtccaaaaggcactgatagtgtgatcatcaaggaaccacacaaccctactgtgactaccaccaagttttggtcagaatcatttgctactactgagacagtcaccaacggtccaaaaagcactgatagtgtgatcatcaaggtaaccacacaaccctactgtgactaccaccaagttttggtcagaatcatttgctactactga

SEQ ID NO: 2598 - DNA, 1941 bp, Candida albicans
gaaatttcattcattgacttgtataaacatcatcagcatcaccattcaccgacaatgaagacagtaatactattacatctttttttctattgcacgatagcaatggcaaaaactatatcgggagttttcacgagtttcaactcattgacctatactaatactggtaactacccatatgggggtcctggttatccaacatggactgctgttttaggttggagcttggacggaacactagctagtccaggtgatacatttacattggtcatgccctgcgttttcaaatttattaccacacaaacttcagtagacttaactgctaatggtgtcaagtatgcaacatgtactttccatgcaggggaagactttactactttttcaagtatgagttgtgtagtaaataatgggctatcttcaaatatcagagcgtttggtaccgtcaggctaccaatttcattcaatgtgggcggaactggttcatctgtcaacattcaagattcaaagtgtttcactgctggaacgaacactgtaacatttacagacggcgatcacaaaatttctactacagtcaatttccctaagactccacaatcatctagtagcttggtttatttcgcaagggttattccaagtcttgataaattatctagtcttgttgttgcttctcagtgtactgctggatatgcatccggtgtgctcggattttcagcaacaaaagatgatgtgacaattgattgttctactatacatgtgggaataacaaatggtttgaatagttggaatatgccagtatcatcagaatcattttcttacaccaaaacttgtacaccaaacagttttattattacttatgaaaatgttcctgcaggttatcgtccatttattgattcttacgtgaaaaaatcagcaacagcaacgaatggatttaatttgaattacacgaatatatacaattgtatggatggcaaaaagggaaatgatcctcttatatacttttggacatcatacacaaatagtgatgcaggatccaatggagctgccgtagttgttactacgagaacagtcactgattctacaacagcaattaccacattaccgtttgatcccacagttgataaaaccaaaaccattgaagtaatagaacccatccctactaccactattactacttcatatgttgggatttctacttcactttctacgaagactgcaactattggaggaacagcaactgttgttgttgatgttccctatcatacaactaccactatcactagtatatggactggatcaactaccacatcaagtacttatacaaatcccactgactcgattgatacagttgttgtacaagttccactgccaaatccaacagttacaactactcagttttggtcaggaagtgtgcccacaaccgaaactgtgaccactggaccacaaggaacggatagtgtgatcatcaaggagccacacaaccctactgtgactaccactgagttttggtcagaatcatttgctactactgagacagtcaccaacggtccagaaggcactgactcagtcattgtgaaagaaccacacaaccctactgtgactaccaccaagttttggtcagaatcatttgctactactgagacagtcaccaacggtccagaaggcactgatagtgtgatcatcaaggaaccacacaaccctactgtgacaacgaccgagttttggtcaaaatcatttgctactactgagacaatcaccaacaacccagaaggcactgatagtgtgatcatcaaggaaccacacaaccctactgtgactaccaccaagttttggtcagaatcatttgctactactgagacaatcaccaacaacccacaaggcactgatagtgtgatcatcaaggaaccacataatccaactgtgacaacaaccgagttttggtcataa

SEQ ID NO: 2599 - DNA, 2340 bp, Candida albicans
  unsure (1478): Identity of nucleotide sequences at the above locations are unknown.
tatcagatgcttcaacaatttacattgttattcctatatttgtcgtttgcgactgcaaaggcgatcactggtattttcaatagtattgactcattaacttggtccaatgctggcaattacgctttcaaaggaccaggatacccaacttggaatgctgtgttgggttggtcattagatggtaccagtgccaatccaggggatacattcatattaaacatgccatgtgtgtttaaattcactgcttcccaaaaatctgttgatttgactgccgatggtgttaaatatgctacttgtcaattttattctggtgaagagtttacaactttttcttcattaaaatgtacagtgaacaataatttgagatcatctattaaggctttgggtacggttactttaccaattgcattcaatgttggtggaacagggtcatcagttgatttggaagattctaaatgttttactgctggtaccaatacggtaacatttaatgatggcagtaaaaagctctcaattgctgttaattttgaaaagtcaacagttgatcaaagtgggtatttgactacttccagatttatgccgagtctcaataaaattgctactctttatgtggcaccacaatgtgaaaacggttacacatctggtacaatgggattctccactagttatggggatgttgctattgactgttcaaatgtacatattggtatttcaaaaggagtaaatgattggaatcatccagttacgtctgaatcatttagttacactaaaagctgttcatcttttggtatctctatcacatatcaaaatgttcctgccggttatcgtccatttattgacgcttatatttctccctcagataataaccagtatcaattgtcgtataaaaatgactatacttgtgttgatgattattggcaacatgcacctttcactttaagatggactggatataagaatagtgatgccggatctaacggtattgtcattgttgctacaactagaacagttacagacagtaccactgctgtcagtactttaccattcaatccaagtgttgataaaaccaaaacaatcgaaattttgcaacctattccaaccactaccatcacaacttcatatgttggtgtgactacttcctatctgactaagactgcaccaattggtgaaacagctactgttattgttgatgtgccatatcatactaccacaactgttaccagtgaatggacaggaacaattacgacgagtacaactcgtaccaatccaaatgattcaattgacacagtggtggtacaagttccacttccaaatccaactacaactacaacccagttttggtcagagtcatttattagtactactacaatcaccaactctttaaaaggtacagactcagtcattgttagagaaccacacaaccctactgttaccaccacagagttttggtcagagtcatatgctactactgaaacaattantacagggccccttggtactgatagtgtgattatcaaagaaccacacaatccaactgttactacaaccgtgttttggtcagagtcgtatgccactactgagacaattactacagggccccttggtactgatagtgtgattatcaaagaaccacacaatcctactgttaccaccaccaagttttggtcagagtcgtatgctactactgagaccatcaccaacaagccagaaggcacagactcagtcattgttagagaaccacacaaccctactgtgactaccaccgagttttggtcagagtcatatgctactactgagagagtcaccaacaagccagagggaacagactcggtcattgtcaaggaaccatacaatcctactgttaccaccaccgagttttggtcagagtcatatgctactactgaaacaattactacagggccccttggtactgatagtatcgttatacatgatccattggaagaactgtcttctactactgctattgagtcgagtgattctaatatttcaagctcagctcaagaatcatccagtctggttgagcagtcatcaagtatagttggattgtcatcaagttcagatataccattaagttcagacatgccatcatcgagctcaactgggttaacatctagtgagtcgtctactgtctcaagttatgatagcgattcatcaagtagtagtgagttatctacattttctagttctgagagctactcgtcaagtatctctgataccacaaacttttgggattcttcaagttccgatttagagtccaccctgatcacttggagttcctccatcgatgcacaatctagtcagtcggtacagtcagtatcaaac

SEQ ID NO: 2600 - DNA, 1590 bp, Candida albicans
aatgttggattccttggggtttttaatggtgctatcaaatataatggtccagctccaaatcctggaagaccatccatctgtcaagcttgtccaggaattcattctgctccaggtgctgaaccatctactacaaccaagtctattattacaaccaaaaccgatggcgctgtttgtactgaagttgatactgttattgtttcttctgataaatctggatcctggtatacaactacttctggcgctagtatcaactgtggtaccacatctgaagctcctattccaaaccctcgagttactatcactactacttggacggaaatcactactgctaccgtcactgaaactggtaccaaaactgacactgtgattgttcaagttccaacgactcctaatcctcaaattactgttacaaaaacctggactgaatcttttatcacggcaagcactgtcactggtgataagactgatactgttattgttgatatcccggaaaccaccacctcttgtttgacgaccactaatacttggactggggactacataaccacaattacaacttctggttggatcattgttgaagttccaactcaaaatgttgtaactattgtttacacagactctcaatctacatctggtaaaactacaactacacctgtagttactgctgaaacgagtgcaactactggtaatgataacactgcttcgacaactgatgctactggtaagactttaacaactgtcacttccagtaatgacaacactacctccactggtgatgattctacaactgctagtaccggtaacgataacactgattccaccaccactactgctactgtcaataaaaatattgattctacaactaatgccacagataatacttctaaggcaactactactggtaatgataatactgattccaagactactgctagtggtactgacagtactactacaacaggtgacaacaacagtgaatccacaactgctagtaccggtaatgacgataatgattccactactgtaactactggtgatgattatacaactgttaccactgataatgacaacactgcttctacaattgtcacaacgggtaacagtaacacaacaactttaaccgatgctactggtaaggacagcactaccacaactgataatggtcacgatgaatccacaactgttactactggtgatgacgatactgctaccactaaggataacaatactgcttctacaacaactaaaactggtgataatgacacggctacaactgttaaccatagcattgaatccacaactgttactactggtgatgacaatactgccaccactggtaacgatgatactgcttctacaactgatgctactggtaatgattctacaacagccacaactggtaaccatagcattgaatccacacctgttactactggtgatgacaatactgctaccactggtaacgatgacacagcttcaactgtttccactggaaatgataatagtgcttctaaaacggtgccaccgacaccgaaaatgatactaacactactggaagatgatgacactggcaataactatccctactga

SEQ ID NO: 2601 - DNA, 1128 bp, Candida albicans
agactgatgatcacactatcagtgccttctgggttgttggtgattgtctcagtagtagcaaatgattctgaccaaaacttggtggtagtcacagtagggttgtgtggttccttgatgatcacactatcagtgccttctgggttgttggtgattgtctcagtagtagcaaatgattctgaccaaaactcggtcgttgtcacagtagggttgtgtggttccttgatgatcacactatcagtgccttctggaccgttggtgactgtctcagtagtagcaaatgattctgaccaaaacttggtggtagtcacagtagggttgtgtggttccttgatgatcacactatcagtgccttctggaccgttggtgactgtctcagtagtagcaaatgattctgaccaaaacttggtggtagtcacagtagggttgtgtggttccttgatgatcacactatcagtgccttctggaccgttggtgatggtctcagtagtggcaaatgattctgaccaaaactcggttgttgtcacagttggattatgtggttccctaacaatgactgagtcagtgccttctggaccgttggtgactgtctcagtagtagcaaatgattctgaccaaaacttggtggtagtcacagtacggttgtgtggttccttgatgatcacactatcagtgccttctggaccgttggtgatggtctcagtagtggcaaatgattctgaccaaaactcggttgttgtcacaattggattatgtggttccttgatgatcacactatccatgccttctgggttgttggtgattgtctcagtagtggcaaatgattctgaccaaaacttggtggtagtcacagtagggttgtgtggttccttgatgatcacactatcagtgccttctgggttgttggtgattgtctcagtagtagcaaatgattctgaccaaaactcggtcgttgtcacagtagggttgtgtggttccttgatgatcacactatcagtaccgagaggtggttctttgtgtgtctcagtagttaaatatttacctgaccaaaattgtgttgttataatagtcggattgggatatggaattttcacaatgacagtatcgaccaagtctatgtcatcgaagtaa

SEQ ID NO: 2602 - DNA, 882 bp, Candida albicans
gatattacgttaattacaaatgaagaaataactttgattaataactatttacatagtggaaatatggatgcacagatgactctactaaaagcattcattaaatatattgcaaacttgaaaaaacacaccaaccataatataatttatggtggtgattataatcacattatgctgctagatgatgtacaactaccactggaccaaactcgttatattatctccaaaaaagagctggaaattattcagctaatgtcaaatttttataaaaaatggaaacttcaagatgctttccagatacgcaacaaccttcaacccacaaattttcattctaacaaatctgtaaagaaaaggttagatagaatatatattgactccaggattagaagaaaacttcgaaactgccgaattctagaagagtttaagcaaatctcgactcacaaaattattgcgatgtccttccaaattcaaaaagaacctatcctaaaggttggtaacccacgttacctgatacctcaatggatgagtcaagatgaaaatataattaaagatctaaataacaatgaacaaagtagtctcactcctttttctaattggaatggaattattaaccggataaaagaaaaggtgatattttatgaaaaataccaacgatatatcagagcatacattccacatgccggaaattttcctgatgaaaagatgcttaaattcagatttaggccctcgtttaacttttccattattacagaaatgcagactgaatctggtaatacagttcaagacacagaaataatgataaatttagcgaacaaattcctaccaagaattgttcttggtagaagaaaagcattgggaatcatttacctttgtggaacagtttga

SEQ ID NO: 2603 - DNA, 666 bp, Candida albicans
  unsure (86): Identity of nucleotide sequences at the above locations are unknown.
gtggacgggaacgaagcctgcgccggatcggctgggcgggcgtcccgagaacggacgtttgcgagacgagatcatgggcgacgtgntgggttacgcacgggtgtcgaccggagaccaggacgtcgcggggcagacgctgcggctcgagcgggcgggcgccatatgagtattcacagacgtgcggtcgggcaagagcatggaccggcccggcctgaccgaactcctcgcctacgcgcgtcgcggcgacaccctggcggtggttcgcctcgacagaatagggagatatatcgccgagctgttgtcgagcgtaaacctgctcaaggaacgcggcattgcgctcgtgagcctggaggagaagatcgacaccggctcggccgccggcgaaatggtattccacgtattcggtgcgatcgcccacttcgagcggcggctgatcgccgagcgcaccaaggacgggatcgcggcggcccgtgccaaaggcaagcgtccgggccggcaaccggtcgatccggacaaggtcgtggccgccctgaaactcgtccaagccgggctatcgcctacggaagcggggcgccaggtcgggctcggccgcgccacagtatatcgcgaaatggccctcgccgggatcgtcttcaccacgggcgtggaaaatccgcacttgcgtta

SEQ ID NO: 2604 - DNA, 522 bp, Candida albicans
catttcaacgaaagaaagcctatccaagacacaacttactatattaactcatacaaacattatacaatgtcaaataataaaaggccagtattagaggaagttgatgatgatgacatcgacaatatggacatggatattgctgaatttgatccaagtttgactacaccaatagcaccaaaaagaccagagccaacagtagtacgttctcaagattcagaaccatcattatttccaaacattcctttgaatcaagtgcaacctccaccgaaacaagcatctagtagaaatggaataatggatcctaattcgtttacagaagaagaaaagaaacaatttgatcaatttcaaatcatatatccgtgttattttgatataaatcgttcccataaacaaggtagaagagtcagtattgatagggcagtggagaatccattagcaacaaccatttccgatacttgcaggagacttgggttgccagtgtttttagaattagataaaactcatccacaagattttgggtaa

SEQ ID NO: 2605 - DNA, 354 bp, Candida albicans
ataaaactcatccacaagattttgggtaaccccggtagagtaaaagtgttgtttaaagctgttttcgataatgggaaactcattaatccaaaattacaaacaaaaagagttttatttaatgttattgccgaatatttaagtgaacatccaactacattagaatcaattggtccaaaaagtggtgttcctcgtccacctgaatttgaaaatgaattccaaccagaagattttcctaaagtcaaagggattaaaatgaatactatagtgcctatacatgcaaatttgacattggaaacatccatggacaagacacatttattgatccagaaaccagaaactccagctgctggttaa

SEQ ID NO: 2606 - DNA, 246 bp, Candida albicans
  unsure (84),(228): Identity of nucleotide sequences at the above locations are unknown.
tcctgccttcagcttgccccacccccaggtctcttgggtagtctcatttccacaatgtcctttcctctgcctcccagcagctcntggacaccccccaacgcacagtactggtcccagtttcacagcgtgaggccacaggggccccagttgaggcagcagcaacacaaacaaaacaaacaagtgctggggtactgcctcctcctcatgctggcgggcatgggcctgcantacattgccttcaggtga

SEQ ID NO: 2607 - DNA, 411 bp, Candida albicans
  unsure (365): Identity of nucleotide sequences at the above locations are unknown.
ctggagccctggtgggtggatgtcatcagcatgggtcctggggagggacaggcaaagggagataaggggagtcctgccccaccccagctgcacccagaccgggaccctgggaacccaagcctgcacagccgctttgtggagctgagcgaggcataccgtgtgctcagccgtgagcagagccgccgcagctatgatgaccagctccgctcaggtagtcccccaaagtctccacgaaccacagtccatgacaagtctgcccaccaaacacacaggtacagtaatcctgccttcagcttgccccacccccaggtctcttgggtagtctcatttccacaatgtcctttcctctgcctcccagcagctcntggacaccccccaacgcacagtactggtcccagtttcacagcgtga

SEQ ID NO: 2608 - DNA, 363 bp, Candida albicans
tgtttattgtttggatgtgtgcttcttggacttctagtcatatgggtcatatcaacgattgtccaatgtttatgtatgggggtcaagtgtattgaagcgtgctgctgttgttgttgccgaagtcaaagtaacaccgcttatcaacaaccaccacaaacatacattaatccaaatatgtatcccgatgctcaatataatcaaagatatgcttatcaacctcaacctccaatgtccgcttatcctggtcctagtaatgatagtgtgaaatccgaatatggttataacaaccacgatggatacgaaccagtcagtaacaacaatacaaactatcaaagtccattcaatgatcgatacaagtattag

SEQ ID NO: 2609 - DNA, 1344 bp, Candida albicans
cgcggtatttccatcctcgtggtggcagagacaggttaccttaaatcgtcctcaacatcattggaatcgggatcagaaccaagttacgggaatgtgaaaactggatttcatgtatataaatcaaagaaacccatatttttagattatggtgggcatttacctgaatatgaaatagcatatgagacttggggacatttaaacaaagaaaaatcaaaccttgtattggttcatactggattatctgcttccctgcacgctaaatcacaaccagaaaaccctaaaaatggatggtgggaaaactttattggaccggggaaatatattgataccgacaagtattttgttgtttgtacaaatgtgcttggaggttgttatggatcaaccgggccgtcgtcaattgatcctgcaaataacgaacaatatgcaaccagatttccaatactaagtgtaaatgacatggttcgtgcacagatggagttggtgaaagaccaatttggaattaacaagattcatgcatctatcggtgcttcaatgggagggatgcaatctttagcatatgggtgggaattcccagacgaggtcgaaaagattatttccattagtggttgtgcaaggtcgcatccatattcaattgccttaagacatacgcagaggcaagtgttgatgagcgatccaaactggaaccgtgggttttattataacaaaattccacctcatgttggtatgaagttggctagagagattgcaactgtgacatatcgttcaggtcctgaatgggagtatagatttggtaggcaaagggccgacgagagccgaccacctgcattatgtccagattttttggtagaaacctatttagatcatgctggtgaaaagttctgtcttgaatacgatgcaaattcttggctttatgtttctaaggcgatggacttgtttgatttgggattcaaaagtaggagtaaagcattagaagctagatccaaagctgaattgctgtactcaggcaaagtttccagtgatattcccaaactcgctattcctgaaaccccataccaagaaaagtccacaaaggcaatcactacagtagaggaaggtctcctcgatcttaagaagggaatgtctcgattggccaacaaggatgtgctagttgtaggtgtagagtcagatattttgttcccggtttggcaacagcgtgaaatcgctgacgttttaatggaaaacagtgtttcaggtaaagttgagtatttcgaattgggaaacgatatatccagttacggacacgatactttcttgttaagcttgaatgatatcggtaaaccagttaagaaatttttagaggaatag

SEQ ID NO: 2610 - DNA, 363 bp, Candida albicans
cctacaatcatgtctttcgatgctaaaaactattccgattacgaatttttcacaatctcacaaatagagccaggatttgttcacgttcaatacactaacccaaaaacattgaatgcttttaccgaaaaaaattggagaaattatggagaaatctttaaaagattagatcaagaatctgatgttcaattaattttggtttcatcaggggttccaagatctttttcttcgggattgaatttaaaagcagctatggaattatttggaagtgatgaaccaagagatcaagccattaaacatttacatgaacatattgttgatttccaatcttcaccacggaccctggccggatccgagcttaagtgt

SEQ ID NO: 2611 - DNA, 888 bp, Candida albicans
tgtcagttacaacaattggcaaaaaaaaaaaaaaatagagcaacaaaaaagcaacacccacagtatagatatatagttaccctcaacaatagacaaatggaatcattagacgaaatacagtggaaatctccagagttcatacaagagagagggcttaataccaataatgtgttggagtacttttctttatcgccattctacgaccgaacatcgaacaaccaagtgttgatgatgcaatttcagtaccagcagatacaaataccacctggtgtatcattccaccaatactttcagtcgcggttgagtgagatgaccggaatagagtttgttattgcgtatactaaagagcctgatttttggataatcagaaaacaaaaacgacaggacccccagaacactgtgacactacaagattactacataataggagcaaatgtttaccaggcaccgaggatctacgatgtgttgtcatcgagactccttgcaagcgttttgtcgataaagaactccactgacctattaaatgacatgacaagctatcatatctcagacgggggtcattcctatatcaactccatacacggcagctcctcgaaaccatcacagtcatcggctgtctcgaagccactgtcaacaaatactggaacgaatgcaactactaccccgatcactttgacgactccactgggtgctactgtcccgagcacagtgtccaatggaatctcaaccagcacagagattgccagcggagtgtttgatacgttgttgaatgatgtggtgatgaatgatgatcacttgtacatcgatgagattccattatatggtgagggaagcacacttgagagacttgggttaaagggaaataaagatgcgggtttgagtctatga

SEQ ID NO: 2612 - DNA, 954 bp, Candida albicans
actgaattaaagaccatgtcttccgttagaaaaatagctgcatatttggagagaaaggaggatttatcccaagaatataacagtttgaaagaagtgtttaaagatgaaccagattatgaaggattggcaaatgtgttcgaaattttgaagtttttagatcaattgatctatgagtatcatgtccataaatcttaccttcaatgcactaaggggccaattaatgattttgagcgaaaattattggccgaaatggaaaaaactattaaacagttggaggacgatgttagtttaccatatttaatagaaaatgctcagaatttggcgttgattagaagagagctatttgaaaatgcacatgaaggaggacgactaattcatgcttacgaattacaaaatccatcttctaagatgatgattagatcaagtcaaccactgcgtccattcaccactttactggatcagttacattccagcaaactgaccccatctcactctaagtctcctttacaattgtctagtaatgtactggaacaccatgcgttgatacaaagtcccaaggagatgcggaacttggctagagccatgacatggtccaaacgatgcactgacattgttttcgaagcaggaaaactcgacgcaaatctaacacaaaagtatcagtacatcagttcacatattgaagacgaatttggatatcaattttgcagagactttagtcgttatttgtatctacattatattgaaggcgacgctgcaaagtttcgagaagattttgacaaagcgtatatcaaatatcttgatttcagtacacaaaaagtaagcgaattgatagaaaaagatctcaaaataaacagaaaggtctgtagatatggaatctggttacgtgagatatttcaaagaacttacggtaaaataacggagccacccgaaaactttttgtatacagatcactaa

SEQ ID NO: 2613 - DNA, 207 bp, Candida albicans
atgtcgctgagtaaagagaattcgaattacgcctcaggcgataccaaagaacgtgctaactcagatttgtcagaatccgacagatcgacgccaccaagagatccaaattcaacatttcaagcatacagattaaccatcgatgaagttgctcaagaattcaatacctcgattgttgatggtttaggagcacacgacgctgaaaattga

SEQ ID NO: 2614 - DNA, 1407 bp, Candida albicans
caatccttgaaaggaaactctggcttgattagaagagtcgacaaatccaacgacagaaaaccccaaaagagagaatatggtcaagctgccgctggcactatttatgacgttgttggtaacatcttgggtgtcactgtgggtaccccattgcaaagaaagttatcttggttagccatctttttattctgcgttgcagtagttttcgatattattgtcatgggatctcagaaattccacgttaataaggaagtagccatatacgccatctgtgttgcactttcaatgatcccctctgcacttattcttgttttgacaattacaatggcagttggagcacaagtcatggtgacaaaaaacgtcattgttagaaaatttgactccttggaagctttaggtggtattaatgacatttgttctgataaaacaggtactttgactcaaggtaaaatgattgccaaaaaagtttggttgccaaatattggtactttggatgtacaaaactcaaatgaaccatacaaccctactgttggtgatgttagatttgcaccatattcccctaaatttgttaaagagaccgatgaagaaattgatttcaataaaccgtatcctgatccaatgcctgaatctatgcacaaatggttaatgactgccactttggcaaatattgctaccgtcaatcaaaccaaagacgaagatactggagaattactttggaaagcacacggagatgttactgaaattgctattcaagtttttactactcgattatactacggtcgtgaatccatagctcaagaatatgaacatttggctgaattcccatttgactcctcaatcaagagaatgtctgccatttacaaaaaagatggcgagactagggtttacaccaaaggtgctgttgaaagacttctagggttgtgtgattactggtacggcgaaagaactgaagacgattatgattctcaaactttagtcaaattaactgaagatgacgctaagctaattgaagaaaatatggccgcattatcatctcaaggtttaagagtattggcatttgcaactaaagaacttggcgatgctgatatgaacgatcgtgaacaagttgaatcacatttgattttccaaggtttaattggtatttatgacccaccaagagaagagtctgctcagtcggtaaaatcgtgtcacaaggctggtatcaatgttcatatgcttacaggtgatcatccaggtacagcaaaagctattgctcaagaagttggtattttgccacacaatttgtaccattatagtgaagacgtcgttaaagttatggtcatgagtgccaatgactttgatgcattgactgacgatgaaattgataagttttcacacacggggcctggaaggtcccgcgaatggcgaaaa

SEQ ID NO: 2615 - DNA, 576 bp, Candida albicans
  unsure (543): Identity of nucleotide sequences at the above locations are unknown.
tatctacctaccggggcaactttcatgagagattcaagaacgaaattttctttcctagatatattacgtatacttggaggcattttatttttaaatgcatttttatcatggtggttcacatcaacttcaacatgggggtatcgagggaaatggttaaacactgattatttaaaattccgtttattcaatgccaataatccattaaatttaacaatatcggaattaagtttatataatgggactgataaacatttacccatatatttagctattgatgggatagtttttgatgtgtcttcatcaccaaaagtttatggacctggagttccatatcacgaattaacggggaaagatgcagctagagtttatgttactggatgttttaataaaaaagatgaatatacttatgatttaagaggattagatgaaactgaggcagagaatgatatacaatcttggcaacaattttttttcgatcatgataaatattggtatgttggtacggtacaacatgaaccaattaccagtgatccacctgctgtntttacctcggagctgacagaccgaaatatttag

SEQ ID NO: 2616 - DNA, 909 bp, Candida albicans
tacttaagcgctgtccggccagtcccgcctggtgaaaaaaaaccgatcaggatgtcctggtatctagatttgacacatcgtgtgtcaagggatttcggtaagagaatgaaaaacagttctgtttacttatacactgtggtggcacgtgataaagttactggaatgggagtaccttgtgcttttttcattacaaatacattgaaagaagatccaatcattctgtttttgggatttcttaagctgcattcagtgacactcaagcaagttatgattgattgttcaatgcctgaacttagtgccattaaaactgtctttccagagtcaagcgtgtctatctgtaaatggtacattcttcgtaatgtgcgtactgaagccaggtcaatatttaacgataaagaatcacaagattatgctgttgctaagatcactgccctttttgataattcaacgaaagatgaaatagcacaaaaaatacatgagtttaaagagcaatttgcagattatcccaagtggcttaattatttcaaatattgcgaaaatttattgcgttgttggacgaataatgcagaggtgtctttgaaccaagaaaatagtaccaataactgtattgaatcatatcaccatactattaaaattaaattcatcaaatctataagaaagcataccccggacgaccttctttgtgttttatacaaagaggtcactcctttttatatgaagtggtatgatgatgttcgtattcgaggaaggagacccaacttaaataaagcagaacttggatattttgatgcagcatatagcttatcagaggatgatttaaaaaagtatgttacaattcaaaaagaaggggaaatacaagaaggagaaacccaagaagaaaaggaaacccaagaagaaaaggaaacccaa

SEQ ID NO: 2617 - DNA, 1305 bp, Candida albicans
attttaaagatttcagttacatatcttctttctctagactcatctaacatgattttattccaattacccgttgaattaatccaaaaagttttcagtaaactatcaaacaacgaattgcgacattatttcaacctccaggaattactagcaacaaccactgatcaaataactgacagttcctatttacctattagacttattgccttatcagcttacttttacaacaaatcagttattatttcaaatactgttggcgagcattataaacatatccaaaaacacaatactgatatctatgtatccttagatgatttgcaatcgcttttcattaataattttatcattagaccaaaacaaatttttatctacattactgatgatactgatcaaaattcttgtggttgtcaactaaacctttcacatatcagttttatacacaaactaactcaatttttacctatcatgatgactcaatactgttatggttccggtactaaagtcaatctttccgtaagtttatccactactgatggtttaaaatctttatatgaattattgcataacattaaagcatttcaaaagttatcgatcaaatatacagccaagggaactttagacatagccaaagaccaactccaagatttgaagattgataccatggaattgcaattcttcaatcaatataagttgattgacaatttacaagcaaataataatcagcttttaagtattaatcatttgcaattaagttacaacctgatcagcaatttgtattttttcccatgctattctaacttgaaatcattgaacttatctaacaacaaccttgtttgtataaataacgataacttcaattgggaaaaactatataatttggaagtactagacttgtcaaacaataacatcattgaaataaatttaaccaacagaagaggtactggaaattataaattgcggtcattaaatttgtcaaccaacaatttaagagcgttgccaaattttcagcagtgcaaattctttgaaaatttacaagatctaaacttgtcaagaaatgcaataacacagttgtcaattaaatccttccccaactatttggaaacattgtggcttaaagggaattacttgtcgcagttgattgacgaacttaatggtgaaatcttccccaaattattgcaatttttagatttaacttattgtaagattatatcgctcgatagtgattatcaataccaggccactgttatcgaaaaattgattctggttgaaaagctaaacaatctaaaagtgctccaactagaattctaa

SEQ ID NO: 2618 - DNA, 753 bp, Candida albicans
attaattttatttcccattatgtttttatgcatatgacgacaaatccgaaaaagcactccaggtcagatgacgatgaggaagattctctacatgattattccggaaaacgggtgaagttagattcacttttgaagaatttgtccctcaaagaccaagaaaacgaaaagagatatataattaatcccaaaatcacgtacgaaaatatttttagtaaatctggatcacgctattcctcatttacagaatcacaattggcatccaacctaaatgaaaaactaactaggagtttcaaaaatgtactagaatcagggttacgattgataccatggtataattccaagtttcttataaagtatcgatatcaaacatggtttatcaaattgttcaaccggtttatcaagaaatataatgaaagaaacagagtatcgatcagcacgtttcactctttcgcagatatagtgaagttagttagggataagttgatcactttagaagatctagcgaatataataaaccaggaaaatcaacttgaaatgaaaagattagagctcaaacaagagatgagacgactggaaaaacggtttgaagaggtcacagcagaacaagatgcttatcaagatctcaaatacaactattgggataacttaaagtttgacaaagatctcgatatgttggatgtatctgatgatgagccagataatttgaaatttgaagagttagatgatgatacagtaatggtacaggatctctaa

SEQ ID NO: 2619 - DNA, 1404 bp, Candida albicans
atcctcacactaaccatttttttagcacttttgccactcctgcaccctgcatcaaccaaaccaacgcatcatcagaagttttatcacacatctaagtctacttttttttttgttagtttatctttcatcttctttttgaataatataatacagaatatgtctgaatctcaaactgaaactgctgctagtacacctttagtttcttcaattgaggacattccagcggagctagtagaacgaatcaaggctcgtatattggccgaagtcactactgaattaagagattccaacaacgaaacagaatcaaatttttctgcaagcgaaagtgatgaagctataaaggagagcaatgaacataattatttggagttgatcaatgaatcagaaagaatagagaaccaggactccgacttgtcgccttcgagcatgggttaccataccattacccctagtttcattgacgtcaataatcctgctgattatgaagtagttgaagatttcgatagttttgctatttggtcagagcatcaaaaccggaaattgttgtcattgttcaatgacctccccgtgtatgaaccagataatggtgaaattgtggttgaatggatttcagctttcaatcggttttttgaatcgtacagtggtatcaaaaaagctgttttgggcagagaaacgttcaattttgaatccgagaaagtcaaggatattccaagcacaggctattggttgaaaaagtgtatcgactcccttgatgaaagaattgtaagatttcttcaatccaaaaaagtgtctgagtatcctatatgtaatctggagaacgacatccgattgtctaaaatatggaactggcttcatcatactagagtcaatttcagcagagtatttacttcaagattaagtaccattgctggttttatctatggtccaggatacaagaataggttcaatgacgagaacagaaagtttatgaagcattcttttgacccgattaacaagtttctcattaaacttgatcatgtgaccataggtatgaagtattattttgcggtaaaagagtctgttggtgatgtactatgtctggtacttaacaaacactttcaaatttggttagcaagtgattatcttggtactccatctcttgacgaaatccttcaagagttcagagagcatccttcctatgaacccaaattgatttctcaaagagaggcagttaattcagtttttgctattgtcaaaagtgatagaagcaagaaacagatcagagccggtcgattaaggaccgtcaattctagtggtacacaattgggatctcaccatattagtttgggggctactttgtcacgtagaagatatgctggtaagagtttaagaagttcaagatggaatagaagaggcagaatttga

SEQ ID NO: 2620 - DNA, 1014 bp, Candida albicans
ttgatagtttcggagtttgaaggtacagaatttcacaagatgagttccgcaaagaatgatgataacgaaagaaaagtcatggaaagtgttgatcaagctaatgctattagtaaggtggatgaacatatcaaggctagattcaatatgcttttcataaaatttaatgacttacctaagttggccgtcggtaatcagaaaagcgtggataaatggaatgaagaatttaaatatttccacgttgcttaccccgatgttttggaatttttgcttgactataatcctaaagataaattcaaggttaaaaaggtagaaggtatttattttactggttggtgtttacaaatgtgtttacagtccatttttgataggttcagattgatcatgatttctaagctaccaaagcacttgcaaaaggaagcaaacttaatcaaagctgcttatgatgctgttactaaatctaaagattataccattactagtaagatcttgctgaagtttgtaaacgttgaacatgagttagtggtttgctataatcttccatatttgctgcaggtggaagagaaacttgaggaaatactctacaacacttcaaacgttgtcgatgagtatgtccgtagtcttccaaatctcataggtcaagtcttgtacttcaaccatgtgaagaaatctgaggctttaagtttgtttttgaatattcatacctcatactactcaaagtggattcaagctgacaatgatacatcagtactcccaagttgctctaccatagctgaagaaatgtgtgatcatcctgattatgctagattggttgacattccaagcaacaaatatgaacttaatcttattgttagtttaccagcaccagagaaaccaaaaggaaaaccagaggagaactcactggaacaatctcaaaagaagaacctgaaatcaagaaagagaaataagaaacatccaaaatcagataacgataaaggtgaaaaagaaaaagaaaaagaaaaaacttcactggaatga

SEQ ID NO: 2621 - DNA, 270 bp, Candida albicans
acatcagtacttccaagttgctctaccatagctgaagaaatgtgtgatcatcctgattatgctagattggttgacattccaagcaacaaatatggacttaatgttattgttagtttaccagcaccagagaaacctaaaggaaaaccagaggagaactcactggaacaatctcaaaagaagaacctgaaatcaagaaagagaaataagaaacacccaaaatcagataaagataaaggtgaaaaagaaaaagaaaaaacttcactggaatga

SEQ ID NO: 2622 - DNA, 987 bp, Candida albicans
gcaagtcgcggtccttccagcccggtggtgaagatacacaatgatggtttatttcacattgaatatgaagatggatcagtaatatatttaggtttatatgttgatgatattcttatggttggaagttcacaaaaagttattgataattttgtggatcaattgagagatcattttgaagttaaagtgtttggtgaaatatcaaattatcttggtattgaatttcgtaaaaccgaatctggttatattttatctcaagaaaaatttctcaagaaattacttaaggatttcaaactagatgactcatatgggaaaaacataccctggattccgaatgacaaatatgaaaaggttgcaataattcgtgaaaacgttaatccagagaatgattttgaaaaggttccgaatgagacattgcttgaccctgatgctaaaaaactataccaaagtggtgttggcctgcttttatgggctgccacaaacacacgtccagatatatcggtcgtagtgaattcgttgggttctaaatctgcaaatccaaatgtccatgattatgagaaattgatttattgtcttaggtatatcaaaaatagcatgggatatcacattgagtacaaaagaaacagattgaatataccaccaaaatcatttgttatcgaatgtttcagtgatgcgtcatttgcaccaggattggatagaaaatctattagtggaactttgatttatgtgaatggaaatttggtgcaatgggcgaccaaaaaacaaacggtcatagcacaaagctcagcagcttgtgaaatgttggctctaaattatacaatgttgaaagctatcgaaataaaaaacaatttaatggatttgggttttgaagtaggtaagatacattgtcatcaagacaaccaagctgtgattaaagttttgagaaataactattgtcacccacatcgaccaatagtcttccccgcccggctggaaggaccgaacttgcgt

SEQ ID NO: 2623 - DNA, 555 bp, Candida albicans
agatctgttgctatgctcgaaacatattttcagttacaatattttggcgaggctacggagtatctaggaatacagtttagaaagacacctgatggatacacgttagaccaaataccattcttggaaaaattggtcgctacattcaatattcaagatagttatggaaaagacattcctattatcccaaaagatattaatgtggtcaagcaattgagaaagtcaagtcagataaatgatttcgttaagttggagaaacctcaaaagttaatcaattcggtgtcaaaaaccaagtacattgatgattacgaagaaaatgaagaacatgattttaaagaatcaccacaagctgaacccttaagcgcaaaaggaataaaattataccaatccgcagtgggactgttgttatgggcttcgatgaacactaggccagacttagcttttagtgtgaatcagctcggagcaaagtgtgctcacccagatgtcgacgactggaagagattgatgtattgcttacggtatattaagaaagatatggacttcaaacttgaatactag

SEQ ID NO: 2624 - DNA, 573 bp, Candida albicans
agaagaagactcaacaacaagtcaaaagattttattattgaatgtttcgcacaggcctcatttgccccagatttggacagaaagtcaatcaccgggacaagcatttttgtaaatgggaatctagttgcatgggcaacaaagaaacaaaaaataatcacacatagttcagctgcttgcgaaatgcttgcattaaattataccatattgaaggcatttgatttgagaaataccattgaagatctagagttaaaaataaggaatttgcatgtacatgaggataatcaagcggtcattacaatcttaaagaatgataatttccacccacatagaccgattgatatatgttacaaatttctcagacaaaaattgaaagatggatttttttcaatatcatatgttgaatctggagataatttagctgactcattcacgaaagctttaggaagaaataaattgattgaacataccaaaaggattagagaaagaaaggattatgataataatgctacactgatagtggacgttaggacgctcgaagagattaagataaacaagaaattggtacatcattaa

SEQ ID NO: 2625 - DNA, 1425 bp, Candida albicans
  unsure (1099): Identity of nucleotide sequences at the above locations are unknown.
tcaacaacgaacaccaagtaccacgattatggggagggtaattaccccgggcaacaggtgcgcaccgatattattgggcaatttcgagatcgcgggcttaccactctaaacactccgatcgatctaggtgtacccgatgaaacagacgatattagtatgacatcagagaatccaattgattccccaaattccgagatgatcatatccccatctttacccacaaatgaattggaacatcaaatcgatatcagttcaggggagatgtcgttattgcaaacgaatatggaagcagataacgaattgaaaacaaatgaaatggtattatacaaatcaaaaaatgatggtattatcattcaacaacaacaattcactgaaaatttgtcagatgaaaatgaagaagattcatcaacagatgaggaaacattggaagacaaaaaacaacagcgattggaatataatatttcaccaaacgatgagtggataaataatgacgttcagaacgaagatgacacacaagtgccacatgttaaggaaccaatcaattatgaaactcaaagtagaaatgaaacaaacatgccacgaattgaaatgggcataatagaaaacttaagtgatgatggaaagaatacaccacgtgaattacgtatggtcacctacgataataataaaaaaattcaaaagtaccaaaacagtaatatcgagatcctggaacccagaaacgaaaataaaaaccacacattcattgaaagcaacttagaattacttgacaatcaagaaatgtttcaagaagatcctcaagttgaagatattcgattgacaactccaaaaaaggacaaatcgttatcacctgatttcaatcaaacccataatgaaatacaactattcatggcagatatcaatgaagatatgctagaagaatatgatgaaaatataaatatgaatgaagtgttagctgactccacggagacgttggacaaagaattagatttagatgaagaaagtggaaggatcgaatatattgctgatagagttagaaaaaagaacagaggtactgatggtgcgccacacgggaaatatttaaagaaaaatgataaagatnttggttcaataaaaagtcagaaaaaatctgacgcacaaatggatgatgaagttggaattgctatttcgaagatcagaaactttccatttaaattgaaggatggacgagcaagtttcttctctccatataaaacaaaatttggaagatcagtgcatccacctaaaagaatattaaatgccattgttaagaaaatagattacaatcccaaagaatgggcgtcaaatatggaagaagagttcgaagaattaaaggctaacccagtttacccggtgaaaaaaacccaaaagacgtgtccccttgaaaaacccggtggggtacatacttaa

SEQ ID NO: 2626 - DNA, 2637 bp, Candida albicans
  unsure (85): Identity of nucleotide sequences at the above locations are unknown.
gagacttcatttgtgatactctcggtccaatttagttccgaaaataacaagtggtatttaacgtctgttatagatgaacatacgngttacattgaaggaattattactaaagacagaaaggtaaaggatctcttaattcaacgattaaagatctggaataatcggtttaacgataaggtggcatacttcagaagtgataatgctcctgagttcccacaaccttctgatttagctgagttcggtatttggagggagactatagcggcatatctgcctgagcttaatggtctcgccgaggttgttaataaattgattttacaacagatttacaggatcgttgtgacacttggtccacaaatactcaagttgatttattatgtgattcaatattctattacaatgatcaaccacactccacgtcgttcactcaagggacaaaccccttatggttgctattatcaattaagtgagggaaatttctaccggtttccttttgccatcgattgtgtcgttacatttagtaatgccatcgaaaagaaccgttacggagttacatcaactaaaggagctccttcatcgatcatgggtgctgtgattggctacgctagcgattgttttagttattacgtgttgctaaaaaatatgcggtgtgatattatccttagccctaatgtccgtatattgcgaagctatgaggttattaactcctatctcaaaaacttatccactacacctatgtcacacattgttcctatggctgaaggtatccagggaaggcaactgggcgctcagtacgaggtacgcggaacatatgtggaaagtgaatatgacaatacaaatgacgtgatgcacatgcccaaagagtcatattcagttcagccagcatcgtttactttaactacgggtaacagttctaacgaatatgttataaatgatgatccagtacagattaccattgagaatcccgatgattcttctaaccctcttcaaccaactgaagaatcacacgatatggtatccgaagtaaaatcggatgagaatcccaaacccagtctccacgagctaacacctggggataatccggtgtctaaacctcctcaacttggtaccgagacttcagtaatagggaagtctaaagagcctattacaaaccacacaaaggacgccccttccatccaggggagggaccataaacgcctggaatttactgctcaggttggactatcacaccaaccccagactggtactcccgcttcggaggagtcaaaattgtcaggaacagatcatttcggtgtcgacgttgttaaagaaacagtctcagaagattggcatacttctgactacccagaaactagtgctgaagatgaacagcaaaatccctcgttactggctaataagaatcgggtaactgaaaaaatagatgagggagaaaatatttcatttccggggggtgatgatgattctgtcgtgatcaactcaaatgttgagcaatctaatgttgaaacagaggatgctggtaacagttcaattcaagacgaagtttctcaagaggggagaatagtcaatgaacaaacagatatagttgatactgttgctaaagctattgagaatgaagaaatctctcctattaattcattagatgatcatactgaacttgctacagactcgggaaatgatagcaattcaacagaatccgacattcaatcgaaaaatgaaatatcaccagtgattaatgagaaaaatactgaaataatccaaaaacacattgaaagtatccttgttgataagagattggatgaatttgaaacgtataatgttgatgaaatcgaaaatgtgattaatgacgatgacattgctgaagctaatccactaccagatgaaaataataatgttcagatgaatgagagttctgataacaatcatggcatgtcacgtgcaaagaagaaatacacatttgagaaagaagttaacgaaaaaattgctggtactaaacattcacttgatacaactgatccaagagaagcaatcagagtgttaaatactggtgaaaccaagagaatcgaacccaagaaaagagagatacctatcactgtgaaattaaacaaaagatcgcaatacaagtcaccatatgttacaagaagtggtagaacagttataaaccccaaaaggtatttacatgcggttgtcaacaaaatcgactataatgatccgggatggataaagtcaatgaatgctgaactagagaaatttagatcaaaagatgtttacgaagaagttccaattcccaccggtgtgaaacctatatctatgggttgggtacatactgagaaaatagattccctcaaaggtgttgttcggaaatcacgttgtgttgtccatggcaacagacaaaaggaaaaattggattatgacccttttagtgttagttcacctgttatagatcttgtgactataagattattgacaataataggttgtgaattagggatgacgattcaacatttagacgtcgagtcggcgtatctaaatgcctctattactcattcaaatccaatttatgtctttcctcccaaatcagtaacttttgaagaaaaatcattgttgggttatgaaacgttctgtctatggggtaaaaac

SEQ ID NO: 2627 - DNA, 258 bp, Candida albicans
aagatggttttaaaattgagggattttcagatactttgtttgtaccaagaattagataagcgggcctatcacaggtatgagctatctatgttaatgggaattttggtaaactgggcaacgaaacgtcaaaagattataatacatagctcagcaacatgtgaaatgcttgctttgaattattctgtattagaggcatttgatttgagaaatattattcaagatattggattgaaagtaagaaaaaaacatccatattaa

SEQ ID NO: 2628 - DNA, 507 bp, Candida albicans
aaaacaggtgctgcttctattaattgtgtaatgaatatacataattgcagcaaaaccacgtttccagtagaaaattctcattctcttaatgcttctttgaacgtaatgaattttaaaggtttaaggtttaacaagtatctagtgtatgatactggtgccacaatatctgttgtgaacaataaagatatattgctgaatgttaaggacgcaacaattgaagtttctgttgctgatggtgctacattagaagcagattgtattggtgatctaattatcagagtcggtattgtctcgattacgttagagaatacattgtatttaccagaaagttcctttaatcttgtgagtttgaaacaaattgaagaacgaggatttaatgttcttattactaaagaatcagtgattgtatttaaccaaaatgtggctcctactattattgcttcaaggaagaatgctgctgatctttatatgggtcctcaattcagtgaagaatctttagaatgtgat

SEQ ID NO: 2629 - DNA, 708 bp, Candida albicans
  unsure (570): Identity of nucleotide sequences at the above locations are unknown.
aaaacaggtgctgcttctattaattgtgtaatgaatatacataattgcagcaaaaccacgtttccagtagaaaattctcattctcttaatgcttctttgaacgtaatgaattttaaaggtttaaggtttaacaagtatctagtgtatgatactggggccacaatatctgttgtgaacaataaagatatattactgaacgttaaggacgcaacaattgaagtttctgttgctgatggtgctacattagaagcagattgtgttggtgatctaattatcagagtcggtattgtttcgattacgttagagaatacattgtatttaccagaaagttcctttaatcttgtgagtttgaaacaaattgaagaacgaggatttaatgttcttattactaaagaatcagtgattgtatttaaccaaaatgtggctcctactattattgcttcaaggaagaatgctgctgatctttatatgggtcctcaattcagtgaagaatctttagaatgtgattttgattatgatggtttggcagatatgttgtccaatgctaaccgagatgacgaagataaatcnagtatgaatggaatgtcggaatatcaagaacatgattatagttctcgagcattaataaattctttgacggaggttgatgttttagatgttgaaatttccccatatggaattgaaaaattggtaccaactggagaatag

SEQ ID NO: 2630 - DNA, 624 bp, Candida albicans
atagatgagggagaaaatatttcatttccggggggtgatgatgattctgtcgtgatcaactcaaatgttgagcaatctaatgttgaaacagaggatgctggtaacagtccaattcaagacgaagtttctcaagagggaagaatacttaatgaacaaactgatatagttgatactgttgctaaagttattgagaatgaaaaaatctctcctattaattcattagatgatcatactgaacttgctacagactcgggaaatgatagcaattcaacagaatccgacattcaatcgaaaaatgaaatatcaccagtgattaatgagaaaaatactgaaataatccaaaaacacattgaaagtatccttgctgataagagattggatgaatttgaaacgtataatgttgatgaaattgagaatgtgattaatgacgatgacattgctgaagctaatccactaccagatgaaaataatgatgttcagatgaatgagagttttgataataatcatagcatgtcacgagcaaagaagaaatacacatttgagaaagaagttaacgaaaaaattgctggtactaaacattcacttgtcttcaccaccgggctggaaggaaccaagcttgcgtta

SEQ ID NO: 2631 - DNA, 1167 bp, Candida albicans
  unsure (13),(15),(26),(28),(62): Identity of nucleotide sequences at the above locations are unknown.
gatcaaaagcaananatatttgaagntnataatgccaaaaaggccaagcacacctacaacanatcatcttacactgtttcgttgcctatgcaagtacgttatattatgaagagatattgggatagaatgagaggagatattatagttccactatccactgtggcgggtaatattgccatggcattgattctatcttcagtgttttacaatttgcaacccaattcatcttccttctattaccgtacatcagttatgtattacgcattgctttttaatgcctattcatcagttttggaaatttataatatgtatgaaggtagagctattgttcaaaaacatcgtgaatatgccctttacccaccaatggcggacgctataggatcaattatatctgatttcccattaaaagttgtttgcagtgttttattcaatcttatattatatttcatggtcaattttaaaagagagccaggcgctttctttttctatttattgattagtttttgttccactttgttcatgtctcatttgtttagaactatcggtgcattcactaactcattggcagaagcaatgactccatcctcacttttattatttgccttgtcaacatttagtggatttgctattcctgtgacatatatgcttggttggtgtaaatggatccgttgggttaatccattagcctatgcttatgaacccttgatttccaatgaattccatggtcgagtgtttgattgtagcaatattgtgcctagtggatttggatatcctaaaacgggtaactctgttgtttgtgcaagtattggtgcccttccaggagaatttaaagttgacggtgacttgtatttgaaattagcatttgattattcttattctaatgtgtggagaaattttggtgtcctaatggcattcatcatattcttatttggtacaaccatatttttcgttcaaaccaacaaatcaagtattctgaaaggtgaaactttggtgtttagaaggaaaaatattaggaaaatgaggaaaatggaggaggatgaagaagcctatatggatggtatggcgccattagattttagtggtagtacggaaatatctgattattcttatgactatatggatcgcaaatttcttcaccccgaccctgacctatccattctcctcgca

SEQ ID NO: 2632 - DNA, 345 bp, Candida albicans
tgcggttccttccagccgcgtggtgaatatcaaaaatgtcaggattatatgggagcctatattagtattgctggtggttatttattgaatcctgaagccactgataactgtaaattttgtatcatggataagactaaccaatttttggattttatgaatatttccattcataattttggtagagatactggtattttcattgtgtttattgtctttaatatggctgctacagtattttcttattggttgttcagagttccaaaatgtaatatagaaaagggaagctttttcgataaattgccattcttgaatggtggtggtgacaccaatcatgaaaacgtttaa

SEQ ID NO: 2633 - DNA, 783 bp, Candida albicans
  unsure (33),(85): Identity of nucleotide sequences at the above locations are unknown.
caaactaaggggcattcactttttcaacaaaanatggccaaggcatcacaagcagaaggacacctttacaagggttattacaatnacaaatctcaaggtcagccgtatcatggatactatagtggctttaacaaaagtgcatcagcacaaattcatcacttggcaagatccttaactcaaggagtccaatctcattacgatgatacctataccacagcaaccatgcaccctaatgggatcaacccaatttcagacaagactgatccaacattagatccagaatctccttcgttcagttcgaaaagatgggtgcagaatatgtggaaattatatcagagtgactctgaatattacaagccaggtaaattaggtgttgcttatagaaaccttcgagtttatggtgatgctattgaaagtgattatcaaacaaccgtatcgaacggggtattgaaatatgccagaaacattttcaacaaatttagaaaggataatgacgactatagctttgacattttaaaaccaatggaaggtttgattaaaccaggtgaagtcacagttgtgctaggaagaccaggggctggttgttcgacttttttgaaaactattgcgtgtcgtacagaaggattccatgttgctgatggatcagtaatatcttatgacggaatcacacaagatgaaattagaaatcatttgcgtggtgaagtagtatattgtgctgacacagaaacccatttcctcaaatatattgccacacagccctggaaattccgcaatcgggcgcgg

SEQ ID NO: 2634 - DNA, 234 bp, Candida albicans
agaagacaatgggaagaggtggttattccattgaatgactttgtcatgactaattggggtgtcattcaagatggaagtgaattgaataaaggtgaagttaaatctgttggtattggtttattggataaacattatggtccttattcattgaaaattgattggattaaagttatgactggtgctgaagttgccaaagtagctactaaatctagaatggaaagattacattcatga

SEQ ID NO: 2635 - DNA, 495 bp, Candida albicans
attaaactttatacatatttatccaagatgtctatgaaagctttaggtttaaacgccaccaaatccatctttgccaaacaagctgaattaactcgaccagtacaatctgtactcaacttcaaacgagaaccagaaaaatcattggatcaagtattaactagatccgatcaagaattgggaggttattctactgtcaattttgatattgatcctaaagaacattgtgggcatttctatggtaatttgagtttggacttacctaaagacaacccacaagtgacaagatctggttatgccatgtttagaactaaagatcaaaatcaatcttggttatttggtgattcattctgggattggaataattattcatcattagttttaagagttaaaggtgatagaagacaatttttagttaatattcaagccaatactccattggtcactgatttattcccacatcgattatttttaaatcatcctggaacatgggagacg

SEQ ID NO: 2636 - DNA, 525 bp, Candida albicans
atttatacaatgtcatcagtaattgcttcaaatattccttccgatgtatcaccggtgaaagttagggaattcttttccttctgtggtaaaataaccgatttaaagccattggatgataatgggaaagttaaaaagtacgaagttgtgtttgcttccccaaaagctgtatctactgcattattattgagtgatgccgaattagaaaacacttttattaaagttgaagaagttccagaaatcaccgagggcgaaaccggacttgcaccagaacaaggaggtgctgctgctgctgccgctactactactactacaactgaaaaggatatcaaagaggagccagtattgacaggtgacaagacatatgatgaagttgatcaagaagaaaaaccaaaatacgctatttttgcacaattgttggcagatggatatgttatttccgatcaagttattgccaagggtattgaatttgacaagaaaaatggtgtttcatctagattcaatgatctcttcaccacggaatggaag

SEQ ID NO: 2637 - DNA, 1539 bp, Candida albicans
tttaaacctaaacctaaagccaaactcaaattcaaactcaaaccacaaggtaagttccgaccattggtgtatggtgtatccattgttgctacagggttgggaacggcttactatattgacaaccattattattcatcattaatgacacgttcagtaagagcagtatatgtattattatggatagcctatgcatatgggttcaattccaattcttaccaaaacattgatgatttgcatgaaattgcttctgataaattattacatttattaactaccaacaaagggttatatattaaattacgacaagcaattgccaatcaagggaatcttttcccacttgcttatcaaaagaaattctcacaattgtatgatcaagccccagtacaaagttggcaagacattgatcggattttaaaggaaaatttgggtgatgattatcaaattcgattatttgaaaccattaatcatgaacctattgccagtgcatcgattgttcaagttcattatgggaaattgaaaaatggagaagaagttgccataaaagttcaacatggttatattgagaaacaagtggttgttgatttaatgatttatcgatttatttccaaagtatatgaaaaagtgtttgatattcctttgagtatgtttacgaaatatatatctgaacaattgattaaagaaactgattttgttcatgaaatgcaaaattctgaaaaattgaaaaaattcattgataaagattcaagtttgaaatatgataatataaaacttcctaaaaattatcctcatttaacaactaaacaggtgcttactgccgaatggataaatggaattccattaactaataaacaaacattattggatcaaaactatgatttaactttaattatgaaacagtatataaaattatttggtagacagatttttgaatatggttttatccattctgatcctcatccaggaaatttattggttcgatttgattccaagaataaacaacaattggttttaatcgatcatggattgtacattacgttatcggattcatttaggttacaatattgtaatctttggcgctatttgtttctgttgaatactaaaggtattgaacaaattggtagagaatgggggatatcttctattgatttatttgctacagtggtgcaattacgacccgtattacttagtcctgaagtacaaagcaatgcaaatgcaaatgcaaatgcaaataaaaatgaagatgaagataatcgtaatatatctgatttattccgagattttataggtgatcaaaagaaatttcctggtgaactcccatttttatcaagaacaatgagaatgattcaaaatttaaaccaaagttttggaagtccagtaaatagaattaatttattaaccaaagagctgattaatgcattattacaagagaaggatttgaaatttggaaattattgggatcttgttagaataaaaatcacattattgttgtcaggattcatgttttatattgttagattaagacaaatattatctgggtga

SEQ ID NO: 2638 - DNA, 2739 bp, Candida albicans
atcataattgctgttgaacacttttttttccataccacttttcatttattatccagcataatggcatcatcggaaactttacacacctccaacactagtgattcccatataactcaaaaaaagaacggatttttcaataagttgatcaaaaagtctaaagatctgaagggtctgtccaaaacattaactcaatctgaattaaagtcaatttcactggctagtcggagatcgagcatcaaaaatggtaaacgagattctatatatagcaaacaatttgttgatgacgataactcgtcgttatataatgatgatatggatgatagtacctcgataatagacgatgagactgatgactccatgtttgaaacagtagacaattcggactcgccagcatcttttgagaaaattgtcacaggtaataattcaacatttgataatcatacgctaagtgaaaaggtcatgtttcctgccagtactgagggattggatatggatatccctattgatcaagaaccgccgtacgttggtcttacctatgaatcatttcttagtcccaaatacgtaaaaaccactcgcagaaataaacagagtccgagggttgtgaataatttgtttttggcccaggaattgaatgtcaatgagacggctgttaatagtggtgacgcggaagctgaaacagaagatgagcacgacggattactgcatgatgaagatttcggaggagacaccagaagagaaatatttgtcatggagtttagcaaggatgggaaatatttagcagcagcaggaagagactctgtcataagaatatggaaggttatttcgtctccacttgcaagaatggaattcaaccaactcgagaaggagaatggccaaccactacgcagcaacaaacgagatagtgtttttgatacagcaccggtgttccatagacagccagtgcgcgagttcagaggtcattccagcagtgtgttgtcattggcatggagcaaaaataattttttgattactgggagtatggacaagactgtcaagctatggcacgtagatcgtgaccggtgtcttcagacttttgagcacgaagattttgtaacttcggtaaagtttcatccgctggatgacagattctttcttagtgggtctcttgataacggggttcgtctttggtcagttttagaaaactcggtttcgtatagtaagaacttgggcgatgaagtgttgattactgcattagagttttcgcctgatggtctacattgttttgttggcggattcaatggctctttgtttattcttgaaaccaagggattgtttgaggtatttagagtagagatcaaagagagatcaatagttcatccatttgttaataaaaatggtaataaaattactgggatcaaagttttcgataacaatctatatcagggctcaggtgtaccgggtcaattggacaagtggactgttttggtcacaacaaacgattccaaggtcagaatcataaccactacgcaaaaaagattaataacaagattccgaggactaacaaacaactcgtcgtcgattgttgcccacagcagtgatgaccaaaaatacattatttctggatctgaagaccactattgttatatctgggaaaacaacaattcaattatcaataacaaactcaaacaatcattgaaggagtttatgattgatggtaaacaacacatttcagactttcaccacaagcacgaaaaatattcaaagtttgtatcgttgaacaaatttttgaacaagttcttagaggaagataaagatcgaaagtacgactttgtggccaatgaaaataacagctacacctgcttccatgcacatcattctcgatgcaacgtcgctatttttgcgcctgagtccaccaaaaagcatttattgttatcagacgatttgatatatgatctcaaaagacgtggggaaagctgtcgaatcagcccatcaagctgtttcacttgcaactcaaagaaccacaaacttgaggatactgttcagagtggcgatatcattgtcaccactgaccagtttggtttgataagggtcttcagacaggactgtgcctatgcctacagaaggatgtttattgatttttacagaaagggacaaattaaaaactgtaatgatattcaactgattacccaatcagaaaagacattgcctataagaagagccttgacacgtcgtgaccgaagtacctctcgtattagagctcccagcttgagtccagtacgacagagtgagaattcgaagagtattagaaacatattggcatcaaaaatcaactcctcggtaccctccacaccctcatcggagacgtctttttcaagcacgatcggaagttccagtattgatacacggcattaccctggagtagctgtacttccaaagaatccaatgttgagtatatctgcagcagctagaaatccactgtttatgcagccaggtgtttcagtaccaatagaccacgataatgtagtggaagcagacagaacaggaagtgataccacgttaggtgcagaatatggtacgcagactccccagcctactttaaatcaagatgatatgcaatcaagtagaacttctacagtaccacaaatagtgttctcgaaagaatcagagtctccagatgccacaaataacaaccatcattcacaacttgaaggggtaaagataaatagtcaatcacaaagtcgaggcagaaccaaatcatga

SEQ ID NO: 2639 - DNA, 720 bp, Candida albicans
  unsure (700): Identity of nucleotide sequences at the above locations are unknown.
aatagaacattatttgaagaagaaaaattactcattatgtcctcgacaaccactcaaactccaactgtattatgggctcaacgttcatctgaagatgacgctgccaaaaatatcatttatttaaccattcaaatatctgatccaattgatttaaaaatagatttaaaaagtgatcatctaattattgattctaaatctaatgattcagtttattcatcaattgattatcatttacaaattgattttttcaaagaaatagatcctgatcaatcaaaaattaatactgaaaatggttcacatatttttatgattcttcgtaaaaaagatcaacaagaagaatattggccacgtttaactaaagaaaaattgaaatatcattatattaaaaccgattttgataaatgggtggatgaagatgaacaagatgaagttaaagatgatccaaatgattttggtggacctggtggacctggtggagctatggatttctcacaaatgttgagcggcatgggcggtttaggtggcgctggtggaagtggcggtcctggtggtgtcgatcttagtgcattggcttctcaattgggtcaagctggtggtgctggtggtgctgcaggtcttgatggcgaagaaggcgaagaaggcgaagcagaagctaaagaagcgcaagaagaatcaaataccactgctactgaaaaagatnaatctcaaataacaaagtaa

SEQ ID NO: 2640 - DNA, 720 bp, Candida albicans
atcacgcacacttcttttttgtctacaaaactaatatccttaccaaccaacctgttaatgaatcgaacatgcatgtccattgcttatcttttagatactttgccaacagatcaaaatacaccaccaccaccaccaccaagaaatatccttactgaaatttcaaatatgaatgataatgctggggtaaacaattctagtgagagttcagtggtaacaagcatcagcaacacaaaccaaagcgtaacagttggcagtagttataatcctgaatctgatgactatgtccatgatagagaagggttcaaaagaagaattgaaagattggatgaaacctttgttgatttgacttctcgagagaatcctagcgaggaagatacgaacagaaacattggcaagaatggttctccagttaaaaagaaaaacaagagagataaagaaattctaaaccttctttcactgccaccaaaacaaggaagctctcgagactctttgggttctctgaaacttaaagaaagaaatgttgcaaaaactaagaaaatagaaagtcaggcttctattgaattcaaagagatagtgcaaagcttgatagaattgggatcagaaatcgatgctaagggtcttgatactcatccagacattgacaaaatacttgagagtttgagtgccattcgtatggattttcttcatatgttaactaataagaagaacttagcgcaataa

SEQ ID NO: 2641 - DNA, 1050 bp, Candida albicans
catttcactatgaagagagcttttggtgataactctaagcctggtgttaaaaaagcaaagcttcaccaagataaagaagctgttcacaataatgaaaacaacgataagactggacttgatgtagaaatacatccgttattaaaaaatataggattaacaaacattcctaaattaccgaaagaccataatccactacgacaatccaaccaaaaatggtttgatccacttgcattaaatccatatctcgatcaaagtgatatggttattaataataaaaaatctagacatattccacccccgttaaagtttatctcacagggaaagtatgtggcccagggggagaaattacgagagaaattgaaagttgaacacgaacaaactcgagaattggaagcaattaaacaacaaggattaataccagatgagaccattggggaacaattgtatcaacttgaagtgcaaccattgattgaatggtgggatcgtccatatttgcgtgataacaattatatgaacattaacgacgaatctcgtaaagtccttgatgatgaaacccaacctataacgtcatatatacaacatcctgtattgatcaatcccatttgggagaccaaggattcaaactctccaatacaaccggtatatttaacgaaaaaagagcagaaaagaattagaaaaaatgaaagacaacttaaacaacaagagaaacaggacagaattaaattagggttagatccaccgccaccacctaaagttaaattatctaatttaatgaatgtattgaccaatgaatcgattaaagatccaactgcagttgaaaatagagtgaaaagagaaattcaacaacgtgttgataaacatttggcacaaaatgaagctcgaaaattgaccaaggaacagaagcatgaaaaattatggaacaaacaagaaaaagatttggccaatgggtatcatactacagtttacaaaattgacaagttagttaatcctaaacatttgtttaaactcaatatcagtgctcaagaagagaatttggttagatttgtttga

SEQ ID NO: 2642 - DNA, 1944 bp, Candida albicans
aaattgtttggtccgcctgtccgtagtgaagacatcgtccatgaaagtaaagaattgtttactccaaaagataaattgatcaattttttcacaaattatattgaatatttaccacttaatactgttatatttgttttacaatattattcagatagtaaaatgtgcagtttacttaatccgttttggcgagaaaattctatgaaattattaaatcatttttatttacctagtgatattgatgtgacagtgaaaatgaggtgtattcaagtcatattggatgcttataacacttcagttgcaatatttaacgataatgatatcaaatatgaaattattctagaaatagcgaaaaggtcattacgtgaaacaaatgaagagttgttaaggtatttgattaataacttatttggtgttgtttttttgaaatgtcccaatcctgtatttattcaattaatgactgtttttcttcccttatttcaacctcaaataccaccaccaccaaaatccctgcatctggtttttgaaggtctgatcactctgagttttgtaacttcgacacgtgtactgggaaccgttcaagaacatggaagtatcgaattcaccgaagctataactaaattattatgtacaacatttattaaggcaactccggaaagagctcaagaatgttataattttttgatacaaatagccaatttatcaaaacataattgtaatatattattgataattgctaaatgtttagttcgaattagaactactacagaaaactacatttatttcactcaacctagtgatatggcaggtttagcattagcattccgtcgagataattcaaccacatgttctggtaatacaaatgtactgtgggtatacccggaaacagtagattatttacctgaagaattgtttgattcccccaatagaagcttattattatcaagagttgataatggaaatgttgatgatttgggaagtgataaatattatattgatattcaaaagtggcttcaattagttttatttataatggatcaatatattgattgggaaatatattcatatgtttgggcccattttgttagtcaattatccaatactcaattattttatgattgtgatttagaaattaatgaacttcgtaaaatcatatgctatcaattaacattgaatttacccaccaatattaaattacctcataaaacaacaccaacaacaacaacagcagcaacaacaaatgtgaacattgaagtgacaaaggcagatttacaagttgttttcgttagaagtttatcttcacttacaggatatttcaataaattcactaaaccagatcaagatcaaatagttaatagtttaatatttggattaggatcttgggataaaactgctgttccatgtattaatattttgacggtttgttgttatgaaattccattatcaattaaaaaatatttgaattcaattttaacaaaattacaaacaagaataactagtgctaatgctgctgctcattcacttgaatttttaatatcattatcacaacttcctaatttaacaactaattttactattgaagattttaaactaggatttggaattgcatttaaatatattcaatatgccatagatttagaaaaaagatcacaccaacaacaacaacaacaacaacaaggacatctgcagctggcgcaaataattcaacaacatggagttgatgctgatgttgaagaaactccactgacacaacaacaaacaattactccaattctttccgagtatatattaatgttatcgtatcatattattgccagttggtttgttacattaagaatgagtgatcgagttgaattacaacaatttattattaagaatttgaaattatgcagtgaaattaatgaaaatttacaagatcaaacaattggatttcttgatttctattaa

SEQ ID NO: 2643 - DNA, 1149 bp, Candida albicans
aagaaaacgatggttgtggatcaattgaaaaataatattgttctgatatcgtctaatattggaactcatattaaggacgggtacaagtacactgaatcagaattcaaaaatatatcctacaacattgaagacacagttacattccacaccagagattacgataaggatgatgaacttgttgagatttattatcacgatatcaaacaatcagtttctggtttgaagtacatcacatcgcagaatcaccatttgtccaagagtttcttgccacatgtgctcagcctgaatattaaaattattaaaggatttatcaacttgattggtcaagattctttgcgttttgataaaatcaacgagtattaccaagaatttgattcatggcaagcaacacaagaaatcccacatgtacacccaaaggagatgcaatttttgaatgaatctataaatgaagagttgaataattatttgatcacggtggagaacttaaaatttgatttggaaaataattgggaagcatatgacgaatctctcaaatatagaattgacgaaatgaagaaatacttgaagaaaactttgaaattgattaaaaagcgtaatatgaaacgaacagagcaggatcatttgcatcgcaaaattgagaaattgaaccagaaagcgattccattggacgagaaagataatgacaaacttgagaaattagaaacaacatatcagacagttgatgctgcgttcaacagcttgaataaaaagtgtattcaattattgcctaacatagtttcatttcttgatgagtttgttgaaaatattaccaagatgatattatgtcaacaattggagacgtttaaaaagctaactgatacttttcaatattttacagagttttatggattgattaaagaaaattcaccaaaatcgtatactgaaataatagacgattgggaactgaacagtacagctacaagattgcagatagagtctcttctaacaattgtgcacgagaaacacccggatttgcttgataaggagatcaatgatgaagattcgctgctgaactattacagattttggcgtaatatgagtaataaatttgttgaaaagaaacatgttgtgaatacaaaagacaaggtaaatggcatattcaatgatact

SEQ ID NO: 2644 - DNA, 783 bp, Candida albicans
gtatcacatcgagatgcatatgaagatatgaaggacaaagaatatgaagcatttattgctgttgaagaacgttataaattgaatgatcaatataataagaaattgaaatcgtttcaaaataatcagcatgcagaatatatcaaattgacaaataaattgaaatctttacaaaattatgaatctgatttaattgataataaattgaaatatattgataatttgaaaaattatcaaactaatggattagctcatttatatactcataattatagtgattatttaagaatgagatcacaaaagagatcattggaagaaataaaagatgctgaagatatgaaacaagaacttgaagagattaaaaagaatggtggacaagttgcaagtacaaacaccaacaccaacacaaagccatccacctattcttctggtgtatcagaattagccacaacaagtgttgaaactcctaaatcaacaacaacaacaacaacaactaacgacactactgatgaaccagtggctaaaaaatcaaaacttgcaaaagaaatcattatcattgacttaccaccaacggttaaacaatcattacaagagaaaattgttgaattggttgaaaattctcttggtataaaagatgaatttttgattcaagtgattaatgaaaatcttgaagcttccaatcttgataataaacaagaattaattgatgaattggtacaagtattagatgaagatgcagaaagtttggtcaatgaattatgggattatatagaaaccatggtgtaa

SEQ ID NO: 2645 - DNA, 339 bp, Candida albicans
agtcatatttggtgtttaagaatatcttcacaactagataagatacccctcttttctcgtaacatgtccgaaaacacatcacaagaattaaaagatgaattatcatctattcaaaaaaattccatcaattattccatattaacatcggatcaagattttcataatgctaatattaaacttaataatcccaagttaattaaagatgaattattacattatcaaaacattttttctaaattgaaatttttatatttagaacaagaaactagagatattttcctaagagaaatatcagaaattaattataaattaccaccaaaaagatctaatttccattaa

SEQ ID NO: 2646 - DNA, 1245 bp, Candida albicans
ctcggatggaaacgaaactgcataaaaaaaataggtgaacccgcaccaccatattcctctctctctgcccccacacaatttcgctttttattcccgttccctcatgagataaacccaacccatataaataccactggccaactcccctcccatctttttctttttttttttttttttcaaattacaaattatttgcttctgcttctatcttatattgatcttaatcctttaaccacaccaccaagtatgccaattccagtttcaatgaaggcaattgtcttctatgccccttatgatgttagaaccgaagaaagaccaacaccaaagatcaaagatcccaaagatgttattgtcaaagttagatactctggattatgtggtacagatctccatagttatcgtggtcatatcaaaggtcccgtgggtacaattataggacacgaattcgttggtaccgtggtcgctactggtgataatattacaaaattctccattggtgatgatgtaattagtaatttttcaattgaatgtggtgaatgttggtattgtaaacatggatattctggacaatgtaatgttaccaatacatttgggaaagttggtttagatgggggacaagcggaatatgttcgtgtgccatatgcagaaacaactttaaccaaaaaaccatcaaccacaaattccaatgacgatgttgatgattcagtttatgtgcttatggcagatattttcactactggttattatggggtgaaaaaaatcaaagattttctttcaatttcagctgcagaagggatcaaacctcaatcatttgaagaaacgacaatattacaattaggggctggtcccgttggattatgtgccttgagaattttgaaatattttggatttggtaaagttgtcgttgtcgacaatgttccatctagattagaagaggttaaaagattaggcgcaactgaagtgataaattttgaaactgaacccgatggtataaagaaatacatcactgaagaaactgatggtgttgggtttgatgctgttttagaagtagtgggatctgctgctgcccataaaacatcatttgacgccgttcgaagaaatgggtttatttcgtcgattggaatgggccacgaacctttcccatttaatggattagatgtctatttgaagaatattaatatgtcatttggaagatgtcattcatggtcattatttcctgatctttggctatttttgaagagatga

SEQ ID NO: 2647 - DNA, 1383 bp, Candida albicans
  unsure (818): Identity of nucleotide sequences at the above locations are unknown.
acagcacgaaccgcccaattatttcaccattcacctattatgacagatctcaccaaacaaccactcaaaggatatgacaatttgtcaacgcctactttattcaacgacaggaatttgcatccaattgcaagatcattcaccacaaatattcttatagttggtggggcttatagtgggttgtctgctttaaggtctctacaactgcatttggccgaacagatacaacgctttaaacaggagcagccatccacaccaataaagaaattgtcactaactatagtagagccaagaaatggacttttgaacatccttggaatcccgaaatcgattgtggattctgcatttgcaaggacacaatttattccgtttaaagacttaaacaattgcaagtttgcaaacatattttccgacaccccaggcgaatacgacatatcgtggtttggtgacgacaacgaatggcttgacatcaactatgtgcatgggagagtgacatatttggaccagcacaaggcacaatatactcttgggtcacccgtatccgagaaagcaattattgagtttgactatgtgattttggccacgggtcgagatagaaactggcccaccacccctttggcaacaacatacgggcaatacatgcttgaaatggacaatgcacgacaggaaattgccaatgccgacaccataagtgttataggtgctggcgctgtgggtattgagtttgctggagatatcaagactaagttcccacacaaaactgtcaatctaatccacccacacgagtgtttcccacaagagccgttgtctaacgagtttanacggctcacacaggactcactcgaacgagcgggtgtcaatgtgtatcttaacacgagaatcagagccgaatcaatagagacacgccatggtgatctcacaacaacaaacaataagacgattcattcaaacctaaatatatggagctgttccaaacacaacaacattgggtttctctcacagcatatctacgagaattacgtgacaagcaacaaaaatatatccatcaaccagtacttgcagctttacaatgcagaaacaaacacaacaatagagaattttttcgtgttgggtgatttggtggagttacccattatcaagtctgcgggctgggccatgtacatgggccgacaagttgccaacaatttgagcaacttgatattcaatgggatatttgttgaactgttcccggacttgaatgccattccgtacgggatggtgattgttggtggtaacaacgagattatcagtgagctagctggtgaggttgaagtggataatgagcattataaacaagagtatgaggattattgtataggtaaaattagagcaactatagatatgtaa

SEQ ID NO: 2648 - DNA, 993 bp, Candida albicans
tttgcaaacatattttccgacacgccagacgaatacaacatatcgtggtttggcaacgacaacgaatggcttgacatcaactatgtgcatgggagagtgacatatttgaaccagcacaatgcacaatacacacttgggtcacccgtatccgagaaagcaattattgagtttgactatgtgattttggccacgggtcgagacatgaactggcccaccacccctttggcaacaacatacggacaatacatgcttgaaatggacaatgcacgacaggaaattgccaatgccaacaccataagtgttataggtgctggcgctgtgggtattgagtttgctggagatatcaagaccgagttcccacacaaaactgtcaatctaatccacccacacgagtgtttcccacaagagccgttgtccaatgagtttaaacggctcacacaggactcgctcgaacgagcgggtgtcaatgtgtatcttaacacgagaatcagagccgaatcaatagagacacgccatggtgatctcacaacaacaaacaataagacgattcattcaaacctaaatatatggagctgttccaaacacaacaacattgggtttctctcacagcatatctacgagaattacgtgacaagcaacaaaaacatatctatcaaccagtacttgcagctttacaatgcagaagcaaacacaacaatagagaattttttcgtgttgggtgatttggtggagttacccattattaaatctgcaggctgggccatgtacatgggacgacaagttgccaacaatttgagcaacttgatattcaatgggatatttgttgaaccgttcccggacttgaatgccattccgtacgggatggtgattgttggtggtaacaacgagattatcagtgagctagctggtgaggttgaagtggataatgagcattataagcaagagtatgaggattattgtataggtaaaattagagcgactatagatatgtaa

SEQ ID NO: 2649 - DNA, 957 bp, Candida albicans
cctcttaacgcaatgctgaccttccaggccgctgtgaagattgggaggaaagtccctgcttttgttttggatgacatttctgacaaggacttggcaactgttgctcgaagaattgcttggggtagatttgtaaatgctggtcaaacatgtatcggtgttgactatgtattggtggcaaagtccaagcacgacaaatttatcctggccttgcaagaggtaattgaaaaagagttttttcaagacgttgacaagacgagaaactttacccatatgatccatgaccgggcatttgagaaaatggagagtatactcaacactacttctggtaatgtgataattggaggcaagcttgatcatggcacaagatatgtgggacctaccgtgattgataacgtaacctggacagattcctctatgaaagacgagattttcggtccaattttaccaattttaacctacactgatcttgaaaaatcctgtcgtgaaattattgctaaccacgatactcccttggcacaatatatctttacaagtggacctacatctagacagtataattcccaaattaacactattaccactttggttagatctgggggattggttatcaatgacgttttgatgcatattgctttgcacaatgctccgtttggtggtgttggaacttcgggaaacggtgcctatcatggagagttctcatacagagctttcacacatgagaggaccgttctcgaacaacatttgtggaatgattgggtactcaaatcaagatatcccccatatgccaataaaaaagacaaattgatcgccagctcccaacaaaagtacggtggtagagtttggttcaatagagaagggaatgtgagaattggaggtccacccctcttgttttctgcttggaacaatgctcttggggtagctgaattagtacgtgattttattggagctggtttgtga

SEQ ID NO: 2650 - DNA, 948 bp, Candida albicans
gcgtgtacatctctatcaccaacaaccatgagtaaaccatctgccatcaaaaagtgtaaggcatctgctattaaaccctcgggtaattcaaaatcaaaaaccccaaaaattgagaccccaaaattgcaacaagttgaaacacgattagaaggcgaagttccaacaactaaagtttcaattaaaagaaacagtattactactgaatctgttaaggcttcagaagataattttactccacaaagcactgacacccctgctgctgctgtagcaaagtctaatccaaaaaccaatgcagagccagctaaaattccaaacgaaaaactgttaaaaacagaatcaccactgagtcaaaaacaaaacggtgcaacaacaacaaaggaaaaatctgatgttctgttggagacaaaatcgacgtcatcaactactgtcagcaacaataactcggtcttacaatataccgagttgtcggagatccctattggtgttgaaagaattactaaggccttccatagtggcaaaacacactctttacagtttagattgaaacaattacgaaacttgtactttacaatgaaagacaaccaggaagctttgtgtgacgctttgcaaaaggactttcaccgtcttccttccgaaacaagaaactatgaatttgccactggattgaatgagctagtgtttattatgtcacagctccacaaatggagcaaaccacaacctgttgacgagttgccattgaatttgtctttgaatccagtttacattgagagaattcctttgggaacaattttagtcattgctgctttcaattatccgttttttgtctcgatctcaccaatagttggtgcaatagcaagtggcaacacagttgcactcaagccttctgagttaacaccccgtttttccaagctttttactgacttgttgtcaaaagcattggacccagag

SEQ ID NO: 2651 - DNA, 1485 bp, Candida albicans
  unsure (1430): Identity of nucleotide sequences at the above locations are unknown.
tttgactataaatatcaagggatattcattttgccttcaagttcctgttttttttttcctaattttccccaactattcgttctaagtaatttcccctttgtccaaaaaatgtcaccaccttctaaaattgatgaatcttttactgatatcggtaatactagtacttcttggtacactgaaatcaaaagtattgaaccgggtgtcaagcatttaactgactcgttgttcaccaagcaaaagacacatgatatccaattcagattaaaccaattaagaaacatttattatgctgtccaagataatgttgatgctctttgcgaagcattgagcaaagatttcaatagatctgccagtgaaaccaaaaatttggaaattgttggtggattgaatgaattagtccacaccattgccagtttacacgaatgggttaaaccagaaaaggttaccgacttgccaatcactttaaaatccaatcctatttatattgaaagaatcccattgggtgttgttttgattatttctcctttcaattatccattcttcttgtcgttttccgctgttgtcggtgctattgctggtggtaatgcagtggtgttgaaacaatcggaattgacccctaatttcacaagattgttcagtgaaattttgaccaaggctttggataaagatatctttttggcagtcaatggtggtatcccagaaactaccgaattattaaaccagaagtttgataaaattatgtacactggtaacaacactgtgggtactattgtcgctaaaaaggcagctgaaactttgactccagttattttggaattgggtggtaaatctcctgcatttatcttagacgatgttcaagataaagatatagaaattattgccagaagaattgcttggggtagatttactaatgctggtcaaacctgtgttgccgttgactatgttttggttcctaaaaaactccatgacaagtttatcactgcattgaaaaaagtgttgaatgaagaattttatcctaaacttgacaaaactgataaaacttatactcatgttatccatgaccgtgcctttaccaatttatccaaaataatatcaaccaccaaaggtaaaataattgttggaggtgaaactgacccagaaacaagatatattgcaccaacagtaattgataatgtctcatgggacgattcatcaatgaaaggtgaaatatttggtccaattttgccaattttaacttatgataaattgactgactctctcagagacattatcagataccatgacactcctttagctcaatacgtgttcacttctggttctacttctcctaaatataacagacaattggatcaaatcttaacaactattagatcaggtggtcttattgttaatgatgttttgatgcatgtggccttgataaatgctccatntgggaggggttggtcaatccgggttatggctcttatcaaggtaagtttccgttcc

SEQ ID NO: 2652 - DNA, 606 bp, Candida albicans
gttatatacattttcttgtttttttctttacttactcattctatcaacatcaaaattaaaaccatgaaagctgctgtcgttccagaatccgtcactgagaccaaattggccgaagtcaaagaaatccctaaaccaaccattggcgatgaccaaatcttaatcaaagcagaagctgctgctgtaaaccctactgattggaaacacatagtatttcaaatgagtaaacctggtgatgtcattggaagtgacgtcagtgggaccgttgaagaagttggatccaaagtcaccaatttcaaaaaaggtgatactgtcagttctttcattattgggaatatatcacctgatagtggggcttttggtgaatatgttattgcatatcctcaagccactatcaaatacgaccatagtttaagccattcctcagcaacaaattcatcaactatcaagtcttatgaaggtgctgctagtgtcactttgggtttatctactattggtatttcattttcccattacttaaacataggcaaacataagaaagaaggtgattctatattgatttggggtgtgctactgtcttcacacgcggctggaaggaaccgcacttgc

SEQ ID NO: 2653 - DNA, 426 bp, Candida albicans
atttacaattttataatatactatacaattaatcttaaacattacacaaccataatgcaaactcaatcaggatatggatacgtcgaaggatattcagacattcaaaaattcactgatatcccaattccaacgccaaaagggaatgaagtattattaaaagtggaagctgccggattatgtctttctgatccccatgtattaattgctggtccaattgaaagtaaacctccaattccattagctacaaaatttgtcatgggtcatgaaattgccggatctgttagtgctgttggtgaacaattagttaacgatccaaattataaaaaaagtgctagatttgctttacaaattgctaaagcttgtggaatgtgtgattcatgtcataaacgatatgatggtgtttgtgatctgagtcatcaagcctaa

SEQ ID NO: 2654 - DNA, 873 bp, Candida albicans
atactccgagatatctccaatctcaaaaatagaaaaaccagctaccaagaaaactcgacacataagcttgcaatgtctcaattattttccattaatggccaagtagcaattttaactggtggtaccaatggtattggattaggttatgccaaaggcttagctagtgccgacttggatcaattgatattaacctacagatcagaatccactttggaaaaagcaaagaaaataatccatgaggtcaatccaaatgttcaaattgatggtatcaaaattgattttttaaaagatgaagaagatgaaattatcaccaaaatagttgaagaatcctataaattatctaaaacttcaaacattgatattttggtcaataatgcaggaataactgaaagatatccttttgaagatttcccacaagataagtttgatgacgtgataaaagttgatttgaatattccggtaaagttgactaaagctattggtaggaaaatgcttgaaacaaataccaagggtaagattgtttttaccgcttctttattatcattccaaggcgggatgttgtcgaccccctatgccatcagtaaaggtgctttaaaacaattcacacaagcagtatctaatgaatggtcatcaagaggtatcagggtcaattcaattgcacctggatatatcaaaaccaatttgaccgacagcatgagtgaagagaacaagaaaattgttgatttgagaatcccaatgaaaagatggggtaacccagacgactttatggggccaattgtctatcttacatctgatgcatcgaaatatgttactggtgacacattattagttgatggtggttggatgggccgatatatacacgaaatctattga

SEQ ID NO: 2655 - DNA, 282 bp, Candida albicans
ggccctgacgcagactacattgttgtctatgccaaaacagagccggaaaagggctccaagggcatttccgcatttgtcgtcgaaaagacgttcaagggcttctcctgcgcgcgcaagctcgacaagttgggtatgcgtggatcaaacaccggagaacttgttttcgaagacgtcttcgttcccaaagagaatctcctcggggagttgaacaagggtgtccgagtcctaatggaaggtcttgatctcgaacgtcttgtcctcagtgctggtccactcgggtaa

SEQ ID NO: 2656 - DNA, 1635 bp, Candida albicans
tcaacaactgatttaaacttcttccacccccccagaagaaaaatgaaaactgaagcagccgttgaagaagcaaaaaaaaaaaaaatttgcgctagatctgatcttggaagtttatcttcatccataaaacacaacattatcactaacaacacgatgtctagtttccagctcactgatgaatctgacaatgaccaagattccgtgttagagtttgaaagattggaatcaacattgccccctgctttaaaaagatccgcatcctcattattggaagcaattcaagcatcccccacaactccattgcacaatcctatttcacaatccgggaaccaccacgctcatgatgagtctagcttgaggtctccacaaccacaccatgttcgtgaaaactatcacgcaagcacatatcagacaattcctggaagaacaccactggctaccccaaacttgaaaaactcaaactttagacagcatttgatctccaaattgtcaaagctggagaatggtagagaaagctcgcccatcccattgcccaagccaagatttaacgagagcaccttcaagcccgcattgaacaccaaacagtcttcgaccggggtcttgtgggtaacggaaagggccgcagagtatgggtacgactctgagcatgttggtgattgggctaacttggggcaaggtgcacctgaacacggtgacacaattcccgggtcttttcctagacccaaacaaatcaacttgccagtagactatcgtgagtacgccccaactgccggtatcaaggagcttcgtgaggccgttgcaaactactacaacgaagagtaccgtcaaggcaaagcatcaaagtacacgtacagaaacgtatgtattgtaccaggaggaagagcagggttgacaagaattgccacgatcattgccgattgttatttgtcattctttcttcctgattacactgcgtactcggagcttattgccactatgaaaaatttctctcccattccggtgcctttaaaggaaatggacaattatgaaatgcatcttgatttgattagggatgaattggccagagggatgagtgcattgttgacatccaaccctagaaatccaactggaaactgtctctctagggatcagttgcaggaattgcatcgcatgtgtcgtgaaaagtgtttgattatcatggacgaattctactcgcactattattacgatgagggctgtactgggtcatctataagttccgctgaatatgtcgaggatgtgaaccgtgatcctgtattgattttaaatggtttaacaaaggcatttagattgcctgggtggagaatttgctggattttgggacctgaagactacatcaatgctctttcttctgctggatcgtttttggatggtgggtcaaattcacctttgcaacatgttgctgttgacttcttgcagccattgaaagtgaagcaagaaatgatggcattgcaattgcactttaaaatgaagcgtgactatatcattggaagattgtcaaagatggggttcaagttcaccaagaaaactattccaaactctacattctacttgtggttgaatttgagtcacttgccagggaagttgagcaactgtttgggcttgttttcaccacgg

SEQ ID NO: 2657 - DNA, 615 bp, Candida albicans
catgtaggattacaagttaaaccggaacattatcctaaattgggacaagtattaattaatgtcattattaatttatttccaaaacaattagttcatgatgaattcattgaagcttggacattagcatatcaaaatttagctaatttattaattaaattagaatcagaacaatacgttgaaaaaccatggtatggattcaaacaattcaaagtgacaagattacaacgtgaatgttcagatgttaaatcattatatattactccagtagatggttcacctattcctaaacctaaacgaggtcaatatttatgtatgagatggttgttaccaggagaaaaacatgaaataactcgagaatattcaatttcagaatatcctaaaaataatgaatatcgtatcacagtaagatatattcctggtgggaaagtttctaattatattcataataacataaatgttggtgatattgtttattctggtccaccatgtggtgattgtgtatatgaatcatcactgaaaaatttagtgtttttagctggtggtaatggagtcacagcattattacccatgattgaacctgtgtcttcaccgcgagtagccggaaagcgcttaggt

SEQ ID NO: 2658 - DNA, 300 bp, Candida albicans
atgactgttgctagtgctagtattatcaataattatattgaaagtaaacctttaacaccagtacatattcaaatcattattgattcggtccctatattagaacatcttgacgttcaattaattgagaaattttatagacgattattaaaacaatatcctgaatttaaaccatttttcaatgaaactcatcaaaaattattacgtcagccacgaatcatgattcattttttaatacaatatgctaaaaatattcaagatttaactcccatgattgattttattaaaaaaattgattcttaa

SEQ ID NO: 2659 - DNA, 1269 bp, Candida albicans
ttttatgttgttttatatcactatagaatagataactttactttagacaactttagaacagagcagctaaacatgacagtcgaatacgaaaccaaacaattaactccagcccaagtcaaaatcattttggataccgttccaattttagaagaagccggtgaaacattgactcaaaaattctatcaacgtatgattggaaattatgatgaagttaaaccatttttcaacaccactgatcaaaaattattgagacaaccaaaaattttagcatttgctttattgaattatgctaaaaacattgaagatttgactccattgaccgattttgttaaacaaattgttgttaaacatattggtttacaagtgttaccagaacattatccaattgttggtacttgtcttattcaaaccatggttgaattattacctccagaaatcgctaacaaagactttttggaagcttggactattgcttacgggaacttggctaaattattgatcgatttagaagccgcagaatatgccaaacaaccatggcgttggtttaaagatttcaaagtgacaagaattgttcaagaatgtaaagatgtcaaatccgtttatttcactccagttgataaagatcttttaccattaccaaaacctgaacgtggtcaatacttgtgtttcagatggaaattacctggtgaagaatttgagatttctcgtgaatattcagtgtcagaattccctaaagaaaatgaatatagaatttctgttagacatgtcccaggtggtaagatctcaggttatattcataacaatttgaaagttggcgatattttgaaagttgctcctcctgctggtaattttgtctatgacccagctacagacaaggaattgattttcgttgctggtggtattggtattaccccattgttatcaatgattgaacgtgctttagaggaaggaaaaaatgtcaaacttttgtactcaaacagatctgctgaaactagagctttcggtaaccttttcaaagaatacaagagcaaatttggtgacaaattccaagccattgaatacttttctgaagacaataacactgatgacaagattgttattgataaagcatttaaccgtaaattgactactgatgatttagattttattgctccagaacatgatgtgtaccttgttggtccaagagagtttatgaaagatatcacagaacatttgggtaaaaagaatgttcctgtcaagcttgaatattttggtccttacgatccttaa

SEQ ID NO: 2660 - DNA, 924 bp, Candida albicans
cgcaagctcggatcctgccagccggctggtgaagaacattacctagatgagttagatgctgcaatgaacgaaaaattttcagacaagttgttcgctaatagttctgaaacagaagctaagcagtggttgagcaagactgcaaacgctcaaccggcgatattagcatcaacctgtatactttcaaacttggtcgaaactgaacatcaaatatctattattgacaatgcttcttatttattaggtcactcgttaggcgaatatactgctcttgtgctaagtggaattattgattttactattggtataaaggttgttagacgaagggggcaattgatggaagatttatgtctgggccaaaactacggtatgattgcattgttaataaaacccaagtttgccaaagaagttattgaactagctcaagaacacaacgtgttaggaaatattaattcaaattatcaagtagtgatatcaggtgagattaccaagctaaaagagtttattgacatactaagaaagatccaaaagatggctttaataaaagcagtgcaattacctgtatcaataccattccatagtgagattttgaaacccgttgtccctgagttgaaactgctattggacggtgcactcaatgatcaaaaaattccaataatatctaacttgaatggccaggtgtcgtatgaaaaggagtctactatccgtaatatattggaggccaactaccaaccagttcagtggcagaaatcaatagcgtatttggaaaattcacccgtgagtacaattttcaatcttggacctggtgaagccttacatgggattaataaaaagtataacatcaagtctgttagtctagacgatgtgaaatcgcttgataaaaattcagagtttatggaactaaaacagcagctaaagcaaaattga

SEQ ID NO: 2661 - DNA, 789 bp, Candida albicans
ctgctttacaatatgagttccattacattagcaccagaatctcaaatcaaaggtaaaactgcaattattactggtggtactaaacatttgggtggagaaacagctagagaattggctaaattaggagccaatttattcttgcattatagactggatgcaaatcaagcagaaactttcaaacaagaattgacgaaagaatttcccgatttaaaaattgaaatttatggtagtaaattggataaagctaaagatttaaccaaattatttaccactgctaaactgaaatttcctcaaggtattgatattgctattaataatgttggtaaagttttgaaaaaaccaattactgaaatttctgaagaagaatttgatgaaatggatattgcaaataataaaagtgcatttttttttattaaagaagccggaattagtttaaatgataatgggagaattgtttctattgtcacttcgttgcttgcggcttatactgattcttatggattatatcaaggaaccaagagtggagttgaatattatagtaaagctgcttcaaaagagttacatggacgtgggattagtgtcaattgttgtgctccaggtcctatggatacaccattcttgtatggtcaagaaactgaacaaagtgttgcatttttcaagaccatgggattacatggccgtttgacaaaagtttctgatattgttccaattgttagatttttggtcactgaaggaggatggatgactggtcaaactttgtatgcctctggtggattcacagcccattaa

SEQ ID NO: 2662 - DNA, 1083 bp, Candida albicans
gaaaaaaaaatgtcatccaaacaacaatacttgaagaagaatcctgacgatgtcgttgtcgttgcagcatacagaactgctttaaccaaaggtggaagaggtggattcaaagatgttggatctgatttccttttgaaaaaattgactgaagaatttgttaaaaaaactggtgttgaccctaaaatcattcaagatgctgccattggtaatgtcttgaacagaagagctggtgatttcgaacatagaggtgcattattatctgctggattaccttattcagttccatttgttgcccttaacagacaatgttcatctgggttaatggccatttctcaagtggccaacaagatcaagactggtgaaattgaatgtggtttagctggtggtgttgaaagtatgacaaaaaactatggtccagaagcattgattgctattgaccctgcttatgaaaaagacccagaatttgttaaaaacggtattccaatgggtattactaatgaaaatgtttgtgccaaattcaatatttcaagagatgttcaagatcaatttgctgctgaatcttatcaaaaagctgaaaaggcacaaaaagaaggtaaatttgatgatgaaattttaccaattgaagttttccaagaagatgaagatgctgaagatgaagacgaagatgaagatgaagatgctgaaccaaaagaaaaattggttgttattagtaaagatgaaggtattagaccaggtgttactaaagaaaaattggctaaaattaaaccagctttcaaatctgatggtgtatcttcagctggtaactcttcacaagtttccgatggtgctgccttggtgttattgatgaaacgttcatttgctgaaaagaatggattcaaaccattggctaaatacatttcttgtggtgttgctggtgtcccaccagaaattatgggtattggtccagctgttgccattccaaaagttttgaaacaaactggattatcagtcagtgatattgatatttatgaaatcaatgaagcatttgccggtcaatgtttgtactcaattgaaagttgtaatattccaagagaaaaagtcaat

SEQ ID NO: 2663 - DNA, 582 bp, Candida albicans
  unsure (22): Identity of nucleotide sequences at the above locations are unknown.
ggtatgccaactttggcaccanactatttgcctgacaacattcacgttacgttgcaatctgaaaatggtatactaggattaggtccatatcctaaaaaaggtgaagaagatccagatttaatcaatgctggtaaggaaactgtcactttagcaccaggtgcttctttgttcggatctgaagagtcttttgggatgatcagaggtggtaagattgatttgacgatattaggtggcttgcaagtgtcatcgaaaggggacttagctaactggggattaccaggaagagtaaaaggaatgggtggggcaatggatcttgtaagtaatccctccgccacaagagtggttgtggttatggaacatgttgacaaaaaaggtagaccaaaaattcttgaggagtgtcaattcccattgactggtaaaaggtgtgtttccagaatcattactgatttagctgtatttgatatcatcgatgaaaagttgattcttgttgaaattgatcctgaaacaactgttgacgaagttacttcgaagactggagccaaattcgaagttgcaaaagatttgaaaaaaattgagatttaa

SEQ ID NO: 2664 - DNA, 909 bp, Candida albicans
atcgtgatgaagttgttagccaagaaaaccacattccttgttagatttgtttcgactactcgtccaaaatcaaaagttgtaaccacaactgacgaagcccttaaagggattggatctaatatcactttgttatcaggagggtttggtcttagtggtgttccagatacaattataaacgcaatggtaaaccatccagcaattaaaaatgtaacagctgtttctaataatgctggtttggatggcagaggattatcccaactattagtcacgggacagattaccaagatgatttccagttatattggcgggaacagaacattcgagaagttatatcttacaggtcaaatagacctagagttgactccacagggaaatttagctgagcgtgttcgtgctggagctgcaggcattcctgctttttattcttctgctggtgttggcacttggttagaagaagggaaattaccagtgagatacgacagcacgggagaaaaagtgttgaaaaccagcgatcctcgagaagttcgtgaattcaacggaagaaaatatttacttgaacctgcaattcaaggagacgtggctattattaaagctttcaaggctgacactttgggaaattgttggtttagaggagctgcaagaaacttcaactcggtcatgggcagaaatgcgaaattaacagtcgtcgaagccgaacacattgttgaaccaggtgaaatcgccccagaggatgtccatttaccagccatttatgttgacaaaatcattcaatcaaccacaccaaaagacatagaattatttaccttttcagacgaaaaatccgggaacgaaagtaaccaaaaactggaagtggaattgaaacgagctaagatagtgatcttaaccccgggactgccaataccgcgctaa

SEQ ID NO: 2665 - DNA, 1209 bp, Candida albicans
cggattttccagccccgtgggtggagacgacctttaattcagcttagatatagatctacaaagccgttctatataactacacctatattttatgtcaatgcagcaccacatataggtcatttgtattccatgttgatagcagatacaagaaacaaatgggagaaattaaatccactgaaagagtcatttatgttgactggtacagatgaacatggtttgaaaatccaactgacggcggaaaagcttgggttggaacctaaggtattggttgataaagtatcccaaaacttttccaaattggcagaacaatttgatgttaattatgacagattcataagaaccacagataatgatcatattgagctagttcgttacttttggaacttgatgatggaaaaagggtttatttacactgatactcacagtggatggtattccatcagcgatgaaacatttttcccagaaacacaaatagaagaagtggtgaagaatggaaaagcagtgaaaatatccagtgaaactaaaaatgaggttgtataccagaaggaaactaattattttttcaagttgtcgatgttccaagaacaattgattcaatttttaaaacagaatcctgaattcattaaaccaaaacatagatatcaatttattttgaaagaactagaggacactaagttacctgatttgtcaatctcaagaccatcttcccgattgaaatggagtattgaggtacctaacgacagcactcaaaagatttacgtttggttcgatgcgttgttaaactatttgacggccacaaaatttccccacggttttgaggttcaagattcaaaatttgtcactcctgaaaatagtatatggccagccactcatgtgataggaaaagacattatccgtttccattgcatctattggccaatatttttaatggcagctggtattgaattgccaaaacaagtgatagtgcactctcattggttgtgtgatgggttcaaaatgagcaaaagcttgggaaatgtggttgatccaatggaaattagtgagtattatggtgtcgacccagtgcggtttttccttgttgaaaactcaaacatcgatgacgattgtaaatttagtgaagagttattacaaagatctagagatgctgtgttgggaaaatattgtaacttaatttcacgaattggcgggaaaaactttagcattgaataa

SEQ ID NO: 2666 - DNA, 903 bp, Candida albicans
atccggtccttccatggctgttgcgaatacccaaaccccacggaatgggctttgctcaccccgttaaactcgttgaaggattttactactgaagttgattcacaattacatttcattgttaccatggtgcctgaaggtaaacatgtgaaatcagttgtgtccgaattggttggtcattataaatcaactggtaattatgatccaagtatcaaaaccactttcttggattcttcaacaatcgatatcccaacctcaagagacgtacaccaattggttaagtcaagtattcctgaatttgactttattgatactccagtgtctggtggtgttgcaggagcaagaaagggaacattgtcatttatgttgtccagagaaacccatgatgatattgatccaagtttaaccgcattgttatctaaaatgggtatcaacattttcccatgtggtgctactcatggtactggtttggctgctaaattggcaaacaattatttattggcaatcacaaacattgctgctgctgattcattccaattggctgaatcatttggtttgaacttgcaaaactatgctaaattggttgctgtttctacaggtaaatcttgggctagtgttgacaattgtccaattccaggtgtttatccagataacaatttaccaagtgatgtcaactatgaaggtgggttcattaccaaattgactagaaaggatgttgttttggctactgaatctgctaaattcaacaatagattcttgatgctcggtgacattggtagacattggtatgataaggcttgtgaaagagaagatattgccaatagagacttgtctgttctttttgaatggttgggtgatttgaaacaaaatgaaaaaggtgatgtaattgatgtcaaaagaaaataa

SEQ ID NO: 2667 - DNA, 1620 bp, Candida albicans
gcaagtcacaacatgctactgcaccgactaattcccagagtaataccgagagttggaaactttattaggccttttttggtttcacactatctgaccacgtcggatgccgacaatttaacatacgagaatagaaaagggatcatcaccaatgatggaaagaatcacgttgattccaagtattatcccctgctttcggtcgttcgtcaaagattagcaggaagtgaaaaattacgtgtcaaagaattttgtaaaaactttaaagacgttgttaaatttctggacatagataataaccgactgtgtgagatttatttgcttgaagggagaataactagtataagaaaatcaggcaaagctatgtattttattgacatagtccaagacgactgttcagtacagattatggcaacgaataaattaatggggatggatccgacggcttttaatgattgtcatagctttttcaaaattggcgattatattgctgttaggggttacgcttccagaacgaaaactggagaattgactttgaaattgaacaagcaaattgaaatgttgacgcctgttttgctgaaaatgccaaacagattagaggatcgtggcttgattaataataatagggttctaaactatctagtaaaccgagattccaaggatgcaataattgtcaagtcgaaagtcattcaagccattcgaaattttttactcgatagagattttttggaagtacagacaccaatattgagtggtcaaggcactggtgctaatgcaactccatttgtaacaaaattcaagggggaacccgtgcatttacgtgttgctccagaactatggttgaagaaattagtgattggtggatttgataaggtatttgaaattggcagtaactttaggaatgagggcattgatatgactcacaatcctgagtttgccacctgtgaattctatcaagcttacactaatttggatgaattaatgaaaatgacagaagatatgtttggttatgtttttgacaagttgggggttacagataaatttcctactggcaatttccccaaatacgagtttttgcctacgatcgaacaaaagaccggagtgtccattactgatttgactttggacggattggttaattatcataagagattggacttggcagtaccaccaaaccctaatccagttaaattgttgaataatttgtcagaaatatatttggaatcaatttgctcggaacatccaaataccccagtttttatatataaccagccagagattatgtcaccattggcaaaatcaattacagatgctgcgggcaatagaatttcatcgaggtttgaattatttataaatgccagagagatggccaatgcatatgaagaggaaaatgatccatgtaagcaattagagaaattcaaattgcaacaaaaaatgaaagctgattacaacgatcaagaaatgttgatcccagatcataattatgtttgggcaatggaatatggattgcccccaacaggtggttggggatgtggcatcgatagacttgcaatgttgattgcaggtgcaaatagaattgaggatgttctaacatttgggacattgctgtctgttttgaaaaattga

SEQ ID NO: 2668 - DNA, 1863 bp, Candida albicans
aaccttcatttaaactatttaacccgcctctttccttctacaacaattctttttttcagaaaacaactgaaaagatttatgaataaatatcccaaatcaataatgtcgaaacaatttatgaaattcccctccagaaggtcaacagtatattctgctaaaggaatagttgcttcaactcaaccactagctaatgctgctgggttgaaaattttagataagcgaggaaattgtgttgatgcagcaattgcggtttctgctgctttaacaattactgaaccagggtctacaggtattggaggcgactgttttgcactttactacaaattgaaagataaactggatccaaaaagtggggtcgtgttggggttaaatggatctggtagagctgcacaaaatgtgacaccacaagatgtttggaacgagcacaacgaagggaaatatatgccaagaataccttacacttctgttttttcaatcactgttccaggggcaattgctggttggtttgatgcttatgaaaaatgggggtcaggtaaagttacttttgaagagattcttactcctgctgttcaattggcggaagaagggttccctgtttctgaattatcaagccacgcctggagaaattgtattcctaaattattgaaacaaaatcctgacgtgaaagagaatccttttgttcttgaaggtaatcgaggacctgaagaaggtgaatatgtaactaatcaccgcgtggctgaatgtctcagattaattggcaaacatgggaagaaagttttctatgaaggtgcaatcgcagaggcaattatcaaaactaccagtggtagaaatcacaaattaacacttgatgatcttaaaaatcatacttctaccatagttgaaccaattaaacttaattttcaagactacaatgtgtgggaaattccacctaatggacacgggttggttgccttaatagctttggggataattcaggaacttcacaatctgggtaaaattaatttacacgaattgaaacacaattcgtcacgttatttacacatattaattgaagcctgtaagcttggattctacgattcagatgaatatgtcacagacccaactttcaaggatattccaattgatggcttattaaatcctaaatacttgaaagctagatcagaacttgtcgattcaaacaaaatcatagatggtgataaaatgaaacacggagttccagatccaaaatttaaatcggacacagtttatcttacagtgagtgattccaatggagaagtttgttcttttataaactcggtttatgaaggatttggctctgccatattagtagaagattatggattctgtttacaaaatcgaggcaataatttcaattttacagcgggacaatcaaattgtttagaaggtggtaaacgaccatatcatacaatcatcccaggaatgattactaataatgatggatcattgtatgctggttttggtaatatgggagggtttgctcagcctgtatgccatgtgcaacatgtattaaatttgactgtatttggaatgactccacaacaactgattgactctcccaggtttgtattgaattctaataatgacgactccgctgacagaggacgcggggcaggtggtccagttcgtactccaataacagttgtgcaattagaagaaggtattgagcctaatgtgattgatgatttgaaaaagcttggacatgaagtggaagttttaagtggctatggtagagaaactttcggccgagcacagatcattaaaaatgtttccaaagatggaaaattaatatacgctggtggtagcgacatgagaggtgatggtgcagctgttgccttgatttaa

SEQ ID NO: 2669 - DNA, 1290 bp, Candida albicans
tttatacacccatgttatcaagggttaatttggaaaaataatttttttattaataagaacaggacccatattggtgtttcaaaacttgctactagaaataaatccattatttgttattcatcaaccaccactgaatatccaaagggccatacgacaggtaatggtgaaccatatttaactccaagttttgttaataatgaattcattaaatctgaatctgacacttggtttgatattcatgatcctgccaccaataatgttgtttctaaagtcccacaatcaacccttgaagaattggaagatgccattgtttctgctcataaggcattcccaaaatggagagacaccagtattattaaacgtcaaggaatcgcctttaaatttgttcaattattaagagaaaatatggatcgtattgcttcagtgatcgttttagaacaaggtaaaacttttgctgatgctcaaggtgatgttttacgtgggttacaagttgctgaagctgcttgtaatgttactaatgatttaaaaggtgaatcattagaagttgccactgatatggaaactaaaatgatcagagaaccattaggtgttattggatctatttgtccatttaatttccccgccatggtaccattatggtcattaccattggtattggtcacaggtaatactgcagttgttaaaccaagtgaacgtgtacctggagctgccatgattatttgtgaattggctgctaaagctggtgtccccgctggtgtccttaatattgttcatggtaaacatgacaccgttaataaattaattgatgatcctcgtattaaagctttaacatttgttggtggtgataaagccgggaaatatatttatgaacgtgggtcccaattgggtaaacgtgttcaagccaatttaggtgctaaaaatcatttagtggttttacctgatgccaataagcaatcatttgttaatgctgtcaatggtgctgcatttggtgctgctggtcaaagatgtatggccatttctgttttggttaccgttggtaaaaccactaaagaatgggtcaaagatgttgttgccgatgctaaattattgaaaaccggtagtggatttgatccaaaaagtgatttacgtccagttattaatccaaaatcattaactagagctgaagaaatcattgaagattccgttcaaaatggtgctgtattagaattagatggtacacgttataaaccaactaatgatcctgaaacaaaattcactaaaggtaatttcttggctccaactattttaacc

SEQ ID NO: 2670 - DNA, 2352 bp, Candida albicans
ttcttgctagacccaaaggtgaaccatcatcaagatggatctcaggaacatggtggggataacgacaacaatgatgaggacgatgatggagatgaagatttgaaggcgattttcaattttattagacataaattacgtaatatatcttcatattctgccgattcaaaacgtttaattctcaaagatttcaaacgtgttaaggcatcagcaaattccccaggtggaggtggcaattctgatttccatgttaaacgtaattatttagaaattgttatggatataccatgggataattatgtgactaaattcaaatctaataaagatattgatttgaaattagctaaaaaacaattagatgatgatcattatggattagaacatgtgaaaaaaagattaatacaatatttagtagtattaaagttgttgggtattaatgctgaaaaagatcaagctctacaatccaaagacgaagagaattccaaaaatccagcccattatgattccaattccaattccaattgtaattctaactcaagatcattaaccaaatctccaacatcttcattggcatccaaaacaccatcatatattgtcatagcaaataatgatgaaacatatttagctaaacaacaagctaaaaccagaaatcaaaaatcaattactgaagctaaaaccaatgtttcaactaagatggttccttccaatgaatctattcaagtatctaaaaacaataaatcaccaataattatgcttgctggacctccaggtactggtaaaacatcattagctaaatcaattgcttctgccttgggacgtaatttccaaagaatatctcttggtggaattaaagatgaaagtgaaattagaggacatagaagaacttatgttggagccatgcctggattattaattcaagcattacgtaaatccagatgtatgaatccagtgattttattagacgaaattgataaagttataggtggtaattctggtggtgtcaataaatttaatggtgatccttctgcagcattattagaagtattagatccagaacaaaataatacttttattgatcattatttaggattcccagttgatttatcccaagtgattttcatttgtactgctaatgatccatggaatatgacaagacctttattggatagattagaaatgattgaaattggtgcttatgattataatgaaaaattaatcattggtaaaaaatatttattacctagacaaattaaacggaatggattcccagttacaaaagtgggtaaaaataataccggtaatcaagatgaatttattaaaatcaatgatgacactatgaaaaaagttatacttgattatacaagaggagaagctggagtaagaaattttgaaagacgattaggaactttatgtcgatttaaagccgttgaatattgtgaatggttaaataaagacattaaaaattataatcctataattgatgaaaatgatttaccaatatatttaggagttccatattctctgggtgatgtcactactgaaggaacagtgggagttggagttgttcatggattatcatataattctgatggatcgggatcagtattagtttttcgaagtattggatttgatagaagaatcagtaatggtaataaagaacataatggtggtgatggcagtggtggaaatggagctacattaaatatgactggtagattaggtgaagtattaatggaaagtggtaaaattggattagtatttattaaactgatgatttataaaaacatcttaaaatttgataacaacaacaacaacaacaccaacagacatttattattggataaatataataatttggatattcatatgcatgttcctatgggatcagtatctaaagatggtccatcagcaggtgttaccatggcattactgtttttatcagtattattagataaaccagtaccatcagatattgccatgacgggagaaatcactttaagaggtatagtattacctattggaggagttaaagaaaaattgatgggggctcatttaaatgcaaatattaaacgaatgattgttcctagagaaaatcgtaaagatttaattaaagaatatagtagaagtattgaagaagctggtgaagtattagatcatcatttaattaacgatttaattaaagataatgaagataatgaattcaaattaactcaagtggaagattattatcaaaataaatatggtatttccttgttttatgctaaagaattttatgatattattaaaattgtttggaatgaagatgaagtgttattgaaagaaaataattcaagattacttgaatatcatatttag

SEQ ID NO: 2671 - DNA, 606 bp, Candida albicans
acaatgctttcatcattgagattatcaagcataagagctgttaatagtgggtcaatacgatttgttagttcaactgttccaaaatcaaatgcaaaattgtctgtgggtgactcgaatgatacatcaagcaaaacaaacattgatgatatgaagagtaaaacttcatggaacgaatcatatacttcagggtcatcaatacaagtgaatttgaatgaaaatttaaacaaaataaccgaaaatatatcctcatctgatccaccaatttacgtgtcgcctaacttgcatagacatttcacaatgggtgatacatataacccctttgatttcagtatgaacagatttgatatggaaaagaaaatgaaatccaccaagaagttatcagatccatttgaaaagtcaggaatcgatccaaagaatttgtatttgatgccagagatattatccaagtttttaacctcgactggtcaaatattgcctcgtcaagtaacaggttgtaatgccaagaatcaaaagagactatccatggctatagaatatgcaagaagcttaggattgttatcctcacaacatagacatgccagatacatgccaacaagaaatttgtag

SEQ ID NO: 2672 - DNA, 741 bp, Candida albicans
  unsure (720): Identity of nucleotide sequences at the above locations are unknown.
tcaaataaatatcacagtaaaagtattaactgttatcaaaattcttacatagagtggttgtttttttttcaactattaataatgcaaagtgggttctcaaaaaacaaacagttttatacctatattccagcagtcaattctagtagcactaaactattattgttcttacatggattaggctcatctcagaatttttattatcctattgctaggaaatttcctcaatttaatgtcttgttaattgatcatgaaggagcaggacaatcgaagttgttgcatcatactaatttgtcgttacaggacttgtctgaaaacgtcgtttcggttttacaagagttatccttgaataaattagaaattaccttaattggacattcaatgtccggaatgcttgtcagttatatgaatttgtttactgatttaccaattattgaaaatgtattgattgctcctgttcatcctcgaaagaatttggtagatataatgcaaaagaggatcgattcattgcaagtaagtaaatcactaattgaatttagtaatactattcctgaagcagctactgggtctaactgtggtgatttacaaattgcttttataagacaattaatacaaggaaattctgttgatggttatattgccaattgtcaggctatcaatagtggtataaattacgattttgactatgcaagaattaataagccaactttgtcttcgaccacnggggctagaagatccgcgtcc

SEQ ID NO: 2673 - DNA, 2205 bp, Candida albicans
ataaataactttatgcaacccacggtaccacactttaagatcctagggatatctcccacgtcaacattagatgaaatcaggagggcataccgcaaactatcattgcgataccaccctgacaaaacaccacgtcgagaagatcatgaaaaatttaaagagatcaatatagcatatgaaacaattagagattattatcaagagaatgggcaaaagaacagtcaaccgatccctaacacaaacacagagcataattcccatcaaaaaccacattataacactggcccttattccacatatcgttttacgacctcatctaccacgactgataataccaatcacactggacattcaagttctcggtttacttattataatttccaccaaaaagcgcaagagaataaccgcaaacaagatgaagaaagggcagcccaacgtgaacgattaaaaaaggagctcttccagaggcaacaagcggaagaagcacaacgaaagaaggaatttgaacaaaaggccgaattcatcaaagcatcattacttgaaatgcgccgaagagaaatagagaggcggaaacagcaaaaggaaagggaacaaagacaaaaggagcacgaagcaaagagggatatcaggatacaacaactttcagagcaggattcacggagtaatcaaactaaagaagaagaggaagtgttcaagaaggcccggtctactgattcgggagcagacgagactggtttgatgtcagataaagagtttgatgattctgcatattcacccgattatttgtttgaagagaatttgtggaataaaccaaatcatccagatacaaatcataaaaccaaaaaatatactgagaatgtggttgaaagtctagattctccaccaaatgatacatctgcgtacaattcaagttttcatgatgaaactaatattcaaaatgagatccaaataccagaaaatgacgagtatgtaccacagatgaaagctacatccagtgtcaataatacaaccatccctgcacaaagaagacatgagtcactttccacttctgaaaacaaaagaaggaaatttgaaacagccgacgttggggttgatgggttagattctccagtgcgggcacaaccagaaatatctgcaaaatccaagtctccgataatccctgatgtaatacttttactggacgaagagactgaaactcctgaagcaaatgctgtgcaggacaatagtacatatattcctcaggggtctttaggacacgaatttagaaatattttagaagagcatccaggtcaagtaaagaataaacaaaattctggtgttgcttttgcatttccgaatgcttccaagaataccgaaaacaaactccactctaatttcaaagataaagatgaagggataattgatgttgaagcttacgtacctgatgtcaaagcagcaacttcaaacaccacaccagcaacaggacaaacatcagcaaggttggaaaaactgccacccttacctactcatattccaaatccattgaccatgaatgaagctcgacctcatccaacaactccacataaaagatcaaaagtcattttcgatttaaaagatttagaacaaaagttaggtaatgatattgaggatttggattttaaggaaatgtatgagagtttgcctgaccattcaagtaaggcaacacctagagacgatattataacccgttctaaaagaagactttatacatataccgatggaacatcaaaggctgaaacgttatctacaccaatgaacaaaaatcctgttcgtggacatagtaccaagaaaaagcttagtatgttggacatgcatgcgtcttctaaaattcaaagtcttttacctccacaaccgccacaaatgtcaattgatccttctgtttccaagcaagtgtgggccaaatacgttgatgcaatcttgacttatcaaagagaatttttcaattataaaaaagtgattgttcaataccaaatggaacggataaacaaagaccttgaacattttgacgatataaatgatggttcacacactgagaatttggatactttcaagcattgtttagaacaggattatttggttatgagtgagtttaatgaagcgttacgacaatttggtacgaccatcgccacgtatcagcaaaacctccagtgggttaacactttcatggaaagggatcctaattggctataa

SEQ ID NO: 2674 - DNA, 594 bp, Candida albicans
aaaatattgacttaccaaaaaagcatggcattcccacctgaagatatagcacaaattgtattagaaatagccacaatattacgaacgagaaatcagacattggcagtttctgaagctgcttgtggtggattgatatcagcatatttagtgtcagtaccaggggcatcggatttttatattggtggtaaattattatattcgatgaaaacaagattaaaactttccggatggtctgaaaatgaaataaataattatatgggtccaagtgaacaagtagctttgaaattggctcgaacaacaaaatatgaattgggttcaacatttgtattgtcagaaactggatttgctggtccttcaacagctttgcatttgaaaaaagatgaagagacaaaagataataataataatgaatctggtgttgttgatgctgatggtgtggggacagtgtatataggattatcgggtcccaatggtgatgcttcaacgagttatcatactggtaaaactgatcgaaatgtaaatatgagcgaatttgcaaaattaggtttacaattcttgctagagcaattgcaacaacaacaacaacaaaaataa

SEQ ID NO: 2675 - DNA, 558 bp, Candida albicans
tctttttcagttcaaattcttcttccccttccaaaacttttctttttttttcctttcaaaacacaaaccatcattataacaactttaatgaccatagatagatcagtgacaataggtgttttggctttacaaggtgcattccgagagcatattgcatatttcaaacatctcattgaatcaaacccggacgaatatgcagtgtatgactttgatataaaggaagtgagaacaaaagaagatcttgaattgtgtgactcattggttattcctggcggagaaagcagttccatgtcttatattgccgaaagaaccgaattgttaccacatctttacaaatttgtttccgatgaatccaaatcagtttgggggacttgtgctggattgatttttttgtccaaacaattaatcaatggtattgagaatcaacgagttttgggtgcattagacatagaagtcagtagaaatgcatttggtagacagattgattcatttgagcaatcgctcgatttcagttcatttatacctggttgtacagatttccccacggtgtttaattag

SEQ ID NO: 2676 - DNA, 1179 bp, Candida albicans
atcattaggtcaaccccaatggaatcaaacaaatttggaataaaaaacaagatgaggaaaaggcaagtcgattatgtcttgctaaaattggttaatgccattagtggatctttgttgggtggtccaacatcaccagcaactccagatttattacaaatgaaattaattgatggtgaatatcaatttgatcggaaaaaattgattttttattattggacttcaagaagaattgattttcgagatttagtaagagaattgtttagaatttataaaacaagaatttggatgtgtgccgttattggattaccttatcaaatcacatcatcaaatgcaatgggtccaacaactacaactaccaccacaacgacaaccttaacatctttgtcatcaccatcgtcaagaagaaattcaaatagtccaccattagcaccttcacaacaaatacaacaacaacaagggatagctcgatcaggaaattttattaatccacttatgcaacaaccggtgcaaccaccgcaacaacaacaacaacaacaacaacaacaacagcaatatactagtaatagaatagacagaagattaagttttcaaatgccatcatcatgtacatcctcaacttgtcaacaacaacaacaactgcaaaatagatctaatagttgtaattattatcctccttcattaatttcatttcataataatcaacaatcacaacaacaacaagtaccccaacaaccgcaggaatttattcctagacgatattcagattcaaggagcgggaccattcaacaacaacaacaacagcaaccacaatcatttggcaggtttggtggtggttcattgaaatttcaatttcctgatcatcaacatcaacaacaacaattgaatcctcaacaaaatttagggtctactactacatcgtatttacaagaagaatcaatgatgttattatctccatcaataccaatcttttcacaaagacgtactaataatgaaaataatgatgataatgtgaaagagaatgatgaaaatgaaaatgtaaacgatagggataagaatgaaaacgaggatggggatagagacgaacaagaagaagaagaagaagtcgaagatatatttaataataatcattcaggagaatcatttgttttaaaatcattagttgattcaatcaatcattaa

SEQ ID NO: 2677 - DNA, 1113 bp, Candida albicans
  unsure (36): Identity of nucleotide sequences at the above locations are unknown.
attcgcattctcggggctccttgcccagtggtgaanaccgacgtgctgctcagtcatcactcactcactcactcaatcaatgatccacatagtatggctataactaatgtgctatttcggaagtcgcttgacaggttgttcaatggaaacgcaccgaaaaaggtggctgttgcgttatcaggtggtcctgactccatgcttctaacatggttcttgctgcagtgtaaattcgagatatatgccatcaccatcgatcataaatacagaccagaatcaagtcgagaagctttgtctgtatatgaacgagtgaaaaattggaacttaaaccatatcatcaagtcgctcgactacccagctggggttgatcctacaaaactaaacaattttgaagagattgccagaggaaagagatatgaggccatggctcaagtttgttacgacaaggacattccggttctatttttgggccaccatagagacgaccagctagaaacgtttattcagagactacagggcaactcttccatttttggattggcaggaacacataaagtatcgccgttgcccattagcaaagacttaagtcccacgtcagcacttttcaaccaaaccagccaagtccgtattttacgaccgttttgggattacgataagcaagacattcttgaaacgtgtcagctcaacaatattgcctacgtgaccgacccaactaacaaagatgtgagcttgacgaggagaaattatttgcggcatttgataaacgacattatacctgcaaaaaacaatcaaagccattcgccgtatttgctaatagataaaagccaattaattgatctgcacactaagtgcttggagtttgcaacgatgtttgaaaatagggctatggcattgtctgagagtttacaaagtagtgggctaattaaagagtttcctgcgttaggatcgctacaggttaaatttcctcgccaatgtttggatcaaacaaatgggattgttacaagccgatttctttataggattctacactcctattctacgttaaaacactaccactgggcatatgccaaactggacagacaattgatactccacaatattgtcgaccacggatag

SEQ ID NO: 2678 - DNA, 993 bp, Candida albicans
cttattccttattcttcttcggtaaatcattcaactgattatcttacttcaacagtaatgggacgtgttcaggatattttagaaaaaagaaaattagtcatcgacggtgctttaggtactgagttggaaagattattaccaacaacttccacctatctcccaagcggcagcccactttggtctggtcaagttttgatcaagaaccctgggttggtggaacaggtccatttagattatatcaatgttggcgccgacatgattattacttcaacataccaaacatcatatgcgtcattgcataaatatattggctacgatatggatcaagccattgctctttggaacctggctttgaatgttgctaaaaacgccgtcaagaaatctggtcgagacgatgttattattgctgggtctattggaccttatgctactttgcttgccaacggatcagaatataacggtgattatcaaggtgttactgacgaagagttgattgaataccacactccgttgtttgaattttacgagaattccgacgttgacattatatgcattgagactattccaagcttccaagagttgaaggttataattgggttggcaaaaaagtacacttcgaaggaatttttcatttcaattaatcctcaaacaggatctgctttgagtgatggaacatctttgattgaagtagctcaattgtttgctgaaatcaatgacccaagatttgttgccgttggtattaactgtaccagttatgaaaatgttgatcaaatctcaacatatttgaccgacttccctctttttatttaccccaacttgggatttgtgtatgacactactgtccacaaatttgtttcgaaagtgttgcaagaatcaacttggtcaaaaagcgttgcaaagtggttggcttttccaaatgttaaggctattggtggttgttgtagcaccactccagcggaaatcaagcaagttgcacaattgatcaaccaatag

SEQ ID NO: 2679 - DNA, 483 bp, Candida albicans
tctcgaggtgatgccaataaacctttaaccgtacatgaaacttatcgaaacacattaataatatcaattttaggtatccctggctcattgattggtggaatattagttgaattaaaaataggtcgcaaaggaacattatttttatcattaatattaactgggatatttttatttggatcaacaacggcgaaaacttcaaaagcaaatttggcttggaattgtatgttttcattcatgtcaacgattatgtatggagtattgtatgcttatacaccagaggttttttattcacaaattagaggtacggcaatagggttagccgcttcatttaatcgtattatgggagtatttgctcctataattgccatatatgctgatttaaccacttcagcccccatatttgtctcaggagcattattcatttttgccggaatcttgagtttatgttgtccatatgaaccaaggggtaaaccaagttattaa

SEQ ID NO: 2680 - DNA, 294 bp, Candida albicans
ctactaagcgcggattctgccagcctcgtggtgaatatttattgtgccttgtatatatattatggggttatgtatgcttataccccagaagttatgccatcagctgctagagccactgggaattgtttatgtgtgtttatcacaagaatctctaccgcaatggtccccattatagcttggtattctgatacttcatcggcagtaccaatttggatttgtggtgctttaataggtgtcattgggattgttgccttggcccttccgtttgaaccaagtaaacaaagagttgtttaa

SEQ ID NO: 2681 - DNA, 927 bp, Candida albicans
tctttaatagccaagtgtccagaacaggctccacgtgccatgtatttgttagtcaaatacttgattgaagccggtgttcctgtgaatgtcttacagttggttcatttgaaaccagaagatcatccaaagtttctagatgctttattagctacaggggctataaagaaaatctacttcaccggatcaacattgatcgggaagaaaattgcttctactgctgctatatacttagttccctgtttattggagttgggtggcaagaatgtttcaattgtttgtcaagatgctgatattacaaaagctgtgggcaatataatttggagtgcatggacacataagggacagatatgtatgagtaccgacagggtgttcatacatgacacaatttacaatgattttaaactgaaattgattaaagttgcctctgaaatggtccaggacccggactattcaattgcacatcgtgatccccttggggctaataaagtgaaggaattactcaatgacgcattacaaaagggtgcttctttggtttttggtaatccagatgattcagaattgaagagaaataatgttgtctcaccaatgattttggaaggtgtaacaccagaaatgaagcttaatgacaccgaaagctttggaccaattttcgctatagaaaagtttaccgacgtcaataatgtggttgatgtagtgaacgaaagtgattttggattgaaggcatctatttggtcttccaatttaatgaatgctattgacttggccaaaagaattgaatgtggtggggttcatatcaataattctagtatcggcgatgcatctcatcttccgcatggtggggtaaaagcaagtggaagtggtagatttaatagtaaatgggggattgatgagtttctgttcatcaaaactataactgctaatccttga

SEQ ID NO: 2682 - DNA, 975 bp, Candida albicans
gttaaagttgaaaaattatccaaggaacccaacccaaagaaacctggtaaggaaaagctggtgacaactccccaagttacatgccaccagttcatgaaggtacccccaatggcctcattgggtttagctgaaattattgaatccaaatcagaaaaataccaaaaaggtgatattgctagtggtagaatttactgggccgattacgctgttgttccagatgttgttttcttcaacaaaattgacaagagtttgggattgccattggaattctttttgtccattttgggtatgaccactttgactgctttcttcggtttaactgaagttggtaaattgaagaaatacttggacggaccaaaagaaggtgaaaagggtcctgttgtgtgtgtatccgctgcttctggtgccactggatcttctgttgttcaaattgctaaacacttgttgggtgcttctaaagtcattggtatttctggttctgatgaaaaatgtaaatgggttgaaagcttaggtgctgatttgtgtgtcaactacaaaaactctgaatggaaacaacaagtcagtgattacttagctaaagacaatgaaggaattgatgtttactttgattgtgttggtggggaaatcttgagtttcattttgaccaagatgaacaagtttggtcatgttgctgcctgtggtgctatttcaggttataatgacaataaagcttttgctgttacttcttggccattcattatcaccaactcattgaacgtccaaggtttcattgtcggtaactttgctgctcaattcccagaagctatcaagattcttggtgctgctgttaaggaaggtaaaattaaagcccaaggtgcttaccatgttgaaaaattatctggtgatgaaccatctaagcgtttagctgacattcccataaatttggaacatgtgtttcgaaaaataacaacccacaccggtaaattgtttatttaa

SEQ ID NO: 2683 - DNA, 597 bp, Candida albicans
gtaattattaataccaataaagatatacaaggtttatttatcttatttttgattctaacttttttttttcttttcttgacagctggaagtgtgattggtggtgagatatcagaacattttggatttatcagatcaatggaaagcttatcagttatatggattataggtataatttttgctttcattctggacaccataaccatgttgattattggtaaaattattaatggtattgcaattggaatggcatttgttacgattcccatatatcagtacgaaatcattcctgtgcaaaacagaggtaggattttatcaatatttatatttagttgtgctttgggaaatttgttcatttatgttatccgtttgatatcagaaagatttcttaacgaatcgaaatactctagattgttctgggctattgaagtgatcccacttgtttttgctgctacttttatcgcatccataccagagtcgcccaagtggttagcggcaaattgtgaatggacttctgccgctgatgtgttaaaactgatagaagttaacaactcttctatattgaaacgtcccataaacatagaaagacggatccgatga

SEQ ID NO: 2684 - DNA, 621 bp, Candida albicans
gaattaaacgaaatcaattatataaatagaggaaggatccccctcccttaccttcccttcccctccagttgcttcttttcattgaatattcatttcatatctaacctacaaaccataaatatgccaagaattaaacaagttgatgtattcaccaatgtcaaatatttgggtaatccagttgccgttatttatgatagtgataatttaaccactcaagaaatgcaaaaaattgctcgatggacaaatttatcagaaacaacatttatattgactccaaaatcatcaattgctgattatagtattagaattttcacttctggtgggaatgaattaccatttgctggtcatcctactttaggtactgcatttgcattattggaagatggtaaaataaaaccaaatgacaatggacaaataattcaagaatgtggtgctggattagtgaaaatatccgttgaaaaaacacctaataataatagtaatgagttgccgtttttgttatcttttcaattaccatatttcaaatttcatgaaattgatgacaaagtaattgaggaattacaacattcatggaatggaaccgatctttattgtcttcacaacgggtggaaaaccgcgtca

SEQ ID NO: 2685 - DNA, 699 bp, Candida albicans
gaattaaacgaactcaattatataaatagaggaaggatccccctcctttaccctccccccccctccagttgcttcttttcattgaatattcatttcatatctaacctacaaaccataaatatgccaagatttaaacaagttgatgtattcaccaatgtcaaatatttgggtaatccagttgccgttatttatgatagtgataatttaaccactcaagaaatgcaaaaaattgctcgatggacaaatttatcagaaacaacatttatattgactccaaaatcatcaattgctgattatagtattagaattttcacttctggtgggaatgaattaccatttgctggtcatcctactttaggtactgcatttgcattattagaagatggtaaaataaaaccaaatgacaatggacaaataattcaagaatgtggtgctggattagtgaaaatatccgttgaaaaaacacctaataataataataataataataataataatagtaatgagttgccgtttttgttatcttttgaattaccatatttcaaatttcatgaaattgatgacaaagtaattgaggaattacaacattcatggaatggaaccaatattattggtaaaccggtacttattgatgctggtccaaaatgggcagttttccaacttggctccggtaaagaagtattaacacttgaatgttga

SEQ ID NO: 2686 - DNA, 426 bp, Candida albicans
  unsure (384): Identity of nucleotide sequences at the above locations are unknown.
cacttgaatgttgatttagcacaaattgagcgattaagtttagaaaatggttggacaggaattggtgtctttggaaaacataatgaaaatggtgattcggtcgaattgagaaatattgctcctgctgttggagtcgctgaagatcctgcttgcggaagtggatcaggtgctattggagcatatttggcaaatcacgtcttcaatgaaaaggaaaaatttacaattgatatttctcaaggtaaaccaattgaaagagatgctaagattcaagttaaagttaatcgtcttagcaccaaaaatggtgatttatctattcatgtgggtggtcatgccatcacttgtttcgaaggtacttatttctatttaaaacttgatataattctngagttatatctaatttatctaattcacttgtccctggagtag

SEQ ID NO: 2687 - DNA, 531 bp, Candida albicans
agaccgattgttacgttagctattccgtatcttgccaacctccatttgtgggatttattgtggtatgcccctgagcaattttacttgtcgtcatactttttgacaatgcagattgccagtgtctatcgcccaaagttgacggaatccaacgactacctcaagtatctttggaagtactggtcaccttcttacaacacatcaaaagaagagattgatgaaattagaaacgcgtttactaaagacaatgttgttgatgctgtgacttcctattatagacatctttttagaccattttctttagtcaagtctagatggcccgttgattttaacagggtgccaactttgatcttggttggaaaagaagacgggtgcatgtcaccaagaattgctgaattggaaaaggaaaagttgaaagacttccccaaagccgaagtcaagattcttccaaatgctggtcatttcttacaaagagaacagccagaaattgttgctaaaattagtattgattttttcgaaaaatattctaaataa

SEQ ID NO: 2688 - DNA, 513 bp, Candida albicans
aacttaactttggataatgcaagagttggagaaattgcctcagcaatcaagggccaagatgctgtagttttcactgttgggtcagctggcaagaaccttttgcaagttgatttggatgctgcagtcaagacatttgaagccagtgttgaggcacaagttagacgtttcattatcattagtgctctccatgccgacaatcgtgagttctttagcaagttgggtttaagaaactactatattgctaaacattatgctgatcggattttggttgacgagtttagtgacaagttggattacacgattttgaaacccacgtcattgagcgacgatgcagccacagggaaaatcagaatcatcaagagcacagacgaggagattggtactatcaccagagcagacgtggctaaagtcatttatgagattgttaatgacaaagacacttttggcaagagctacaacattgctaatggggatttagatattagagataaaagaatatataaaagtgtataa

SEQ ID NO: 2689 - DNA, 897 bp, Candida albicans
gacattgatcaacatataatgagctggaaaagactaatcagatttgtcgctcgagatgggaagatttataggggagaaccaattttcacagatacgaattatgatgtaggtaaaaaatatcttgctggtgatcaactcaaagcgaaagttataaaaggaacaaatatttttgaaaacacaattgtcacagacgagattttggaggtagtaaagttgttaggtccattaaccccagaagatgtccccattgtcaaatgcattggtttaaactacacgaagcatattgaagaaagtggtataccagcaccaccttaccctccgttgttttacaaacctcgaacttgtgtagcggactttaatgaaccgatcccaatttcaaaaattgctcaagtagatcaatgtgattatgaaggtgaattatgtgttgtcataggaaaatctgggaaaaatattgccaaagagaacgcattagaatatgttggtgggtatgttgttggtaatgatgtttctgccagaacttggcaattagatccaaaatatgcaggtggggctccacaatggtgtttctctaaatcttttgataaatatgctcccttaggtcctcagttggtttcacctgctgttttaacagatccctcagctttacatttacaaactcgagttaatggagagttacgacaagattcccctacatcagatttgttgttcaacgtttcagaaataattgcctttctttctcaatcaacaacattagaacgaggcacagtcataatgacaggaacaccaagtggtgttgcaatgggaatgaaagaccagaaatatttacaagatggtgatgaagttgaggtgagtatcactcaaattggtaccttggttaataaaatgagatttgagtga

SEQ ID NO: 2690 - DNA, 423 bp, Candida albicans
atagattcatatcatctttccttcgactatcacaactattctacaatgtcaactactactagaactcttcaagctataaagtttgatagagataatatcaaattggaaattcttgatcaattactcttaccttattcgacaagttatatccccatcaacaacatcgaagatgcctttaaagccattaaattaatgcaagttagaggtgctcctgccattgccattgttggtgcattttctgttgtggttgaagtttccaattatttaaaacaatcagattcgaatcaaaaaactattaaaaacttgaatgattctttgaattatttaattacttctagaccaacagcagtgaatcttgctaatgccttaaatgacattaaacaattattacaaaaatataacgaaactgatatcattggttga

SEQ ID NO: 2691 - DNA, 756 bp, Candida albicans
gagcatgatctgcatcggctggtgaaaaatggcacttttggtcatactggttcagtacccacatcaggtcatggtaccgcattagggattattcgttcaacttatcaagctttacaaaaaaataattctaaacaagatttttggttagatcatatttacccatgtgaaactagaccttataatcaaggagctaaattaactacttatgaattagattatgaacaaatcccatttacgttgatttgtgataatatggtttcttcattgatcaatactttaagtgatgataataaaaaacctattaagactgatcaatctgcccctgtgaaattcattattgttggcgctgatagaattgtggaaaatggtgatacagcaaataaaatcgggacatttcaattatcaactattgcaaattttttcaataccaatagatttaacgctaaagcaacaaataaacaaattaagtttattgttgcggctccgaaaactactattgatttgaacactaaaactggtgatgatattgttattgaggaaagaccagctaatgaattgacaactttagttggtccattgttaaatgaatcaggaaaagtgggtgaaaaattaactgtgggaattgctacgcctggaatatctgtttggaatccagcatttgatgtcactcctcatgaattgattgatagcattgttacagaagatcctcatgtttttaccaaagataaaaacggggaatttaatttgattaaatag

SEQ ID NO: 2692 - DNA, 495 bp, Candida albicans
agacgctcagaggtctacatcacctcccgtaaagccaaagcgtgcgatgaggccgtcgccgccctgaatgccctccccaataagcgtcccggcgcggtagccattgccgtccccgccgacaacgcacgcatggacgacctggaccgacttgtggccgaggttaagaagacaaccgatcacgttgatattctctttgcaaacgcgggcgctacctggggcgagcggttcgaaaagtatcccgagtctgccttttccaaggtcatggatctgaacgtcaagagcgtgttttatttggtgcagaagtatgtccccattagtttttggtgtatatcaactttaactgagctatggttaggtttgcccccctactcacggccaaagcaacccgtgagtcgccctcgcgcgtcatcgtcactggttccgtcgctggcattggggtcggctctatcggcgaaaatgccacctttgcgtactccgcctccaaagcagccgtga

SEQ ID NO: 2693 - DNA, 1251 bp, Candida albicans
agaaagatcctactacaatctcctaaacaacttaccacactaataagaccaactaattcatttataatcaaacgaagaaattattctggatcatctattttcaaaggtgcaagaaattatttccttggatttcgtaataattctgaagattctcaaattaataataataacaacaacaacaacaacaattcatcaatgcattatgattcagttgatgaactgattccatatgttaaatatcctttatttacaaaagaacaattgaaaaaaattgctaccgataaatttaaattacaagttggacatgcatcatttggatatcattcagattcaatagttccttccattaattctttgagtgatttaactgatcctactctgttgaatagtttattaccaagaagaagacctcaaggatcacctagtgatactttaagtattaaagctggtgatgataccatgttagtttccccctcagtaatagcagtagctgatggagttagtggttgggaaagtgatggtatcacatcatcttcaggtatttggtcaagatctatggtggaaacttttagtcgattaatgacagaatataaattaaatcattttcctcattatttaaaccaacgagatattcaagaaattttagatgattcttatttacatacttctcatttaatggatttacaaaaattaaatggttcttcaacattaatcttggggatgcttaatggagatttattatcaattgttagtattggtgattcggaaattttcatcattagagatggagaaattgttttaactaatggaggacaaactaaagccgggttatgtcctggacatattggtactcatactttagatcatttactttccgacattgcttggattaaatcatttaaattcatggaaggggattatattttaatgtgttccgatggtattagtgataatttatatgaatgggaaattttaaattatttaaatgaatggattaatactaaacgtaataataataataataatgatgttcaaaatattgctagtaaattattaattaaagctacagaagttgcctttgatgattatgcttatactccttataatgcaaaagttaattcattgaataatactaatgggggtagtaatggtactaatcatagtcaaggtggtacagttgatgatatgtcagtgattattgctaaagttgaattaaatacaaaagataatactaaattggtaattaattag

SEQ ID NO: 2694 - DNA, 291 bp, Candida albicans
gattcaattagtaattgtttgttgtggtttttgtcaatgtcatctggtccattttatcgatcttattcatttaatgcgttatgggcgcttgttttcaaatttcctttatttgcttattttgttggatttgttgaggatttcgttatttcaattatcaagacaggtccaattcctaaacatgttgctatgattatggatgggaatagaacttatgccaagaaacatcgattaccattgaaagaaggccattttgcaggtgcaaatgcgttagttaaagtatgtaaagactag

SEQ ID NO: 2695 - DNA, 1551 bp, Candida albicans
gaagatatgtcagatattgaaaaaaaacaaacaaaaatttcacctgcatcatctgtggctcatgatgaagatactttggccaacgacgaattgttccagttaactgactcggttttaaataaaaaattgaaattaattaacgacgcaattgatgaaattgggtttaccccatatcatctcaagttattctttctaaatggaatgggatattggacggatacccaattaacatatcttgaaagtagtgttagaacatttgtcaactatcaatttggctacaagtaccctgtttcaaatgaaatgttagctgcgggtttgcttgtgggagcactattttgggggttttctgcagatttgattggaagacgtttagctttcaatttaacattattattaagtgcacttttcaccattttaactggtgtcatgaacaatatggcctcatattgtatctttgtatttttgagttgttttgctgctggtggtaatttagttttggatacctgtatctttttagagttcttaccccataaagaccaatggttattgaccttttttgcattcttttggggtattggtcaaaccatcgccgttgcattagcatatgcatttttaccaaacaacagttgtgagtctgctgacaactgtccttcccacattaaccgtggttggagatacgtttattatacgaatggatccattgttttagctatggctattttgagattaacccttatcagattgcaagagactcccaaattcttagtttcaaataatcgtgaccaggaagctgtggaaatattgcaaagaattgctcaaaagcacaaccgtacatgttccttaactatcgaggatttagaaagtttaggtaaagttgaaatcaatgacgattacagaaaacacattgacataaaggggacttttagattggttacccatcatgttcagattttattttcaaatagaacaatggcaaggtcttctgtattagtttttgtatcatggctcttgttaggaatttcttatccattatattcgtcattcttaccggtatatttggccacaagaggtgcaaatatttctgcaccagacgttcacggagtgtaccgtgacaacttgatttccaattgtgtctccatgggtggtcctctcattgctggtgcattgttgttttgctttccttggttgggtcgtcggggagttttgtttattggcggtgttgcttctatggcatttttgttcggatacactcaaattaaaacaagagcccagaatgtggcactttcatcaatatcatttgcttctatgtacatttactattcagccttatacgcctatacccctgaagtattcccctcagtagctcgagcaaccggaaatgcaattgctattgcctgtacaagagttatgacatgtattgtgcctgttattgcctactactccaatacttcgtcgtcagtccctatttgggtgtgtggtgcatttgttggagtgattgggttcttagctttactctttccatatgagccgagtaaacaaagggttgtatga

SEQ ID NO: 2696 - DNA, 1179 bp, Candida albicans
ggagaattcactgtccccattgctgaagaattagctcatgaattaattaataacttggatagtagtagtggttatagtggtggtgatgttgatccgagtaaaaagattgcaaaagtttattttgccaattctggaagtgaagccaatgaagcagcaattaaattagtaatgcaatatttttatgaacaaggtaaacacacaaagacgcaatttatatctcgacatcaatcatatcatggtaattgtcttggtgggatgagtttatcaggacatatagctagaagaaaaccatatgaatcaattattgatcaatcaagatttcataaagttgatccatgttatgaatttagatataaacaatcaaatgatgaatcaaatgaatcaagtgatcaatatgttaaaagattacttgaacaattggaaaacaaaatattacaaattggtcctgaaaatgtggctgcatttttcgctgaaactatagttggggcaactactggttgtgtaccagcaacaccaggatatttcaaaggagttcgagaaatttgtgataaatatgatatcttgttagtacttgatgaaattatgtgtggatcaggtagaacagggactttttttgcttggcaacaagaacaagaaggagaagaacaaggcggaaaatctattatacctgatataactacttgtggtaaagccattactagtggttattgtccattatcatgtgtttttttcaataaaaaaattcttgatgttttatctaatggttcaagttgttttaattgtggtcatacttatcaaagtttccctattgcatgtgcagcagctcatgcggttcaaaaaatcattaaacgagataatttattagataatgttgttaaaatgggggtcattttacaagaattattaatgatgaaaattgatccattggaaattgttgcaaatattcgtggacgaggattattttggggaattgaattttgtaaaaataaatcaactctagaaccgtttaatccttcttgtaatgttagtataaagattggagaatatactaaaagaaatggagttgttgtttatcctggaaagggaacaatagacggaattaagggggatcatatacttattgctccaagttttaccattactaaagaggaaatcttcaccacgggctggaagatccac

SEQ ID NO: 2697 - DNA, 1107 bp, Candida albicans
gttttggaaggatttcccaaaggatttcggtcaatcattttaacaaaacccaggttaggaaatttcttcaagcacacgatatgcgggttggaaattatcatttccataattcgtggatcggaggatgacatgagattgcaattgaatgtggcaaaagtgactgattggtatccatcatacaatattgcaccaactaattctgcattgataatatatatgacggagtctggtacacaattcaatgccaaatatattttagagcctctgaagtttgggattgtaccatcttgggcaaagccatcggattcgactcctgtcggcaaagggactgataaggaaggaagtaaatattcccgagaactagggagaatgcaggccaagtatttcaattgcagacgtgagtcgttgaaacaagcaaaatcactttggaattcatgcaaaaataataggtgtgtagttccgatacagggttattttgaatggatgaaaacaaagacgggcaaaattccatattttgttcattccacaacagctccattgtgctttttagctggattctattcgcataattacaattatacagaaaatcaaaatgtcagcggtgaatacttatcaacatttacaatcattactgttccggcagtaaaggaagatgctaacgatatgtcttggctacatactaggaaaccaatgctcattgcacccggaacgaaggtttggtatgattggttagatcccaaaatacattggaacgataaatttgttgaaacggttttgaattcgactttgaatcaagcatacactgatatcgaagcatatcaggttacaaaggaggtcggtaactcaagtaatgatggcgaaaatatgatccaaaagataaatgtcaagaagcagtcttcccttagctatttcttaagcgcccaaaaagggcagaataaacccaaatcaacttcacgttcaaatccggtgaaatcggaaacagaagtgaagcaggagttcaaaaaagaagggaattcaaagaaaagggtgaaatctcagcttttgaattcacaaaagaaaaggaagacagttactggtgagctgtttgaagtgaaaaaagaggtttga

SEQ ID NO: 2698 - DNA, 2400 bp, Candida albicans
ggattacacacacaaaaaaaaaagcattacaaaccacatcgaatcaagaaaattaactatcgcaaaggcgaccaggtggttcatcataaatgcattttgctcccaagcatgaataattcaactccttggattccttttttccaacaaagtataaagattttccaagagattaacactcacttgacttttttatcgtcgcattcacgtagtgtcgtgccgtcattagacttattacagaaattgaatagttccataacacccttggacctagctgtaattaaatacttatttcctgaagatgagatattttttgattatgtcgatgaaaaccaaataatgttgtcctttattgaggaagtaaaagtagatcagagtggatatcatcaaacaccaattgctgataagtatgatgaacagacgcgtcattcaaagcaaatattaattttctcctttcaagatgccaaggtgcatggaatagggaaaatgaaaaagtcaaataacaggaaaaggctaaaaaatgattcaggagattataaatccgatcaaagaagtggactttttttaggcgataatagatttctgttgcaacctttaactcaatctcaattaagtagcatgataagaagcagaaatgacaaattcatcctattgttggaaagatttgttgacaaatacgaaaaccaagaaaaagcgaaaaagagccttttgaagaaagcagctgaactgattcctcaagaacctgatttacaagatatggtggaggtgttgcaagaaaagaaaagtgttactacagattctggccacaatttttccacagacgaaatgattcagatacttgaaaattcaaaattttactgcgaccaaatagcatcaacacaattactaaacaggaatcgtcctgcggattttaggaagctaacgactgaaacctttctgtatgtgcatcctgatcttaaggacgcattacttaaaaccaaaaatatatgcttagaagacgggttgtattcacaccaggcaggagctttggaaacattattgaaccctgcgaacaagtctcatgttatagtaagcactctgacagcatctgggaaatctttaatttaccaaattccagttttaaattctattttatgggatatttctagtggattgaagggaagacacactactgctttctttattttccccacaaaggctttagcgcaagaccaaataagacattttcgagagtttttaaagaacttaccaactgcatcaagtcggccaattatcgtcaacacatacgatggagatacacctttcaaagaaagagacaaaatctcgaaagaatccgatataatctttaccaatcccgatacaatacacgcgtctattcttcctaaccatagctttaacaactggaaggaatttcttggtgcattgaaatttgtcgttatggatgaattgcatgtatataaaggcacttttggggtcaatgttggctttgttatgggacgactatcaagaatgaaaaatttgctactgagagacgactctattcaatacatttcttgttcggcaacaattcataatcctgtatctcattttagaactgtttgctcattgccagaaaatgaattaatagttcatgtcgaccaagatggtagtccatgttgcgaaaaaaaattgatagtttggaatccgccaccattgatgaaccaacgtggacaaaaggaagacacagttgataaatatgttcctcgagtgggtatgatttcagagctggctaaattgctagtaaatttggtaactgcgaatgacagcttgaaaataatagtcttttgccctataagggttgtgtgtgaaatgttgatgaaagaagtgcgtcatttgttacaaaattcatttaaaaattctggaataactcagagtgatattatggcttacagaggagggtacagtaagagtgacagaaggatcattgaacagaaaatgtttagtgggcaactccgagctattgtggcaaccaacgctttggaattgggcattgatttgtctcatttggatgtcgtcattacttgtggatttcctatgctgaaactgaatctacatcaacagtttggacgagctggccgaagaaagaatgcaaatggtagtttggcaatattcgttcccggcaaaaatccaatagaccaatactatttagaaaacccacatgagttattagggaacgattacgaagatctctgtgtactgggggttagagatatggaatgtggtaaaatgattctagaaagacatttacagtgtgctgcctatgaagaacctattgaactagatgatataaaatggcttatgcctggtggttccaaaaaggactttgaagatgttttgtgcctcaccacggggctgaaaggtccc

SEQ ID NO: 2699 - DNA, 480 bp, Candida albicans
atgtttaaacaattattcaaacccacaacaacaacaacaacaacaacaaccttaattaaacgtttcatgtcggcctctacaccaattaagaactcaccatttaaagctaaagtaacgtcaattgaacctttaactaatgggaaatggattcaaaccaaaaaaatcaattatgatgaccctaatggtaattctcgagtatgggaaatggccattagaacaacaagatcaactacaactaatatagatgctgtatcaattgtatcaatcttacataatcatgcaaacgattctaaagaaatagtgcttgttaaacaattccgtccaccaactgaacaagtagtccttgaattaccagcaggattagttgatcctaatgaatcaatagaatctacagctataagagaattacttgaagaaaccggttattatggaacgttcaattctcaatcagttcctatatttagtggatccggggattaa

SEQ ID NO: 2700 - DNA, 1140 bp, Candida albicans
aagtctcatcaatttgacttgtcatctgtaatggaaaacaacaatactataccggcattatttcaacccataaagatcagtgactcgatcacattacctaatagaattggtgtttcaccaatgtgcatgtattcatcgtcaccaactgacaatcaagccactctgtttcattttgttcattatggatcatttgctgtacgtggaccagcattaatcattttagagagtacctttgtgtccgaaaattccggattatccattcatgatttaggtctttggaatgatgatcaagctcacagtttacggaaaattgttgattttattcatgatcaagacggaatttgctgtatacaattgaatcacgctgggcgaaagattggtgaaggggtaccattccaacaaatacaacatggttggcaagaacattgtgtggggccatctactgagccatttagtgattcacacaatacaccacgagaattgactgttaatgaaataaattcaattgtggaagactttgccaatgcagcttggcgggctgtggaaatctcaaaattcgatgccattgaaatacattgtgctaatggatgtttaatacaccaatttttaagtaaattgacaaacaagagagctgaccaatacgggggctcatttgaacacagagttagatttcttttacaaataattgagaatataaaacgacagatagacacaccgattttcttaaagtttccaatgtcagataattgtagtgatccggaagcgtggtctacggaagatgcattgaagttggccgatcttgttattgatttaggagtaaaggtgatcgacgttacatcaggtggaaatgttgcgcattgcaaatctagatatctattaaatgacgacaaacaactaccttctcaagtgcccttggctcgtaaattgaaaagccacattagaaaccgatgtttgatcgcatgcagtggaggattagatcgagacatatttaaactcgatgagtttattgctaatggtgactttgatatagcattgataggtaaaggatttctcaaaaacactggattgatcagccgtattgctgaccaattgcaagcacaattcagaacagcacctcaatataagttggccttatcataa

SEQ ID NO: 2701 - DNA, 1293 bp, Candida albicans
ccaaactgctttaataaactatttgcaacaatgacagttccataccaagtaaaaccatcagatgaaatcaaaggtgctcctgaggtttcctattacactccagaacagcctgttccggctggtactttttatccccaatcgtcagatgaagttgctcccaaaatttttcaacctttaaagattggtaagcttgctttgccaaacagaattggggtatctccaatgtgtcaatattctgctgattataattttgaagcaactccataccatttaatccattatggttcattagtgaatcgtgggccaggtatcaccattgttgaaagcacggctgtttctcctgagggtggattatcacctcatgatttaggaatctggaaggatgaacaagcagagaaattgaaaccaattgtcgattacgctcattctcaaaagcaattaattgccatccaattgggccatggtggtagaaaagcttctggtcagcccttatttttgcacttggaacaagttgcagataaatctgtcaatgggtttgccgacaaagcagttgctccttctgcattggcattcagaccaaatggtaatttacctgttcctaatgagttgaccaaagatgaaatcaaacgtgttgttaaggattttggtgctgctgctagaagagctgttgaaatcagtggctttgatgcagttgagattcatggtgctcatggttatttgattaatgagttctatagtcctatttcaaacaagagaacagatgaatacggtggcagttttgaaaatagaaccagatttttaaaggaagttatcgatagtgttaaatcaagtattccaaacgatgttccagtgtttttgagaatctctgctgctgaaaatagtcctgatccagaagcttggactattgaagattccaaaaaattagctgacattttagtagaaaagggtattgctttggttgatgtttcatctggtggtaacgattatagacaaccaccaagatctgggatcagtaaagagttgagagagccaatccatgttccgttgtctcgtgcaattaaacaacatgttggtgacaagttattggtcagtagcgatggtgggcttgaaaaagatcctgaattgctcaacaaatatttagaagaaggaacatttgatcttgctttgatcggtagaggatttttaagaaatccaggtttggtatgggagtttgccgataaacttggtgttagactccaccaggcccttgcagttaggttggggtttctggcccaacaaacaacaaattgttga

SEQ ID NO: 2702 - DNA, 477 bp, Candida albicans
tcttcaaaaagagtcttaccacagcattccactaacaccttgagcaacagaatcggaaaagggttgatggttcttgttggtatcaccaccacagacacagaggacgatattgcaaatctctccaagaagcttctatccctccgtgtgtttgaagatttgtctgagccaccgcagactgccaccaagtggtatggcaagccatgggcaaagtcgatcgttgacatccaaggtgaaatattgtctgtgagtcagtttacattgtatggcacagtcaagaaggggaccaagcctgatttccaccgtgcagccaagggccaccacgcagttgaattgtacaacaagttattagagcaattgagagcagggttgggccaagagaaagtcaaggacggagagtttggagctatgatggacgttgccttggtcaacgatggtcctgtgaccatcgtctgggacacccaggacagttccttgtaa

SEQ ID NO: 2703 - DNA, 1140 bp, Candida albicans
tcctttatccatcgagctctatataatcagaagtacttcataaaatcaatgaacaggtcaaatttacatctacatttttttgtacagaaaaggtggaactctatagactatttactaaagtctataccacagtctccgcgaactacaaatatctaccaatcatctaaaagctcaaaatctaaaaaatctaaaaatctaccatcagaaagacaactcaagtcttatagaaacagtattgtgtcgcctttacgattaaatgaaatatattctcctagctggcgtacatcgtacaaggaaaatgatttagtgaaatcccgtcaatttttcggaaatgcaagagttgaattagactggacattggcagactacgacgaaatacccgacgttaaatatgcaaaattagcaaaagaaagagaagagaaattaagtagcattgatccatattccagaaacgaaaccactgaatccatgttaaactctagaaaaacttttggtatcagaccagaactattgcgtgccctcccagaagtgctatttatgggccatacaaatgttggaaaatcttctttaatcaacggcctcctagtaaaaaacaagtctattacgggacccacacaactagcatatgtctctgcacgtgctggtttcactaaaaccatcaattgtttcaatttctccaagaagctcaggataattgacagcccaggttatggagaatacggagatttgaaacagggaaaagttgttgtggattacatatcaaggcgtcatcagttaaaaaaagtgtacgtgttaattgattctgttgaaggatttcgtgaagaggactcgtatatcttcaatttgttaatagatgaaggagtgccctttgatattatatttactaaagtggataatgtggtcctgaaatatattcctaaaaatgcatttgaggcgaacaattgctatgatttgattcaaacctgtaatgatcgagtagtggaacactatggaaagctcatcactagttctggtctacaggatattgccatgactccaacatttttgtttagtaatgccaacaccaataaatttttacctaagcctgcaggaatgaatgaaatccaaagcaatatccttgatagttgcaatttgctttga

SEQ ID NO: 2704 - DNA, 732 bp, Candida albicans
accccaatgcttattgttggcttgactggaggtatagcttgtgggaaatccactgtttccaaagaattaaaagatcggtatgggttgactatagttgatgctgatttagttgcaagagaagtcgtttacccaaataagccagcatttaataagatagtagcagcatttggggatgaagttcccaacttgataaatgaagatggtaatttgaacagagcagctttgggacaagcagtgtttggaaataaagaaaagttagcaatactaaactcaattgtacaccctgctgtcaagtgggagatatttaaacagatcattagggcttatttctctttaaacaaattagttattttggatgtcccattgttatatgaaagtgggttaagtttgttatgtgggctaactgtcactgtgtcttgtgaaaggaatgtacaaattgaaagattgttagctcgaaacaacgaattgtctgaatcggatgctaacaagagaattgagagccaaatgtcaaataaggagagaaattaccgatccgatatagtactagataactctggaagtttagactcgttaaaggaatcaataaagtgtttagtacctgaaatgaaacctaaccttatttggtacttactagatttgttcccaccatttgcggttacgtcagctttatttacttttactattagaagaattgcagaaagattcaaaggcactaaaccaaaatccgattaa

SEQ ID NO: 2705 - DNA, 1095 bp, Candida albicans
aaccagtcaatcagcatgacagttatcactctcaattggggtattttaggagcaggaaacatctcttcacaatttgtacacgatttggttttgaataaccagagagatactcaatttcatcacattgttaagtctattggatgttcgagccacgacaagggcttggattttataaagaagaataacatcactttagagaacaattttcaaaccacgccgattgttgaatcctatgaagatttttataaaaacctggatatagatgtggtgtatattggaactccacatacattccataaagaacaatccattgcatgtttaaataataataaacatgttctttttgaaaagcgttttacagttaacaaagctgagttagaatcaatattgaatgtcgcaaagtcaaagaagaaatttttcatggaagccatgtggacgagattcttcccagcaattactgaattgaaaaagaaaatatatgatgaaaaagtcattggggaaatacacagactatttgcagatttgagttacaattgcgatatttcaaatattccattgagtttcaggattagaaataaagacttggctgctggatcgttattggacattggaatctatccacttacttattcaagagttttgcttgatgatagtttaggtgagaatcattcaccgtttcaaattaaatcatttttaacaattgatagccaagatcaagttgatcatttgtattcagcaatagtgaaataccaaaatggcaaacatgcagttttgacggcatcagaattgattgatggacccaaagcatatgtgagattggaaggttcacagggacatgttgagatgtacagtgataaccctgcacgagccaagcattttaaaattttcaatgctaaaggcgatgaaatttttgaatataaagatggctcaggttataatggattcatctatgaagcaaatgctgttgctaaagatattactgaaggaaaattatctaacgataccatgcctcatgatgaaagtttattaataatggagacaatggatcaaattcgtcatgaaaatggtttggtttacccacaagatgaaaattga

SEQ ID NO: 2706 - DNA, 972 bp, Candida albicans
tatgttgatgccattttattattgcattatttgtttttgagaattaagtgtgggtacgatgtatttaatttcatttccactttggcaagagaattattgggtttcgccaaagatggggtggcatttttaactaataaagatgtctctcaattaggaatgttctttttcaccgtgttaccttcagtggctttttttgtggcgttcattcatatttggtattatttcggtgttattcaatgggccattagaaaatttgcttactttttcttttggacattaagagtttctggtgctgaagccattacagctgctgcctctccgtttatcggtattggtgaaagtgccattttaattaaagatttgatgccatatttgactaaagcagaattacatcaaatcatgacttcagggtttagtaccattagtggtgctgttcttgttggttatattggtcttggtcttaatccacaagctttggttagtagttgtgtcatgtcaattcctgcatctcttgcagtatcaaaattaagataccctgaacttgaaaacccaatctcaagtggtacagtaatgattccaaaagttgaagaccctgaagaagcaagggaaaaatcaaaagatgaacctcaaaatgtcttgcaagcattttcaaatggggccactttagggttgagaattgccgggacaatgatgattcagtgtatgtgtattattggacttgttgccttatgcaatggtattttaacatggtttggtaactattggaacattgatcatttgactttggaattgatgctttcctacattttttacccaattggattcttgttgggtactccgcgtaatgaaattttgcttgttagtaaattgattgcttataaattcattcaaaatgaatatgttgcttataatttgttaacaaatgacgctccgtcttcaccacgccggctggagcctccgagcttggtataa

SEQ ID NO: 2707 - DNA, 1161 bp, Candida albicans
ctgggtattgtaacccattttaaaatactactgaaacaggtaacaatcaatagcaatatgtctaaagagaaaagtaaacaggttgtcataattggtggttcatatgctggaattttggctttgaagactttgctcaaatcatcaccaattgaattgaatatcactttaatctcaccaaatgattcagggtattttaatgccgctgctccaagattattaattgagccagaaagtattgacaaaactatatttcctattaaacctactattgaaaaattaaccagtggaactattcatacagcaaaattccttcaaggtgtggtcacaaaagttgatttgactaatcaaaaggtttttgttgataacgaatcggaaatcgattatgacaatttgattattgcttctggtgccagagcaaaatcaccggcatttaaattaaccaacaataacgatcaaaattacactataaaggcaattttggagcttggtgacgagatcaaagcagccaataatattgctgtaattggaggtgggagtactggtgtggaaacctctgctgagattgcattcaaatattctgacaaaaacgtggtattgtacacaggagcttcaagacctttgccctcatttcccaaatccaccagctccaaagcaacaggcaagttgaatcagcttggaatagaaattgtcaatggcgagagagtcaatgtcaaagataaaacgatcgagtttgcagatggttcaacaaagtcatttaatttgattattgaaacactgggccttttacccaacaccgattttcttcctaagaaagttttgaatgaatatggatatgttgagacagatgaataccttcgtttgaaagaccaccacaatgtaatatgtttgggagacgtggttgccctgggtgcaaactcaatagttgatcttgtatatactcaaaaacccgtttttgaaaagactgttgaatttgaagtggttgataacgaagcaactcaattgaaagcataccagaaagccagtggtatcactacatttatcccaattggtagaaatggaggtgttggattattgtttggttactgtgtaccaagctttttaatttggtttgctaaggcaagagattttatgatttccaaagctggggagcattttacgtga

SEQ ID NO: 2708 - DNA, 276 bp, Candida albicans
tctgcagggagtatcgctttgtcctacgcagcacattcgcagctctgcgtaaaccaactgtccttgaacggtactgaagaacagaaggctcggttcctcccaggtcttctgtctggcgagaagatcggagcattggctatgtcagagcactccgcaggctccgatgtggtcagtatgaagacgactgctaaagcagtcgacggtggctgggtgctgaacgggacgaagatgtggatcacaaacgtgagtagtaatcaaacctacaacagctcttga

SEQ ID NO: 2709 - DNA, 1431 bp, Candida albicans
ggtcgtatgagtgatattttcggtgggaaaaatgtcattatgacatgtcttatgattttagtcattggtgatattgcttgttctgttgctcgtaacggaattgaattttttgtgtttagagcattagccggtataggaaatggaggagtttcatcattatcaatggttattcttagtgatattgtttcattaaaagatcgtgggaaatatcaaggtatattgggagcttccgttggtataggtaatgctattggaccatttattatgggggctttcattaaaaaaagtagttggagaagttattattattttttggcacctttagggtttgttgttaatgtcatattatatttttgtcttaaaaataataagaaattagatgatgttatatctcgtaaagaaaaatttatgagtcttgattatacggggattttggcagctactgcaagtttaacattaattttaattccattaaatggtggtggttcaacttattcttgggatagtaatatagttattattatgtttaccgttggtggagtattattaattgtatttttgggaattgaatggaaatttgctaaattacccatgatcccattacgacttttcaaaagtccatcactttgtttattatatttagctactttttgttttggtgctacttattttagtttcacttattatatgccatatcatttccaaatgattaaaggtaaagatgaaatcggtactgctattttcttattacctttggtattaatgcaagccctttcatcgattatttgtggtcgaatcattagttttactggtcattatttctatgttgttcaagcgggatatttactttggttattaagtgtttgtttattaatattatggaaaaaaactttacctgatggtatccatattttaattttgtttattatgggtactggagtcggagccgctttccaaccatcaatggtcgccgtacaagccaattgtaaaaaagctgaaagagccgttgctatatctacaagaaacgtattaagatcattaggtggtaccgtgggtattgctattggatccactattgttagtaattccgttttaaaagaattgaaaccccttaatagttccaattcaaatttgtcaccggaaacaattaattatattaaaggtcatatttatgaaaaaatcccattgacaaatttgaataatcaacaaattaatgaaattaaagatatttatactgcagcattaagaaattattattatttcttgatcccattaatggctatttgtgttattacggccatgtttgttaaagataatggattgaaagctttagatgaacaaactccaatcgatactaaagatttcattgaacgcaaaaaagatcttgaatcttctgcttcttcaatgactgttaaatgtgagaatgtttaa

SEQ ID NO: 2710 - DNA, 906 bp, Candida albicans
gacgcgggttttccacctcgtggtgaagatagtttgccggaacatgaatccaataccagtctacatgatatggagaaaaagcaattggctgatcagttaggtgatattcattacaagattctccccattaaaaaacttttaatttgtttattttcattatctttagcattatttttatcttttgttgatcagactagtgtaacaatagcattagccactataggcaaagatttgaatgcagaaacaacaatcaattgggctcccacggcatcattattggcaaattgtatatgtcaagtattatttggaagattatctgatattttcggcaggaaagtcatgttaataacttgtttaatttgtttatcattaggagaattaatttgcagctttgctaaaagtggagttgaattctttgtctttagagcattaactggattaagttgtggtggtatccaaagtctttgtatggtgatactaagtgatgttgtcactttgaaacaaagaggtaaataccaagggatattgggtgctagtgtacggttaggaaattccattgggccatttatgatggcagcatttattgaacataacacatggagaaatttctatcgtatgatgtgtcccataaatattcttgcatttgttattattgcaattttcattgatacaaagcaacaaaccaagcaattgaatcaattgttaagtaaatcagaacaatttaaaaaattggattatttggggatgttaattggttgctctggtttgactttattgttggtatctattagtagtggtggatcaacttataattggaatagtgcccctgttatttctatgtgtgtcattgggggtatccttttgattacatttttatttgttgaatggaaagttcctgaattgccc

SEQ ID NO: 2711 - DNA, 663 bp, Candida albicans
ccagaaggttcacctggtttgggtatggaaggtaatgtttcagagaaattgatacgtgttgactttttgggatcattctttttggtcagttcacttatggtgtttttaagtgcagcttccttgggtggtagagaaattgcttattcatcatttacattcattggtttaataatttccgcatttgtattattgacagcttttgttgcagttgaactttatgtctcagaagaaccaatattaccaattgaattgtttgctaatagaacagttttagcttcttcgttaaccaattggttctataccatgtcaattttcacaacattgttctatgttcctatttattatagttctgtcattggtttaacacctactgaaaatgggttgagattggtgcctaattttttcggtgtctcatttggatcggttggagctgggatttatatgaaaaaaaccggtcgttattacaagttggcagttttagctggtattttcgccatttttggtattggcaaaatagcgttacttactcctaacattccaacttggcaacagtttttattgttgattccttcaggattgggttactcgtgtatattgactgtcactttacttgccttgattgctacagcggctttaagtgccaccaagggtgaaattccgcgt

SEQ ID NO: 2712 - DNA, 681 bp, Candida albicans
aaccaaatgatatctccaaaatattctgctactcattattatttatcggccaaagcattatctggagctaaaactgcccctcatattatcaatttatatttagattataattgtccatttagtgccaaattatttttgaaattatacaatactgttatccccaatttagaaaaaacccatcctggtagatttcaatttgttttcgtcaatgttattcaaccttggcataccaattctaatttattaactgaattcgccttagcttatgccaaattacttcgtgaaaaagagacagaagttgatggtgatattgattcaattaaagccttttgggatttttctgaaaaattatttgaaaataaagagaaattttatgatacagcaaatattgaattgacaagaaatcaaatttatgaacaaatttataatgttgtcacatctggtttggaattgaaagtttctaaagagaaaatattgaccgaattgattattaaaccaagtgaagttccaagtaacgctgggaatggggttactgcagatgtcaaatattttaccaaatatctcagaggagttggtgttcatgttacacctactgtcagtattgatgggattgtagatgattctgtttcaagcggtagttctgaagacgatttggtcaaattatttgagagtaaattataa

SEQ ID NO: 2713 - DNA, 1329 bp, Candida albicans
ataagaattggtactggagagtctccaccggtagattgtgtgttagtggaaggaagcactgagtttgatgaaagtgcattgaccggtgaatcgactccagttaaacaccaggagggccaccagatcttttccggtaccgttaatattggtaatagttcagttgttggaaaagttactagtctcgaaggagattcattgttaaatcaaattgtgaatacggtaagagatggtcaaatgcgcaaagcacctatggagcgcacagctgatttgattactggttattttgttccattgattattgcttgtgctgttattacatgggttatatggttggctttgggctattcaggagccttacctcaaagctatttggacattgatgttggtggatggactgtgtggtcacttgaatttgccattgcagtgtttgttgttgcatgtccttgtggaattggtcttgctgcgccaacagctctttttgttggttctggattggcagcaaagaatggtattttagctaaaggtggtggggttgcattccaggatggagccaatgtcaacatcgtgtgctttgataaaactggaacattgactaaaggagaattaacaattactgatttccatttccctgataaaagctctattgctaaaacgtttgccttgcaagtagctcgtgatttagaggttccatctcaccatccattgggcaaagcagtgaaatcgtttgtgacatcgtacgatggaaaatcattgactgcaaataagattcctcaagttgagactgttccaggaaaaggattgagaggacaaataatctacgacgagggtgatgatatatggaatgagtacaagccaacacaagcaattcttggtaacgaaaaattaatggaagaaaatgatattgaattcacagaaaaggaaagacaatggttaaagaaatggaagggagaatgtaaatcagttattttagttggtttacagtgcgaatcatattttaaagactccaagtttcatttggcacttataatggctgctagagaccagcttagaccagaaactaaaaaagttattgagtttttgaaacataaagacatcgaatgttggatgattactggtgataacaagcttacagctgatgctatcgctaaggagataggaattgagaatgttgttagtgaggtgttaccagatgaaaaagaagcacaaattaaaaagattcgacaattgaacctgggtggtaaaaaagaaccagtgattgccatgattggtgatggaatcaatgatgctccagctttagcctcggcggatgttggaattgctttatcttca

SEQ ID NO: 2714 - DNA, 393 bp, Candida albicans
aataaacaaacaaccatgactactactactactgctactactactactagtgaagttccattattatacactcttggattcattcgttgcaaagataataataaaattttattattaaatagaaataaatcaccatggatgggattatataatggagtaggaggtaaattacaatcaggtgaaactgctttagattgtatgatacgtgaagctaatgaagagacaggattacatttaactaattttataagtagaggtattatgacttggaaaatagattatagtgataatgttaccagtcatcaacaaccaagtattgaggattatatttatttagcagccgatatatcaattgaactatatgaacgatatcgaactccagtagggttataa

SEQ ID NO: 2715 - DNA, 759 bp, Candida albicans
atgcgtatctccacgcgtgctgaaaaagtctatcagaaatcacaagtccctatattagtttcaacatttattttcacaaacatgatttctcgtacaagcatgttcagatcaatcgttgaaaatgctcaactgacattgaaacaacaaatcaccaatatccctaaatccgcgggcatcaattatcaaaatttcgtcaacttgaatgatgttcaaaaacgtgaggttttaacggcaattcaatctttgaaaagctatgaaaccagttccaaagctcaaaacgaccggagaagaaaactattccaacgcatgtcatacaaacagcagaaagcatgtaaagatattggatatttgaaaaaattggataaaatcgataatgctatcagtgccaattacaaatttgttaatgatgttgctgaccatgctatcgctaaatatggaatttcgttaaaagatttcgatttattaaattcagaaaagaaaaatgcaagtacaacatctgcttccaattatcgagtaattgaagctttaggtcattatactcgtgattggcatccagaaaatattggattggaattattacccatatacgaatatgttgccctgcaactctcggcgttgatcccttatgatgccaaaaaagatacttgtttggttttcccaggatctggattaggtagattagcccacgcatttgctaaatgggattttggtgctgtgcattcgattgaatattcccgggttgatgaatgcttttgttga

SEQ ID NO: 2716 - DNA, 840 bp, Candida albicans
ccttgcattataaaaggggcacaaattccccaaaactttgctgttctgtacatccccccatcaacaatgtctacaaatcctgaaaaacctactagaaacgaggacttgtttgaaaactcaagttcctcatccagtgttcctcacaacaaagaagcctcggagttggaatcggtaaactctactgctgaaagagaaggaggcgaacatggtaatattttagctcagtacactgaagagcaagtaatgcaaatgggccgtaactacgcccacaagtacgacttggacccagatttgtttggaagagctgctgcccttgctagagcacctagcgccttcaattccatgccctttcttaccgacgaagaaaaacaagggttgtatctcgaagcaaccaagaaatggcacatcccgagaaaattgattgaagttattgctgttggtgctattgctgctgccacccaaggtatggatgaaagtactatttctggtgctaccttgttttacccaaaagcgtttggtgtcacagaaatgaaaaacgccgatttaatcgaagggttggtcaactcagcaccatacttgtgctgctcggtcattgcatgctggacatccgattactggaatagacatttgggtagaaaatggacaattttctggacctgcttgatttcggccgtcacttgtatttggcaagggtttgtcaacaactggtggcatttgtttattgccagattcttccttggattcggaattggggtcaaatccgctactgttcctgcttatgccgctgaatgtacaccaaaacacgttagaggtgccttggtcatgttgtggcaatttttc

SEQ ID NO: 2717 - DNA, 570 bp, Candida albicans
  unsure (26): Identity of nucleotide sequences at the above locations are unknown.
tttcccttcacgttggttttttcttnttcaccactttttggagtacttttttgttcaatcttcagatctacaataaactatctaccaatgctgtctgtttcactggaaaataattccggtttgtttggaactgatgtatatgatgagaccaaggaaaacaagcccaaatatgaacacgaggaagggttggagtttggttcagactttgactttgacggcgagtttgaaaagtatgccgccatgggtgctgctgagaagcagtcgggcgcttggatgaccaatttcaaaaacttagagttcccccttggagtatccccgtcggtgttggtccagacgttgggtatatttgctgcattctgtggtattctttctggtgtcgaccagtcgttgatctcgggtgcctccattggtatggacaagtccttgcattttaacagtcacgaaaactcattggtatcgtcgctcatgccgttgggcgcagtagctggttctattctcctcacgccgttgcagaggttcgggcgtaagaaggcgctcatggcctcctgtatcttgtacacgtatgtataa

SEQ ID NO: 2718 - DNA, 330 bp, Candida albicans
ggcagaaaccctgttgataattataaaacattaatcagtgccattgttcctacaccaattgggtttgtttctacagtatccaaaactggtgatcgcaatttggccccattttcatactttacaatggtaaaccacgatccacccatttttacattgggattttccggtgggaaaggaaccccaaaggacacatgcaaaaatattttagagactggtgaattgacaattaatattattattgaatggtttgttgaagcggctaattattgttcaacaaatgctccaccaggtatcgatgaatggaatctttctggattgacacctttataa

SEQ ID NO: 2719 - DNA, 1065 bp, Candida albicans
tttgataatatttttaatcttcaccgaatacttatatacagtaaacccaatatcagaatgtcttcgatatttcccaaattatcatttcaagaatggtatcaagtattgtatggattatggccaagtaaccctcaatttactgaaaaagatatttcttcaaatactttgaaagacaaggtggttgtgattactggaggtaatagtggaattggttatgaaacagctaaagtattagctggtaatactgaagcacgaatttatatatgggctaggaatagacaaaagtctattgaggctatagaaaagatcaaattagaagtggctgagaaacacctgaaagatgttggagatagattgcaatttattcaaattgatttaagtgatttaaactcaattgagccagccgtcaaagagtttttgcaacgtgaacaacgattggacatcatttatcataatgctggtgttatggaatctccactggatcagaaaactaaacaggattatcaaatggagttaggagtgaattgcattggtcctcagttattgcaaacactacttgatccattattcataaagactgcagaaaagaatccaccaaacttatcaagaattgtttgggttagttctactgctcatatgttttcaccaattggaggaatgtatttgcgagacccagagttcaaatctatagatgtagagttgaagacaaagtacgatcaaagtaaagcaattaatttgatacaggcaagacaatggaatattcatcacccaggtgcaaacgcaattagtctttcattatgtccaggatatttaaaaacaggaattcaacgacacgtcacagggttgacaaaattggcatataatttgtttttccatgaccagaaaatgggtgtctatactttactttttgcgggactatctccagaaattacaactaaaaataaaggcgaccacgttatatcgtttgggaaattgggattgattcgaccagacttgaaagatgatgagaatgggaagaaagtttgggattatttgcaggataaaattaaactgtatgtaagataa

SEQ ID NO: 2720 - DNA, 930 bp, Candida albicans
attgctgcaactgtaaaacacaaatttttttttttaatatcccactttttttataaattttggcaaaaccctttaaactctatctcatatctgacaagattaggagttgtttcactcaatttattcataccatattcaatcatgtcatataatttagcaaacaaaattgcaatagttactggtggactcaccggaattggtttagccaccaccataaaactacttaaacaaggttcaaaagttattgtaggtgattttttacatgaacatgaaattgatactgttttaaatcatattcataaacaagttcctgaaaataatcgaaacattaaatttttaagaataaatattgctaattatcaagataatgtcaatttagttgattttgccttggatgaatatctggatttgcattatgttgtaacaaatacagccattactaccaccaccgccattgccagtaataaaaccgaaacaatcgatcaattcacagaagtgatcgatactaatttgaacggggttttcgctttaaacaaattagctattaattattgggaagaatttcataaaccagggagtattgtcaatgttagcaatatattgggattaaccaccactaaggggttaacaagttatcgtgtttgccaaggtggagttcaatcattaacacaatctttagctttaccatatgctaataaagatataagactcaattcagtgattccaggttatgttgaaatatcccctatgttgggtcaaattaatcaacatattgcaactacagccataaagcaacatccaatggctagattggggaaccctgatgaaattgcaaatgctattgctttcttgttatcagatgaagcgtcgttcgttaatggtacatcgttggtggttgatggaggatattctgcccaaatgggaaattaa

SEQ ID NO: 2721 - DNA, 1509 bp, Candida albicans
acgcaaatgaaagtaaaccataatcacatcagcaacaccagtgtcaataattctgaagacgttttggaagcacaagatgaaatatcaaatgataacaacaagaatcaggaaagcatttggaataagaagagcattttccatacatggttacttctttgttattctactggacctgtggcttcaatgagtcggacttatgttccagcttcaattcaatccattgcaaaaaatgtaggcaaaactaaaatgaaccaaccttgtggcacacagggaaatgattgttatgttaagtttggatttatgactgtacatcacacctcctatgtgttatacttgagggcagtatccaccgccattgaaggtgtagttgctatttttttaatgggtatagctgattattccaattatagaaaattgtttctcatattttcaattcttgtgtatgggtttcttgctttgcctttcattggtctaacaaataacgattaccaaactttagtactcgcatccatcttatattcattgttgataattgatgattccatctaccaaattctcgaaggctcttatattcctttatttatgagagcagacaaagaaaatcccatgcaaagaggttcggttgtcgctgttttagggctatttcttggtaacttgggaggtataactgctcttgtaattggcattatcatttcctatttaagtgctacacctgaactgaaaggatatcataattttttacttgcaatcacaattgctggttgcttgacaattggtttatcattattctcagctttatatattcccaatgttcaaggaaaacaacgaattgacaattttctagttttaccatttaaaagatttttcaacttgttgaaagatatacagaaatatccaatggcatttctttactgcatttcttgggtgatatggaatgtgagctttaataactttatgagtatgtttcttttactattcagatcaacgttgggattggggaattccgatgcagaatatactgtttacacttttatgtcttatatctgttcctcctggggatcacttctttggatgttcttataccaaaaatggaacagcaatatcaaatattgggggtatagttttctactggtcagtttattagccaatttttggggatgtttaggaattcataaattgactccccttgggtatcagaatagatgggaattttgggtttttgaagttttttattcggccacttcctcagcaatgagatctttaaataggtgtgtatattctctgttgctaccagagggaaacgaagcacaatactttgggttggaggtaacattaggaattgcaagtggttggattggtggcttggtcaacgcagtaattcaagacagaaccaatgatgatagattcccattcttgcctaacatgtttttagttgttgtctcgcttatagtatattattatgttgacttgcaaaaaggtaagaatgacgtgaataatggaaattcataa

SEQ ID NO: 2722 - DNA, 456 bp, Candida albicans
gaagttttgttgaaagttggacaaaaccggtacctggtgaagatcccaacacaaaaaaaaactagagctactgtggttaatcaattacaaattggtggatcagggattttaattgttggtgatcccgaagaagttactgaagaattaattcgttggcatgaaatctctggtgttgatggattcaatttcacttatgctgtcacaccaggtagttttgaagatttggttgaatatgtcattccattacttcaagaaaaaggttatgctcaaaaggaatatccaactaatgaaaatggtaaacctcttacatatagagaaagtatttatggtgctggtaatgggtttttaaaacctgatcatcctgcttataatttaagatggaaatctgaagaatctaaagaagaatttgaagaaaagttacaaaagactttgaaagaaaaatttggaaaaacttag

SEQ ID NO: 2723 - DNA, 1221 bp, Candida albicans
acatgtcataaatccttctccttcaaatctaaaaaatttattcagcattgttgtttttccatcattgacatccactattctctctcgacaatgacaattagtcctaataaaagacaaaaacgtgattcttcatcacctaaaaaacacctcatcctcaatgcatttgatatgatgtgtccatcacttcaaactgcgggattatggagtcatcctgaagataaatctcgagattataataccattgaatattggactaatttagctaaattattggaaaaggggaaattcaatgctcttttcattgctgatgttttaggtggttatgatgtttataatggacctcgtaatttaactgctgctgctaaatctggagctcaatggccaattaatgatcctcatgcaattgttcctgctatggctgccgttacagaaaatttatcatttgctattacttcaagtaccgtcagtgaatcaccttatcattttagtcgtcgattagccacgttagatcatttaaccaaaggtagaattggttggaatattgtttcatcatatttggattctgcagcaagaaatttactcaatggcggtccattacctgaacatgatgaacgatatgttaaagctcaagaatttgttgaagttgtatatcaattatttttgtcttcatgggctgatgatgccgttaaatttgataggaaaacaagagttttcactgatccggaaagaattagagaaattaattataagggagaacattttattgttcctggacctagtattactgaaccaactccacaaagattgccagttattttacaagcaggtgcttccaaaaaaggtttagaatatgctgctaaaaacgctgaagcagcgtttattaatggtatgaccccggaagcactaaaagtcaaaattgatcaattgaaaaaattggtgaaacaacatggtagaaaccccgatgatgttaaagttttatcattagttaccgtgattgttgctcctactcatgaagaagccattgctaaatatgaagaatataaatattattctaatcctgaaggtgcacaagctctttttggaggttggacaggaatcgatttagggaaatatgattatgatgaaccattagatcaagttgaaagtaatgctgtaagaagttttgttgaaagttggacaaaaccggtacctggtgaagatcccaacacaaaaaaaaactag

SEQ ID NO: 2724 - DNA, 1620 bp, Candida albicans
ccaaactttaattttttagttttattttggtttttattatattttctatatacaatcaccaattctacaaaccaatcaaatcataaaatagtaccactgtcgatgactgcttctaccaattccaccaatgacaagcaaaatagagctccattaatttggaattcattttgtatgggatgtctgggtttacaatgtcctggtttgtggtcacatcctgatgataaatcacgagactttaataccattgagtattgggtcaatttagcacaattattggaaaaggggaaattcaatgctcttttcattgctgatgtgttgggtccatatgatgtttatgatggtccaggaaattttagatccgttgccaaaagtggagctcaattcccaactacagaaccaagtgctgttgtttctgcaatggctgctgttacaaaaaatattggttttgggataacattcctgacaattagcgagaacccatatcattttgctagaagattggctactttggatcatttgacaaaaggaagagttggttggaatgttgtgagttcttatttggattcagctgctaaaaatttacttaatggagaatccttgccacctcatgcagaaagatatgaaagagctcaagaatatatcgatgttgtttataaattatttttgagttcttggagtgacgatgccgttgaattgaaaaatcgagtattcactaaccctgataaagtcagagaaataaaccacaaggggaaatttttcactgttcctggacctagtattaccgaaccaactccacaaaggttacctgttattattcaagctggtacttcaaaagcaggtaaggagtttgctgccagaaatgctgaagttgtgtttatcacaacgttttctccagaagaattaggcaaacaaatcaaggctatcaaaacacttgccaaagaaaaatatggtcgtccagaaggttcgatcaagtttttgcaattaattacccctgtggttgctgatactcacgaattggcagaagagaaatttaaagaattgcaactgtatggggatttagatggtgcccaagcgcttttttcagggtggactggtattgatattggcaaatatgattatgaggataacatcactgataaaggcaccaatgctgtcaagtcatttttagagttgtggaataagacatctcccggtgaacctgcaaatgtcaaaaagactagacgtgatattgctcgtcaaatcaccgttggtgggttgggaccagtgttttatggtacacccgaagaagtgacagatgagattcaacgttgggttgatatttcaggtgttgatggatttaacgtgacttatgcaatttctccaggaacttttgaggactttgttgaaaaagttgttccattgcttcaggaaagaggattaacacaaaaagattacccacaggatttagaccactctttgacatttagagaacaattgtttggtagtgacagaaaagaaccttattatttattggaaagtcacccggcttatgatttgagatggagagccggtgaatctaaagatgaatttgaaagaagactcaacaagaaaagaaaaagtgaaacccaagaaattgcataa

SEQ ID NO: 2725 - DNA, 1239 bp, Candida albicans
acccacaaatcaacacaacaacaaaaaatgaaaattttcttttcatcaatgaagaccattcgatatctttcacatactacaagactactcgcgaaatctacttctacgcctaaagtcttgggccgtgcatccaacaacttatcggtaggactagtgggattggcaaatgtgggtaagtcaacttttttccaagcacttacaaaatcgaccttaggaaacccagctaattacccttttgcaactattgaacctgaaaaatcgatcgtgttagtacccctggacaaattaactcactatgcgaaactttacctgtcgcaaaagactgttccaacaaacctaacgatatgggatattgctggtttggtgaggaacgccagtagcggtgctggtttaggaaacaagtttctaaatgacatcagacaagtcgatgggatattgcagatagtacgaggatttgtcgatgacgaaattgttcatatcgaagataacaaggttgatcctgtgagagacttggtgattgtcaacgacgagcttatactaaaggacttggaaatcattgaactggaaattgaacgtgtaaataaaatgaaaaacaaaccaggaattggtgggtcgtatgaaataaacttacagacattagacaagctatccacattattgtatgatggtataaaagtggtcaacggcgattggagcgatgaggaagtagatgttataaacggattaaacttattgacagctaaaccaactgtatatttgcttaatgttagtaaggaagattatgagagtggaaacaatcaattctacaaagaagtagaccaatggatagccacaaactctccaaatgataaactaatcatgttcagtgcagagtatgaaacggcgttaaacaacccagaagagctgctcggtacagggtctgccattggtacggttgtggaagagatgagactggtgttgtcgttaatatcattctttacatgtggtgaaatggaagcacggcaatggactatccgaaaaggcagcactgcaccagaagctgctggattaattcacactgatttacaaaaaacatttatcaactctattgtatataagtgggacgatttaaaacaacttgatacttttgatgaaagtaagttaaagtcccaaggcaaacagcacaaatgcggtaaaaagtatatagtcgaagaaggcgatgttttaatcatcaaagccggaagtggtaaagctagatag

SEQ ID NO: 2726 - DNA, 279 bp, Candida albicans
ttgattaagtttaagactgatgatgaagttataaaactggccaatgacactactgttggacttgctggttatttctatgcaaatgacgtggccaaagtttttaagattgcagatgcacttaatgtgggtatgttgggtgtgaatactggagctatatctgaagcagcattgccgtttggtggtgttggcgagtctggttttggtagagaagggtccaagttcggagtcgaagattatttggttattaagagtgccgtactaggtggaattgaaaattag

SEQ ID NO: 2727 - DNA, 687 bp, Candida albicans
atgttcaccatcagaagaaatagaaacggggctattgggtcgtggatcgttatgtttatgcaacagttctgtggtatcaacgttattgcttattatgcctcctcaatctttatcaaggcaagatacagtgagatcagtgccttgcttgcatcgtgggggttcggtatgattaattttgtctttgccatcccggcatttttgacaatcgacaagtttggtcgtcgtaatttgttacttttttctttcccgctaatgggggttttcctattgattgcggggttcgggttcttgatccacgacagacagggtcaattggctatggtcacaaccggcatctacatcttttcagcaatatactcaagttcagaagggccagtcccattcacatactctgctgaagcattcccattatacattcgtgatttgggtatgagttgggcaacagcaacttgttggttctttaactttatattggcgttcacatggccacgattgcaaaatgcatttactccaaccggggcttttggctggtacgcagcatggaatgtcagtgggttcttcttggggttatggttattgcccgaaagtaaaggattgacattagaagagttggacgatgtgtttgccgttccaatgttcgtgcatgcagtataccgtaccatagagctcttaaacgggttccaatga

SEQ ID NO: 2728 - DNA, 357 bp, Candida albicans
agtatatctgtatatagttatgctccattatatataactgcatatattagtattgtagctaaagtatctataatgtcatttatctatttaaatatacatttatttagtacacaattattaatattagctttttacttatcagtagccgtggcagcatatacaccattatatcaagttaatattaaatctatattagcatatagtggtatattaaacttcggatatttattaacagcagtattaactaatgataatgcatattatatttatataatacaatatagtttaacacatgtgactatattcttatgtatattagcgataacagagtatactaataaacctgcatcatattga

SEQ ID NO: 2729 - DNA, 273 bp, Candida albicans
tatggtatccctttattacctttagctattatcttctttataggttgtgttgctgaatgtgcacgtccaccttttgataatgttgaagctgaatctgaattagtttctggtcatatgactgaatatagtagtagtatatttgttttattcttcttatctgaatatgcttctatcttattcttaagtactttaactgctatcttatttatgggtggtggtactggtattatattaggtttaaaagctaatttatttgcttttacttatatttga

SEQ ID NO: 2730 - DNA, 825 bp, Candida albicans
ttatatattatcaaaatggtcgacttcaatgttaatgggaaaattgctgttgtaactggtggtactcgtggtttgggtttatactgtgctgaggctttgttattgaacggtgcctccactgtggtcattacatcaagaaaagcaaaagcttgtgaagaagctcaaaagtatttggaaaaacttgccaaagacaacaacaagaattgtaaaattatttcatatcctgcagatattgctgttgaagaagaatgtgaaaaattctacgccgaaatagccaaacaagtcgacaaagttgacattttggtcgccaacgctggtgctagttggggtgctccgttagaagaccatccagtttcagcagtcaaaaaagtcctcaacttgaatgttgttgccgtctaccacaccatcaagttatttactcctttattggaaaaagctggtaccaaagaagatccttctagattgatccttatgtcctctgtcattagttattcgactaacgatatggtcggtgtatacggttatttgtcttccaaggctgcagtatctcatttgggaagaaacttgtctgttcaatttgccccaagacatatcaatgttaattcaattgccccaggttttttcccatcgaaaatggccaatggtttgatcgaagctgctggtgaagctttgacttcaaccaacccaagaggaagattgggtgagaaggaagacattcaatctttgttaatcttcttgtgttccaaacagtccaattatgtaaatggtatcattgttcctcttgatggaggagcacacaataaccaaccagctgctcatttttaa

SEQ ID NO: 2731 - DNA, 324 bp, Candida albicans
gctatggttaggtttgcccccctactcacggccaaagcaacccgtgagtcgccctcgcgcgtcatcgtcactggttccgtcgctggcattggggtcggctctatcggcgaaaatgccacctttgcgtactccgcctccaaagcagccgtgattcacctggccaagaacctggcggttgagctgggtccccggggcatcctgtgcaatgcgattgcacccggcttctacccgtccaagatggcccatgggttgatcgagaagcagggcgggctcaagcagctggaggagcactcgcccaaccggcgaatatgcatgccgggatga

SEQ ID NO: 2732 - DNA, 1278 bp, Candida albicans
atcaaattccaaaggatatttaatgggagtgtatttcctaccttcccttcaaggctagactttgatcaccaagccatgccaattgatatcaacactaaggcaaagtgttattttgatactagacccttaactaaaggggaaagaaaaatcatcaaagattctattcccatacttgaatatcttgatattcagtttggagagaagtttttcaaaaggctaattaaacagtttccacaatacaaaccctatttcaatgaaacgcacctcaagttattgcgtcaaccacgtagtttccatcattgcttgttggaatttgcaagaaatattgatgatttgagaccaatgaaggatttcattatgagaattgcgtcaaaacatgttgcaagacaagtcagtcccgatcagtatcgagtttttgggcaggttttggtagaagttatgatggatcagttcccgaaagaatttgtcgatcaggaatttgtggaagcatggactatggcatttaggattttggccaatatattgataaacatagaagttagagagtaccaagataaaccatggtatggatttaaagcatttagagttacacgattgcaaccagaatgtgtaggtactaaatcttttttcattaccccagttgatggaacgccagttccaatccctaaacgtggtcagtacttgtgtatgcggtggaagttcccaggtgaaaaacaggagaggttaagagagtacacgatatcggaattccccaaaaacaacgagtatagaattacagttaggtatatcccaggtggaaaggtaactacgtatatacatgaaaagctagcagtgggtgatattgtacaggtatcgcccccgtgtggtgattgttattaccgctcgtcaaagagaaatatggttatgttagcaggtggaaatggggtggtcgctctagctccaatgattgagaaagggttggctgaaggaaggaaggtcaagttcttatattcgaacaggtctactgaaacgagatcatttggacagttttttagagatctcaagcaaaagtatggcgatcagcttgaggttgtcgagtatttatcacgacgcagggttattgatccgattgataagtattatagacggtcgttgacggtagaggatttggattttattgtccccgaagatgatgtgtacttgattgggcccaggacatatatgaaaatgattgaagattacttgaagggcagaggtgtgaatgttacattagactattttggtccccaagaagtgtag

SEQ ID NO: 2733 - DNA, 879 bp, Candida albicans
cattggatccgccagcgccgtggtgaagactatttcagaaaaggaatttataaagcaagtttaccttatgttttcggtagagaagctagtggtgaagttgttgcagttggagatgaagtcagtactttgaaagtgggagacaagattgcctatttatctcctaacacatttgcacaatacactagaatcacagacgataattacaagtatataaagctaccagacaacgcaagtgatgaagaattgaagatttatgggtcattatttttacaaggtttaacagctttgacatttgttaatgaagcttataaagtgcaaaaggatgattacattcttgtttgggctgccgctggtggtgttggtaaaattttagttcaattgatttcacaactcggagctcatgtgattgctgtggcatctacacctgagaaattgaaaatcgctcaagacttgggggcagaattcttgattaattcaacttctgatgatattgttgaaaaagttaaggaaattactaatggagaaggtgttgctgcctcatttgactctgtaggaaaggatacttttgaaatttcattaaactcaattaaaagaaaaggcacttttgttagttatgggaatgcatctggacctgtcactccattcccattatctattctttcgccaaaaaatatcaagattgcaagacctcaattgtatgcatatattggcaatgctgatgaatgggaccactactcaacagaattgttaaagttatttgagagtgggaaattaaagtttgatattttcaagacctacgatttgaaagattacgttcaagctgcaaaagatttggaaggcagaaaaactactggtaagttaacattaaaaatttcttaa

SEQ ID NO: 2734 - DNA, 909 bp, Candida albicans
tatttgcatcacatgagggaagagtatcaatcaaatagtagccacgttgagccaatcaatttagatgaagtgtacggagttacaaagataggacctaatacatatcgtggaaacagaccattaaccaaaccagatagaagatcaaggggggtttacgggggaaatctttgtggtcaagccgtcttagttgccatggaagcatcgccaccagagtttaaaccacattcctttcattcatattttgttaaagctgttcgtgatgatgagccattgacttggaaagtgcaagaagtgtctactggtaggacttttgctaatcgttcattacaagctcttcagcttggcaatattgtttttactgcggaagtgtctttgaccaagaaaaactctatttccaaaaccaaatcagctgaaaataaaccgtcctttctgttcgagactccaataggtaaaactttcgatgcttataataatgcttccttgccgattgtctcaaacgatttagttttacttgactataggctattcccaaagcaattagactcagataaaatatcatattcacttaaatggggtaatgacaatcagaatagttgggatatgttgcatgttaaaacagattatcagtttgttgggttggctatactatcagatacacttgatgttggtgcatttttgaagcatttaggttacgaaagcaatccgaaatttaatgcatctttggatcacagtgtttatttccacgataatgattttgatgtaacaaagtggtgcacaacatttataaaagtttctagaatgggtaacgatagagcattaatcaaaggtgaaatttactcaaataatggcctgcatattgccactattgttcaagaaagattgtggatcacagggggtgctaaattatag

SEQ ID NO: 2735 - DNA, 1173 bp, Candida albicans
tattactttattttagaaatgcttgagttaacggctggtcctaatcccgttccagattttgaagaggcacttcgagtaattaaattagatgaaacccattatgttggggcgcatccattgagattaccagttacaggaggaagaggtgtatatggtggtcatttgattgcacagtctttacttgtggctatagaatctacacgagactcaacaactaatcaagtttttattccagattcttatcatctgtattttatcaatgccggtaatgccaaaactccaatgaattatacagtaaccaaattgtatgatgattcaatttcaagtaaacgttttattgttgttcaacaaaacggtaaaaatcgtttaacctgtttagtcaatttaagaaagcccggcacaaaaacattacaccaagaaggatccggaccaaacattagtatccccgttccaccaatacaactaaaatatccaaaccccgatgaattacatcaagtacaacatacagattttgttagaaatgcatttggcaaagagtttattgattatcgagaatgtcctgaggaaaaagaccagtacgctgcggaacggtggttaacggtattcactgggttaagaaaccatgccgagccaggtgcttcacttgaagcagttacagaagaattaccagatgccagtgggaaaattcataaagtggagaaagtgatattgcgaccaaaagattctcaatctgtaagggatccaatttacaattatgtgggtttagctgatttatccgattctgcatttcttacaacaatggcaagaattttgcatattccttgggctccatcattggaaatagatgaaacgtacgacgaaagtagagatgccacatatataatgaggactactttaaatgctgctcatattttccattataacgcaatgtcgttagaccatcacatatatttccataaccaagattatacacctgatgatgattccaattttgatatttgcaaagattggttggcattcacatatcaaatgaaaagactctcaaataatagaacactagttcgtgggtttctctttaatgaaaaacataaatgcattgcaacagtggttcaggaaggactaaccattgtttataatggtgttggtaacacagcagataaatcgcgtttatag

SEQ ID NO: 2736 - DNA, 1002 bp, Candida albicans
atttgcaaaatttgttacactatgattcaaaatgttactagagataaattatacccagaaggtaaacctgtcgatttagaggaagagtttggtgttgagaagattggacctaatttatacagagggaaaaaaccaatagcaaaaccagataaaaggtcccgtggtgcatttggtggatttttagctggacaagcattagtagtggcaatagagtcagttcccaaggaattcaagccacacctgtttcattcctattttgtgaaagctgttgacgatttagcacctttggaatgggccgttgacgaagtttcaaatggtagaaattacgccaaccgttcattaaaagcttaccaatacgaagacattgtttataccgccaatgtgtctttgacgaaaaaaatttctacaaagaaggccatagaagaaactggggtgaaaccatttgaatttcaaacaccgaaacatgaatggtttaataggcataaactcgaagacttgccagtggcggatgtaaactccagacttttggcttatcataaatttttcccagaagtagtgtcattggaagataccagagaggaagataacatctcaccagcagaaagacaattaagttggtatttcaaatggggtattgaaaatgagggtgatttccaccagcctttggcaaacttggattccaagtaccagtatgttggtatggcatcattgacagacacggtgtatttgacaagattgttgagaatcttgagaattgaggatgccgaccatagtcaattcatacattatttctcagtttcattggatcacacaatatactttcatgatgatgattttgatgtgaccaagtggatgtcattcacattcaaggtgacgaggttcagtcataatcgtgcattgtgtcaaggtgaagtatataatgacaagggtgttcatgtagctactattgttcaggaaggattagtaatgcttaatggtcttgaggaaggtgctaaattatag

SEQ ID NO: 2737 - DNA, 291 bp, Candida albicans
tatttgcatcacatgagggaagagtatcaatcaaacagtagccacgttgagctaatcaatttagatgaagtgtacggagttacaaagataggacctaatacatatcgtggaaacagaccattaaccaaaccagatagaagatcaaggggggtttacgggggaaatctttgtggtcaagccgtcttagttgccatggaagcatcgccaccagagtttaaaccacattcctttcattcatattttgttaaagctgttcgtgatgatgagccattgacttggaaagtgcaataa

SEQ ID NO: 2738 - DNA, 1143 bp, Candida albicans
gattcaagtcacgattacttttcctttactttgtcaagtttttatctcagcaaaaatcaacttagtttgtacctatcaagaatgtttgagtataactacaagtttggggagacagtcgatgtacaaaaagagtttggagtcactaaaatatcagacaataaatatgttggggtcaaacctttgatcaaaccttcacctcaatcaagaggagcttttgggggtaatttagtaggccaggccctattagtagccataagatcctgtcctgaagggttttcgcctcattcattacattcttatttcatccgtgctgctaatgtggagaccccagtggaatgggaagttgaaattatttctaatgggaaatcatttagcaacagagctgttaaggggatccaagaaggtgttgtggtgtatatggcaaatatttctttgacgaaaaaaaattcgtacaaagaagctttacagaaacacgaggaacattatgcaaaaatacaacaaagaggaaaagatggtgacgttgaagaagacgtagacgaggatgatgaagacgagcctggtccaccaaagccatttagcttccaaactccaccaagcagcctgcttaagaaatacgatatagataagttgccagtttcagctatggaatcaactttgttgttatactacaagttcccccctgaatttgtcaaattgtcaaaatccttggaagagaacagtttgcctcctgctgaacgtagattgacagcattggctaaatggggaattgagaacgaacaaggctatgatcaacctttgactaatcttactaaggactttcaatttgtggggttggctaacgtaaccgatggattgtatttaggtactttactcagacttttgagagtgaaagatattgatacaaaaattcattcgactgattatgtgggaatctcattggatcatgtgatatacttccacgatgatgattttgacgttacaaaatggatggagttcagttataaatgtacaagatatgctcaagacagagtggattttgaaggtgaaatctacaacgacaagggtgtccaagtggcatcatttttccaacaaggattggtgagatttgagaatggagcacttttagagaaagccaaattgtag

SEQ ID NO: 2739 - DNA, 420 bp, Candida albicans
aaagtgcgcggtgtatcatggagtttcttgtttcacacttctccttgttcactctttctttcaatcaaacataaaataatggccgaaaatatccctccagaagaatatattaaacaacttaaccatgcttctgatacaataaagcacaaaattgatcaatttccagaattgacccagccaagagtcatgataatatgtgggtcgggcttgggaggtattgctgatgtttcacaagcagaacctaaacttgaaatcccatactcgaaaataccaggattcaagatatccacagtccctggtcatgcaggaaaattagtgtttgggctaattggtaaaaagaaagtaccagtgatgtgcatggttggtcgtttacatttctacgaagggtacagtttccaattaaactacttttcccgttag

SEQ ID NO: 2740 - DNA, 1230 bp, Candida albicans
tggcaaggttgggaatttagagtatcaccaaattctagagaaggttttgctatttatgattgttggtttaaaggtagacaaacattttatagaatttccttatcagaaatgacggttccttatggtgatccaagagctccttatcatagaaaacaagcatttgatttaggtgattgtggatttggtgtcaatgggaataaattggctttaggttgtgattgtttaggtgttattaaatatttggatggtcatggtattcatgctaatggtgaaccatttgttatccctaacactgtttgtatgcatgaacaagatgatggtttattatataaacatgtcaattatagaactgataatgctgttgttgctaaaaaaagaattttcattgttcaaaccattgccaccgtggctaattatgaatatattattaatttgaaatttgttactgatggatctattgatattgaagttagagctacagggattttatctactatgccaattgatgaaaatgttaaagttccatggggtacaattgttggtccaaatgttatggccgcttatcatcaacatattttaggatttagaattgatcctgctgttgatggtcatatgaattcggttgtttatgatgatgccattaaattaccacgtgatgaatttaatccttatggaattggatttgttactgatagacattttgttgaaaaagctggttatattgaacaaagaccatttgataatagaacttataaaatcattaatgaaaatgtcattaatccaatatcgaaaactcctgttggttataaaattaatatgccagctagacaaatgttattagctgatcctgattcatttaatgctaaacgtgccaaatttgctactcaacaagtttgggtcactaaatatcaagatcatcaattatttgctgctggagaattcactaatcaaagtaaaattgatactggtataactgaatgggctaatggaattgatccagtaagaaatgaagatattgttgtttgggccactatgggattcactcatattccaagagttgaagatttcccagttatgccagtggaaactcataatattcaattggctccagcaaatttctttgatagaaatcctgcgttagatttacctcaatcaaataatgggtttaataaatcagtgttggttgctgataatagtgatgaaaaagcttgttgtaaaaacaagatctaa

SEQ ID NO: 2741 - DNA, 1401 bp, Candida albicans
caacatcgttgcataattattcattcacttacgccaactatgtttctacgaagagctttacctagaaacctattacttatacagagaagaagaatatcaaatgttaatgttccctttgaggatgatttgacaggattcgaagacgacagtttggcagattttcagcattatccaggtttacaacagtcaacaccggtcgaccagaataatacaccaagcactaaaacagacaagacaatcgcacaagctcccttgcaagagacaactattattcctcaattgtctaaaattagtcaactaagaaacccagtgatttttgtatctaaattgacaaatccttatatgaatcttgctatcgaagattatatttacaatgccatgcctaaaccagaaggtgccaaagataattcatttgatcggctaatgttctatataaatactccatgtgtagtaattggaaaaaatcaaaacccttggcaagaagttaatttaccggtattgaattctttaggggtccccatgttaagaagacggtccggtggaggaactgttgttcatgatttaggaaacgtgaattattcatacatgaccacgaaagctaattttgatagacacaagtttgccagttatattgtggaggcagtgaaccaagctagtccacgttttaaaatagaaactaatgaacgtggtgatattgttagtgaaaaactcttagggttgaactataaaataagtggatcggcttataagttatcaaagggaaaatcctaccatcatggaaccatgttacttaatctgaagttagatgtattaggtaaattattacatcgtgatgaaaaaaaattaggcattgttgattccaagatgtctataccttcagtcaaatccaaagtcattaatttggaaatgaaaagtgataaatttattgatgttgttagtcaaaaatttaaaagtctttacaatgtggttcctgaagaggatacagaaatggatgagtttaatgagatgtttggattgactgattttgccaagtcacaagaagttacattgtttgttattgatgaggcaacaacgataccggaagaaatccatataactgcagatgaattaaaacagtggtcatggaggtttggtcacactccgaaatttacacattcattcaaaaaccaaaagcatgggcttgaaatattattcaatgttgagaaagggtgtcttaaatcattcaaactaacatttgatgattctaactctgatactaaagaaattgaaaagtctttccaatatttggagtcacatatcaagaataatgatttagagtatactggtagtaatgtagccggatttgtacttcatgatgagataagtgactggataggtgaatctatagatggcacaatataa

SEQ ID NO: 2742 - DNA, 264 bp, Candida albicans
ttcaaaaccacaagatttcataaaccaggccatatattaccgttaagagccgttccaggattattgatcaaaagaagaggtcatactgaagcagctgttcaattaagtactttggttggattacaacctgctggggtgatttgtgaattagtacgagatgaagatggtttaatgatgagattagatgtttgcattcaatttggtaaaaaacatggcatcaaaattattaatattaaccaattagttgaatatatttctaaataa

SEQ ID NO: 2743 - DNA, 375 bp, Candida albicans
tcactgtgcgacaattgttgggtatttgaagttacatataaattccttcaattgcaaaaaaaaatcaaaaaaaaagaagatttaaccaagttcaaaatgagtctggtgaatctagaagacaaagattttgataagcaacatatatggcatccatattcgtctatgacaaaaccacttccatgttatcatgtgaaatcagcttcgggtgttcgcctacaccttgacaccggtcaatcattgatcgatggaatgtcttcatggtggtgtgcaattcatggatacaaccacaaagatttgaatgatgccttgataaagcaagtaaacatcatgtcacatgtgatgtttggtggcattactcatgacccggcaattcaa

SEQ ID NO: 2744 - DNA, 852 bp, Candida albicans
gagcgttgtcctgctagccggctgttgggcactcagaattcaaggcattccagttacaccagctatggtccagataatatatttgctgaagctccacaagtaggatttggtgatgaatgggatgagactgatattgaagactttaagcaaaaaatcaagaaacatcataagattatcgcagccgttatcttagaacctgttcttcaaggggcaggagggatgcgtacgtatcatcctcagtatttgaaaagagtacgtgaactttgtgataagtacaatgttttgctcgtgttagacgagatagccactggctttggaagaacaggcaaactttttgcccaggaacatgctggtatctgtcctgatatcatgtgtgttgggaaagctataaccggaggatacttgaccttggctgcggtaatttcaacaagaaatgtcgcaaatgtcatcagtggtggacgaaccggttgtttcatgcacggtccaacatttatggcaaatccagcagcttgtgctgtaagtgttcggaatttagagattatcaaaactggagcctgggaaactcaggtccataacatcgaaaagatattacaaaagaagttcaaaccattaatggaatcaggtcacagaaagattaaagagatccgtgtacttggtgcggtaggcgtgattgaaatgaacaatcaaatcgatgttgctttgtatcaaaagagttttgtcgatttaggtgtttgggttcgcccttttggaaaattgttgtatataatgccgccatatatcattagtgaagaggatttgaatcaccttgttgactctttgataagtgttgctacagatgactctcttccctaa

SEQ ID NO: 2745 - DNA, 2703 bp, Candida albicans
atcatggaagattttacagataacgctatcaagattatcaataatgctactgaattggcaaaacaacaggccaattcgcaattgttaccccttcattttcttgctgcatttatcccatcagatgatactgaaggctcaacacagtatttgaaaacgttggtcaagagagcaagatacgaatggggcgatttcgaaagaatcgtgaacagacatttggttaaaataccatctcagaacccccctccagatgaaatacgaccaagctatcaagcaggccaggtgttaacgaaggccaacaaaattaaacaacaacaaaaggactcatatgttgctcaggaccatattttgttggcgctcttggaggaccaatcaattaaagatattttcaaagaagctggtatgagtgttgacacaataaagacacaagctattgaattgagagggtcccaaaggattgactccagacaagctgattcgtcttcatcttatgaatttttgaacaagtattgtgaagattttaccgaaaaggctagggaaggtaagattgatcctgtaattggtagagaggaagaaattcgaagagtcatcagagttttggcaagaagaagcaaatcgaactcggtgttgattggtgatgctggtgttggtaagacttctattgttgaaggtgttgcacaaagaatagttgatggggacgttccaaatgttttggctggctcaagattatttgctcttgatttgggtgcattgactgcaggtgcaaaatacaagggtgagtttgaggaaagattgaaaggtgttttgaatgaaattgaaaaatccaaagagtttatcatcttgttcattgatgaaatccacatgttgatgggtgatggtaaatcagatgctgctaatttgttgaagccaatgttggccagaggtgcattacattgtattggtgctactacctttgctgaatacagaaagttcatttccaaagatggtgcatttgaaagaagattccaaaaaatcgatgttcctgccgccaccgtgcaagaaactgttgccattttaagaggtatccagcctaaatatgaaattcaccatggggtccgtatattggatagtgcattggtcactgctgctcagttggcttcaagatacttgacatacagagcattacctgattcagctgttgatcttgttgatgagagtgctgctgctgttgctgtggctagagactctaagccagaagagttggacactttggaaagacaattgcatttggtagatgtcgaaatcaatgcattagaaagagacaaagatgcagactctgcttccaaggaacgtttgaatttggccaaaaagaagaaagcagaattggaagaaaaaattggaccattgaacgagagatacagacaagaacgagctagtcatgaacaattgactgctgccaaaagaaaattggatgaacttgagatcaaagctcaagatgctgaaagaagatacgatactgctactgctgctgacttgagatactttgctatcccagatatccagaagcaaattgaagagttagaagtcaaagttgttgaagaggaagcttctaatttggacagcttgttgaagaatgcagttggaccagaacaaatatgtgaaaccgctgctagattgactggtatccctgtcacgaaattgtcgcaagcagaaaacaataaattgatcaatatggaagcagaattgtcgaaagaagttgttggacaatcggaagctgtgaaggcagtctccaatgccatcagattaagaagatcgggtttggctaatcctaaccaaccaccatcctttttgtttttgggtctttctggttcgggtaagactgaattggctaagaagcttgctggttttctctttgcagacgaaaaggcaattattagaattgactgctctgaattgggagacaaatggtctgcttcaaaattgttgggtgctgctccaggttatgttggatatgaagaaggtggtatcttgactgagccattaatcagacggccatactctgtggtcttgttggatgaagttgaaaaagctgctcctgaagtgttgactgtgttattacagattttggatgatggtagagttacctcttctcaaggtaagcttgttaactgctcgaatgccattttcataatgacgtctaatttgggtgcaaactacatcaatgccgccaagggaagcaagattgatgccaacacaaaggaacatgtaatggatgctgtgagagcacatttcagacctgaatttattaaccgtatttccagtattgttgtgtttaacagattgtcgagaaaagccatttccaagattgtcaagatcaggttgtccgaaattgaaaacagattcactgctaatggtaaggctatacaattgaagctagatgatgatgccatggagtacttgtgcaagaatggatggtcacctgacttgggtgcaagaccattgaaccgcttgatccaaaacgagattttgaacaggttggctgtaatgttgttgaaagggcaaatccaagataaagaaactgctagagttgttcttggcgaaaaaggtttggagattttacctaaccatgaaccagaagatgtggaaatgaatgatgttgataactggcaagactcagaggatgaagatgatgacgaagccagattcacctcacctggacttgactaa

SEQ ID NO: 2746 - DNA, 1725 bp, Candida albicans
ataatattaatcaagagtttcacaacaaccagaaactcaaaccactaccactaccactacaacaacttaatactattaatttccaagatggtttattctagcgaagcttctaaatggaaagcctatcaattcaatgacccatttgctgctggttcattttttgtttgtaataaagtcagtcaaatatattgtcgtcccgattgtgatgctcgaccaaccaccaatttgaaactggaaatcaagttcaccaacaccaatgaagaagcattgctgttgggatacaagccatgtgaaacatgtgaccctattcatagttatgccattgatgtcaacttgttaatcaaatgtgttgctactgtcaatgaaagaattgggttcatccaaccattattggatgaaaatgaagaatccaatagtcagaaaatcaaagaaaatattattggaacaagaaaagacgaagacagtttaagatcgatccatgattttggcgatctcaaaaacagccaacatcgtggttcagttccaaacattactagtaaagacttgagcttatcaaagaacgattcagatcattatcgtttggttgatttggcttgtcgtcatttggcattagctgctgctattaatgtattccaaccaaaacaacaatcaacaaatactgatgaaccaagttcccctactactaatggtaatggtaaaagaagaagaagaagaggtggtgttcttggatttaaagagttggctgctaaatcgaagttgagtgcttggcatttccatcgagtatttaaatctgtgcttggcttgaccccaaagacttatggggacaaatgttgggatttcatcaagaaggtcaaagaatcaggagaatataccacatttgaagtgtactcgacaccaaagtctacgacttcatcgtcggtaacttcgccacaattgactgctacaaccaccaagaagagacaacaccaccatagcagcagtgactctatattttcccttcatgatgacacgacttctaatgcttctattcctttgacaccaataagccaaaccataccaagtctaagtaatccaaacactgcagcttcagatatggcaacaatttcgcacccaacaactttagatgatcaattgttgaatatgaactttgttgatgaatcaagtttgcaaacgaaaatgctttcttattctgattataatttacttcccaacaacaacaacagtataagcaacagtgatgaacaatttcaatacggcgtattaccatctcaacaaaactatcaactacagcaacaacaattttctgtgccatcatcagctgctcctgctttgtttgattccatgccatcatcatcatcaacaaccaatgtcagcgtaaccgattctattccaaataataatgctagtgcaccaatgtttaacactgatatgtttaaggatttggattattctcaaccaacacaatcatcctcgattgattatggattaggcgaggatttaaattcctattcttcaatttttgatgaaaacatgtttactaccgctagtgctaatccatatcatagcacagctaatataaatggtctcagttcgatgtttacatttggcgctggcgcagatgaagacaccaccgccaatatcaataatgatgatactattactgctgggttgtttattccacaattagctagtattgctactcctactggtacccatcacaactaa

SEQ ID NO: 2747 - DNA, 561 bp, Candida albicans
ttagacgtatacatcaccatgagattcacagacgatgaaacaaagtatcaagcaattctaaatagagatccacaagcagaaggagagtttgtttatggtgccatatcaacacgaatcgtctgtcgtcctacatgcaactgtcgagttgcaatgcgcaaaaacgtggtattttttgatactattactgaggcagtggaacatggatatcgaacttgcaagcgctgtaaaccagaaaagtgtagtggttggaacaaaagcagagaattcataaacaaatcttgttttatgatttctagacgagccataaatggggaaaaactaaatattgacacaatcatagcggccgtgggtgtttttaaatggcacttttatcgaatgtttaagaattacagtgggttaacccctcgttcattctacatacaatgccagttattacaggagaatcctttggatacgacacccctacgtgaaatcgaaactaagcgaaatttgaaacgtgtcaaggaaatacttaatctatacacaaccccgaattcgaattcgaattcgagttcgagctaa

SEQ ID NO: 2748 - DNA, 1704 bp, Candida albicans
tggtggattgtgggagttcatggtggatgtgaagcagctacaggttcggcaagatctcaaacccgtataacattgataactccttatataaataaaattgggacagcttcttgtaatctttttatgggtggtgtaggaaagggaaccttattgcgagaagttgatgcattagatggtgtaagtgcaagaattactgataaagctgggattcatttcagaattttaaatgcatcaagaggtgcggcagtacatggaccacgagctcaaatagatcggaaaatttatcttgaagaaatgcaaaaagaaatattgaattatcccaatttaaaagttctagaagctcaagttgaagatattataataaaaccagtattgtcgaatggtgaagatttttcaggaagagaatttggagaagtgaaaggtgttatattactggacggaagagtattgaagagtgagaaagtcgttgtaaccacggggacttttcttggaggagaaatacatattggattgaaatgtttcccctcaggtagaatgggagaagatgccacatttggattatctaaaactttgaaacaagcagggttcagattggggagattaaaaactggtactccaccaagattatcatcgcgaaccatcaattttaagggactaatagagcaaccatctgatttccctccacaaccaatgtcttatatgaatgataaagtttatttggaagatcagttaatgaaatgttaccagacaaaaactaatcctgaatttcataaaattattgctgataatttagacaaatcaatccatataagagaaactgtcaaaggtcccaggtattgtccaagtattgaatctaaagtgattaaattcccacataaggattatcattatgtttggcttgaaccagaaggattagattcagatttaatatacccaaatggtatttcgtgtaccatgccagaagaaatacaagaaaaattagtaagactaatgccaggatgtgagaatgtaaccatgactcaaccaggttacggagttgaatacgactttattgatccacgtgagttgaaatcaactttggaaactaaattggtgaatgggttatatttggctggacaaatcaatggtacaactggatacgaagaagctgctgcacagggatgtattgcaggaataaatgctgggttgtcatacttgcaaaaacctttattggaattgaaacgtccagatggacttgttgctattttgattgatgatttaattactaaaggtgtcgaagaaccttatagaatgtttacttctcgttctgagtttagattttccataaggtcagataatgctgatgacagattaactcaaaaaggttacgaattaggtgttgttagtgaggaaaggtatcagttttttaaaaaagaagctgaccagtttaaagatataaaaaatgcattatctgtattgaaattactggggaaacaatgggctcccggtttgcaaggcttaaaaacagatactatagaaaatgataaagtctctggttggaaattattatcatacccaggagtgctgataaatgatattttacctcatatgtcacactttatgacgcaagtgccaccttgtttacaaaatgtatctatgaggttgcaaaacaaaattgatgtcgtgagtgattatgatcccattatgtacagggaaaaaagctaa

SEQ ID NO: 2749 - DNA, 666 bp, Candida albicans
aaaacacgttgtttttgtttttataatactatcgagtttttattcattttttttcttcaaataatgtccgttgaatatcctaatagtgtaacgtcactagataaaaaaccccaagttgacttggaaaatgtgattgaagatgcatcaacatcatcagagcatagagtcgcacaaacagagaatcttaatagaagtttaggtgctcgtaccatcaatttgatttgtcttggtggtgtcattggaaccgggattttcttaggtatggggaaaatgttactgaatgctggaccattaggtttattattgaattatcttataatgggttcaatgatttatttcatgatgttgagtcttggagaaatgtctgttcagtatcctatatctgggtcatttgccgtttataccaagagatttggttctgattctcttgcctttgcaactttatttaattattggcttaatgattgtgttagtgttgccgcagacttggttgccttacaattagtgatgcaatattggaccaattttccattggtatgtgatatctattatattttgggtatttttattattgttaaacgtgttacatgtgagattatacgccgaagcagaatattcacttgccttgttgaaagtggtgacaattattatatttttcattgttag

SEQ ID NO: 2750 - DNA, 597 bp, Candida albicans
tgcaatattggaccaattttccattggtatgtgatatctattatattttgggtatttttattattgttaaacgtgttacatgtgagattatacgccgaagcagaatattcacttgccttgttgaaagtggtgacaattattatatttttcattgttagtattatttgtaacgctgggaaaaatccacaacacgaatacattgggtttaaatattggagttatggcgatgctccatttgttgatggaatccgtggattcagtaaagtctttgcatcagctgcttatagttttggtggattggagtcagtatctcttactgcaggtgaaactaaaaatccaagtagagtaattcccaaaactgttcaaatgacatttttccgtgttttgatattttatatcttaactgcttttttcattggtatgaacattccttatgattatccaaatttgttgactaaaaaagttgccacttctccatttaccattgttttccaaatggtaggagctaaaggtgctggaagttttatgaatgcagttattatgacttcgattgtttcccgcccggaaatcattccttttatgtgcccgccgggatga

SEQ ID NO: 2751 - DNA, 243 bp, Candida albicans
aatttcattttatattatgccccatttatatttgcctcattgggtttatcgggaaatacaacttctttgcttgcatcaggtgtggtagggatagttatgtttttatgtactattcctgctgtaatgtgggttgataaagttggacggaaaccacttttaatctcaggtgccttagttatgggactttgtcattttgtagttgcaggttttcacaacggccaggaaggcccgcatttgcgcaag

SEQ ID NO: 2752 - DNA, 264 bp, Candida albicans
aaattcatgcccatagtaaactccatatccacccttggcgttttcacgtccattatttctgcatgctccatcgacgtatactggataaatgtagtatcgtccgtcgttttcacaatattcttttgcttcaatcaagttctcaaatttcctataacgagctcctttacaacaatatacttgtggccgacattctctccaactcgaataaatacccacttcgcgtcccctagcaacagcgtaataaggcattatggtccaaactaa

SEQ ID NO: 2753 - DNA, 498 bp, Candida albicans
gtattcacagacgtgcggtcgggcaagagcatggaccggcccggcctgaccgaactcctcgcctacgcgcgtcgcggcgacaccctggcggtggttcgcctcgacagaatagggagatatatcgccgagctgttgtcgagcgtaaacctgctcaaggaacgcggcattgcgctcgtgagcctggaggagaagatcgacaccggctcggccgccggcgaaatggtattccacgtattcggtgcgatcgcccacttcgagcggcggctgatcgccgagcgcaccaaggacgggatcgcggcggcccgtgccaaaggcaagcgtccgggccggcaaccggtcgatccggacaaggtcgtggccgccctgaaactcgtccaagccgggctatcgcctacggaagcggggcgccaggtcgggctcggccgcgccacagtatatcgcgaaatggccctcgccgggatcgtcttcaccacgggcgtggaaaatccgcacttgcgt

SEQ ID NO: 2754 - DNA, 630 bp, Candida albicans
  unsure (526),(533),(594): Identity of nucleotide sequences at the above locations are unknown.
acagttatcatgttaggaacaaaatattttgctatatccaaacgaatcttaacattaaaatcatttaaacccttaacacttggtggtacaactattattactttacgttataattcgactaaaccaagtactaccaccaccaattctaatgctaattcatctaggctaaaaccgtcatcatttgccttcccatcgtctccaacttctcaacaatcatcatctacaactacttcaaccaatgattccataacatcatcacaacaacaagaagatattaatgatttcagagcaacaaaattaattcatggaaaaacaaatttatcatttgcaataactgaaagagctagtaagaaattaaatgaaatttctcaacaagataatcaagattcaggattattaatacaagtagaaagtggaggatgtcatggatttcaatataatttgaaattaaccaatattgataaagaattacaacaacaacaagaacgcgatgctaatgatttggttgtgtttgaaagaaaatcangaggganagtgattatgaatgaatcatcattaatgattttacaagaatcaaaattggattatactaanagaattaaattggtaatcaatttaaaaattgttgaa

SEQ ID NO: 2755 - DNA, 444 bp, Candida albicans
  unsure (36): Identity of nucleotide sequences at the above locations are unknown.
ggggggataagctttgtccggcacctcctagtgaanatatgtggacagagaactccaattgtcagaactcatccagtcactggctggaagtatttgtttgtcaaccgttctatgactgttagaattgttggattgttgccagaagaatccgatttgattttaaactatttgtattcggttattgaaaccaacagggacattcaagttagatggtcttggcagaaggaattgggtagtgttaaaaacaacaagaaggatgaaccaaaacaataccgtggtgttagtgccttatgggataacagaattagtaaccatagtgttgtccatagtgaagaatcaattgttggcagacatggtacaagagttacatctttagctgatactggttattacgatccaaattcaaaatctcaaagagaatctttggggttatctttggattag

SEQ ID NO: 2756 - DNA, 840 bp, Candida albicans
gtggaatacaaattatcaccattaacattcaaaacactactatatataatgttatcacaaataatatctaaaccaaatgtttatcgtcaatcaggacatgttttctaccgtcaatttacaaatcgtggacctttgtcgttattaagttcaaccactcctaccacacctactactactcctccaccaccgccacctccatctccacctcgttcttcatcatcagtacaacctacttcttctacttcaagtagtatcgccacttcaattttcccttcaacaacaacatcaactagtactattaccccaccaacatttttccaaaccaaaccattaccaaccaatactattattaaatttgtaccacaagaagaagcttggatagtagaaagaatgggtaagttccatcgtattttgcctcctggattagctattttagcccctataattgataaaatcagttatgttcaaaatttaaaagaaatggcattagaattaccattacaaaatgctattacattagataatgtgaaaattaaattaaatggaataatatatattaaaatcattgatccatataaagcaagttatggaattgacgattataaatattctatattaaaattaattgaatcaagattaaatttacaaattggtaaattagaattatcgaaaattttgaaaaatcgggaattattaaatgatttaattgttaaaattattaatgaagcagcaatggaaaattgggggattgaatgtattagatttgaaattaaagatattatcccaccacaaaatgttgtggataattatattgataaatttatcaatttacaaaaataa

SEQ ID NO: 2757 - DNA, 366 bp, Candida albicans
attaacaggttggatcgtgacgtatattgtttggatttaagaaactgggtacttattcgtcatcatcttcgtatggaatatccaattttgccagcagatattgaaaattgggtcggattgcaaaatatccctgaatctgcaaaaccaatattaattggtcattcaatggttgctaaagcagtcatggcagtagcattaagaagacctgatttgcctaaattcatttgttctgttgataattcaccaattacatatccaaccttggatttgctgtttgggaaatatgtcaaccaattacgtttggcaatagagaaatataaatataccaatatcaaagatgtggatgccaagttggcccgaggttga

SEQ ID NO: 2758 - DNA, 1068 bp, Candida albicans
cccgcccgcacatatttaaaaaaagtggaggaaaatttagttgcacaacaatttcagtttttttttgcaataaaaacaaaactacacatgtatataagtcctggcaatccctacctatttctcccaggtatagaatacaggaggttatcaatatcacccacaatgtctccttccaaattatcaaatgacgaaactccacctgatttggattttcgattcactggtatcaaacaacggttaattaaatccgagaatgtcaaacaagtcactgctagttggaaaagattattagttgaaataaacaaagagtttacagagattgccaaaataggaccctcatatgttccgaaatgtgattttattgacatcaaagacaacaagcttccacagcaagtttccgaattgttcaaacaacggggatgtttaatgattgaaaatgtaattgatgttgatcgaattgatatttggttcaatgaattggtcgagttttgtaaaacacaccccgaaacagcaggatacacttttcctaatccaacatcttggtacaatgttttttggtcaaagccacaaacagaagcaaggttccaccctaatatgaaagccattttcaaagccatgagtaaagagttttatgttgaagataaagagaattgtttaattgatttagatacacagcttgtttatggggacaggattagaatcagagagcctggaaaggcagctgctttgccattgcatttagactcttcgtcaatcgaaagatgggaagacatcatgtattctgaagtgtacaaatcaatttttgaaggtgattgggagaattgggatgcattcaaattagatgaaagaacttactccaaagaaaatttatataaagatgaagatgatactggtgggaaatccacaatatgttcttcatttcgtacattgcaaggttggttggcactttccaacaataagtcaggtgaaggtactttgagagtattacccagtttgaaattatcaatggctttaaataatgctagaccattttttttggaaagaccccgagtcagggaacatagatga

SEQ ID NO: 2759 - DNA, 573 bp, Candida albicans
ataatgctagaccattttttttggaaagaccccgagtcagggaacatagatgatatggaaattgatttgattacacccaagtttcttggaacagtgccaggaactggacaattgtttcttgataagttttatcctcatctacatcaaggtattatttctatcccagatgttaaaaagggctcatttgtgttttggcattgtgatatccctcatgaggttgatcgagcacaccatggaaatggacactcttcggtgttatattatggccacactccattaagtattacacacattcagacattgttggatactagggatgcatttttgaaaaatatttcaccagctgattacagatctcaattgaacgaggaagaaaagcaaaaagaatttcaaggtgccaatatcgatgacttgaaaaacgatattgattcgaaaagatcgatggggttggaagaatttgaaaaaccagaaaatatgagcggtggtcaagcaaaaattagaagtattgcaaatcaagcgttaaaaagtagtggcttcaatgttgataagtatattcaccatgctgctaagtag

SEQ ID NO: 2760 - DNA, 699 bp, Candida albicans
gataaaggtggtaatagatcccatactttggtgatttgtttactctgcaaagacaacctcaacaaaagtatgaaattatacactgctccaactggaaatggtcgtaaaccattgatttttttacatatcttagatgttccaaatgaaatccacatgtttgattggcccactaaggaaatcaaggagaattggtatcttgaattaaaccctcatggccttgttccaactttagttgatggtgatgtaacattatgtgaaagtaatgctattttgcaatatcttgctgataattatgataccgagaacaagtttagttacccaagcactgatccattgtattggcaacaattgagatggttattctaccagtcaacccaattcagcgatgccttgtctagattattcttttacaaaaagtttcgcagtgacgatcaatggttagtcgacaaagggtttgaacaaattcgcaaagtttatcaggttttggattcacatttggcgcaaagaaaatggtttgttggtgataaattcacaatagctgacttggcttttgccgttgggcatttccgtcgtattgaaaaaacaacagggaccaaatttgagattgaaaattttgaagaaaagtaccctcatgtgactcaatggtataatgatgttttgtccattgaaggcatcaaagaaggatttgaattgaaataa

SEQ ID NO: 2761 - DNA, 1503 bp, Candida albicans
tcacattgttcacgcggtaccttactgcaaatggagagttacaatcaacaagaaataattcgaattttgttatgtgaaagatatccagataatcctatacccgaagagatcaacttggagattaacaaattaatccgttggcagaatgataacaaattacatacatcagtgcaatcattgaccaataattacaatatagccaacacaactgtatccttatggaagggtgatattaccactttatcaggcgttaccgctatcgtgaatgctgctaacctggccttgttaggatgctttcaaccaagtcacaaatgtattgacaatgttattcacactgctgctggacctgagttaagacaagcatgttataatttgatgcagggcaaatctgaacctactggatctgccaaaattacaccgggatttaatttgccggcaaaatatgttattcacacagttggtcctattattcgtgatgggaatgtcacagagagagagcaagaacaattagcaaactgttatcagtcaagtttgaaagcattggaaatggtgaacgacgagaaggataagtctattgcattttgttgtatttccactgggttgtttgctttcccaaaagaattggcaagtacaattgctataaacacggtacaacattatttggaaatccatccagattcaactatcaagcatattgttttcaatgtattttcagatgaagataaagaaatttatgagaaaaatttacaaagcttctcagtggattcatcccgaatttcgctgaaggcagatgacatcattaatcacaatttgaataaggcacattcatggttgcaagaagcagactgcttaattatcagcgccggtgctggactttcggcaagcgaaggtctcgactacacatccaaggagcttttccaaagagaatataagccgtttctcaagtatggaatcacatctttgtatggcacaattgggtatccttggccaacaaagctagatttttggaatttctttgtttatcattatatcaatctttacaaaaaatggggaaagactgatacttatcaacgacttttgaatctttcgttgcgatttgaagattcatttgttattacatccaatgcagatgggtttttcgttaaaaatgggtttgacaaagatagagttttaacggttcagggaaactacgcaaatatccaatgtctgaaaaactgtcgttttgatgcttatagatcaatggaagaaatggttgataaatatccactaacagccaaagatcagattccaagatgcgagtattgtgggtctgaaatgacagtgttcttgcgaatgggggactattttaatccagcaatagtgaaaaaccaaaggaaaaattacaatgagttgattagtggaattgttagaaccaaccaaaaagctgtcatattggagttgggagtaggattgaatactccaagtgtacttagatggccaaatgagtcttcaccacggggctag

SEQ ID NO: 2762 - DNA, 921 bp, Candida albicans
  unsure (16),(152): Identity of nucleotide sequences at the above locations are unknown.
atggataaacaattanaaggatttcaaggatacctacccaagtgtcggaagattattgcattagtgggggccggactatatgttttttcagggttacctacatttaggggttcacaaggtttatggaaaaatttcaatatgatagatttagntactccagacgcattttacattgatccaggattagtttggcagttttattcatggagacgatatggggcattacgtgccaagccaaacaagggtcattatgccttgagcaaattatcccataagtttaactcagatgaatatatcactattacacaaaatgttgatggattactgagtcgaagtggacataatctcgatagtttatatgagattcatggatcattatttgatttgaaatgtactagttttatgtgtaattatgttgatcataataatttcaaacaaccattaactaaagcattggaagatactgaatttgaatatagcaatttgagtaccagaaaacgtacttttggtgatagtgacggcaatgacggggttgatatttcattgtcacctcagtttaacccagtgaaaacaattctggaaaaagatctaccttcatgtcctgtatgtcatgacttgttgcgaccaggagtagtttggtttggcgaatcattacctttgaatttgattactgaaattgatagtttcgttgagctggacccatcagttgatttgattttagtcattggaacaagtggtacagtgtatcctgccaatagttatgtcgaaagagtgaggttgaaaggggggaaagttgcgatatttaatactgatattgaggacaacattctaaatggcaaagtcgaagatacttgggggtttaaaggtgatgcagctgagttattacctattgcattaaagccattgattggtgatatataa

SEQ ID NO: 2763 - DNA, 1299 bp, Candida albicans
tcagatcatctcttgcaccataaacccatgatgttgttaagacgtagcctacgaggcctatctagatcatgtcgtatatataccacaacaacgccacaaccgtactatcctgtgcataaaccatacactcctacaaccaccacagaaccaataaatatactcccagaaaatacatacacccagccaacacccaaacctgatgaccatataattgttgctatgtcctctggtgttgactcttcggtgtgtgcagcattatacaaagactatccaaacgtgcatgggctatacatggccaactggtcgcaactggcaacatgcacagaacgagattggaaagatgtgcaacgagtgtgtcaagatctaggtatttccagttgtgagagagttaactttgaacacgaatattggcaggatgtgtttatgccaatgatagagaaatacgaaaagggactaacgccgaaccctgacattgggtgcaacaaatttgtcaaatttgggaagttgattgattacttgcataagaaatacgatggcacaggcaaagattggtggttagtcactggtcattacgcccgaatcatgaaacacaacgaaactggggagtaccatttattgcgaggtttgagtcaacggaaagaccaaagttactatctttcgtcgatcccacaatcttcgttatcgaaaatcttattacccattggccactatatcaaaccacagattcgggaattggcacatgaccagtttaaattacatacagcaacaaaacccgactcccaagggctatgctttgttaatccgcaacagtcaaacttccgagagtttttaaatgattatatcccagaaaatccaggtgacataatcactgaagatggtaaggtttggggtcaacacaaggggctatggcatgctacaataggccagaaatcttcagtttgcatgccgcaagcagatccacaataccaaggcatttggtttgtcagcgataagaattatgagaaaaatcaaatcatcatagttaaaggtcacgataaccccaagttgttcaaacaaactgtggaattgacgcagttagaatggttacaccccaaggaaaaggtgttgtgtctccaatcattgcaatttcagtatcattcattgctgaagtcaatccctgttacaagaattattgagctgcaagataggttaaccgtcgaattagaaaccccagttcgtgctttggcgccaggtcaagctggtgtgttgtacaaagggaatcaagtattgggaggtggaatgattaatagaaccatgtaa

SEQ ID NO: 2764 - DNA, 762 bp, Candida albicans
atccaattatatctccactttttaattctttttttttttcactatttatcaacacacccacttgaaatgtcattgaaatacttagacaccgccagaaagatcctttgtattggtcgtaattatgctgcccacatcaaggaattaaacaatgccaccccgcaacagccatttttctttttaaaaccatcttcatcagtattaaagcccgactctggcccattcttggttcccaagggagttattgttcatcatgaagtggaattggcatttacgttaaacaaagacttgaaaaacttgccatctactttttctcctgaagaagctattgacagcattgaagggtatgccttgactattgatatgacagcaagaaacgttcaggatgaagccaaaaagaaaggattgccttggtcaattggtaaagggttcgacacctttttgccagtgtctaaattcatcgccaaggaaaaaatcccagacccatacaaagttgagttggtgttgaaaattaacggtgaagtcaaacaacaagataaaaccgacttgatgttgttccccattcataaaattttgagccacatgtcagcaattatgacattggaaaagggagacttaattttgactgggaccccaaaaggtgttggtcaagttaagccgggcgataaggttgaagctcaattgttggttaacggtaaagtcattgaagagattaaattcgacgccgaagaaaaaccaggtccttacgaatataaacagatatag

SEQ ID NO: 2765 - DNA, 384 bp, Candida albicans
aaagagaaattggctaatatggaatctgatgaagaaagagaagcttactgtaaagaaattggtgctcaatctgctttaccaaaaatcattgttgccatgagacaaaaattggatttgatttcatttttcactggtggtccagatgaagttagagaatggaccatcagaaaatggtacactgctccacaagccgctggtactattcatacagatttggaaagaacatttatattggcacaagttattaaatacgatgatttgattgaacttggtgatgaaaacagtgttagagctgctggtaaattaatgcaaaaaggtaaagattatttcgttgaagatggggatatcatttacgtcaaagccgctgatggtaaagcccgttaa

SEQ ID NO: 2766 - DNA, 1278 bp, Candida albicans
tcaaagaagaaaatgagtaatcccattgttccttttgggaaacaatttagggctaaatatttcactaatatggatgatgaagtgtttcctgtaaatcatggatcttatgggttgacacctactccagtacttgaaaagtatttggacttgatagtcaaaaatgcatcatacaccgacaagtttatgaagtatggtattaaagacagttatgttgaatcattgaaggcagtgggtagagtactcaattgtgattaccacaatcttgcctttgtcgataatgctacttctggtgttaatacaatattgcgtagttaccccttgaagaagggcgacaagttggttattcaaagtacagtttatggagcttgtggaaatacggtaaagtttttgcatgatagatatggtgttgaatttattgttgtggatttgaactacccaataactgatgaagaaatattatctaaatttgaacgagtgtttgttgaagaaaagccaaagctttgcatgtttgataccatatcatccatgccgggagttgttttcccttatgaaaaaatgacaaagctttgtaaaaaatatctggttttgtcattaattgatggtgcccatggaattggttgtattccccaggatttaggaaatttaaaaccagatttctacgttacaaacttacataaatggttctatattccatttggttgtgccgttttgtatatcgaccctaagcatcacaatgttgttcatactttaccaattagtcatctgtatcttgaagatcacgtcaaattatctgatggagatcagaaaaacaggttaattgatcgatttttcctctatgggaccaaaaattttgcatcaattcaggtgattcccgaagctattaagtttagatctgaagtttgtgacggcgaaacaaagatttatgattattgtcacggtttggccaaacaggttggtgagttggtctcaagaaaatggggtacttcatatttagatcaaaaaggttcaactttgattagtacaatggttacagttgaggttccaacacaagattatcccgagattgtgaaaaactggtctgttattgatcatcatgtttataataaaatgtttgatcgtaaggcttacaccccttgtatcgcccacaatgggaaattgtttgctagattttcatgtcaagtttacaatgaattgagcgactacgactatgcaagtgatgttgtgttagagactttaaaagaagttgcctccgaacaatacaaaaaacataagttatag

SEQ ID NO: 2767 - DNA, 1749 bp, Candida albicans
ttgacatcccttttgttatctcaattcatgcttaaaaccagtatcaggacacttaaaagaatgacaaattcgaaattaatagaacttccaaagtcatcttcatgtactcaacggataaagccagataaaagagttccatcagtggaggttgctttggaaaacgaaggcaacattaccaataccccaagaaatataactcatggtggattttcatgggtgttacccactccgagagatgactatgagtttatgattgctaacccattaacaatgaaagacctaggattgagtttagatgaaatggaagatccagtttttcaactgattgtaagtggagaattctacaaagataaagttacttttgtcaaagaaaacttccctatgccttacgcccaagcttatgcaggttggcagtttggacaatttgccggacagctaggtgacggaagagtggtcaatttgtttgaagttcctaaagctgtaccagatggcgagaatcgcgacaaatacgaaatccaattaaaaggtgcggggaaaacacctttctctagatttgcggatggtaaggccgtgttgcggtcatctatcagagaatacattatatcagaacatttacatgcaattggagtaccaactacgagagcccttgcattgacgtatttgcctagtactttggctcaacgacatggagctgagagatgtgccatagttgcacggtttgctgagagttgggtcagaatgggtacctttgatttatacagatggagaggtgatcgtgaagggattagagatttgtctgattatgtgattaatgagttgtttactattaatggagtaaagtttcagaattttgaaagaattgttaagactggccctaactttttcaaattaaatgataagttactaggcgaattgactgattacgataaaatgtattatgaaacagtagtaagaaatgcagagaccactgcaatttgtcagtgctatgggtttttaaatggggttttgaatactgacaatacatcaatcttaggtttgactatagattttgggccattttccataatggataaatataatccaaactatacaccaaactcagaagaccacgaaggtagatatggatatagaaatgttcctactgcaatttggtggaatttgactagattgggagaggatttggcagagttggttggagctggtaatgagttgttaaatgacccactgtttcaacaaggtattaaagaagagtgggaagattcaattatcaagcgcgccacaaaaattatagaaattggtggagaaatataccagcatgcttttactaaaaaatacgttgaaacatttttcaatcgattgggtttatcacatgaattgatagatgctcaaaacccagaaatacaacgtaccgatgttattgttccgatgttggatgtgttgtacaagattcaaaccgattttaatttgtttttcttgaaattgcaggatttagatcttgactctggtgattatgctttgattgcagaaaaagagttcttgccaaactatgatttcaacacatacagacagcacaaagatgatttgataaagcaaattagtgaatggttgatactataccacgaattaaggaacaaaaccaagaaatataaatcaactcctgatccagcaaaatacaaccctaaatttttaccaagaaaattggattttagatcaagtgattcagcaagcagaaagctcacgtggggctga

SEQ ID NO: 2768 - DNA, 696 bp, Candida albicans
aagcaaacaataactatgaagaaaacagcattaatagtagttgatctacaagaggatttcttaccgcctaatggatcattggccattaaaaatggtcgatcagttatacccaaaatcaaccaattattaccatcacaagataatcattccaaatttgattggtccttaattgttgcaacacaagattggcatccaccaaatcatacttcatttgcctctcaacatgaaaatgttgcaccatttactgaaattgaattcattcacccagaaaagaaacttgacccgaaaacgaatcaaccaattgttatgaatcaaattgtttggccagatcattgtgtacaaggcaccaagggagctcagttggaacccctgtttgctaatcaatttgaaaaattaacaaaacaagatgataataatactgccccatgcaaaatagtgaaaaaggggtatctacctgatcgtgaatattattcatgtttccaagattgttgggggttacatcatactgaattgattgatcttttacatgaatatgacattgaaaatgttgtttttgtagggttagcttatgatttctgtgttttaagttcagctattgatagtgctaaaaatggatttaaaacatttgttttgaaaaattattgtgaatcggtttatccagagaaaattaatgacacagataaactatttattgat

SEQ ID NO: 2769 - DNA, 729 bp, Candida albicans
acaataaatatggctcctccaactttaactcaagcagcaccagctgcaccacaattagacactccaaagatgttggtcggtgaacacactttaccggctagttggtggacatctgaaagtatctttgaattagagaaaagggcaattttccacaaatcctggatgttttgcacccactcatcccgtttcgctaaagctggtgactactatgcgtttaatctcgctggaattaactttttcgttatcaagtccaagattgatggccaattgaaagcattccataatgtttgtcgccacagagcttatcctattgttagaaaagatcaaggttctagtactgtattgggatgcaaataccacggatggagctacaattccgatgggatcttaagaagagcacctcattttgataacgtcgaagggtttgttaaagaggaaaattcattgtttccaataaacacccatgtaactcctcagggattagtttttgttaactttagctccgatccaattccatttgatgattggttcctgggtttgactcctgaaatgaatgaatttgatttttcagattatgaataccacatgtcctacgaattagatggaaaattcaattggaaaacattgatggatggttatcaagagtgtatgttacttctggagttggctttgtcagctccatttactaatttgttgtctaaaaccgaaataaatactaacaacttctaa

SEQ ID NO: 2770 - DNA, 681 bp, Candida albicans
catatatttattaatagacattgtccaactacccatccaggtctcaatactgcgtttaagatggaaacctataaggttgtccctaaaaacagatattgtcgtcattttgcaaaaatcgtacgtcaagagaaaccagtagaaaagcaagattcttcttcttggtttggattcaagaaagaaacaaaggaagttaaagaaacaaaacccaaccccggtggtgaatttgatggattatgggtttacttatttcctagcaacggaattaattgctactctccagcttggtattccattagaatgttgcctatcaatgcaaaacgcactattttgcaatacgatatttataccaaaaaggttttggatgacgaagagaaaaaggaatttgttgactttttacaacaagttgagttggaagattttgacttgtgtgaattgactcaaaggaatttgaatgaaaggatttatagtactggatacttgcatcccgaaaaagagaggggtgtgttgtattaccaaggtgttgttcgtgatatggttaaagaacattttgctttggagcaagctgctggccaatcaattgatccagccgcagtgggtactaaccctaagaatggggaagttgaagaattagaagggatttgcaagtcgcttgaatgtggcaaggaaactgttgattggtaa

SEQ ID NO: 2771 - DNA, 561 bp, Candida albicans
aacacactctcgatgattaaaagtttaattacaagaaacagtacgaggatacgcggtgccaatacaaatttaaccttggtaagatttgctggtcattccaaatggcagaacattagacacgacaaggccaaaaatgatgctagaaaatcaaaggaagcaacattgatctcgggaagaattgagagttgtgtacgtgtgggaggtaaagaaagtaatgctagattagaacagttgttagagaaagcaaaaacattaaatgttctgaaggcggttgtcgagaaggcaattaaaagaggatgtggtgaactaacagatactgcacaacttcaaaatgttcaatatgaatttatgggaccaggtggtgttgctattattgttaatgcccttactgataataaggcaagaacagtcctgatggtcaagaatgcaatgacttatttccaagctacattgagtccatgtctgtacatgtttgataaaatgggagaggtcatctttatgtcttcaccacggggctggaaggagccgcgcaaagcgcaaaaaagacaagaaaagggctag

SEQ ID NO: 2772 - DNA, 600 bp, Candida albicans
aaacatacatatcctttttttttttccataatgtctgttgatccaattacttgtcatatattagataccacattaggaacaccagcttctggtgtcattgttcaattgtttcatatatctaatgatcctttattatcttcaatatctgaagacacaactacaaccaatggtaaacattttgcaatggcaaagactgataatgatggacgtattaaacaatggataattaatccaaatggagatttccaaaatctaggaatcactaaaaatagtagcaagaataatcatcaatcatggaataatttaaaaccaggcatatataaagctaaatttttaactgggaaatatttcttactgttagctcaaaatcaacaaggatcgactagtggtggtgacggtggtagaacatttttcccatttgttgaaatttcatttattattgataatccaccagataatcattatcatattcctttattgttaagtaattatagttatactacttatcgtggaagtcaatacatttatacatatatatgtagaaaatttacaatactacaacatagaataaacaatgtatttatcaataaaacaaaatag

SEQ ID NO: 2773 - DNA, 600 bp, Candida albicans
  unsure (78): Identity of nucleotide sequences at the above locations are unknown.
ttcccttggtccttgggcccgtcggttaagaatttggtgaaggtgatgggaaatatttcattcaattgggccattcantcaaccggaaaaattttgaatttatccactcttccctcatatcttacagagagaaaagtgattataatagattcagttaaatcaggaacaggaagaacaccggggaaagatatatacctggatattcttgatccattatttaaagagctttctatagaacacgaatatcatgccactaaatcagcaacatcaatctctgaattagcactgagtttgaaagatcataaagtcacaataatattcattagtggagatacttcaatcaatgagttcatcaattcattaaacgactccgaaaaaggtgaaatagcgattttcccaatacctggaggaacaggtaatagtttatctctttcattaaatatcaccaatccattagatgcaatcattagattattttccgcaggtacaacactgccattgaatctttatgaagttgatttcccacaaggatcacactatttgatagctaatgaattaggatctccagttccttcacatttgaaatttttagttgtttga

SEQ ID NO: 2774 - DNA, 954 bp, Candida albicans
ttattttttcggtggtcttctttatcaacgatgaaacgatcacttttacgtatatcacaagaagttagacaagcactatttgagaaacggccagtagtttccttagagtctacaatcatttcccatgggttgccgtatccgcagaacattgaaatggccaaaagtgttgagcaagtgttacgagacaatggtgttgttcctgccacctgtgcctttattgacggtgttccacacgttggactagacaattttgaacaattgcgcaatgccgtgaaggtatcgagacgtgatattgggtatgttatggccaacaagttgaatggtggcaccacaattgcactgacgatgatcttgtcgcatcttgcagggattaaggtctttgcgacgggcggacttggcggtgtgcaccgtgatgggcagtatacgatggacgtttccgcagatttgaccgagttggggagaacacccgttagtgttgtgtgtgctggcccgaaatcgattttggatattgggttgactatggagtatttggagacccaaggtgtttttgttgggacgtataaccccgaaaaggtggacaatttgcaggtgccggggttttattgtcgtgaatcgggcgtgccttcgccatatgggtttgaatcgtttgcagaagcagcaagggttagttattaccaggggatggtcggcagtggaagtgtgttttgtattccgccaccacaagagactgccatggatagtgagtatatcaggagcgtgattgagaaggccaacgagaaggcgaaggaggtgggtgtcacaggcaagaagttgaccccgttcttgttaaaggagattgccgttgccacgcagggccagtctgtggaaagtaatatagcgttggtgaagaacaatgccagggccgcggcagaaattgccaaagaattgagtcaattggtatgtaaagaaaaataa

SEQ ID NO: 2775 - DNA, 1068 bp, Candida albicans
gagagggatgcatctgttttggtagttgggtcggttgcactcgatacgatggcgaaacttggaccaagcaccaaaatgggggactcgaatattggcaccgtcacgaattctattggcggtgttgggtacaatattgcgagggcgagtgggtatgtttgtgacagcaccaagtttgtttcgcgggttggtaatgacgcagcagggaaaactatccaggagagtgtgcccgggttgggtgtggggagcggtggtactgcgcagtatgtgtctatgcacgacagtagtggtgagctagtggttgcgtgtgctgacatgtcggtaattgaagaagagtttgaggtagaccacaaagcgagtgtggcggtctacgattgcaatttatcgcccaaaaccgtctcgaaagcgctagacaataacgagtataacattattgagccgacctcccatgtcaaggccagacgtattggagagatggagttggcggtgtttcccaacaacaaagtcaagttgatcacgccgacagttgaggagttggcgtcgatctacgactctatgaaggataagtttgatgatgaatggtttggtgtgttggatgcaatgaaggttgatcagataagggagcggttggataagaagtggtacgataagggtgtgtaccagcagtgttttcagttgttgccgtttttccagaacatactagtcaagctaggcaaggatggggtgttgttggttagcttgtgttctacagtggaggactataagtctataccgacgacgtctccatatagaccaaagtcgataatctacagtaaggggaaccaagttggtgctgttgtggagtatttcccggtgcccaaagatgtggaggtggttaatgtaactggtgctggcgatacacttgtagggtacttggctgccaaaatctcggagctgaactggctccaccacgaaattgggtcggctgagcaggtttggggaaagtgggagtcaatatataaggcgcaattggctgcgggtttaacgttggggtgtgcagactcggttattcaggagattgcgaatatatag

SEQ ID NO: 2776 - DNA, 558 bp, Candida albicans
agaaccactaaaaacgagctgaaatctgattggtttgttaaattgaatcctaatggacgtattccaaccattgttgacccaaactttaaggatggtgaaattaccattagtcaaaccggtgcaatcttacaatacttggcagataattacgataaagaacacaaatattcttatgcattcggaacagaagaatattacaagactttagaatatcttattttccaagtttcagaaaacggtccaattcaaggtcaattgaaccatttcaagctttttgcaaaggaaaagatcgaatatggtattactcgttacgaaaacgacactaaacgtatctatggggtctacgaagatattttgaagagaaactctgcaaatgatagcaaatatttagtgggtgatcgttacaccgttgctgattatgctttgtttggatgggcctacagtttgcataaagttggtattgatattcatgattggccattgttaggcaagtggttcgatgcacttaataaagacccagctgttatcaaaggtgtcaatgtcccagagaaaaaataa

SEQ ID NO: 2777 - DNA, 723 bp, Candida albicans
aaagatccaaaggataggttagaatttgaaaaattattaaaagatgctgatgtggtcattgacggatacagaaagggagccattgagaaattgggttacggcccaactaagttaacccaattggggattgaacgaggtaagggatacatttatggagctgaaaattgttttggatttgttggcgaatggagtggtcgtcctggctggcaacaaattgctgattgtgcaagtggtgtggcatgggtacaaggattatcaatgggtaaaaacgagccaatggtcccccctttcccaatgagcgattacggtactggttgtttgggtgcaattgctatcatgttgggcatctacaaacgacacaaatacggaggtagttatttatgcacctcatcattagtgcaatatgatttattgttgttgaagcaaggtcaatatccagaagagttatggaaatcacagatccttttaaacgacaaatataaagagtttactaagattagatattatgattctgttgataagatatccaagacggctttagacgcgatgattgcacaaagaccaggtttgctaaacaacgcgcagtactttgttaaacaagaatcaaaaggatttggggcaacaatatcgacccttaaacccgtgtgtcaatttgacacaattgagactggttacaggtgttctagtagacctaatggctatgatgctcctgaatggtggtag

SEQ ID NO: 2778 - DNA, 1065 bp, Candida albicans
ttgtcactattacatcattcaccatccatgtttgttattctctctctaatcatcgacttgatctattggttaaataaacaatttagatatatatctgatctaatcattggtaatgtttttgatccgaggtttgatattgttttagtgactggtggtgtaacagggttgggacgagaacttgtgctgcaaattatttccaaaggtgcacaggttgtcgtattggatatattagaacctttagaagaagatttaaacacagttggattgacacattacaaatgtgatgttagtgatcctcaggatgttttaagaacacaaaagctagtgagaaaagaaattggggtagtaaccgtactaataaacaatgccggtattgcaacggggaaaccggtattggatttatccttccaagaaattgaaaaaacaatacaaattaacttgctatccagtttttacactataaaagcttttcttcccgatatgatgctacggggccgtggttatatagtaaccatagcttcggttttgggatacatgtctccggcgcgactcagtgcatacggtgcatcaaaatcagggctaattgcattacatgaatctttaacttatgagttggggtctccttctttgaacccacagggaatcaaaactctattagtgtgtcctggccaattgaagaccggaatgtttcaaggcgtggctaccccttcgaccatctttgcacctgaattagatcctgcatttgtcgcatcaagtgtagttaatgccattgaactgggaagaagaggagaaattaaattaccgttatatggcaaagtaatacccatgttccgagctttgccgtggccaattgttgaagtcactagaagaataactggtattgatcaaagtatgattgacttcaagtcgaaaatatcaaaagtagccagtagtgtttcgtctttgaggaatatttcgttgctggggtcaaaaaatgtgtcaactgaagttactccgacatttgctgtcgccgagtcaacaccacaggaaaacaaggcggctttgtctcagacagagatttcctaa

SEQ ID NO: 2779 - DNA, 564 bp, Candida albicans
  unsure (260),(422): Identity of nucleotide sequences at the above locations are unknown.
gccccgacttggatattccagccgcgtggtcaagacttgacggtgatgggggcattgattttgtacgaacaagggaaactccaattagatattcccgtttctacatatttcccagagattgccaatatcggggtattagagccaggagcagtagacaagtatagtggtaagctttcaaagccgttgacgacaccgcaaacgccaattactgccaaacacttgatcacccatactgccgggttttcgtatgggtttattantcccgattactttgcgttgatcaccaagggcgaacgaatctacgccatcaacccgcccatggagtttttccataaaaagacacctttgattcatgaaccaggtactgattgggcttatggacataatattgactggttggggtgtgttcttgaacggattantgggcaaaagttgggtgagtttttggccacacacgtgtatgaacctattggcatgacaagctgtaccttccacaagaaagacccttcggacttggttaggatccattttagaaagcctgatgagacattggttttgctctag

SEQ ID NO: 2780 - DNA, 621 bp, Candida albicans
atagactcaatcatcgtcatcatcatgtcaactcaatcaggatttggatatattaaaggacaatcagatattcaaaaattcactgatattccaatcccaaccccaaaaagtaatgaagttgtattaaaagttgaagctgctggattatgtctttccgatccccatattttacatgttggtcctgttgaaagtaaacctccattagaaacaccatcaaaatttgttatgggacatgaaattgctggatcaattagtgctgttggtgaccaattagctaatgatccatattataaaaaaggtgctagatttgctttacaaattgttcaagcttgtggaacatgtgattcatgtcgtcgaggtttagatagtgtttgtgacctgagtcatcaagcttatggattgaatgaagatggtggatttcaacaatacttgttagtcaaaaatttacgtactttattaccaatccctgatggtgtcagttttgaacaagctgctgttgctactgattctgttttgactccattccatgccattcaaaaagttagaaaattcttgagtccaacttcaacagtattagtccaaggtttcttaaccgacaggctggcaggtccatacgggctc

SEQ ID NO: 2781 - DNA, 549 bp, Candida albicans
  unsure (8): Identity of nucleotide sequences at the above locations are unknown.
gtagtggngatactgtccgtcatgacgttgtgcaaagacctcaaggccgggggaaatcgcgccgcatgtgtcgacgcaacgatcatttattgcaagtcaccaactgttgcgggcctggtggcgcgcgagctgatcaggcttgggcatggcactccgactgagaatccccatgtcgactgggtcagcgaagatttcgatgccgactgggattacacagtcgcccttagaaacggtattggcttgcattttggcgcgctaccgagggcactgcagcaatacactgccgaccaattcaatgctggaaaactgcgctttttgctctgcacctccacgatcattgaaggagtcaacactatcgctaagaacgttgtgatctacgacaaccgcgatggaactcgcagcattgacaaattcacccatgggaacatcaaaggtcgcgccgggcgcatgggcgttcacttcgtcggcaaaatcttttgcctggaggaaatccccggaagacaatctcaatcaagaggtggatattccgctcggtattcatggcattga

SEQ ID NO: 2782 - DNA, 399 bp, Candida albicans
tctacgacaaccgcgatggaactcgcagcattgacaaattcacccatgggaacatcaaaggtcgcgccgggcgcatgggcgttcacttcgtcggcaaaatcttttgcctggaggaaatccccggaagacaatctcaatcaagaggtggatattccgctcggtattcatggcattgataccccaatcaacctgttagccagcgttcaaccagaccacttgtccgagtcttcacaggatcgctttgatgaggttttcataaacgaccgtgtttccaccgaccttgtgaagaaacattcgtacttcccgtgtccagccatttcgaaatgccgcaaagcctgttccgagatgaaggaccgataccaatttcccccccttagtgttttcactgggactcccccc

SEQ ID NO: 2783 - DNA, 639 bp, Candida albicans
gctttttttcaaaacaacatcttaaaatcacaattactacagtttatgtttagacaattgaatagactacgccatttccacacatcggctgtattgcaatctgacttttcacacgttgttattggcggaggtgtcgtaggtacagcaatagcggccgaactccaagaacaaccgggaaatgaagttttattaattgataaaaatgaacaattaggaatggaaactacgtcaagaaattcagaagttattcatgcagggatatattatcctccgaattcattaaaatccaaactatgcattgctgggaaaaacaaaatctatgacgcttgggcaaaaggtaatttccaagttgctttgaaacaatgtgggaaatgggtggttgctcaaacagataaagaggcagaataccttgaaaaaataaacaatatagcaaaagaagttagcgtcccagtaaattttatctcaccaacaaaggcaaaggcaaaataccctttaattcgagccgagacagctattcttgaaagtccaactacaggaatcatatcacctcatgattaccctcttttccatccagcaagattcgagagtaacaaccggactatgggactctatacagaattaacagaactgggagtataa

SEQ ID NO: 2784 - DNA, 528 bp, Candida albicans
ctgaccatgtgtttatgtctttcggatttatttcttattgttctttcagtattattcccaccattacctgtttggattagaagaggatgttgttcatgtgattcattaattaatattgccttatgtatgttaggatatttcccagggttaattcattcatggtatataatagctaaatatcctccttattattatcaacaacaacaacaacaacaacaacgtaaagataccatttattatgtttatcgaagtgatttagaaaatcaaacaccaagaagagatggcagagatgggagagatgaatgtcatcatgaccaccaccaccaccatcatcatcatcacaaccaggcagaatcacaaagtgcgggattaatagtttctaataatcataataataataataataactatggatctgtggttgaaggttcatcatcatcgaatttgactcctgtggctcctattcctgttgaaaatggagctccaccaccagcttatactgagattgataataaaacacaacattaa

SEQ ID NO: 2785 - DNA, 318 bp, Candida albicans
aataaactagacaacaacaacaactacaacgagtatttaaaccaattcaattccccccaagtagtctctttttttttggttctctcttttctattttataatcacttctttttttatttctttcaagtacattttactatcaaaatgccattcacgtgttccgatatcattaaaatcattgttgctattatcttaccaccattaggtgtctttttggaaagaggatgttcctcatcattgttcattaatattcttttgactattttgggttatattccaggtatcattcacgcattgtacgtcattctaaagtactag

SEQ ID NO: 2786 - DNA, 942 bp, Candida albicans
ccaactttagaaatcaatttcaatacattagtgggagttaatgaacaaggtacaattgattttattcataaagattatgatgcatcgctttataataataaatctcctatacaattctttattgatcaagaggaacacccccacagtcaaccacatcaggaaaatcatggccaacaacgatatcaacattttgaatttgttgattattcccatgatttaacgaaattttttataccaggatttattgatacacatattcatgcatcacaatatcctaatattggtattggattaggtactccattattagattggttaaaaaaatatactttccccttggaaaatcatttttgtcaatctggacaggagcaacagcaagaacaagaacaagaaacaaagttacaatttgctaatgaaatttataatcaagttatacaaagaactttagaaaatggtactacatgtgcatcatactttactactattgatccggaaacaacaaatttatttgccgaattattattaattaatggacaacgaggatttgttggtaaagtatgtatggatcataatgaaccatatcaagaatatcaagaatcaattgaagattgtgaaaaatccatgcacaaaataatcaatcatattgaaaaacttaataccaataccaataccaataaaaatttagtgacacctataatcacaccaagatttgcccctgtatgttctgataaaatattaaaatttttaggtgaattaagtcatgaaaaaaatttaccaattcaaactcatattagtgaaaataaacaagaaattgaattagttgataaattatttcccgattgtgaaaattatgcttcagtttataataaatttaatttattaactaataaaaccattttagctcatgctattcatttaacccctaaagaatgtcaattaatt

SEQ ID NO: 2787 - DNA, 747 bp, Candida albicans
ttccaattttcagttcatccttttttttttccttccctccaacgtcatgttgtagaattaaacataatggtgcatcaaattacatatacttctaatgaaattcctcaattgtgtgacagagtgcacaaggactacctatcaaaaagaaaatcagattctcaacctagatatttgatatcacttgcaggcgttcccggctctggtaaaacaacatttgctaatgctatagccaaaagactttcaacttttgcaaaagtggtagtactatctcaagatgggtttcatttatatcgctcggaactaacattaatggcagatccaaaggaggcttttcgaagacggggtgctccttttacttttaacgcacaggcttttgtcaatttgatctcaaaattgaaggaccgttcccaaaccatcaaagcaccttcttttgatcacaaattgaaagatccgatagaagatgatatagtgatacacggtaatgtagacattataataatcgaaggaaattatgtatcacttcgagacaaatactgggatgaaattgaaaattttgttgacgacacttggtttataaaaacccctgaaaatctagttcgagagagaattattaaacgccatttgaacgcaggaatagccgcaaatgaaaaagaagcagccgaaagagccgatgggagtgatatgcaaaatgctcattatatagatggcaattctaagcccaccaaagttctaattctatccgaatag

SEQ ID NO: 2788 - DNA, 423 bp, Candida albicans
aaaattgagattttgaaatttgctggtgaagatggtgcttataagagaagaccatcaagcttcagggaatttatcagctctaagccaggtgcacgtttcccaccagaagccggtagatatcatctttatgtatcttttgcttgcccatgggctcaccgtactttgattactcgtcgcctcaagggattgacttctatcattggattgtctgttgttcattggcatatggatgacaaagggtggagatttcctacaaaggaagaattgaagacattaaaaactgaagacgacatttcattaggtacacctgaccataactatgatttttcccgtcttagagaattgtactttaaggctgaaccagaatacgagggaagattcacagttccagtattgtgggacaaaaaagaagtacaatcgtaa

SEQ ID NO: 2789 - DNA, 636 bp, Candida albicans
  unsure (117): Identity of nucleotide sequences at the above locations are unknown.
accagaatacgagggaagattcacagttccagtattgtgggacaaaaaagaagtacaatcgtaaacaatgaatctgctgaaatcatcagaatgttgaatactgaattcaatagtatnttgccaagtgaatatgccgaaattgatcttgttccaaaagacttagaatctcagattgatgaattgaacagctggatttacgataatattaacaatggtgtttataaagctggatttgcatccaagcaagaggtgtacgccaaagaatgtcaaaatgtgtttgatcatttggacaaagtggaagccattttggagaaaaaccacaatgggtccaagaagggagaatttttgttgggcaaccaattgactgaagcagatatcagattgtacacaacaattattagatttgatcctgtctacgttcaacactttaagtgtaacattggtacaatcagaactcactatccatacatccacaattggctcagattattgtattggaagattcctggtttccaagaaactaccaatttcgagcacatcaagtaccactacaccaaatctcatatcaagattaatccatacggtataacaccattgggtccagtaccaaatattttaccattggaagaaaagtaa

SEQ ID NO: 2790 - DNA, 531 bp, Candida albicans
tcatcaacgatgtcagagttaaataaatcccaagcagtcagtagtgatgtgtatctctcggcatttggtaccacccgtgctaaagcaggatcagcagagaatttcaagaaaattgactatggtatcaattatctgtcagccaaagctgccaaagagaatggatccaaagtatgtgttttagtcagctcaatgggtgccaatgcttcgtccccatttctttatatgaaaacaaaaggtgaattagaggatgatattattaaattagggtttgaccacaccgtgattttgagaccaggcgcattactcggagaacgtaaggaatctcatggacttggaaactcaattgctcaaaccattggtaattggacaaaggggacttggctccaaggattattgaagccaattgatgccagtgatgttggtaaagtcgctattgattttgctcaaaagggtattaatggagaattgaaagataaggttattattgttggtggagatgacttggttaaattggccaatagtttgaattaa

SEQ ID NO: 2791 - DNA, 363 bp, Candida albicans
ctcaaaattcttgaatatttatcattttctctactaattttttattatttatttagcaaccaacaacacaacaacatacaacacttaacagttatgtcatcttctgcattaactgctgattcattaagagatataatcaccaccagattaaatgctaatttagttcaagttgaagatatgtctggtgggtgtggtcaagcatttgctgtaataattgtatcatcattatttcaagggaaaaataaattagctcgacatcgattagttaataatgaattaaaagatgaaatagcgagtattcatgcatttactcaaaaggggtttacaccagatgaatggatagctcaaggtggacatctataa

SEQ ID NO: 2792 - DNA, 1233 bp, Candida albicans
cagccggtccctttaaaaaaaaaatcataccgagaaatacaaattatttccgatttcgcaatttatagaatcatcaacaacagtgatcttttttttctttgtgtgtcaccattgctagtctcaaagatgatcagggtcgttgttaaaacagttaccagactaaactcacaatgcaagttttacagtactgtttccggaggcgtgcaaggagttgaagggcgagtgccgcgtgttaatcagagatcagaaaacaccaacagtttgtcaataacagacccttacctaatataccttggttacattcaacaagggatcctagaaaaagatgaatcacaattacgagtaatgaaagagtttcaaaaattgtatcatcgagttcttgattatactccaccagaagaattgcaaatacaattgagtctcatattgcgacaaattgaagttagccaagccaaggagactaatcgtgacaataagttcaatcctatgaaattgtttcaaaaagatcccgaacacaaaaggaaacagctagtaagatatatgactgatgaagaagagctacaaaactttgcatctccccaaggattattgattaacggtgaagttggttgtgggaaatccatgctaatggacatttttgctgcatctttaccgcataaatccaagatgcggtggcactataataacttcattttgtgggtttttagtgaaatgcataatatccaacaacagcgacaacttcaagttggtttacaaaaatatactatggagaatgaatttttactatacgaagttgctcaaaagatggttcaaaaaaattctattttgatgttggatgagtttgtcttgcctgatattgcttctgctaatattatcaaaatattgtttacgttttacttcaaattaggaggtgtattggttgcaacgtcaaataaattaccagaagaattatattcaactgatttcagtaagcgtaaattcaaagattttgtgggaatattgaatatgagatgtcagtcgattgacatgaaatcggaaaaggattatcgtacttattttgctaatgaatcttcaaaaattctgtatatggtgactaaaaaagataatccggaaaatgagaaagattggctaaagttattgaaagttgaagccttgggtattccatcaggttcacattggcttgatgaaagagtttctttgggaagaattaggagatgggccatccttcggtga

SEQ ID NO: 2793 - DNA, 513 bp, Candida albicans
  unsure (32): Identity of nucleotide sequences at the above locations are unknown.
aggtccgttataacgaaaattttcaggtcatntttaggtaaaacttcaattaaaaacaatagcccttcgtcgttattggttgatgaacaaacattattgacggtaagtaatgaagttcgagggatttatttatatggagatgttggatgtggtaaaaccatgttgatggatttattttatgatacgattccggaaaatttacctaaaaaacgattacatttccatcaatttatgcaaaatttacataaacgttcacatcaattaaaaatgcaacacaacaacaacaacaacaacaacaacaacaacaacaacaacaccactaaaagtggtggtggtggtagacaacataatgatattgatgtcataccattattagcgagtgaaattgctcaaacatcgacaattttatgttttgatgaatttcaagtgactgatgttgccgatgccatgttattacgtcgattaatgatgttattattactgccacaatttggagtcatattatttgctaca

SEQ ID NO: 2794 - DNA, 660 bp, Candida albicans
taccacaattctttaataatgtcatttaatcatcctttaatagctaaattaagaaattataaattaattttagggtctagttcaccaggacgacaagaaatattgaaaactaatttaggaatacatgattttggaatccttggatctaattttgctgaagatctttctaaagatgataagtcacctttagaatatgttcaattgacaagtaaacataaagcagaagctatagtagcaagcctaggtattaaggaaaacggaggattggccacacttattcttacttgtgatactattataagttgtaacaacaaagtgtttgaaaaaccaataaccaaagaggtacaaagacaatttttcaattattttaaacagtttcctgaattacaagtgatatcggcattaactttgattataatagataaagataatgctacaactgagttttctgattatactattaccaagttacgatttaaaactgatgatgatgatgagattattaatgcatatatagaaagtgaagaaggtttagaagttgctggtgggtttaaatatcaagaattaggaggtttattgtttgaatctattgatggtgattatttaaatgttgtaggattaccattaaagacatttgatttattacataggagtatttag

SEQ ID NO: 2795 - DNA, 609 bp, Candida albicans
cttagccattgcggatggcccaggcccgtggtgaaaactcctgtggtattaccatttttggctgtttatattgtccttatgatggaatgtattggtgatgttactgccactagtgatgtttctcgtttaccagtttctggagaaatgtatgaatcaagaattcaaggtggggttttgggtgatggtatttgtggtattctttcaacattaatgaccatgactccaatgtcagtttttgctcaaaataatggggttatttcaattacaaaatgtgctaatagaaaagttggttattggtgtgcatttttcttaattgttatgggagtatttgctaaatttgctggcgccattacatcaattcctaaaccagtacttggtggtatgacaagtttccttttctgtctggtggccattagtggtattaaaatcatttcgactactgaattcactataagagatagatttgttttgacagcagctgtattacctggattaggagctacaatgcttcctaattggtttgaacacgttttcacttatcaaggtggtaataaatctttaaaagggtttttcaatgctattattgttgttgttgaaagtggattttgt

SEQ ID NO: 2796 - DNA, 327 bp, Candida albicans
  unsure (290),(297): Identity of nucleotide sequences at the above locations are unknown.
atggcgaatgaaagaacatttttagcatgggtcagaacatcacttgcatttctaacatttggtgttggattcctacagtactatcgggttgaatcaaaggcaagcgttttggagagcaattccaagacctcagcaattgaaaggttgaatcgtccaataggtagtatatgtatggtgttaagtgggttaacattaatttttggggcagtacgatatttccaagttcaagatttactacagaatgactattatccagccacaagattcactattcctaataatagtttttnacaatancgggccctgggccgatccgcaatgtgcatc

SEQ ID NO: 2797 - DNA, 465 bp, Candida albicans
tctcaattgtcattaaccatgtcctgggatcaaactaaatttacattaagcccaaaaagtaaaggatgttaccttatcactgatgacgttatcagaagtgttcctcaaatcaaggattatgaaatgggtattttgaatttgtttttacaacatactagtgctgctttgtcaatcaatgaaaactgggatcctgatgtgagaacagatttggacaagtctctggatagaattgccccggaaggagatttctatttacacgacgccgagggaccagatgactctgttctgcatatcaaaagtagtactataggtgtcagcttatctattcctataaccaatggcaagttaagtcttggacagtggcaggggatctacctttgtgaatctagaaggtacagacatagcagaaccattgttgccacaattaagggaaaaagaaatagaaatatatgtacattaacatag

SEQ ID NO: 2798 - DNA, 1062 bp, Candida albicans
aaaactttaacaaaacaaaaaccacgctatttgcctttaattgacgtttttctcaaaatatatacaccaatgacgaaactgcctattccaatttggttagactgtgatccaggaaacgatgatgcctttgctatcttattatccttgtttgacagtcgattccaacttttaggtatttccacagtacatggaaatgccccaattagcatgacaacacacaatacattagggttactagatctattgcgtgtctataataaagttaaagtctacaaaggagccgaattcccactcaaagtaccttcaaagtttgcattggaagtacatggaaagaatggattagccgatatagaattttctgaaaatacaatcaatgaaattagtcaagacatggattgtattgaagctatgaaacaaacaatagacttgaattccgaaaatatcaatcttgtatgcacaggtacattaacaaatgtcgccaaactaattacaaaatacccagatgtcacatcacagattaaatgggtctccataatgggcggaagctttgggtttggcaatattactccctatgctgaattcaatttgcatactgatccacatgcagccaaattagtaattcaggaattaagtaacaaggttattgtatccccattgaattttacccataaagtcattgccacttcggaaattagaaaacatatgtatgacgacaataacgagaaacgaagttctccaataagaaatgttttctttcgtattttgacattctattacaaagtgtatgctgcaaatggatttttggaaggcccaccaatacacgatccattggctgtctatagcttgcttccatttttcaattcatttgaacaatatggatatacctgtgcgcagaagaatattgatattattactgaaggtgttagaatgggtgaatcggtgattgttgaaggagggaatactgacaaaggagtttatattggtgaagcgatagataacaaaaagttttgggatagtattttattggctcttcaaaatgcggatttacaaacaaagaattga

SEQ ID NO: 2799 - DNA, 708 bp, Candida albicans
accaacttcattatcatgtcatttggtagaaaagctgcagaaagattagccaatcgatcaattcttatcactggtgcctcttcaggaattggtgaagcatgtgccaaagtatttgctgaagcatcaaatggtcaaattaaattaattttaggagcaagaagaaaagaacgattaattaaattatccgatacattaattaaacaatatcctaatattaaaattcatcatgatttcttagatgttactattaaagattcaatttcaaaatttattgctggaattcctactgattttgaacctgatgtattaatcaataatagtggtaaagctttaggtaaagaacaagttggagaattaaaagatgaagatattacggaaatgttagatactaatgttgtgggagttattcgtatgactcaagccgttttaccattattgaaaaagaaaaattatgctgatgttgttttcattggtagtattgctggacgggttgcctataaaaatggtggtggttattgtgcttcaaaagctgctgttcgtagttttgtcgatacatttagaaaagaaaccattgatactggtattagagtaattgaagttgatccaggtgcagttcttactgaatttagtgttgttcgttataaaggtgatactgaggctgctgatgctgttgtcgtccaccaccgcggctggaaagtacaacgttcg

SEQ ID NO: 2800 - DNA, 630 bp, Candida albicans
accaacttcattatcatgtcatttggtagaaaagctgcagaaagattagccaatcgatcaattcttatcactggtgcctcttcaggaattggtgaagcatgtgccaaagtatttgctgaagcatcaaatggtcaaattaaattaattttaggagcaagaagaaaagaacgattaattaaattatccgatacattaattaaacaatatcctaatattaaaattcatcatgatttcttagatgttactattaaagattcaatttcaaaatttattgctggaattcctactgattttgaacccgatgtattaatcaataatagtggtaaagctttaggtaaagaacaagttggagaattaaaagatgaagacattacggaaatgttagatactaatgttgtgggagttattcgtatgactcaagccgttttaccattattgaaaaagaaaaattatgctgatgttgttttcattggtagtattgctggacgggttgcctataaaaatggtggtggttattgtgcttcaaaagctgctgttcgtaattttgtcgatacatttagaaaagacaccattgatactggtattagaataattgaagtggatccaagtggatttcctactgaaatttaa

SEQ ID NO: 2801 - DNA, 540 bp, Candida albicans
agactgattagtgaaacgtcaaactccgaaaggaaaactattgttgcatatttcaaacaggggaaatttcctgtcttgtgcaatgttactgtgtttacagaaggtacagatataccaaatatcgattcaataattcttgcacggcccacaaaactgaaaccattgatgattcaaatgattggtaaagggttgcgtttgcataaggagaaaagtcattgtcatgtggtagatttagtgggaataatggatgaaaatttggaacttaaagcaattttggaaggtaagcaattacaaatgaagaaggcaaaagatggtacaacctcaaaaattgagtctcgagatcaagtaaattattttgaaaatgatcgcatatcaaagacgatagaatgcgctctacagattcatagcaagaatattgtcgagttaagaagtgttgatggtttggaactattcagggaatatatgctggatgtgggagttggtggtacatacaacacgctttttctaattaaaaaaatcactggttatggccaaacagat

SEQ ID NO: 2802 - DNA, 1095 bp, Candida albicans
cactacaactctatgaatttgtttttcataccaataatagcatctattatttactattactatttcactaatcctaacttaaacaccaaagaaacacaaattgcaaacgatatggcttcacaattatcaaaaaaatttattcaaaatccaactccattcccaacctatttcttttctcacggaggtccaacattcatgtatgaattagatgattttggtaataaaggagcatggaataccgttaagaaaattggtaataatattaaaaagaattggaaaccagattatattattgtgatcagtgctcattggcaaagtaagggagataatttgattgaaattgattgccctcgaaacaatgaagaaaatccattaatctatgatttttacggatttcctgatcatatgtataaagaagaattccattctaaaaataatttgtttattgccaatgagattaaaaaagaattagaaaagaatgggtttaattccagtcttacaaatcgtggaattgatcatggtgtttgggtaccgtttaaagtagcattcagtgactataatacacaatctagaccccaaccagaggtcaaaggtttggatttaccagatacatctgtaatccaagtttcattaacttctagagatggtgattttgctaaacattttaaattgggagaagttttgagcaagttcaggaacgaattgatttgggatgaatcgagacagaagtatttatcagggttaattatttgttcaggaatgtcagttcataatttaagagatttaggtgcttccttccgtcaacctaaacagataatgccttatgtcaaaccatttaatcaattattgactaaaacagttgaagagaatcatggcgaaagtttattacaagcatttttagaattgaaaaagaatccattattacgtcaagctcatcctactttagaacatttcttaccaatagttgttgccggaggtgttgcttcgaaatccgatgacaatattaaagaagtttacaatgattcaatgctcagtttaggttggggtgtctaccaagttggccagtacaataacaataacagctcaaaagtgtaa

SEQ ID NO: 2803 - DNA, 357 bp, Candida albicans
ttttctattgctgaagtcaatattggaattgctgcagacattggatctttacaaagattgccatctgttgtcaataacaaatcattattaatgcaacatgctttgttgggagataaatttggtgctgaagaagctttgaaattaggatttgtgagttgtgttgttgactctattgatgaaggtgttgaatttgctaaaacattaggtgaaaagatatgtgatgcacctgcttgggctattaaaggtactaaaaaatatattcaacacattttaaatggtggtactgttgaagaaggtttgaagagtattgctgaatataatgctgtgaacattactgatagcaaaatgaaattataa

SEQ ID NO: 2804 - DNA, 699 bp, Candida albicans
aggcctttggttttattttttggaataggtaattcaaagcgtggatcaataccatacattcgtttaacatcaatgaatatgaatattgggtctcaccgagacgaatcggtttcaactaacccgaacagtttacatatgcagttttttcaagacgatccagaccaaatagctccggtgcaccttgatccaacatctatgattgtcaatagagttacaataaatacattggaagagcagctgacgaaccccaagatttttgaagacaaccaagataacgacgaaagtgacaagtactcagaggataaactagaccctatagccttttccatcagaaatagaaagtttaaagcagaattgacaccagatgaaaggggatatattattggccgatcagtaagcacgagtgttcaggaactagcaaaagaattaaaactatctcgaagtactatacagcatacgctcaagatgtgtcgacaaagaaaacataacaaaacccttaatcaaaatagaggtcggaaactagccatctcgcctgaggaaatggaaagagtgctaaagttaatagagcaaagacccggaataagtaaacaagaaataatatcgtctttggatttaaaagtgagttcccggactcttgcgagagctttacaaaggaatggaacaaaaagactaacgctgcgaaatcatggcaagcagtaa

SEQ ID NO: 2805 - DNA, 333 bp, Candida albicans
tacccccttaaaatagtcatggcaaaacgtaaaaaatcaagatcaaaacttcaacaaaatgttgacagtaacgagtcaaccaaatcacctagcacacaaaatccacaccagccaacatatgttgaacaggaatcaactcagtggtctactactcaccaagaagtggaacctaacactttcatacaagcaccatatgcggctgaagttactcaaccaccaaacgttaatcagccaacttatccaggaatccaaccagaattacttaaccccgttatagaaaattcaccaatttccaccttatcaagtgtccaccacgcgctgattgtccgcaat

SEQ ID NO: 2806 - DNA, 888 bp, Candida albicans
caaactcaaccttcaaatctacaaacaatgtcaccaacttcaactacccaacaaccagtaacatctcgaggttacgaaatcggaaccagagggtcacataatattgccaaaggtggtaagcatccttatcagttgcctaaatttaccgataaaaaagaagagcgtaaatggatgcttcaacatatggcagctgcatttagggtttttgctagaaaaggttatactgaaggtactgctgggcatatatcaattcgtgatccaatagacccaaacacattttggatcaaccccttgggaaaacattttggactactcaaagcaagtgatatggtacatgttgatcacgaaggaaacattttaccagatggtgcacaggttgccataaacgctgctgggttttcgattcatattgcattgcatcatgctcgaccggacgttcatgctgcttgtcatacccactcagtatatggtaaagcttggtcagctatgggcaaacctttggccatgattaatcaagatgtttgtaccttctataaaagtcacgcagtttatgaggattttggtggtgtagctttagaagctgaagaaggtatacatatatccaaagctttgggtgatggtaaaggtgttattttacaaaatcatggattattgactgttggaaacacagtggatgaagcagcatatttgttcactctattggaaaaatcgtgtcaagtccaattggcagcacaagcagcactcttgcctggtgaaaaattaaaaatcattggtgacgaagaagctgcttattgtgagaggaatgacggggatccagagacgttgtatactgaatttcaacctgattttgagatggaggtatatttgaatgatgacttcttgaaataa

SEQ ID NO: 2807 - DNA, 684 bp, Candida albicans
acaaacatctataagaaagatatgactccagctccaacttctacacttgcaacaacagaaaaacccaacacaaaaacctcatcaaaaggttatcaaattgatgaaaacagtttccacaaattagcaatcggaggtagtttacccaaccagtatcctaaatttaccgataaattacaagaaagaaagtttatcttagaacatactgcagcaacattcaggatatttgcccgcaatgggttcaatgaaggtgttgctggacattgttcagttagagatccccttgagccaaacacattttggataaaccccttgggtttacactttgcattaataagggctgaagatttagttcatgttgatgaagatggtaatattttgcctgatggtaaccaggatccaattaatgctgctggatttgccattcatagttccttgcataaggcaagaccggatgtgaatgctgcttgtcacacccactcattatatggacgggcatatagtgcttttggtaagccattggaaatgattaatcaagactcatgtacgttttttaacaatcaagcagtttacaactcctttggaggagtggctattgaaaaagatgaagggaaagccatagctgaagcagctggggatgctagggcagtgatattacagaatcatgggtttattgactatgggtaa

SEQ ID NO: 2808 - DNA, 1068 bp, Candida albicans
gcattaatgttttctaaactgggtgtgaatagagtgagacagcttatattaaaacgttatacacaccagacatcacagacgtcacagacaaatgtattaaccccaaccttcagtgttgatcagatcagagatttaccttatgtggaccatgttgacttggtttggaaacaactcctaccttacaaagtgaagattaataaacgaaagacaccgatattgtttttacatggactatttggatctatactgtctttcaattcgattgggagactgctcagtgcagtagtgaaacaccccgtttatgctgttgatttaagaaaccatggagactctcctcgtgccttgcctcacacatacacgatcatggctcgagacattcataattttatcaagcaaagaaaatgggacgagtgtatacttgtcggccactccatgggtgccaaagttgccatgatggttagtttattatatccttcattagtttccaagttggtggtggttgataacactccgcattccagaccactaaaccatcaattttacaaagacttgttgggaatgtgtgaagtagaggttaatggccatcaatataaaactgccaacaagaaaactgtagggaagatatctcaaatcaaccgttttttaactcaatatgaagaagatcataaaatgagacaaatattgacaggcaatttaatgacttgtttgaaacatttcaaaaatcgaaaggatataaatcacgaaaaagaggttttcaaaatgccagtaatgaatttctacaagtatgatatattaagaactcttggtgggtggccccagctaccacaagtgcagaaattcgacaagccggtatacgtaatgtacggcaaccaaagtgaattcgtcgcaccccaatttcacaaagaattttacaggtatttcaccaatgtgaaatttcaagattttgatagcggtcattgggttgccatggaacaacctcggcaatttctcaaaaaattggccaagttcatagactatgatgagtactgcaagttcaagccgaataaagttcgatatgtaaagtggtaa

SEQ ID NO: 2809 - DNA, 711 bp, Candida albicans
gtgtgttttctcattttgacgatgtttaaaggcaaaactgcattagtcacaggcggatctcgaggaattggacttgcaatcagtaagaagttagccattgaaggagcagcagtatcattattatctagaaatgaaaccatattgcaacaatcattactggaactagcgactgatcatggtcaaacccatacatatcactcattggatttgacaagtctattgttacgcaatccacaggatttgaattttggatctcctacaatattagtaaactgtgctggagttactaatcattccttgttacttcgtatgacacaagaagaaatcgttaacacaatcaatttaaatctaacggttcccatactactaagtcaaatggtggtgaagaatatgcttcgccaaaaagggtctgatccaacaatattaaatatttcttcagtattatcaatgactgaacattttataccagggacttcggtgtatgctgcatctaaggctggcttattaggatttactaaaagtctatcaaaagaattaagagggaaaattagaatcaatgcattgatgcccggattagtcaaagaaacagatatggggaataaagtcatggcagatataaatctggttctggttgagtcggtagcaaatgaagctataagaatattacaagatacaaaattaaatggagaatgcattgtattggataaatag

SEQ ID NO: 2810 - DNA, 909 bp, Candida albicans
tatctccacattatgactgatcttacaaccgtccaccagctaccatatgttgacattgcatctgtttttgatgtcaaacaaatagaaacttatagatatagaggaataaaaccattgcaaaagcagtcttcacaacacagaggtgtctttggaggtaattttgttgctcaatcgttattagttgctatcagatcagcgcctcacggttttcaaccacataccatacactcgtattttgttagagctggtgacgataaaactcctattgaatgggaagtggatgaaatcaccaatggtagaacatttgctaatagggcgatacgtggatttcagaatggtaaggttgtgttcactgccaacgtttcgttgacaagcaagaactcggttaaagatatcgttaaaaagacaggtaccatgccagtgatatttcaaaaagaagtggatacagaataccaagatctcaaaaataatatttcaaaatgtcctttatttgtggaaaactcaaatgctcatttcacggtgagaacctttccaataaatctctctagcgatatttatgcttttttgctgaaatttggagctgaaagcaaagaaactgtcgttgggttaaccactgaataccaatatgttgccttagcaacaatatctgattttgtaaggcttgaagaagttttcaaaatcatgggtgtcgaggtagatgtttcctttaacgtgtccttagaccattcgatttattttcatgataatgatttggatgccaccaagtggtctacctatttggttgaagtaactagatggagtcatgatagggttatgattgttggtaagatttataacgacaagggtattcatgttgctagtatctcccaagaacgtcttttcgttatcaagaacaaaccgaaattttaa

SEQ ID NO: 2811 - DNA, 1863 bp, Candida albicans
ccatttctttgtctttccttcttttccttctttttgaaatttttccttattttgactccatctcatccttcaaaaaacacactcccagtatttttcctccccccaatgtcaaaccaggatatttctaattcagatttcgatgtcaatattcttcatgacccattgatagatcccaatgtcgatttgaaattcccacttccaattgataaggaaacttatattaatgtcgatggtaatgtgaaaactttacatcaatcatttaatcttttgaatctggcatttagattaattactggtggatctaaatacgacaaaatttattctgttccggagtatcgttatttcactaataaacattctgatgaatttagaaccaaatttaaaaattatatgaataataaattagaaaaagatgacaccaaattagatgaaataatttatgatttaattaatcaagaattgagtttaaaattaattaaagctaatcaattcaaagaaagatttcaaaaagtgaaacagtatatggttgaatattataaaaaacaaaatgaaaaaaatttacctactttcccatctcataattttattagatcggcttatgtcaccgttatgacaattatgcaaaaattgttccccaaggggatttgggtatcaaatcaagatatgtcagatttatatcaaaaatatcttgatgaccccatgtcaattatttttttaccgtcacaccaatcccatttggactacataattgtgcatttggtgtgtgttcggttccaaatggctactccttcggtaattgccggagaaaacttgaatgttgccgttattggagggcttttgaagaatttgggggctattttcattcctcgttcattcaataatgaagcttatacggaaagaaatttaaacaatgtcattgaatttattttggtcaataaaatcccctttgaagtgtttattgaaggcacaagatcacgagatgggaaattgttattacctaaatatggtattttgaaatcattatgttcaatatatttaaaacaacgtaatgaagagaaaaatactgatttcaatttattgtttcaaccaatttctgtcacttatgaaagagtttatgaaaatgacgcgtttttaaaagaattgaaaggtgatgacaagactcaagaaagtttatttggtactatttctgtggctaccagtgcatttttcgttaaaaaggaagataaagtcatttacaataaaaacgggtggaatgacaacagtgaaagaactttaacagggaaaatttttgttaaattgggtgaaagtttcaaaatatcagaatttgttgatgatcaaaatgaaattgatcgagctttaaatgatgacgttaatctaaagaagttagggttcaaaattttacatgaaatcaataaaaatagttatatccctgaaatttccattgttggcaccacccttcaagcttatcaatatttttctggtaaagacacttttgccatttccgaattaatcccagttttacgaatagtggttagaacattactcaatgaaaatcaagatagtagtgccaccaacagtaaaatcttggaagatatggcaatttgtaatgatgctgaattgacagaattagttaaacaccaaatcttatcatttttcagatacattaaagtcaatcgcaaaactgatcaaatcaaaattgaatcaccaattgaattattatactataagaatttgactattcatttgattattaagagatgtttggtaatgtttattttgaatttgttgaatggctgtactaattgtaatcatcgagtcattggcaaattattctatattttaattggattcctcaagaatgaa

SEQ ID NO: 2812 - DNA, 270 bp, Candida albicans
aataaaatcaatattcctcttataggcatggttcaaaacatgagtcattttatttgtcctaactgcaaacatgagtcacacatattcaaaaacaaaggtgctgaaagagtggcattggaaaacaatttgaaagtgttaagctctatacctttgaatgaagaaatatgcgttcaaagtgacgttggaaaaccaatagttatatctgaccccaattcagaaatagccaagccatattttgacatagcaaaagccattgttgattttaaatag

SEQ ID NO: 2813 - DNA, 447 bp, Candida albicans
gtcaaaatggttaagaaagtacttctcattaatggtcccaatcttaatttgttaggtaccagagagccagaaaaatatggtaccacatccctttcagatattgaacaagctgctatcgaacaagcaaaattgaagaataatgactctgaggtcttggcgtttcaaagcaatacagaaggttttataattgatagaatacatgaggcaaaacgccagggtgtcggttttgttgtgataaatgctggtgcttatacacatacatcggttggaataagagatgccttgttgggaacagcaatcccattcatcgaagtccacattaccaatgtccatcaaagagaaccattcagacaccaaagttatttgagtgataaagctgttgctgttatttgtggtttaggtgtttatggttacacggcagccattgaatatgcgttgaactactag

SEQ ID NO: 2814 - DNA, 1335 bp, Candida albicans
atacatttttttgctcccagaacaaccgaatgcctatatatatattgccatggctgcccacatcacttgctatgttgttctttctccctaagcatgtcatttactagattcacaaactgtcatttgattgataacggtgagttgtatgagtttactgacttgtacgtcaacaacgccaccaaaagaatttgtcatccgccagcaaaccctgagttggttagtgaggttatagatttgaagcagcaaatattagcacctgggtttattgatattcagaataacggtatttatgggttgaacttttccaatcttggcgaggagtctaccgcagaggatgttgctgagtttaagcggttctatagagatgctatggccaagtatttgagtactggggttactgctacgtgtcctactgtcacatcaagcttcccagaagtgtatgccaaagtgttgccaatgtacaagaggagtgttttggctagtcagacagattcgcttggagctcatgttgaggggccatttatcaatgtgcaaaagaaagggtgccacccagtcgaaacgtttgttgatgccaaagagggtgaatcaaaattgttagaagtttatggggacttgtttgataatgtgtgtattgtcactgctgctcctgaaattgctggtgttttagacttgatacctgttgttaaatccaagaactgtgtgttttccattggccatacgatgtcggattatgacacagccgtgaaagctgttgagaaaggtgctacgatgatcacacacttgtacaatgccatgccacagccacatcaccgtaatgctggtgttgtgggtttgattaattcgcctattgttgataccccatatttcggattaatctgtgatggtgtacatgttgacccgtcgatggtcaaccttgcatataggtcgaaccccagcaagtgtgttttggtgactgatgctatgcacttgataggtttgcctgatggccactacaaatgggactcgcaggttattgtaaagactggtgatcggttgtatttggagaacaccgacacgttagctggagctgccactacgttgccgcaatgtgtgcgtaacctagtcaagtggtcgcaaatcagcttgccccaagcggtgatgactgttactaataatgctgccaagtcaattggcgttgaccacgagcgtgggtttttgaatgttgggtgtttagctgattttgttgttttagacaagagtgggtttgttcggaaagtctacaagttgggacgtgaagttcaatcgtcagatatacctttagatagagctactgataaattaactgctgttttatag

SEQ ID NO: 2815 - DNA, 873 bp, Candida albicans
atggaaaagcaaccacgttcaggaccaattcaagaatgtctactcagcggaggtaactgtgttttcaatacttatatggttaatgcagactccgaagttgatttcaggggaatatttatatttgtccacggttggtccgaacacatcttgatgtatctggatttagcatattttgtagcctccctaggatatgacttttttgcatttgacttgagagagagtggcaaaactagaggaccatatacagatgttgactgtcctataagagatcttgactttgtaatagaaaagagtacaaccaaatataaatctttcaatcttataggccattcgatgggtggagcaattattcttgattatttatgtaagggaaaatatagagatatgatagattcggtgatattgagtgggccatgcgttaagctccatgactctatacagccaagtccactaaaaagaatgtttgttaacataatcttgtactggtttcccggcattcgttattgggagtcgaaatcgatttctgcatatgcactggtgacaaccaacgaaaagaaacaattggaaatgttcaatgacaaactatgttgccctaatggtccactaaaaattatatcagatatgtattacagaggtaaaagactagtggaaacaatcccagatatctcaaataaagccaggatactaatatttcaatcagaaaatgattcaattgtggatccatctgctgtaaagagctttttcaatgatttatcatctaccaccaaaaaaattgtttgcatagagaactctggccatgccttgtttcttgaaaaggaatcgacagtggaactcataaataaagaaatagagagttttttaaaaacacaataa

SEQ ID NO: 2816 - DNA, 642 bp, Candida albicans
aaactcgttgagacacttaagcagacacatgtgaagcagttggtggtattagatgcttgtactggtacaggatgcataccattattgattggtcacgaattgaacaatattgccccaaagatttatgggcttgatgtttctggtaaagcttttgatttggcaaatgagaatttatcattgtataagcaaagatatcctaacaatcccattgatttgaaattttatttaggtgatgtctttgatgcggagattatggacaagctcggtctacctaaaataaatttattgacttccaatcctccttatattccataccatgactatattaaatctattgacagagatggtgtcgcaaaatcagtgaaattgtatgaaccgagtttggcgttacttggggatggtgaattttaccgttcgttggtgcagaatattttgcgaccatcgcaagcagaggcgtttgtttttgaaattggatataagaatcaggctgattatgtcaattttcttctcgaggatgacagtgcgtggtcaattggagttatgaaagattcatcaaatcatattagatgtgttttaggttggttgaatggttcagattttgatggattaaaaactttatgtggtgatgtttatgttcgttga

SEQ ID NO: 2817 - DNA, 438 bp, Candida albicans
tcagcttattttcacaaactttctatcaatttaaagattgcctttattaattcaacaaataacagaacatcaatccgttctaaaatactaaaacaatttagtaaccaagaagttaacattttgatcactactgatttaattgccagaggtattgatgtggcatctatcaccgatgtcatcaactacgacttaccaaattcttccagagaatatgttcacagagttggaagaactgcgagagccaaccaagtagggtatgcatacagtttctgttttggtaagggagaaaatagttggttcaaaaaattagcccatgaagtgagtcgaagtaaagaagttgaaaacgtggacttgaatgtcaaagaattaatatccgacagagacgaagagatttatcaacaagcattacatgagttacaacaacaagctaagaaataa

SEQ ID NO: 2818 - DNA, 1221 bp, Candida albicans
aggtgtttgggacttgaatcaccccaaacaggtgttggtcgattagctttatctgatttagataaaaaagttagagattggtttgttcaagaaactgaaaaattgggatgtcaagtgaaaatcgatgaaatggggaatatttttgccatttatccaggtaaaaaccaaggtccgccaattggaattggttcacatttagatactcaacctaatggtggtaggtatgatgggattttgggtgttttgctggggttagaaatattgagaactttaaaagataataattatacccccaactatcctattgccgtaattgattggactaatgaagaaggtgcaagattcccaacaagtatgatatcttcaggggtttgggctgggaaaatcccgttggaaactgcatggtcgctcaaatcattagatgtcaacccagtgtcaatgaaacacgaattagaaagaattggttacaatggggatgttaaagcatcgtatttggaaaatccattggcttgtcattttgaacttcatattgaacaagggccagtgttggaaaatgaaaagaaaaaaattggtgtagtgactggtgttcaagcatttgaatggaatttggtaactgtaactggtaaatcttctcatgctggtactactcctatgaatactagatcagatgctataatgatggcatccaaaattatattaatggccatagaagttgcttctcgagaaggtgggttggctacagtggggacattagatttggaacctagatcagttaatgtaattcctaatattgttaaattttctttagatgttagacatgttaaagatgataaattggagaaaataatgaatgaaatcaaaactaaagcagctgaaattgctcaaaccaatataaattcttcttttgctaaaccattaactgttgaatttcaaaacttgatcacttcaccagcaatcaactttaatcaaacaaatatcgatacggttcggaaatctgctttgcaacttttcaaagaaaatgaaattagagatattgttagtggtgcaggacatgattcttgtttcactagttctagagttcctacatcaatgatcttcattccttctaaagatggggtttctcatactcccgaggaatattcttcaccggaagaagttgaaaatggatttcaagtattattaagatcagttttattgtatgatgaaatgagaggagaataa

SEQ ID NO: 2819 - DNA, 408 bp, Candida albicans
agctatacgttacatcctttccagtcccttctccactcgattatgctaaggctgtttatacgcagaatgtcttcagctaaaccccctcaaatatcacattctgaaactccaggaccaattgaatcatcaataatatcgaaaataactaatgaattcaaaccattatattttaaaattgataatgattcccataaacatgctcatcatgctggtattagaggtgcaaaaaacaaaacagaatcccattttagattagaaattgttagtgatgtatttgaagggaaatcattatctgctagacatagattagtgtattcattattagctaatgaattgaaaaatgatggtgttcatgctctacaaatgaaaacgaaaacgccagaagaaatcaacaagactcaaaattaa

SEQ ID NO: 2820 - DNA, 210 bp, Candida albicans
ttgatgattacgatagtttgcaggcatacctattatttgaatgaacaatctgctcattttgctttattgctggatctagatttgaatatgaaagtgaatcatttgacattatttggagggcagcagcaacggatttctatagctagagcatatttgaaaaattctccagtactaattatggatgaaagctttagtgctctggataactga

SEQ ID NO: 2821 - DNA, 969 bp, Candida albicans
tacccactcaacccccttatgttatcacttttacaaaaacgaattgctgtaacaataaacagcaatccagcaataagcaaagcccattatgctactgcatcacaagaacctatagatcatcataaacggtttcaacttcatgaatggccaaagtccgcaaaaccttcggcatatgagatatttggattaacttccaaagatatggggatgtcaacattagagctaaataaagttcttaaaagaaaatatttagcattagtgaaaatttaccaccctgatacatccctttccattcaatataaaggtggtgaaatgaccgccgaaatgaagaggaaacgatttgatatgattcaagaagcttatgatatattgaagaatcctagacgtagaacggcatataatcggtatcaaaccacttcatgggatcaacaggggcattattcgggaaatggaggacaatggagtaaagagaattttgaagcttatagaagagcccatgctcatagaacaagatataattttaaaaatgatgaacaattttggctggctagtacctggcaagattattatcaaatgaagtataatagacctccaccaacaaaggaagaattggagaaaaacaaatacaaaatcttatttggggttattgctgttggtgtattagggtttggattacaaataatgaatgccatagataaaacaaaccagtatttgctagagactcatcgtttgaatatgaaatctatgaaagatttgaatgaaagttatgataattatggtgaaggttatagtgatgctgataaacttagaaggtttttgataaatcgaagaagcaccatgaaactgaaacgggaagaagaaggggttgaaaaggaaccagaacctagtgatcatgaactattaacaaaatttgccaggaaaagagtagatatatgggatagagaagagggcaataacgggaagcattga

SEQ ID NO: 2822 - DNA, 699 bp, Candida albicans
gcaccatcatttaacagtatcggaaaagattggtggagttggcttacttatggaaaaaactctaaaactaacaagtcgttttttttcgataagaacttaacgtcggacgatattcataacacggaggacacgttcaagagcatttacccatataaagataaaaagtatttcaatacctttgtgactcctcaggttactagaaagatgaaaattcaacgggggttatctcaaatagaacgcgctgatgtgttttcaatcaatgattccaaatttgaaattgacactatagacaacgaactttcacagacaactgacgtcaacaatagaaatgagcttttggaaaagaaatcattacttacatggagagtattaagagatcaaaggtcatctgactggttgaaagccacccaagctttacgagctaaggcagtttcagatcaagaaagaaatgctgataatgaaacaaaggaagaccattcagaagatattgctaaatctcaaaaaagaactttggctgagtctgtggatgatgattcacctgaagaaaagaaaataaggttagatgaacaaattaatagtgaaaattctgatgatgtatccgaaaaggatcctcaaaatcatgtgattagtgaagccaatgatgccagcgcggacagtgatggtgaaaatcatgatgcagttgatgtggacatcaagtag

SEQ ID NO: 2823 - DNA, 372 bp, Candida albicans
atgtgcgtgtacatgggaacaaaaaagttatccaagatttttttttttcgggaattttgtcaatgcataattttttccatcatattatcgatcacttataacagactaaccacacaccatatcaacatgatttctattactaaggttatttcccaacaatttaagctgtcaaatatcaccaagaacttatttaatgctaccccaagaataataaatccaataacaactggttcattataccagccaataagaggcttcaaagttagaacatctgtgaaatgtatgtgcaaagactgctacttggttaaaagaaaaggcagagtatacgtttactgtaagagcaatggtaaacataaacaaagacagggttag

SEQ ID NO: 2824 - DNA, 609 bp, Candida albicans
ttggttgctattttcttttatggtagagaaaaccaaccaatcgattcttcaataatgttttcattcaccagagcagttccaaaatctcaattgagatttacagtcagaaattcattcagaacttatgtttccattggtgataaggttcctgcaactccagttttcgaaggttctccaggtaatgacattaatcttgctgaagaaactgcttccggaaagacaattttaattggtgttccaggagctttctccccagcatgttcagcttcacatgttcctggatatattaaaaatattcgtgccttcaatgacaaaggctaccaaagattctttgtcgttgctgttaatgacccattcgtgacaaaagcttggggtgagcaattattggaatcggtagctggtcaacaaataagatttttcgctgattccactggtgcttttacaaaggagctcgacttgttgtttgatgccagaaaagcatttggtaacgagagatctaaaagatacgctttaatcattgaagatggtaaagtcgtcaaaagctttgttgagccagacaacacctctgtcgatgtatctgctgcacaaaaagtcttggaagaagcttaa

SEQ ID NO: 2825 - DNA, 1530 bp, Candida albicans
gtattttttatacgttcatttgtaatattaccattatctgatccaattacatttattgaatgtttaaaaattgctggagtatttattgtggggatgataatattaattcttgttgatgttaatttaataaaaggtttgaaatttgtttttaataaatttggtcataataaagatgataaaattcattctgatgaagaagtagtagtagaagaagaagaaattgaattacaaaatttacaatccaaatctaaatctaaaggtattactagtatgagagatgatattacaactatagatcttgatagtttacgtccaactgaaaataaggaagtaactccaccaccaccaccattaccacgactaccaattaatgaaaatccatttgaagatacttctgatttgattgaaccagaacccatttatcataaacctcatcacgttgatatgtttcctagaacttcttctcaaaatatatctattccaacaacaccaacaacactaccaccaccacccgaaacaaagagatcttttgaacaacaagaactagtagtggaggtagatgacgatgattctgaactttcacaaataacaatatttatcactaattatattgattggatattatattcattattatttataatttctttaccattgtattacataccatcaattcatacttgtttaccatatcatttaagtataaccataatgtcatattatattgcattattatttcatcaaagatatccaatcacaaaaaatttgcttcatccaatcattgtttccaccggattaatattatttatttgttttattggttcattgatctaccatcataattcaccaaaaggttttttagatgatttgaaattttataaaactggtaaaaattatttaaatttattcactggtatcactttaaataataattctaaatcaactttggtgccttctgataatccaacatcaactccacaatggcctggatgtggtgattttttatcatcattaatggatgtatcaattgtggcattatcattaccaatgtttactcatcggaaagatttcattaagaatgcgtcaattttaatgccaacaatattcattagtattgcattgacatttttcatttatcctgtgatttgtcatgccattggtattcaaccagaacgatcaattgggtttattggaagatcagtgacattggctttgggtacaccattaatttcagcattaggtggatctatttcattaatggccgtgtgtacaatattatcagggattttgggagttttaataaatgaaccattatttaaatttttaaaagttgataaacaagattatgtcactcgaggggtaactttaggaattaattgtggagctatcgcaacggctcatttattgaatgttgatcctagagctgcttcaatgtcaagtttaagtttttcagtgtttggtactataatggttataatggcaagtgttggtgccgttagagatttagttagaacttgggtaggactatag

SEQ ID NO: 2826 - DNA, 912 bp, Candida albicans
aatataacaacggggatcatctttccctttctcccctttactactattatcataactattactaattatgaaatggaatatgaagaacaaactaaaattaaaaccaaaaccaatataaaattattatcaaaacttacttcattatcattatcagaagcaattcgtccaacaacatttgaacaatatgttggtcaagatcatcttattaatcccatcgatggagccattagaaattttattaaattaggttatttaccatcaatgatatttactggaccttcaggtattggaaaaactacattagcttcagtgatatcatatgaatgtggattaccatttttagaattatcagcaacgacaatgacaaccatggatttaaaaaccacaataatgctaaaaaaccaaaaaaaccaaaaaaaccaaaacgttggggaacaaaaaattgtattatttattgatgaattacatcgattaactaaaattcaacaagattggttattaccatatttggaaaatggggaaattgtattgattggggcaactactatacaaccaaatacaaggattcgtcaagctattttatcacgatgtcaagtatttaaattagaaaaattgactcgtaaagaaattaaaaaagttttatgtcaagctataactttccaaaatttaaaacgtaaacatctttatcaattaggggcaattgtatatgatgatgatgatgaagaacaaggagacggagtagatgaatgttttgatttgatattggatagagctcaaggtgattgtagaattgctattaatttgattgaattaataagtgataatttccttaataatgtcaatgatataaaattactgaaaaatcaattacaaaaaattttccacagtttaaattataataataataataat

SEQ ID NO: 2827 - DNA, 384 bp, Candida albicans
gttattgaattttctgctaaagtattaattgtgggatcaatttatcaaattaatgattgtttatcatgtgccacggcaggtgtattacgtggccaaggacgacaaatgattggaggaattgttaatttaattggttattatttaattgcattaccatttgcttatactttggcatttattttccaatttggattattaggtttatggtttggaatgattattgccttgattttcgtttcatttacacaaactttttttgtcatttctagtaattggcaaaaaatcattgatgattgtattgaagaagcaatcatagaagatgggaatttaaatattgatgctcattcaatattacctagtatgagtaattcaattgttgtgtaa

SEQ ID NO: 2828 - DNA, 774 bp, Candida albicans
cggatatcaatattcatacaaatcaaatcaaatcaacaacagcaaacatcaaggcaacttatccgaataaataaccaactaccaccttcagtagtactacacaatataatcatgaaatcaatattaataacaaccggagcaaccattactttcaaatcattaatacaaataatcttatcacctcaatttcttaataatttaatccgtttaaaaatcaataaattaattattcaatatggtcatgaaatcaaaaattcaattaatttaagtgagtcatttttcaatgaaacaatcaataaatacgatttgattaatttattcaacctagaaatagaagaaactcccattggtgacgacgacgacgacgaagggatacgattatttaagaattctgatattgaaattttggcattttcatatagttcaaacattaataaatatattgaaaatgttgatttaatcattagtcatgctggtactggatcaatcattgattgtttacatttgaataaaccattaattgttattgttaatgataaattaatggataatcatcaattagaaattgctcaacaatttacaaaattgaattattgtatttattattcaattaaagagttagaacagtatgttaataacaatgataataacaaggatagtaggttttggaatcaattgaatcaattgattaatggagaattacaattgaataaattacctcaaactgatggatcaattattgaaacgataatttgtgaggaattagaaaagtaa

SEQ ID NO: 2829 - DNA, 615 bp, Candida albicans
tcaaataaattcaaactacatacacaacaaatcatacacatatatatatatatacctatcattatgtattcattatccaaaagaacattgtttcaacaattaaacaaaagaatttcatccactaccacatcttctactattataccattatcatcattatcatcatctagtcatatatctacacgtcgttatgtatctactaaagaattaacaccacaaactttacctactgatttccctttaatgtcagagaaaaaggccactaatgctgctgattatgtattaacttcattagatatgattgctaattgggcgagaaaatcctcattttggcccgttacttttggtttagcttgttgtgctgttgaaatgatgcatgtatcagcaccaagatatgatcaagatagattagggattatttttagagcttcaccacgtcaatcagatattatgattgttgctgggactttaactaataaaatggcaccagctttaagacaagtttatgatcaaatgcccgatccaaaatgggttatatctatgggatcatgtgctaatggtggagggtattatcattattcttattctgtcgttagaggttgtgatagagttatc

SEQ ID NO: 2830 - DNA, 450 bp, Candida albicans
aagaaaagaataatgttaagatctgccagtagaatatctagacataggttatatcaatctttgtcgtctcaaatcaacaagcagtcagccagatgttatgcagcagcagcctcatcgggtcctgaaaatagaccattggtaaccccattgggtagacacccacaaaagtattcgaccccagcaccagggtttggtcctactacattcactgaagtgttagatgatgttaatattacttgggataaaaacgatgacccagatagattggaaaagcaaaataccaaaattcgtcatttcactataaattttggtccacaacatccagctgctcacggtgtcttgcgtttaattttggaattacacggggaagagattgttcgttctgatcctcatgtcggattgttacataaaggtactgaaaaattaattgagtctaaaacttatatgcaa

SEQ ID NO: 2831 - DNA, 372 bp, Candida albicans
aataatatacgttcattattatatttcgaattaatacttaacctgggagttatactattaattaactttatgtgtcaagatatgttatccttctatgtatacttcgaaatatcattagcacctttatttatccttattggtttatatggtgctaataatagagataaagctgctgattatatactaatctatactttatttagtagtctatttatgttattagctataggtacatatgaagtattaataggtaatactgattatcaagctgttagtctagttgtactgtcaactgatctacaatgtatcctattcttatgtatctccgcaggtataatggttaaaacacctttagtaccagtacatacttga

SEQ ID NO: 2832 - DNA, 291 bp, Candida albicans
atagcattattaatgttagtaaatttaataggtttaatattatttcctatggtaaatgacctaatacctttatacgtaatcattgaattacaatcttactctctttacctattaactggtgtttataataaatcatataatgctactcgtgcagctatattatacttcgttacaggtggtatagcctcagtacttatattattatcatcagctgaagtatatgaagctacaggtttaactaatttatctgaaattagtacttattatagtatatcaggtattaatacttga

SEQ ID NO: 2833 - DNA, 381 bp, Candida albicans
tcacctatagtaaatgttaatcagttagtggtacctaataaagcattatgtatagccttaatagtatgtttattctccttaataggaattcctcctctacctggtttctatggtaaatattatattattgtaggtttaatgtctaatggtctaaacttagaggcattaactataatagtatttagtgttatagctacttattattatgcttatataattaaacaattagcaagtaatttatataataataatactaatgttatagcaacacctattaatagtacattaggttttataataagtatattaatggtaatattaataacattttatatgtatttaccaactctattagatgggttaacattattacatagttaa

SEQ ID NO: 2834 - DNA, 1560 bp, Candida albicans
  unsure (1526): Identity of nucleotide sequences at the above locations are unknown.
atatcaatttttgtaacaatgttagacgacgttgcattcatcaagacacctgctgctaaaaagcaaccacctgcttccaacgagtgtggtgtttggactactgattctccagctattcataatgcaccattacctgctgatggacctggttcaacttctttttcaaatacaattttgttcagtattttggcattagttccaggttacatcacttacaaattaggtttaggtttcaagacctgggtgtttttctttttgattttggcaattcctattttaatggcttattggagtattatgtctacattttctccacgtatcaatgaaaaagtcaagtacccaaacagaccaatttcttactatttagaattccatactccagaattgaaggctaaatacgaaacttccaacggtggtaaaggctctaaaatcccaattgaaactttccaagaattgtattttgatggaaaagtttcctttaaaggggactgtttggatgttttggaatacaagcacgattgggccagctttagatttacattgggtttgtttagattcttcttgttgggtatgattccagaagttattttccactctcaatcacaagacgaagaacaagttagagatcattacgatcgtggtgacgatttctacacctggtttttgggtccaagaatgatctacacttctggtgttattagtgacattaccagagaagaaactttggaagaattacaagacaacaaattgactgttatggcagataagatcgacttgaaaaaaggagatcatgttttggatattggttgtggttggggtacctggaccacttttgcctcctctaaatatggtgctaacgttactggtattactttgggtagaaaccaaaccaaatggggtaacactttattgaaggaatatggtattccatccgatcaatccagaattgtttgctgtgattatcgtgatgctccaaaatcttctaaaccaagtggtaaatatgacaaaatcacctcagtggaaatggctgaacacgttggtatcagaagattgactgcatacttggaacaatgtagagacgctttggaagacgatggtttgcttttcttgcaatactctggtttgagaaagaactggcaatatgaagatttggaatggggattgttcatgaacaaatacattttcccaggtgctgatgcctctactccattgagtttctttgctagttgtatggaatctgtagggttcgaaattgtcagtgttgataacattggtgtgcactattctgctactttgtggagatggtacagaaactggattgggaacaaagataaggttgttaacaaatacggtgtcaagtggtacagaatttgggaatttttcttaggtagttctgttgttgccagtaaaaacggtactgccacttgttatcaattcatttgcagaaagaatattaattcatatataagaattgattacgttccgcaacaaaaaggtttgcaaggtcctgttcaagaaagaactanatgggctaaggagtttaccaacttttacgattaa

SEQ ID NO: 2835 - DNA, 537 bp, Candida albicans
ccactctcaactttcataaatatgtcaagccggatcaatcttttcagatcattatttacatcaaactcacttaaatatggaataccaaagaaaaacaaactacctccaagacctaaacatttaattaaagaggaggatatagaggaaaaatttttgcatggagggaggggacctggaggtcaaaaaattaataaaacgaatagcaaagttcaattaacacatattcctacaggtatggtggtatcttgtcaagcaactagatctcaagaacaaaatagagcgattgcaagagagaaactagctttaaaattggatgatttttataatcctggaactagcagaaatgccgtgctaatggaaagagctcaaaaagtgaaacaaagtaagtctaaaaagtccaatcggaaatacaaaaaagttgaagatgaaaatatacagaaacaaatggaattatcaaaactagaagaatcgttaaacataaaagacattgatgatgaatttgatgactttatcaaaaatgctaaagtggatttatag

SEQ ID NO: 2836 - DNA, 717 bp, Candida albicans
tgcattgagaaaaacactactgatgtcattactcatttccctaaattgcttgatttaattttggtttcagcaactatccctaaagtatttgagaaaaaattatcgaaattatttcctgatcaacgttcattaattagagttgctactcctctgttacataaagttccacgtaacatcaaagtaatgactattgatgctgatgttgctccttataatggatccaaacctagatgtttagcacaagctctttatgccatatctaaagatggaactgaaccaggttacgtcaaaagaattattgttttcgtcaatgagaaatctgaagttgatgggattgttgaatcaatgattacaaaatataaagtaagaccagaagatattgttggagtttccgggtcggttaatatcagagatcggaaagatatgttacaaccatttttacaaccggcagaattgattgaaaatgatgattttggtagtacagtgaaaatattggtcactactgatttattagctcgaggattaaatttccaaggagtgaaaaatgtcatattattaggattaccgagaaattccgttgatttggttcatagattaggtcgaactggtcgaatgaatcaaaatggcagagtttttgtcattgttgataaaaaatctaagaaatcttgggtaaaaggattaggcaatgcaattattcgaggacttcgaattggttaa

SEQ ID NO: 2837 - DNA, 726 bp, Candida albicans
atcatgtctaatcaacaaggtacacagacacaagatactgattattccagtgactttgatgaatttgctgcaacgttcaacaatttcaaaccgaaagaatttaaatcaacgacagaaacaagtactttgattctgagtgctgccagactagaattagaatcaataactttgaaacaaacaatgtcagacacaataaaatcgtttctgaaacttccagttaaaaaactaacggagactcattcacaagtcaaacaactttataaagatattctggatttgaaacagacaattaatgagaccaaccaaattgttaaagaagagttgttagagattaaaaattcatttttgaacaaccaagagcaatttaacctccaaatccaagacttggtttcgaatcagtcgatggttctagaaagcaggtttctggaacaaacaaactacgttctggaaattattgggaaggagcgccaattatttgagacttcacaacaacaatgccagtataacttacaagaaaaaataaatcaacagtccatagaatacaacaaattgacaactcaaatcgaaggacaaaataaagacatacaagaaatcaaacaatttttaaaattattggtccctagaatagttggaatcgaagcatcctataaagtactttcaactgaaaatccgataatggaaagccaacaaaaaccaagaccaataaaacggaaaaaacaaagctag

SEQ ID NO: 2838 - DNA, 1113 bp, Candida albicans
caattttgttttccaacgaaaaacaatttttttgataaacacaatttcaattattacatcataaccatggaggaattgctacattcaaaaatattttggggtcgaattctaaatttggaaatgttcttatggtgctcaatggcagtcatggaacttgtgtttgttcacaatttgcaatatgtaaaggaaatgatttgtgataatattattgtcaagtttcttaggttagcatgtgattgggatattctgtttacacaatctaaagatagcttggattcactattaaaaacattgtggtatagacaaactactattttgcaaactgatgtgataactagcaacagattagttcatgtcattacattgttgctaggaatggtgcttacaactggccctgaaagcacaactgctaacgttgaaataccctttaattttttgagaacatgctatttgatgagacaagatgaatttcccctcatattagagaagatgaattgtgataaaagcttgatggaagaatttttcaataatttggtaaccaaaaatgacaatgaaactttattgagactacaaaagttcccaccatttgtgaaaagtatactcaaagagtttcaaatgttgaaagaacaacacaacaaaacagattatttgaaagtatctaatatgattagtgtgacacttcataatggtggtaaattgggacaaatgaatagtatatatatcaagagttttgaaaaagattgtgaactgatcaaaagtcaaacaatgaatgccgagttagctaaattcaataggttggtacaagataaagaagagagtattaaacatttaatttccacatatcatggattgaaaacagaaatttcaagattatttgaagatcatagcactaaaagttatgtgttggactatattgaaaatacaaatagaatgagaaaaagacttgttgttgaagatcagctaccagaatccgaacgactcacgtataatattgatgttccattgaagaaaattgattcattcactaatgcaagtgctattcaccaatatgacgctgctattactgccactgtcttcacctacggggctggcaggatccgcgcaaaggtctca

SEQ ID NO: 2839 - DNA, 1026 bp, Candida albicans
ttaattattcaactatttattacaactattacctcctattatctttgtcaatatatttatcagaaatcaaataatagttcatatactcaagacacacacacaccacccccttctatcatgagtaatccaattagtcaatatttagctctggtttcattaaactcagttcaatcaactttaaaatatgaaactgacgcggtcaccaatttattcaatcaatatcaacaagatgaatttgctattaataatataattcaaagtattaccataatgtataatactatagtggctaataatgggaaaattgttattactggagttggaaaatcatataaattagggttaaaattggtggccacattaaattctttatcaattcaatcatcatcactacatccaaccgaagcattacatggagatttaggtttaattgatcaaaatcgtgattgtttaattatggtgacttcaagtggtaataccccggaattaattcaattattacctcatttatcgtcaaatttaccaatattattattaacttgttcaaaaaattcaaaattatctcaatataatcaaattaatagtttaatactagcagaattattatcttgtcataaagaagagatcattcatggtatacctgcaccaacagtttcattcacattaagtatgatgcttgctgatgctgtgattttagcattactggaattaattgaaactgattctttgaaaaggaaaaaattatttggtttaaaacatcctggtggatctattggtgctaatttagctcaagagtttaatcaaaataatactaatagaagtggggataataccattactactactactactactaatactaatactaataatagtagtagtatcactgttcaagcaccaattattcctccatcgaatttaatgtcagcaacaacatcaacaacaacaacaagactttcatctaatagttcatcaatgttaagtcttaaagaaatggaattggaaagttattcatcggtaggatga

SEQ ID NO: 2840 - DNA, 756 bp, Candida albicans
aagattaacaaagatctatccaaccacatacacattaaaggaaccaccccttttataatgcttaggtcacaaatcatacaaactagatcatttacatcattaacaagaaatttatcatggtttggtgatatttttggtaaaaataaaaccagtattgaatccaaacaaaaacgacaagatataatcactaaacaagatgaattaactgaatcagattcaattaaaattcatcatttaacatttaaaaattctgataaatatcaatcatttactattgaacaaaatatgcccaatttccataaattgaaaaattggaaatttcaaaaatctttaacaccaaatgattatgaatcattttattctgataaatcaattttacaaaatataattaatcaagaattgaaaaatttaattcaaaaagatattattgttagtagagataattataaagatataaaattggatgatttatcatttagattccaaattgttaaatcattacaatctaaattaggtattgatataaatgattatataatcagtaaaagtcatgatttagaaacattatatgaagaaattgaaaatttggttaataaacgatggaaatttgaaagaaatccaaatgctattgtattaagatcagaagattttgatgctgaaaatatttatttgaatcaagaacgaaatgattttgaaaaaaatttggaacttcaaaaattaactcaaaaattgaaaatttctcaatctcaacaataa

SEQ ID NO: 2841 - DNA, 1908 bp, Candida albicans
  unsure (84),(100),(126): Identity of nucleotide sequences at the above locations are unknown.
aggattccaacttttcattggccaatacccaagaatttagctacgttggacaattccatgtggactaaaaaccagggaaaattnttggaaaatttttttntgtggttaagccctttattggtattnttacgaatcaatctaaattccaagaacttgtttttcaatgatcttgctttgaaacaacaacaacgaagaaatagagtcaaaatattttgggttttcaaaatcttgttgaaatgtttcaatttgaaatttggtttcaaaccaagtttaaataccaccgtgattaatcccgtgacaattgatcggtatttccaattaacaccagaaaaattgtcttctttattagatgataatgatgatttattcaacactctattgaagccaagtattgaatttctcaatttaatgaatataattatcccgtcgtcgttttcaccaaattattaccaatatctcaaacaagacagaaagaagaaagataaagataaagacaaggataaagacaaagaccaccaccatcatcatcatcaccacactactcctcaccgattagatttaatattaaatgaagatgacggtgaaggtaatgatggtaatttgaactataattatcaccaatttttaattattgacaaaaatttatcagcttggcgaaaatcattacagaataaaaagactcagttgacactgttgatggaattgggtttaccaaacttaataaacatcgttgagaatgatctttactttgatatgaattgtgatgcgttgtcacgagaaggattaatcaattattatctgacaggtttacctgatatccatactgcatcacatcttattaaattgcaattgaatttccattatatattaatcagatcaaccaattatttaaattttattgttgatcgagaattaacatttgaatactatagagaaatttctttattgtcgatggaagtgttacagtttttcttacttatttttgaacatgtaagtaaagctgaagaaaaaattaatgagccaaaagttccatccaattcgattgtcatggaaagtttaggtttagatgttgatgaagatggatttgttattaatgatttttctgtgaaacgaaggaaacttgattccaacaacaaggctactaatcaattgaagaaattggttaaagaaattcctatatcaccatttaatactatgttaaatggattatcattgtgtataataaatttgaagaaatccataattttgcaaatgttgtatttgttaatttgtcaaatgaagtttattaaacggccacaaggatgggaaagaatggatgagtcgtttgatttgttgaataaaactgtcgatttgtttattagactttttataaattataaaccaggaacgtcaaagaaagttcacgaagacaagttgtataaaaagttggtcaatgatgagttgaaagacgacattttacgacatcatcaatatggatctgatgatgaggaagaagaagaagatgatgatgatgatcagtttaatggtgctaagaagcggctgccaggatattacaagtcgattgattgggatgatgaagatttggatgaagatctcaaatatttaaaaattttgaaatttgtgaaatataaatctaatgacagtttacaaaaattccgcaaaaagcagaaacccgacaataatactaatactaatggcaatggcagtggcaacggtaatggaattcctcaaccaacttctgttacccatcatcatcacctccatcatcattctcaaccacaaactgaaactgacattgctgtaccacaactaccaatccaacattcttcttcagtgtctcctgccacagccaccaccaccaccaccagcgccagttataatggcggatgcaacaaatttatcaaatga

SEQ ID NO: 2842 - DNA, 1101 bp, Candida albicans
attaaatgttcttccggctggctcggtagaaaacgttataatggtgttgctgttgataatctgcttggatttgatcaagtgattacggcaacggttgaaattttcaaattgaaaagtaaatacgaatcagaagctttgaaattatcaaaccaattaaatactttaattaatcaattatctttagatatttctgatttgaaaaatgatttcactatggatatattgtcttgtttaaaattattggaagattcaatattggattcaacaaagttgactcatttccaaaatagttttaatcatttaaatgtaaaactcacatcattagtcaatatattacaaagatttcaaaatttccgatttgaaattaaatccgaattggtctatcaaagctatccacaaattattcaaatacttggttcaatcaaaagcatgttacaatcatttggagacattgattatattcctgcaagcaaaacgttaaacatagatcctatttccactaaattagaacaactaataacattagactctttgatcttagcagaaatcagtgaagtgatattaaacacgaacagtgaagaattattcattaaattaagtaaacttaaagatgtgaaaacaaaacacaaactggtgaaaactgaatgtgaaacaacaattgaatatttcttaggatttttccgtaaattagaaatgtttgaatcttctttacaatcatcacctcctttaaaatattttgaagctcgtgatccacctgattttgatatcacccctgatatttttaatcaatttaaaactgttattttaagacataataattgtcatcatgataaattatttagagttttacaagaacaatttgttccttcagatttttcaaatacaactcttgaatttttcactagactaataccaattaaagcttctcccatatcttcaaatgattctagttttgatttgacttcttcaacttcggttgatgatgatgatatttttgatgagttgcaacaaaaattagatttccatttactgctcacaaataataaaatttatgatatccaagaatttatacgaagatttgagaatgggtttaaattgtaa

SEQ ID NO: 2843 - DNA, 849 bp, Candida albicans
atgatatccatgaacccaattatgattagaaataatttgtcacgtagctcatcaccagcggcaccacccaccacgaatcattcttccactgttgactacttttctatcaaaccaaaattatctttggataccaacagtcaaagtgacagcaatagtacacaatctaacaacaatgaagatactcattcagaacaatcagactacaattcatatacgcacaatcaatactacgacagtgacgacgatgaggatgattttgatatacgggatcaactacttgatccatttgataaaataaccttatcaaactgtaatgaagaatattattcacctttaacaccatttgatggccaaactacctcaccacaagattcaatcatatcatccaaatcatctaataaatccaccactgtcgttccatctccacaatttcaattaactttgccaaaattaaccacttacagctttcttatagtggatgataatattattaatttgaaaattcttaatcgtattttacttaaattgtttcctaaatgtcatattgtccaaatacaagattcaaaattggttaaagatttactacataaacaactgtttgattccatatttatcgacattgagatgcctgatgtaaatggaattgatattgctcaatttgttagacaagataccaaatttgataacatgggaatggttgctgtaaccaccagaaatagtactcaagatttggaattgtttaaacaatgtggtattgattttactttccataaaccattgaactattctttggattttatggcaaattcaattgatgatataattataacaagaaaaaacaaaatataa

SEQ ID NO: 2844 - DNA, 642 bp, Candida albicans
agaccgggaatgaccgaggacaaccgagtgaataaatctcagagaaaagaattaagatcacaattggatgagtcttaccaaaataattcagaattgaaaaatgagaaagagattggaataccaaatgatcaaatactgaccagttcatgtcttgatagcaacgaagaaccaaatcatgattccaagaaaacactaaaaaattccataagtgaaaattatacatcaccagctacaaataatagttccgtgagtctgcaaaatttgcataattcgacacccaaaaccatagctgtcaatgtgaagcaaaacacaaacgggaaaagaactaaagaaaacgtcaaaaagtcagtgaaatgtgacaatgaacatgttagcaaagatataacaaaactgtctaacaatagcaagtcagtgccaacgaaatcatctgcaacagaaactgcaacaagtaacttatcacattctaaaactgcgagcaacaaggaaaatatagatgctgttcgaatgaatcgaaagataattaggaaaagaattgcttcaaaaccattatcagaaatatgcaatcagcatctgagatctagagtaggcttatcaaaacgggtcaagatagatcctttgcatcaaaaactaaagaataaataa

SEQ ID NO: 2845 - DNA, 432 bp, Candida albicans
tgcctttcacaaatagatcgttcacttatttcagcaatgctatcgaaaattaaattattggggtcacgtaaatgtttctcaacctggtctattttggctcacgaaaatccattaggaataccgagattggctggtaaaccaaattcaattccaaaagcatcaaagggtttaccaatacgacagaaaattcctaacgtgtcgaacataatattgatttcatcagcaaagggaggggttggaaaatccactgtatctgtaaacaccgcattggcattgaacagtctaggcaaaaaagttggaatattagatgcagatatttttggtccttcaatacccaagctaatgaacctaaagggtgaaccacgattatcgagtctgggtaaattacttccgttatccaattatggtgtacaaagtacgtttatgggatag

SEQ ID NO: 2846 - DNA, 1125 bp, Candida albicans
gataatggttctttacctgaactagaaagttttatatgttgggattgctcgattcacaatgcaggagattttgacaagtcattatcaatttttcctccaaatttgaagacattagaactcgaaacttgcaagtttgtaaatgcagactttagtaattgggaacttcctaatacattggagagtttatatgtttctgatctgccttttaaggatggttttttgggtgagtatctaaaggatgtcgacgttagtgggaacgaactcacacttgatagtaactttagaatctttcatatggtcgaaaaattcatattgcacccccagtatctaacttttgaaagtctggattttatgtatcatttaccaaatagccttataaagttgcacttgatttcccggaagcagggaaggttaagccctctcatccaaatggttaaatggccaccgtcattatgtgatattactttagagaactttaatattgatcagtccatgttagagttcttgaattttaaagaatctaggcttgagaaaattaaaattattaaaggtgacgtcaaaaggttcattgctgatctatttccggtcactgtcagaaatctatccttgaagtatatgggaatccagcaattgtcagattcttttgaaaatttggaaaatttacgcaagttgtctttaaagggaaaccaactaagaaaagtaaaccctgtaaaattgccaatgtcaacgttagagactttaaacctatatcaatgtaaccttcgtttgatatctccatttttggtttcaatgctcgaggaaaagaacaaaaatgcagaactaaaagtttacgcttgggggaatacaaatattagtgtcattgatataagaacagcattgaaatcaattaaaggactttcattggagctcaatgactttgataaaacattgacagaaatatccaaacattcttcccgtttacaatgtaagtattttgtatatgatccttattctaaggagtctaaatcttctgcaacagaagaggttgcccttgactatgatccagatgatctttacgatggaagcgatgttagtctggatgaagaagatgttggcggtggtgatactaacagaagaaaaatgtaa

SEQ ID NO: 2847 - DNA, 1569 bp, Candida albicans
  unsure (182): Identity of nucleotide sequences at the above locations are unknown.
gaatataattatattcccacaattaataaaacttttaaacagtttgttgataaattgaaatcaattgaatttattaatgatttaataaattggataaatgaaatttatataaaattgggtacatctaaacatgcattgaaattacaacaaaaatcaaattttttacaaaatgaaatcaaaantttagttacatttgatgattttaatcctaaagaaattaaaaataatgtattgcaaatagttaaagatatgcttggtgaaaaatcaattgatgagaaatcgattgaacaaactttgactgatgaaccaactggagatgaaataccattggaattaactccaaatgaacaaactatttccagtgaaaccgcaaataataatgtatcaggtgatgatgaagtgcatgtggaagaagtttctgcagaagagactccagatgaagaagtgcctgttgaagagaccccgattgaagaagcgcctattgaagaaattccaactgaagaggaaccaattgaagaaacctttaaggaagaaaccacaattgaggaaacccctactgaagaaatctttattgaagaaacccatattgaagataccccaattgaaaagtataaggctgaggttgaggaggaagaggaggttgttattgaagaagaagttgtggttgaggaagatgaaattgaaattgaaccagaaattccaagtagcaatgatgatgaagatgaagacgattctgaacttgaaccggaaactatacatttaacatcaactattgtggtaactcaaagtgaaagtgaagtcactggcgttaatgatgctgtttcaactgatgatcctgtttggggaccaattcttcatgaaatcaattattgggaaacaaaagttaataaaactatgatattagctcttaataatttaaaaattgaaatgaaacctaaaattgatgaaattattaacgatataaaaccggaaattagtgatattttacaagatttacaaaaaaccaattatgaacaatatcaattaattcatcggaaaatatcacaaattaataaagattatgaagaaatcaaattaactaataatagtttgattgaaaccattactcgtcaagaaattagagatgatatttcaaattgtacaaaaacttctgaagatgcatcactgaagattcaagaaatcctaaacaataatcatgaaaaacttttgacaattttttatgaagtattacaagacacgatagatattttagaaacatcgagtgaatctgttataaatgaatttaaaaatcaattgaattatttcatttatcaatctgacctcaaggatgatgatgaaataaattggacaatttggaaaaaatatcataaaattaaagaatcattatttgaatttagagataatttaattaaagatgctgatgattatcaagtagataataaaaaaaattctgttgataaattaacaaatgattcattgaatgaatgggataattatttgaaaaatattgaatttcatttgaattttttgattagtgataatattgaatttttacaatttcttcaccac

SEQ ID NO: 2848 - DNA, 981 bp, Candida albicans
ggagttattcggaccctttcaagccgtatattagttcaggatcagtttttctttgatttccacacccaggaaccgctgttattaccaaaggaagttattattagactcattccaaaattaataaagccccttaaaatttataaagactgggaacgtgattttaaggaacatcttattgaaaatgatgtagtccaatacaatgaactattaggaaaaatgtccagggtcaatcttgcaataaacaaggctgctgccatttatgaaaagttgtcgacttcggtcacattaccaaatttccttatatcacggaaaactttagaaaaattcaatgacgagtcgttaattgaagttgctaaaaaatccaacaaagatggaaatgatcagttacccagaaacgtgcaattaaaacagcttttttcgttagaggcatcatcgactttacctttaccggaattcaaggtgatcaatcagttaatcaatattgagtaccgtttgagattggaaaaacggatacaattggagttgttgactttgataaagcaaaagctcaattccgaaaatagagaatgggcgaaaaatcttgattctttggatagattcattacgcagagcattccagaagcgatttcccaagtagaaagaatcaaagcacaggagcttgatgccaggtctaaaaagattgaacaggagagtgactcgctggatgatgaagagagtgagatccaagacgtggaaagagatgacgatgatatggagcatagaagagaagaagtagacgtggaagataatgaaatgggcaaagagtcagatgtcgagagtgacgttcagcactcaccaatcgataccactagtctgcccctcccgtctgatcatcacgaagatgaggaagacctcgaactgcatattcaccaagaaataacagcaccagatgattccaacaccgacaatgatgaggacgaagatatgctacttgatcattga

SEQ ID NO: 2849 - DNA, 417 bp, Candida albicans
atgacattactgaaacagacaccaccacaacagcaacaactactgcataatgaactattacaacaagccaaattaaatcaaatcaatgatttaaaaaattctcaattatattcaaaacaattaattcaaacattacaatcattaattaaatctaattctaatacattgctgccttcatctggtttaattgataaaattaccacgattcatcaattaaataatgaaattgataaacaattgaatcatgatatagcacaaaattattatgaattgattcaatataaacaaaaactagaaaaagttattaaagattgtcattatgtaattaatgaaattgataatttacaatttaaaagtgaattaattgatcaaaatttacgaatattagaacatacattaaaattaattaaaaaataa

SEQ ID NO: 2850 - DNA, 597 bp, Candida albicans
  unsure (7),(13): Identity of nucleotide sequences at the above locations are unknown.
atgatantgcatnacataatattactgttgtggtcactactattattagccagtaccaacaatgacgagcactacacccaagccgttattggattggaacagcttgcaagaaatttcacaagacccaatgtatacaatattgacaatatcgaggggaacttgtacataccccagtttgatcaattgacaaatgactataaatcaaaacaggagaagccacagccaccactagaattaactcgacgcattatcccacttttgaaaaagtcagcatcagaatcccgtaatgtcaatgcactagtaactttgggagacctatacttgtttggaaattactcattgactccagactattacatggcaaaagagtattatcaggaagcagtaagtttggctcccaatggtcatgcatatttcatgttaggttacatatattccacgggtttgtttggaacgtttccagtggaccaagaacgaggagttttatactatcaatttgcagtggaaaatggtgacaggaatgcccaaatggtcatggcctacaaaaactttaaaggtttgggagtgccgaaaaattgtgagttggcattggagtat

SEQ ID NO: 2851 - DNA, 1191 bp, Candida albicans
atgagaatgaatggaggtgatccacatacgagtgagcatcacaaggaaatttacacatacatgaaggatgcggtgtaccaccgagacacagaggctttatattatatggggagctttttacaatctggtttatccaaaattgccgactcaaaaaatgatatttcctgccctaacatagtcatgtactaccgtgttttccttgaaaggttatcttccttttacgcgccacatttgaagtttgcttttgaagagttgatcgctgggaactaccaaaatgctcttattggatatctgatagcggccgagcatgggtttgaagaagcccaaatatcagctgcatacttgttatatcaattacaaccactttattccaaacaaccaccaaaaacttttgttcctgaaagagttgaaatggcagtggattatcttgaaagagcgtcaaaacagtcaaatgtagacgctactattttacttggtgatttatattcaggtcaagcaggagcttctcatattacaccagactttgatcgggcattcaattattaccgaacagcggcggaaagagaatcatctcatggtgcctataaacttgccgaaatgtatgagtatggaataggaccagcaaataactcggtggactactttatggcgaaacgttattatgactttagtctaaaatacaatgaaatgctcaatcatgcgaaactggaatcaccatctcaattcgtatctggcaaaacacacatcgactgggctctattgagattgcgcttgaaatatttatttaatagactggcttccaaacagtcaggaaactccgatggcgggtggttaagtgcatttaaaaaagtgggtaacagagtacccaacgaagtccctcaagactccaatagcatttcaagagcgaatgcacatcatgagggtggcacgtataatgatgatttgattgaagagtacgatattggggattacttggtaattgctatgacgtttatatttttctttgtgttttttgtacaaaacatcttgagacagtttagaagaatgagaaacggtcaacggagagatgaagcaaataacaacaacaataacggtgacgataatgatgacaatcaagggcaaaatggctggaatggtaatcaattccatttcaaaagaggtaattttgaatttcatttctttgctatatag

SEQ ID NO: 2852 - DNA, 594 bp, Candida albicans
cagaataatgagattaaaaccgaaaaattattattacagtatttgttaatgatagaaccaatactaaaatccacccatcaatctgatttaaatcaatctgaacagcgaatactgaacatgctaaatgagctttacaattatgacgaaaatgataccggcttggtttttcaaaagatagctaacagtaaaaaacaaaatgacttgcaatcaggaaattataatttgattaaaaatgtagtcaaaccaatacttgacggtctaggcgagttaaacaaaacacttatgacattaaataaagaatatgttagcaagaaacaagctcaagtggaaaacgaccctgaggaaggtgccaagcggaaacagtattatgagcttgtcaggaaatggagagaacttgagaatatggtaactgaaatcccggtattgatatcggacctacctatcaattggtatgatgatcccacgttactacaaataatgcaagaagtagacgaaattcaaataaagttgaatacataccagctgataattaatgaggacacgatatctgcatacagtacaacagaactcctagctttagaatttccatgttga

SEQ ID NO: 2853 - DNA, 807 bp, Candida albicans
ctcaaagaaacttaccttacgatgtttagatctgtgatagcccaacaacgatttgttcttccaagattggccattcacccaagaatactgcgctcaattcttttttgcccatcaaactctttccattcctcatcacaatgcttggccaaaagaaagaataagaaaagtagcaataaaaacgacgaagaattagattcttcagaaaaagctgatgaaaatgccgaagttactattgattttcagaaagttacatcaaattttgataatgttttgtctaaattcaataaggcagctacagatatcaagttgggtaagctcaatcctaagatttttgacaatttggaagttaacattggcaaccatggacatgaagaattggtcccatttacatctgttgcacaaacttctgtaaaaggaagaaactttattatcaacttgtttgatgctggttacggtaaacatgtcatcaactccattataggatcaggattgaatatgagcggtactattgaccctactaataaatttcaaattaaagtacctattccaaatataactacagagactaaacaagaaaatatcaaacaattgaaagaaattttcgaaaatcttaagaataatcataaatcaaattctttaaattacgttagaagtgaagctagaaacaaatttcaatcatcattaaaacataataaaattagtgatagtcaacaccaacttttgaagaaattagagactttacacaaaacttatgtagataagttaactgatgcattcaagcaagctgaaaaaagtattcttaaatag

SEQ ID NO: 2854 - DNA, 906 bp, Candida albicans
cgcgtgtccgtccagccccgtggtgaagattcctccagtgctaaagatgatgatgaaatatctgacatagaaacgagttcagtttcacagggaaatggcaatggtatcattgagcaaccagaagttctgtcatcaagaagttccaacggaacacttgtaagaaagagagagcatccagaggaatcattagccccatcaaagagatcaaaagtttgtgagagcacaaattctgctgaagatgggttgaaggttacaaaaacacagttgaatgcaaatgaaaaatcattaccattggacgatgaaattgcacttgagaataaacagggagaactaaaaatgagcaaagttgatgtggacttcaatgggcaacaaggagaaaatattcaagttgattcatgtaacttttcgagcattaataacaattctctggaccctaaaacatttgcagaatctattgttagtactgatggtgaagaaaaatctgagaatggtgaaattccaccagccaaggaactcgatattgaatgtactacatcgcctgatttaaagaattctgataattcagctatattagaaaccaacaatgatatcaacaagaaagatacagaggaagaaaaagagaaaatgaaagaggagcaatattcgatggtacaagaggctccttcgtattttttgccattaaaagaatttgaagaaatcaaatctaaaaaagaaattgatgatgactttgaaaattcagtgggataccgttcaaatggaattagcaagtcttacagtccgatggacttggttgatttactttctacaaagtctgatgctgagttggcatgtataacaagtgacgaaaagtacgaaatggaaaccaagttgctaaatttgatggttcgtttaagaaacttaaaatag

SEQ ID NO: 2855 - DNA, 936 bp, Candida albicans
atcaaaactagtcatcttttaatgcatcaccttaaatattcaccactttctatattcattacaaaacactcaatgataaactcgatacggttattatccactcaagctagcaacaatcttactcattaccagatattagatatacctgcaacagcatcgattaaagaaatcaaacttcagtttaagaaactactgaagaaatatcacccagatttaaaccaacatttatcagatgatgagagggatgccataaaggagaaatatatgcagatgatcagctcctatgaggtattgaaggatttgaaacggaaaaaagcctacgatcaatcaatcaatttgaatcataaacgtgaatggaacaacaagtattatggggaagctaaatatcattcaaaaaccaataaatcatataattacacgtctctgggactaaatactaaacgacataaagttaggttccacaatggatatactccagataataccaacgctaatgccaaattcaccggagaacatgtaaactatggcgaccgatatgacgtgcctcattttgattacgaaaagcatctaaatcgaaatttgaaatttgagcaacgattaattgataaatacttggaccaaagcactcagaccaaaatattaaatcaaatcactcgatcaaaccacgatgatattctgcaagaattaaaaaccaaacatttactacgtcatgtcaacatgatcaggaatactaacacttcttattcgggatcgacttcctcaccgaaatatggagaatcaactactttcaacggatcatctgcatcaacggcttttcatcaaaatatttatcaaaaacctcgttctaccgatgaagattcctccatgttcaaagcatttgcaatacttggtggtgcaggtagttcgctatatttgctttaccaggtggtattctaa

SEQ ID NO: 2856 - DNA, 597 bp, Candida albicans
aatatgggtattccattccctgatattgacccttatgaaacattaggggtatcaaaggactgtagtccactagagattaaaaaaacatataaaaaactttgtctcaaataccatcccgacaagttacgacaaaacaacaatgataatgacaaggataaacaacaagatatgttcaccaaaatacaatttgcattcagtatattaaatgatcccgtgaaaaggaagagatatgacaatacaggatcattagcagattatgatttagaagatgaagggtttgattggaaagattattttgaatccattaatgaaaaaataaccgttgagatggttgaagaagacagattaaaatatcaaggttccgaagaggaaaaatatgatattttgaacaatttcatttattacgatggagattttcttaaattatttgaattgattccacatttagaattcactgaatcagaagaacaaagagtttataagattattgataaagagttgaataatttacaagtcaatgatagtgtacgaaaatcatgggagaaatatactaaatccagaaaaacttcttcaccacggcgtggaaggaccaagtcc

SEQ ID NO: 2857 - DNA, 981 bp, Candida albicans
attttcaacttattttacaacttgatcttaatagatgcacctattccaagcgatcttccattcatgatagcaactcaacaaaatataatagataagttaattgatatatgttggaaacgagtaagaggaacttctgactttatatttttatcccagatccgacctattatcaatgaaattcaagatatattgcagaaagattcactatttaatgaacgagaaaatgaaatcatcaaacaatttatacaaagtgatcctatgaagaaacttcaaaagcaggagctcaaaaagtttatagaccgatctgttgagtttgggaattatgaaatatttttgttcaatagacataaactaacgtcatatgaaattaaacgacgaattgaacaaaatagcttactgaatgattctatggcaaatactaaaataccaagactcttgcctaatcgtgagtataagtacaaagtttgggatgagttgagacaaaaagacgattatatcaaagaaaaaacacaggccctagaatcgaaagatttgaagtattcgctgctgttgtctcaaattgatgaacaattgcttgcagtaaagaccctcaagggtgaaaatcttacacttaaaaagcaaatactagagcttaaatcacaactatcgaggcaaccaccagtgaacaaatcaaatgctgtttatcatttgcaattgaaagaacgcgatttgactatcaaaaaattggaccaagttggtaaagagtataaaaaacgtatacatcagttggagcagcaacaactcgaaacaagcaaggctatgaataaactcaaacaaagcatacttgagcatgataagctagtgggaagactaaaggaaaagtcgatcaccccgactaatgatgatacatctaacctaaagaagtttgtaactactttgcccataataaagcaatggtacattttgcttatatacaaaatggataataacagcatcaagatg

SEQ ID NO: 2858 - DNA, 861 bp, Candida albicans
  unsure (95),(101): Identity of nucleotide sequences at the above locations are unknown.
gaacaaatacttattaagaaaagtgtacaacttcataatgatattgattctttgatttcaaagttagaaagtttagttgaagcagttgatattgntagccnagacaaacaaagacttattcaaattaccaccacgaaaatcaatttgattataaatgaatttgaaaccaatccaaaactattagattctcatttgcaaaattatattactcgattatgtgatttatatttgaatcaattatcagttcgatcacattgtggtgaaattgtttataatttggccaaaattcgacaaatgaaaaatataattttatatttccctagtgatttatatttaatcaataaaatactatcaattgtaacaacaaccacaaaagccaatgagtttataacattttttgctttattatggatttgtaatttgagtttgttaccattcccattgaattctattgataaaaatttatcaataacaatctataaattaggtattgaaaatttacataaatatcataatgggagtaaaaatcaaattgcttcactgattttattatcaaaattattaactagaaatgattgttctcatttacttcaacaatttttccaaaatatagatatcaataattgggttattctagatgcaaattctaaattaagttattatttaacggtgaataaattattgaaaagtcaaaatattgttggtgaagatgaactattgaaaataaatcaatgtataaataatgatttattgcaactgaagagtttaaacccttcaaatttgaatgtattgtatctggttaaaatatttagtaaattggccttaaattatatttcacgagggatttctcccaaaatctga

SEQ ID NO: 2859 - DNA, 615 bp, Candida albicans
aaacgtagaaatatgattcatttaaatagtgatgaagaaccaaactctaacctaactgctcgtactccagcaacttctacacccactccttctacttctactgctactactactgctactactgctactactagcaataaccacataccagtaataactagcccagttccaagctcttcatcaagaccaataccaaacactgctgccaatcaaaccgttgttgaaactttctatacaaatcaacttcatcaaacaatcacagaccaattaatcagttttagacaagaattgacaagtaataatgaaattttggttgaaagaaaccatcaaggtgctgcattaggagatttattagatcaaagaattaaaaaattagaaaccactctaattaaaactaataatcaattcaagaaaaaatttgaaaaattgactactgatcatttcaataagattaatagcatcacaaatgagtttctattggaacaaaaagatttaactaggcaaattaagcagctattcaatcaagatcctcaaaataatgaaaatttacaactgagaattactaaaattgaggaattgtatgaaagtttactcaacaaaagaaaatcactgtga

SEQ ID NO: 2860 - DNA, 975 bp, Candida albicans
tacttgcaatcccatattggagaaagggaccagtataattttttgcatatatacactaccaaatgcactacataccatctcttcatcctgaaaaaattagaaatcagatattttggtgatgcatggtttcaaacaagggacattactatcaatatgggagcatctacatcgaaacaaggaggcagaaaattagccaaatcagtctctgaaagcgcagcgaaaaccattaatagaacatccaatgtaaatcaattgccactgcaaaatttgcgagataaatttgaacaacaacataaagacaatctggtttctcaaggtgatgaaaaatcccatcaagatgaaataagtcagcattcgttccgaccagattcaactaccaagtttgatcccaagtttttacggaaaaaattaaataatgaaacaacttcagcttttgaaggtaaagatggcggagacccacatgaacaaggaacatcaacatatgataagagctttatagactcagtatcgaaattaggaactcaaatcaagaccattgagtttgatccttacaaagataagaatgcgttgcccttaagacagttgcgttcacgaaagaaactatacgatttaggagaacaagaattaaaagatttaatggaaccgactagtctgcgaaacgaggttgaaaagacaatggtccatcctcagacattaagtgccatattgcgagatttagatgatccacgtgtggataacaaggaaatccataaagactatcaattggaacccgatttcttgaaaaaattaggtactagtatacgacttccgaaaacaacagtggtaatagaagaagttgtgaaaaaggatgaagttggccataaaaaagtggttccgcggaaacgccatgaagaagctgaaataatcgaggacgaccatgggttggaaaaggatcaatatgataaattaaaaaaaagattgagtttggatgattga

SEQ ID NO: 2861 - DNA, 672 bp, Candida albicans
cactatggagtatccaccctgttcaaactagcaaatttacataagcacgtcatcaagcatcaaatgtcaagtaatcctgctaaacatattggcatcaagcaacaaaagttgatagaggaaagtataaagaactatgtggtatactatgacaaaactttcagtctgtatttaaaattacgaagtgacatattagagcttcacaatactgtgcgtttattatcaactcacaaagagaaaagaaacacttcaaatccagatgataatgaaactaaagaggaagttagtacagcagaagaaaacagcatcagcaaggatgaaatcgaacctgacaatattaaaatagacgaagcagatgccgagtcgttcaaaaataagctagcggaggctgcagttagattagaacaattgaaatttgaggcagacaaagttcagatcacctatgaatcatatttgaatgagttaagaaatattttggcgatcgagtctcgcaagcatgcagaaggttaccaacctgaagttctaacagacgcaaagaataaattgagctcactagttaaccaagagacggaattgaatgccaaaatcgacgacataaaaaccgtgcagaagcctttattagacaaagtcactaaccttgtcagcaattttaattcaaacattactatatccagc

SEQ ID NO: 2862 - DNA, 624 bp, Candida albicans
aacaacttcaacatggttaaacaagaagactttgctgtagagcagtttatggataaatatgagactaaaatcgagtggaacatggcagagacgtgtactgcttccctcagtttcaatgaattgtttgaattgattcccgacaagtcagtatcccaatcacttcaacagaaagtgtttgatacacggttaacttatgggcgtattaaaggatctccagaattgaaacaggtaattgctcagttgtacaatgatgaaggagggtcaattactgctgacgatatagttatcactaatggggctattggtgccaactttttgacattgtatgctatagttgaccaaggggataaagtaattgtagtaaatccaacgtaccagcaattagcatcggtctcaagagttttttctggagcttcagaaaacattattccatggaatttgaattttgaggacaattatttaccaaatttagacgaattgcaaaacttggtcgacacgcacaatcccaaacttgttattattaacaaccctaataacccaacaggagtcgtgtggggccataccattatggaaaagattgttgggatttgttctgctaaaggtatctacattttgtgcgatgaa

SEQ ID NO: 2863 - DNA, 867 bp, Candida albicans
cattcgttttcatccgattactccatgtcctcctcatcgttaccaccacctacaacaacaacatctacaacacacattgccattttagttttacaatcctacattccaaatgtcactgaaaaacatggtgattttggtgataatataattgatcttttgaatcgggctcaaatcaactaccccatgatcaaatatcaattatgtactgatgacgaatcacaattatgtgaaacgtaccaacaattaaatcgaaacctctcggcaaatctaatcactggaattgttttgagtgggtcaaaaaatgatgcctttgataattcaaaattatggatcaacaaattggatgaatttattgtggatacattattcaaattatcaacaaaattacctattgtgggaatttgttttggtcaccaaatattggccaaaaatttaggctgtaaaattggtagaaatgaattgggttgggaagcaggaactcatactattgaattgaatcaagaaattttcaaaatcgaaaacactccattcttgccagcgttagtatcaccaaaggatactagtaacagcaatggtgataatgacaatgacaacaatcctgaaaatcaagtcatattggatcatttgaatttggttgaatcacatcaagatataatccatgggttacctacaattactggatttgaagatatggtgagtattggatcaacagttaaatgtaatattcaaggaatgatgaccaccaagacttgtccaatacgattattgactttccagggccatccagaattcactacttcgattgaattggatattttgaaaaactcttacgagcatggtgtgtgtaatgaacaagaatatgaataa

SEQ ID NO: 2864 - DNA, 615 bp, Candida albicans
catcaccacataatgcaagttaaaaacaaagccaaattaaaagacaagaatgttgcaataaccttggtacccgaagattccgaggatttatggtatttgtacaacttactaaagaaaggagacacggtgcaattggttactcaccgtaatgtcaagaagggaaaccaagctcaaatcacaaaggggaaaagcaaaatggaaaagattgtggttagattgaagttactagtagaagacatagactacattgcttctgatcaaaccatgagaatcaatggtaaatctttagtgcaacaagaatatatccctttgaacagtatccacaccgctgaggttgaattgaataaagaattgactattttgaaagataactgggatgaatacgacatgactttattaaacgagttgtgttctattgagaataaagctgacattggtgcagttgttttccaagaaggtgtggcacacattcgttatgtggctgattccatgactgttctaaaagccaaagttgaaaagtctatcccacgaaagaataacgaatacggcactacagatttgggaaaacgccacgaattcttttttcaatacggatccatatcgaagcatgaataa

SEQ ID NO: 2865 - DNA, 2103 bp, Candida albicans
ggtcgttcaagtgatagggggtctgcttggggtttgtggcaactgttttctttttctaaacgatattggttgataaaaatgttatttaaaatatctttcccgtacagacaactctgtggatttttgcttggtgatagagttgaactcgtcaaatttatgaatcagccacaatatgccagtgatatttccataagtggagttgaagaaactgttactgaagatgtgagactggcattgcttgatattggattagtttatcctgggttgcaaataaatgttgacaacaagagaattaccattgttgatgtaaacgacagtttggatgcatccatggacaaattatcaatcaaggatagtgactccttattgtctgttcacactgtgtcaccaccatatttgttctcaccaacaacgtctatcaatgtagcaacactgtcattccctgcacggtccaagtatcccaacttaccacaacaaatcacatacgatcaagttggcgggttatcaaagcaaattgaattgttaaaatcaactattgaacttccattgaataatccaactttattttctgattttgggatttcaccaccacgaggaattttattacatggtccacccggaacaggtaaaaccatgcttttaagatgtgtggcaaactctattactgaagcacatgtcttaacaatcaatggtcccagtatcgtctctaaatatttgggtgaaacagaaaacgccattcgagacattttcaatgaagctaagaaattccaaccatcgattattttcatggatgaaattgattcaatagcacccagcaggacttcagacgattcaggcgagacagaatcaagagtggtagcacaattattgaccgttatggacggaatgggcgataatggaagaattgttgttattggtgctaccaaccgtcccaactcaattgactcggcgttaagaagaccaggaagatttgatcaagaagttgaaatcgggataccagatgttgaagctcgtgaagagattttgaccaaacagtttgcaaagatgaattctgaaaagtgtcaaataactaaagaagagattgcaagtattgcttccaaaacccatgggtatgttggagcagatttgacggcgctatgtcgggaatcagtgatgaaagcaatcaatcgtggcctaactgttggtattccacaaaccgcgattaaagtgacagttgacgatgtgtaccatgcgttgccggaaatcagaccgagtgccatgcgtgagattttcttggaaatgcccaaagtacattggtcggatattgggggacaagaagaattgaaacggaaactaattgaggttgttcaattacccttggaagctagtgattcatttaaaaacttaggtgtctcttcacccaagggggttttactttacggccctccaggttgttcgaaaactttaactgccaaagctttggcaactgaatctggacttaatttcttggcggtcaaaggtccagagattttcaacaaatatgttggtgaatcagaaagagccattcgagaaatctttcgcaaggctagggctgcatcgccgtcgataatttttttcgatgagattgatgctattgctggtgatagagacggggatagttcaaccacggcggcactgaatgtgctcacgtctttgcttaatgagattgacggggttgaagaattgaaaggtgtggttattgttggtgccacaaataagccaacagaaattgatccagcattgttgagaccaggacgattggatcgtcatatatacgttgccccgccagactatgatgccagattgcaaatattgcaaaaatgcagtcgcaagttcaatttacaaagcggagacgaatctgtggatttgcaaaagttggcagaattgactgatgggtgctatggtgcagaggtaacattattgtgccaggaagcagggttggctgctattatggagaataaagaagcaaccacagttactaacaaacatttcgagcacgcactcaaaggcatatcaagaggtataactccggaaatgttggaatactatgaaaaattttcaaagaaaagtgggttaaatatataa

SEQ ID NO: 2866 - DNA, 882 bp, Candida albicans
attcatatttccttcggccggctcgtgcaaatccatggatgtggacccgttagcttaaacgcaaataaagaagacatgatcaagaaatttgagcaaaaatcagaggctgaaaagttgtcaaccattaaaaagtttttaaacatgcatccagatccattgaatcaagaacaattggcacctttggctatcacgtatcaagattttgtaaatgcacttcccagtgtccagcccagtgccaagagagagggattcgcaactattccagatgtcacatggcaaaacgtgggcgctttattcaagatcagaatggaattgcatatgtgtatagtgcagccaatcaaaaagcctgagttgtatttgaaggttggtattgctgctccagctggtgttttgatgtggggacctccaggttgtggtaaaacgctattagctaaagctgttgctaacgaatcccgcgcaaactttatttctataaaaggaccagaattattgaacaagtatgtcggggagtctgaaaaggctgtgcgacaagttttccaaagagctcgagcctctacgccgtgtattattttctttgatgagttggatgcgttggtcccaaggagagatacttcaatgtcagagtcgagctctagagtcgttaatactttattgacagaattagatggtttgaatgatagaaaaggagtatttgtcataggtgccactaatagaccagatatgattgatcccgcaatgcttagaccgggtaggcttgacaagactttgtacattgaattacccactcctgaggagagattggaaattttgaaaacattagtacgcaccaacaatagtcccttgcacagaaatgttgatttgaatgcgatttcgagagacccc

SEQ ID NO: 2867 - DNA, 549 bp, Candida albicans
aaaattcaacaggatttaataatcaccaatcctaatttaatgattgatatgtcatcaataataactaatgaaatggaagaaaattcaattcaattagtgaatattgtggaaagtatagccaaagaaaactttaaattcaccaaattcatgtcgagtattaaagaatattttactaaagtgaacatgtcattatccgattttaaatatcgagatttggaaacagaaaaattacctacaccaactgatttgattgatttgaaagaaattactgctgatccagaaaccataaaggaatatttcactgaaattgaaccaagtgaaattatagcaagaacaatattaaatgaatgttataaattatatcataatattgaaacattactaaactatataagtcaaaatgatccattggataaagataatgaatcagcaatagcaaaattacaacaagatttggaagtaatgaaatcaaattggcaagatgctttgaaaacatcagaaaattggaaaaaattggctgagcaacaacaaaaacatctttcaacctag

SEQ ID NO: 2868 - DNA, 1176 bp, Candida albicans
tgggaaaagtcgcctcaatactggacaactttcagtggctactacagagaaataagaaatatatgccatcaagtaagtttaccatttgctaaagatcagattttacaagtgtatgggaatattactgagttttacagaacattaatggatgaaatgactaattcgaacaaatacacagaaaacatacaaaatgaacttaaagctaaatttgataagttgataggtgtcatagatcttatactagcagacagagaaaagaatagagaagatctcaaaagctcattcaatatgtttaagaacaattttgaaaaatcattgaataatgcattggtggtgatgaagcactcttatgaagatgcaaattcaaatgtaaaggagttggaaagtcatttgaattattttatcaatgatatgctgcaagtttatattcttattaatgaaaaagcattggaggtgaaatcacaacaggatagaatcaaagagcacaatgcagatattttaaatcaaatagaggaaatcaaaaagaatcttgataatgcgtatgaagaagcactggaagtacaaatatccaataatcaattggttcatgatatacaaagtagtttggattacagtcttttcacagtgtctaatttgaattcacatcttcaacttagtattaatgattttattgagaaaaatgaagatattcgaagccgtgctccaatcatatttgaagaaatatttggactatttttgaatcatttgaatgaatcgggtcagcttgccatggattcgtttgaagcggctctcgatttatccttgaatatgctacatcaaaaattaaatcaaacagaaagatcaattgacaatctcaactccaaagtttcagatcttgctcattttgcagattcactcaaaaaatatgcttcaagtatttttaatgtaccaaattacgtgagaacttcaatgaatcataagatacagcaatggagggaatttggaaatattatggtagttgggggtgttttcttttttgttgtgctaactttacttgttctctcattcataagaacacaggttatgaaggtattcagatttgcatttattggcataccaatgattacgggaattgcattagctatattcatcttaaggctcttgagtatgcctatgaaagttgttgatatagattaa

SEQ ID NO: 2869 - DNA, 822 bp, Candida albicans
tttatgctgtcaaaagttccagttgctggacaaatgtgtactactagccaacaaaaaaaaaaggacgtgttcatatttattcgtgcagttgaaaaaaaaaaaaaaaccacaataattgaagcagaaaaattggtaagctttacacacacttttccacatggatacgagtgtttacaaacatcgaatcagttcttcaaacgcactacgatggacaactcatatgatgacttgctggcaatctcaacattggtactgtcacttagtcagaatgtgagtgactcggaagaatatataacgaaacttcaaagcttatcaaaaaatctagtatcgaaagaccaatacgaacaactatcaaaagaggctgacgttttaaccgagtccaataacaatgctaatgacaatgatgaaatgtcaattatacgcaaattggaagaagaaagattatctttgattatggacattcagcgagaggattttgtttcttccaagttgattgaattgattgatcaaaatcaagaaataatcgagtcggttaaagaatacctagaggccagggaatcaatacaagaagaggaggcggcttacaccaagaagcaactagatatatttgtaaatgatattgtgctacctattttggctcagctaaatgaaaatttgactggattgctggcgaggatgaaaaatgttgctcggaaacttctcagaatacaactcagagccaaggaaaaccccgatttagcaatgtccgaaaactaccggaaggaatttaccgagttggtccaatgcttttgctcattatgtaaggaatacaaaactacttag

SEQ ID NO: 2870 - DNA, 3027 bp, Candida albicans
catcctccatcaatcgatcattcttccaacaatataaaccaacagcaatttgcaatgccaaatctaccaagtattctgatcccgccagaaacaccaagagctaaagctaaggactctaacacatcaaatttaggaagtgtgaatcgaaatatcctaactccttctttctcatttggtttgaactttctgccgtcattcaactttaactcaccgtcagtccaagcaatatcaccgggaaactttttacatatttccaacagttttaataaggcaattaatagaacacctataacatcaacttcactggcattagtgccaccttcaactggtaaaaaacacaaccgatttcttgaggctttaacaaggtcttcccaacaagatggtgacaacaataaagagggaagcagtgtttcagacacagataataacgacgaaatttggtctacagtaaacacatctcaggcacagcataattcaacaaaccaaacttcaatgtacgaggacgaaaatgaccacgaaaaagataactcctttttacccccaaacaaattagtgcttgaaaaaattgaagagaataacaaatcgcctagcttggataaagctgctgatatatcaccgaaaacagccggtgatgattatatagttaaaaagagaaagttatctacagaccaaagtctcactgactcgccgaacaattcagttgcttcgaagatagactcaacaatgcaatcgccaataaactatcggaagcaaagtgttgcttattcaacaaaatctaattcaagctcgagtgctattgccgatgagaaggtttggtggccggaactagatgacgtgctaattaaatccttgtataaatacaagaaattcaaagaagatcaggattccttcaatgcatcatcaattcttaaaaagacatcacaaaataagattatatcaagaatgttgttgaataaaactgggattttgagaactaccaagcaaatatcgtcccgtatttttcgtttatcgaaatccgaaaagttggttaaggagaccaaaaccctgcaaactggaagttttgcaaacaacaacttagatgatatattgctgactcccttgcgaagcttagtgaatgcacgggggtcaattgattcctcaaaactcaatacgattattgacgaggagttagatatgttgttgggcacatcgccattaaatgaagaatttgatgatactctgtacaaattggaaataagagatttccgattaagtttcagaagtgttcatgatcatcacattttcaccaatttggtgtcgattgacgttaataaatcattatctgttccaatagaggaagccataagaataaaacttgagctgaaaaaagtccctgcttggatcatcaatcacgatttgaatttgaattgccatcacattgcaagctctacaccttgctcggctgtttcggcttctcatcaattccaacaactgcatttgagtttaactggtggtaattttgaatctcatatgacaatagatgtttcatgtggggagaaatctcacaaaattcttagctggaggagccatatcgttgtttacaagaaaggaaataaacttctcgaagtagttgatgttatcaatggatattttagtgaatcttccaaatcttacactttgcagatcccttttttgaagaattttttccttggatatataacttatttggcaaatggtgccgccataactccagatgaaaatttgaagatagtgcaaataatttatagtaatcctaaaagtggcacaatggagtttgatttgggtgaatcaactatacgggcttatattatccatgagctcaatatagcaggcacatcagggagctctaaaataaatattatcgacgtccatagcaaataccaatctgcgtcaaagcaagaccactgtgatattgatgataatgaaactgtgcttgctgattcgtcaccattgaaactttcaccgaattcttcaagacagtgggatacaccaagcaagtctcgtttacgaattgatacaaacaaggctaatattgatgggggagccattgctggtccaatgactgctcctatttacaatgcggaacttttaaataagaaaatgcttgatgaacaagagaaaatgaagtcaaatttgcagaaagagcaattaagaccacctttgatgcattcgcaatcggtgtgcaatgttaatttgagtacgcaacggattcattcatcaccggaaatggcaaataactcaacattggctttctcaacaccaatgacaaatagactggggcccgtccaaaataatccaccatccgacagtaactttactccatatcaaattgcccaaaaactgtttattgctagaacacaactggaactgcatttgcaactgcaggctaacatgcaagaacagcagcagcatttgcaactgcacactcagagttttcttcatcagcaactcgaaggaatgattaaccctcagattcattttgttcaaactcaaatgccacagcaagcttcagctggagcggccattgctatttctcctcaaatacagaatcagttgccgcaacaaataatccagcatgtgcctcttcaaaacttgggtcaaatgagaaatgtgccgcagcagtcattctcactagcaactaacaataatgttattactcccgataataattttatgagacagcaatggcaacagcaaatgtactttcaacaagttgcccaacagcaattacacaataatggacaccaaactggtacggtgtccgggaatggacaatcaggaagacataatctgaaaatgataaagcatccaaccaatttatcatccagccaacagaatgtacacaacaacaaagagaatatcaaaccaaggcaaattacattcgggccaatactaggtcatgacccttctccggatttgaagactatacagaagcagaacactaagaataacggtattgttcaatgttttcccgccaacacgcaaatcatgtataaacctaaaaagtag

SEQ ID NO: 2871 - DNA, 948 bp, Candida albicans
ttgaacatctggaaaagattattaacaaattttttaaataattgtcttgagataaaacaaatacgaagtttagaattttttgccaaatttttagatcctaatgctaattggggtgatgaaattgctttaattcagagtcaattaccaaaatctatttatctactgaatccagaaaatggattaaaaactgatcccatatattctaatctacccaatccatcaaacaaaaatacaatatcttttttcaaagataataaaaagaaattgacgaaaaaaaccaacaagttgttgagtaatggtagtgaaaatcatgatattggtgttggtggtggcggtggtactattgggaatggtggaaatggcgtaaatggtaatggtactaattctcaaagtcaatacattgccaatacatcaatgttggatgatataaacaagcgaatcatggagaattatattgggttatctaatgattattcaaaattaggtagtacatttaattccttttcattgatattagctgaaacaacaaccacaacaaccacaggggtactgtctgctactaagaaaagtaatgataatgaattgaatttaatttttgataaaattggacaagtttttgacaggtcatacattacaatcaattctttgattggggaattagaaacaaagttttctgaaccacttggagaaattgttcaatatacaagtattatacattacgttgccaaatatcaatcaaaaaaaataaagcagaaatcaatgttagataatgaaataaaagataaacggaaaactttggaagatttgttgaaaatagaacgggaatccaatagaattgaaaatgctataaattcccaagttaaacctaaaaacggtaaatataatcttgaacaacagcaactgtcaacagtatcgcctgcaccaccacctggaccacctccatcatct

SEQ ID NO: 2872 - DNA, 1302 bp, Candida albicans
gttatcatcggttgggtattagggtgttctggatttttatatcatcgttattataatatgcatgtattgaggaaaatgaacgatgcatttgaaactggtgatccgtcagcccaattgaagatgcatacgcgtactcatgacgattcgttggaagatgaaatcaatgcccactgggttgatcgaccacaacaaaagctattaaatgatattattgctggtgatataattggacgttatttcttaattattggagagaagggaactggtaaaacttcgttgattctagaatctatgaaacgagttaatgggtttaatgtttgtatatttgatgcccatgctgacccagaaatctttagaatacgattgggtaaagcattgaatttcactttcaatgaggattatattgggtcattgttttctattagaggaccaagagacactactgcattattggatattgagagagctttcagtaagttggaggaattggctattaaacgagttaataaagttcataaacctttaataatgattataaacaatgctcatttgatcaaagaaaatgaagaaggtgttaaattattagaattgctacaacaaaaagcggaatcattaagtggatcaggattgttaaccatgatttttaatagtgatgattattgggtttatgagaaattaaaacaattaggtactcgacttgaattgatcaatgttagagattttaatcgtatggaaaccataaatgcattgaaatttgtacgtcatcgttatttccccaaattagagaaattggatgatgagttatgtaatgccgtgtatgatttaattggtggacgtccacaacatataacccaagtcgctagacaccgtgatataatgaaagcatgtcatcaaattatagacagggaaaagacatggtttttgaatcaatgtggcttgctaggggatgacatggatgatgatgttatggaaagcgggatatcttctactagtgccatgttattaatgagagaatttgttgagatggatcgacaaaaatcgaatccattattgattaacctgtcatcttcagatggtactcactcttctcagttaatgaatcatagattaccggaacttccactatggagagcgagacaaattatgactagacctgattatattcaaagatttgataatttaaatatagttaccattgattctgaatcgcgagtgcgagctgactcggtaccaatgatgagagcatttcatgagattgcatcgcagccacatttccgatcaattattagaagacacatttga

SEQ ID NO: 2873 - DNA, 450 bp, Candida albicans
tactactccttctccattcattcacaactatacattatggatgacgcagaattaaatgctattagacaagcaagattagcagaattacaaagaaatgctgccggaggtggcagtagtaccaatccatcttcttcttcttcgggtggcgcacaagacctggcacaagagaatatgaccataaccatattaaatcgagtcttaactaatgaagctagagaaagattaagtcgtgtaaagattgttagacccgatagagctcaagcagtagaaaattatattattaaattatattcaatgggtcaaatacatcaaaaacttggtgaaaaagatattgtgcaaatattagatggattaagtagagatagtcaacaaaagcaacaaacaaaaataactttcaataggaaaaatatagctggtgatgatgaagatgacgatgatttctttgactaa

SEQ ID NO: 2874 - DNA, 2091 bp, Candida albicans
  unsure (12): Identity of nucleotide sequences at the above locations are unknown.
gccgttgtgaanacgccatcatcggtgctggcagtcaatacatccaaagctacatttgaaaacactcaatcgcacttttcaaatttgcacatcgaatatcaaccacaaccaaccctcaaaccgtcactgaaagattctgatgttgtcgtttttgacaaagcttcatcatataataactctccaaattccgagagtaaagatggccaaaacagacaaagtgatggtctagatgactcgtttcaagctatcagcaaggctattagaaaaagcattgcagggagagtaggtgacactatatttaagcaagacttgagcgggctggatttgttaccaaacaggtcaagttcgaagagtcaatattctaagctggatactactatgcaatctttaaaatctgatgaaaaatcattagctccaaaaacacccaaaagtagaagttcaatgtttattgcattgcccacaagagaaccaatagttataaagtctgtgtcgagaaggaaactgggcgtttcgaaaagacggacaatggaaaacactaaaagtttaaattctgaccagaattcagtgacactgaatacgaatattaagtcagaactaaataacaccccagtatccaccaagggagagaaacaaaagtttgaacagatgtcgccggtgaaactacctgtagataagagagtattccgagaaaaagtccctatgttaagcacaggcgaaaaagatgataatggagaaaagaaggttgataagctagtggagaggacaatgagaaaagaggaggaacacgtggaacatgtttttacactaccagaagttgaacatgagaagcctattgtgtcagtcactaggaaagttgaaaatgaggaatcagtcgtacaatctacagacccaaaagatgtgaccaatgacactgtgctgcctagtggtatttggagtgccattggtaaatataggtcattatcaccagtaagaaaaccgttattcaatagtaaaacagatgacagtcccaggtcaatactggcatctacgtcgaggtcgaggtcacgatctcgatcaagatcccccttgagaaaagaagttttggtacatcgaaagaactccagatcacctaggcatgaactatttcgtggaaatagccctacttctccttcaaaattaacagcaaatggaggtgaaagtgaccttattaacagattgacagccccaacaagttccagcgctgctaaatcaaaatcgcaaaatcgtaaaacagactgcagaaagcctgaaagaaacaagttcttgaccacaactttaattcctacaactggtggaaacaataaagcgaaagaggtatctcctataaagttgaaatccgagccgtacagatttccaaaacttgaaacgagtagcatacctaccttaaaaatgtcaatgatggagaaaaggagtgagaccactctttcaaagactaggcaaaaatacataatcaagccaacaaacacttttaagcggaaatctgagctcgggaaggaaaaacatgagcatagtataataccgcaacacacacatttaagtgaagatcagaaacttgaaaccaacccacaaacgacgttgggttcaactacacaagatagaaagagtgagcaaaggatcaaaaggatcaaaactgccaatggtgtcgcgttaccggaagctgctcgtggattgctaaataaggataatgctaacaaaaagagtattgcatctgttgcaattaccccagcaagagatgagattcgagtggggaacaatgtgcttccagttactcctacgaggatatcaccaaggaatctaccggaaattgattcagacgaagaaggcgacttttctaaaaaaaagattttgcaaccttgggcagatagtccgattcttcgtagaagcatagctgccagtagaagtatagatccagccactgtgatcaccaataatccaaaaattgatttacatgagacattccaaagtgtggtttctgccaaaagaggccaggaatcgcctgctgcaactccaaacatgcgacaactagaaaaagatatgaagagatactttcaacaactgggatacattcaatag

SEQ ID NO: 2875 - DNA, 240 bp, Candida albicans
tactcggcaggaaccacaaaaggggaaggaaaggagtccgaaatcaactcagtcagagacccagagggagaacagaaggagataaagatccatcgaaagggtagaacgtctttcaaaacagtaaagaataaccgtgattatttgaaaaataaacaaacttcgaattggatgtatctttccccgtttaggcggctgccaaggagtaccagtttatgttttcgacaggcgccgaaatcaata

SEQ ID NO: 2876 - DNA, 294 bp, Candida albicans
  unsure (18),(41): Identity of nucleotide sequences at the above locations are unknown.
tccccaaacaactgtccngccatccgcctcgttgaagaccnatttgcttcgcacccaacatcgattgttagagaattacatgtgtatggatcggtggtacccttacattccagagatccaagaaagttccagcatcaaggctttggtacattattaatggaggaagctgctagaattgctaaggaagaacacggctcagaaaaaattagtgtgatttctggtgttggggtgagaaactattacgccaaattaggttacgaattagatggtccttacatgtcaaaaatgttgtaa

SEQ ID NO: 2877 - DNA, 720 bp, Candida albicans
  unsure (130): Identity of nucleotide sequences at the above locations are unknown.
aggtcttgtagaacagttattccagttgccaaatccgttaatttaattttttggttgttgaacttccacaaccttttgcaacataaaaaatttattgaacatgagttagaaggtatgggaataaggatanaccaagacccacctaacattgtgatcacaaagacagataaaggtgtattccacatcaccaatactgtccctttaacacatttggacaatgacgaaatcagagccgtaatgtctgaatataaaatcaacagtgctaacattgcttttagatgtgatgctacagtggacgacttaattgatgccatcgaggcgaaagccagtaaatacattcctgcaatctatgtgttgaataaaatcgattcgttctatattgaagagttgaatcttttagcaaaaatccctgatgccattccaatatcctcagctaacggctggaacttggatgacttgttacaaatgatgtgggacaagttgaagttggtaagagtatacacaaagccaaaggggaaattacctgatttcaatgagccagttgttttgagaagtgacagatgtacggtggaggatttctgtaactctattcacaagtctttggtggaagatttcagaaatgctctagtgtatggtacctcggttaagcatcaaccacaaattgttggtttgaaccatcaattggaagatgaagatgtgattacgattttgaagaaataa

SEQ ID NO: 2878 - DNA, 759 bp, Candida albicans
cctaaaaactatactggtcttctaatcataatgggtagagagattgttattggattagtgggtaaaccctctagtggaaaatcaactactttgaatgccttgacagatgccaatgctaagtgtggagcattcccattcacgaccattgatcctaataaagccactggttaccttgagatagattgcgcctgtgccagattcaataaacaggacaagtgcaaacccaattatggatattgtcgtaacgggaagagaggtgtacctataatgttgttggatgttgcgggattggtgccaaacgcccacttgggcagagggttgggaaacaagtttttaagtgatttgacagaagcagattgtttgatacatattgttgatgccagtggaaccactgatgccgagggtaaagcaacaaggggatatgatccattgcaggatattgaatggttgcaagatgagattttccaatggatattgggaaacttgaaggaaagatgggggtctgtggtcagaagacatattggtacaaaatcatcgacattggaaactatgagacaacaattaggtgggtatgtggccaacaaaaaattaattggggatgccttacatttgatacctgacttgccgccattacaggactgggatgacgaaatgcttggtaaagttgttcgtgcattcatggaagtcaagttccctacagtattatctttaaataaaatggaccaccctgatgcagacaagaatgtgtccaagattata

SEQ ID NO: 2879 - DNA, 471 bp, Candida albicans
agtcggtccgttgaggacccgaccaatggtggtattgacataacagaagatgctattgacaggcacctttatacgaaagatgtaccacccttggatttattagtaagaacatcagggacatttaggctttctgactttcttttatggcaaacagtgtcgccagaatgtgccgttgtgtttgtcgataaattatggccggcattcaagccatgggatatgctcaaaatattgcttaactgggggtttaacaaatacatgtatggtaatccaaatgggtatggggttagtagtaatttggtagtgaaaaccccggtagacggagaattaataaataccccaaaatccaccacaggactcgacaggtacctggaggatgaggagacagaagttagtagtaacaatttggggacagaagaggatacagtgacatcagaggaagaagacagcgaaggtatagtcaaaaagcaatag

SEQ ID NO: 2880 - DNA, 705 bp, Candida albicans
gttcttgaagtctgttataaagttggtattgaacaagtgactatttatgcattttcacttgaaaatttcaatagatctaaagaagcaattgatactttatttgcattattacctgataaactcaaagttatgtcagaacatgaagatctgtatgctagatataataaatttcgtattagaattattggtaaccgatcatttatacctgaagatattttaaaagatttagaaaatgtcgaagaaactactaaagatttacgatcgaagaaaactttgaatgtttgtttcccctatactgctcgtgatgaaatcacttatgcgattaaaactattgctagtaaaagagtttcaggagaacttaatgatcgtaataaaatcactactaaaaccattgaaaagaatttctattttggagatgatgtaccaccattagatatattaattcgtactagtgttcatactcgattaagtgattttttactttggcaatgtactactgaatgtactattgaatttcctgatgtattatggccagattttggatttattagtatcatgtcaattctatttaaatggagttattatagaactattcaaattgaagaagaagctatacgtgggaaagaacctcgtgttcaagaagttatcccaccggtattgctaaaagaattaccaaatcctccacccgctacatcagttatttaa

SEQ ID NO: 2881 - DNA, 198 bp, Candida albicans
actagtccatgtgctaagttaccggaacaaaacttggaacaagatacaattgttactgtttatgccgaaggtaaggaaaacgcattggctattggtaaattgttgatgagcacagatgaaatcaaaagtaaaaacaaaggtattggtatagaattattacattacttgggtgatgggttatggaactatcaagaataa

SEQ ID NO: 2882 - DNA, 978 bp, Candida albicans
  unsure (964): Identity of nucleotide sequences at the above locations are unknown.
aaaaaatttattcttccattatcaacaattcacttattccttgtatcaactattaaagaaatgcttaaaagttctagaatacttctaaacagatcatcatcatcatcatcattatacctaaacagaagactttctacattattaaccactaaaccgattgagaaattaactattgaagatttatcacatccatcaatcaatcaacaagatgaaattggtcgattaaaattaattgaatcaatacaaaacacatcaactttatcaacccaaaatcgtaatgaattattggaatttttaatccccaatttttctatttatttcaaattaccccaacatactattaaacaagaagttttacatcgattaattcaattaaatcctggtagagttcatagtacttttgatttatataataatcatcgtaatgaaattcaagattatatgattcaagatgttttgaaaaggttaattcatggagaaaagaatgctactattgcccgagaagatggcgatgatgaaagtgaaagtattgatttgaataatattattcaaattgttaatgattatcaacatttacaatttgatcaattattaattgaattattttataaattgattgataataatagtaatgaattgattgttgaattaataaattctggagtattaaatggtgaaatgatattaaaggaaatggtggggcaagtcaatattaagacaagttctattactactaaatttgcatttattactatattcaatcgattgttcaataacaatccacaatctatggaccaccaagtttatactattgccttgaatttattaaattttgatgattcccacaaagagttagcagtgtcattaacaagtaatgaaatattacaatatgttacagaatcaaaactcgatgaaattcctgaagccataaatttaagttcttcacagcagcccgccaaggacncatgcaagtcgggg

SEQ ID NO: 2883 - DNA, 1296 bp, Candida albicans
  unsure (194): Identity of nucleotide sequences at the above locations are unknown.
tttttattgcgtgataatttattattagctaatcctataattcctgctgatcaaaatgggttatattcattattaccaattgttaatggatttgatttcaattctcatattgatcatttatctaatttgaaaaaaattaatgaagatttatataaattaaatgatcaagtgaaattatatgaattgaaaggatntgaacaagatttagaattttctatcccggaagaattgattcaatttgaaattaaatttcatcaaacaattaaaattttaactgatttaaataaattaaattctaaaacaacgaaaaattataaaagtatggttgatactttaattgatttaggtggtaatttaaataatttttcattacaggtttatcaacagaaatcaggtagtaataatgaattactggaagccattgaaaaatttggttcaactatggatcaatcttttcttaattttgaaagttttattttaaatcaattggttccacaatggcaagaaccagttgatcaattgatattataccttcaaaattctttaggcttaataaaattttacaagtataagattgttcagtttaaaatcttgtataaacttaagtttaacaagtttcaacaattgataaatttaactaatattggtggtgttagtagtagtggtagtggtggtggtggattattagcttcaagaatatcaactgataatgacagtaataacagcaataacagtggtaacaacaacaatgatggagatttagatacagaaaattttgatcatttgaaggaattgaacagtccaacaatcaataatgcattgaaaaatttatcagcgaaaaagatatctaaaaaatcatcatggtatgggttatttggtgggaataatcaaaccaaaaaattcaatttccaactcccaattgaagaaccaacaactgcaacaggatccactgaacaacagtcgcagcaacaactggcacctaattccccacaaagggaacaacaacagtcacagtcccatcatctgcatcaaacctcaattagattcaaactcaatcatatagaaaaagaattgaataaactcaatcaattgatagagttgtgtaatcaagatatgcataaattgactgaagctttagtcaatacctttgaagaatttttactgaaaatagaacggaaatggttacaattaatgataacttatattcaaaattgtaaaaatatgtctgaaacaaatttaactaattggagacaatttaaagaatctttatttaatgaaaccagagaagtgaactag

SEQ ID NO: 2884 - DNA, 564 bp, Candida albicans
aatattattagtattagtagtagtagtattagtaagaccaaagttacaatttctgaaaatgaaaataattccaaaagaaagagaattgatgatgatgatgataatgatgatgatagtttggcacctgataccactaccaccattattaatacgaaaaatcaacaatttattgatgaacaatttaaaatatgggaattacaagaacaaattaatgattatattcataaaattgaattaaaaaataatgaaaaacaatttgcttttaaagaatatgaaaattgtttaaaatcaattgatgattctaataaacaaattgaaaatttaattgatcaatataataataataaacggaaatttgatgaattaattgaaaaaaatcctttaaataacaacaacaataataataaccaatttgaaattgaaaaacaaaaattaattactaagattaaagatcaagaaataattaatgaatcattaaaatttaaattaaacaatgcttttacatttttaaatgatactaaatatttgaaaaagaggaaaaatcgaggaataactcctaaataa

SEQ ID NO: 2885 - DNA, 954 bp, Candida albicans
ccgaaaatgggtttgctaacaaaaatcaaggaatcgaaacacagaagatcacaaaccagaagctcaatatttctggcgaatgaatcggaggcctcccatacatcaagtgatactttcaactatgagccaccacagccaattaaaaatgttcccacagctttgctaccaatgagaaagcaacgccaacctcggcccaaatccgactatgtgtatgaaaagagcttaccacaagaaccgatacacaatcgatctcgttctgaggattttaatgaattgccaatcctttcaataggtgatgaaactttacaagtaccattaaatgaaactaagcaaaatacagaccagcatagtcaactcgacccagctttatctaaacagtctaatgctaaacttcataaaaaatccccatctaatgattacgatataaggaacggttcacagtataagtcaaattccaaagctaatgaatcagactattcaaaacaaacaggtattggtgaccaagctcaattgacagaacaagacatacagcatgaacctacaaaatcgacttttgactatccgaattctcaagtaactcagccacaagcagaaaacttacaacctatgcatgaacaaatagaaaaactagaatcgaaaccactgtacgaaccggtagaccaacataatgattcgttggaccagcaatcgctgtatgttaatcaactgtttaatcattcacaatctcaagccgttgaccaacaacaacaacaacaacatttatacatgcaaggaatgaattctcaaagaatgagcccacgattttcatccaataataatttgtttgctaacgaaaaccaaacatctgaagagtttaatgtgtcacaaccaaaccaattttttcaacccgtaccagatgtgtcaagcaaactcattctaccaaccaggaccggtccttacagcatcatatgctaa

SEQ ID NO: 2886 - DNA, 1281 bp, Candida albicans
gcaaaagttatattatttcatttttttgaagatctaatttaccaatatctaacaattatgacgccaaaagtggtaatcattggaggttcatacgctggattggctgctttaaacacattaaaactgttaattaccaaaaattcaggggccattgccaagtctatatctatcacattaattgaaccaaaatcggggttcttgaatatattaggattaccaaaatcgattgttaataaggaatttgcaagtcaacaatatgttccattttgtgattttttaaagtttgataatgtggttagcaattccaatgatttaaaggttcaattgaaaaagaatacaaactccgacaataacaacttgatgttgaattatattcaagggaaagttactaaattaactagtagcagagtcacttacaccaccaatgataccgatgaatcgagcattgattatgactatgcaattttggcaacaggaagaaacagaaattggccagtcaacccaaaaggcattacatttgaatcatacttgaatgaaatggagatcacaaacaagaagatccaaaaaagttcaattatcagtattattggcggtggtgctgttgggatagaattagctgccgaaattaaattgcattacccaaacaaagttgttaatttgattcatcctcatggtactttaccaccagagccgatcctggatgctttcaagaataaaactttgcaatcattaaaacaggctaatattaacgtgtttttgaatacgagaatagatacttcaaaaacttcactaaacaatggggaaacatccaatttgaaaactactgatgggaaaacaatagaatcaaacttaaacatatgggctacttcttttaaaaacaaccttgattatttatctctagatttacaaagaagcattcacataactgcaaatcataatattaaaaccaatgattatttacaagtgtcaaatatgtcaaatatttatgctgttggagatttaattgaattgtcaacaatcaaatcagctggttgggcatttcatactggaattcaagctggaactaatgtttataattccatatttgataaacctttgcaattgtcaagaatatccttcaagcaaatagattctcataaattgaccattgttggcggtgaaggtagcataatccacgaagttaaaggaaatttggaaatcaaccctgaatcaatggttcaagagtatcaggattaccggttagggacatgtaagaagtttattggtgcaacagtcaattaa

SEQ ID NO: 2887 - DNA, 939 bp, Candida albicans
aacataaatcgcggatcctggcagccccttagtaaagaagttcggacgagcaaaaaaacaagtctaaaatgtaaacaaatcttttcttttattcttggtgaacacttagtaataatgtttaataaagacccctttaaagtatatcatgacaatgttaataaaaacattgaaaggatgaaaaaggagaagaaactattagtttcttcacaacatattccaggtgacagacaacatcatgcacatcatcacaaaagacagcctttaagtaatataacatcagccagaataaacaagcctacgtcaacaaccaaaacaaatcttctatctacacgaaaactattatcaaagtttgagaaaccaaaacgagaaattttttcaaataagtcgtacgaatttgaggtgcttaataatcgtggatcgaataataaatataccaaaattgaaaatgaatttgacagtaaaaatatcaattctaaagatctaactattaattcatttttaaagaagtttaaagaaatggttaattggtacaaattgaacaaatttcaatttgaaataacaaacacaacctctaaagagggtgtcaacaataatggttattttgagcaagtcaataaaaatgtaataacgggacaaataatgcaaaacatagttaaaagaaattatattcgacctgaatatagtaaggccaaaattactgcaactcataaagtcaatcagataggtaaattaagtgaatttatgtacgctgttaaagtttcaggtgaaacgagtaacgatgataaccaaacacaaacggaaaaaacagtattgctcatgaacgtgggaaattgtgagataaaagtcaacgatagacttaacttgaatgatttgtgttatttaatggattatcagggaggaaaattaggagtgtacttgcgatggcatgtagttaaataa

SEQ ID NO: 2888 - DNA, 648 bp, Candida albicans
ccatatccaccagtagaaacagaaatccaacatgatcctgtactagtacctggagttgattccacactagatgtacctggtgtggtagcagaattagaacctggtgtggtagcagagctggaacctgatgtggattcaatagtagatgaacctggtgtggtagcggaacttgaacctggagttgattcaacactagatgtacctggtgtggtagcagaacttgaaccaggagtagtagcagaactagatcctggtgtggtagcagagctggaacctgatgtggattcaatagtagatgaacctggtgtggtagcggaacttgaacctggagttgattcaacactagatgtacctggtgtggtagcagaactagaacctggtgtagtagcagaactagaacctggtgtggtagcagaacttgatcctggagtagtagctgagcttgaacctggtgtggattcaacactagataaacctggtgtggtagcagaacttgaaccaggagtagtagcagaactagatcctggtgtggtagcagaacttgatcctggtgtagtagcagaactagatcctggtgtggattcaacactagatgaacctggtgtggtagctgaagttgttttacttgtcacaatagtttcctgttga

SEQ ID NO: 2889 - DNA, 861 bp, Candida albicans
gaagagttgggatttgaaacatccccgaagatattgtttttgcaggatttgaacagattagtatgtgaagcgtattctttaactggcagctcaaagaaggctaaacagttttgtgatagttttgatgactcggataacttgtttttgccaaagcacatcacagaaatagacaagtatttactgaaaaagaagtatccccaagcagaggaattgttgaataagttcaataataatgtcaagcaaacgaaattgtttactgacagatggaccaaagtagaggaatatcatatgaaactcaatcaacaaagacaacagcaatattttcaacaacagcaacaacagcaacaacaacgtcaacgtcaacaacaatatagaggtgctcaaccacatcaacagcgaaagaaaccagctaatgattattataaggttttggatgtgccacgtgatgctgacgaaaagactattaagaaagggtatagaacacaaacattaaagtatcacccagataaatataaaggtgatgatttgactccagaacagattgagaaaaaaatgcaagctattaatcaagcatatgaagtgttaagtgaccctgaattacgtgaacgatatgatagaggtgatgatccaaatgatcctatgggtcagagccatccacaatggcaaccacaaggtggtggtggacaaccaaatttcaactttaattttggtggcggtggcggtggtggaaaccaatttttccaacaattttttggaggtcaagggtttaaatttaatggacaaggtaatccatttggtaattcacatcaaaaagtgaagattacaaagaataagaaaaagaataggagcagaaagcagtag

SEQ ID NO: 2890 - DNA, 267 bp, Candida albicans
ctaacaaccaccatgagtcaagacaaaaaagaatttggtcaattgggtgatattaaaaaacaaattgatgaaaaatacagtcatttatctgctgctgaaaaagaaaaattggtaattggcaaagttgaagggaaattggggaaagttgaacgtaagttatgcaagacagaaggaaatttaggcaaggttgagggcaaattgggtaaaactgaaggtaacttgggtaagactgaaggtaatttaggaaaatttgaaggtgattctaac

SEQ ID NO: 2891 - DNA, 1122 bp, Candida albicans
gttaaggtgtgtaaagagcaattaaacttctttcgatgcgttttttctttatcttatgtggacatcacggatagaaatattctttggggtgaaaaaaaaaaaaaacataaacataaactttactacacccaaaccacatcccaacttgaccttaaaggaatgacagtatcatttgataaaagaatagttgttagcggcggagctgggttcattggtatacatttcttatgctatatggtaaagaaatatcccaactttcatttcacttgtattgataagctaaactatgctagtaatgctactgaaatcgaaaatcttaagagtttctcaaactttgaatttgttcacttggatttatcagataatctagaataccttctcaaaatcactaaaaacactaccgacattataaactttgcagcagaatcatcagttgatcgatcatttaaagatccggtatattttaccaaaaataatatactagctactcaaaacctattggaatgtcatcgactaaatccaagcattgggtattttttgcatatttctactgatgaagtttatggagatgtttatgaaggtgacaataaagagaatgcggtcatgaacccaactaatccatattctgcaagtaaagcagctattgatttaataatcaaatcatatcaatattcatataaattgccaataacaatacttcggcctaataatgtttatggaccattacaatatcctgaaaaaatcatcccattgactatacaatgtataaacgaaaagaaaccaattccagttcatggcaagggaaccaataaaagaaaatacttgtacgttcttgatattgtgttggctattgaaactgtgtggatcaaaaaccccatgacaacagttaatcaaatctataatataggaggtacagatgaattggataacctaagtttaatcaaacttataatggaaatatttggccgtggtgaaatccaatttatcaaagatcgaaattacaacgatactaattattccatagacacaacaaagatccataatttgggatggtctccgagaatatctcttgttcaaggtttacagtggtgcaaacaactgcttgactctcccatcgaataa

SEQ ID NO: 2892 - DNA, 585 bp, Candida albicans
attaacaactatttcttaactcaaggtttcaagaatattttcttctaccttcatcattatatagtctatcatacaaagttcaccttatttgccatgtcaattgctcaagaatttgaaaaagccaacacacattattcctccaatttcactaaaggagatttaccacttccaccagctagaaaagtagccgtggtcatatgtatggatgcaagaattgatcctgcagcatcacttggattaactgaaggtgatgctcatgtgattcgtaatgctggaggtagagctagtgatgcattaagaagtgttattatatctcaaagattattgggaacaagagaaattgttgttgttcatcatactgattgtggtatgttgacattttctgataatgatttaagaggaattgttgccaaagaaacaggtcataatgttgatcattttgcctttttaccatttggtgatttagaaaaaagtgttaaagatgacgtcgaatttttcaagagaaaccctttggtattggatgttcctgtaactggatatatttatgatgtgaaatccggtgcgattaataaagttgattcatag

SEQ ID NO: 2893 - DNA, 354 bp, Candida albicans
tcattattgactcattttatttctctctctctctctccactctctggccactgttatctttttcaccaacagaccaattccattatgtcgaaccaagtattaaaatctccattatccaaatcaattaaaattgcactcattcaattaaaagcaggtgcagataaagcagcaaatttgaccaaagtaaccaaatttattgatgatgcagttaccaaatccacaggagtaaatttggtcatgttaccagaatgttttaattcaccttatgccgtataccaatttagaaattatgctgaagacatcccccaggggacaaactactcaattgttgtcaagtttggcacaaaaatataa

SEQ ID NO: 2894 - DNA, 588 bp, Candida albicans
aattacaatacatcgttgactttcaatcctcaaggtgaaatcattgcaaaacaccgcaaagctcatttgtttgatatagatatacctaatggtattactttccaagaatcattaactttatccggcggggacaaagctacggttttcaaattgggagaatatggtaatgtaggtttagggatttgctatgatatcagatttccagaattagcttcgatagcatcgcgttacccatacaactcgtttgctatgttttaccctggtgcatttaacacaaccaccggtccattgcattggcatctattagctcgtgctcgtgccgttgataatgaaacttttgtagttttatgttcacctgctagagacgttgaaggaggtggctaccaagcttacggacactcattagttgctgatccatttggtaatatcattgccgaagctggagaaggagaagaaatattgtatgccgaattggacccggctttgttgcccaaagccagagatgggattccagtacactatcaaagaagatttgacatctatggtgattttgttggtgagggaaaggcaaaagtaagtgacaagtag

SEQ ID NO: 2895 - DNA, 576 bp, Candida albicans
gtcaagtctctaaatggttcgacctacttatcaattggaatacatttgccagcgaaaaagagagttcgaaatgtacatgttttgattgaccccaaaggtgccatagtttccgaataccaaaaagtgcatctatttgacgttgacgtgccaaatggaccaatattgaaagagctgaattctgttgagccaggaaacaagattgaggatcccatccccatcgatgattttaaactagggttgggtatttgctacgacattagattccctgaattggctttgaggctcaggagattggggagtgatatcattacatttcctagtgcatttacaactcgtacaggggaagcccattgggagttgttatccaaagctagagccatcgactctcaatgctttgtcattaatgcagctcaatgtggacaacaccaggttggaacagaccctaatgatttatcaaaagtaataaaaagaataagttatggtgattccataatcgtcgacccatggggtgaagttttagcacgaggggaaaagtacactggcgcgttgacacatgacgttttaaataccgcctga

SEQ ID NO: 2896 - DNA, 1215 bp, Candida albicans
tccttccagcccccgtgggtgaagacgatatccaaagcaaaatggtctagtgatggtaaaagaattattcttttcgcatcaaaaatggtgtcacgtcaatcacttaacttggctgatagaattactagtgcaaataaattgaaagaagaaattggttctggtttgatatttatgggattagtcggtatagaagatccaccaagaaaaaatattgaccatgtgattggcattttaagagatgctggtattaaaatcgtcatgattactggtgattttgaattaactggggtatcaattgctaaacaatgtggaattgttactagtggaaaaattgccaaagtgaataccttgggagatagtgataaaaattcaattagtgtcactggtcctgaattaaacctgttggatgagtcacaatgggaacaattggtggcacacaatgaattggttttcactagaactaccccagaacagaaattattgattgttgaaaaatttcaaaagtatggtcaagtagttgggatgactggtgacggtatcaatgatgcaccagcattgaaacaatcagacattggtatctctatcttggatgcatctgatattgccaaagaagctgccgatttgatccttatgaattcagatgctgatcaattattcttatcaatcgtcgaagcattgaaatttggtagattggtatttgaaaatttgaaaaagactatttgttacttattaccagctgggagttattctgaattatggccagtggtgatgaatgtgttcttcggtatgccacaaatgttgtcgtcattccttatgattattatctgttgtttaactgattgtgctggttcaattgtattagcatatgaaggtgctgaaagtaacttgttaaaaaagaaacctagagtggtaactggagaaagattagtcaatttcaaactcttgttccatgcttatttctgtcttggtactttttacacattcacgtcatttttggtggcatttttgaatttaactcgtcgtggtttgaaatttgatcaattttcgttatcttttggttcttatcaagatattcctaatgtaaccaattggcttaacatgtcttcatcaatttattttgtcaatttgattatattgcaaatgtttaacttgttgtcattaagaacaggacatttggtcttttttttcacaacggccggagcatccgatatggtt

SEQ ID NO: 2897 - DNA, 1878 bp, Candida albicans
gatctactgtactttcttttattccttagttatcaaccaataatgacaaaagacagtgtcaactcggatctcaatgagaatctgcctttattaaataaaacattgaaaagtccgaagactgctataggatccgattcctcaaaatcaaacacacaaccaattaataccaattccattagtgccaacccacttcgtcatgctcaatattcaaatccagctttgactaactcaacaaatcgacgtcctctttcaggtattgccgcccccgttactcctttggaatacactgaatttgatgaatatttgacatctatgcgtcatcattcttttagtgccaatgaattttatcaaaataaggcagcagaaagaccattattccatcgtttattgtccagtcatcattctgttaccaacccaaactcaccctttgataattatgttagtggtaatatcagtggtactcagattaatgctccattattccctcaaaatactggtggcgatagaagcagtatggaatctttaggtgaatttggtgaattgagaagattgagtgttgttgattttgttagtagtttgagaccagcaagattgattggaacagtattaccattatgtacatggaaagattattttaaatctaatattaacaaaataaagggtggtgatgttcgaaaatattatgaggaacaaaatcatttaattgaaaaattcactgaaattgacaatttcttggatgccggtaaaatacattataatatgttaagaaattatgggtctgatgttaatgaatctttaggggacattgctgaaggtctgcatgaaagttctcgtgctgcatcaccggataatttgaatggggatgagttacaagctactgatcttgaacgtggtgattccacctcaaaatattcaacaagatttaatgatgttcctggaaatgtcactaatgatggatcgagataccttggatataacgaagaggaaactaattcccaggttttaacagcaattttggtcaattttttgataaatatcttattacttgttgggaaaattgttgttacattattaactagttcaatgtcggttattgcttctttggttgattccatattagactttttgtctacttttattatttatattgtcaatagattggctactcaaaatgattggaagattcaacatgcttatccagtaggaagatcaagattggaaccattgggtgttttaattttctccatcattattatcatttcttttttccaagtgggtcaagaatcgtttaaaagattgtttttccctacaccaaatcaaaaaatacctgtccctattggtcttgatgcaattagtatcatgatgattactataattgcaaaacttggctgttggatatggtgttctagtagtcaatcttcatcagtacaagctttggcacaagatgccatgactgatattgtattcaatactgtgtcattgttgatgccaactattggacactatttcaatatctggtggtttgatcccttgggtgcatttgcattgtctatttatattgtcgttaactggggacatactgcatttgaacatatcaataatttaactggggctgctgctgatcctttggattataaagtgattttgtatcttgcctacagatttgccgaaccaattaaacatattacagcattgaaagtgtatcatgtgggatacaatctaaacgtggagattgatttagtttttgctaatgataaatacaagttgtcgttcaaagattgtcactatattgctgaagcattacaatactcaattgaaagtttacctatggtggaaatagcttttgttcatatctattatatggaaggtaactattaa

SEQ ID NO: 2898 - DNA, 315 bp, Candida albicans
agaacaatggaaaaaaaattttttcttttttttttttgttttgttttgtttccattcttaatttttgaagttgaaatttttcacaacaattctttattgaatttctttaaacctaaacgctttttctacaattactatcctagacatccacacacaatgtcatcacctaaagaagcacttgaatggaaggataaggggaacaacttattaaaacaacataaatatgatgaagcaatagaagcttataccaaagccattgacatcgacgtcttcatccacgaagcgcaagggccgcgcttatgttattgggggggg

SEQ ID NO: 2899 - DNA, 648 bp, Candida albicans
cttggtgtgttgatggggacattacggcgttttccaccacgaaagatatttctttgtgttcccctcaagctaataatatgggaagtgatttggctacttcagtacaacaaagcaattttggtagatcatttaacttatcgtgatgctaagatcaaattattaaagggagatatcgaaaataacaactatcaaggtaatttgataacaacacctaattcagatgatgactataatttagaactaggtaagcagcatcaattgacgatttatgattacataacaaattatttacaggattcactgatgtcagttaaccagtttatcacttactataagtactacagctatttacaaaacaagggttattttattaatcccggaataaaatttggtggtgacttggttatttatccaggagatcctttacgttatcattcttattcgattgttagatttgagttttttgacgttcatgacgttgttgtaggtgggagattagccactagtgttaagaaaaatttggttttaatgggttatgatcaagaagcagacaagacacatcaggaagtgaacgaagatgttataagcgatttatttgacgagtctgtgccgttgaccttttatatagaatgggctggttttggctag

SEQ ID NO: 2900 - DNA, 588 bp, Candida albicans
acatttacaaattcaccacttgattcaataatggtatcgactatttcaccaactattcttaaaacttcaacttccaagctcatcaatctttcagcgggttgtttctggggggtcgaaaatgtatttagaaaacagtttacaaacaagggtctagtagacattaaagtcggatatgctaatggtaaaccgtcaatttctaacgtaacatacgaaaaagtgtgcacaggtactactgattatgccgaaactgttcaaatatcatacgagccatctcaattgaagttagcagagattttagatatatttttcaaaatgcatgatcctactacagtgaattcccaaggacctgatgtgggcactcaatacagatcagctattttcacttttgacgacgaagataagtctcttgcattgaaaataagagatcaattccaaaaggaatggtatcctaatcataagattgccaccaccattgaaacgatatataactggtatgacgctgaagactatcatcaaaactatttgactaaaaattctggtggttatgagtgccctactcatttcattagaaccaagccaaaaatataa

SEQ ID NO: 2901 - DNA, 1386 bp, Candida albicans
  unsure (110),(159): Identity of nucleotide sequences at the above locations are unknown.
aacttggtgaggttagttaccaattacatttataaacctttggacacacacatatatatttttttttcatatgggtattccagaattatgggattatttaaactttcatntggtaaacgaatatcgcttgatgaattagttgaccaatccataaagganagacaacgaccaccgcgtgttgccatagatgcttacctgtttattttccaagcagatcatagtagtatcatagttgaagaaaaggatggggttctcatgcaaaatgttatggccaaaattctagcgttggtggggttaaatatttctgtgattgtggtatttgatggtatattgaaacccttaaaattgaaaagtaaagaaaatgagggattaatttatgaagacgaattacaaagacttgctctaatttctaactattcggaaaataatccattcgtggaacaattgaaaattgaattatctaacaataaaattgaatatgttcaagcaccaggtgaaggtgaagcccaatgcgcatatttgcaaaaacttggaattgttgattatgtcatatcacaagatgttgatgcattagtatttggtgctcgtcgagtattaagaaattttagtagatttgctgaagatattgggaaatcaccgccgaaatcctctgatataacagcaagatcatcttattatgtcactccagtggatatggataaagtggaacaagaaactggactcgcaacatctcgacttgtatttttagcatcacttcgaggaggtgattattctgttggggcgaaaaaaatggggattgtcaatgccaaaaatttggcattaagtggcacatcaaagtcaatgtattatactgaaaataaaagtaaaatacaattgaaggaattacagaaaagtccacaaaaatgtaagggtcctccaccagattttgctaatgaattaatagattgtgttcaatcgaaagatagatcaataaagctacatccgtgggatctgagattatatccagaggctcgtcgatctaattttgattctttattgaaaaagatgaatttttatttaaaagaacagaatagagacatatttggacgtaaagttacatttcaagaggagtttgaatttgatgaatattatactatgttatatttgtttcctttggtgtcagatcaagtaccaatattcatacccgatactttggggagtggagaactcaaatcagacttacacattaaccttcctgaaaaaacaaaagtatcaagaataagcaatgccattaaaagaaactatacacaaatagtgggtgaaccaattgatgaattaccagaaaaacaaacccacctatttgttccccaaatattatacttggtcaataaaacacattatatgtaa

SEQ ID NO: 2902 - DNA, 477 bp, Candida albicans
caattcttggggcagatggtcacattggctgatgactggggtgtaaatgttgaaagtattttgattaaggacttgacattacctgataaagtacaagcttcattatccatggccactgaagctaaaagaattggtgaggccaaaattattagtgccaaagctgaacttgaaagttccaagatcattagaaaggccagtgatattttggcatctaaagcagctatgcaaatccgttatttggatactatgcaagcagtgtctaagaatgctggaactaaagttattttcatgccttcagctgatcaagttgaaagaattgcgatgtctaacatgcaagaccaacctccttcaggtaagggtaagcctttagatttagaagaagataaggattgggtaggtactccacaaagtattggtattaacaataataggcatatcagtgagacagttgcattgcaagaagccatgagagtatga

SEQ ID NO: 2903 - DNA, 852 bp, Candida albicans
  unsure (296): Identity of nucleotide sequences at the above locations are unknown.
ttgtcgggggatcccttatgttcccagttacaggccaaacggacgattgggaatttgatgccagagggacctttgtttttgccattcattgtggcatccttgccagtcgggataaaccagatcgataccactgacctcacagggagtttgatgaggcccattgtagtggtacatctcatcctggcagcggcactcacacccatactttggagggttgaaagggctgcaccggatcccgtggtgcaggtgaacttgctggccagccgtgaggtccgcattgcaaccgcaatctctgntggtaatggcctatcgcaggctgcaatcgtattcatacccagttacgccttcctcgccctttcactgtcagagtccatggccagtttcagcctcctccccttcgtcaccaccatggccctctcggcccccattgtgggtgttctgctggacagggttggttcaagggtagtgatgatctcagggagccttatcctgatggttgggtgtaccatcatggccctcctctcatcaaccacccctctcttcatacttgctgaggtgctcatggccctcggactcataaccgtcataggggcacccctcaggtacataatgctatctgaaactccccccgaacacagggcatctggacaggccctgataaacatattatcaagtgcagggcagcttgttggaggtgcactcatcggtggcattgtagcgtccatgggtagtggagtaatgggttacaggttctcattcctcttccttgttgcagttgcattcacactcttcctgctatcaaccggtctcaagggaagaaagcaacagcttgagactatgaagagcccagcc

SEQ ID NO: 2904 - DNA, 891 bp, Candida albicans
aactatagaaccatgtcagattttaaagtaaaggccggtttagcacaaatgcttaaaggaggtgtcattatggatgttgttaatgcagatcaagccaagatcgccgaggcagctggtgcttgtgctgttatggcattagaaagaattcctgctgaaatgagaaaatcaaatcaagtttgtagaatgtctgatcctaaaatgattaaagatataatggaaacagtcaaaatcccagttatggcaaaatgtagaattggtcattttactgaaagtcaaattttggaagctttaggtgttgattacattgatgaaagtgaagttttaacccctgctgacacggtatatcatattgataaaaccaaattcaaagtaccatttgtatgtggggcaagaaacttgggtgaagcattgagaagaatcaacgaaggtgcagccatgattagatgtaaaggtgaagcaggtactggtgatgtttcctcagcagtggatcatattagaaccatcaagaaagatattgaagaagcttctaaattgaaaactgaaacggaaattgttgagcttgcacgtgaattaagagttccaactgaattattaattcaggtcatcgaagaaaagaaattacctgtggttttattctgtgctggtggtgtgtctactccagctgatgctgcattattgatgcaattgggatgtgatggtgtttttgttggatctggtattttcaaatcaaagaaccccgaaaaattggctaaagcaattgtcaacgctaccactcactacaatgatcctgttaaacttttgcaatattcaactgatttgggtgaattgatgggaggaattgccattgattcaattaaagaaaaagagaaattggaaaaaagaagctggtga

SEQ ID NO: 2905 - DNA, 1143 bp, Candida albicans
atgattgctccaaatctccttcaaataatagttgtgggggcaggtttaattggtcctagacatgcattacacgtttccaacaatcctcaaactgatttatttgcaataatagatcctaaccccgccactgccgatgttgcggaaactttcaacacgttatatttcccatcaattgaatcatgtatgaaatattgtgatgaaaactcgattccatacccagatggtgccatagtgtgtactcccaatcatacccatgtttccgtgggtgctgaattagcatcctatggaattcatttattagtcgaaaaaccaataggaagtacacctgaagatgccaaggcattaaaacattattgtgagataaaaaatgtaaaagttcttgtgggtcatcatagaagattcaatccttatatcttggccacaaagaaaaacttgtttaaagttggtcaaataattgccattcaaggaagttggatgttgagtaaaccacaagaatattttgatatatcaccatggaggaaaaatacaagcactggaggtggtgtgctattgatcaatttagtacacgatttggatttattacaatatatgtttggtaggattcagcgaatttatgcagaattactactgcaacaaagaactcatgaagccgatgaaggtgcagccttgacgattaaattcgaaagtggggtaactggtacattcatttgttccgataatgtcgtatcaccgtttaattttgaaagtggtaccggtgaaaatcctacaattcctcagaatcaaggggtgtcaggtatttatcgtatatttgggtctaaaggtacctcatcgatgcctgatatgaaattgtatcatcaagataaaggcgtcacatcttcatggactaatccaataaatgagactgttattgaactggatttggacaaattaccgtttgattctcagttggaacattttattgatttaattagaggtaatgtcaaagaaccttggtgttcaattgatgatggtatttctgcgttattgtgtattgatgcagttatgaggtcgattgaaagtgatatgccagtgaaagttcaggatattaaaagtgtgtcggccgattataaaaagttagggattgaccaaggtgtttttatgtag

SEQ ID NO: 2906 - DNA, 762 bp, Candida albicans
aaaaaaaattttggcaacctcatcaggaatctaacggacagaatatcaataatgtcttcagaagaaattttgcaaggagtagaagatatacatctcaatacttcttctgactcagatagtgaatatgaacttgaagaagaaaccacgacgaaaagtttgccactgagctctcgtactattaccgaaaaggaggatatagtcacaaaatatgcagacaaaattaaaacagatccaatcaaaaaggggccaaaaattaccaaggatagagctaacagggctacagttgaacaagttttggatccacgtactcttcgattcttagcaaaaattataaataaaggtatcatttcaagaattaatggatgcataagtactggtaaagaagctaatgtgtatcatgggactagtgatgacccagataacgatagagaatacgctgtcaaaatttacaagacatctattttggtgttcaaggaccgtgagagatatgtggatggtgagttccgattcagaaatacaaaaaatcaaagtaatccgaggaaaatggttaaagtgtgggttgagaaagagtttaggaatttgaaaagaatttatcagaatggaataccgtgtcctgaaccaattgaattaaagtctcatgttttggttatggaatatttgacaaagggtgatggacaaccatcacctaaattgaaggattatctgttcaaagatgtacaagacattgtcaactattatcaacaagatgttgttctaatatga

SEQ ID NO: 2907 - DNA, 747 bp, Candida albicans
  unsure (282): Identity of nucleotide sequences at the above locations are unknown.
aaacaacagacgggtaattttgttacaaaaccatggaagataatacaggaaaccagaggttggaatggaattgcaactgaatcactccgaaaaaaggaaaatgcgttggattatagatacgctccagattcagagttgccgttgattcgacttgacaagaatatacaagcacaattacaaaacacacttgatgaattacctgattctgtgcttgataggctaacgaaagaaccttataatttacagttagcacatgcaagaaatttgttgtttcaaccaganatattggattattacgagaacatttttgggagaataagggacgcaaacaaatggttcttccatgagcttttagccgcttttgcaaagagtgatgttgagtttcaagttgacatcgttttgccagatatgcttgttgatattgtactgtctgtggaaaagaatgagatttcattaaccggagcaagaattatcttaaagcatataatacggaacaagtcaaccaagacattaccacaactaattaaagagcttgatattggtaaaccagaagcctcagctgagttggaggaagcaataaacgaaatttgtcagcaaatcattaacacaaatgcagatgttgtcgaaaaaattgctcgtggccatactaacgccctacaagttcttattggtcaggcgatgaaggctacaaaaggtaaagtacacgcaaaagaatttagatcaaaatttatggaactactcaaatag

SEQ ID NO: 2908 - DNA, 1185 bp, Candida albicans
gcaaatacaaataccctttcacaacatcaacaacaccttttaatacaaacaatggggatacttgagaaaattgctcaaattcaagaagaattatctagaacccaaaaaaataaggctacagaataccatattgggcttttaaaggggaaacttgcccgttatcgtcgagaattattagaaccacaaccaggtcaaggatcttctggtggtggtggtcaaggatttgaagtggcaaaagccggtgatgctagagtttcattaattgggttcccgtcagttggtaaatcttcatttttatcaaaagtaaccaacacaaaatctgaagcagccaattatgaattcacaaccttaacttcagttggtggtattttagattataatggtgctgaagtacaaattgttgatttgccagggattattaaagctgcttctcaaggtaaaggtagaggtagacaagtcattgctgtgtcaagaacttctgatttgattcttatggttttggatgcaacaaaaggtggtgatcaacgtgaaatattggaaaatgaattacaatcaatgggtattagattaaataaacaaagacctaatatttccataaaagtgaaaaaaaccggaggtgtgaaaatgaattcaattactccaccaaaatatttggatgagaaaattgttactgcattattaaaagattacaaaatacacaatgctgatgtattaataagagatgaaaatgtcaccattgatgattttatcgatgttatcaatgaccaacatattacatacatcaaatgcttgtatgtttataacaaaatagatgcggtgtcattggaagaatgtgatagacttgccagagaaccaaacaccgtggtgatgtcgtgtgagttggatttgggtattgaagatttgaaagaagaaatatggcgtcaattagatttgttaagattatacacgaaaagaagaggtgttcaaccaaaatttgatgatccaatggtggtacgaaacaatagtactatattagaagtgtgtgattctattcatagagatatgaaaaatcaattcaaatatgcattggtttggggttcaagtgctaaacattcaccacagaaatgtggattgactcatccaattcatgatgaagatgttgttcaaattgtcaccaagtcaatgtccttggggggggggtattga

SEQ ID NO: 2909 - DNA, 477 bp, Candida albicans
tatattgcagttgacacttttagttctcatattatgtctgattgggtgtctacgtttccaggttataaacaggtgttattaacttgcaagaaaatgcttggtacgattataatgactggtccagtgcctcagcatgtgggtataatcatggacggaaacagaagatacgataaaacacacaaaatagaaatcaaggaaggtcacagcttggggtttgataccatggcaagcatactagaattattatatgaactgggtgtcaaatgtgccactgtatacgcattttcaatcgaaaacttcaagagactgcagtacgaagtcaaatggttaatggagttagccaaatcaaagtttacacaaataaaccagcatggattgttgtgtgaggagtatggagttaaaatcagaatattaggaaatactaaacttttaccaagagatctagttttcaccgcccgcagcggcaatacgggggga

SEQ ID NO: 2910 - DNA, 396 bp, Candida albicans
agaagttctcgtacaaccaggtccaaggagtggaagatggtgtgtgaacgtatttgggtgataacagactcatctagccgtagaatcatggtggagagcggaaataaaatttttttttttgttgaaaccaaaaaaaaacctttttcttttttgtcaacaatcatgtcagacgaaacagtcccacaaacggtgttgcctttggaagtaatagataggtcagttggtaagagggtccgggtgttgatgactggagataaagagtttaatggaaagttgattggttttgatgattatgtgaatatggttttagaggatgtcactgaagtcgatggaggtgctccaattaagaagatgctattaaatggtggccacattgccatgatcgttcctgagtaa

SEQ ID NO: 2911 - DNA, 300 bp, Candida albicans
aaacacctcatgtcaacaatacaagccgaacaacaacaagaccagcaaccattggacttaattcgtttccagctagatgaatatgttttagttaaattaagaggtgcaagagaattgaaaggaaagttacaaggttatgacagtcattgcaatatggtattgagtgatgctgaggaaacgatatacacatccaatgaagacgatgatagtgagaacacttctgaagaacctatagtgaaaaagactgccatggtatttgttagaggagattcagttattttaataagtccaatacagtaa

SEQ ID NO: 2912 - DNA, 1050 bp, Candida albicans
ctatatctttatatatatatatatactagcaaacttaacaacgggggtggaactatgtcgaaagaattatcattaaatcaaaaaaattatttaatacaagcattaaaatcgaatattcgattatcaacttctaccaatactggtggatcacgaaaattcaatcaatttcgaccaattgacatcaaattatccaacactagatatggatcagtagaattatcattaggtaaaaccaaagtcatggtaaatattacatcaagaatcactgaaccatatcaagatcgtccatttgaaggaatcatgaccataaattgtgaaatacctaatcatattaaacttcaatctaatgatactactaataataataacgataatgaagatgaatttataaatttgattaatcgagcattagatcgagctatacgtagatcaaatgcagttgatttagaaaatttatgtattatagctggagaaaaagtttgggaattaattattgatttacaagtattaaattatgatggtaatttgattgatagtggatgtttagccataattactgcattactcgattttaaaaaacccgacgtcacaatcaataataacaataatagtaatagttcttatactagtggtggtggcggtaatattatagttcatgatgatgaaatgaaacgaccatttattgaattatcaatattacatattccaatatgtttaacattcgtgttatttaatcttggaagtaaagaaactaatttaaaaactaatgatattgatcaagaaatttggttattacgtggtgatgccatggaagaatcgtgtcgtgatggatatttaatcatgacaatgaatcaaaatcatgaattaattcaattgagtaaaatcggtggtggtggtaataatggtggtgtatctatagatggtcaacaactaattaatttatgtcatgaatcaatcgatgaaattaatcgattgaccaatttggttaaatcaacggtaaagaatcatcaattgaataaatataataatgaaaattataaattattataa

SEQ ID NO: 2913 - DNA, 942 bp, Candida albicans
aacaacagggctggtcctttgttacgagcagttttaaccaccaaatacacttttgatgttcatgaagatgatattttgtttactgctggtgacattggttggatcacaggtcatacttattgtgtttatggtccattgttagctggtgccacatcagtggtttttgaaagtaccccaccttatccaaattattccagatattgggaaattgttgataaatataaagttaatcaattttatgttgctccaactgctttaagattattgaaaagagctggtaccaaatatgttgaaaaatacgatttatcatctttaagagtcttgggttccgttggtgaaccaattgctgctgaagtttggcattggtataatgataacattggtaggggtcaagctcatattgttgatacttattggcaaactgaatcaggatctcatttgttgactccgttagctggtatcacaccaactaaaccaggttcagcttcattaccattctttggagttgatccaaagattttagacccaaccactggtgaagaattacctgataatgatgttgaaggggttcttgccattaaatcagcttggccatcaattactagaggtatttacaatgattacaatagatttattgatacttatttggcaccatacgccaattattatttctccggtgatggtgctgctagagatagagatggtttttactggattttgggtagagttgatgatgttgttaatgtttctggtcacagattatcaactgctgaaattgaagctgccttgattgaacatccaattgtcggtgaatctgccgttgttggttatgccgatgaatcgactggtcaagccgttgctgcatatgtttcgttaaagaaggataaagctgttggtgaagatgtcgaaaacattaagaaggaaatgattttaactgtgtag

SEQ ID NO: 2914 - DNA, 210 bp, Candida albicans
ctgtgtagaaaagaaattggaccatttgctgctccgaaaatgattttattagttgatgatttacctaaaactagatctggtaagatcatgagaagaattttaagaaaagtattggcaggtgaagaagatcaattgggtgatatttctactttatctaatccaggtgttgttcaacaaatcattgatgttgttcatcatgcaaagaaataa

SEQ ID NO: 2915 - DNA, 795 bp, Candida albicans
  unsure (46): Identity of nucleotide sequences at the above locations are unknown.
aaattagggaaatcaaaccttttaagtaggtattattttgctctgngggttaaacaagttggattcccaccgggagtcattaatattgtttggggatttgttgatacagctggtgctgctttggccagtcataaaaaagttgccaaaattgcttttacaggttcaactgcaacggggaaaattattcaaaaattggcggctgaaaatttaaaggctgttactttagaatgtggtggtaaatctcctttaattattagatcagatgctgatattgatcaagcagttaaatggggtgccattggtattatgagtaatcaaggtcaaatttgtacatcaacatctcgtatttatgttcatgaatcaatttatgataaatttattgaagaatttgctgctcatgttaaactggattataaacaaggtgatgttttcgatgatgaagccgttgttggacctcaagtttttaaaatgcaacatgataagattttgaattatattgatattggtaaaaaagagggagcccgttgtgttcttggtggtgaaaaaaatattgaaggagaattatcaaaaggttattttgttaaaccgactattttcgctgatgttaaaccagaaatgagaattgttaatgaagaaatttttggtcccgttgttgttgttggtaaattttctactgatgaagaagctattacttatgctaatcaaaccgattatggattaggtgcagccattttcactaacgatatcactgttttcaaatcgcagtgccgatccatgttatgtaagccgagtgaa

SEQ ID NO: 2916 - DNA, 1149 bp, Candida albicans
aactacttggtcctggcacgtcgtagtgaagattactgcacatcctgtggtggttgggccgacaaaattttgggttcccaaatcaatactggtaacactcatttcaactacactcaaagagtcccattagtctgtggtcaaattattccttggaatttcccattattgatggcttcttggaaattgggaccagttcttgctactggttctaccactgttttgaagactgctgaatccaccccattatctgctttatatctttcccaattgttagtcgaagccggtatgccaaaaggtgttatcaacattgtttctggttttggtgctactgctggtgctgccattgctaaacatccaaagattgaaaaagttgctttcactggttctactgccaccggtaaaattatcatgaaattggctgctgaatcaaacttgaaaaaagttactttggaattgggtggtaaatctccaaacattgttttcaacgatgctgatttggacaagaccattcaaaacttgattgtttctatcttctacaattctggtgaagtctgttgtgctggttctcgtcttttgattcaatccggtgtttacgaccaagttgttgaaaaattcaaagaggctgctgaaagtgtcaaggttggtaacccattcgacgaagacacttttatgggtgcccaagtttctgacgtccaattgtccaaaattttgaaatacgttgaatctggtaaatctcaaggtgctactgttgttaccggtggtgctagagctgatggtaaaggttactttgtcaaaccaactattttcgctgatgtcaagaaagatatggatattgtcagagaagagatctttggtccagttgtcactttgatcaaatttgatactgttgacgaagccgttgaattggccaatgattccgattatggtttggctgctggtattcactctgccgacgttaacaaatgtattgatgtggccaacagagttaaagccggtactgtttgggtcaacacttataacgatttccacccaatggttccattcggaggattcagtgcttcaggtatcggtagagaaatgggtgaagaagttttgcatgaatacactcaagtcagagctgtgagaatgaaaatcaacccaccaaactaa

SEQ ID NO: 2917 - DNA, 201 bp, Candida albicans
cttccttattatttcaattattttttactcttttcatttactcaattacatattcatacttttaaactaacaaaatcaatgacaattcctttatcagtagatgttacattacccgatggtaaaaaattcactcaaccaaccggattatttattaataatgaattcattaaatccaaatcagtagagtctcaacagccgtag

SEQ ID NO: 2918 - DNA, 669 bp, Candida albicans
  unsure (60): Identity of nucleotide sequences at the above locations are unknown.
gaaaactctcccagtcaaaattgcagccattatgtggaaccagttcaatcagaaggagtngacaatcatgccacgtcattcttctttcaagttctcagagacattaccaaaaaacatggaattttattcattgtggacgaagtccaaactggtgttggggcatcaggaaaaatgtgggcccatgagcattggaatttgactactcctccagatatggtgacattttccaaaaaatttcaggctgctggattctatttcagtaatcctgatttacaaccaaaattgccatatagacagttcaatacttggtgtggtgacccatccaaagccattttggcaaaggccatctatcaagaaattgtcaaatctaacttggtagaaagaactgctgaggttggtgattatttatttgagaaattactgtcaatcttatcaagatttcctgataaagtcttcaatttgagaggaaagaactatggtacatttattgcctgggactgttcaagcactgaccttagaaacaaaatattggcagcatcaagagaacaaggactcaatatgggtggctgtggtgatcaatcaatcagattaagaccaactttattgtttgaaaaagagcatgctgatatatttcttggtattttagaatcagttttgaacaaattgtga

SEQ ID NO: 2919 - DNA, 1308 bp, Candida albicans
tacttcatcagatctccatatcataaaatgtctagcaaatcagtttcctccctttacttcccagaagaaccaaaagaaccagtcgttgttgattcacacgctaaaagcaaagaaattgctgaccgtttaggtaaagtctttgacaatcgtggcgtttactttgttgccgactatgaaaagtccgttggtaactacattgctgatgttgatggaaacgtttacttggatgtttatgctcaaattgcttctatcccattgggttacaacaatcctgcattgattgaaaccgccaaatccgacaagatgatcagagccattgttgacagaccagccattggtaatttcccaggtaaagacactgatgaaattgtttctgaaattctcaaggttgctccaaaaggtcaagataaagtttggtctggtttgtctggtgccgatgctaacgaattggcattcaaagccgctttcttttattatcaagccaagaagagaggttacaccacacaattttcagaagaagaaatgaaatcagttatgcaaaacgaagctccaggttctccagaattggctattttgtcatttgaaagaggtttccatggtagattgtttgcttctggttctaccacttgttccaaaccaattcacaaattggatatgccatccttcaaatggccaaaagctcaattcccatcttacaaatacccattggataaatacgccgaagaaaacaaaaaggaagatgaaagatgcttgaaaattgttgatgacatcattcaaaacaacaagatccctgttgcagccgtattggttgaaccaattcaatccgaaggtggtgataaccacgcttctgctgaatttttccaaggtttaagagatatcactttgaagcatggttcattgttgatcatggatgaagttcaaactggtgtcggtgccaccggtgttatgtgggcccacgaaagattcaacttgcaaccacctccagatttggtcactttctccaagaaattccaatctgctggttactttttccacgacccagaaatcattccaaactttgcttacagacaattcaacacctggtgtggtgatccagcaagaatgattttggctggtgccattggacaagaaatcctcaagcatgatttagtcaagagagcagccgaagttggtgactacttgttcaagaaattggaacaattgcaagaaaaataccctaaatatatcaaagaccttagaagaaaagacagagccactttccattggccggtctttgggaaagtggtgaagccagaaaacaattccttg

SEQ ID NO: 2920 - DNA, 1008 bp, Candida albicans
ttatgtgaaagcacccatctgcaagttggttttttttttgtatttatatttttcatctctccttactcaattgtttctttcttccttcgtttttcattggctccttctagtctaacaacaagtttcagttttaagatgcagagaacacttatcaatacttcgttgaggcaagttcaaaagagatttaattcaacttctgtgactgcaagctatttccctgaagaacccaaaaacccaatatttcagacggaaacaatccccggtcccaaatcaattgctttaaacaaagagcttggtgaagtttatgataatcatgcaacttactttgtgaccgattacttcaactctttagggaattatattagtgatgctgatggtaacaaattgttagatgtttattgtcaaatttcatcaattgctttgggttataataatccagaattaataaaggcagccaaatcagacgaaatggtcaatgcgattgttaatcgtccagctttggcatgtttcccatctaccaattacaaacaaattcttgaagagggtcttttagcagctgcgccaccaggaatggacaaaatatggacatcattaagtggatctgatgccaatgaaactgcatacaaggcagcatttatgtaccaacatgcaaaattaagaggtgataaggcatttactgaagaagaacttgccacatgtatggaaaacaaaacccctggtgcctctgacatgtctattttatcatttgataaagggttccatgggagattgtttggttctttgtcaactacaagatccaaagcaattcataagttggatattcctgctttcccatggccaagagccccatttccacgattgaagtatccattagaagattttgaaacagaaaacagagatgaagaacaaggttgtttgtatcagttggaatcaataattgaaaactctcgcaagtcaaattgcagccattatcgttgttcacctcgggagtgccggtccgcgggcaat

SEQ ID NO: 2921 - DNA, 273 bp, Candida albicans
aaaagttttgaattgatctgctcagatccaaagtttaccggtattttcgtcaaattctttggtggtattgtcagatgtgattacgtcgccaaaggtttaattgctgccaccaagaatttcaacttggacattccagttgttgtcagattacaaggtactaacatggctgaagccaaggaattgattgacaactctggtttgaaattatatgctttcgaagatttggacccagctgctgaaaagattgtccaattggctccaaagaacaattaa

SEQ ID NO: 2922 - DNA, 726 bp, Candida albicans
gagaaacccctaaagaattttttgaaaagacaaccaaataaaggtcacattcatgatgtcaatcaatacaaacaaatgtatgaacaatctattaaagatcctcaaggatttttcggtccattggccaaagaattgttatcttgggatcacgatttccacactgtcaaatcaggtactttgaaaaatggtgatgcagcttggtttttgggtggtgaattgaatgcttcttacaactgtgttgatagacatgcatttgctaacccagataaaccagctcttatttgtgaagttgatgacgaaaaagattcccatatattgacttacggtgatttgttaagagaagtttctaaagtagctggtgttttacaatcttgggggatcaagaaaggtgacactgttgctgtttacttaccaatgaatgcccaagctatcattgctatgttggctattgctagattgggtgctgcccattcagttatttttgctgggttctcggctggttccattaaagacagagtcaacgatgctagttgtaaagctcttatcacttgtgatgaaggtaaaagaggtggtagaaccactaacattaaaaaattatgtgatgaggctttggttgattgtcctactgttgaaaaagttttggtttataaaagaactaataatccagaaattcatttaactgaaggtagagattactattgggatgttgaaactgcgtcttgcacc

SEQ ID NO: 2923 - DNA, 2046 bp, Candida albicans
aacgagacaaaaataatgccggaatctactcaacaatctcatctttctttggaccatgagaagatgcaacaacctcctaaagggttcactgaacgttttaaaacaaaaccaaacttagatgattttgaaacttatcaaaaattatataaacaatcaattgaaaaccccaatgaatttttcactcaacaagccaaagaaaatttggattggtttaaaccatttgatttagctagattccctgttgatcctaaagatgattacaaaaatgatgatttgccagcttggttcatcaatggacaattgaatgcttgttataatgctgttgatagatgggccattaaaaaccgtgataaaccagcaattatttatgaaggtgatgaacctgaccaaggaagaattatcacttatggagaattattaaaacaagttagtaaattagctcaagccttaactaaattgggggttaaaaagggtgattcagttgctgtttatttaccaatgattcctgaagccattgtcactttattagccattgttagaattggtgctatgcattcagttgtttttgctgggttttcttctgcttcattaagagatagaattttggatgctgattcaagaattgttattactgctgatgaatctaaaagaggtggtaaaaccattgaaaccaaaaaaattgttgatgatgccttgaaagaatgtccaaaagttagaaatgtcattgttttcaaaagaactggtaattctcatgtcccattttctcctggtagagatttgtggtggcacgatgaaatggctaaatatggcccatacttcccaccagttcctgtcaattctgaagacccattgttcttgttgtatacttctggttctactggtaaaccaaagggggttcaacattacactgctggttacttattgggtgctgctctttccactaaatacatttttgatattcatccagaagatatcttgtttactgctggtgatgttggttggattactggtcacacatatgccttgtatggtccattgttattaggtgtcccaaccattattttcgaaggtaccccggcttatccagattacggaagattctggcaaattgttgaaaaacacaaggctactcatttctatgttgctccaactgctttaagattattacgtaaagctggtgaacaagaaattgctaaatacgatttgagttctttgagaactttaggttctgttggtgaaccaatttctccagacatttgggaatggtataatgaatttgttggtaaaaaccaatgtcacatttctgacacttattggcaaactgaatctggatctcatttaattgccccattggctggtgttgttccaaacaagccaggttctgcttcttatccattctttggtattgatgctgccttgattgatccagtcactggtgttgaaattgaaggaaatgatgctgaaggtgttttggctatcaaggaccattggccatcaatggcaagaactgtctacaagaaccacaccaaatatatggatacctacatgaatccatacccaggttattactttaccggtgatggtgctgctagagatcatgatggatactactggattagaggtagagttgatgatgttgtcaatgtcagtggtcatagattatctactgctgaaattgaagctgctttaattgaagacaaaaaagtcagtgaagctgctgttgttggtattcatgacgacattactggtcaagctgtcattgcttacgttgccttgaaagaaggaaacagtgacgaggattctgaaggattaagaaaagaattggttttacaagttagaaaaactattggtccatttgctgcaccaaaatctgttataattgtccaagatttgccaaagactagatctggtaaaattatgagaagaattttgagaaaagtcagttctaatgaagctgatcaattgggtgatatttctactttatctaacccacaatcagttgaaggtataatttctgcctttggtgcccaattcggtaagaaataa

SEQ ID NO: 2924 - DNA, 1326 bp, Candida albicans
attaataagctcggtccagcaggtcccgtaggtgaagacggcacgaataacaataactatgctaatgttgatctcattgtagagatagcagaaagtacaaatgctcatgccgtttgggctgggtgggggcatgcttcagagaatcctttgttaccagaaaaattagctgcatctcccaaaaaaattatttttattggtcctcctggttcagctatgagatctttaggtgacaagatttcatctactatagttgctcaacatgctcaagtaccatgtattccatggtccggtactggtgttgatgaagtgaaaatagacccacaaactaatttggtttctgttgctgatgatatttatgccaaagggtgctgtactagtccagaagatggtttagaaaaagccaaaaaaattgggttcccagttatgattaaagcctctgaaggtggtggtggtaaaggtattagaaaagttgatgatgagaaaaacttcattaccttatacaaccaagcagctaatgaaataccaggttctcctatctttattatgaagttagcaggtgatgccagacatttagaagttcaattactagcagatcaatacggtactaacatttccctttttggaagagattgttccgtacaaagaagacaccaaaagattattgaagaagcaccagtcaccattgccagaaaggaaactttccacgaaatggaaaatgcagcagtcagattgggtaaattagttggttatgtatctgctggtactgttgagtatctttactcccacgctgaagataaattctactttttggaattgaacccaagattgcaagttgaacatccaaccactgaaatggtgacaggtgttaatttaccagctgctcaattacaaattgctatgggtataccaatgcatagaatcagagatatcagaactttgtacggtgccgatcctcataccactactgatattgattttgaattcaagtcagaaacttcattggttagtcaaagaagaccaacaccaaagggacattgtactgcttgtcgtattacttctgaagatcctggtgaaggttttaaaccaagtggtggttctttacatgaattgaatttccgttcttcttctaatgtgtggggttatttctcagttggtaaccaatcttctatccattcattttcggattctcaatttggtcatattttcgcatttggtgaaaaccgtcaagcttcaagaaaacatatggttgttgccttgaaagaattgagtattagaggtgattttagaactactgttgatcttcaccaggcaatggaaggacatcgt

SEQ ID NO: 2925 - DNA, 531 bp, Candida albicans
acactcaaaaactactcacaacaacaacacttattttcacttgctttatttcttcgattttttatgagatgcaaattatctctaataaagaatactaactcacttgtacatagatcgcgtttcctaattacaaaaccacaactatatatacctcatcgtcattatatcccattcaagaacatattcaagtcattgttaatgtcagatcaatctccatctcctagtcctagcgattcccttagctacactacattacatgaaaatttgccatctcatttcttgggtggaaattcagttttgaatgctgaaccttctaaagtcagagactttgtcagagctcatcaaggtcatacagttatttcgaaaattttaattgccaacaatggtatagctgcagttaaagaaatcagatcagttagaaaatgggcttatgaaacatttggtgacgaaaaagccatacagtttaccgttatggccactccagaagctgtgcaagctaattcctctatagcaggctgtagaaattccatc

SEQ ID NO: 2926 - DNA, 3069 bp, Candida albicans
attggtgaaagaccagatccaatagttgctgttgtttgtggagctgtaaccaaagtacacatccaggctgaggaagagaaaaaggaatacatccaatctttggaaaaaggtcaagttcctcacagaaacttattgaaaactattttcccagttgagtttatttatgaaggtgaaagatacaagttcactgctactaaatcttcagaagataaatatactttgttccttaatggttctcgttgtgttgttggtgcacgttcattgtccgatggtggtttattgtgtgcattagatgggaaatcacattctgtctattggaaggaagaggcatctgccactagattatcagttgatggcaaaacttgtttattagaagttgaaaatgatccaacacaattaagaactccatctccaggtaaattggtcaagtatttggttgacagtggtgaacatgttgatgctggtcaaccatacgctgaagtcgaagttatgaaaatgtgtatgcctttgattgctcaagaaaatggggtagtgcagttgattaaacaaccgggttccacagttaatgctggtgatatcttggccattttggcattggacgatccatttaaggtcaaacatgctaaaccattagaacgtactttaccatctatgggtgagccaaatgttacaggtactaaaccagcacataaattcaatcattgtgctggtattttgaaaaacattttggctggttatgataatcaagtgattttgaattctactttaaagagtcttggtgaagttttgaaagacaatgaattgccatactctgaatggcaacaacaaatttcagctttacactccagattgccacctaaattggatgacggattgactgcattggttgaaagaactcaaagtagaggtgctgaattccctgctcgtcaaattttaaaactcatcaccaaatcaattgctgaaaatggtaatgatatgttagaagatgttgttgcaccattggtttctattgccacaagttaccagaatggtttggttgaacacgaatacgattactttgcatctttgattaacgaatattatgacgttgaaagtttgttttcaggtgaaaatgttagagaagataatgttatcttgaaattaagagatgaaaacaaatctgatttgaaaaaagttattggtattggtttgtctcattcacgtgttagtgccaagaacaatttgattttagctattttggacatttatgaaccattgttgcaatccaactcgtcagttgctgcctctatcagagaagctttaaagaaacttgttcaattagactctcgtgcttgtgccaaagttgcattaaaggcaagagaaattttaattcaatgttctttaccttccatcaaggaaagatccgatcaattggaacatattttgaggtcatctgttgttcaaacctcttatggtgaaatttttgctaaacatagagaaccaaatttggaaattattcgtgaggttgttgattccaaacatattgtttttgatgtgttggcacaattcttaatcaatccagacccatgggttgccattgctgccgctgaagtttatgtcagacgttcataccgtgcttatgatttgggtaaaattgaatatcatgttaatgacagacttcctattgttgaatggaaattcaagttggctaatatgggagccgctggtgtaaacgatgctcaacaggctgctgctgccggtggcgatgattcgacatctatgaaacatgcagcttctgtgtctgatttgacctttgttgttgattctaaaaccgagcattccacaagaactggtgttttagctccagcaagacacttggatgatgttgatgaaactcttacagctgcattggaacaattccaaccagccgatgctatttcatttaaagcaaagggtgaaactccagagttattaaatgttttgaatattgtcattaccagtattgatggttactccgatgaaaatgaatacttgagcagaattaatgaaatcttgtgcgaatacaaagaagagttgatttctgctggtgttcgtcgtgttacatttgtttttgctcatcaaattggtcaatatcctaaatattatacttttactggtcctgactatgaagaaaacaaggttattagacacattgaaccagctttggctttccaattggaattgggaagattagccaatttcgatatcaaaccaattttcactaacaacagaaacatccatgtatatgatgcaattgggaagaatgctccttctgataaaagatttttcaccagagggattattagaaccggtgttcttaaagaagacattagcattagtgaatatttgattgctgaatccaacagattaatgaatgatattttggatactttagaagttattgacacttctaattctgatttaaaccatattttcattaacttttccaatgctttcaatgttcaagcttcagatgttgaggctgcctttggatcattcttagaaagatttggtataatattatggagattaagagttactggtgctgaaattagaattgtctgtactgatcctcaaggtacttcgttcccattgcgtgctatcattaataatgtttctggttatgttgtcaaatcagaattgtatttggaagtgaaaaatcctaaaggtgaatgggttttcaaatccattggtcatcctggttccatgcatttgagacctatctcaactccatatccagttaaagaatctttacaaccaaaacgttacaaggctcacaatatgggtaccacttatgtgtatgacttcccagaattgtttcgtcaagcaacaatttcacaatggaaaaaatatggcaaaaaagtaccaaaagatgttttcgtgtctttagaattgatcactgatgaaactgattccttaatagctgttgaaagagatccgggtgctaacaaaattggaatggttggattcaaagtcactgctaaaactcctgaataccctcatggtcgtcaattaattattgttgccaatgatatcacccacaagaatggt

SEQ ID NO: 2927 - DNA, 1833 bp, Candida albicans
ttggtggctcaagggcggatccttccagcccccgtggtggaagacttataccaagttgcctggaatgaagaagggtctcctgacaaaggattcagatacttgtacttgagtactgctgctaaagagtctttagaaaaagatggtaaaagtgacagtgttgttactgaacgtattgttgaaaaaggtgaagagcgtcatgtcattaaagctattattggtgccgaagatggcttaggggttgaatgtcttaaaggatcaggtttaattgctggtgccacatcaagagcttacaaggatatatttaccatcactttggtaacttgtagatctgttggtattggtgcttatttggttagattgggtcaaagagccattcaaatcgatggtcaacctattattttaactggtgctcctgctatcaataaattgttgggtagagaagtgtattcttccaatcttcaattgggtggtactcaaatcatgtacaataatggtgtttctcatttgacagctaatgatgatttggctggggttgaaaaaattatggaatggttatcatatgttccagctaaacgtggtttaccagtgccaattttggaatcagaagattcttgggacagagatgttgattactacccaccaaaacaagaagcttttgatgttagatggatgatccaaggtagagaagttgatggtgaatatgaatctgggttatttgataaagattcattccaagaaacattatctggttgggctaaaggtgttgttgttggtagagcacgtttgggtggtattccaattggtgttattggtgtcgaaaccagaacagtggaaaacttgattcctgctgatccagcaaatccagactctacagaaagtttgattcaagaagcaggtcaagtgtggtatcctaactctgcttttaagacagcacaagctataaatgatttcaacaatggtgaacaattgccattaatgattttagcaaattggagaggtttctctggtggtcaaagagatatgtacaatgaagtcttgaaatatggttcatttattgttgatgctttagttgacttcaagcaacctatcttcacttacattccaccaaatggagaattgagaggtggctcttgggttgttgttgatccaaccatcaactcagatatgatggaaatgtatgccgatgtcgattcgagagctggtgttttggaaccagaaggtatggttggtatcaaatacagacgtgataaattattagcaactatggaaagattagatccaacttatggtgaaatgaaagctaagttaaatgactcgtcattatctccagaagaacactcgaaaataagcgccaaattgtttgcacgtgaaaaggctttattaccaatttatgctcaaatttccgttcaatttgctgacttgcacgatagatcaggtcgtatgttggccaagggagttattagaaaggaaatcaaatggactgatgctagacgtttcttcttctggagattgagaagaagattgaacgaggaatatgttttgagattgattagtgaacaaattaaagattctagcaaattggaaagagttgccagattgaagagttggatgccaactgttgaatacgatgatgaccaagctgtcagtaactggattgaagagaaccatgccaaattgcaaaagagagttaatgaattgaaacaagaagtttcaagaaccaagattatgagattattaaaagaggatccaaatagtgcaatttctgcaatgaaagactatgttgaaagattgtcaaaagaagataaagagaaattcctcaaggcattgaagtag

SEQ ID NO: 2928 - DNA, 1284 bp, Candida albicans
gagcacacactcggaggagacacttacactctcacacacaaaaaaaaggggacgacattaattaagtatgaggaaaaagctgtcaaaacaaacaacaacaaaaacaaaaagttcaaccacatcaagccgaaacagagcaaaaaaaaacgagccttttttttcatttcaaacgtctcaacaatttgttttacccttttcttcttcttctttttcctctttctttcttcctatcttgttttctcttattcaattttatttgaaaataattattccattttaaccaaccacctccccctcatttcattcctcacaatgtatagacaatttacacgtggattttcctcctctttgccagccagaaattatgcatcaaccatcaaaaacttgaaggttactaaagacacaaaagttatctatcaagggttcactggtaaacaagctactttccatgctgaacaagcaattgcttacggtactgatgttgttggtggtatcaatccaagaaaagccggtaccactcatttggatagaccagttttcggtactgttgctgaagccatgaaagaagctggtgcctctgccactggtatctttgttccaccaccacttgctgctgctgccattgaagaagccattgctgctgaaatcccattggcagttgctattactgaaggtattcctcaaaaagatatggttagaatttcccaaatcttgaagactcaagaaaaaaccaggttagttggtccaaattgtcctggtcttattgctccagatcaatgtaagattggtattatgccatccagtatccatcaaagaggtaaagtaggtgttatttctaaatcaggtactttgacttatgaagctgttgctcaaaccactgctgttggtttaggtcaatctttagtcattggtatgggtggtgatccattcccaggtaccaacttcattgatgccttgactttatacttgaatgatccagaaactgaaggtatcattatgattggtgaaattggtggtagtgccgaagaagaagcttctgaattcttaaaacaacacaacttgaccagaccagaaggtcctaaacctgttgttggtttcattgccggtgtttctgctccaccaggtagaagaatgggtcatgccggtgccattgttgccggtggtaaaggtgatgccaaatccaagattgatgctttggaatctgctggtgttgttgttgaaaaatctccagctagattgggtaactctttattggctgaattcaaaaacaaaaacttgttataa

SEQ ID NO: 2929 - DNA, 429 bp, Candida albicans
atgttcgtttctgaagcaaaattgaaagaattgggtttaaaacctttagctaaaatcaatggttggggtgaagccgccagaaatccaattgatttcacaattgctccagctttagctgttccaaaagctgtcaagcacgctggtttgactcttgatcaagttgatttctttgaattgaatgaagccttttccgttgttggtttagccaatgctgaaatatgtcaaattccattagaaaaattgaatgcttatggtggtgctgttgccttgggtcatcctcttggttgttctggtgcaagaattgttgtcactttattatctgtcttgattcaagaaggtggtaaaattggttgtgctggtgtttgtaacggtggtggtggtgcctcatctattgttattgaaaaagtcgatagtgactttaaattgtaa

SEQ ID NO: 2930 - DNA, 378 bp, Candida albicans
  unsure (349),(351): Identity of nucleotide sequences at the above locations are unknown.
tttaattcttgcaacaactttctctttccattgcttatagctaattattctccaaataacatcattatggtcccacctgtttatattgtttctactgctagaactccaattggttcatttcaaggtacattatcatctttaacttattcagatttaggtgctcatgctgtcaaagctgctttgaacaaagtccctcaaatcaaaccagaagatgttgatgaaattgtatttggtggtgttttacaagccaatgttggtcaagctccagctagacaagttgccttgaaggcaggtttaactgataaaattgttgccagtaccgttaacaacgtttgtgcttctaggttgnanaacgcgcccggaatatccgcgatgggt

SEQ ID NO: 2931 - DNA, 1062 bp, Candida albicans
cgccttgtgatgaggactggttggaccgttgtcagaatgaatttctcccatggttcttatgaataccatcaatctgtcattgacaatgctagaaaatctgaagaagtctacaaaggtagaccattggccattgccttggataccaaaggtccagaaatcagaactggtactaccattggtgacaaagattacccaattccaccaaaccacgaaatgatcttcaccactgatgatgcttacaaaactaaatgtgacgacaaggtcatgtacattgactataagaacatcaccaaagtcattgctccaggtaaaatcatatatgttgatgatggtgtcttgtcatttgaagtcatctccgttgatgatgaacaaactttgaaagtcagatctcttaacgctggtaagatctcttcccacaaaggtgtcaacttgccaggtaccgatgttgatttgccagctttatcagaaaaagatatcgctgatatcaaatttggtgtcaaaaacaaggtccacatgatctttgcttcctttatcagaactgctaacgatgttttggaaattagaaaagttttgggtgaagaaggtaaggacattcaaattatctccaagatcgaaaatcaacaaggtgtcaacaactttgacgaaattttggaagttaccgatggtgttatggttgctagaggtgatttgggtattgaaattccagctccacaagtgtttgttgtccaaaaacaattgattgctaaatgtaacttggctgccaaaccagtcatttgtgccacccaaatgttggaatccatgacctacaacccaagaccaaccagagctgaagtttctgatgttggtaacgctatcttggatggtgctgactgtgttatgttgtctggtgaaaccgctaaaggtaactacccagttgaagccgtctctatgatgcacaacacttgtcttaccgctgaaaaggccattgcctacccacaattgttcaacgaattgagatcattggctaaaaaaccaactgctaccactgaaacttgtgctgttgccgctgtttctgctgcttac

SEQ ID NO: 2932 - DNA, 225 bp, Candida albicans
ttttaccaattttcaacatatacaactcataataataaaaacttaaacatgtcaaacgaatatattcttgttactggtggtgcaggttacattggttctcatacagttattgaattaatcagtaatggatataaagtaatcattgttgataatttaagtaattcctcctatgaagcatttgctagaattgaattccttgtcaaacaacatgttccattctatgaa

SEQ ID NO: 2933 - DNA, 1833 bp, Candida albicans
gatggggagactctaggccggtatcgtcacatccccatggtgaacactcagtttgctgctttgaaagctgttggtgaatcaacaaaaatccccttagcatattatgataataatgtatcaggtactgtcaacttattggaagtatgtaaagccaatgatgtgaagacaattgttttcagttcttcagctactgtctatggtgatgttactagatttggtgataattcaatgattcctatccctgaacattgtccaatggatccaacaaatccatatggaagaacaaaattcattattgagtcgattttaaaagatatttataatagtgatgatgcttggaaagtagcaattttgagatatttcaacccaattggtgctcatccatctggtttattaggtgaagatccattggggatcccaaataacttattaccttatttggctcaagtcgctataggtagacgtgaaaaattgtctattttcggaaatgattataatagtcgtgatggtacccctattagagactatattcatgtggttgatttggcaaagggtcacattgctgcattggcatatttgaaaaacttgcaatctaaaggcttgtatcgtgaatggaatttaggtactggtaaaggatccactgtttttgaagtttatcatgcatttagtaaagttgttggtagagaattaccccatgaagttgttggaagacgtgctggggatgtcttggatttgactgctaagccagacagagcaaacaaggaattgcaatggaaaactgaacttgccattgatgatgcttgtaaagatttatggaaatggactactgagaacccttttggattcaacattgagaattattcttggaaagaatttgatgggttcaataaccgtttgcacagttttgttgctggtgacttgaaagttaacttagcgaatcgtggtgcattgatccaagctatcacgttgaaggattccaatatggtcaaagcttataataatgctgaagatttcaaatctgaaactaacccatttttcggtaccactgttggtagatatgccaatagaatttccaatggagaatttaaattgaatggaaaagtgtacaaattaactaaaaatgaaggagcaaacaacttgcatggtggtgcaaatggattcgataaacaagatttctttggtccagttgtgaaaagtcgtgatggtaagtttttcgttgatttcttgttggttgataaagatggtaatgatgggttcccaggtgagcttgaagctatcgtacattacacaattgatgactcctcagtggaaattgaatatgaatgtcaattattatctggtgaagcaacaattgtcaatatgactaaccatagttatttcaatgtttccaactcagacactattgaaggaaccgaggtaaaattgattactgataaaatgttagaagtggattcacaattattaccaactggtaaatttattgaaaatgaaaaagctgctagcccaattgtgttaaatgagaatgacgtatttgacaattgttttattgttgatgaagaatgtggtatagatactcgtgataaacctttgaaacaagtctttgaagcaactagttttgtcacaaacaacaaattgaagatatccaccactgaaccagctttccaattttacactggtgacggtgttaatactaaaggttttgggaaaagatgtggtttctgcgtggaaccaagtagatttattaatgcaatcaatcacaaagaatggtctaatcaagtcatcttgaaaaaaggtgatgtttatggaagtaaaattaaatatgaatttcaatag

SEQ ID NO: 2934 - DNA, 1635 bp, Candida albicans
  unsure (9),(96): Identity of nucleotide sequences at the above locations are unknown.
ctaccgatntaccagaatggaaaaaattggaagaaacttacaaatcccgtcggtgagaaattcagtgtcagagatgcattcgccaaagacccaaanagatttgaagagttctcctggatctacaaaaactacgatgactccaagatcttattcgacttctccaagaacttggttaacaaagaaatccttgatcaattggttactttggctaaagaagccggtgttgaaaaattgagagacgccatgttcgctggtgaccacatcaacacaaccgaagatagagctgtttaccacgttgctttaagaaaccgtgctttgagaaagatgccagttgatgggaaagataccgctcaagaagttgacgatgtcttgaaacacatgaaagaattcagtgactcaattagagacggttcttggactggttacaccggcaaatccattactgatgttgttaacattggtattggtggttctgatttgggtcctgttatggtcactgaagctttgaaagcttacagtaaaccaggtttgaatgtccactttatttctaacattgacggtactcatactgctgaaactttaaaaaacttgaacccagaaactagtttgtttttgattgcttccaaaacattcactactgctgaaaccatcaccaatgttacttcagccaaaaactggttcttggctactgccaaggattctaaacacattgccaaacatttcgctgctttatccaccaacgaaaaggaagttgttgcctttggtatcgatgctaaaaacatgtttggatttgaaagttgggttggtggccgttactcagtttggtctgccattggtttatcagtcgccatttacattggtttcgaaaactttaatgatttcttgaaaggtgctgaagccatggatcaacactttttgaccactccattagaaaacaacattccagttattggaggtttattgtctgtctggtacaacaacttctttggtgctcaaacccatttagttgtcccatttgatcaatatttgcacagattccctgcttacttgcaacaattgtccatggaatccaatggtaaatctgttactagagccaatgttttcaccaactatcaaactggtactatcttgtttggtgaaccagccactaacgctcaacattcattcttccaattggttcaccaaggtactaaattgattccagctgatttcattttggctgcccaatctcataatccaattgaaaagaacttgcaccaaagaatgttggcttccaacttctttgcccaatctgaagctttgatggttggtaaagatgaagccaaagttaaagctgaaggtgccactggtggtttagttcctcacaaggaattctctggtaacagaccaactacttctattttggctcaaaagattacccctgctactttgggttctttgattgcttactacgaacatcttactttcactgaaggtgctatttggaacatcaactcctttgatcaatggggtgttgaattgggtaaagttttggccaaggtcattggtaaagaattggatgacaagaaagctgttgctacccatgatgcttctacaaatggtttgattaaccaattcaaagaatgggaagaataa

SEQ ID NO: 2935 - DNA, 1164 bp, Candida albicans
ccaaaagagtttactcatttacaaatgtcatcattatcatcagtcaccaggagtgctaaattagccactcaatctttgaaatacaacactagaccatcattatctaaaattggtcaatttcaaacatcaaaaatcacttatcgtgccaattccacacaatcaactcctgtcaaagaaattactgtcagagatgctcttaaccaagctttatctgaagaattagacagagatgaagatgttttccttatgggtgaagaagttgcccaatacaatggtgcctataaagtcagtagaggattattggacaaatttggtgaaaagagagttattgacactccaattactgaaatggggttcactggattagctgttggtgctgctttacatggtcttaaaccagttttggaatttatgacttggaattttgctatgcaaggtattgatcatattttaaattctgctgctaaaactctttatatgtctggtggtaaacaaccatgtaatataactttccgtggtcctaatggtgctgctgctggtgttgctgctctacattctcagtgttatgctgcttggtatggttcaattcctggtttaaaagttttatctccttattctgctgaagattataagggtttacttaaagctgccattagagatcctaacccagttgttttcttggaaaatgaaattgcttatggtgaaacttttaaagtttctgaagaattttcatctccagatttcattttaccaattggtaaagccaaaattgaaaaagaaggtactgatttaaccattgttggtcatagtcgtgcccttaaatttgccgttgaagccgctgaaattttggaaaaagatttcggaattaaagctgaagtgctcaatttaagatcaattaaaccattggatgttccagctattgttgattcagttaaaaaaactaatcatttggttactgttgaaaatggattcccaggttttggtgttggttcagaaatttgtgctcaaattatggaaagtgaagcctttgattatttggatgctccagttgaaagagttactggttgtgaagttccaactccatatgctaaagaattggaagattttgctttcccagacactgaagttatcttgagagcttgtaaaaaagtattaagtttgtaa

SEQ ID NO: 2936 - DNA, 693 bp, Candida albicans
gcgcggatccttccagcccccgtgggtgaagacggtatggtcatcaacacagaatggggttcatttgacaacggcttaaagatcttgccttccactgagtttgatgaaattgtcgattccgaaactgctaaccctggttatcacttgtttgaaaagagaatcagtggaatgtttttgggagagattttgagggttgctttaattcatttattcaaaaagggattgattttccaagagttgtacaaggcaagaggcggatctttgccacacagaattgaagagccatggttgttggatgctgaagtgttgtcttatctccagattgatgactccactgatttgaaaacgtcgggtcttattctccaaaatgttctcagattggaaaccaacaaggaggaacgtgaggttattcaacgtttgacaagagctatttctcagagagctgcccatttgtctgcgatcccaattgcagctatagccaaaaaagtgaaagatcaatataaggatgatgatagagactttgaggttggttgtgatggttctgtgattgaattttatccaggattcagacaagcagtgttggagtcaattgaaaaaatcaatcctttgaagggcaccaataaaaagatttatttgaagatcgccaaagatgggtcaggcgttggtgcagcattgtgtgccagtaccgcatag

SEQ ID NO: 2937 - DNA, 1440 bp, Candida albicans
tatctatatttctccatcatcatgtcactttcacccaaattagaagaaattgtcagctcaattgaaaaatcatttgaaattaaagatgattttttagtcaaggcaactgagtatttcattgaatcaatgaatgttggtttggaatcaccaaaaccttcaaaagatgtcatgcctatgattccaacctatgttacttcaattccaactgggaaagaagtagggctatatttggcagctgatttaggtgggactaatttcagagtttgttcaattgacttgaaaggtgaccacacattttccatgaaacaaagcaagtatcgaatccctgtggatttgatgaaagcagaaaagtccaatgatttatttggttttttggcaaagaaagtccaatctttcttatttgaaaaccattcggaagcctgtactgcaaaaaacaccgagcccctcaagttgggtttcactttctctttccctgttaatcaaactgcattgaatcgtggaacattaatcagatggaccaaaggttttgatatccctgatactgttgaccgtgatgttgttgagttattacaagcaaatttgactatcttggaagtcaatgtcaaagttgtcgcaattgcaaacgatactgttggtactttgcttactgctgcttactccaatgactcagcaaagacaaacagaaacacaatcattggttgtatttttggtacaggaacaaatggtgcttatttcgagtcaaaaattcccaaattatccagttcgactagcaaaagccaaggtatggtcatcaacacagaatggggttcatttgacaacggcttaaagatcttgccttccactgagtttgatgaaattgtcgattccgaaaccgctaaccctggttatcacttgtttgaaaagagaatcagtggaatgtttttgggagagattttgagggttgctttgattcatttatttaaaaagggtttgattttccaagagttgtacaaggcaagaggtggatcattgccacatcgtattgaagagccatggttgttggatgctgaagtgttgtcttatctccagattgatgactccactgatttgaaaacgtcaggtcttattctccaaaatgttctcagattggaaaccaacaaggaggaacgtgaagttattcaacgtttgacaagagctatttctcagagagctgcccatttgtctgcgatcccaattgcagctatagccaaaaaagtgaaagaccaatataaggatgatgatagagactttgaggttggttgtgatggttctgtgattgaattttatccaggattcagacaagcagtgttggagtcaattgaaaaaatcaatcctttgaagggcaccaataaaaagattcatttgaagatcgccaaagatgggtcaggcgttggtgcagcattgtgtgccagtaccgcatag

SEQ ID NO: 2938 - DNA, 1440 bp, Candida albicans
tatctatatttctccatcatcatgtcactttcacccaaattagaagaaattgtcagctcaattgaaaaatcatttgaaattaaagatgattttttagtcaaggcaactgagtatttcattgaatcaatgaatgttggtttggaatcaccaaaaccttcaaaagatgtcatgcctatgattccaacctatgttacctcaattccaactgggaaagaagtagggttatatttggcagctgatttaggtgggactaatttcagagtttgttcaattgacttgaaaggtgaccacacattttccatgaaacaaagcaagtatcgaatccctgtggatttgatgaaagcagaaaagtccaatgatttatttggttttttggcaaagaaagtccaatctttcttacttgaaaaccattcggaagcctgcactgcgaaaaacaccgagcccctcaagttgggtttcactttctctttccctgttaatcaaactgcattgaatcgtggaacattaatcagatggaccaaaggttttgatatccctgatactgttgaccgtgatgttgtggagttattacaagcaaattggactatcttggaagtcaatgtcaaagttgtcgcaattgcaaacgatactgttggtactttgcttactgctgcttactccaatgactcagcaaagacaaacagaaacacaatcattggttgtatttttggtacaggaactaatggtgtttatttcgagtcaaaaattcccaaattatccagtttgactggcaaaagccaaggtatggtcatcaacacagaatggggttcatttgacaacggcttaaagatcttgccttccactgagtttgatgaaattgtcgattccgaaaccgctaaccctggttatcacttgtttgaaaagagaatcagtggaatgtttttgggagagattttgagggttgctttgattcatttatttaaaaatggtttgattttccaagagttgtacaaggcaagaggcggatcattgccacatcgcattgaagagccatggttgttggatgctgaagtgttgtcttatcttcagattgacgactctaccgatttgaaaacgtcaggtcttattctccaaaatgttctcagattggaaaccaacaaggaggaacgtgaagttattcaacgtttgacaagagctatttctcagagagctgcccatttgtctgcgatcccaattgcagctatagccaaaaaagtgaaagaccaatataaggatgatgatagagactttgaggttggttgtgatggttctgtgattgaattttatccaggattcagacaagcagtgttggagtcaattgaaaaaatcaatcctttgaagggcaccaataaaaagattcatttgaagatcgccaaagatgggtcaggcgttggtgcagcattgtgtgccagtaccgcatag

SEQ ID NO: 2939 - DNA, 1434 bp, Candida albicans
attttttttttgttcactttctacgaaatatataaatcctcttttaattccaactcaattcactcctcatttcattcaattgaatttttttttctttcttctttctttttttatttcttatattttctaattcaatttttcaatcaagcgattatcaattgcagaagaataactatcaaaatgtcattatctaacaaattatcagtcaaagacttagacgttgctggaaagagagtctttatcagagttgacttcaacgtcccattggacggtaagactatcaccaacaaccaaagaattgttgctgctttgccaaccatcaaatacgttgaagaacataaaccaaaatacattgtcttggcttcccacttgggtagaccaaacggtgaaagaaacgacaaatactcattagctccagttgctactgaattggaaaaattgttgggtcaaaaagtcaccttcttgaacgattgtgttggtccagaagtcaccaaggctgttgaaaacgccaaagatggtgaaatctttttgttggaaaacttgagataccacattgaagaagaaggttcttccaaagacaaggatggtaagaaagtcaaggctgatccagaagccgttaagaaattcagacaagaattgacttcattggctgatgtctacattaacgatgcctttggtactgctcacagagcccactcctctatggttggtctcgaagttccacagagagctgctggtttcttaatgtccaaagaattggaatactttgctaaggctttggaaaacccagaaagaccattcttggccattttgggtggtgctaaagtttctgacaagattcaattgattgacaacttgttggacaaggttgatatgttgattgttggtggtggtatggccttcactttcaagaaaatcttgaacaaaatgccaattggtgattctcttttcgatgaagccggtgctaaaaacgttgaacacttggttgaaaaagctaagaaaaacaatgttgaattgatcttgccagttgattttgtcactgctgataaattcgacaaagatgccaaaacttcttctgctactgatgctgaaggtattccagacaactggatgggtttggactgtggtccaaaatctgtcgaattgttccaacaagctgttgccaaagctaagaccattgtttggaacggtccaccaggtgttttcgaatttgaaaaattcgccaacggtactaaatccttattggatgctgctgtcaaatctgctgaaaatggtaacattgttatcattggtggtggtgatactgctaccgttgctaagaaatacggtgtcgttgaaaaattatcgcacgtttctactggtggtggtgcttcattggaattattagaaggtaaagacctgccaggtgtagttgctctttccaacaaaaactaa

SEQ ID NO: 2940 - DNA, 621 bp, Candida albicans
ggatgtggtatttattactggttacggttgcggcccaccattactgcaaatgtccaagaaggtgataatgttgctgtctttggtggtggttgtgttggtttatctgttatccaaggttgtaaagaaagaaaagtcaacaagatcattttggttgatataaacgacaaaaaagaagaatggggtaaacaatttggtgccactgattttgtcaactcaactaaattgccagaggggactaccattgtcgataaattaattgaaatgaccgatggtggttgtgactacacttttgattgtactggtaacgtcaacgtcatgagaaatgcattagaagcttgtcacaaaggttggggtacttctattatcattggggttgctgctgctggtaaagaaatctctaccagaccatttcaattagttaccggtagggtgtggaaaggtgctgcctttggtggtgttaaaggtagatctcaattgccaggtatagttgaagattacttggatggtaaactcaaggttgaagaattcatcacccacagagaaccattggacaagatcaacactgctttcgatgaaatgcacggaggcgactgtattagagctgttgtttctttatggtga

SEQ ID NO: 2941 - DNA, 408 bp, Candida albicans
tacatttatacaattttagaaacaatggctcgtcaatttttcgtaggtggcaacttcaaagctaacggtaccaaacaacaaatcacttcaatcatcgacaacttgaacaaggctgatttaccaaaggatgtcgaagttgtcatttgtccaccagccctttaccttggtttagctgttgagcaaaacaaacaaccaactgttgccattggtgctcaaaatgtttttgacaagtcatgtggtgctttcactggtgaaacctgtgcttctcaaatcttggatgttggtgccagctggactttaactggtcacagtgaaagaagaaccattatcaaagaatccgatgaattcattgctgaaaaaaccaagtttgccttggacactggtgtcaaagttatccttatgtattgc

SEQ ID NO: 2942 - DNA, 231 bp, Candida albicans
ggtttagccgctaccccagaagatgctgaagacacccacaaaggtattagagctcatttggccaagagcattggtgccgaacaagctgaaaaaaccagaatcttgtatggtggttcagtcaacggtaagaacgctaaggatttcaaagacaaagcaaatgttgatggtttcttagtcggtggtgcttcattaaaaccagaatttgttgatatcatcaaatctagattataa

SEQ ID NO: 2943 - DNA, 1260 bp, Candida albicans
gctctttcttttcttcttgtttatcttcccacatcaatccaacctttattaccaatgtaccgtgcaacagctactagtcgccaattggtcggtactaccgccaatatacttgtcgccaaaagatcaatggccaaagccgcctcagatttggtcactatcgaattaccagccagctcctacgaaggatacaatttggaagttccagctttgagttttgaaaccgaaaaagaaaccttattgaaaatgtacaaagatatgattatcatcagaagaatggaaatggcagccgatgctttatacaagagtaaaaaaattagaggtttctgtcacttgtctgtcggtcaagaagccattgctgttggtattgaaaatgccattacaccaactgacactgtcattacctcttatagatgtcacggttttgcattcatgagaggtgcttctgtcaaatctgttttggccgagttaatgggtagaagatctggtattgccaacggtaagggtggatcaatgcatatgttcactaacggattctacggtggtaacggtattgttggtgcccaagttccattgggtgctggattggctttctcccacaagtacaagaacgacaaagctgtcacttttgatttgtatggtgatggtgcgtctaaccaaggacaagttttcgaagcttacaacatggccaaattgtggaacttaccagttattttcgcctgtgaaaacaacaagtatggtatgggtacctctgctgccagatcatcagctatgaccgaatactacaagagaggtcaatatatcccaggtttgaaaatcaacggtatggatgtgttggccacctaccaagcctccaaattcgccaaagactgggcttctcaaggcaatggacctcttgttttagaatacgaaacttacagatatggtggtcactccatgtctgatccaggtaccacttacagaaccagagaagaagtccaacatatgagatctagaaacgatccaattgctggattgaaagctgttttgttagaaaaagagattgcttctgaagacgaaatcaaatcttacgacaaagccgctagaaaatacgttgatgaacaagttgctgctgctgaagctgatgctccaccagaagctaaaatggatattttattcgaagacgtttatgttccaggtagtgagattcctgttttgagaggtagaatctccgacgatagttgggatttcaaaaacaagacttttttgaacaaggtctattaa

SEQ ID NO: 2944 - DNA, 1518 bp, Candida albicans
atattctttctttctgttcacattatatattcttctcaacaaatgttaagatcattcaaatctattccagccaatggaaaattggcccagtttgttagatatgcatcaaccaagaaatacgacgttgttgtcattggtggtggaccaggtgggtacgttgctgccatcaaggccgctcaattaggattaaacactgcctgtattgaaaaaagaggtgcattaggtggtacttgtttgaatgttggttgtatcccatccaaatctttattgaacaactcccatttattacaccaaatccaacacgaagccaaagaaagaggtatttctatccaaggtgaagttggcgttgattttccaaaattgatggctgccaaggaaaaagccgtcaaacaattgaccggtggtattgaaatgttgttcaaaaagaacaacgttgactacttgaaaggagccggttcttttgttaacgaaaaaaccgtcaaagtcactccaattgacggcagcgaagcacaagaagttgaagccgaccacatcatcgttgctactgggtctgaaccaactccattcccaggtattgaaatagatgaagaaagaattgtcacttctactggtattttatcattgaaagaagtaccagaaagattagccatcattggtggaggtatcattggtttggaaatggcttccgtttacgcaagattgggctctaaagtcactgttatcgaattccagaacgctattggtgccggtatggatgctgaagttgctaaacaatctcaaaaattattggccaaacaaggtttggacttcaaattaggtacaaaggttgttaaaggtgaaagagatggtgaagtggtcaagatcgaagttgaagatgtcaaatccggtaaaaaatctgaccttgaagccgatgtcttgttggttgccattggtagaagaccatttactgaaggtttgaactttgaagccattggtttagagaaagataacaagggaagattgattattgacgaccaattcaagactaaacatgaccacatcagagttattggggatgtcacattcggtcctatgttggcccacaaggctgaagaagaaggtatcgctgctgctgaatacatcaagaaaggtcacggtcatgtaaactatgctaacatcccttctgttatgtatactcacccagaagttgcctgggttggtttaaacgaagaacaattgaaagaacaaggcatcaaatacaaagtaggtaaattcccattcattgccaactccagagctaaaaccaacatggacactgatggtttcgtgaaattcattgctgatgccgaaacccaaagagtgttgggtgtccacattattggtccaaatgcaggtgaaatgattgctgaagctggtttggccttagaatatggtgcttccaccgaagacatttcaagaacatgtcatgctcatccaactttatctgaagctttcaaggaagctgctttggccacctttgataagccaatcaacttttaa

SEQ ID NO: 2945 - DNA, 1371 bp, Candida albicans
cgcggatcctgccagccccgtggtgaagatgggggtacctctgaagaagtgctttgtgatatcaaactgtcgttgaaagagaattccccaattactatgttgcctaactataatgtctcccctacaggcaacgagcatggacagtatttggttattgatttaggagggtcgacattgagaatagcagtggtagacatttccaagccacacccaaatttgtcgagaagtgagaggataactatagttgtggaaaagagttggattattggcaacgactttaagaggattgatggtgagtttttcaagtatattgggtccaagattaacgagatattggtgggacagaatgttattgatgtaaagtcggttatcaatactggtataacctggtcgttcccgttggaaacaaccgactacaatagaggcaagatcaagcatgtttccaaagggtatactgtgggagaggatatttacgacaaggatttaaagatggttttggaagacacgttgagacaagagtacgggttgacacttgacgtgcagtctatattgaacgactcgttggcggtgtattctgctgggtgctttattgattcgaagatgaagttggccatggtgttggggacagggattaacatgtgctgttccctaaaaaggtcaagtgatatccacccctccaagatgttggctgatgctacgttgtttaattgtgagctctcgttgtttggccagaatctatgtaaagactttgctacgaaatatgatatcattatagacaagaggtttgctggtttcctgcaccactttaagacgtttatggagcctgaccctattacaaaaacgcttttccagccgcacgagttgatgactagtgggaggtacttgccggaattgacgaggttggtggtggtagatttgattgaggctggcgagatttttcaaaatgttgaccaccaacagatgtaccaagagtatggtgggtttagtggggagttgatgtgttttgtgcatgagaatgacgattatgatgatatacatgacaagttgtgcaaggcctacggctggacgacggttgggttgagtgacattgtctgcttgaaagaagttgtatcgtgcattatcaagcgggcggcgtttattgttgccaatgcgattattgcgtttttcaaattgttgggcagtgacgagttgggtggtgatgtgacgattgggtatgtggggtcggtcttgaactactttcacaagtatagacggttgattgttgagtatgtgaatagcgcagaggaggccaaggggataaaggttgacttgaagttgattgaaaatagctcgattataggtgctgccataggtgctgcctatcataagtag

SEQ ID NO: 2946 - DNA, 1476 bp, Candida albicans
ttcaattttatattacttacaatggtgcatctcggtccaaaaccagctcaaaaaagaaagggaactttcactgatgtttctcctcaattattagaagctcttaaaccaattcaagagcaattcaccatttctgcagacaaattgagagctattgttaaacatttcatctcagaattagaccgtggtttatcaaaagctggtggtaacattcctatgattccaggttgggtcatggatttcccaaccggtaaagaaactggttcttatcttgccattgacttgggtggaaccaacttgagagttgtcttggttaaattgggcggtaacagagactttgacaccactcaatccaagtttgctttgccagctcacatgagaactgccaccctggacgaattatgggattttattgctaaatgtttgaaagagtttgttgatgaaatctacccagatggttgcagtgaaccattgccattgggtttcacatttagttatccagcttctcaaaaccgtatcaatgaaggtatcttgcaaagatggactaaaggttggtcaattgatggaattgaaggaaaggatgttgttccaatgttgcaaaaagccattaagaaagttggtgtcccaattgatgttgttgcgttgatcaacgataccacaggtacattagttgcttctatgtacacagacccagaagctaagatgggtttgatttttggtactggtgtcaacggtgcttatttcgatgttgtcaaggacattcctaaattagaaggtaaatgtccatcagatattccaccagaatcaccaatggccatcaactgtgagtacggttcatttgataacgaaaagtatatcttgccaagaactaaatacgatgttcaaattgacgaagaatcgccaagaccaggtcaacaaactttcgaaaagatgatctccggttactatttgggagaagttttgagattgattttattggaatttgctgaagagaagaaattgatcttcaaaggtcaaaaccttgacaagttgaaggttccatacgtcatggatgcctcttatccatccaaaattgaagaagatccatttgaaaacttgtctgatgtcgccgacttatttagagaaaaattgggcattgaaaccacagaaccagaaagaaagattatccgttgtttagcggaattgattggtgaaagatctgctagattctctgtttgtggtattgctgctatttgccaaaagagaggttacaaaaccgctcattgtgctgctgacggttcagtgtacaacaagtacccagggttcaaagaaagaactgcccaagctttaagagacatctacgaatggccagctgatgtcaaggacccaatcatcattgttccagctgaagatggtagtggtgttggtgctgccgttattgctgctttgaccgaaaagagattaaaagaaggtaaatccgttggtttgttgggtgcttag

SEQ ID NO: 2947 - DNA, 954 bp, Candida albicans
gagttgctttgggcagaaaagacattgaagttgtcgccgtcaacgatccattcattgctccagactatgctgcttacatgttcaaatacgattctactcacggtagatacaagggtgaagtcactgcttctggtgacgacttggtcattgatggtcacaagattaaagttttccaagaaagagaccccagctaacattccatggggtaaatctggtgttgactacgttattgaatccaccggtgttttcaccaaactcgaaagtgctcaaaaacacattgatgctggtgccaaaaaagttatcatcactgctccatctgctgatgccccaatgtttgttgtcggtgttaacgaagacaaatacactccagacttgaagattatctccaatgcttcttgtaccaccaactgtttggctccattagctaaagtcgtcaacgatactttcggtattgaagaaggtttgatgaccactgtccactccatcactgctacccaaaagaccgttgacggtccatcccacaaggactggagaggtggtagaactgcttctggtaacattatcccatcttccactggtgctgctaaagccgttggtaaggttattccagaattgaacggtaaattgactggtatgtctttgagagtcccaaccaccgatgtttccgttgttgacttgactgtcagattgaagaaagctgcttcttacgaagaaattgctcaagctatcaagaaagcttctgaaggtccattgaaaggtgttttgggctacactgaagatgctgttgtctccaccgatttcttgggttcaagctactcatctatctttgatgaaaaagccggtatcttgttgtccccaactttcgtcaaattgatttcctggtacgataacgaatacggttactccaccagagttgttgacttgttggaacacgttgctaaagcttctgcttga

SEQ ID NO: 2948 - DNA, 1023 bp, Candida albicans
cgaattagaaatatgcctagctcatccgacgcaatcaataggataagttacatatcccttgtcaccagtgacaatgacaaattcaaccaaacattccaattctacagtcaattgggatttagattgacaaaaagtttctccaaagtttcaagctacggatctggattaggtgccaaccatccagaattccaattgggtgtttctcatgattcacttaaagaagtttggttagaatcttacccattacaaaatgtcgacagtaatggaaaccttcgtccttggcaagaaatggaagtttatgacggtgataattgtgaaagattaaatgaatcaactgtgattaaagttagattacttggcgaaacccctttgaagtcaatttctcaaaaacaatttgtgtttttcaccactcaattgaataaaattgaaaaaatcttgaccgatgcaaatgtcaaatatgggaaagttgttgataatgtcattttagctgaggatccattaagcaacattatcagtttttccaatactcaaaatgaattgtgtaaaactagattccaatcaccagaagagtatgttgaaaaaaccactgcagaaatattggctaaaagaaagaaatctcaattgggttctaaatttggttcatttgaagaaatttcaccaagtgaagttggcggtggtaatggtttacgtaaaaagaaaattggggtgatgacatctggtggtgatgctcctggtatgaatccagcagttcgtgctgttgttagagccggtatttattatggttgtgatgtttatgccgtttacgaaggttatgaagggttagttaaaggaggtgatcttttaaagaagatggagtggagtgatgttcgttcttatatgtctcttggtggtacttcaattggtactgctagatgtaaagaatttagagaaagagccggaagattacaaggggcatacaatatgatcaagaatggtattgacgcattagttgtatgtggtggtgacggttcatttcttcaccac

SEQ ID NO: 2949 - DNA, 711 bp, Candida albicans
atcttaccatcaacaatacctttggtaaagttgcatacaatttacaaaaattccatatccaaagggttattgattgttggtggatttgaagcttttattcaattgcatgaattatgtgaacaaaaagccaattatccaatatttgaaattccaatggtggttgttccagcaacagtttcagacaatgttaatggtactgagtattctcttggtgatgacacctgtttgaatcaattagtttcatactgtgatgcagttcaacaatcagcatcttcaactagaagaagagtgtttgtagttgaagtgcaaggtggtcacagtgggtatgttgcatcctactgtggattgataactggtgctttagccacttatacacctgaatcaaacataaacttgagagaattacaaggagatatcgatttattgcagaaagtgtttgccactgaccgtggtgaagatcataatggtactcttattgttagaaatgaacaagccagtgctgtttattcgactcaattgattgctgatattcttaaagaaaatgccaataaaagatttgaaaccagaacagcaattccaggtcatgttcaacaaggtttcacaccaagtgccaatgatcgtgttatggcagttaaattatcattaaaagccatggaatttattgaaacaagaaatgggtgttatggtaaacacgatcgtaaattatcgtga

SEQ ID NO: 2950 - DNA, 903 bp, Candida albicans
ttcaggaatattacaacaatgtcttacgccactaaaatccacgccagatacgtctacgactccagaggtaacccaaccgttgaagttgatttcaccaccgacaaaggtttattcagatcaattgtcccatctggtgcctctactggtgtccacgaagctttggaattgagagatggtgacaaatccaaatggttaggtaaaggtgttttgaaagccgttgccaatgttaatgacatcattgccccagctttaataaaagccaagatcgatgttgtcgaccaagctaagattgatgaattcttgttgtccttggacggtactccaaacaaatccaaattgggtgccaatgctatcttgggtgtttctttggctgctgccaatgctgccgctgctgctcaaggcattccattgtacaaacacattgccaacatttccaatgccaagaaaggtaaattcgttttgccagttccattccaaaacgttttgaacggtggttcccatgctggtggtgctttagctttccaagaatttatgattgccccaactggtgtctccactttctctgaagctttgagaattggttcagaagtttaccacaacttgaaatctttgaccaagaagaaatacggtcaatccgctggtaacgtcggtgacgaaggtggtgttgctccagatatcaaaactccaaaggaagctttggacttgatcatggatgccattgacaaagccggttacaaaggtaaggctggtattgccatggatgttgcttcatctgaattccaccaagacggtaaatacgacttggactttaaaaacccgaatccgaaccatctaaattggtgtccgggcccccaattgggtgaatttatttcaacaattgaattccccaataccccattggtt

SEQ ID NO: 2951 - DNA, 447 bp, Candida albicans
attgtttctattgaagatccattcgctgaagatgactgggatgcttgggtccacttctttgaaagagttggtgacaagatccaaattgtcggtgatgatttgactgtcactaaccctaccagaatcaagactgccattgaaaagaaagccgctaatgctttgttgttgaaggttaaccaaattggtactttgactgaatctatacaagctgctaacgattcttacgctgctggttggggtgtcatggtttcccacagatccggtgaaaccgaagatactttcattgctgacttgtcagttggtttaagatctggtcaaatcaagactggtgctccagccagatctgaaagattggccaaattgaaccaaatcttgagaatcgaagaagaattaggttctgaagctatctacgctggtaaagatttccaaaaggcttctcaattgtaa

SEQ ID NO: 2952 - DNA, 255 bp, Candida albicans
ttaacaatggctattaaaattggtattaacggtttcggtagaatcggtagattagtcttaagagttgctttgggcagaaaagacattgaagttgtcgccgtcaacgatccattcattgctccagactatgctgcttacatgttcaaatacgattctactcacggtagatacaagggtgaagtcactgcttctggtgacgacttggtcattgatggtcacaagattaaagttttccaagaaagagaccccagctaa

SEQ ID NO: 2953 - DNA, 414 bp, Candida albicans
tatcacacaatgccaaagttagttttagttagacacggtcaatccgaatggaatgaaaagaacttgttcaccggttgggttgacgtcagattatccgaaactggtcaaaaagaagctaaaagagctggtgaattattgaaagaagctggtatcaatgttgatgttttgcacacctccaaattatccagagccatccaaactgccaacattgccttggatgctgctgatcaattgtacgttccagtcaagagatcttggagattaaatgaaagacactatggtgctttacaaggtaaagacaaagctcaaactttggaagcttacggtcaagaaaaattccaaatctggagaagatcttttgatgttccaccaccaaagattgatccaaaagatgagtactccccaagttggtga

SEQ ID NO: 2954 - DNA, 372 bp, Candida albicans
tttctcacgttaagcgggcctcttgccacccccgtggtgaagaacgttgatccagctgttgttccattgactgaatcattagctttggtcatcgacagattgttgccatactggcaagacgaaattgctggtgacttgttggctggtaaagttgtcttaattgctgctcacggtaactccttgagagctttagttaaacacttggacaacatctctgatgaagatattgccggattgaacattccaactggtattccattggtttacgagttagacgaaaacttgaaaccaactaaaccttcttactacttggacccagaagctgctgctgccggtgctgctgctgttgctgctcaaggtcaaaagaaataa

SEQ ID NO: 2955 - DNA, 807 bp, Candida albicans
atcttttatcaattaatcataatgggggttcataaattaataattctaagacatggagaatcacaatggaatcatgagaataaattctgtggatggattgatattccattatcacaaaagggcaaacaagaagcaatttatgctggagaattaatcaaaaagaaccatcttgatcctgatatcttatatacatcgaaattaatgcgatcaatagaaactggattgacaattttggaagtattacacaaaccatggattgatcatatcaaaacttggagattgaatgaacgacattatggtcaatatcaaggaagagataaacatgaagtgtttgttgaattgggtaaagataaagagaaattccaatatattagaagagattatcatggattgccacccttaatagaatatggtcaagataaatcaattgatgaaaaatacaaggatgtattgaataaagatatattacctcgaggagaatcattactgatggtgatggacagattgattccgtttttcaaatatgaaatattagataatcaaatgattcaattgaataaaactgttttgatagtgactcatggttcaattgttagaagtttgatcaaatatcttaatcatgtaagtgatgatgatatatccaagattaatgtccctacaggtataccattggtatttgaattgaatgatagaggtgaattgatcaaaccttattattatttggatcaagaaaaggcagaaaaggggatcgccaaagtgaaaatggaaggtcttgaaagaaaaggacaaacagatgaaaaactataa

SEQ ID NO: 2956 - DNA, 1101 bp, Candida albicans
tcaattaatatcaaattaacaatggctcctccagcagttttaagtaaatccggtgttatctacggtaaagacgtcaaagacttgtttgactatgctcaagaaaaaggttttgccattccagctatcaatgtcacttcatcctcaactgttgttgctgctttagaagctgccagagacaacaaggctccaatcatcttgcaaacttctcaaggtggtgctgcctactttgccggtaaaggtgtcgataacaaagatcaagctgcttccattgctggttcaattgctgccgctcactacattagagccattgctccaacttatggtatcccagttgttttacacactgatcactgtgccaaaaaattattgccatggtttgatggtatgttgaaagccgatgaagaattctttgctaagaccggtactccattgttctcatcccacatgttggatttatctgaagaaaccgatgacgaaaacattgctacttgtgccaaatatttcgaaagaatggctaaaatgggtcaatggttagaaatggaaattggtatcactggtggtgaagaagatggtgtcaacaacgaacacgttgaaaaagatgctttatacacttctccagaaactgttttcgctgtctacgtatctttacaccagatttctcctaacttttctattgctgctgcttttggtaacgtccacggtgtttacaaaccaggtaatgtgcaattgagaccagaaatcttgggtgaccaccaagtttacgctaagaaacaaattggtactgatgctaaacacccattatacttggttttccacggtggttctggttctactcaagaagaattcaacactgctatcaagaatggtgttgtcaaggtcaacttggacactgattgtcaatacgcttacttgactggtatcagagattacgtcaccaacaagattgaatacttgaaagcaccagttggtaacccagaaggtgctgacaaaccaaacaagaaatactttgacccaagagtctgggttagagaaggtgaaaagaccatgtccaagagaattgctgaagctttggatattttccacaccaaaggacaattgtaa

SEQ ID NO: 2957 - DNA, 1323 bp, Candida albicans
aatactggatctgcccgccgttgtgaagatcctgtgtacattgctcttccttctaatatggtagacatgaaggtgccacaagcgatgctagagaagtctattgatttatctttggagcccaacaatattcaatcgcaaaatgaggtcattgatagaattttgggtatggttagcaaagctagtaacccaattgttttggtagacgcctgtgcttccagacatgattgtaaaaaagaggttaagcaattggttgaaacaactcagttcccagtttatgttactccaatgggtaaaggtatgattgatgaaggtggtattggtggtgaagatctagcagatgcctctgcctttaaaaacttggcatccaatttaagttctggcacttcagttgcttccagatatggtggcgtttacattggctctttatctaaaccagaagtcaaagaaggtattgaaaattcagacttgatcttttcctgtggtgcattattgtccgattttaacactggttcattttcgtactctattggtaccaagaatgttattgaattccattctgaccatgccaaaatcaaactggcaatatattctggaatcaaaatgaaagaactcatgcaggcattgaataaaaaaatttcatccgtacttactaattatgttcccaaatctgttccaaaagtcaaattggtaaacgcacccactgaattgtctgcccccttgactcaagcttggttttggacacgtgttagctcctggtttaaagaagaagatatcattattactgaaagtggaacggctgctcatgggatcctcgaagcacgatttccaaacaacgtggtggggatatcacaaattttgtggggttcgattggatactctgttggtgcaacacttggtgctagtgtagctgccaaggaagttgatcctaagaaaagagtcattttatttgttggtgacggttccttacagttgacaatgcaagaagtatcaaccatgataaaaaacggggtccatccttatatttttgttgtgaacaatgccggctacacaattgaaaaattgattcatggattaaatgcaaaatataacaatattcaaccttggaatcattcacagattttgctgttgtttaatgctaaggatagtcaatctgctaaaatcagcactgttggtgaagctgatgatttattccgcaacaaatattttggtgtaaatagcaaaattaggttgattgagcttatgtttagttcgttagatgcaccaaaggcattagttcaacaggctaaggctgctgctgatgtcaatcgaggtactactgattga

SEQ ID NO: 2958 - DNA, 960 bp, Candida albicans
ttgaagaaactcaattcccagtcttcattactcccaatgggtaaatcaagtgtcgatgaatcccacccaagattcggtggtgttaacgttggtagtttgtccaaaccagaagttaaagaatctgttgaaagtgctgacttgatcttatctatgggtgctttattatctgatttcaacactggttcattctcatacggttacaaaactagaaacattgttgaattccattctgattacaccaagattagacaagctactttcccaggtgttcaaatgaaagaagctttgcaaaaattattgacaaccgtcaagaaatcaatcaatccaaactacactccagttccagttccagaaaccaaattaatcaacaccccagctgccccatcaactccattgactcaagaatacttgtggactaaagtttcatcttggttcagagaaggtgatatcatcatcactgaaaccggtacttctgcattcggtatcgttcaatcacgtttcccaaagaactctattggtatttctcaagtcttgtggggttccattggttacactgttggtgctacttgtggtgctgccatggctgctcaagaattagacccaaagagaagagtcatcttattcgttggtgacggttccttacaattaaccgttcaagaaatctccaccatgtgtaaatgggaatgtaacaacacctatcttttcgttttgaacaatgatggttacaccattgaaagattgattcacggtgaaaaagctcaatacaatgacattcaaccatggaacaacttgcaattattgccattattcaatgctaaagattacgaaactaagagaatttctactgttggtgaattgaatgatttgtttgccgacaaagcttttgctgttccagataagattagaatggttgaagtcatgcttccaactatggatgctccagctaacttgtcttcacgc

SEQ ID NO: 2959 - DNA, 777 bp, Candida albicans
aactcacaaattatcaaatttacaatgtccgaaattactttagggagattcttctttgaaagattacatcaattgaaagttgacaccgttttcggtttaccaggggatttcaacttggctttattagataaaatttatgaagttgaaggtatgagatgggctggtaatgccaatgaattgaatgccggttacgctgccgacggttacgccagagtcaatccaaatggtttatctgctttagtcagtactttcggtgtcggtgaattgagtttgactaatgccattgctggttcttattctgaacacgttggtgtcattaacttggttggtgttccatcatcttctgctcaagctaaacaattgttgttgcaccacactttaggtaatggtgatttcactgttttccacagaatgttcaagaacatttctcaaaccagtgcctttattgctgatattaactctgctccagctgaaattgacagatgtatcagagatgcttatgtttacccacgtccagtttacattggtttaccatccaacttggtcgatatgagagttccaaaatcattattagacaaaaagattgacttatcattacatccaaacgacccagaatctcaaactgaagttattgaaaccgttgaaaaattgatttctgaagcttctaacccagttatcttggttgatgcttgtgccatcagacacaactgtaaaccagaagttgccaaattgattgaagaaactcaattcccagtcttcattactcccaatgggtaa

SEQ ID NO: 2960 - DNA, 234 bp, Candida albicans
cttacactttcacacaaacagttacaaacaagcataacttatataatgagagaaatatcattgggtagatacatttttgaacgattgtaccaattgaatgttcacacagtctttggtgttcctggagattttaacttatcacttttggataaaatttacgaaactgaaaatgaacatggaggaggttcgtttatttgggcagggaattgcaatgagttgaatgcaacatactcg

SEQ ID NO: 2961 - DNA, 711 bp, Candida albicans
gatcttccaacaacgtccaaggttttggtttctgaagagcaagaagaccttattgtgttcccaggtggtggcacatatgctgtttgtactgatccaattgatgggtcgtccaatatcgatgctggtgtttctcttggtacgatttttggtgtgtacaagttgcaagaggggtctactggtggcatcagcgatgtcttgcgtcttggtaaggagatggtcgctgcggggtacaccatgtacggtgcatctgcccatttggcattgactacaggtcacggtgtcaatctttttactttggatactcagttgggtgaatttatcttgacccatccaaacttgaagttgccagatactaagaacatctactcgttgaatgaagggtactcgaacaaattcccagaatacgttcaagattatttgaaggacattaaaaaggaagggtacagtttgagatacattgggctgatggttgctgatgtccatcgtactcttttgtatggtggtatttttgcttaccctacattgaagttgagagtgttgtatgaatgtttccccatggccttgttgatggaacaagcaggcggttctgctgtcaccatcaagggtgagaggatcttggatatcttgccaaaaggtatacacgacaagagttctattgtgttgggatccaagggtgaagttgaaaagtatttaaagcatgtaccaaaatag

SEQ ID NO: 2962 - DNA, 942 bp, Candida albicans
ttcacgtcaaatactctggtgtctgtcaacattgatatacatgcttggaaaggtgactggccattggctactaaattgccattagttggtggtcacgaaggtgccggtgtcgtcgtccgtatgggtgaacacgtcaaaggatggaaaatcggtgactttgccggtatcaaatggttgaacggttcttgtatgagttgtgaattctgtcaacaaggtgctgaaccacactgtggtgaagctgacttgtctggttacactcacgatggttcattcgaacaatacgctactgctgatgctgtccaagccgctaaaattccagctggtactgatttagccaatgtcgcaccaatcttatgtgctggtgttactgtttacaaagccttaaagactgctgacttagcagctggccaatgggttgctatctccggtgctggtggtggtttaggttctttggccgttcaatacgccagagccatgggtttgagagttgttgctattgacggtggtgacgaaaaaggtgaatttgttaaatcattgggtgctgaagcttacgttgatttcaccaaagataaagatattgttgaagctgtcaagaaagctactgatggtggtccacacggtgctatcaatgtctctgtttctgaaaaagccattgaccaatctgttgaatatgttagaccattaggtaaagttgttttggttggtttaccagctcacgctaaagtcactgctccagttttcgatgctgttgtcaaatccattgaaatcaaaggttcttacgttggtaacagaaaagacactgctgaagctattgacttcttctccagaggtttaatcaaatgtccaatcaagattgtcggtttatctgacttgccagaagtcttcaaattgatggaagaaggtaaaatcttgggtagatacgtcttggacaccagtaaataa

SEQ ID NO: 2963 - DNA, 1059 bp, Candida albicans
ctcaattacaccatgtctgtcccaactactcaaaaagctgttattttcgaaaccaacggtggtaagttggaatacaaagatatcccagtcccaaaaccaaaagcaaatgaattgttaatcaacgttaaatactctggtgtctgtcacactgatttacacgcttggaaaggtgactggccattggctactaaattgccattggttggtggtcacgaaggtgctggtgttgttgtcgccttgggtgaaaacgttaaaggctggaaagttggtgattacgctggtgttaaatggttgaacggctcttgtttgaactgtgaatactgtcaatcaggtgctgaaccaaactgtgctgaagctgatttatccggttacacccacgatggttctttccaacaatatgctactgctgacgctgttcaagctgccagaatcccagctggtaccgacttagccaatgttgcaccaatcttatgtgctggtgtcaccgtctacaaagctttaaagactgctgaattagaagccggtcaatgggttgctatttccggtgccgctggtggtttaggttctttagctgttcaatacgccaaggccatgggttacagagttcttgccatcgatggtggtgaagacaagggtgaattcgtcaaatccttgggtgctgaaacctttattgattttaccaaagaaaaagacgttgtcgaagctgtcaagaaggccaccaatggtggtccacatggtgttatcaatgtctctgtctcagaaagagccattggtcaatccactgaatatgtcagaactttaggtaaagttgttttggttggtttgccagctggtgctaaaattagtaccccagtctttgatgctgttatcaagaccattcaaattaaaggttcttatgtcggtaacagaaaagatactgctgaagccgttgatttcttcacaagaggtttgatcaaatgtccaatcaagattgttggcttatccgaattaccagaagtttacaaattgatggaagaaggtaaaatcttgggtagatatgtcttggacaacgacaaataa

SEQ ID NO: 2964 - DNA, 1308 bp, Candida albicans
cttctcttgttagtaccaatgtcggaattatcaattaaaacaattgaaactaaaccatttcaagatcaaaaacctggaacttcaggcttaaggaaaaaagtcactgtatttcaacaacctcattataccgaaaatttcattcaatcgattttagatgccattcctgaaggttctcaaggttcaacattagtcattggtggtgatggtagattttataatgatgttgttattcaattaatcattaaaattgctgctgccaatggagttaaaaaattgattcttggtcaaaatgggattttatcaactccggcaacttctcatgtaattagaattaaacaagccaccggtgggattattttaactgctagtcataatcctggtggtccccagaatgatttaggaattaaatataatttaggtaatggtggtccagctccaaaatcagttacaaataaaatttatgaaatttcgaaacaaattaatcaatataaattaattgaattaccaaatgtcgatttatctaaaattggtactattgttgaaggaccaattgaaattgaaattattgattcaactaaagattatgttgatatgttgaaatcaatttttgatttcccattgattaaatcatttattgataaagctactaaagaacaagactttaaagtattatttgatgctttaaatggtgttactggtccttatggttatgaaatatttgttaatgaattgggattaccagaatcttccattcaaaattataagccattaccggattttggtggattacatccagatccaaatttaacttatgctcatacattagttgaaagagttgataaagaaaatattgcatttggtgctgcttccgatggtgatggtgatagaaatatgatttatggtgctgggacttttgtttcaccaggagattccgttgctattatttctgaatatgctgattcaattccatatttccaaaaacaaggagtttatggattagctagatcaatgcctacttcaggtgccattgatcttgttgctgctaataaaaatttacaatgttatgaagttcctactggttggaaatttttttgttcattatttgatgctaaaaaattgagtatttgtggtgaagaaagttttggtactggatctaatcatattagagaaaaagatggattatgggccattgtggcttggttaaatgttttagctggttataataaacaaaaccctcaatctaaaacatcaattgaaattgttcaaaattcattttggggaaaaatatggtcgaacttttttcactag

SEQ ID NO: 2965 - DNA, 447 bp, Candida albicans
aattgttcaaaattcattttggggaaaaatatggtcgaacttttttcactagaaatgattttgaaaatgtttctagtgaaggagcttccaaagttaattgatttattacaatcaattgttaatgaaaaatccgttggtgatgaattagctccaggttatattattaaacaagcagacaatttctcatatactgatttagatggtagtgtttcatcaaatcaaggattatttattagatttgataatggattaagatttattgtgagattatcagggacaggatcttctggtgctaccgttagattatatttagaaaaacattgtgatgataaatctaaatatcatttgaaagttgatgaatatttgactaatgaaattcaatttgttttagaattattgaaatttaaacaatttttaaataaagaagaacctgatgtacgtacataa

SEQ ID NO: 2966 - DNA, 297 bp, Candida albicans
ccccacacacattggctgacatattcaacgatgaatgtcacggtgactttgacactaagacagctattccgggacacgtccaaacaaggtggattaccttcaccaatagatagaagcagaggtgatagatttgccattagagctgttcaatttattgaagaccactgtgatgttttagctccatacagatacgaattggacttcccaattgatgacaagaaaatcttaaaacacagcggctgtattaggtatcaagtctttacgtttgagattcacttctatcagacatttgtttga

SEQ ID NO: 2967 - DNA, 1632 bp, Candida albicans
aagataaaagtgaaatcaccaatgaacaatttgaaagacacaaacacctgtacatttgtggtatggtgggttcccattgataatgatatggccatgactgatgctacaattggtggttactctgcattagagagaatttgtcgtgccatcgattacattgatgctactgctaactcccattcgcgtgcctttgttgttgaggtcatgggtagacattgtggttggttagctttgatggccggtattgctaccagtgctgattatatttttattccagagaaacctgcctcctcaaaagattggcaagatcaaatgtgcgacattgttggtaaacatagagctcaaggtaaaagaaagaccattgttattgttgctgaaggtgcaattacctccgatttgaaaccaatcacatctgacgaagttaaagatgttttggtcgacagattagggttggacaccagaatcactgtgttgggacatgttcaaagaggtggtactgctgtagcctttgatagaactttagccactttgcaaggggttgaagcagtgaaagccattttggaattaactcctgatgttccatctccattaattgccattgacgaaaataagatttgtcgccgtccattggttgaagcagttagaatcaccaaatccgtggcttcagctatcgaagctaaagattttgaaaaggcaatgtctttaagggatcacgaattcaaagagcatttggctaatttcatggccatgaacactgccaaccatgaaaagccaactttacctcgtgaaaaacgtaagaagattgccattatcaacatcggtgctcccgctggtggtatgaattctgctgtttatgctatggccacttactgtatgtctcgtggtcacaccccatatgctatccacaatgggtttgctggtttatcaagacacgagtcagtgaaactgattgaatggattgacatcgaagggtggaacagtattggggggtctgaaattggtacgaacagacaaacacctgaagaaactgacattggtatgattgcccattattttgaaaaataccagtttgacgggttaattattgttggaggttttgaagcatttgtttcgttagagcaattggaaagatcaagagctatgtatccatcgttcagaattcctatggttttaatccctgccaccatttcaaataatgttcctggtaccgaatattctttaggggctgatacctgtttgaattcgttaatggaatattgtgacattgtcaagcaatcagcttcagctaccagaggtacagcatttattattgatgttcaaggaggtaattccggatacattgccacatttgcctcattaatcagtggagcacaagcatcctatgttccagaagaaggtatttcattacagcaattggaaatggatatcaattcattgagagaagcatttgccgtggaacaaggaatgacaaagagtggtaaattgatcatcaagtcgagtaatgcatccaaagtactaaccccacacacattggctgacatattcaacgatgaatgtcacggtgactttgacactaagacagctattccgggacacgtccaaacaaggtggattaccttcaccaatagatag

SEQ ID NO: 2968 - DNA, 300 bp, Candida albicans
ggaaatgaaatggcaagacgtcagagttttctttcagaagggggtaccaatattggtactgccagatgcatggagtttaaggaacgttggggtaagatgaaaggatgtaaaaacttgattgatgctggaattgacgggttgatcgtgtgtggtggtgatggttctttaactggtgctgatttattcagacacgaatggccatcattaattcaagaattgaaagataaaagtgaaatcaccaatgaacaatttgaaagacacaaacacctgtacatttgtggtatggtgggttcccattga

SEQ ID NO: 2969 - DNA, 816 bp, Candida albicans
cgaaaaacaaccaccatgatttcaattgttaatggtacttccacactttcattggttgctggtagtgtggaaactttaaatcaagcaatcaagttgtataccaacatacttgggttgtccgtccattcggaacaaaatgactggacatatttatcaaatgacgacaataaaatgattgtcaagatacaattagacaccaaatctgggttatcgcttgaccaaatcaatgatagaagaacagaaattattgccaaattgaatatcactgattggagatcattggacaccaccagtgttttgaaagttcaaaatttagttgctttgattgaaactttaaccacattcaactacactttgcaaatcacccctaacgaattgtaccctaatgaagtttattgcgtggacccattgggttatattattgggtttacagcttgtgatgaaccattaacccttgttccaccattgcaaaaatcccaccctaagccagggttggtttccaacttgatgtcaaaatctggctctcaatcaagaaatattgaagagaccaaagcagtgagaagaaacatcgctgtcatgacttcaggtggggattctcaaggtatgaatgctgccgttagagctgtcgttagagccacgattttccatggaagcaaggcctttgctgtccaagaaggttatgctggtttggtcaaaggtggtcctgaatacattaaggaaatgaaatggcaagacgtcagagttttctttcagaagggggtaccaatattggtactgccagatgcatggagtttaaggaacgttggggtaagatga

SEQ ID NO: 2970 - DNA, 396 bp, Candida albicans
gcattggaatatggtgctaatgaattccataccgatattggaaaatccaagcatgaaccaatgtcatttgatgtgattttcgactttgtcggtattcaaccaacattcaataattctgataaatttattaaaagacgaggtaaaatagtaatggtagggttaggaagatcaaaattattaattccaaattataaattggggattcgtgaagttgaaatcattttcaattttggtggtcattctgccgaacaagttgaatgtatggaatgggttgcaaagggtttaattaaacctaatgttcatgttgctgatttcaattctttgccacaatatcttgaagatttggctaatggtaaattaacaggaagagttgtatttagacctaataaattgtaa

SEQ ID NO: 2971 - DNA, 528 bp, Candida albicans
attataatgtctgctttatttgccgtttcgagatcagcaattgctcttcgtagcattgctccaagaagttctactgccaccacttcatcattcttagcattggcaagattatattcttcaggtaaattcccaccacatactgttatcaatatgccagcattatctccaaccatgactcaaggtaacattcaatcttgggccaaaaaagttggcgatgagttaacacctggtgaagcaatcgccgaaattgaaaccgataaagcatcaatggattttgaatttcaagaagaaggttatttggccaagattttattggatgctggtgctaaagacgttccagttggacaaccaattgctgtttatgttgaagatgccggtgaagttgcagcatttgaaaatttcactgctgctgatgccggagaagcaccaaaaccagcgcctgctgctgaagaaaaacacaaagaaagaagaaccaaaggcttctacctccacttcagctccagcttctactccatccccatcttctaa

SEQ ID NO: 2972 - DNA, 1215 bp, Candida albicans
cacctggtgaagcaatcgccgaaattgaaaccgataaagcatcaatggattttgaatttcaagaagaaggttatttggccaagattttattggatgctggtgctaaagacgttccagttggacaaccaattgctgtttatgttgaagatgccggtgaagttgcagcatttgaaaatttcactgctgctgatgccggagaagcaccaaaaccagcgcctgctgctgaagaaaaacacaaagaaagaagaaccaaaggcttctacctccacttcagctccagcttctactccatccccatcttctaaaaaagccccaaccgacagaataattgcatcaccatttgctaaaactattgctttagaaaaaggtatttccttgaaaggtattaaaggttctggtccaaatggtagaattgttgccaaagatctcgaaggtgttgaaccacaagctgctgctgctgctgctccagctgccgccgccgccaccgccggtgctgctccaagtgctactgcttcctacgaagatatcccaatcacttctatgagaaagacaattgcttccagattattacaatctactcaacaatccccatcatacattattcaatctcaaatttccgtgtctaaattattgaaattacgtgcttcattgaatgccactgctgaagaaagatacaagttgtctatcaacgatttattaatcaaggctattgctaagacctgtgtcagaattccagaagtaaatgctgcttggttaggtgaacaaggtgttatcagacaatacaagaatgttgatgtttctgtcgctgttgccaccccaactggattgatcactccaattgtcactaatgctgaatctaaaggattggctgaaatttctaaccaagtcaaagatttgggtaagagagccaaggttggtaaattacttccagaagaattccaaggtggtaccatctgtatttccaacttgggtatgaaccatgctgttactgctttcacatctattatcaacccaccacaatctgccatccttgccattggtactaccgaaaagaaagctgttccaagtgaagttaacgaacaaggatttgtgtttgatgatgttatcactattactggtacttttgatcacagagttattgatggtgcccttggtggtgaatggatgaaagaattgaagagaattgtcgaaaatccattagaaatgttgatctaa

SEQ ID NO: 2973 - DNA, 669 bp, Candida albicans
tttgacattttgacaatttttttatcaaactacggaaatgtctctaccatcggacatgtagttcctgttacaacaacaaaaaaaaatatcaataaagatgctcttctaacaaaaatagtatctacactcatctttatttattcaaagtttttcgtatttctcaattgtttttatctattcattataattaatatgcttagggcagctttcaccagaagaacagtaaaccaaatacgtgcatttcatggctcatcaatttattatgccgcatctgtgtttaaaatgccagcaatgtctcccaccatgagtgaaggtggtattgtttcttggaaagtgaaaccaggtgatactttcagtgcaggagatcctattttggaagtagaaactgataaggccaccattgatgtcgaagcagccgatgatggtaaattatgggagattttagtcaatgaagggacctccggagtaccagttggtaagccaattgcctttttagcagaacaagatgacgatttaagcactttggaaaaaccaagcatagaagatgtcaagcaagaaactcaagctcccgctccacaggagaagaaccccgaagaaaagactaccaaaaaagaagttaaacaatcagcaccacgtgaatttcttcaccaagggtggaagatccgcgtc

SEQ ID NO: 2974 - DNA, 1143 bp, Candida albicans
ttaactaatggacatttaatactacttcgaagaacagaaacaaacatctataagattatgacacacacagaacgacaaaaagtaacctttgaatttttcgataatactagtcatcaaatgcaacgaaataaactcaaacaattaccaccattatccacagacatcgagtctagctcgagtccacacagtccttcgggtgctgacttgagattcataagctcctcatcatccataaattctttatttgactcagtgccattatatagcagaacagcttcaaccaccaccataacacccatcttatcaagacatgattccaacccaggattcaaaaacaactatcacaacttgttacatcacccaaccatacaagaattagatttcactcaaacgatagatttgaaactacgtcaacaccaatcctgtacaacttctgctcaaccaaaggaaaaactaatacttttgttagttggattacctgctagtgggaaatcaaccatttgcaaacaatttcaagaatttattaatgaaaacagtgaatacaacgctcaaatttataatgctggtgatgtgagaagaagaagatctgccagtgagtttaacgatgcccaatttttcgatccaaataacgaacaaggtaaaaaagatcgtgaattatatgccactataactgtcaacaatctaataaatgatttacaatcgaatgttattgatgttgggtttttagatgcaactaataccacattagaaagaagacaaagaatgattaatttaatcaatgaacaagttccaaatggaagaatagtaatatttgatgttcaatgcaataatcaaaaattattagaatataacatcagtggtaaatcagaaaataatgattataaaaataaggattacaccactgccattaatgattttaaacaacgtgccatgaattataaaaaaatttataaaccaataacagaagaagaattggctagttatggagataaagtcgatatgtatatgaaatgtgtaaatggtggtcaacaatttgaattttcacacattcatcatgctgatacttggtattataaaattttgtctgatttcaaaagcaattacaaattaagtgaggtttatagagagttattgggtcaataa

SEQ ID NO: 2975 - DNA, 1365 bp, Candida albicans
ccagtattatatttagaaagtgtttgtaatgatcctagtattattgaatcaaatattcgattgaaattaagtgggcccgattataaagatatggatcctaaattggcatttaatgattttgtgggacgattacataattatgaaaaagcttatgaaaccattgatgaagaagaagaaaaaattcctggattccaatatgtcaaaatgattgatgtggggaaaaaagttgttagttttaatattaaaggatttcttgcatcacaaacaatttatttcttattaaattttaatttatgtgaacgacaaatttggattactcgacatggagaaagtcaagataatttgaatggtagaattggtggtgatgccaatttaactaaacgaggtcttaaatttgctcaagctttaacacaatttatgaatttccaacgacaagaattccggaaacaacaattggaaagattttcaagtcgattagaattaaaatataattcccttttcaatgaagatgatgttgctctattagattctattcatagtgaaccgaatttttgcgtttcgacatcgatgcttacccgtgcggttgaaaccggacaatattttaatgatcaattatattcaattaaacaattaagaatgttgaatgaattaggtggagggaaatttgaaggtatgacatatgaagaaattcaatcgaaatatcctaaagaatttgccagtagattgaaaaataaattaagttatcgatatcctggagttggaggtgaatcttatttagatgttttaactcgattaagaccattgattgctgaagttgaaagaaccactgatcatttattaattatatcacatcgagtagtatcaagaattttattagcatattttttaaatcttgataaatcggccattggagaattggatgttccattacatacattatattgtttagaactgcatccttatggtactgattataccatgtatgaatatgatgaaaatttagattggtttgttaaagctgaaccagaacatcaaaaaaatgttaaagaagttggagttgtttttaaagaacggaaatattctgtggtcccaacagctccaccaacttcaaagtctcgtgctgtcagttttgccgttacaaacaactacaacaacaacaacaacactgatcataccaacaataaagctactgatgatgtaagagatgaaattagaagaagattatcaatggggacatccaataaaccaacattactggtacgtgatggtgatgataaatcaattacagctaaacacttacgagatttaaaaaatttaagaaaaccaatgggacaacggaagactgctgctgatcaattatgttaa

SEQ ID NO: 2976 - DNA, 183 bp, Candida albicans
  unsure (70): Identity of nucleotide sequences at the above locations are unknown.
gagaaaaaatgggctatggatactttagatcaattattagattatgttattagtggaagtggatcagtanggattttcgatgccaccaattcgactaaattaagacggaaacgagtcttgaaaagaattcagcaacgattcaaatggggaataaccagtattatatttagaaagtgtttgtaa

SEQ ID NO: 2977 - DNA, 1986 bp, Candida albicans
atgccaccaacaagtacagattcaacaaataattctacaccatcacctaatactagtgctaattcactggatcaatttcctcatcatagtcaagaatcaattcggattttaattgccgctaatttcaaacaaccaaagccacaaccacagcaacaaccacacccacaacaacatagtctggaactatctcatcctacgtcaaacttgcaccaggtttcatctaattcagctcattcaagtgatatctcaccaactgattctggaatcagtttacgaccaaatcgtgtcaaatcttattctattagtaatggagtattaagtcattcaagaacagccaataaacgtgtctcattttccaatcttcattcaacaaattcttcacaattatccttaacaagttcagaaagttctgaaaatgaaatttatagtgacgaggatgatgaagaagaagaagattatgaggctggaaaagataatgataattccgaagatataaaacatccaaaccataatgaaccttcggaattgcttctacgagaaccaaatttcaaacaagttaaaaaagatgataccattaccacaactactcaagaagaactgtcatcacataactcttctggttcgattaatcgttctactattggtaaaaaaattgctaaatttactgcaggaagtatgacaccttcacctaatgaattatcaccaacatcatcaagtgcatcattaaaatctaaaaaaaataaatccagctatccatatccttattcttctcgtcataattttttgaatcattatggaggagaaaagttggcattatcaaaatcattagattctcaattattagaaccttatgattctaatagttctgtcaattcatttttacccgaattcaataaacgtccattaactgatacaccaattgtttcaacaataggatctcccataactagagaacaatcatatgatgattatgatgaagatgaagaagaagacgaagaccgaggtaacattaattccattcaagaagaagaaggtggcgactcaagtggtactactactaataaacataaacccacatcattacataagacgaaaaatatttcacatttaaatttatcagaattatcacataaagacactactactaataaagaaggttcacctgatgctgaatcacttaagaattcaagagaacacgcggctctgattgctgctaaacaattagttggtaataaagcattagaaaaagaggatgacttaccgacagggacaattgcagcacaattattacgtaaatcagctggtatatctgataattctggtcaattactgtattcagttccatcaagatcacctccacatgtacttattgatgaatcaactggtgtcagtactcctgtgggttcagtagttacggtttcttctggtgaagatggtaaagaaaaggggaaaggactagtgatggctaaaaatgttaaagataatttattaaaagatttaccaccatatatgaaggaacaatttgaaaaaaccccatccctcgaaaaattgaaaaatttattaatgcataaacctccaccatcagctagaaaagcttatactttaaatatcccgggtcaaacatcttctaaaacttcacctgacgggaagattgcttcagttgatgttggatctaaattggtgattgttatggtgggattacctgctagagggaaatcatatattactaataaattgacacgatatcttaattggttacaacacgattgtcgagttttcaatgttggtaatactagaagaaaagataaattaaatgctggtccagagaatcaaccattacctgataaagccactacaccaacagaatcaagatcacctcgacaacatgatgctgattttttcaacccagaaaataaagatagtacggcattgagagaaaaaatgggctatggatactttagatcaattattagattatgttattag

SEQ ID NO: 2978 - DNA, 279 bp, Candida albicans
atattcacattaactacacatatacatacccagctcaacatcaacacaatgttaaaggttgccagactccagatccgatttaattcaagcacagccgcctcagcagcagcagtagcagcaaagaccgctgaagtgcgtactcgtactgtcaaaaccccagttggtattaaagccgcaattgaatcattaaaaccaaaggccacgagattgtcaatggatggtccagttgagtgtgcactttctgggttttccttgttgaattcaccacaattcaattaa

SEQ ID NO: 2979 - DNA, 855 bp, Candida albicans
ggatcagcatattccaaagaagaaagagaaagttttgatttaactggacttttactttcacaagtcaattctttagatgaacaagtggaaagagcatatcgacaattttcctatttgaaaactcccttagccaagaatgatttttgtacatctatgagattacaaaataaagtgttgtattatgaattggtgagacgtcatattagagaaatgttaccaatcatttatactcctactgaaggtgacgcaattgctagttattccgacagattcagaaaaccagaaggttgtttcttggacattaatgatcctgacggcattgataaacgtttgtctgcatatggagaagataaagatattgattatattgttgtttccgatggtgaaggtattttgggtattggtgatcaaggtgtaggtgccattagaattgctatagccaaattgggtcttatgactttatgtggaggtattcatcctgcaagagttttaccaattgctttagatgttggtacaaacaatgacagattactaaatgatgaattatacatgggtaacaaattcccaagagttagagatgaaaagtattgggactttgttgataaagtgatccaagcaatcaaaaaaagattccccagttcagttttgcattatgaagattttggtgtgtcaactggtagagacttgttatacaagtacagagaagaattgccttcctttaacgatgatattcaaggaaccggggctgtggttatggcatcaatcactgctgcattgaaattttcaaaacgtgacttgaaagatattcaagttttggtatatggagctggatctgctggtttgggtattggttga

SEQ ID NO: 2980 - DNA, 801 bp, Candida albicans
cccattcatttagtgtcacgtggtgccactgaggaacaagcaagagcaagaatccattgtatggatcgttatggtttgataactaacgaatccactaatgcaagtccagcacagcttaaatatgctgatcctgcctcagaatgggacggtatcgatactaagagcttattggcatgtgtcaacaagattaaaccaacggtgttagttggatgttctacccagccaggtgcttttactgaagaaatcgtcaaggaaatgtataagcacaacccacaaccaattattttccctttatccaacccaaccagattacatgaagctgttccttctgatttgatgaaatggacagataacaatgcattgattgcaactggatctccatttgaacccgtggatggctattatatttctgaaaacaacaattgtttcacattcccaggtattggattaggtgctgttttatcgagatgtacgacaatttctgataccatgatttcagccgccgttgatcgattagcttccatgtctcctaaaatggagaatcctaagaatggattgttacctagattagaagaaattgatgaagtgagtgcccatgttgctactgcagttattttacaatccttgaaggaaggtactgctagagtggagagtgaagaaaaaccagatggtggatttgttgaagtgcctacagactatgaaggttgtcttaaatgggtacaatcacaaatgtggaaaccagtttatagaccatacgttaaggtggaatacgtttccgaaattcacacttatcagtattag

SEQ ID NO: 2981 - DNA, 285 bp, Candida albicans
gcactagcgcggtcctggccgcttcgggcgcgtagacgagagtgtcatcgtcgagcaattgctaaaagggaaccatgtgatatcctcgtcgttgctcatggtcatatattgagatgtctaggagctagatgggtccaacgtgaattgaatgtcaatccacaattgattttggatgctggtggtgtacgaactttgagttatgaacaccataatatcgatgaaccatcaatctttttatcaggggcattcaccgtaccggttgccgaacaatgtgctgatctttag

SEQ ID NO: 2982 - DNA, 474 bp, Candida albicans
tattccaccattatacaccatttttctttttctttctggaattctccttttttccttttgcaattgattacactcctaaatcccaaaccttacaaaatgtccaaaattccttatccaagattgatttttgttcgccacggtcaaactgaatggtctaaaagtggtcaacatacttcaactaccgacattgacttgactccatttggggtcgaacaaatgagaaatactggtagagcacttatcggtcctagtaatttacaaatgatcaaaccagagaatttgactcgtatttttgtttcaccaatgcaaagagcacaacaaactttacaattattattggaagatgttgaccccgaatttaaggacaaaatcccagttgaaatagatgaggatgtgagagaatgggattatggtgattacgaaggaataacgagtgccgaaatcaacgaattaaggattaagatacgattatat

SEQ ID NO: 2983 - DNA, 831 bp, Candida albicans
tcttcttcaacgtgtgctccgattacaggagggttcatttttttcagattttttttttttttttcattcatattccattttttagcaaagccagaaagaaacaatataatgacaaaaagtccttgtccaagattaatttttgtccgtcatggtcaaactgaatggtccaagagtggtcaatatacttcaagaaccgatctcgacttgactccatttggtgtcaaacaaatgagaaatacaggtaaaggtcttattggtcctggtaatttacaaatgatcaaaccggaaaatttaactcatatttttgtatctccaaggaagagagcacaacgtacctcacaattgctattagaagaagttgatccagaaattaaggataaaattccaattgaaatagatgaagatgtgagagaatgggagtatggtgaatacgaaggtttaaaaacaaacgaaattatcgaattgagaaagcaaaaaggattagataaggatctggagtggactatttggggtaaagggtgtgaaggaggtgaacaacattatgaagttgcagcaagattggatcgttttattgagaagatccaaaaaattcaccgtgaagctcttgctaaaggagtggcatctgatataattgttgttgcacatggtcatatattaagatgtcttgttgcaagatgggttaaacgtgagttaagtaccaatccccaattaattttggatgctggtggtgttggtgttttgagctaccaacatcacaatgtcgacgaaccagcaatttatttagctggtgcatttactgtccctgttgaagaagaaggtgcagatatttaa

SEQ ID NO: 2984 - DNA, 738 bp, Candida albicans
attttgggtgaaagaattgaattacataattcaaattatggttatttgattaataaagtggtattttatttaatgaatgggaagattaaacctggttctttatatttggcaagatgttataaaaattccgttgattataatcaagatcctccattagatgaagaagggattaaatatgccaaaaatttaacttatacattatttgatcatttggaaaaatccgggaaccttcaagaaaaacaacaacaacaacaacaacaagaagcaactcctaaagataataattcacttgctatttggacatcagtgaaaagaagaactatcgaaaccactcaatttttcgctgccaaaaacatccccattagacatcgagttcaattatctcagaaaaatcctggtataactggaacattaactgatgatgaaattagagaaaaattccctatagaatatgctcaatatgatcatagtccatatcattatcgttatccaagagcagaatcatatcatgatttagcgattaaaattgaaccattaattttagaaatggaaagaatgagtggtgatttattaattattgctgatgaaaccgtattacaagttttttatggttatttaatgtcttgttcttgtgatgaaataccaaatttgaattttaaaccaaatgaaattgttgaagttaaattcaatgcttattcaaattctgctaaaagaatccccattaaagattattcttaa

SEQ ID NO: 2985 - DNA, 861 bp, Candida albicans
  unsure (580): Identity of nucleotide sequences at the above locations are unknown.
atgtctgaatcaacaacaacaacatcatcatcatcagcatcaacaacttcagcatcgtttatccctgacactgaaacggaaatattaaatggttttggttcagcaccaatttcctccgatactaatcaattaagaaccactaaacggtggtcatttactagtaaaactagacccaatatgggagattcagtaaagaatggtccaccagcaaattatgtccccaagagaagaatgagtgatattactggtattgatgctgttcataatcaaagaaatccactggattcattaggtggagcacaattatatctgacggaatcaggtcgattatttcatgctggagaaatcattattattttagcggggattcctggtcgaggtaaaactcatctttcagtatctttaacaagatatttacgatggttaggggttaatactcattctttccatttaggtaattatagaagagctaatgctgaagatgatattactcatgatttatttgttccttcacctcaatcagctaaagctcatgctttaagagaaaaaatggttaatgattgtcttggtgatatattanattttttccgtaatgatggaggtcaagtagctaattatgatgctacaaatgccattcctgaatatcgattagaattacataaaaaattccgtgatttaaacattcaagtaatattcattgaaagtcttgttactgatgattctattgtcatgcataatattgaacaagcagctaaatcttctccagattatcataaatgggattatgataaggcctataaagattacacagaaagaattaaagccataacacctcattatattgaaaatggggggatctga

SEQ ID NO: 2986 - DNA, 2454 bp, Candida albicans
ggtaaaacagaaggtatggagttttcaaataaaagatcaagagacgactttgaacaagatgaaggtcaattccacgatggtcctagccatgatagttttgaccataaacgacaccatattgacccagcacaggaattgataaataatatatgtaaagacattcgaagattgggtgaagcaggtgatatcgagaacttgattgctgacacaaactatatttccaaccctatagttgctgaatttgagaaaattgacaacttgagaaactccatcttgtcaactgtttatgcattgataactgaacaacctcataaaatcagtgctattgcaaacttgatattgatttgtaacgccaagaactttgtcattgccaaatatgtggttgaatatttacattcaaagatgcaaaccatgttggattctcaagaaggctcagtgtttaatgatattaagaatatattgaaatttttgagcacattgacaccaattatcgaagataacggaattatccaaatcttcaaacaatttttaaattttgcaatcgaattacaagagcaaactgaagttagaaatggtttagcccaagagatatactataatgttttgattgccataccatacgtacttagtaatgataattctgacgatttgaaaaaaagtatcaatgagttgattgaattggctagaaattttaaaatcgttgcagagtctgccactgttttacttccatttgatacaagaatggggaatttcgagttgccatatattccaaagcaaatggtagatttaattttgccagcactcataaagttacagaatgatgactggaattttagattgtttcttgatttcaagactcatttggatccagtaattcaatctgctttagaaaacaactcgatttctagtgagttagtcaaacacaaattgcctcagttatcgtttccaagtgttgagaatgccagtttcaagtcaacgtcaattgataaattatggaatgataatccacgctacttgttccaagtgtataacaacactacagagtatgaaactgttcctccaatcgaaacatatttaggattgtttttcaaagatatcgcttttgatattttgaccaatctctccttcaacaaaaatgaaactgcaattgaacttagtattttggatatgtttttcgataataaattgtttgctccaccgggtacgagcattgatcaattgaatgccatatatgaggacaacaaactgggaactaatgatccgtcattatcaacttggaaaattgaagatgttgccgttgaaagtattcttactatgattttccaattacccaacccattggaagtagaaatttactattacaccgttttgatttcgtgttgtcgtgaatcaccagaatcaattgcccctgtgtttggtcgtgccattagatatttctacaatcacttggagacattagattacgaacttaaaatacgatttttagactggatgagtattcagttgtcgaattttgagttttcttggaaatgggaagaatgggttagtgactctaagaaattaaaagatcttaaataccaccccaaaaagaatttcatcaaaaatttaattgccaaagagattagattatcaaataagaaaagaataaaggatagttttattgatatagtagacggtgaagttgtgaatttagacgaattttatcaatacttggatatcagtatggttccagatgtgaaatcttatatcatctcatacgacacagaattatatggtgaaagtctgcgtgacacattaatccagttgtatgaacagaaacaggaacagcttaattccaaatcgaatattggtgctcaaaacgaaatatttttcaactttactaattcagaactaccatttcatgaaacagcatctaaagtttatgatttcattcttacgcattggaagtcaaacactgatttcaatgagttgtacaaatcagttcttgagtcaataactgcccctaacaatgaaaggtttgccatcaacttgattatacaaacgtatgcctatattggatcaagatccatttattctgtggtcagtattttgagtagagatatcaacaagttgaaattcttgagtggcgctccaattgattatgttggcgacaaggcacgtgttgaagatttgcattttaccgaagaagaaaaactaaatacacagaattggatcattgaagctgtgttcagaatatggattcatcaaccccaagtggtgtctgtgatctcggagtatttaatcgagtttggaatcattgatccagaatatatattggtaaaagcattggagtctaacttgattatcgataatgtatcatgtatggagtcgattaatagaatattgagcagtgctgagctgaaagaattgatcattctatcattcactgccattattgataagttgatcaaataa

SEQ ID NO: 2987 - DNA, 675 bp, Candida albicans
tatcaaatgacctttgaaattaatgaaaatcctgaccctgaaatcatcagagtatttattgttagacatggtcaaacagaccataatgtgcaaaagatcttacaaggacatttagatacagatatcaatgagaccggtaaggaacaagcagagatcgttggtaaatacctttccaaaattccgtttgattattttgtatcttcagatcttagcagatgccagcaaacgttgataccaattttatcccaccaacaaacaaagacagtaaagtacacacccaatttgagagaaagagacatggggaaagttgaagggatgtatttgaaggatgccttagaaaagtatggtcctggattccgtaatttgggggaaaaggaagatgcattatgcaagcgtgttgaaaaagaatggaatgaaattatcgagcaaaattaccataatgttttgatttgtacccacgggggtgtaattactagatttattaattatctacataaagatttggggtacaaattaaacaacaagttgacaccagataatttgaaggtcccattcaacacctcggtttcagttatagatgttgagaagaataccaaaaggggagttattcaagctttcggaaatacattacacttgggaggaaatttcgaagtcaaagaccaattattaagatag

SEQ ID NO: 2988 - DNA, 666 bp, Candida albicans
agactgatgaacccaggtaaaaaatacaatttacaatattatttgaaagttgttgatgaaattgttaaaatgggtactcatttcttagggattaaagatatggccgggacattaaaacctgccgctgctatacttttagttggagaaattagaagtcgttaccctgatttaccaattcatgttcatactcatgattctgccggtactggtgttgcttcaatgacggcatgtgccattgctggagctgatgttgttgatgccgctctgaattccatgtcaggattaacttctcaaccttcaattagtgcaattttagcatcattagaaggatcaattgaaactggtctttctgaatctatggttagagaattagataattattgggcacaaatgagattattatattcatgttttgatgctgatttgaaaggtcctgacccagaagtttatcaacatgaaatccccggtggtcaattgactaatttattattccaagctcaacaattaggtttaggtactaaatgggttcaaactaaagaaacttataaagttgctaatcaaattttgggcgatttagttaaagttactccaacttctaaagtcgttggtgatttagctcaatttatggttagtaatactttaactgaagaagatgtctatagatta

SEQ ID NO: 2989 - DNA, 501 bp, Candida albicans
agactcatgagaggtacagcttttgctccttacgctgatttgatttggatggaatccgctttgccagattatgcccaagctaaagaatttgccgacggtgttaaagctgctgtcccagatcaatggttagcttacaatttgtctccatctttcaactggaacaaggccatgccagctgacgaacaagaaacttacatcaagagattgggtaaattaggttacgtgtggcaattcatcaccttggctggtttgcacaccacagcattggctgttgatgacttctctaaccaatactctcaaattggtatgaaagcttacggtcaaactgtccaacaaccagaaatcgaaaaaggtgtggaagttgtcaaacatcaaaaatggtctggtgctacctatattgatggtttgttgaagatggtcagtggtggtgttacctccactgctgctatgggtcaaggtgtcactgaagatcaattcaaagaatccaaagccaaggcttaa

SEQ ID NO: 2990 - DNA, 1074 bp, Candida albicans
aagaccaagagaatctattctgctgaagacattgctaagaagagaggaaccttgaaaatcaaccatccatcatctcaacaagccgacaaattgttcaagttgttggaaaaacacgatgctgacaagactgtttctttcacctttggtgctttagacccaatccacgttgctcaaatggccaagtacttggactccatttacgtttccggatggcaatgttcttctactgcttccacttctaacgaaccatctccagatttggctgattatcctatggataccgtcccaaacaaggttgaacacttgtggtttgctcaattgttccacgacagaaaacaaagagaagaaagattgactttgtctaaagaagaaagagccaagaccccatacattgacttcttgagaccaatcattgctgatgctgacactggtcatggtggtattactgctattatcaaattaaccaagatgttcattgaaagaggtgctgctggtatccatattgaagatcaagctccaggtaccaagaaatgtggtcatatggctggtaaagtgttagtcccagtccaagaacacattaacagattggttgctatcagagcttctgctgatattttcggatccaacttgttggccgttgccagaacagactctgaagctgccaccttgatcacctccaccattgatcacagagaccactactttatcattggtgccactaacccagaagccggagatttagctgctttgatggctgaagctgaatctaaaggcatctacggtaacgaattagctgccattgagtctgaatggaccaagaaagctggcttgaaattgttccacgaagctgttattgatgaaatcaagaatggtaactactctaacaaagatgctttgatcaagaaattcactgacaaggttaacccattgtctcacacttctcacaaagaagctaagatattggccaagggaattgactggtacagatatttacttcaactggggatgttgccagaagcagagaaaagttactacagatacccaaggtgggtctcaatgtgccgtcatgaataa

SEQ ID NO: 2991 - DNA, 1428 bp, Candida albicans
  unsure (42),(43),(81),(85),(119),(121),(124),(193): Identity of nucleotide sequences at the above locations are unknown.
cccaaacatattgaagttcaattattagccgataattatgtnnatgtcattcatttatttgaaagagattgttcagtacanagangacatcaaaaagttgttgagatgccccctgctananatntacctaaactggttcgtgatgccattttaactgatgctgtcaaattggctaaaagtgccaattataganatgccggtacagcagaatttttggttgatgaacaaaatagacattatttcattgaaattaatccaagaattcaagttgaacatactattactgaagaaatcactggcgttgatattgttgctgctcaaatccaaattgctgcgggcgcttcattacaacaattggggttattacaagataaaatcactactagaggatttgctattcaatgtagaattactactgaagacccaactaaaaatttccaacctgatactggtaaaatcgaagtttatagatcagctggtggtaatggggttagattagatggtggtaatggatttgttggatcaatcatttctcctcattatgattctatgttggtcaaatgttcatgttcagggtctacttatgaaattgctcgaagaaaaatgttgagagcattaattgaatttagaattagaggtgttaaaactaatattccattcttattggctcttttaactaatgaagtgtttattactggtgattgttggactacttttatcgatgatactccatcacttttccaaatgattagttctcaaaatagagccaccaagatgttatcatatttggccgatcttgtcgttaatggatcttcaattaaaggtcaagtaggataccctaaattagacactgatgccattattccagaaattcatgaacctaaaaccggcattactattgatgttgatcatactccaccacctagaggttggagacaagtattattagaagaaggtcccgaagtgtttgctaaaaaagttagacaatttaatggtactttaatcaccgatactacttggagagatgctcatcaatcattattagccaccagagttagaaccattgatttattaaatattgctcctacaactgctcatgctttgaaaggtgcattttcattagaatgttggggtggtgccacttttgatgtttgtatgagatttctttatgaagatccatgggccagattaagaaaattgagaagtttagttcctaatattcctttccaaatgcttttaagaggtgctaatggtgtagcttattcttcattacctgataatgccattgatcaatttgttaaagaagctaaagaaaatggagtagatattttccgtgttttcgatgctttaaatgatttagaacaattaaaagtcgggattgatgccgttaaaaaagctggtggggttgttgaacccaccgtttgttaa

SEQ ID NO: 2992 - DNA, 351 bp, Candida albicans
tatcgcttagcgcggatcgtccgacccctctgtggtagaagacccactgagcaatcattgaaatactataaagatcaaagtttggttaaatctcaagtggaactcatcgacgatatagattcattaagagcatgtgttgcttttgaaaaatgttttggtaaagttgttgagccagcttgtggagcagcaatggcagttgtttataacaaaattgacttgttgtacaagaattttaaacatttgcaaccagaagatattgttgttattgttgtatgtggcggttcatgtactacagggtctgatcttaaagggtttgaaaaaatgatacagaaatcagaaattaaattatag

SEQ ID NO: 2993 - DNA, 1671 bp, Candida albicans
ttatcaatcatggctcctcctactgctgttgaatcttcaatcaatttcggaggtcacccaactatcaaatccactcaagacccattggtccaaaagttgtctcttaataccgacactgtgatcagacacaatgctccacctccaaccttatacgaagatggtttattagaaaaaggtactactatctcatctactggtgctttaatggcttactctggtaacaaaaccggtagatctcctaaagacaagagaattgtcgacgaatccacctcatcccataacatttggtggggtccagtgaataaacaagttgacgaattaacttggaagatttctagatcaagagctttggattacttgagaactagagaaaagttgtttgttgttgacgcttatgctggttgggatccaagatacagaatcaaggtcagaattatctgtgctagagcttaccatgctttgttcatgaccaatatgttgatcagaccaactgaagaagaattaaaaaactttggtgaaccagatttcaccatctacaatgctggtcaattcccagccaacatccacactaaaggtatgacttctgccacttctgttgaaatcaactttaaagatatggaaatggttatcttgggtactgaatatgctggtgaaatgaagaaaggtatctttactgttatgttctacttgatgccaatcaaacacaaggttttgactttgcactcctcatgtaaccaaggggttgaaaaaggtgatgtcactttgttctttggtctttctggtactggtaagaccactttgtctgctgatccacaaagaaagttgattggtgatgacgaacattgttggtccgacaatggtgtgttcaacattgaaggtggttgttacgccaaatgtttggacttgtctgctgaaaaagaaccagaaattttcaactccatcaagtttggtgctattttggaaaatgttgtctacgacccaatcaccaaggttgttgactacgaagattcatcaatcactgaaaacactagatgtgcatacccaattgatttcattccatctgccaagattccatgtttggccgacacccatccaaccaatattatcttgttaacatgtgatgcttccggtgtgttgccaccagtctccaaattgactaatgctcaagttatgtatcatttcatttctggttacacctccaagatggcaggtactgaagaaggtgttactgaaccacaagctacattctccgcatgtttcggtcaaccattcttggtgttgcacccaatgaaatatgctcaacaattgtctgacaagatttccgaacacaatgccaacgcttggttgttgaacactggttgggttggttcttctgttgctcaaggtggtaagagatgtccattgaaatacaccagagctatcttggatgctatccactctggtgaattgtctaaagtcgaatacgaaaaagttccagttttcaaccttaatgttccaacttcttgtcctggtgttccaagtgaaattttgaacccaactaaagcttggacccaaggtactgattcattcaacaaggaaatcaaatctcttgctaccaagtttgctgaaaacttcaagacatacgctgatcaagctactgctgaagttaaagctgctggtccagaagcataa

SEQ ID NO: 2994 - DNA, 738 bp, Candida albicans
aatcgcggatccttccagcccggtggtgaagattcaaacttgagtcttttggatatccaaaatagtttgcacctgcatctgccaaacgagaacggcgaaaactgcccatgtgggtgctccaatccacatgccgtccacgaacgaccagtttcgatagcagggtccatttacggtgctgttgctgccaatgaaagagttccaatatctatagctggatcgataaaattaagtgatgaagaagatgaagaagataatgcaagtttattgagtattgaagactataattctagacaccgagaccagcattttcattttgcttcaaactcaacaaatagagaacaaagtccagcaccaggggcgtttgccgcagctactgctattgctcaaatgcagaagaacaaacttttcctacaacaacagcaacaattagaaaacgaaaacaacaaacaacaaatgctcacatcattagtggccatgtcgataccaagaagtacagaagaaacattatgtgtacctacattacttgcaagaatttgtcaaacttatggatacgattctaagcaggcgattttagcagccaactctttagcatctttgaaagaaaatattacctctaatacaggaacactgttggatgaagaacgtaaaaatgctttgaacagtatgataatgaacagatatgaaacaacaaaattgtcagaggaagaagctattgtttttacaaaaggatttgattaa

SEQ ID NO: 2995 - DNA, 1377 bp, Candida albicans
tccccgcatttcgcggccccttcggcaccctgtggtagaaaacgcgactacgacgacgtgaaccaggaagataatgtcaatatcttgattgttaacaataccaagttatctattgtagggaaagtgtcgaaaatggctctaagtgtgatgctgtacagtaaagtgttggcaaatattttggattctatatattcacgattcgataatactaacattcataagaaagcgttacaaagagataggatgctagattgttggagacgagaattacccctagacttaaaatttgaaatcgatattaatgggttgtctctcaaagattccagtaacaattttatagagggtaacatttggagaaactacaacaagcaacagttgacgttaatatttttgtattaccatgctaaaatattgatatatttgccaatattatcccggtttggaaatcaccataatgttgggttatcacagaaagagcagctcctgaaaggagaaggtgatgtggctactatagtgtcaagcattagtttgattcaacaatcatcgattcagatattagaggttttgaaatatttgacatcaacctcgtcgtcaaacattttacctataccaattcatattgtgcgtgagcagtcattattggcgttaatggtagcaaaaggagccttagattatataaaaggaggtcctttattcagcaatctgaagcaattattactagatacaatgggtaacctttctcgtgatgccaactttgacatccctggggctttgaatagaaaatcattcaaattgtttgagattacaatattaggtatccttggtttgaatataaacaaaagcatgacctcgggggttaatatgaaaagaaagggatcaagtgcactacaacctatcaccaaaactgcggttgaaagatcaccaactgttaatttaactaacaatttcgcagcttcgaaattgaaaacgccaactagcaatacagatatggtaaacaataatcaaatacttaaaatagagcaacaagatccagttttatcgcagcaacaaaaacaaacaaggaatatatctactagggaaatctctaataatggggatattgagttggacaattcgaataattacgccgatgacatagaatcattagaggaattattaaattttgatccatttaaagtcaatgttaaccgtcaaatgttagtgaacgagtttgtcactgatggatctttaggtttagttccatttttggaaatgaacaatgaacaattaaatgacagttctatgttatttgacaagtcgtacaatgctataaacgaacgcaagaccacaaaccatgatgattacatatcacataatgatagtcatttctggaaatga

SEQ ID NO: 2996 - DNA, 1008 bp, Candida albicans
agacaacccattttcacttgccaattttttcttgtatttatttgtttcctttccattgataagaatactaccattagaggaagtcacagtatgctggaatcagaggacccaaacaaaaagcgaaaaagaattagacgagcttgtgatttttgtcgttcaaaaaaagccaagtgtgatggcaagtcaccagtgtgttcaaactgttttgcaaataaggaggaatgcatttattcccaaccagttaagcgaagaggattaccgactggatatacacatgatttagaaaagaaagtccgactatttcaggggttaatagcaaggttgtgtgaagataaatatgtccaatcacggctacaaaccattttaaatgacgagtcattggtggatgatcttgtggaactagagaaatcatggaatagtaatagcatttcagaactctttgaccaagttgcatcacagagtaattcaaaaaataatattgccaaacttgcaacccataaaccaacaccagttcaatcggactcaacacctgtatcaacattggacggtaacccgcctttgacaacactgcaatgccaagtatgtcaaaaaagtcaggatagaaaatttcggaaagcacatacgccagacccactgcaaacaatctcagcgtcaccgtcaacatcacaaacagcaacagcagcaacagcagcaacagcagcagcaacagtagcagcagataacgctatcaatccagttattggaagtgatagacctacctcgatatatcccagcacacctagcccttttgttagtgatctggcgttttttttaaactatgatgttttccagtttatttccgacgagattgaaggtgttgaaaacccagaaaactgggagccggtggccttacaatatcatggattgtcttcaataatatccgggttcacgaataaagtagtacaacaatataatagtaaattgaataatgttttcacaaacccatttcgagtgggacaattgtcttaa

SEQ ID NO: 2997 - DNA, 975 bp, Candida albicans
  unsure (781): Identity of nucleotide sequences at the above locations are unknown.
gctatttcacttcctattatgaaggcaattgtataccacgatagaggagatattagatacgaccccaatttccctgatccacaaatcattcgactggatgatgtcaaaatcaaagttcattattgtgggatttgcggtactgatttaaaagaatatagtgatgggccgatttttttcccaccgaaaggtgaattgaatgaaatttctcaaatggaatcaattcaagtcatgggtcatgaaattagtggtgaagtaattgctattggggatgatgtaaccaatgttaaagtgggtgataaagttgttgttgaagtgacaggaacttgtttagatagacatcgttaccaagattctaaaaatggcgatctgcctaaaccaaattgtccaagctgtgtttcgggtaactataatgcttgtgattatcttgctttaattggttgtggatttgctaatggtggatgtgcagaatatttagttgttgctaatctgaaagttattgcatttgatcaagataaaatccctatggatatagccgcgttaattcagccaatagctgttagttggcatgctgttaaagtatcaaattttaaacccggttctaatgcattaattttaggtggtggtcccattggattaacaacaatttttgctttgaaaggtaatcaagtttctcaaattgttctaagtgaaccagcattagcaagacgtcaattggcagagaaattaggagttattacttatgaccctactggtaaatcaattgaacaatgtgttgaagatntaaaaaaattatcccccggaggttatggatatgaatattcatatgattgttctggagttaaagcaacttttgaaactggattgaaaactttgaaaattcgtggatgtgcaacaaatgttgccatttgggctcataaatcaattccattatatcctatggaaattaccctttcagaaaaaatgttaactggatca

SEQ ID NO: 2998 - DNA, 849 bp, Candida albicans
gccaatggttcatgtttggataaaaagtatttacaacagctgcaagaagaacaaaatgatgtttgtagtgcttgtgctcatggtagatataatgcttgtaagcgacttggattttatggccttgggtatgataatggtggatttgctgaatacattgttgcctcagaaaataaagtgattccatatgatgctaatattatccctgatgaagtcgcagcattggttgaaccattggcagtgtcatggcatggtgtacgtcaatcaaagattgaagaatgtaaatcaccacaagcattgattcttggtggtggtccaattggattgtgtactatatttgcattgaaagggcacaaagtcaccgatatcgttgttagtgaaccagctgaaggacgtagggaattagctcaatcttttggtgtcaagacatttaatccgtttgattataaagatgccgagattcaaatcaaagaattgttgaaaatgaccaaaaccaatagtggttttactcacgtttatgattgttcaggaaacaaggccactttcaatacaatgcttaaagttttagccactggtggtgtaggtactaatgtggcaatttggccaaaagttccgattgatttctacccaatggatttgactttgaatgaactttatcttactgccagtatggattatacaaagattgactttgaattggttgtcaaggcatttgaaaccggattaattgatccaaaagaagcagccaaattggtttccaaaaaagttcctttgagagatggcattgaacatggaattttagatttgattaacaacaaggaaaagtatattaaaattttgttacatccttga

SEQ ID NO: 2999 - DNA, 2109 bp, Candida albicans
tacaaaagaaagacaacaatcataatgtctatttctgttgaacccaatgaaacagaagctttgttgagaaagcagaatgatctttccacaactgcctcaattgaagaaaaatatcctcaccaacaaggagaggctgcagaagacgatgacgacactcttaaaagaacccaatatgatgaagctaaagaaaccgctgaatctttaaaacaagttgaatcgatattagcacctattgttttcactgcattgtcatttttcgtgagattttatcgtatttcagtgaatgaccatgttgtttgggatgaagctcattttggtaaatttggatcctattatttacgacacgaattttatcatgatgttcatcctccattgggtaaaatgttagttggtttatctggttatttggctggatacaatggatcttgggatttcccaagtggtgaaaaataccctgattatattgattatactaaaatgagattgtttaatgccactttctctgccttgtgtgtaccattggcttatttcactgggaaagaagttggattttccatgtttactacttggttatttactttgatggtggctcttgaatcaagttatgtcactttaggtaaattcattttgttggattcaatgttgttattcttcaccgttgctactgttttctgtttttcacgtttcaacaattttaacaataaatcacaagaattttctagaaaatggtggaaatggattcttttaactggtgtttccattggttgtacttgttctgtaaaaatggttggattgtttgttaccacattggtcgggatttacactgttgttgacctttggaataaattgagtgataaatctatttcatggacaaaatacattcaacattggtttgctagaattgttgctttgattcttgtcccaattttcattttcatgctttcatttaaagttcattttgatttgttgtataaatcgggtactggtgatgccaatatgtcatcacttttccaagctaatttggctggttccgatgttggtggtggcccacgtgaagtatccatgttccactcggttatcactttaaagaatcaaggtttaagtggtggccttttacactcccacgttcaaacattcccagaaggttcaaaacaacaacaagttactacttatggtcacaaagattcaaacaacaattggattttccaaagagctagaggacaaccttattatgatacttctggtaacaccactgacattgaatatatttttgacggtatgcatgtaagattgatgcatccacaaactggtagaaacttacatactcatgatattccagctccagtgtctaaatctgaatatgaagttgcatgttatggtaatttgactattggtgatcctaaagataattggactgttgaaattatggaacaagcaagtgatgaagataaaatgagattacatcctttgacttcgtcatttagattgaagaatgaagtgatgaattgttatttgggggtcactggtactacattacctcaatgggggttcagacaaggtgaagttgtttgttacaagaacccatttaaaaaagacaagagaacttggtggaatattgaaaacaatcgtaatgcagttttaccaccagctccagaagatttcaaattacctaaaactaagtttattcgtgatttcattcaattgaatttggccatgatggctactaacaatgctttagttccagacactgaaaagcaagatgatttggcttcatcattttggcaatggccaacattgaatgttggtattagaatgtgtggatggggaccagaaaatcctaaatattatatgattggttcaccagcaactacttggacttctactgttggtgttatattatttgctttcattgttttgtattatttgattagatggcaaagacaatacgttgatttcccaagtacaaatccacacaaattgaaattattccttatgggaggtatttatccaatgtttggatggggattacatttcttaccatttgccattatgggaagagttacatatgttcatcattatgtgtcttcaccacggggctggaaggtccgc

SEQ ID NO: 3000 - DNA, 843 bp, Candida albicans
cttcttaacatattcttgatgccaattgttcaagaatcaccaaaagaagtggatactgttttaaaaaatcagtcaaccaatgcaagcacaaacacaaacacaaataaacaacaatttcgagaatcaccagaatttacattatcaaatgtattagacgatatcaaacaaggtataattgcctttcttattaatcccaaagtaacaattattgtatatcctataatcatatgtttaagttctatattaaccaaaattgtcattaataaaatttcatatactgaaattgattttattacttatatgcaacaaattaaattaattaatcaaggtataattaaatatagtgaaattgaaggagattcaggaccaattgtatatcctggtgggtttgtccaaatttatcaatttattcaatggttaatcagtagtagtagtagcagtagtagtagtactggggaggaaatattgtcttatgatgttagagaagcacaatatattttcagttatttatttactactagtataattttcaattgtttgatatatattaatttaattaatatcccaccatggacaatatatttatttttgttgagtaaacgattggtatcgatttatgttttacgattatttaatgattgttggacaactttagctatattgggagtgattttaatattacaacaagctagtactaacatcacggaagattggttggtatatttattggtgatattggcaagtgatttatatagtaatggcaaatcgataaaaatgaaagcattattaaattttcctgcgtttaacaaacatggtctaattcctaattggaagaaaatttaa

SEQ ID NO: 3001 - DNA, 771 bp, Candida albicans
  unsure (36): Identity of nucleotide sequences at the above locations are unknown.
tttaatcaaccagtgtttttattagtgatgatattnatccaaatattattgggtggacattttttattaccattggaattgtttaataatgatgtggatgttagaagaatggcatcgattataagatgggattatattaatcaagctttcaattttaaacgaaaattcttatatgaatggaccgtaaattggaaatttttatcaattgaaactttcacatcagatggatttgctaaattattattgttattacatgttttcaccctcttggttttcattatcaccagatttttgaattctcgtatcacaggcaaatcaatcactagtttaatttatcaaattgtgttaccattttcttcttcttcttcttcttctaaatcatcatcatcatcaaatggtaataattcaaacttgattaaaaatcctcaatcaggtccacaattaattttcattattatgtcaattactaatttaattggtattttatttgctagatctttacattatcaatttttaagttggtatgcttggtcattaccaggattattatatttgaatttcccaatttattttgccttgccaatttggtttgttcatgaatggtgttggaatgttttccgtagtaattcaattagttcaattacattagttagtattttatcattgattattggtgcaacttggtggaattttgatcattggttcccaccatcagtcaatttatcatatacttctaatgaaaacaagaacaataaaaagaaacaagaataa

SEQ ID NO: 3002 - DNA, 294 bp, Candida albicans
attggtaccaattctagttcagtatctgatgaaattaccgctatcactaaactagcccgtgactcaccccttgaaaccacgttacattctgcaggaaccacaattgctggaccttgggatcaagtaatggatttgattggacaaatgcatcaattgttgcatgaaaaacatggagttgttagaatccaaagtgacattagagttgggactcgagttgataaacccaatcaattaccacaagataaaatcaatgttgtacaacgtaagttggcacaacaagaaaaacaattctag

SEQ ID NO: 3003 - DNA, 540 bp, Candida albicans
gaagggtacccaacgggaatggaaggggaattagaaaaatgttgggaatttttaaaaaaatatttctatatcttgggagattatgttgaattggaattacaagaaaaaaagagaattgttgctgagaatgattcatttatagttgtggtgccatattgggcattatggccatttgaaactttattaatatcgaaaactcatttaaaatcaattcaagaattcaatgacaaacaaaaacttgatttggcagctattttgaaaattttaacaacaaaatatgataatttattcaatacttcattcccttattctatgggtattcatcaagctccatttaaatgtactcatgaacaaaatgaatgttcatggttccatatgcatttttaccctccattgttacgttcagctactgtgaaaaaattctgtgtgggatttgaaatgttgggtgaaccacaacgtgatttgactagtgaacaagcagctgctagattacaagaattgaatggagatgttcattatatgaataaacctcaagcataa

SEQ ID NO: 3004 - DNA, 495 bp, Candida albicans
gaccaagtatccccacctactaacgtcatcatcatcatgtctcttgatcatcttctaaatccactaacatcaacaccaacatatataaaaatgactcaagaatttgatttcactaaccattctcatcgtcgcttgaatttgttaactaataagtttgtcttgtgttctccacatagagctaaaagaccatggcaaggtgctaaagaagaaatcaaaaaatctgcattaccagaatatgatcctaaatgttatttatgtcctggtaacatacgtgctactggtgatatgaatcctaaatatgacgctacatatatttttcctaatgattatcctgctgtgaggttggatcaaccagaatataaagaagatgagcaagataaacagaatactttaaaaagtagattattacaaactcagggtgtaagaggtaaatgttttgtcatttgtttctctcccaaacataatttgactttaccattaatgaaagatgaataa

SEQ ID NO: 3005 - DNA, 3282 bp, Candida albicans
  unsure (1247): Identity of nucleotide sequences at the above locations are unknown.
aaggtggaacgtgaagtttatggattaaatgatgaaatcaacgattatggtagttcacccaagaaaaaccaagtcatttcattttcaagaccaatgaacaacgaaaaaccagctaaacctaaacatgatatatatttctggaaagtttattgttatgctattacattttgggcaccagctccattattgaaattatttggattaccaacaaaagatcgtcaattcgcttggagagaaaaaatagggttgatttcttgtattctttacgttggggcatttgttgcttatttgacttttggtttcactaaaactgtttgttcgagtcaagtggtcagaacccaaattaatcatgtcaacggaggttatttgattatcaatggtagagcctatgatttaacttcgtcacaacatcctaaagcagctggtatacaagcaggttctaatgttttatatcctcccatgaatgccggtggtaaagatgcatcatttcttttccaaaatgttaatggtaactgtaagggtttgattaaaccaagagaaaattgttctattccctacgatggtgatgaattggcttggtatatgccatgtcgtcttttcaaccaagatggttcaaccaaaccaaataacacatttgcttattataaaggttgggcatgtcatactagtgagaccgctcgtgatgcctactacaaattgaaagtcaatggtgatgtttatttcacttgggatgatgtcaagaattcttcaagaaacttggtagtgtattctgggaatgtgttagatttggatttgataaattggattgaaaccgatgatgttacttatccagaattatttgacaaattaagagatgatgaaacttatcgtggattggatatatctttggttttgacaaactctgaagaacgacaagcagctagatgtttaaccgaaatcatcaaagttggttctattgatactgatactattggttgtattgcctctaaagttgtgttgtatatgtccttggtgtttattttatcggttgttgtcgtcaaatttattatggcttgttggtttaaatgggtcacttcaagaaaacagggggcaacaatgtatgattccaaggcttgggccaaaagaaatagagaaattgaagactgggtcgatcatgatcacggtattggtgctgaagttgagccagtgcctgtgaaagccagagccaattataaagcagctaaaaccaatagacaatctgtttccantagagctcaaaaattgtcattgagaccaaatgccgatttatcacaatattatgataatccaaatgctctttccaagacttttaaatataccactatgtctacccaagcggcattgttaggacgtaacggatatggtaaacgtggtaataatgccaataaaagtgttagtggaggatttaatggtagacaatccaatctttatttaactgatcaaggttcttccactgatttattgaaccgtccagtgtcttcttataatccatttgattccatgggtgatgattctattgtcattaatgggttatctccagatattattcacccagatgttgttcctcaaccaccagttgaatatcaaccatttggatacccattagctcatacaattaatttggtcacttgttattctgaagatgaagaaggtattcgtatcactttagattctattgccaccaccgattaccctaattctcataaattaattcttgttatttgtgatggtattattaaaggttcaggtaatgatgaaactactcctgatattgtgttggatatgatgtcggacttgactgtgccaagagatgaagttgaagcttattcctatgttgctgttgcccaagttattaaacgtcataatatggccaaagtttatgctgggttttataaatataacgatgaaactgtgccaccagaaaagcaacaacgtattccgatgattactattgtcaaatgtggtacccctgaagaagccagtgcaccaaaaccaggtaatagaggtaagcgtgattcacaaatcattttaatgtcatttttacaaaaagttgttttcgatgaaagaatgactagtttagaatatgaaatgttacaaagtatttggagaatcacaggattaatggcagaattctatgagattgtattgatggtggatgctgatacgaaagttttccctgattctttaactcatatggttgctgaaatggttaaagatccaactattatgggattatgtggagaaacaaaaatttctaacaaggcgcaaacctgggttacagcaattcaagtttttgagtattatatttcacatcatcaagccaaggcgtttgaatcgattttcggtggggttacttgtttaccaggttgtttctgtatgtatagaatcaaggcaccaaaggggtccgatggatattgggtgcctattttggcaaatcctgatatcgtggaaagatattctgataatgtggttgatactttacatcgtaagaatttgttattattgggtgaagatcgttatctttcctcattgatgttgagaactttccctacgagaaaacaagtgtttgttcctaaagctgcttgtaagactgttgtccccgataaatttaaagtgttattatcgcaacgtcgtcgttggatcaattctactgtgcacaatttgtttgaattagttttagttaaagatttgtgtggtactttctgtttttctatgcaatttgttattttcattgaattgattggtactttggtgttaccagcagccattacatttactatttatgtgattattgttgctattgtatctaaaccaactccagttatgtctttggttttattagcagttattttcgggttacctggttgtttaattgtcattactgtgtcatccttatcttatcttgtttattttgtcatttatcttttcgcattaccaatttggaattttgtgttaccaagttatgcctattggaaatttgatgatttcagttggggtgaaacaagaacagttgctggtggtgataaaggagatcatagtgctgttgaaggtaaatttgattcatcaaagattgccatgaaaagatggagagaatgggaaagagaacgtagaagtactgaaaatagaaaacagcaacaacagcaacaattgacaaacaattctagtaataatttggctgttcctggtgctgcttgggatccatctaatactgggggaaatttgattgatgatttaagtcaaggatcttcttcagggtccagttga

SEQ ID NO: 3006 - DNA, 2238 bp, Candida albicans
tggatctccatttcaccccaacagcaatccccaagacaatcacctaatattttttccagaagtactgcaagagcagcaacctcaaagctgaatatgagcatatatgataataccccgaacttacaattcaacaaaagcggcgcagccacaccaagagcacaattcacatcgaaagaatctccgaaaagacaaaaaactactgaagtgaccattgactttgacaatgatgatgataacaatcacaccttagaatttgaaaatgggtcacctcgtcgttcatttcgtagtagtgctataagcagcgaaagatttttgcctcctccacaaccaattttctctcgagaaacatttgctgaagccaactcccgtgaagaagaaaaatcggcagatcaagaaacattagatgaaaaatacgattatgattcataccagaagggttatgaggaagtagaaacattgcattcggaaggtacagcttatagtggctcatcttatttgtcggatgatgccagtcctgaaactacagattactttggagcttcaattgatggtaatattatgcacaacattaacaatggatacgtaccaaatagagaaaaaaccattaccaaaagaaaagtgagattagttggtggcaaagcaggtaacttggtcttggagaatccagttccaacagagttgagaaaagtgttgaccagaaccgagtctccatttggtgagtttaccaacatgacatacacagcgtgcacttcgcagccagatactttttctgctgaagggttcaccttaagagctgccaaatacggcagagaaactgagattgtcatttgtataaccatgtataatgaggacgaagttgcatttgccagaactatgcatggtgtgatgaaaaatatcgctcatttgtgctcacgccataaatccaaaatatggggcaaagatagctggaaaaaagttcaagtgataattgttgcagatggtagaaataaagttcaacaatccgttcttgaattgcttacggcaacaggctgctatcaagaaaatttggccaggccctatgtcaacaatagcaaagtaaatgcccatttgtttgaatataccactcaaatatctatcgatgagaacttgaaattcaaaggagatgaaaaaaaccttgcaccagttcaagtcttgttctgtttgaaagaactgaaccaaaagaaaatcaattcccatagatggctttttaatgccttttgtcctgtcttggaccccaatgttattgttcttttagatgtgggtaccaaacccgataaccatgccatttataatctatggaaagcattcgatagagattccaatgtagcaggggctgctggtgaaattaaagcgatgaaaggtaaaggttggattaatcttacaaatccattagttgcgtcacagaattttgagtataaattgtccaatattcttgataaaccgttggaatcactttttggatacatttctgtgttaccaggtgcattgtctgcatatcgatacattgccttgaaaaaccacgatgatggtacagggccattggcttcttatttcaaaggtgaagatttactctgttcacatgacaaagacaaagagaataccaaagctaactttttcgaagcaaatatgtacttggctgaagacagaatcctttgtggggaattggtatcaaaaagaaatgacaattgggttcttaaatttgttaaactggcaaccggtgaaactgatgttcctgaaacaattgcagaatttctttcgcaaagacgaagatggattaatggtgccttttatgctgctttgtactccttgtatcactttagaaaaatatggacgactgaccattcgtatgctagaaaattttggctacatgtcgaattcatttatcaattggtatcattattgttttcatttttttctttgagtaatttctatttaacattttattttttgacaggttcattggtgtcttacaaaagtcttggtaaaaaaggtggattttggattttcacattattcaattatctctgtatcggtgttttgacatctttgttcattgtctccattggtaatagaccacatgcatcaaagaatattttcaaaacattaatcatattgttaaccatatgtgcattatacgcattggtggttggatttgtgtttgttatccatactattcctacttttggagtgtctcaacacggcgaaagcaggactaatgtg

SEQ ID NO: 3007 - DNA, 1512 bp, Candida albicans
acaatgcaagcagctttttccaaattaaaacttaaaagtaaagcttcagatatccctcaagcggattcagcaagcacttcaggcaaaccaccttcgactaaacaaatttaccaatcacgacaaaattttggtgtgaatttcggagcttgttttgttttagaaaaatggatataccatgaattgttttcagaaaccaacggtgatgctgaattggatgctgttctgtctttattcaaaaagcttggtgaagatgatactagatccagatttgaaaaccattggaaaggctatgttaatgatgatgattggaaatggctttctgagcatcatgttaactcaattcgtttaccgataggttattgggaagtggacggtggtgcttatacatctggcacaaattttgacaagtataaaggtgtttacaagaatgcatggaagataattaaagatgactttattaagaaagcattggatcataaaatttctgttttggttgatatccatggtctcccaggaggtgcaaacaattccggtcattcaggtgagtctggtgctggaggaaagttttggaaagacgagaaaaaacaaattgctattgctaagatgatggggtggattgctaatgacttgaaatcatttgataacattgctggtattcaagtagtcaatgaagccgaattttcagatccagctaaaaaacagtcaacttactacagtgcctgtatcaccgaaataagaaagagcgataagctggtccccatcgtgatttcagacggctggtgggctgatcagtgggttaaatgggttcaagaaaaacaaggttcagacggatacattggtgttgttttggacgagcatgtttataggtgtttctcagacgatgacaagaaaaagaagcctcaacagattattgatgatttacaaggagatgttttaactaacttgaatgacaacggaaaaggagttgatttcattgttggtgaatactcgtgtgttttggatcagcaatcctgggataatgataaaaatgccgatagagacgacttggttaaaaagtttggtcaacgtcagtctgaggagtttgcacaaaagacttcaggttcttatttctggacattcaaatttcagtctggtaatggtggtgaatgggatttcaaaacaatgaccgacaagggtgctttggttccaccgccaattccaagtaaccaacctctggatgataagtttgaggaagctttgaataatgcctataacggtcatgttgacttctggaaaaatgaacatcctgatggtaaatttgaacatgataatttcaaagaagggtttactattgcttggaaagatgccgatgcctttgcacaattcgatggttccagaataggaagaaaggaagcctggaaaagatccagattacaagagtttgcatcaagcaaggggaaactggatttcctttgggaatgggagcaaggttttgatcaaggtttagaagggttttactctgcatcaacataa

SEQ ID NO: 3008 - DNA, 534 bp, Candida albicans
aacgcggcacattcatttcgtggtgaacacgtcaaacctcatttatccataattcaagttggtgacagaccagattccaacacctatgtgaaaatgaagttgaaggcagctgaagaagctagtattggttgtgaacttattaaattaccagaagatatctctcaatttgaattgttgagtaaaattgaaaaattaaataactcattagatgttgatgggattttagtacaattgcctttgcctgaacacattgatgaaactaaaatcactgatgccgttttagctaacaaagatgttgatggatttggtccatttaatgtcggggaattggccaaaaaaggcggtgaaccattattcttgccttgtacacctaaggggatcatgcatttgtttgagaaatctaaaattgatcttgaaggtaaagatgttgttgttttaggaagatccgatattgttggtaaaccaattgctcgtttacttactaaagccaatgccaatgtcactgttgttcatttcaaaaacaccattaaataa

SEQ ID NO: 3009 - DNA, 279 bp, Candida albicans
gaagatccgatattgttggtaaaccaattgctcgtttacttactaaagccaatgccaatgtcactgttgttcatttcaaaaacaccattaaataaacttaaaaattacttgggtgatgccgatattgtcgttgcagctattggacaaccacaatttgttaaaggggaatggttgaaacatggtgttgaagttatcgatgttggtaccaatttcattcctgatgccagtaaaaaatctggtcaacgtatggttggtgatgttgattttgaatcatcttaa

SEQ ID NO: 3010 - DNA, 243 bp, Candida albicans
aacatggtgttgaagttatcgatgttggtaccaatttcattcctgatgccagtaaaaaatctggtcaacgtatggttggtgatgttgattttgaatcatcttaaaaccaaagccagtttcatcactccagttccaagtggtgttggtccaatgaccgttgcttgtcttttggataatgttttaattggtgccaaaaagcattataaggccaataatgaaaccccaaattcaccaaccctttaa

SEQ ID NO: 3011 - DNA, 1536 bp, Candida albicans
aaccccaaattcaccaaccctttaaaattacatttacaaaaaccagttccttccgactttgaaatttcccgtgctcaacaaccaaaaagaattactcaagttgctgaagaagcaggtatcttggatgctgaattagaaccatttgggttttacaaggccaaagtttcacttgatattttgaaacgtttgaacaacaaagttaatggtaaatatgttttagttactggtatcacgccaactcctttaggtgaaggtaaatccactactactgtgggattggctcaggctttgggtgctcatttgaaaaaaaatgtctttgctaatgtaagacaaccatctatgggtccaacattcggtatcaaaggtggtgctgccggtggtggttactcacaagtcattcctatggatgaattcaacatgcacgttactggtgatatacatgccatcacaatggccaacaacttgttagctgcagctattgatacaagaatgttccatgaaagcacccaaaaggatggtccattgtacagaagattagtaccagaaaagaaaggtgtcagaaaattcactccttcaatgttgagaagattagaaaaattgggtattaacaaaactgatccaaatgaattgactccagaggaaattactcaatttgctagattagacattgatccagaatccattacttggagaagagttgttgattgtaatgatagatttttaagaggaatcactgttggtcaagcaccaacagaaaaagggttcaccagagccactggatttgatattactgttgcttctgaatgtatggctatcttggcattggctaactctttagaagacatgagagaaagattaggtaaaatggttattgggtcctcaaaagctggtattccaatcacttgtgaggatattggatgtgctggtgccttgacagccttgttaaaggatgccattaaaccaaatatcatgcaaactttggaaggtactccagtttttgtccatgctggtccatttgccaatatttccattggtgcctcatctattttagctgataaaatggcattgaaattagccggtacttcttctgaattgtctgaagaagaaagaaaagaacaagaaggttatgttgttactgaagctggttttgattttactatgggtggtgaaagatttattaatatcaaatgtagatcatcaggattagttccagatgtcattgtcattgttgccactgttcgtgcattgaaagttcatggtggtggtccagaagttaaagctggtgcaccattggctccagaatacactcaagaaaacgttgaattgttgagaaaaggttgttccaacttggccaaacatattgccaatgccaagagctatggtttgccagtagttgttgccatcaacaaaatgtcttctgattccgacaaagaacatgaagttattagagaagaagctttgaaagctggtgctgttgatgctattgtatctaaccattgggttttcaccacgggcctggccggatccgcaattgaa

SEQ ID NO: 3012 - DNA, 3063 bp, Candida albicans
atgactcatcggaaaaactacaccgatactgcatatacacgtctaaaaaattttgtgatgctcttccttaaaaaagaacaactatttgttttctttcttttttcttttttttcactttctatcccaccagcaatgcttaggttaagaccaactatacgctcgttgagtagaaatttccaccgttcgtgtatcaacttagatgccgtagtggtttccggaaccaagttggcaaacaccatcagagccaacgtggcagaaaaagttatcaattacaacaaagaacattttggcgacaacaacaaatcttttgaaaattttagatttcagccaagtctgaccattttacaggtcgggtcaagaccagactcttctgcgtatgtccagttccagctaaaggcagcagcctcctcaaatatcaaatcaaaactaatcaaactagacgaatccatctcccaagaagatttagttgaagtgatagaacgtttaaataaagatccaaaggtgcatgggattttagtgcaattgccattaccaaaacatattgacgagtcagttatcaccaattctgtcgctaccgataaagatgtcgatgggtttgaccattacaatgttggccaattatcgaaaaggggcggtacaccatacttcaaaccatgtacgccaaacggtataatggagttgatcaagactactggtattccactaagaggtaaaactgcggtcgtcattggtagatctgacattgttggtactccagttgctacaatgttgagaaacgaagattgtaccgttaccgtgtgccacagatacacgcaaaacttgccggaaatcgtgagacaggccgacattgtcgttgctgcagttggtattgcagaatacgttaaagccgattgggtcaaagatggtgctattgttatagacgttggtattaactacaaagatgacccaactgcaaaaagaagaagacgtttggtgggggacgttgactatgaagaagtcgccaaaaaggcttcctttatcacacctgtccctggaggtgtgggcccaatgacagtggcaatgttatgctccaacgtatacgatgctgcattaatccacgccaagaaagcccatgagcacgggttcaagcctttggaactcaacatcaaggacccagttccgtcagatattgaaatttcaagaaaccaaaagccaaagaaaataaccagggtcgctcaagaattgggtatactagatgcagaattagagccatacggccacttcaaggctaaagtcgaccccaagagcgtgattgaaagattggacgagcaagctgaaggttctgctcaagacaaaggtaactatgttttggtggccgggatcacccctacacctttgggtgaaggtaaatccaccaccactatgggattgacacaagctcttggtgcgcatttgggatacaacgcaatcgctaatgttagacagccgtcaatgggaccaacattcggtgtcaaaggaggtgctgctggaggtggttatgctcaagtcattcctatggacgagtttaatatgcatttgactggtgacattcatgcaatctctgctgcccaaaacttattgtgtgctgctgtcgacacaagaatgttccacgaatctacatccaagactaccagtgggttttacaagagattggtgcctattaaaaagggcaagagaagtttcaccccttccatgcttaagagattggaaaaattgggtatcaccaaaactaacccagacgacttgactgctgaagaaattgaaaaatttgccgtgctcaacatcgaccccgattccatcaccatcaagagagttgtggactgtaacgatagatttgtcagagaaattacaatcggcgaaggtaaaaacgaagctagcaaatacccacctcgtaaaactggtatggacattactgtggccagtgagttgatggctattttggcattgtccaactccctaaaggatcttagacagagagttggtaagcttgtggttggtactcaacgcaaaaccggcgaggccatcaccgcggaagatattggctgtgctggagcaataactgctttattaaaagacgccattaaaccaaacttgatgcaaagtcttgaaggtactcctgttttcgtgcatgccggaccatttgcaaatatctcaattggtgcttcgtcggttattgccgacaagcttgcacttaagttgacctcaccatcaaacccaattaacaatggcgaaactggttttgttgtcactgaagctggttttgatttcacaatgggcggtgaaagattctttaacattaaatgcagagcttctgggttaaaaccagatgctgtggttttggttgctacttccagggcattgaaattacacggtggcgctactgatgtcaaacctggccagccattgccagcagaatacgttaacgagaaccttgagtatcttgaaaaagggtgtgccaacttggccaaacaaatcgccaacatcaaacaatacaacgtccccgttgttgtggccatcaaccagtttgaaacagacaccgatgccgaaatcaaattaatccagtctcttgcattgaaagctggtgccgatttcgctgttccatccaaccactgggctaaaggtggtgccggagccgttgagctcgcttcttcagtcgtcaaagctgtcgagttggcaccattggaacaacaaaagtacctctatgatgtgaacgataccgtcgaaaataaattattggctattaccactaaaatgtatggtgcgtcaggaatcgagttatctccattggccaaaaagcaaatagagacatacaccaagcaggggtacgacaagttgccaatttgtattgccaaaacccagtactctttgtcgcacgactcatcgttaaagggggtgccaaccgggtttactgttccaattagagaagtaagatgctcggcaggtgctggttatttgtatgctttggcagcagaaataatgactattcctgggttgccaacccatgctggttttattaaacctttaagttctacgcacgaattgtga

SEQ ID NO: 3013 - DNA, 267 bp, Candida albicans
aaattgttgatttttttgggctgtggcgtacctgttgtatcagtagatttcccagccatagatgaattggtgaaaaacaaagttaatggactaatcacaaacagcaaatcagatcaaacaaaggaagtggctcgcttggtaactgaagtgttcaccgatgatgccttgttaagatcaataaaggaaggggctttagaggagagtaattccagatgggatgagaactggatgcaaacttttagttctatatttgaaaataaatcttaa

SEQ ID NO: 3014 - DNA, 1194 bp, Candida albicans
tccaacactagtttatacagtggtatgggagaaattattaaatataaaggatttgatcatgtatggcaatactctggaccatggttatattgcttaattgggatctatattagcttgccagtcttagcttaccatatattaccatggatatttcataaaaacagatcaaacaaacgaaaaacaatatcaatttttgtgctaggagacttgggccactcacctagaatgtgttatcatgcgtcgtcattcagtaagttggattactatgtcaatttgtgtggttatgttgaaacagagccatcacaccaaattgtggatgatgtaaacattgatattattccaatagaggcaatcaaaaacactagcaatttgccatttattatgtttgcgatcctcaaagttgttcgacaatgcgggaaaatttggagtatattatgggacaccagaggatcagattacattatgatacagaacccacctagtattcccatactattgattgtgattttattcaaaacagttttcagtagagaaacaaagctaattattgattggcacaatttgaattatacaattttgaatttgagatacaataatttaaaccacccgtttgtgaaattggtgaagctttatgaaaagtttttgggccaatttgccaatctcaatataactgttacgaaaagcatgaaaaagtatctagtcaaagaatttggatttcaaaagtcaaaaattgttacattgtacgatagaccgggtgtacaattccaacctttgtcgaataagagagagtttatgtcagaacacaagttgtttgaagacattgacattgaaaaatataatgtgttgatcagctcaacttcatttactcctgataaagactttaatatcttgctagatgcattgaaaaattatgaaaatacaccaaacacgccaccaatactattaattgttactggaaagggacccttaaaaggtaaatttttggagacggtagataagttagagtttacaaacaaagtttgcgtgaaaagtgcatggttaagttcaggggactatcctaaagtactagcatgtgccgatttgggcatttccttgcacacttcatccagtggcatagatttaccaatgaaaattgttgatttttttgggctgtggcgtacctgttgtatcagtagatttcccagccatagatga

SEQ ID NO: 3015 - DNA, 1446 bp, Candida albicans
aaagcatcaatggttcaaggaaaagtcttggtggtttcaaatagaatacctgttacaatcaaaagattggataatggttcatacgattattccatgtcctccggtggactcgttacagcattacaaggtttgaaaaaaacaaccgagtttcaatggtatggatggcctggattggaaattccagaagatgagcaaactaaagtaaatgacgaattgaaatccaaattcaattgtacagccatatttttaagtgatacgattgctgatttacattataatgggttttcaaatagtattttatggccacttttccattatcatcctggggaaatgaactttgacgaaaatgcatgggcagcatatattgaagccaataagaaatttgcattggaaatagtcaaacaagtcaatgatgatgatatgatttgggttcatgattatcatttaatgcttttaccagaaatgttaagacaagaaattggtaacaagaagaaaaacattaaaattggattcttcttgcacacaccattcccatcatcagaaatttatcgtattttgcccgttcgtaaagaaattcttgaaagtgtgttgaattgtgatttaattggattccatacctatgattacgcccgtcatttcatcagttcggtttcaagaattgtgccaaacgtcagtactttacctaatggtataaagtaccagggacgttcgatcagcatcggggctttccccattgggattgatgttgataactttattgacggtttgaaaaaagatagtgttgtggaacgtattaaacaattgaaatctaaattcaaagacgttaacgttattgttggtgttgatagattagactatatcaaaggtgttccgctaaaattacatgcatttgaagtctttttgaatgaaaatcccgaatggattggcaaagtagttttggtccaagttgctgttccatccagaggtgatgttgaagaatatcaaagtttaagaagtacagtgagtgaattggttggaaggatcaatggtgaatttggtactgttgaatttgtccctatacattacttgcacaaatccatcccctttgatgaattgatcagtttatacaatatcagtgatgtttgtttggttagttctactcgagatggtatgaatttggttagttacgagtatattgcttgtcaacaagatcgcaagggtgtcttgatcttatctgaatttgctggtgcagcacaatcacttaatggtgccttgattgttaacccatggaacactgaagatttaagtgaagcaatcaaagaaagtttaacattaccagaagaaaagagggaatttaatttcaagaaattgttcacctacatttcgaaatacacttcaggattttggggtgaaagttttgttaaagaattgtacaaatgtaacccacaaaagagtttgagggactag

SEQ ID NO: 3016 - DNA, 624 bp, Candida albicans
acaagtttttcttctacaccaatcatgaaattagccactgaaattgatttcaaactcaacaatggtaaaaccattcctgccttaggactaggtactgttgcctcaaaagatcctaaagatgttaaggatcaagtaatcactgctgttaaagcaggatatcgtcatattgatactgcttggttttatggtactgaaaaatatattggtgaagcattacaagaattatttgctgaaggaattattaaaagagaagatttatttatcacgacaaaattttggccatcatattgggctaatccagaaaaatctttagatgaatctttaaaagatttgcaacttgattatgttgatttatttttacaacattggccaatttgtttacatggtgatgaaaatggattaccgaaaatacctaaggatgagaatggtgaattgatttatgatgatgatccaaccccaaatggtactaaatatatcgacgtttatcataaattagaggatattttagaaacaaccaccaaagttagatcaattggtgtttctaattattcaattccaaaacttcgtcaattattacctaaagttaaaaatcttcaccacgcggctcgaaggtccgcagcttac

SEQ ID NO: 3017 - DNA, 1347 bp, Candida albicans
aaagttcatcatcaaatattaaaaatggtggaaaattatacacctgatgattttcaaaattcaataactgcattgactaataaatttgatttttcatatttacctggatttaaaggaatcatcaccaaaaataatagcactagttttgaatcattagatgatcttgatattaatggattttcattaatccctggtaatgttcaatttaaatttttaaataaaggtaataaaaagggtacaccagaacaaattcttgaacaaaatatgaaagattataaagaattattaggatcgaaaactattggacaaccaaaagatgccaaattggttccaccaccaccacctgaagaattaccaaattataaaagagccaatgcaactatattatcattagtacgtaatggtgaattaggggcaattggtattagtattaaacgattacaaaaaaaattcaattcgaaatataattatccttatacatttttaaatgatgaaccatttactgatcgatttaaacaacggattttgaaatatactgggaatgcacctgtcgaatttgttcaaattaaacctgaatattggcaaaaaccatcatttatagatacagttaaagaagctaaagaaatggaaattatgtttaaacatgatgttgcgtatgccaagaagcaatcatatcataatatgtgtcgattttatctgagtcaattttataaaattcctgaattacaaaaatataaatattattggcgagtggaacctaaagttaattttttcactgatattaattatgatgtttttaaatatatggaagacacccaaaaaatttatggatttaccattaatttatatgataatgaagaaaccgtgaaaactctttggcctgaaaccattaaatatttaaatcaaggtgataattataaatatattaatccgaaaggatcatttcaatggttattagaagatttacaaaatcctaaaaaaacaaaatttgctggaggttattcaacttgtcatttttggtcaaattttgaaattggtgattttgattttttccgtaatgaagcttatgataattgggttaaatatcttgattctacagggaaattttattatgaacgatggggtgatgcaccagtacattcaattggagttagtttatttgctgataaagataaaattcatttttttaaagatattggttatgatcatgatccttatactaattgtccaaatactgaaactactcaaatgtgtgaaattgggaaatttagtagatgggaacatttatatgatcaaaattgtttaatgaattggcttcatcatgatcaacccaaagatgtatattaa

SEQ ID NO: 3018 - DNA, 2190 bp, Candida albicans
ggagaccatgaagttttgattcagtatcatccaatcatgtttgtgttcaagtacgctggtaaagagcaattgagaattaacgacaaacaattcctaaatattgagcacagaagaaccagagatgaaaatgacaataatatgttaccacaggaatctgactttaacatgttttctgactcatttcaggactcaaagtttgacaccttgccattgggtcccgaatccattggtcttgattttacgttgttggggttttcaaatttgtacggaatcccagaacatgctgactcgttattactaagagatacttcttctggtgaaccttatagattatacaatgtggatattttcgaatatgagcccaattcgagattgcccatgtatggttcgattccgttggtcgttgcagcaaaacctgatgtttcaattggtatattttggttaaacagtgccgacacatatgttgacattcacaaaagtaaaagctccaccgttcattggatgtcagaaaatgggattttggatttcattgtgattattgaaaaaagtccggctatggttaatctgcagtatggaaaagtaactggaaacacacaattgcctccattattttctttggggtatcatcaatgtagatggaactacaatgacgaaaaagatgtgttggatgtacatgcaaagtttgacgagtatgagattccatacgatactatctggttagatatagaatatactgacgaaaagaagtatttcacttggcataaggagaactttgctactcccgagaaaatgctccgggaattggatcgaacagggagaaatttggttgcaattatcgatccacacattaaaactgggtacgatgtcagcgatgagatcatcaaaaagggattgacaatgaaagattccaacaacaatacctactatggacactgttggcccggagagtcggtttggatagacactttgaacccaaattctcaaagtttctgggacaaaaaacataaacagtttatgactccagcacccaacatccatttgtggaatgatatgaatgagccttccgtatttaatggtccagaaactagtgcaccaaaagataatttacattttggacaatgggaacaccgttctatacataacgtatttggtttatcataccatgaaactacgttcaattcccttcttaaccgatcacccgaaaaacggccatttattttgactagatcttacttcgctgggtcgcaaagaaccgcagcaatgtggacgggtgataatatgtcgaaatgggaatacttgaaaatatcgattccaatggttttaacttcaaatgtcgttggtatgccatttgcaggtgctgatgttggtgggttttttggaaacccatctagcgagttgttgacacgttggtaccaagctggtatttggtacccatttttcagagcccatgcacacattgattcaagaagaagagagccatggttggcaggcgagccatacacacagtatattagagatgcaattagattaagatatgctttattgccattgttctacactagtttctatgaagcttcaaagactggaacaccagttataaaaccggtattttatgaaaatacacataatgcagatagttatgccattgatgatgaattctttattggaaactcggggttattagtaaagccagtaactgatgaaggagcaaaagaaattgaattttatttgccagatgataaagtttattatgattttacaaacggggttttacaaggagtatacaagggtggtaaaaaacctgtacaacttagtgatataccgatgcttttgaaaggcggttccattattcccatgaaaactcgttacagaagatcttcgaaattgatgaaatccgatccttacactttggtaattgcgttggatgaagaagggtctgcttctggtaaactttacgttgatgatggtgaaactttcgctcagggaacagaagtcgcctttacagttgacaacaatatcattaacgccaaaaagattggaccaacagcctctattccaattgaaaaaataatcattgcctcaaaggatcaaacaactacattgaacaatcctaaactagacatcaacctggattggagtctcccctttagttttgacagccacagaaaaatcgagcatgacgaactataa

SEQ ID NO: 3019 - DNA, 1494 bp, Candida albicans
ctaagttccatgctagcaaggcttttgaaacttgcaatagtagttgcagcaatagcggcaatcacacccaataacccaatacgtacactgatttcatttgggtgtataggttacgtggcaaccttactggtaataccgaaagttagcccaagttttgtcaagatcgggctcaaagggaaagatttatctaaaccaccaccggtgtcagaaatacccgaaacaatggggctagtggcgtcaactacatatatgtttcttatgtttggtcttatcccatttatttttttcaaataccttgtttcttttggatcaatgtctaacgacgaggtgataactaaaaattacttgtctcaatatcaatcgcttgccgacaacaggttattcccccacaataagttggcagaatacttgagtgccttgttgtgtttacagagtaccacattgttgggattactagacgacttgtttgatatcaggtggcgtcacaagtttttcttacctgcagttgcatcattgcccttattgattgtatactacgtcgactttagtgtaacttcagtcgtgatccccaagtttgtcactgaattccctggaggctacgttctaattaatactataaatttttttataaagtatagtaaccatttggtcacaagtatcactgggctttcatttagaactttacaaacagactatgttgttcctgacagttcaccaaagttgattgatttgggaattttctactacgtatacatgtcggctatttcaattttctcaccgaattcaatcaatattcttgcaggcgttaacggtttggaggttggacaatcattagttttagcagccatatttttaattaatgatttctgctatcttttttcaccgggaatatcacaagcagctcatgattcacacatgttttctgttgtatttataattccttttgtcggagtgtcattggctttattgcaatacaactggttccctgcaagagtatttgttggtgatacgtattgttatttcagtggcatggtatttgctattgttggtattataggtcatttttccaaaactcttttgatatttttgttacctcaaataatcaattttgtgtattcagttcctcagttgtttcacatcttgccctgtccaagacacagattacccagatttagtattgaggatggtttgatgcatcccagttttgcagaattaaagaaagcaagccgtctaaacttggcgattttagaaactctcagttttttcaagctcataaaagtggaaaggggttccaaactgaatcagattgttagattttccaatatgaccataatcaatcttacgttggtgtgggtaggacctttacgagaagaccaattatgtatatctattttggtcgttcaatttgttattggcgtgacaatgatagttgttagacataccattggaccatggttatttggatacgataatttatcatggggtgtaaaataa

SEQ ID NO: 3020 - DNA, 612 bp, Candida albicans
ttacattatattatcttaattatatcaccaaatttattgaatttatcgatacggttttctttagtggttaaacagaaaaaattgacatttttacatacttatcatcatggagctactgctttattatgttatactcaattagttggtactacttcgatttcttgggtaccaatttcattaaatttggcggttcatgtattgatgtattggtattatttcttagccgctagaggtataagagtttggtggaaagaatgggtcactagatttcaaatcattcaatttattattgatttagtatttgtttattttggtacttatcaaaaagttgttattactcatttctctaaagttttatcttattgtggagattgtgctggtactatgattgctgcttattctggttgtgccattttatcatcttatttggtgttatttattgcattttatattgatgtttatcgtagaaaagattctactaaatcaaaaattgttaaatcagttaaaggtggggttgctgctcaagttaatgaatatgttcatgcttcaggtgttcaaattccatccaatacaaactccacagccaaaaccgtacgttccagaaaggcataa

SEQ ID NO: 3021 - DNA, 384 bp, Candida albicans
attttttttttttttaattatttaaaggaagaatttttgggattacacattcgcttaattaattatcacattttttattctgggtttaccattatcatgtcttcattatcttcatcatttccaattcctacttgggatactccatttggtattcaattatggccaatctttgataaagttattagtcaagctactaacaataaatttattccatcacaatttcaatttatttctggtcatttaccattatcaacattaccagaagctcttatggctataactatttattattttgtgatatttggtggtgattatatcttcaaaaaatccaatattaaaccatttgttttgaatggattatttcaaattcataatttattttaa

SEQ ID NO: 3022 - DNA, 888 bp, Candida albicans
ccactgaacatgtctttaccaattcctacttgggaaactccatttggtatccaattatggccaatttttgatttcgttgcttcaaaactttctcaaggaaaatttgtcccatcggaatttttatttattaatggtattactccattatcaacatttccagaagcagctgtgattattgttatttattatattgttatttttggtggtagatttgttatcagtactttgaatttaccagttataaaattgaatggattatttcaaattcataatttatttttaactagtttatcattgacattattggttttaattttagaacaaatcattcctattttccattctggtggttcatatcattccatttgttctcctaatgcttatacttccaaattagttgtattatattatcttaattacattactaaatttattgaacttatagataccgttttcttggtccttagacaaaagaaattgactttcttgcatacttatcatcatggagccactgcatggttatgctacactcaattaaccgggtacacttcagttcaatgggtgccaatcactttgaatttggcagttcatgtggttatgtactggtattatttcttggctgctagaggtattagagtttggtggaaagaatgggttaccagatttcaaattattcaatttattattgatttaggtgtggtttattattccacatttactcatttcgtttataaatattccggtaaaatgagagattgttctggtactgaaactgctgccgttgttggatgtctgatcttgaccagttatttgatcttgtttatcagtttctatatcactgtttacaagaaatccggtaatgcatctaaaaaagtcaagaaagcctag

SEQ ID NO: 3023 - DNA, 429 bp, Candida albicans
ccactgaacatgtctttaccaattcctacttgggaaactccatttggtatccaattatggccaatttttgatttcgttgcttcaaaactttctcaaggaaaatttgtcccatcggaatttttatttattaatggtgttactccattatcaacatttccagaagcagctgtgattattgttatttattatattgttatttttggtggtagatttgttatcagtactttgaatttaccagttataaaattgaatggattatttcaaattcataatttatttttaactagtttatcattgacattattggttttaattttagaacaaatcattcctattttccattctggtggttcatatcattccatttgttctcctaatgcttatacttcccaattaattgttttatattatcttaatttacattactaa

SEQ ID NO: 3024 - DNA, 687 bp, Candida albicans
  unsure (13): Identity of nucleotide sequences at the above locations are unknown.
cctcccatctgcntatacatagaccgcgtatccagccagctccgtagtgaacacttaagatcacatgataaaaaatatgaatcgattttccccaaaactactggaagcatcaccaccaccaccaccaccaccaccaccaaagaaggggagggggggtatctctcatttgtgattttacaaaatgaatatcctgatacggttaaatcgattaattggataaaatccaatcgtccacaattaaatattgcctataatccatcaccatttaaatcagaattaattactaaagaattattatcaaaaatagatttattaatagttaatgaaggtgaagcattagatgttgctaatcatttattaaaaaattctcatcaacaagatttaattgataaaattaatcaaatcaacaaaagtaatgtcacaaactctactggcgataatcatacagtgttggttgaagtgtttctgaaattagccattgaattacaaaaattaattaatcctgataatatacaaattattgttataaccatgggtagtaaaggatctatttatattgccaaaaatagtggtggtggtagtggtggtggtggtagtcaaaccactccacaattcattaaatctagaaaagttgaaaaagtcattgatacaattttcaccacggggcgggaaggatccgcgccaccc

SEQ ID NO: 3025 - DNA, 309 bp, Candida albicans
  unsure (235): Identity of nucleotide sequences at the above locations are unknown.
aaaattatcgttatgtcatcctccaatccatcaattactattattggatcattaaattatgatttagtcacatatacaaataaagttccccaaggtggagaaacttatcaagcaaattcatttgaaactcatgttggaggtaaaggattaaatgaatctattgccgttgccaaattaactcctaaaaattccgtattattgagcagtactactactactactactactagtggtngtggtgatggtgctattcgtatggtgggtaaaattggtcttcacacgcggctggaaggaaccgcacttgcgcac

SEQ ID NO: 3026 - DNA, 534 bp, Candida albicans
atacaccttgcaatccccccccccattcattcgttttttatttccccaaccatgacaaacccttctttagtgcttaacaaaatcgacgacatttcgtttgaagattacgaatccccagaaatcacctcccccagagacgttatcgtcgaggtaaagaaaaccggtatttgtgggtcagatatccattactatgcccatggcctgatcgggccttttgttttgagaaaaccaatggtgttgggccacgagtcggccggtgtggttgttgccgttggtgacgacgtaaccaacttgaaagtgggcgacaaggtcgccattgaaccaggtgtcccgtcaagatacagcgacgagtacaagtcaggaaactaccacttggtgtccacacatgggcatttgctgctacgccaccagtcaaccccgacgaaccgaacccaccaggtactttgtgcaaatactacaaagctccagctgatttcttgttcaaactcccagaccacgtttctttggagttgggcgctatggtcgagccattga

SEQ ID NO: 3027 - DNA, 816 bp, Candida albicans
accaggtgtcccgtcaagatacagcgacgagtacaagtcaggaaactaccacttggtgtccacacatgggcatttgctgctacgccaccagtcaaccccgacgaaccgaacccaccaggtactttgtgcaaatactacaaagctccagctgatttcttgttcaaactcccagaccacgtttctttggagttgggcgctatggtcgagccattgacggtcggcgtgcacgcctgtaagttggccaacttgaagtttggcgaaaacgttgttgtgtttggggctggccccgttgggttgttgacagctgctgttgccaaaaccattggcgccaaaaacattatggtcgtcgacatttttgataacaaattgcaaatggcaaaagatatgggtgctgccacccacaccttcaactccaagaccggcgacgatttggtaaaagcgtttgacggtattgagccttcggtggtcttagaatgcagtggcgccaagcagtgtatctacaccggtgtcaaaatcttaaaagccggcggcagattcgtccacgtcggtaatgctggtggcgacgtcaacttcccaattgccgatttctcaactagagagttgactttgtacgggtcgttcagatacgggtatggcgattaccagacctcaattgatatcttggacaaaaactacatcaacggcaaagaaaacgcaccaatcaattttgagttgttgattacccaccggttcaagtttaaagacgccatcaaggcctacgacttggtcagaggcggtaacggcgccgtcaagtgtttaatcgatggcccagaataa

SEQ ID NO: 3028 - DNA, 726 bp, Candida albicans
aatgagacaatgatgtcatttgttaatgaaacttcagatggggataagcaaaacttggaaacaccaactttgtttttcaagttgggtgggccaacattagaatcaactgaagagcaggcgaatttggttgatgagattgccaaaaagaataacgtcatgaagttacaacgaagcactaatgatgaagaaaacgctgagctttgggctgctagaagaaatgggctttggtatacttttcaatatggatctaaagttttaaaagacaaagacgatgtccaggtttggaccactgatgttgccgtaccaatttcgaaattgtcgattgtaatttccgagatcaatgattatttgatagaaaaggggttcaaggataggttttctgtaatggggcatatcggagatgggaactgccatttcattattttgtacaattctccagattatgataaagtgcatcatgtcgttgatcatatggttgaacgcgctttgagccacgatggaacatgcactggagagcatggtgttggtgttggaaaacggaaatatttgccactagagttgggtgtcgaagcaattgacactatgagacaaatcaaacttgcattagacccacgtcgtattttgaatcctgacaaaatcttcaaaattgatccagaagaaaatttggatgaacagttggatcaaggatcggttaaagtgaaacccaattgcatgcataaccattag

SEQ ID NO: 3029 - DNA, 1140 bp, Candida albicans
cgtatattctcaaacccaagtacaatgtggaaaaggttgttaagttcgacctcatcaaggcttgtcactggtgtagttaccgttgcttcgacgtcattttttgcttatagatatggacaagcagcgagcaacggccaatcattacttccattgggatcgacagccaagttgagttcattaaagccaccgcaatattgtcctgaactggagatccccaatattatgtcgaaaatacaacaattgggtatttcagtagtcaacagcaaaccagaaattgatcatcatactgggaatgatttcactacccataaaccattaccaaacgaagtaccacagttcattatttatccagattctactgaacaagtttcgcaagcattgaaaattcttaatgagtataaagtcccggttgttccattcagtggaggtacttcattggagggacatttccactcaacacgtcgaggggtcgttatagatacctcaaagctaaataaaattttggcaatcaatgataatgatctcgatgttgttgttcaggcgggtgttaattggcaggatttaaatcaagttctagaaccatatgggttgatgtttggtactgattgcggacataatggtttgatttctggaatgattgggacaaatgcttcggggattaatgcctcgagatatggtgctatgtctgcaaacgttatatcagtaactgcagtcttaccggatggaaccataataaaaacaagaaatagaccaagaaaatctagtgctgggtataatttgaccaacttgtttgttggaagtgaaggtactttgggaatagttactgaagcagtatgtaaagtttatcctattccaaaactggaaacagttgttgttgtgcagttcccactgattttggactctaccaacgctgtagctcaggttttccgatcaggaatccagcccactgccattgaacttttggataaagatatgatgcattgtttgaattatagtggttatactacaagagactggttggaatgtcccactattttcttcaagattggtggtataaacgaaaccgttgtcaaagagaatgtgaatattttgcaacaaattatgcaagcgaatcatgccgactcgtcaccacggaaatga

SEQ ID NO: 3030 - DNA, 570 bp, Candida albicans
ttccatttgtttttttgttttaaaagtaaaatttggagagaaaaactcaacttacaggttatgttttctaaacttggaaaaaacggtggaagattaagcaaacgctttgtcagatacaactccagtatcaaccgaaataactccaaaaacccattgctagcttatacgtttgctgcaattgggtttctgggagcagggtattttattgggaaggcattgctgaaagagcctttgccaacatcctcagaccgatctacttccccgctatcaacattgctgtccccacaatatgccaatgaaaaagatttcgaagctggattatcgaaaattgttgaaattgttggtcacgaaaatgcatcttttgataaagatgttttattggcacaaaacgattccttttattccactcaccatcccccaaatcctgatgttcaaaaacccagtgctgtaatttatccaacttccactgaacaggtatcagaaattatgaaagttgcccaccaataccgaattcctattgtggccaattctgggttaacttccttagaaggtcaaaatatccatacttag

SEQ ID NO: 3031 - DNA, 429 bp, Candida albicans
  unsure (413): Identity of nucleotide sequences at the above locations are unknown.
gtacagttgcaacacaccatgtttaccaaatttcaacctccagcgaggcaattgtcaagaattttcagaagctacagtgtgaaatcaaatgtccggctaccatcaaagacttctaggtacttgataattggtatagtttttttgggaggtgggattgccattggaagccacaatagtcgcggtagaaatgaggacgatttatccacaactcctttatcaacattggattccccaatatatgccactaagtatgagtttgaaactggtttagcaaagattgttgatattgttggagctgacaatatttcaagagataaaaaaaccttacaatcacacaatgattcattcttttcaacgcaccatccacccaaccctgaagtccaagttcctggggctatcgtcttcacacacgngggctggaaggttccg

SEQ ID NO: 3032 - DNA, 1092 bp, Candida albicans
atactatctgcgcggattcgtctagtcccggacgtgatacttgggagtagcgcttctggtactaatgcattcaaatatggaaccatgaaggaaaacgtcgtgaatttgactgtggttttagctgatggcactgttatcaaaactaggcaaagaccaagaaaatccagtgctggttatgatttaacgagattgtttattggaagtgaagggacactaggattagtcaccgaagctactgtaaaattgcatgtgcggcccaaatatgaattagtgagtgttgcgtgtttctcgaccattaaagaagcagctgaaatggcgctggatgtgattgctcagggggttctgcctaatgcaatggaaatattagatgaaacaatgattgaatttgtgaatgagtcaacatcgaaaaagcagttgcaaactccaactctattctttaaattgggtgggtcttctaaaaattcaattttggagcaatcaagacttattcaaaacattggttcgaaacacagaatgctagactttaagaccagttcaagtgaagaagaaaatgacgaattgtggtctgccagaagaaatgggttttggtcaacttttgaatatggtaaaaagattttacctgataccaacgatgttcaaggatgggggacggatatagcagtacctgtgtcccaactagctaaagttatttctcaaacgaacgatgacttgataaactctggattcaacaagaaattttcaattatgggccatatcggggatgggaattgtcattttttgatactatataactcaccagattaccacaaagtcaaagtcttggttgacagaatggtaaatagagcaattgaagcttcgggaacatgtagtggcgagcatggtattggtgttggaaagagaagatatttagcaaccgaattaggtcaagctacggttgatcttgagagaaccattaaattgagcctagaccctaacaggatcttaaatcctgataagatatttatgattgatccaaaggatgatttggataaccagctagacgaggggagtcttctcaacaataccagctctagttgtaatcatcaacattga

SEQ ID NO: 3033 - DNA, 402 bp, Candida albicans
gaagacgttaggatctgggtgaccgacattgcagtgccgttgtccaaattatccaaagtgcttaatgaaatcaactccttgattaaagcgtccccatttcagtcaattattttggcacatgctggtgatggaaattttcatgcagacattttctacaaacatgaacaaagagctgaagttgagcaattggttaataaaatgatcgagttagggttgcaaaatgaagggacatgcactggtgagcatggggtcggtaatgccaagcgtaactttttacaattagaattggggtcagatacaatagatctcatgagaaaaatcaaacttgcagtcgatccgaacagaatacttaatcccgataaaatattcaaaatagatcctactgatccgggtgaatactaa

SEQ ID NO: 3034 - DNA, 732 bp, Candida albicans
ggagtgaatagagttggtattgccgatactgttggttgtgctaatccaagacaagtttatgaattggtcaaaactttgaaatcagtggtttcttgtgatattgaatgtcatttccataacgatactggttgtgccattgctaatgcttatactgccttggaagccggtgctaaattaattgatgtttctgtgttgggtattggtgaaaggaatggtattactccattgggggcattaatggcaagaatgattactgctgatcgtgattatgtgttatctaaatataaattacacaaattgagagatttagaaaatttggttgctgatgccgtacaaattaatattccattcaataatccaattactggattctgtgcttttactcataaagctggtattcatgctaaagccatcttggccaatccatcaacatatgaaattttaaatccaaatgatttcggtttaaccagatatattcactttgctaatagattgactggttggaatgccattaaatcaagagttgatcaattgaatttacatttgactgatgatcaagttaaagaagttacgaataaaattaaaaaattgggtgatgttagacaattgaacattgatgatgtcgattcaattattaaagatttccatgctgaacaaagcactactaatactcctcttttaaaaccagtagaggatgatgaaggtccagaaattaaaaaacaaaaagtatag

SEQ ID NO: 3035 - DNA, 1446 bp, Candida albicans
  unsure (1304),(1383),(1404),(1405),(1420): Identity of nucleotide sequences at the above locations are unknown.
tttcttataatctcaatactagttaaaacaatggttgacggatataaagaagtttcagaatcattcgatcgttccaaaatccaacataacccttatggtcctaatccaggtgattttctttcgaatgttggcaattttcaattgattgaatcaactttgagagaaggtgaacagtttgccaatgcatttttcagcaccgaaaccaaaattgaaattgctaaagccttagatgattttggggttgattatattgaattgacttcaccagtggcatctgaacaatcaagaaaagattgtgaagccatttgtaaattaggtttaaaagccaaaatattgactcacattagatgtcatatggatgatgccagagttgctgttgaaactggggttgatggagttgatgtggttattggaacttcccaatttttaagacaatactctcatggtaaagatatgaattatattgcacaaagtgctattgaagtcattgaatttgtcaaatcaaaaggtattgaaatccgtttcagttctgaagattcttttagatcagatttggttgatttattaaacatttaccgtactgttgataaaattggggttaacagagttggtattgctgatactgttggttgtgctaatccaagacaagtttatgaattggtgagaacattgaaatcagtagtcaagtgtgacattgaatgtcatttccataatgatactggctgtgccattgccaatgcatacacagctttggaaggtggggccagattgattgatgtttccgtattgggtattggtgaaagaaatggtattactccattgggtgggttaatggcgagaatgattgctgctgatcgtgaatatgttttgtcaaaatataaagttcataaattgagagatattgaaaatttggttgctgaggcggttcaagttaacattccattcaataatccgatcactgggttctgtgctttcactcataaagctggtatccatgctaaagctatcttggccaatccatctacttatgaaattttgagtccaagtgatttcggtttaaccagatatattcactttgctaatagattgactggttggaatgccatcaaatcaagagttgatcagttgaacttgcatttaactgatgaacagtgtaaagaagtcactaacaagattaagaaattgggtgatgtcagacaattgaatatcgatgatgtggattcaatcatcaaagatttccatgctgatatgtcaacaccactttttgagatcaaatggagcggaagaaaaaaacaaatgttttnaaacaaaaagtttaaaagtcagagagtaattgtaaacacatataccctccaaaaagatttatattttgaaaatattttngggttggtttggtcctttatnntgatgtttttcaatncaaatatatattccaaaccccgttga

SEQ ID NO: 3036 - DNA, 522 bp, Candida albicans
atacagcgttggatcggaatttctttaccctttttccatctttccctttgctacaagaaatcacttaccatgacttcacatacccatcctgttaaattaagtagaacatttaagacaaaatccggtgatgaactttcaattggaactggtaccggtaccaaatggaaaaaagattcaaaattggacgaaatcaatcaagaattggttgatcaaattttgttggccataaagttgggatatagacacattgatactgctgaagtttataatacccaagcagaagttggtgaagcaattaaacaatcgggtattccaagggaacagctttggatcactaccaaatacaaccctggttggaatgatattaaggcaagtagtgccagtccccaagaatcaattgacaaagcattgaaacaattaggaactgattatattgatttatatttgattcatcaaccttttttcactgaggaaaacacccatggctattctttaattgacacatgggaaagtattaattga

SEQ ID NO: 3037 - DNA, 432 bp, Candida albicans
gctattaaacacttggaagcattaaaagaggtttctgaacctgaattttacccagtagtcaaccagattgagagtcatccgttcttacaagatcaatcgaagaacatcaccaagtactctcaagaaaacaatattttggtggaagcattttctccattgaccccggcatcaagactcgatgccaacccattgaccgagtacttggaagagttgctgaaaaagtataacaagtcccttggtcaattattattgagatacactttacaaagaggtattttaccaatcaccacctcggctaaagaaaatagaatcaaggaatccttagatgtattcgattttgaattaactaaggaggaatttgacaagataaccgaaattggtaatgccaatcctcatcgtgtctttttccatgaagcatttaaagatttatag

SEQ ID NO: 3038 - DNA, 888 bp, Candida albicans
agaaaagacctactgccgaagaagaagaggctctccaaggtttatagagtgtgtagttacaaatttttagcgacaacaaaaaaaaaagttcacacttgttaccacaccatgactcttactaccgtctcgggtgacccaattactatcggtattggcaccggcacctccatcaaagatctaaagagagggcagccaaccgcagaaaacaaggcgcgtattgttgacatccttaggtatgcacttctgatcgggtataaccatatcgacaccgccgaagtatacaccacccaaccagaagtcggcaccgccatagctggcttccaaagagaaaagttatggatcaccaccaaatactccgtcacctcgtcgatgatcaagaaaaaaagctttacccccaccgactttgtcgagcaagccctagacgagatgaacactaactacatcgacttgttgttaatccactttcccccaaagccaaacgacccctacacgatacaatcgttgtggcaagagtttgtatcaatcaaggcaaccggaaaggtgagatacattggggtgtccaactttgacatcccccagctaaacacccttcttgagataggcacccccaccatcaaccagatacagtactacctcgggtcagacaatttggaggtcgttgagttctgcaagaaccatggcatactcgtcgaagcatatggcccgctaactccactcagaaaccccaaccccaaaacagacgcattgatagagaaactacaaaacgccaaccacctaaccaagagccaggccttgttccgttacttgctcgacaacaatatcttgccaatcactacatcgttcaagaaagaacgcctcaaagaagcattacatagctatacatactaa

SEQ ID NO: 3039 - DNA, 930 bp, Candida albicans
  unsure (902): Identity of nucleotide sequences at the above locations are unknown.
gttccaagcataactttaataggtcaggtgtttgtcatttgtcatttgtcatttgttatttgtagttgtggttgtgttggaacttggcttaggtcttctagtgtcaaaaattggattttttttcgtggtcgttcaaaatttttcaacccaagacaacaacaacaaccaattacaaccaattacaaccactcccctatatctttattgtctagattaagttactacactaagttgattgtcatgacaaaggaattgccatctgggtattttcaaggtccctttcgaccatacaaaactttccaaccaagtcttaccgaacgaccattatccaaattcgaacaatttgcagtgttttccatattacttatttcattaattcgattatacaaattatacatccctgatagagtagtatttgatgaaattcatttaattaaatatataaaaaattattatgatggtagtatatttgttgatattcatccacctttagggaaactaatttatttttatatcacgaaattatttctgtttgataaagatttccaaattgatattattggggatttgtatcctgaagatttcccatatttatggctaagattattcagtggtatttgtggcattggacatgttttattgacttttttcacattaagaataacttgtaacctggttatttcgattgttattactattttgatttgtttggaaaattcaatggtgacagtatcgagattgatcttgttagaaggtccgtcattatttgtccaaagtttggtgatttacaattataaggcattcactactcgtattccatttactggatgctggtacttcaatttattcgttactgggaataccttggggttaaacatctcgttgaaaatttcacgattgtntacatttgcatgggttggaatattgaca

SEQ ID NO: 3040 - DNA, 834 bp, Candida albicans
ttgttgttacctgttggccagccatttgttcaattatcaatttttggaacctatgtattggttatgtttttcagatgcattcttggtacacttttgtcaacaaatacacatgttttcaatgtcaatgtgcaaattttttcatatgttttaggatgggctttacattatcttccatttttcattatgggtagacaattgtttttacatcattatttaccagcattatattttggtattttggcgttgggacattttttcgaaattttcactggttatttgacttctcgttctaaatatttccaacaagtggcatttgtattagttggattattttccattttaagtttggtattttatgtcaattattcatctttaatctatggtactccctggactaaggcaagttgtgaattgaccaaaccatttagtggttgggattataattgtggcacatttttcgatactttaggagaatatgacattcaagagaaatcattagcttcagaatctgaaataccaacagaaacagtagttgttgaagctaaacaaactcctaaagctgaaccaaaattggctaaacaagatgatcacattgaatcccctgctgctgctgaacctgttgaagagaaagaagtcaaagaagaagttgaacaattggcaccacccttagctgttgattttgaagaagaaactcctaaagtggaagacccacaagttgctgatgtagatgcttccagtaacgatgaaaaatctgttgaggaaaagcaacaacaagaacaacaacaagaacaagaacaggttgaagatgaatcagtgcatcaagttcaacaatag

SEQ ID NO: 3041 - DNA, 1383 bp, Candida albicans
tttcagaatataaaatattcaatttggaaacccttcccaaaaggagggaccttgatcgaggattttttaacaccacacttcagatcaactttggatgattatcaacaacaaccattacaagttttatatggaagtactatcactataaaacataatgcattagagaaatatttgcattcacacgatttgacatatcccagaggatcgaatttacaacaagtgacactatatgacttccctgatgtcaacaatgaatgggtaattgaaacaaaacagaaatataatgaagaaaaattgatgactgatcaaagagaagtaaaagatggtgatgttgttagattgtaccataaagctactggacattatttacatgtcaatgatattcgtccacctatttctgaacatgaatatagttatgaagtaaatgggaatgaaactagaggattattgggtaatgaagattatgagtttaaaatccgaatgttggtaaagaaacctcatgcggaaaatgatttgcccttgattaaattaagaaccacagagactattttccaattaatccaccaagcgactcgttgtaatcttatgagtcacgaacagaaactaccagattggggtgaatatcaaaatgaagtattgtgtgtaaaagaacctacaatccccaatacattatggtatgtcgaactgtcatcacatccattactcaaagataccaaaaaattgaaaactttccctaaattttcattttggtcaaaattgatcgaaacccataaagtcatgtttaatttaaataaggggttcactaatcctcatccatatgcttctaaaccacttgattggccacttttatctagaggtattgcctttttcagcaactacaatttgaaatcaatcgatgaagaatcaagtctaatttattatttaggaaatgttgccatttattatctggtattttttgtgggtttaatagctatattcaaatgtgccatttattcgtttataaagttaaacccttatgcatctcctccatcatcatccaaatcatcaccatatgccaacttttacaacaattcctggccatatttggtgggatggtttattaattatattccttattgtctcatgtcaagaaacttatatttacatcattatttactggcattaaattttggaatattattattaagtcaatatttgaattatcgtgtcgctaaaaacaaaattattggtggtataataactgcaacaatatttgtcagtgcaatatactgcttttatgaatttataccaatcacatatggattgccatggacattatatcaatgtaattctcataaatggtttccaaattgggacattgattgtatgacatatacaggttaa

SEQ ID NO: 3042 - DNA, 1776 bp, Candida albicans
aacaaatttttatatttttatttttatttttatttttattttagtttcccattcaatatggcaaagaaaccggtcacacccgcttctaaagttgctgcaaaacaggctgctgttagaagcagacaccaagaagatgtattcacacttgatccattgatagatccaatatttcaaaagggagaattgcgttcgtatttggtaaccgaaccttctcctagtgttcttaaaaaaagactgattcacaccaaagaatactggatgctttcaagtttattattaattgctttctacgttagaatgtataatttatccaatccaaactcagtagttttcgatgaagtccattttggtgggtttgccagaaaatatattttgggtacttttttcatggatgtacaccctccattggctaaaatgctttttggagctgttggagccattggtggattcaaaggtgattttgaatttaaatcaattggtgataaatttcctgattctacaccttatatatttatgagacaattcccagcattgttgggtgttggaactgttatcttgtgctatttgactttgagacaatcaggtgttagaccaattattgcttatataactacctttttattgattattgaaaactccaatgtcactatttcaagatatattttgttagattcccccttgattttctttattgctgctgctatttatgcttggaagaaatttgaaattcaaattccattcacctttggctggtatagaagtttattggcaactggtattgctcttggtttagcattgagttccaaatgggttggtttgtttaccgttgcctgggttggtttcttatgtatataccaattgtggttccttattggtgatttatcagtaagtaccaaaaaaatttggggccattttttcgcaagaggaattatcttgttgggtgtaccaattgccttatatcttggattttttgccattcatttccaattattaaataaagaaggtgatggaggtgcctttatgagtagtgcctttagagccggattgcaaggtaataaaattccaagagatattaccgaacaagttggattaggatcagttgttactattcgtcacgttgatactcaaggtggatatttgcattcacatgaacatttctatcaaacaggttccaaacaacaacaaattaccttatatcctcatttggactctaacaacaagtggttaattgaaccttacaacggcaccatccataatgaaacttttgttcctttaattaacggtatgaagattagattgaagcatattaatactggtagaagattgcattcacatgatgaaaaacctccagttagtgaacgtgactggcaaaaggaatgttcatgttatggatacgatggatttgctggtgatgcaaatgatgattgggttgttgaaattgtcaattatagatcacaaaagggtgaagctcaaacatttgttaaagccatcaatactattttcagattgagacatgccatgaccggtcattatttgttttccagtgaagtgaaattaccagaatgggggtttggtcaacaagaagtcactagtgcttcacaaggtaaacgtgcattaacacattggtatattgaaaccaatgaaaacagtatattgcctccttcagaagccaaaattatcaattatcctaaattatccctttggcaaaaagttgttgaatcacacaagagaatgtggaagattaatcaaggattaacttcacatcatcattggtaa

SEQ ID NO: 3043 - DNA, 1323 bp, Candida albicans
acattcaaagaaccaaacacaatgattagaacaaccactaccagagccattaaccgcacagctatgttgcaaaaccacattcgtgggttttccagtactgcttcaattttagataagatcaaagtgaaaaaccccattgtcgaattggatggtgatgaaatgacccgtattatttggcaaaaaattaaagatcaattgatcttgccatatttggatgttaatttgaaatattacgatttaggaatcgagtctcgtgatgccaccaatgaccaaatcaccattgatgccgcaaatgcaattaaagaacatggtgttggtgtcaaatgtgcaacaattacccccgatgaagctagagtaaaagaattcaatttgaagaaaatgtggctttctccaaatggtaccattagaaacattcttggtggtactgtctttagggaatcaattattattccatgtattccaagattgattccgggatggaaagaaccaattgtcataggtagacatgcttttggagatcaatacaaagctactgatttagttatcagtgaacctggtaaattggaattgagattcaccccggaaaatggcggtgaaacccaaactcataaggtctacgactacactggtccaggtgtcggattggccatgtacaacaccgacgaatctatcagtgggtttgctcgtgcctccttcaacatggcattatccaagaacttgccattgtatatgtcaaccaaaaacactattttgaaaaaatacgatggaagatttaaagacatcttccaagacatttacgaaaatgaatacgccagtgaatttgaaaagaaggggttgtggtatgaacacagattaattgatgatatggttgctcaaatgattaaatccaaaggtggattcgtcatggcattaaagaattacgatggtgatgttcaatcagatattgttgctcaaggttttggatcattaggtttaatgacatctgcattgatgactccagatggaaaggcatacgaagctgaagctgcccacggtaccgtcaccagacactacagacagcaccaacaaggtaaagaaacctctacgaactccattgcatctatatttgcctggacaagaggtttggcccaaagaggaagattagatgagacaccagaagtcgttgactttgctgacaaacttgaaaaggctactatcgacactgttgaagttgatcgtatcatgaccaaagatttagccttggccatgggcaaaaccgacagatctgcatatgttaccactactgaatttttggatgctgttgctgatagattgaagaaataa

SEQ ID NO: 3044 - DNA, 219 bp, Candida albicans
tttttttctcgtgtactttttctcgtccaacatataatctgtcacactcccaaaaaaaaaaaagaaaaaaatttccaacacatttttctttcttcatcacacacatcacacatcatgaaaggattaattttagtcggaggatacggtaccagattgagaccattaactttaacattaccaaaaccattggtcgagttcggtaacagaccaatgatctag

SEQ ID NO: 3045 - DNA, 984 bp, Candida albicans
caccaaatcgaaactttggccgctgctggtgtcaccgatattgttttggccgtcaactaccgtccagaagtcatggtttccactttaaagaaatacgaagaagagtacggtgtctccatcaccttctctgttgaagaagaacctttgggcaccgccggtccattaaagttggctgaagaagtgttgaaaaaagacgactcaccatttttcgtcttgaactccgacgtcatttgcgactacccattcaaggaattggccgacttccacaaggcccacggcgctgctggtactattgttgctaccaaagtcgacgaaccatcaaaatacggggtcattgtccacgacagagacactccaaacttgatcgacagatttgttgaaaaaccagtcgagtttgttggtaacagaattaacgccggtttatacatcttgaacccatcggtcatcgacttgattgaaatgagaccaacctcaatcgaaaaagaaactttcccaatcttggtcgaacaaaaacaattgtactccttcgacttggagggttactggatggacgtcggtcaaccaaaagatttcctttctggaacctgtttgtacttgacgtcattgtcgaaaaaacacccagagaaattgtgtaaagagaaatacgtccatggcggtaacgtgttgatcgacccaactgccaagatccacccatctgccttaatcggtccaaacgtcaccatcggtccaaacgttgttgtcggtgaaggtgctagaatccaaagatcagtgttgttggccaactcccaagtcaaagaccacgcctgggtcaaatctaccattgttggttggaactccagaattggaaagtgggctagaactgaaggtgttaccgtcttgggtgacgacgtcgaagtgaaaaacgaaatctacgtcaacggtgccaaggtcttgccacacaaatcgatctcctctaacgtcgaaaaagagtctatcattatgtag

SEQ ID NO: 3046 - DNA, 1389 bp, Candida albicans
accatattagttatgacattaaaggtgcttattttagttggtggggagaccacgggaacaagattcagaccactttccatggaatgtcctaaattattattcccattatgtggtaaaccattggtttcacatattattgataatttaactgatcaatttccaattgatgatttagagattttattgatggggtttttcaaaggtcaacacaaaaccatgttccaggactacattcaaaatgtcaacaagtcgaatcctgatttgagaatcaagtatttgtcggaaccattcccattgggaactgcgggtggattataccatttcaaagatgagattttcactgattcaaactgtaaattattaatgatccatggtgatgtcatttgcaactatccattcaaagacatgttggaattttttgaacaaacaaaatcaaatatcactttatatggtgttgatccagtttcattacttaaaagatcacaagctcaaattttggttgtaaatggtactgaaaatggtgatgaggcacatgatgatgatatagttaccaaatttggtgctatagttgctgaaagaaagaactctaaagtggttcattatgttgaaaaaccaagtagttccatttctgaatttagacaagacagtacttttgaaatattattgaatggtggtatttatatatttgatagatcaatcttagacttattgacgctggctgaaattaagaaaaaaaattcaatccagtttgatgatggattagatgacaacgacagcaacgacaacgacaacagcgataatgttctttcattagagttggatgtttttaagactttaccacaacttgacaatacaaatttcaatgttttcaaatcaaatggtttttggtatcaattgaaactgccactctctgcattgttggctaataacttctttttggcacaaagcggaggtacaaaattgtctgctggcgttgaacttgtccaaccagtacaaattttgacagagagtatagctcaagccaagtcatgtaaaattggacctaatgtctctattggtaaaaatgttacaattggcaatggggtcagaatggtcaattgcattgtttgtgatgatgttacaattggtgacaacacaatcatcaaaaatgcaattattgccaatggaactaaaattggaaaatggtgcagaatcgaaggtacgatcacagctagtattttagcaagcaatgtgattagctccagctctgctgcatatatgaagctgttgaatgatattgttatcttgtgtcaaaatacagttgttcataatcaagtgtttgtttacaactcggtcgttttgccacataaagaattgaaaaaggatgtcaagtacgaaatcatcatgtga

SEQ ID NO: 3047 - DNA, 1332 bp, Candida albicans
gcgcggtaccggccgcctcgtggtgaacattaccattcgtgtatattatttaaacagatcacttcttatcatttgctcataaaaaccaatatcacaataactacaaccacatctcacaccatgtatactactgctaataaccgtttaactcaattgacacaaatcttactgccaatagtcaatgatgctgatagttcatttgctcaatatttattacaaaacccaacatttgctcctaatccagaatcatctttaaatcctgaaaaaccattcaaaattgctgttgttggatcaggtaattggggtactaccattgctaaaattgttgctgaaaatgctttagctagaccacatttatttagtcattatgttaatatgtgggtatttgaagaaaaaattaatggtgaaaatttgactcaaatcataaatcaacgccatgaaaatattaaatatttaccaggggttaaattacctaataatttaattgctcaaccagatattgttactgccgttaaaggtgccgatttaattattttcaatttacctcatcaatttttacctaagattttaaaacaattgaaaggtaatgtacctaaaactactagagccatttcttgtttgaaaggtttagaagttagtaaagatggttgtaaattattatcaacttatattaccgaagaattaggaatagtatgtggagctttactgggggccaatttagccccagaaattgctcgtggtaaatggtcagaaactactgtggcttataaattaccaaatgattatcgtggtgccggtaaagatattgataaattagtattaaaagcttgcttccatcgtccttatttccatgttaacgttattgaagatgttgctggtgtttctgtggcgggggctttgaaaaatattgttgccttagccgtggggtttgttgaaggtttaggttggggtgataatgctaaagcagccattatgagagttggattattagaaacaattaagttttctgaaacatttttcccacaatctcaagctgatacttttactgctgaatctgctggtgtagctgatttaattactacttgtgctggtggtagaaatgttaaagttggtagatatatggctgaaactggtgtttctgctgaagaagccgaaaagaaattattaaatggtcaaagttctcaaggtatagttactgctaaagaagttcatgaattattgacttatgttaataaattggaagaattcccattatttgaagctacgtatcaaattgcttttggttctgaatcaattgaaaatttaccaaacttgttaaataccactgcttaa

SEQ ID NO: 3048 - DNA, 1143 bp, Candida albicans
attcaacaaataaaaaataatttcataatgactacttccccatatccaattgaaactccatttaaagtttgtattgtcggttccggtaactggggtactgcagttgcaaaattagttgctgaaaactgtgctgaaaaaccaaatattttccaaagagacgttaaaatgtgggttttcgaagaagaaattgaaggtagaaaattgacagaaataattaacaccgaacatgaaaatgttaaatacttgccagaaattaaattgccaactaacttggttgccaacccagacattgttgacactgttcaagatgccgacttgattgttttcaatattccacatcaattcttgggtagaattgtcaaacaaatcgaaggtaaagtgaaaccaactgctagagccatttcatgtttgaaaggtttggatgtgagtccagaaggttgcaaattgttgtcaacctctatcactgatactttgaagatttactgtggtgtcttatctggtgctaatattgccaacgaagttgccaaaggtaactggtcagaaacttccattgcctacactgttccagaagatttcagaggtgccggtaaagatattgatccatttattttgaaagaagctttccacagaccatacttccatgtcagagttattgaagatgttgttggtgcctctattgctggtgccataaagaatgtcattgcgagttcagctggtttcgttgaaggtgctggctggggtgacaatgctaaagctgctattatgagaatcggtatcaaagaaaccatccgttatgcttcttactgggaattgttcaagatcaaggctttgtctccaccaaacccaaaaactttcaccgaagaaagtgctggtgttgctgatttgatcactacttgctcaggtggtagaaatgttaaagtcgccagatacatgattaaaaacaatgtcgatgcatttgaagctgaaaaaattgttttgaaaggacaaagttctcaaggtatcttgactgctaaagaagttcacgaattgttaacaaatttcaaccttcaagacgaattcccattactcgaagccacctataaagttatctacgagaatggtagtgtcgacgatttcccacaattattagaacgtgatcaataa

SEQ ID NO: 3049 - DNA, 279 bp, Candida albicans
ttcatgatgacaaaatcatttgttgattataatggagtcattgttgaaaaatataatgttacaaagggagcagtacctcatagagtagatgcagaatatggtaatcaaggattggattttaaaggggttgccactgaaggatttggttgggttaatgcttcatatgtatttggtttgacatttttgaatttatatgctcaaagagctttaggtagtttgactcctccagaaatctttttaagaaatatgcatcctgaacaacggaaacaatataaataa

SEQ ID NO: 3050 - DNA, 960 bp, Candida albicans
tcaattcaaaccttggtcatggcaccccaacaagtaaatgcattttcagcaaatggttctattccttcaccaaaagaatttgaaggaaaaggtaaactaaaattgtcgggaagaatccttaatgtgatgacctcattgcccttacaaattataagtgattacgacaataagacaggacagtattactgggatgttgaaactgtacgtggtaattcagcattgtattcgtcgcaacattttcttgctgagaacaaagaatgggagacacatttgattgcttggactggagaattgataaacaaaaagaaagatacaagttcattaactgcggacacattgcaggatgacccattgtatttggatgaagaagataaactgaagatcgagaaaaaattatgtgatgccagtggcactccaaacatccatcccgtgtggttattgagacgtgatcagggaaggtggagaaaatatgcagagaacgttttgtggccggtattccattatattcagggacaaccatctgatggtaaagctgaaactgatgcttggcatgattatgtcaaatttaacgaagcatatttgaacaaaatcaagtcggtttataagccaggggacattatctggatacacgattactacttattgttgttgccccaattattgagaatggagttcccaaatgcatatatcgggtttttccttcatgtccctttcccatcctcggagtactttaggtgtctttccaaaagatcgcaattattagatggtatgttaggagctgacaagattggtttccagtcggactccttccaaagacactttatttcttgctgtgctcgtgttttgggctgtgaggttaacagagattctgtttctgcatatggtacaacaatctcggttgagacgttgccaattggtatcgatactgagaaaattgaacatgatgccttttcccagtga

SEQ ID NO: 3051 - DNA, 273 bp, Candida albicans
gtgagaggggttataccaaaattggaaggcttcgaaatctttttggatatgtatccggaatggagagaaactgttgttttgattcaagtttccagtccaagatactcacactccgccaatgttgaaaccagaattacggaaataatttctcgtattaattcccaatacggtaacctcaaccacacctcccgtttttgctttaccagattgagatttgccccacaaataatatttaaccatggttatcgatttacacaattgggctttgaataa

SEQ ID NO: 3052 - DNA, 1398 bp, Candida albicans
ggcaaattggccaaggataaattctgtaagaggtggtatggaaacaatttctttgagagtttgttaattgttcagaaataccataaatctccattgatttggtgggaatgcacaggtacagccactgtgttgaaagatgctattatggtcaatccatgggattctgtgggtgtagcaaagactatcaacgacgcattgatgttatctacgaaggaaaaggtttctttggaatcaaaattgtacgagaaggtcctttcaaacactgttcaaaattggacatctacgttcatttgcgatatcctttctcattcaattgtcacacacagtaacagctatacccctgcattaaatagaccattattgttgaataactacaaggagtcacagagaaggttatttttgtttgattatgatgggactttgacccctattgtccaggatcctgctgcagctatcccttccgataaattgaatcgtattttggatgttttatcttcagatccaaagaatcaaatctggatcatatctggtagggatcaagcatttttggagaagtggatgggaaataagaatgtgggtttgtcagcagagcacggatgctttatgaaggatattggttccaaggaatgggtaaacctagcagcatcgtttgatatgtcttggcaagagaaagtcgatgatattttcaagtactacactgaaaaaacaccgggatcaaatattgaacgtaaaaaagtagcattaacttggcattaccgtcgtgctgatcctgacttgggaaatttccaggcagaaaaatgcatgaaagaattgaatgatacagtagccaaagaatatgatgttgaggtaatggctggcaaagcaaacattgaagtaagaccaaaatttgtcaataaaggtgaaattgtcaagagattagttttgcatccacacggagccaaacaagaaaagcatcctactggacattgcacaaaagatataccaattgaagaattacctgattttatgttgtgtttgggagatgatttaaccgatgaagacatgttcaactcattgaatgagattaataagaaatggaaaggtgacaatcgcccaaccaacaagtttgggtcttatggtgtttatcctgttgctgttggtcctgcatcaaagaaaacggtggcaattgcacatttgaacgaacctcgccaagtgttagagaccttgggtttgttagcaggattggtatctatatttgaaagtgctggtacagttgatttagatgatcgtggtcaccttgccaatagtgtgtcttccgaaagatcaaaacatgctgtatctaaggcagtatctttacgtaaaaaagctagtcaagaaaaagaaattgtaaaagaagatcctactaatggtgccaagtga

SEQ ID NO: 3053 - DNA, 972 bp, Candida albicans
ttcatcaccatgttatcaagatctattaaatcatcattgaagcgtactacagctttagccagaccaaccgctgccaagtctgctttgaaaatcgccaatgccagttcagtgagatccctccatattaaaaacacttcgagctatagaccaacaccattcttgactttccaaagatatgccagtgtttctgtcaaagtgccagatatggctgaatctattaccgaaggtactttagccgccttcaacaaagaggttggggattttgtcagccaagacgaaacgattgccaccattgaaaccgataaaatcgatgttgaagtcaatgctccagtgtcaggtactattactgaatttttagttgatgttgatgccactgttgaagttggccaagaaatcattaagatggaagaaggtgacgccccagccggcggtgcatctgcatctgaagctccagctaagaaagaagaagcccccgaaaaggctaaagaagaatctgctccagctgccgcaccaaagaaggaagaaactaagaaagaggaaccaaagaaggaatcaaaaccagcaccaaagaaagaagaatctaagaaggccacccaatctacaactagtgctccaactttcaccaatttctccagaaacgaagagagagttaagatgaacagaatgagattgagaattgctgaacgtcttaaggaatcacaaaacactgctgcttccttgaccactttcaacgaagttgacatgtctaacttgatggatttcagaaagaaatacaaggacgaatttattgaaaagaccggtatcaagttaggattcatgggtgctttctccaaagcttctgccttggctcttaaggaaatcccagctgtcaatgctgcaattgaaaacaatgacactttgttctttaaagattatgccgacatttcaattgctgttgccgtcttcgaccacgggggctggaagatccgcgag

SEQ ID NO: 3054 - DNA, 264 bp, Candida albicans
ccttggccgtctgtggcaaaaggtggtgttttgggatcagtatacggtaccccaattatcaatatgcctcaaactgccgtattaggtttacacggtgttaaagaaagaccagttactgttaacggacaaatcgtttctagaccaatgatgtacttagcattgacttacgaccacagagtagttgacggtcgtgaagctgttattttcttaagaaccatcaaggaattgattgaagatccaagaaagatgttgttgttagaataa

SEQ ID NO: 3055 - DNA, 600 bp, Candida albicans
acagccgaattattgggtacttccataaacgtagatctggagaagaaaaaaaaaatactgaaaaaaaaattttacaacactcaagcaccattaagacaatatcaaatgttcaagataaagacattcacaccaacctccatccctttagcaaaaccgggtctcaactccgttagaagactcagattaataccggactggtctaaatttaaaacaataccacagccaccgggatatgttgtggggacagttaatgacgcctacaaaccaccatcgccagagcattatgaaggtagttaccattggacttatgagagagctattagtataaccatgattccattagtcatgaccccatttgtagctggtgttgagttcccaatgattgattcgattttctccactttattgttgtttcactgtcatgctgggatgaagtcatgtataatagattatataccaaaaagagtatatgggttttggtacggtgctgcttgcaaattgttgacattagggacatttgtggccatgtacggtatctatgttctagaaactacaagtaacggtcttttcaatttagtgtcgtcgttgtgggctgcataa

SEQ ID NO: 3056 - DNA, 435 bp, Candida albicans
cctgtggtgacagattggccaattttactagaaagaattaaaactattcctcaaccaccaggttatattgttggtacagttaatgatgcttatgtaccaccaccaccacataaattagaaggttcattacattggactagtgaaaggattgttgctattggtatgttaccattagttttagcaccatttattactggtggtggtgcttcgactttaattgattccaccatgtcagcattattattatttcattgtcatactggtttccaaagttgtattatagattatattcctaaaagagtttatggatcttatcataattatgccatgtatttattgacttttggtactggtattgctggttatggtatttatcaaattgaaactaaagaaggtggtgtttccaatattatttcaaaactttggaaagcttaa

SEQ ID NO: 3057 - DNA, 831 bp, Candida albicans
aagaatagtttgagggattcgcatcaaaaactggaattttttgttgaaattccaagatcttcactaaaaaaaaaacagaaaacagaaaaatataaaaatcaacattttcatccattgttgatacgagtcaaaaaccgaaaagtaatgtctgaacttccaacagacctcgaggacacctacaccaaaacattcaaacccaataaaaagaatgcatttgagttttccgcagtcacagatttcataacaaagtacaagaaaatagttttatttatagtaacttttgtttgcttgtcattatttaccaacgtaccgtatattcctcatttcagacaagcacctcccaaagttgtaattattttggctgctaatgaaggtggtggagtattgaagtggaagtcaccacaagagtggtcagttgagagatcttctattgccaataagaaaaactatgccaaagtgcacgggtacggcttgacaattaaagatatgactattaaaaagagatactctcacgagtggagggaaagctgggaaaaagttgacattttaaagcagacaatgagacagtttcctgataccgaatggttttggtggttagatttgcacacgtatatcatggaaccacaaatttccttggaaaagcattttcttaacaatttgtataatgctacttatagaaacctgggacacattcaatccattgaaacttaccaacagaatctccttacgttggacacaaccagcctatataaatggttactaatccagattgtgggggaatcaattggggtcctttttaattcaacatcgaatgggtcgagatgctcttga

SEQ ID NO: 3058 - DNA, 360 bp, Candida albicans
agattaattcgaagatcagagtggtcggagatgctcttggatatatggtgggaccctgctatgtacgaacaaatgcacatgcaatgggaacacaaagaacaggacgctctagaaaccttgtattcaacacaagcttggataagagagagaattgcgtttttacctttacgccaaatcaatgcgttcccaccaggcgcttgttcagaccaagctgacgatccacagtattttttccaaaaccatgactttgtagtgaatatggcagggtgtgaatggggtagagattgctggggtgaaatggaacattataaggcgttgtctaaaaagcttcataagagatggtggaagttttgggagtag

SEQ ID NO: 3059 - DNA, 582 bp, Candida albicans
accacaatgacaacgacaacgacaaacacaaccgtaatagtagtaggtggtccagccggtaccggtaaaacaactcaaggtgaattaatatccaaacattttcaatgtccatttatagaaggtgatgcattacatccacaagaaaatgtcgataaaatgtcacaaggtatcccattaaccgatgaagatagatgggggtggttaaaacaattgagtcaagtatcaagttctaaagcccatgaatcagaaaataccaccaaaatagccgtggtttcatgctcaattttgaaaaaaaaatatcgtgatttcattaaagaaaattctgtggatccattgattaaattcagatttgtatttttatatactacttttgaagaattgatgagtagagtggaaaatagaaaaggtcattatatgaaatcagatatggtgaaatcacaatatgatattatggaaattcctcataatggtgaattgttacaaaatggtggtgatgcaattactgttgatacaagtggtaaatctcctgaagaaatttttaaagaaataattgtcactgataatattttgtccaagaattga

SEQ ID NO: 3060 - DNA, 702 bp, Candida albicans
  unsure (14),(35),(42),(143): Identity of nucleotide sequences at the above locations are unknown.
gggcgcgagcatgnaccgttgacccggcccctcgncgagaanagtaagagagtcttgggtatcctggatggcaaaataaaaccgaatatgtcaaccatacgtataaggtgttgcaacagatgttccagaaatatggtactggngaaatatgcatctgattacaagaataccattattggaattgaggtattgaatgaaccactcaacccaaatatggacaaacttaaagaattctacattgagtcctacaacgatgggagagagattcaagttatcaataacacaatttttttccaagaagcatttcaacccattggctactgggatagttttttggagaaaggtgaaatcaaagttaccgaaacatcaaatgggacaaaccacacaactaccaaaaaagcagatttcaaaaatattatcattgatcatcatcattatgaagtttttacagaatcccaagtggcactgaatgtttccactcatttagaaaatatcaagaattatgcatcagctattggtaaagaaaaggcaaaggctatagttggtgaatggtcagcagcattaaccgattgtgccccttggttgaatggaattggattgggttcaagatatgaaggtactgctccttatactaatgatcgggtacgaagttgtgccgagttcaacaagagtccagataaatggtctaaaaaactaaagaaa

SEQ ID NO: 3061 - DNA, 336 bp, Candida albicans
  unsure (325): Identity of nucleotide sequences at the above locations are unknown.
ttttctaacgaaaatcacttttcttattcactattcataatgtgtcataaaatgatgaataaattccaacaaagatttcttcatacaacttcaaccccattatttaagacttgtgtttatttttcaaattgttctgtttatcagaagaagcatttcccacaagacataccaattgaatactatacccatatattttatgcatttatacttattgatgaacaaactgggaaattaaaatttagtgatgaatggtgtgatttacaaatgccacaaccatcacccaatcaatcaattacagtcaatatgtgtctcacaacgccgaagnaggtccatgtc

SEQ ID NO: 3062 - DNA, 564 bp, Candida albicans
acctcaatattctctctctctttctatgcctgttcactagtttttcaattcacatatctattattattattaacaacatttatcatgactccaattcaacagactccttctgttcacaacactattgatgattcctctaacggttttccaaatcaaatttcgcttggtgaatatttattttatagaatttcccaagctaacccaaaacttaaatccatatttggtattcccggtgatttcaatctcaatttattagaacatgtttattcaccaatcattgctgaaagagaaataaagttcatcaacacatgtaatgaattgaattgtgcttatgctgctgatggatactcaacagttattggtggtatgagtgccatgattaccacatttggtgttggtgaattatctgctatcaatggtattgccggtgcgtttgctgaacaatgtcctgttttacataatcctggggaaaacttccatgaaaagatacattgcgtgctcccacacgaaatgaattacatccctccttttgggtaccaaacccatgattcatttaagcccccc

SEQ ID NO: 3063 - DNA, 1551 bp, Candida albicans
gcgtcgcaaatgcggatggcccaggcccgtggtgaagacgtggggacaacttcgatgaaagatagattgcgtgctccaaatgaaatgattaatatccatcatttggtaccaaaccatgatccattaaagccacctaatcatgatgtttacaagtctatggttgagaatatttccgttgttcaagaatctttagactatgacactaagaaaaacttgattaatattgacaatgtattgaaaaaaataattcaagaggcaagaccaggatatttgtgtattccatgtgatgttccagatcttccagttccaagtaagatgttattcctggatccatttactgccgctacaagatacaccaatctgatattatcaaaacaagtattgaatgacgtaaccaatgccatcctcgagaaaatgtatgatgcaaaaaacccatcaattttctccgattgtttaacaacaagatttggattccaaaatgatctcaatagatttatcgaccaaatccccgaaaccgtcaaattgttcactgccaatcttgctagaaacttggatgaaagtagaaataattttgttggcgtgtacaatgggaatggatcttccgatgacaaaactaaacaagaatttgaatcttcagattttatattaactctagggtttttccccaatgaaatgaatactggtggccatacatcaaatttctcaatgataaaagatgttgtcattgttcatgcagattacattaaagttaatcaccaaatttatcatattaaacaaaatgatggagaaagattattcactttgggtgagttcctttgtaccttgactgagaaattcgatccatcaaaactctcggtagcagcagcagaacccaaaaagatttaccaatatcaaccttcgcaacaatacagtccatcaaatcttgattatattccacagggcaaactcattgaccatttcaacagcactcttaaacccaatgatttgtttattttagaaactctgtcatttgtttttggattaccagatatgaaattcccaaccaatgtacagttgctcacatctccttattatggttcaattgggtatgctgttccagctacttttggtgccacacttgctgtcaatgatttaaaatcagatagaagaattattgttgtccaaggtgatgggtcagcacaaatgacggtgcaagaattatccagttttgtcagatataaggagattttaccaaatatgcctcatatttatttgatcaataatgatggttataccattgaacgtaaaatcaaaggcccaaatcggtcttataatgatatcaatggtaaatggaaatggcgtaatttattaaatgtgtttggaggtgttgaaggtgaaatgtacgattcatgtgtattgaagaacagttctgaattggatcaattctttaatggtgataagacaaaaccaatactgtctcacaaattacaattctatgaaataattgctggtaaatttgatgtacctcaaagagtcgataacatgatgtgtatttcaaaaaataaaaattga

SEQ ID NO: 3064 - DNA, 1443 bp, Candida albicans
caactgttgcatatcacgtgcttggtcactatgagattttggttcgcatttagggactcagatcggtacgtatattacataatcatcgacaagctaattcttttttttttttttcgccccctttgtttttttctactactgttaattgtttgtttattgttgttatatgtttcatttttaacatctaacagattacattcactttggactattaccatcccccccagatctccaacaatgactagctattcgattgcatttataagtggtgttatactatctatttactactactttgttttgaactatttttctgagttaaagttcagcgaaccaccatatcaacgatataatccactagcgaaagatcaacctaaattagctagtaatcaatatttagacaaaatttatccaccagagaataggaaacagatagggaaagaaaatgccacgatggtaatgttagtgagaaacatcgaattagaaggagcattagaatcaatgcgatcattagaagatcgattcaatcgagattataaatatccttgggttttccttaatgatgaaccatttactgaagaatttatggagaaaaccacattaatggcaagtggtgaaactttttatgaattaatccctgtcgaagattggcaaccaccaatatttattaatgaaacaaaattacaagaaaatttagataattctaaaactaatgttatttatggtggagttagatcttatcgtaatatgtgtcatttcaattctgggtttttttataaacaaaaaaaattattgaattatgattggtattttcgagttgaaccaaatgttgaatatatgtgtgattttcaatatgatccatttgaatttcttcgaattaataataaaatttatggatttattattgccattactgaatatgaaaatactattcctaatctttggcccacagtagaatcatttatgaaaaaacatccagaattacttcatccaaataatgccattgaatttttaacaagtaaagaaatttctttaaatcattatatggatttaattccttcagcaactgattataatttatgtcatttttggtcgaattttgaaattgccaatttgaatttttggagaggtgaagcttatagaaaatattttgattatttagatcaaacgggtggatttttctatgaacgttggggtgatgctccaattcattctattgctgcagcattatttttaccaaaagataaaattcattattttgatgatgttggttataaacatagtgtttatactcaatgtccattaaatcctcaatttagatacgaacataaatgtcattgtaatccagataatgattttacttttagaggttattcttgtggtaagaaatattttgaaaaaatgggtttacaaaaacctaaagaatgggaaaaatatcaataa

SEQ ID NO: 3065 - DNA, 300 bp, Candida albicans
aaacattgtccgaaattatcaacaagtgattgggataatgaatatactgatttacctaataaattggttaaagtgattgttcctgatagatctatattcaaaactacaaatgctgaaagaactttggttgaacctaaaggtatgcaagatgaaattgataaattagttgcccaatatccaaatggaagatcttttgtaagagcttctggtactgaagatgctgtcagagtttatgctgaagctgatacgcaaaataacgttgaagaattatctaaagcagtatctgaattagttaaatag

SEQ ID NO: 3066 - DNA, 1005 bp, Candida albicans
actatgtcaattgaacaaacattatcacaatatttaccatcacatccaaaaccacaaggtgtgacatttacttatgggacagcaggattccgtatgaaagctgataaattagattatgtcacttttaccgttgggatcattgcttcattaagatcgaaatatttacaagggaaaaccgttggtgttatgattactgcttctcataatcccccggaagataatggggttaaagttgttgatccattaggtagtatgttggaaagttcatgggaaaaatatgctactgatttagccaatgcttctccttctccttctaacgattcagaaggggaaaaaaatctgttggtggaagttattaaaaatttggtttctgatttgaaaattgatttatctattcctgctaatgttgttattgctagggattcaagagaatctagtccagcattatcaatggcaactattgatggatttcaaagtgttcccaacactaaatatcaagattttggattatttactaccccagaattacattatgttactagaacattaaacgatcccgattttggtaaaccaactgaagatggttattattctaaattagcaaaatctttccaagaaatttataccatttgtgaatctaataatgaaaaaatcgatataactattgatgctgctaatggtgttggagcccccaaaattcaagaattattagaaaaatatttacataaagaaatcagttttaccgtggttaacggtgattataaacaaccaaatttattaaattttgattgtggagctgattatgtcaagactaatcaaaaattacctaaaaatgtcaaaccagtaaataataaattatatgcttcatttgatggcgatgcggatagattaatatgttattatcaaaacaatgataataaattcaaattattagatggtgataaattatcgacgttatttgcgttatttttacaacaattatttaaaccaattgaaccccactaa

SEQ ID NO: 3067 - DNA, 639 bp, Candida albicans
aaacggttggcacataaaactttagccttttggttaatggataaagaaatgtataccaatatgtcagtattatccccattaacaccaattattgatagaggtattgcccttcataaattaatccgtttagtcacttttgcccttggtggtgatggatatctcaattttgaaggtaatgaatttggtcatcctgaatggttggatttccctcgtcaaggtaatggagaatcttatcattatgctcgtcgtcaattcaatttaattaatgatgatcttcttcgttataaatatttatatcaatttgataaaaaaatgttacaactagaaatcaccaatactggggaatatgtttctttaaaacatgaatgtgataaagttttagtatttgaaaaaggtaaatcagtttatattttcaatttcaatccaactcaatcatttgttgattatagaattggggttgaattaccagggacttataaattagtattggattctgattcagaagatttaggtggtcatggaagactcgatcataatactaaatatttcacttttaatgaaccttggaataatagaagtaattcccttttagtttatattccaactagaactgccattgtcttagaaaaagttgagtag

SEQ ID NO: 3068 - DNA, 525 bp, Candida albicans
ttgattgataccgctcatggaatgggaattcaagtattattagatgtggtccattctcatagttcgaaaaatgtcgacgatggattaaatatgtttaatggtactgatcattatttatttcatggtggtagtagaggcaatcatgatttatgggattctcgattatttaattatacaaactatgaaactttaagatttttattatctaatttgaaatattatattgatgttttccaatttgatggctttagatttgatggggttactagtatgctttataaacatcatggattatctgttgggttcagtggtggatatcatgaatattttggtgatggagtcgataatgaagctatagtttatcttatgttagctcatcaattaatgaatgaaatttccaccacccaaaatttcaatttgacttcaattgcggaagacgtttccgggatgcctacattatgtcgtccaatatctgatggaggaattggtttcaattatagattatcaatggcaatccctgatatg

SEQ ID NO: 3069 - DNA, 780 bp, Candida albicans
tccattgaacttttgtcacaaattatcatgttgaaacaattatactttttcttagtgtgtttattgtggacaactgtcaatgcatcacgatttgatgttgaacatgcattggtgttatatgatccagaattgcttcgatcaaatgacactagttctttgactccaaaagttgcccaattcatagagtatctgtcagataagtttgacatgaaaatcagtgattacaacagcgaagatatgaatttgttttttgatgactaccctcgttacgagcatctagtattgtttccatcatccaagaaaactattacatctacagaggcattgagtctgcacagtttattgcgattcattaatgaaaatagtaacatttttgtcgtcggtggatcacaaaatgttttacctgatggattaaaaggattcttagatgatcttggtgtcttcccatcgccaaagaattacaagtacattgatcatttcaacagcaaaaatggtgtcgtccaattgaatcgtgacaatgttgtcgacggaaatagattagttcaagaattgtctgtaaccaaatacgatggtaatgctgctttgatttcgaacaacgaattaatcttccccatcgttagaagttcacccccaggatacaccaacaaagttggtgaaccgattgatgctgaacaagcatggaactttggtgagcaaagttatttggcagttgggttccaacctttgattaatgccacattaattggggttgggtccaattccttgttgggagaccctccc

SEQ ID NO: 3070 - DNA, 729 bp, Candida albicans
gttaaaagaataattcaagaacaacaaaaattagttaccaaagtaaattcagctgctaatggacaactgaaattggaattgaaattgaaattgaaattgaaattaactgaaaatgaaaaaatggtactggaattggtagaagattatgttactttaggaaaacgtgtttatccatggatatcacaacgatttccattttatgaacgttggaatggtgattcatactattatccacccaattatgaagagatttttaaagataagaacgaaccccttaaaagtgaacgttcaacagttcgagatctgacatcatcaccactgatttttttgaatcaatttaaagatgcttctaatgggaaaggtatagttttatcaatcactgaaaaacatattgatgacacaattaatcttattcgattgttaagagctttgaataacaaattaccgatccaaattatttattttaatgatatttcacaaagttcaaaaacaaagataataaaagcagctagagaagaaatcaacaatttccccaaatcatatgaaaaagtataccatggtaaacaacctagtgtcccaccatcaccaccaccaccacaagaagtttggtttgtcaatatttatgaatcaataaatccgcaacataggaatttatttgcaaaatttgattttaaattattagcttcacttttcaattcatttgttccacaacgccgtagaagatccatg

SEQ ID NO: 3071 - DNA, 1479 bp, Candida albicans
atatatccttggttatcgtttgaataccctgtatatgaacgatggacggggaaagtacaatatcaacctccgaaaatggccaattatgttaaagatggaaatcaaaaaactaccaaaaagactaaatataataatgacaagtatttatcatcatttctcttgaatcgattaaaacaaaaatgtaatggtcgaggacttgttttatcaattagtgatcttcatgttgatgtcacagttcgattaattcatttattacgagctttaaataatagatatcctatacaaattgtttattatgataatttatcaaaagaaactaaagaaaaaatcgttactgctgctagagaagtaatgtctcatgtacctaaatcatttgaaagagttgccaaatatttccctgatgattatctagataatgatcaaggtggattacctaaacaagaaatatggtttattaatacttataatgttattcatgccgattataaattacaatttagaggatttgccaataaatttttagcaaccttatttaattcatttgatgaatttatattacttgatgctgatacggtattaactcaatcaccaagttattttttcaatttacctcaatatctagaaacagggacttttttctataaagatcgtaccacgtatgaaactcgtcctaaatcagattcaatattttttgaaaaattaggaccatcagtgatagattcagtaatgtttaatatccccattatgacatcatatactttaaatcgatcatttttcaaaggattatttcattatatggagtcaggattagtagttcttaatcgagatatgcattattcatcatttttaaccatggtgcaaatgaatttttttgaaccagtaaattcaagaattcatggtgataaagagattttttggttagcaatggctattaatgggaaacaaaattattattttgatgaaaattatgctgctcccgtcggggtcatgactcccgatatagaacgtactaaacctgataaaactttacatgaatcaaaagaattatgttcaccacatcctggtcatattagtcatgatgataattcattagtgtggttaaattccgggtttttctattgtggacaaaatgataaagttaaatttgttgaagaatttaaacataaatctcgattgaaacatcttaatactttagaagcatttaaaacattttattattctccattaagaattgaaaatgccattattccaccaatggatttagacatttgggcggcaaataatgaagatgaacctgctaaaggttggtttggagatccaagatattgtagtggttatatgtggtgtgcttatgataaaattggtggtaaaactaaatcaggtaaaaatactcgtcttgaagggaaaatcataaattttgatgaacaagctcaagatttatttaattattatggtgatgtatgggtaggaatggaataa

SEQ ID NO: 3072 - DNA, 1065 bp, Candida albicans
atgcctataattccattcataaaaattatcgtgggaaattttcccgattcggtaataaattattggctattttgttcaattcttttattgagtctatgttggattgacgttgatactgttttaatgcgccctccagaatatttcttccaattgaaaaattatcaaacaactggaacttattttttcaaagatcgatcagttttgcaaagaagaacagtggaggatggtaagttttttgaacgaatgggtccatcaacagtcgaccaaatgatgtttgatattcccataatgacaaattatactaccacaagagaattatttagaggattgcaacattatatggagtcggggttggtgatgatcaataaagataaacatttgaattcaatcttaatgatcacacaaattaatcttataggacccattacagggaaagtttggggtgataaagagttattctggttaggatttgccattaatggtgatgaagaatattattttgatgacaattttgcagccgcaattggtgagttgactccgccacaagaccgagcccgcaaagatgggacatggcatcattcaaaagaaatttgttcaccgcacccaggacatgtcagtggagatgacaatcatagtttattatggataaattcagggttccgtttctgtcatcaagcagatgaagttaatttcgaaaaagaggcgaaaaagaaaactcggttaaaacatttacacacagcagaccagtttagaactttttattataatccattaagaataactcatgctgttgtaccaccattagatcaagatttgcaagatcgtaaaaatgctatggatgaaccaactagcggatggttatgggagtcgggttattgcaaaagatatatgtggtgtgcttactcaagtgttggtgggccacaaaagcgtcctgatgaaaaggatgacacagtagataacaatgaaactaaagataacacgttagatggtatattggtggaatataatcaagatgaaatagccttgtttaattatttgggtgacatttgggtaggcacggagtaa

SEQ ID NO: 3073 - DNA, 654 bp, Candida albicans
aagcaaactctttataactttacattcgttatgtcttcagaaaaattatttagaatccaatgtggataccaaaactacgattggggtaaaattggttcatcatcagcagttgcccaatttgttcacaattctgacccatcaatcaccatagatgaaaccaaaccatacgctgaattatggatgggtactcatccttcagttccttccaaggccattgatttaaacaatcaaactttacgtgatttggtcactgctaaaccacaagaatacttgggtgaatctatcattaccaaatttggttcatccaaggaattaccatttcttttcaaagtgttatctattgaaaaagttttatctattcaagctcaccctgacaagaaattaggtgcacaattacatgctgctgaccctaagaattatccagacgacaatcataaaccagaaatggccattgttgttacagattttgaagggttttgtgggtttaaaactttggaacaattggctaaaattttggctactgttcctgaattgaatgaaattattggtcaagaattagttgacgaatttatcagtggtattaaactaccagcagaagttggaagtcaagatgatgttaacaatcagaaaattgttgcaaaaagtgtttggtaa

SEQ ID NO: 3074 - DNA, 630 bp, Candida albicans
ttgacgaatttatcagtggtattaaactaccagcagaagttggaagtcaagatgatgttaacaatcagaaaattgttgcaaaaagtgtttggtaaattaatgaacactgatgatgacgttataaaacaacaaacagctaaattacttgaaagaacagacagagaacctcaagtgttcaaggatattgattctagattaccggagttaatacaaagattaaacaaacaatttcctaatgacatcggattattttgtggatgtctcttattgaaccacgttggtttgaacaaaggggaagcaatgttcttacaagccaaagatcctcatgcttatattagtggtgatataattgaatgcatggctgcttctgataatgttgttagagctgggttcactccaaaattcaaagatgtgaaaaatcttgtggaaatgttgacttattcatatgaatcagttgaaaaacaaaaaatgccattacaagagttcccaagatcaaaaggtgatgctgtcaagtcagtgttatatgatcccccaatcgctgaattctctgttttacaaaccattttcgataaatccaaaggtggtaaacgacattttcaccacgtagtgacaaacccgccattaagatat

SEQ ID NO: 3075 - DNA, 1812 bp, Candida albicans
agaataaaacaatttacccaaatcatgacattagctaaacattggaaatacggtaaagacgaagacattgtggttacccaattgagagggttagtagcttctaatccttatgtgaatttaatcccaagtgaaaaagttgtatttaaccctcattcggatacttccaaaaaaattaccattatcagtggtggtggtgctggacatgaacctatgcatggaggatttgttggagagaatttattagatgctgcagttagtggatcggtttttgctagtccttcaacaaaacaaatcatggcagccattaaaaccaaatctaataaagaaaaaggtaccattattgtaattaaaaactatactggagatattttacattttggtttagttgcagaaagagctaaaagtgaaggttataaagttgaattagtgattgtgagtgatgatgttgctgttggaagagaacaaaataagatggtggggagaagaggattggctgggacagcttttattcataaaatcttgggttctgctagtgctactagtccagatgttgatttgaaatcattgagtgatttaggtcatgccatcaataagaatttagtaactttgggagcaagtttggatcgtacttcagttccggggaaattggaagaagaaattgaattcacaggaaatgatgaaatggaattgggattgggtattcataatgaacctggtactaaaattaaaccaattcctaatatcgatgaattgatccaaaaaatgtatcatcaattattatctccagaagataaagaccgccattatgttgattttgatttcgaaaatgatgaatatgtgttattgattaataatattggtgggacttcatcatttgaattatatgccattgctgaacacgcattagctaatttgcctttgaaaaggaaaccaaagagagtttatgtcagtgatttcgtcacatctttcaattcaccaggattttcaataacattgttgaacttgtcaaatttgaagaaagaagatatttcattcactagtgaagatgtgttgaagtttttggatactccaactaatgccccaggttggaagccaaaaatctataattcagaaatttggaatctgcaaaataaagaaattgaatcacctatgaaaaatgaaactttaacatcttcagatcttaaaattgacggccaaaaatttgaatcacaattggttaatgccttgaaagttttattggatgaagaaccaaaaatcacccgttatgatactgttgttggtgatggagattgtggtcaaactttagctgatggagcaaactccattttgaaagcattaaaagaagatgatgattttaaatcaaatttaaatgatccagtttatactcttgggaaaatcacagaatatgttgaagatagtatgggtgggacttctggaggtctttattctattttcttaactgctttagtgaaacagttgaagcaaaccaaagaaatcagtgtacaatccgttggtgatgccttataccatgctttgtacgatgggttgttcaagtataccagagcaagagttggtggaagaactttgattgatacattgcaaccatttgtggatgccttacataaaactggcgatttaactaaagcagttgaagcagctaataaaggttgtgaagaaactaagaatttacatgcttcatttggtagagcaagttatgttaatgaggaagaatttaaagcagaaggtggtatcccagatccaggtgctgttggtgtattggcattaatcaaagggtttacagagaagttatga

SEQ ID NO: 3076 - DNA, 369 bp, Candida albicans
  unsure (39): Identity of nucleotide sequences at the above locations are unknown.
ttaatgtttcaccaattggtagaaatgcttctactcaangaaagaaatgattatgaaaaatttgataaacaacatcatattagagaaaccatggttgaagctttgaaaaaagaattccctgattttggtttaacttattcaattggtggtcaaatctcttttgatgttttcccaactggttgggataaaacttattgtttacaacacgttgaagatgaacattttgaaaacattcatttctttggtgataaatcttataaaggtggtaatgattacgaaatttataatgatccaagaactattggtcacgctgttaactcacctgatgacactattagaatcttgaatgaaacttttaaattacaatag

SEQ ID NO: 3077 - DNA, 450 bp, Candida albicans
accatgtcttttgcaaacaaacaagatccaaaaactttagttttattcgatgttgacggtactttaactccagctagattaactatttctgaagaaatgaaaaaaactttagaaaaattacgtgaaaaagttgttattggatttgttggtggttctgatttatctaaacaagttgaacaattaggtccaaatgttttaaatgattttgattattgctttagtgaaaatggtttgacagcttataaattaggtaaagaattagcttctcaatcatttattaattggattggtaatgaaaaatataataaattggtaaaatttattttaagatatttatctgatattgatcttccaattagaagaggtacttttattgaatttagaaatggtatgattaatgtttcaccaattgtcttcaccacgggtctggacgggcccgcgcttgagtaa

SEQ ID NO: 3078 - DNA, 546 bp, Candida albicans
ataaattgccccgcggttgacagtgtatatcttcgaggaatggcaacctttgcccccctctcgaaaaacaatataaatagagtcaatttctctagtagaggtaaattctttgaatcttgttttttttcgacaaacaccataaatcccatagaaaactgcaaaatgtctgacgccggaagaaaaaacatttctactaaaatcaacgaagctataacccccgaatccgaaaagtctaccttggaaaagggcaaggaacaagtcaccagtacccttgacaaagctgttggctcaaatgttccagataaccaaaaatctttcactcaaactgttgcagacaacgtgcaacaaggttccgataatgctaaagctgatttgaagaaacaatccgaacaagcagagggcgaagcaaagacccttgctgaaacagctcaagaatatgtcgaggttgccaaaactgaaattggaaaggctgctgaatacgtgagtggagttgtcaccggtgctaccgaaggtgccaaaaccggcgctgatagtactaaaaaatag

SEQ ID NO: 3079 - DNA, 1998 bp, Candida albicans
tttagaagaacaatggctagagatattgataatcatttattatttgaggttgctactgaggtagctcataaagttggaggtatttactccgttttaaaatcaaaagccccagtcactgtagctgaatatcgtgaacgttacactttattgggtccattacattatgactcagcacaaattgaagttgaagaattgccagttaccgaccctcatatcaaacaaacccttgattctatgtcttccaaaggtattagatggctttatggtagatggttgattgaaggtgcaccaagagtattattgtttgacatttggtctgccggccattatttgaatgaatggaaagctgatttgtggaatgttgctggtatccctacccctgatcatgacctggaaaccaatgatgctattttgttgggttatttggttgcttggtttttgggtgaattggtttataacgaccgtgatcgtgctgttatttgtcaatgtcatgaatggttagcaggtattgccttgccattatgtagaaaaagaagaattgacgttaccactattttcactacccatgcaacattattgggaagatacttgtgtgctggtagtaccgatttctacaacaatttggacaagtttgatgttgatgctgaagctggtaaaagaggtatttatcaccgttactgtatcgaaagatctgctacgcattcagctgatgtgttcactacagtttctgatattactgcctatgaagccgaacatttgttgaaaagaaaaccagatggtgttttacctaatgggttgaatgttgtcaagttccaagcagttcatgaattccaaaatttgcatgctatcaaaaaggccaagatcaatgaatttgtcaaaggacatttctatgggaactatgattttgatttagacaataccttatatttcttcatcgccgggagatacgagtttagaaataaagggtgtgatttctttattgaatcgttagcaagattgaatcataaattgaaagaggcaggttccaaaaccacagttgtggctttcattattatgccgggaaaaactcaatcctacactgttgagactttgaaaggtcaggctgttgttaaacaattagaatcaactattggtgaagtgcaaaagaaagttggtgaaagattatttgagtattgtgctagataccctaatactgatcatcacggaaacgatgaagttccaactattgatgagttgattaaaccagccgatagagttttgttgaaaagacgtatatttgcattgaagagagatggtttgccaccaattgtcactcacaacatggttgatgacagtactgatccagtcttgaatcatattagaagagttcaattatttaacaaaccagaagatagagttaagattattttccatccagagttcttgaatgctaacaaccctattttgtcattagattatgatgaatttgttagagggtgtcatttgggtgtgttcccatcctactacgaaccttggggttacactcctgccgagtgtaccgttatgggtataccttctattaccaccaatttgtctggatttgggtgttacatgaatgatttggttgaaaacccaactgattacggtatttatattgttgacagaagaatgaaatctgtcgatgagtctatcaatcaattgactgattacatgtttgatttctgtgcgaaatccagaagacaaagaatcaaccaaagaaatagaactgaaagattgagtgtgcttttggattggagatcagttcattccgaatattctaaggctcgtttgttggcacttaaaagagcttatcctgattatgttggtgagaaggtagttgaatccaagatgaaaatcactcgaccaatgtcagttccaggttctccaagaagtttgttactcacgccaggtgatcttggctcattacaagacgctaaccaagacattagttattttgaattgggtgaagaagaaacttaa

SEQ ID NO: 3080 - DNA, 768 bp, Candida albicans
aataatgagtttatgtggattgatgccgatacaatcttgatgaaatcaccagaatttttcttcaatcatcaatcatatcaacaaactggagcattttttttcaaagatcggtcaccattacttaaacgtccaataaccgatggagaatttcttatcaaaatgggaccatcatcaatcgattcaattatgtttgatatcccaatgatgacacaatatacaacccatagagagttgtttaaagggttacgtctatatatggaatcaggattagttatgatagataaacaacgacgacgtcatttcaattcaattttaatgatgaatcaacttaaattcattcatccaatttccaattcaatgtggggggataaagaattgttttggttaggatttgccatcaatggtgatgaaaattataaatttaataatcattttgctgcagcaattggtcaattaacttcaaatcaatataataaagacagaataaccccattaaaatctaaagaaatatgttcttcacatccgggtcatataagtgatgaagatgatcgaagtttattatggtttaattcaggatttaggttttgtcatgaagcaaacaatattgattatcaagaagagactaaaaataatgtaatattgaaatttcttaatggtcgtcatccattggaatttaagaaatattattctgatcctttacgaattactcatgcaattgtaccacctttgaataagaattttcaaaaaatgtataattatgatgaataa

SEQ ID NO: 3081 - DNA, 234 bp, Candida albicans
tcactgctccacaagaaagaattccgatctttaacacattcatttgaaaaagttgcccatttatttggtgataagtatatcaattcccaatgtaaaggaatgcaaccacaaaaaatttggtttgtgaatgcctataattccattcataaaaattatcgtgggaaattttcccgattcggtaataaattattggctattttgttcaattcttttattgagtctatgttggattga

SEQ ID NO: 3082 - DNA, 618 bp, Candida albicans
gaaaccattatttctttagctggggtgaataaatacagtagtatttcttctgatgatagtgataataattttattaaattttcatcgactgtcaattggcatgaaacttataaatttttaaaagtacaattcccaacaactattactacggcattacaagccaattatgaaacccaatttggtattactaatcgttcaactcattggaataccacttgggatattgctaaatttgaagttgctcatcataaatttatggatttaagtgaattcaattatggagtttcaattttgaataattctaaatatggtggagcaattcatggtaatttaattagattatcattattaagaagtgctaaagcacctgataataaagctgatatggggattcataaatttgaatatgccatttatcctcataaaggtccattaggtattaatactgttaaagctggttacaattttaattataaattgattcaaaatccatattcaaaacaaacggttgcaagttcatatttatcatcagctattaaattgaaaaacgagaatcataaagatgggtcgttaatattatctcatattaaaagaggtgagaacgatatgtcttcacct

SEQ ID NO: 3083 - DNA, 1704 bp, Candida albicans
ctagctagtactatttctatcatgggttacgataacatcaatcttcaacccaatttcaaaccaattgatcatctttatgatgatagattaagacaattcactgacactgggggtcaatttcataatttgaatttaccgaaattttatgatattcatcgtcaagagattcatgatttgaaatcatggaaagtacctgatgatagtaatggtaaaactcaacgaccattatttaaagatattaattttgatgaaataacttgggataatattggtcttggatataattttggaccttcatggaaaactttttgggttaaatttactttgaaaatccctgaagagtggttaaaatatgaagcattagaaattgactgggatctgaattcagaagcattaatttataatgataaaggtttacctttacaagcattcactggtggtggtcaacgtaatttatttcgaatccctaaagaatatttaactagtgatgaacaattgttttatattgaagttgcttgtaatggaatgtttggtaatggtgctgatggtgaacctgatcctaatcgttatttccgattgagtcgtgctcatttagtggttcctaatttagaagccagaagattattttgggatttttggattcttggtgatgccactagagaattccctggaggatattggcaaaaatatcaagcagcagatatttgtacccaaattatgaatacatttaatcctaatgatgttgagtcaattggtaaatgtcgtaaattggctgaacaattattgggggacaaaatcaattctgatgaagtattccatgaatatcctaatgaacggaataaaagaattgatgtttatggtattggtaattgtcatatcgataccgcatgggaatggccatttgctgaaacgaaaagaaaaattgttcgatcatggactactcaattgaaacttgctgatgaatatccagaatatgtatttgttgcctcacaaatgcaacaattcaaatggttaaaacaatatcatccggaaatcttgtcgaaaatccatgaaaaatttgctactaatcaatttattcctcttggtggtacttgggttgaaaatgatactaatttacctaatggagaatcattacttagacaatttgttttgggacaaagatttttattagacgaatttggatttcaatctgacattttttggttacccgatacatttggttatagttcacaaatccctcagatttgtcaattggctgggatatatcgatttttaacccaaaaattatcttggaataatattaatactttccccttgagtacttttaattggaaagggattgatggttcacaattgttggttcatatgcctccagcgaatacttatactgctgcagccaatttcggtgatgttgttcgatcactgcgacaacataaaaatcttcgtgatgtccctgctggtatgttactttatggacatggtgatggtggtggtgggcccacagaagaaatgattgaaaaattaagaagatgtcgtgggttagataataattctggattaattccgtcagttcaattgggtgtcaccgttgatgatttatatgaacatttattagaaaaatctgatcaaggaaggaaactaccaacatggagtggagaaatttatcttgcatatcatcgttgtacttatactactcaagccaac

SEQ ID NO: 3084 - DNA, 714 bp, Candida albicans
  unsure (547): Identity of nucleotide sequences at the above locations are unknown.
agactacccggtgcagaaattcaaagtttatgggaggatctttgtttatgtcaatttcatgatgttttacctggtagttgtattgggatggtttattatgatgaagcatatcctatgttgcgtaaattattgaaacaagctgataaacttattttggaagcattgaaagttgatgttaatagtaatactacttctggtggcggtgttgttaatactttgccttggaatagatataatgaaattgttgaagtttctcgtaaacaatcaccggaattgtttgaacaattgatcaaagataaagttggtatccgtaccccaaaatcatctcaatacaaacatgatgatgatgatgatgatgaaactgttaaagtttcggttgattctgttgatggagtttgtaaaattaacaaaaaagttgactatccagccagtgtttccaagattaggggaagtaatggtaacgatgatgatgataatgatggtggatttattttgactaacaagttattaacggccaagatttcatctaatggggttatcacttctntatttgatgaagttaatcaacgagaaattattgatacaactgccaccaatcaaacaagtaacggtaaaaattctactaatgtgggtggcaatcaatttaatttatttgatgatgaaacattaaatttccctgcttgggatactgaattatattcattacaaaaattc

SEQ ID NO: 3085 - DNA, 1338 bp, Candida albicans
gatcaagaatactctgtccatcccatcccacctcaatccgtacttcctgaaatgtcaaagcgacaagaaaacaagaagattgcatttattcatcctgatcttggaattggaggagcagaaagattagttgtcgatgcagctgttggattacaagattttggtcatgatattattatttatacatcacattgtgatttaacacattgttttgaagaagtcagttctggtcaattgaaagtttctgttcatggagattcattacctaccaatttatttggcaaacttcatattttttttgcaatattaagacagttttatttagtttgttggttaatattcactggcacaattaaaaattatgattattttattgttgatcaattatcattctgcatcccattattgaaaatgttttgtaattccaattgtcaagtattattttattgtcatttccctgatcaattactagttagaagaacaagctttttaaagaaattatatagagtaccctttgatgcaattgaagaatataccacggggtcaagtgatcagattgttgttaactcaaatttcactaaacaaattttccatgacacttttaagaaattaaaccatattgatcctcaagtggtttatccatgtgttgatactgaaactattgtcgatacaaatgcatcatctaattcagaagtatcaaaatttttcaaagactcgccattttttttatcaattaatcgatttgaaagatccaaaaatattgaattagcaattaaatcatttgctagaatgaataagttaatggttaccaataagaaaccaagattggtgattgctggtggatatgatagccgagtagctgaaaatgttgaatatcttgcagaattgtcaacgttatgtgatgaattgaatttgattaactttaccatcagaggtaaattgattatgatgccaccatctgttgatgtattgttcttaccatcaatttcaactcaacttaaaaactcattaatccaacagacagaattattgctttacactccaccaagagaacatttcggaatagtaccacttgaggcaatgttagccaaaactccagttttagcaattaattttggtggtccgttagagacagttgttaattataatggtaataatctcgatgaagcaactggttatactgaaacaggcgattttacaaaatggtcaaaaattatcatgaaacattataatttggatgaaagtactaaaattaaattgggtgaaaatggtcgtaatagagttattaataaattttcaaggaagaaacttgctcaaagtttagacaacattttgaattga

SEQ ID NO: 3086 - DNA, 264 bp, Candida albicans
caatgtaatttactcattgaacaattgtattcacaagtccctgatgttgttaaagcttatagaatcatgccgaaatcgattttaaaagcagatttgttccgattcttgatcctatttgctcgtggtggggtatatactgatgtcgatactgtcggattaaaaccagttgatgaatggatgtcaaattcagaaatgattttagaaaagacaaatcgatctggacttgtgtttggtattgatgccgatccagatcgtccagattgg

SEQ ID NO: 3087 - DNA, 495 bp, Candida albicans
tacttttgtttccattttcttttccaattattgggaataaatatttcaaaaagcaatttccgcaaccccatgctacaactaagagaaccccaaatggttcataaacatctaaaactagccgttttaggaatagtagtcatattcacaacatatttcataatctcgtctctaagtagtccaacatcaacccataaaacagaatataattctcccaaattacaacttgcaaaagaattggaattgaattccaactggaaagaattaggattgaacttccaaccaaataagaaatatagtttaccagatgaatcaacacttcgacaacaactttcatatcagttcccgtatgatgaaagcaaaccttttcctaaaaatatttggcaaacttggaaagtcggtattgatgaaaagtcattccctaaaagatatttgaaataccaacaaacttgggaagataaaaatcctgattataaacactacgttgtccccgattaa

SEQ ID NO: 3088 - DNA, 1995 bp, Candida albicans
  unsure (91),(106): Identity of nucleotide sequences at the above locations are unknown.
ttggaaagtgaacaaaaagtcattgaagaaaatggtgacgagaccacgagtagaactggatttttgaaattggagaatccaaaaaatgttntaggatatgaggganatgtcaaatttgcaggtgtttcagaagaattgggtgcatttgaattggaaattaacgatggccccaaaactaatgtccatccagctggaagaaccgatgttgatcctgaattagatcctagaaaggcacatcattatagtttgactgttccagatgataatgtttggagggcaagagacattttcatgacaatgttgcaagaatcaattcaaaaacttgttgaaaaatttggaggtgttgaagctatcccaccagaaaatttgttcattcttagggacttacaagattttgaaggaaatttacattttgttcaaaaagtgtatcaagggtcatgtgaatttgatgttgtatataacaatgcattaacaccgatcacagaaagaatcacttttgataatttgaaatttagaatacaaaattctttaaaggcatttgatgaaaagtttaataaccatttcgaattggcgcctccattcaattccaaaaaatacaaaaagtttggtaaagaagtattgtctgggttgttagggggactttcctatttttatggtgatcagctagttgatagggaaactgtatttgatgaagattcgtttgagagttacaaattggaaggtacttttgaaggcccatacgagttgtttaccttggttccttcaagaccattttttccacgagggtttctttgggatgaagggttccatttattgccattgttgaattatgactctgatttagttttagaaataaccaaatcttggtttaatttgatagatgaagatggttggattgcccgtgaacaaatcttgggtaaagaactgagatcaagagtaccagctgaatttgttgtacaaagtccacaaattgtaaatcctccaacattgacattagttctcacgtatctacttgattctgtggttggaaattatgataccattaatgagccaaaaaatgtcgatgaatcattatcaagagaaaacttgggcggctttgtgttgaaaaaccccgaagtgttaacaaattataccaaacaagtgtatcctaaattgaaatcacatcttgatatgtttcgtcgaactcaaaaaggttatgttgaagaatttgacagaggaacaaaccccgaagcatatagatggagaggtagaaccttaacccattgtcttgctagtgggttggacgattatcctcgagcattacctgcagatgtagctgaattgaatgttgatttgatatcatggattggtattatgacaagatctatccgtttaatggcagagattttgaatattgatgaggatgtagaaacctataagaacctagaaaacgatatcattgataacattgaaaagttacattggtcaccagaagataaaacttattgtgatgtttcagttaatgatgatgatgagaatatttttgtttgtttcaaaggatatatttcattattcccatttttaaccaagttgatcccggaagctaatactgataaattagaacacattataaatttaatttccaacccagaagaattatggacgccttatggtattagatctttatcaaaagctgacgaattttataagacaggtgaagattattggagatctccaatatggataccaataaattatttgattttggatagtattcaagattattatattggtagcaaacatcatatgtcaactgatttacaagagaaatttgctaaaacttatcatgatttgaggataaatattgttaaaaatgtatttgatcaagctgataaaactgggtttgtatgggaacaatataatgacgaaacaggggaagctcaaagagctaaaaactttttgggctggtcatctttggtcttgataatgatgacaatgcctgaacatttgcaatga

SEQ ID NO: 3089 - DNA, 867 bp, Candida albicans
  unsure (25): Identity of nucleotide sequences at the above locations are unknown.
cttcatgatcgcgcccgtcgtggtngaaaacgatatttgtcaagagttttggttttactgacatttacattttaccttttctactttgttttacattgtacttgggtaacatcgaatgcttattcatcaccatcagttgttttagcatccagaaacccagatggctcacaacatatcattgatgattatagagaagcctattactggttaagaatgaatacaccagaagatgccaaagttatggcctggtgggattatggttatcaaatcgggggtatggctgatagaaccacacttgttgataacaatacatggaataacacacatattgccactgttggtaaggcaatgtcttcccctgaagatgtgtcgtatgaaattttgagacaacacgatgttgattatgtgttagttatatttggagggttattgggttattctggtgatgatattaacaaattcttatggatggtaagaattgctgaaggtatctggcctgatgaaatcaaagaaagagactactttactgaccgaggagaatataaagtggataaagatgcatcactggcaatgaagaattctttgatgtataagttatcgtatcatagattcactgaattgtttggaggtagagatggtgttgatagagttagaaaccaacaaatcccagccaatgaagtaccgaaattgaatgttgttgaagaagccttcacatcagaaaattggattgtgagaatttacaaagttaaagatttggataatgttggtagagatttacatcaagctactgcttttgaagaatcatcatccggcacttccaaaagaaacagatccataaagagacctaaattggaagtaagagagtaa

SEQ ID NO: 3090 - DNA, 594 bp, Candida albicans
caggaacaatattcagcaatggcttctaccatatcatctaaacctcaattgaaagtattggggatagatgttgaactgattagagttttattaaaagttattatatttatatcgatagcaggtgcagctatttcttctcgtttattttccgtgattcgatttgaaagtattattcatgaattcgatccttggttcaatttccgagcaaccaaatatttagtcactcattccttttatgaatttttgaattggtttgatgatagaacttggtacccattgggaagagtcactggtggtactttatatcccggtttaatggtgacttcaggtgccatttggcatattttacgtgattggtttgccttacccgttgatattataaatatttgtgttttattagcaccagttttctcgggattaactgcaatttgtacttattttttgactaaagaaatgaacgattctagtgcacgattattggcagctatatttatggggattgccccaggttatatttcaagatcagtggctggttcttatgataatgaagcaattgccattactttattaatggcaacattttatttctggatt

SEQ ID NO: 3091 - DNA, 1233 bp, Candida albicans
  unsure (1091): Identity of nucleotide sequences at the above locations are unknown.
aaagggagccaaagtactgtattagattatatgggaacccaattctctggtgatggtaaatctgataaccaaaaccattcattgatatttagcagaggagaatatattcaactagttgatgctaacctagataattatttggaagaatgccttaaaattagaagcattttggcagaatttgaggaagcaactttccccttggatccttactggactgatttggaaggcacagagctggtttatcctgttgctataattgggacaagagaatatattttttctgaaaatattggaattttgggagatgtagttgctgggaaagaacaaacttttggtactttatatgccagaactttggcccatattggaggtaaattgcattatggccatccagattttttaaatggaatctttatgacaactagaggcggtgtttccaaggcacaaaaaggtttgcatttgaatgaagatatttatgccggtatgaatgttgttttgagaggcggccgtatcaaacattgcgaatacatgcaatgtggaaagggaagggatttaggatttggctcaatattgaatttcactacaaagataggagcagggatgggtgagcaaatgctttcaagagagtatttctatatgggtacacaacttccattggataggttcttgtcattttactatgcacattcagggtttcatttgaataatttgtttattatgctttctattcatttatttttgcttgttggtgctaatcttgcagctttaactagcgaaagcaccatttgtgaatatgacagattcagacccataactgatcccaaacggccacatggatgttacaatttgattcctgttgtccattggttgcagagatgtatattttctattttcattgtgtttgttatttcttttgttccattggctgttcaagaattaactgaaagaggattttataaagctatcacaaggttgggtaaacagtttgcatcgttttctccgttgtttgaagtgtttgtttgtaaaatctatgcccattcgttgtccagtgatatttcaattggtggagccaggtatcttgccacaggtanggggtttgcaactataaaagtctcatttgccacattgtattctaaatttgcggttgagagtttgtattatggatccatttgcggattattgatatcttactgttccctatcaatgtggaagtcgcaactattgtatttctgg

SEQ ID NO: 3092 - DNA, 807 bp, Candida albicans
ggggagcgtagtccttctagccgcgtggtgaacacaatgttaggattatgttgtaaaaagactggtgctgttattgctggtgttgcccatggtgttgccgtcattgttcatattattttctttattgttatgtgggtcactgaaggtttcaattttgccagattaatgttgggtattgccaccatgatttatgttcaaagattattattcaagtttttgacattatgtttcttgactagagaatttaagaatgataaagccaatactgctttctggactggtaaatggtataatactggtatgggatggatggcttttactcaaccatctcgtgaatttgttgctaaaatcattgaaatgtcggaatttgctggtgatttcgttttggcacatattattttattctgtcaattaccatttttgtttattccattagttgatagatggcattcaatgatgttattctggttgaaaccatcaagattaattagaccaccaatttattctttgaaacaagccagattaagaaagagaatggtgagaaaatattgtgttttatattttgccgtgtggatattatttattgtcattattgttgcaccagcggttgcttcgggacaaattcctgttgatcaatttgccaatattggtggatctggttctattgctgatggattattccaaccaagaaatgtcagtaataatgatactggtaatcatagaacaaaaacctacacttggagttatttgagtactcgttttactggaactaccaccccttattctacaaatccattcagagtttaa

SEQ ID NO: 3093 - DNA, 2424 bp, Candida albicans
tacgcaatcgcgggtccttccagccccgtggtgaaaacgaagttgttagattcaagaacatctagattggggccaacccacgctctcatatctattcatgctgattatattggtggcatgaattctaattttagaaaatggtattttgcagcccagttggatattgatgacttcgttggttttgacaatcttgccaaaaatgggaaaatcaaggggtcaaatgacccagttccaacattggagcaagctgaactgcaatggtctacaaatatgttagctttatctcctactgattcagttatacaattagccatatatcttttgatttggggtgaagccaacaatatcagatttatgcctgagtgtatttgttttatcttcaaatgctgtaatgatttttatttttccatcgatcctgacacaccagttacaactgttactccaagctttttagaccacataatcactcccctctacaacttttaccgagaccaatcgtacattcttgttgatgggaaataccgtcgtcgcgataaagatcacgagtctgtgattggttatgatgatatgaaccaattattctggtacagcaaaggtttggaaagacttgttttggcagacaagaaatctagattgatgagtcttccaccaggagaaaggtatgaggaattaaatcaagtattatggaatcgtgtcttttataaaacttttaaagaaaacagaggctggtctcatgtattggtaaactttcacagagtttggataattcacagtgctgtgttttggtactacacggcttttaactcgccaacattatacacaaagaattatcaaccggcgttagacaaccaacccacaacacaagcaagattgtcagtgttggcgtttggaggtgtggttgccattgttattgatattatcagtttattgttcgagttacggtttattccaagaaaatggactggagctcaacctgttagtaaaagattagctttgttgattttggcgttgattttgaacgtgggcccaagtgtctacttgtttatgtttatcccattaaatgttcagaacacagtgggtctagttatttctgctttccagttttcattttctgtcattatggttttatatttgtctacagtaccattggggaggcttttttccaaaaaacctaaagctaacgatagaaggtttttgccccagcgtctgtttgtgactaatttctattcattagccgaaggtgatagagttgcatcttatggtttatggtttgctatatttgtatcaaaattcattgagtcatatttctttttgactctatcattgagagacccagttcgtgaattgagtataatgaaaatgagtagatgtgccggtgaggtatggttaggcaactggttttgtactagacaaccaacaattgttttagggttaatttatcttactgatttggtattatttatattagacacctacttgtggtacattgtatggaatactgtgttttcagtttgtcgctcattttacattggcgtctcaatttggactccatggcgaaatatattttcaaggttacccaagagaatattttctaaaataatttcggtttctggagacaaaaatataaaatcaaagttacttgtgtcgcaagtatggaattctatcattatttccatgtatcgtgaacacttgatatctttggaacatgttcaaaaacttatctataaacaaatcgataaccccggagttgaaggggattctgttttgaaagaaccaatcttttttgtttcacaagaggatcaaacgataaagtcatcattatttcaagatcaagcagaagcacagcgaaggattactttttttgctcagtctctatcaacacctatgcctgaagtgggtccagtacatttaatgccgtcgtttacagttttaattcctcattacagcgaaaagataacattatcgttacgggagataatccgagaggaggaacaatattctcatgttacgatgctagagtatttaaagctgttacatccattggaatggagctgttttgtaaaagatacaaagttattagcggaagaatttgagactgattcgtcttctgctgaaattaaaagagagaaacttgatgatttaccgtactattccgtcggattcaaggttgccacaccggaatacattcttcgaactcgaatctgggcatcacttcgctcccaaacactttatagaaccatttctggtttcatgaattactctcgtgctatcaagttgttgtttgacgtcgagaatccagacctgactaaatttggcacggagaacgacaagttagaacaagaagcaataatggcctatcgtaaagtgagcctaatcacgtcgtgtttttcaccacggcgtggaaggagccgcaattgcgttaca

SEQ ID NO: 3094 - DNA, 681 bp, Candida albicans
ccggctcgttcgaatatgatttatcaacgaggagctgatgaaaacactatacgaccaccactattttttgtttacgaagatgataacaaattttatgattttattaaaatcgaaaaggaatgggaaagaaggatcacattttttgctcaatcgttatcaagccccttaccagaaccatttccagtagtttctacaccaacatttaccgttttgattcctcattactcagaaaaaatactattaagtttacaagatttaattaaagaacaaagcttttcaaaactaacgttgctagattatttgaaacaacttcattcgaaagaatgggattcatttgttcaagatagtaagatgatccaaactataaaggaaatggatgaagacaagtttgtacgcgaaaatatggatgatttgccatactactgtatcgggttcaaagattcttcaccagaaaatgtcttacgaacaagaatttgggctgcattaagatgtcagacattgtatcgtacagtttcagggtttatgaattacgtgactgctttaaagttgctttaccgaacggaagtaattggttttgaacaaaacgaatttcccgaagaagaacttgaagaatttgtaagcagaaaattcaatttacctaattgctatgcagaatttccagaaattttgccccaaacatga

SEQ ID NO: 3095 - DNA, 465 bp, Candida albicans
agactgaaagaagggtcatggaaagcgttccaaagatttgttagacattttatttccatgtcaccatttttcgaagttttcgttgcccaaatttattcatcatcggttttcactgatttgaccgttggtggtgctacatatatttccactggtacaggttttgccacttcaacaattccattttcaatcttgtattcacgtattgctgattcatccatttatatgggagcaagattgatgttgattttattatttggtacagtttctcattggcaagcaccattattatggttctgggcttcattatcggctttaatgttctccccattcattttcaatcctcatcaatttgcttgggaagactttttccttgattacagagatttcattagatggttatctagaggtaacactaaatggcacagaaactcatggattggttatgttagactttctagatcacgt

SEQ ID NO: 3096 - DNA, 1059 bp, Candida albicans
  unsure (133),(136): Identity of nucleotide sequences at the above locations are unknown.
ttttttaaacttccaaatcaatcttctgggcctccaccaatagatcgtagtatatataagtcacatcacgtcattgttatacccatttctccccatcctaatattaatatcctcattcgtatacctttcagtnttntaaaaagaagttttatttcaacaatgcaattcaaattcttgactactctcgcaactgttcttacttcagttgccgccatgggtgatttggctttcaaccttggtgttaaaaatgatgacggtacttgtaaagacgtcagtacttttgaaggtgatttagatttcttgaaaagtcattcgaaaatcattaaaacttatgctgtttccgattgtaacactttacaaaaccttggtccagctgctgaagctgaaggattccaaatccaattaggtatctggccaaatgacgatgctcactttgaagctgaaaaggaagctttgcaaaattatttgccaaagatttccgtctccaccatcaagattttcttggttggttctgaagctttatacagagaagatttgactgcttctgagttagcttccaagattaatgaaatcaaggatttagttaaaggcattaaagacaaaaacggtaaatcctactcaagtgtcccagttggtactgttgattcttggaatgtcttagttgatggtgccagtaaaccagccatcgatgctgcagatgttgtctactccaactccttctcatactggcaaaaaaacagtcaagctaatgcttcatactctcttttcgatgatgttatgcaagctttgcaaactcttcaaactgctaaaggttccactgatattgaattctgggttggtgaaactggttggccaactgatggtagttcatatggtgattccgttccttctgttgaaaatgctgctgatcaatggcaaaaatgtttctgtgctcttagagcttggggtattaatgttgctgtctatgaagcttttcatgaagcctggaatccagatacttccggtactagctccgttgaaaaaccttgggggtgtttgggccttccgaccaaaacttga

SEQ ID NO: 3097 - DNA, 954 bp, Candida albicans
cctctcgaacatattcataaaccaaattcaattgaagggcttagtgaggagttgcgacaagatagtgaggtggtttcattgatgagtattgttactaacgctttattttttggagttgcgtattctccgagcaatgcgttggaaccgcagtgtgggtttacaagaagagacgcaatgttagatttggataggttatatactattaccacgaaaattagaaattatggtatgcactgtgatcaaagtgaattcattttggatgcaattgaatatatgaatctaaatatgactttagcaatgggggtttggattggatctaatgatactgtaaacgaagaacaaatgaatacaatgaaaagaattgttgccaagtacccaaacccactggaattaatcaattcgatacatattggtaatgaagtgttatttcgagaagataagacaagagatgaattaatcgagtatattcaagacgccaaaacatttttgcaatcaaaagggattgatgatatccccgtaggaacatctgaaattggttctttggtagatctgcctcttttgcaagtttgtgatattgttggtgccaacattcatccttttttcgctggagttccagtggaatttgcaaccatttggtctttagaatttcttaatttccaagttcaaccatacaatgaatataatacaaaaatcgtactttcagaaattggttggccaagtggtggtggcacatttggttcctcggttgccagtttatctaatctggaatattttgctaatgattttttgtgtacatttcgagatttaccaattgagtattattattttgaagcatttgatgaaccatggaaagaaattttttgggaaggtaatagaagatgggaaactcaatggggggtattccaagacgatagactgccaaaatttgctttacaaaatataggatgtgtgtaa

SEQ ID NO: 3098 - DNA, 1029 bp, Candida albicans
gtcacatcaacttcattcttatacccacttcttcccatccttatatttaatatcttcattcgttttcccttcagttttttaaaaagaagttctatttcaacaatgcaaatcaaattcttgactactctcgcaactgttcttacttcagttgccgccatgggtgatttggctttcaaccttggtgttaaaaatgatgacggtacttgtaaagacgtcagtacttttgaaggtgatttagatttcttgaaaagtcattcgaaaatcattaaaacttatgctgtttccgattgtaacactttacaaaaccttggtccagctgctgaagctgaaggattccaaatccaattaggtatctggccaaatgatgatgctcattttgaagctgaaaaggaagctttgcaaaactatttgccaaagatttccgtctccaccataaagattttcttggttggttctgaagctttatacagagaagatttgactgcttctgaattagcttccaagattaatgacatcaaggatttagttaaaggcattaaagacaaaaacggtaaatcctactcaagtgtcccagttggtactgttgattcttggaatgtcttagttgatggtgccagtaaaccagccatcgatgctgcagatgttgtctactccaactccttctcatactggcaaaaaaacagtcaagctaatgcttcatactctcttttcgatgatgttatgcaagctttgcaaactcttcaaactgctaaaggttccactgatattgaattctgggttggtgaaactggttggccaactgatggtacttcatatggtgattccgttccttctgttgaaaatgctgctgatcaatggcaaaaaggtatctgtgctcttaaagcttggggtattaatgttgctgtctatgaagcttttgatgaagcctggaaaccagatacttccggtactagctccgttgaaaaacattggggtgtttggcaatccgacaaaactttgaaatactcaattgactgtaaattcaactaa

SEQ ID NO: 3099 - DNA, 1533 bp, Candida albicans
caagcgctgatctccacccgtggtgaagacatgcaaaatttaattgatggatgtcatgaaagaagaatgaaaattatttgtgatttagtagttaatcatacatcatctgaacatgaatggtttaaacaatcaagatcactgaaatcaaaccctaaaagagattggtatatttggaaaccaccgagaattgacgcaaaaactggtgaaaaattaccaccaaataattgggggtcatttttttcaggatcagcatgggaatatgatgaattaaccgatgaatattatttaagattatttgccaagggacaacctgatttaaattgggaaaatgaagaatgtcgtcaagcaatttataattctgccatgaaatcatggtttgataaaggtgttgatggatttagaattgatgttgctggattatattctaaagatcaatcatttaaagatgcccccattgtattcccagatcaaatttatcaaccgtcaggtgaattaatttctaatggaccaagaattcatgaatttcatcaagaaatgtatcgtcaagtgacttcgaaatatgatgttatgacagttggagaaattggtcattgtgatagaaatgaggcattaaaatatgttagtgctcaaagaaaagaattaaatatgatgtttttatttgatttagttgaagttggatcaaataatcaagatagatttagatataatggatggaatttaattgatttcaaaaaggcaattcaaaatcaaagtgattttataaagggaacagatgcttggtcgactgttttcattgaaaatcatgatcaaccaagatgtatttctcgatttggaaatactaaatcattagatttaattaataaaactgggaaattattggccatgttacaagctagtttaaccgggacattatttatttatcaaggtcaagaaattggtatgactaatttaccaagatcttggtcaattgatgaatataaagatataaacaccattaattattataaagatttcaaagaaaaatatggtaatgaacctgattttaaacaacgtgaagaaaaattattagatgtgattaatttagtagctagagatcatgctcgttcaccagttcaatggaatgatgatgatactgaatcttatggtggattctctacgcataaaccatggacaagaattaatgataattataaacaaattaatgttgctaatgaattaaaagatccaaattcaatcttgaaattttatcaactggtattgaaattaaggaaagaatataaagatttatttatttatggatcatttgatattttagatttcaataatgaaaaattattcacttatgttaaaagccataaagaaggtaatgaattaccaaaagcttatgtgacccttaatttttcagatgaactgattccatttaaaccattgattgaaggtgaatttaaattgatgactactaatgttccacaatctgattatgatgaatcagttttatctccatatgaaggtagaatttatatcgtcgattag

SEQ ID NO: 3100 - DNA, 1284 bp, Candida albicans
  unsure (1017): Identity of nucleotide sequences at the above locations are unknown.
cccttatatacttatttatctgctgccaaattaagatggttgttggataatgatgatgttattagagaagaatatgaaaaaggtgatggcaatttaatgtttggtactgttgatacttggttgatttatcatttgaccaaagaaaaggcatttgtttcagatatcaccaatgcctctcgtacttatttcatggatttagaaactttagattatgatgatgacttgttagacttttgggggattgatcctacaaaaatcagaatgccgaaaattgtatcttcttcagaattttatggggaatttgccgcaccaaaattggacaatttggggttccataataaaatcactaaagaagcttatgatattttgaaaacaatcactggggtgccaatctgtggttgtcttggtgatcaatctgcttcacttgttggtcaattggcattcagtgctggttctgccaaatgtacttatggtactggtgctttccttttatataacactggacctcataaattgattagtaaacgtggagcattgaccacttttggattttggttcccaactttaaagggtactgatggtaaacctcattatgccatggaagggtctattgctgttgctgggtcgattattcaatggttgagagataacttgaaaatgattgataatgccaaagatataggtccattagcttcacaagtggaaaattctggtggagtggtgtttatcccagcattttctggtctttatgccccatattgggatggtggttctagaggtactattttcggtatgacacaatacacatcggctgcacacattgctcatgctgcattggaaggggtttgttatcaagtaagagctattttgaaagcaatggctagtgatgctggtgctgtagatgatttcttggaggacgcattatcatgtcaaaacaccgataaattattatctacattagctactgatggtggtatgtctaaagctgatgaagttttacaaattcaagcggatatnttgggtccttgtgttactgtgaaacgtgcacaaactgctgaatgtactgcattgggtgctgctattgccgctgggttatcattcaagaatgaagaagatcgtatttggaaagatttggatgatgtagtggccaaaattagtggttcaagtgaagatgtggctgctaattcttttactgccaaattatcagatgaaaatagaagaaaagcttggaaacgttgggaaaaagctgtagatagagccaaaggttggttagaagacgaatag

SEQ ID NO: 3101 - DNA, 234 bp, Candida albicans
agttcaaggccattgttattgccaaacatgagagaaaccactattgtttggtctagaaaaaatgggaaacttttgagtggaggtattactgggaccgatagtagaatttcagaaattattcaacatttggaaaaaatgatagatgaagatagaaaagctgaatttaaagagaaaaatggtttaacccttatatacttatttatctgctgccaaattaagatggttgttggataa

SEQ ID NO: 3102 - DNA, 780 bp, Candida albicans
cgtgccttttctgttaaagacagagcttccactagttcctcaattaacaaatatcaaatgacagaaatcgtcactattaacacaagcgtccttttattcgatcttgacggtacattggtcgattccactgctgctgttgaaaagacttgggaaaaccaagtgaatcaacacaatcaagagtttccagacaaatttattgatttacctacattgttgaatgtctcccatggatcacgtactgttgaaacatttgctgcttatttcccggaattaaaaactgacagagattctgtgtatgcatgggaaatgggtattgtgcaaaattatggacatttgggtaaagcaatcaatggttcagtacaaactttaatcacattgaatgaaaaaaatattccatgggctattgttacatcagccaaccctaaattaactgggttttggttggacaagttgtttcatggtgtcaaaaaacccgatgtttttataactgcaagtgatgtaagtaaaggcaaaccagaccctgaaggatattgtacagcatttgaaagattgaaaaaagtttataatttgaatggttctgctaagggagttgtatttgaggatgcacctgctggtattaaagctggtgttaatggtggtttcacagttgtgggcatagctagcacttttccaaaagaagtcttgttacaagccggcgccacttatgttgttgaagattttaccaaagttaaaatcgagcaatcaggggaagcagttaaactagttttagaaattctttag

SEQ ID NO: 3103 - DNA, 777 bp, Candida albicans
gataaaatgagattattcgtcctactagtatatattattccatttatattatgtcagttaactccagtgttggttgcttctcataagttagttcgaggtttgaaagaagaaatcaatccttcaaacactctgcctcataatgttacttcggtgacaaatatgcttaagaagctaataactgaatgttcttcagatgcatatttacttatcaatcaaccagggttaacatatgctgatttgactacggaaaagaaagataattggccatttttaaggaattacttgtatatgtcatcaacaattgttggattgcctagagtggaaaaccctatagatttagattttcttgaacaatacattatcagtaattgtgatgcagagactatcaatgtttggcatgatagtgaagatgaagtagttgattattatgatattcggaaacgagtgattcgaattgatttatcaccattatcaattagcaatcatgatgatcgagtcaaagaaatatttgaacatgatcaattgattagaaaaattttgaggaaattaccatctcctcattatacaattattttaactagtttggaacccgggattgttcatccagtgccacggtttttaatggaagaaaccccagcttcgtttgaaattttcgatgatattattaatgatccatttcataatcgagaaattgaaaaaaatgatcgatttcacaaagtagaaccaaattggaatccaataagagatagtaatgatagatactaccgaaattggtag

SEQ ID NO: 3104 - DNA, 1233 bp, Candida albicans
tttttttttaatacgagcctaccaccaccaactaatttttttttagtcgattttgcgcaattttctttttcgccctcgcaccacccctccccctccctctccctccacaccttcataatgttaataaagagcaattacaattgtataaatatcaaacgatttctccttaatcaaacaagagtttcagttactgcttctaattctttttctttttatttttattttaaaccttataaattcaattgttataaatcatattctacaatgtctactactacacctactattaaattaaattctggttatgaaatgccaattgttggatttggttgttggaaagtcaccaatgccacagctgctgatcaaatttataatgccattaaaactggttatagattatttgatggagctgaagattatggtaatgaaaaagaggttggtgaaggaatcaatcgtgccatcaaagacggattagttaaacgtgaagaattatctattgtttctaaattatggaataattatcattcaccagaaaatgttgaaaaagcattaaataaaactttaacagatttaaatttagattatttggatttatttttaattcatttcccaattgcatttaaatttgtccccttggaagaaaaatatccaccaggattttattgtggtgatggtgataaattccattatgaaaatgttccattattagatacttggaaagcattagaaaaattggttaatttagggaaaattaaatcaattgggatttctaattttaatggaggattaatttatgatttaattagaggggccactataaaaccagctgttttacaaattgaacatcatccttatttacaacaaccaagattaattgaatttgttcaaaatcaagggattgccattactgcttattcatcatttggtcctcaatcatttttagaattgcaatctaaaagagctttagatactccaactttatttgaacatgaaactattaaatcaattgctgataaacatggtaaatcaccagctcaagtattattaagatgggctacacaaagaaatattgccgttattcctaaatcaaataatcctgatagattagctcaaaatttggctgttgttgattttgatttgactgaaaaaaatttacaagctatttctaaattagatattgggttaagatttaatgatccatgggattgggataaaattccaatctttgtctaa

SEQ ID NO: 3105 - DNA, 453 bp, Candida albicans
aaactgaacgaagctgctaaggattacggctggaaattgaacaatgctggtattgccttgatgtggagaggtggttgtattatcagatcagttttcttggctgaaattactgctgcttacagaaagaaaccatacttggaaaacttgttgctttacccattctttaacgacgctatcactaaagctcaatctggatggagagcttctgttggtaaggctattcaatatggtattccaactctagctttctctactgctttggctttctacgatggtttaagatctgaaagattaccaactaacttgttacaagctccaagagattactttggtgctcatactttcaaggtcttgccaggtcaagaaaatgaattgttgaagaaagatgaatggattcacattaactggactggtacacgtggtgatgtttcttcaactacttacgatgcttaa

SEQ ID NO: 3106 - DNA, 777 bp, Candida albicans
  unsure (275),(452),(766): Identity of nucleotide sequences at the above locations are unknown.
tcaattaaagagacccaggaggaattttgctttttgtcaaagctgttgctccagttgatgaattcattaaaccaattattgccatacttggaagaaggtgatatcatcattgacggtggtaactcccatttcccagattctaacagaagatacgaagaattggccaagaaaggtattttgtttgttggttccggtgtttctggtggtgaagaaggtgctagaactggtccatctttgatgccaggtggtaacgaaaaagcttggccacacattanagacatcttccaagatgttgccgccaagagtgatggtgaaccatgttgtgactgggttggtgatgccggtgctggtcattacgtcaagatggtccacaatggtattgaatatggtgatatgcaattgatttgtgaagcttacgatcttatgaagagagttgataaaaaagaagaccnagaaattggtgacgtgtttgccacatggaacaaaggtgttttggattctttcttgattgaaatcaccagagacattttatactacaatgacccaactgacggtaaaccattggttgaaaaaatcttggatactgctggtcaaaaaggtactggtaaatggactgctgtcaatgcccttgatttgggtatcccagttactttgattggtgaagctgtcttttctagatgtctttctgccatgaaagctgaaagagttgaggcctggcaagccctgaaaggtccacaagttactggtgaatctacaataactgtcnaaatacaatga

SEQ ID NO: 3107 - DNA, 2532 bp, Candida albicans
tctatgtttttggggctatttcataattacatattcttggtaatactaagtctaaaaataatccccataaatgcatattctccatataattcatcattcacatctgaacatatacgatatttacaaaatgaaacacaagcattatttgatcattcatggaaatcatatatgaaatatggtttcccatttgatgaaataaccccaatcagttgtgaacctttaggacctgattttgatgactatgaaaataccgttagaaatgatgctagagggaatatatcactgatggtattagataatatcgatacattaataatatttgaacgatgggatgaattagaatatattttgaaatatcttctggataataaacaagattttttcaatcaagacactgtggtacaagtgtttgaaacttgtattcgtcatttaggtggattattatcggctcatttattattaaccgacattaccaataaaccaatcacattatcaacgaaatatcaaccattacgtgaaatttcaaacaaatataatgggtttttattagacatggctcatgatttaggattaagattaattccttcttatcaaacatcaacgacaaatatcccattaccaagaattaatttagcttatggtttgaagaaagtcccacccaaattacaacgtgatgcatgtacttcaggggtaatgactccagttttagaattcactctattatcaagattaactggagatcgacaatttgaatattattcacaattatcattttggaaactttggtcactgaaactggcattaaatctattacctatgacaattgatcctattgctaatcaatggaaagatagtattaccgggataggtgctagtattgattcattttatgaatatgctgctaaactggcaattttatttaatgatgattatatgtggacagttttcaaaacttcatatcgagcattattgagtcatctggctcaaggtggtaaaggtacgatgattttccctaatgtggggatttatgatggggttgttttcagtccttggatagatctgttaggagcattttggtcaggattacaagttttaactgggcaattacaagacgccataaagactcatgtggtttatttaaaaatatgggattttttcgatctgattccagaaagatggatatataaccatcagcaccatcatcaaggtaataagaaagttaaacgtaataagaaaaaattcaaagcagaagattccattgatttggaatggtaccctttgagaccagaatttattgaatcaacttattatttatatcgtgccactaaagatccaatgtatttacaaataggggaaagagtattaaatttattaggtgatagatataaagcaccttgtggattaagtggattacaagatgttagaactgcagaaagacaagatcgaatggaatcatttgttgttggtgaaactttgaaatatttatatttattatttgatactaaagatgaaattttcttacacaattccactataatgcaaaataaaaattggattttctccactgaagcacatccattatggttaaataaaaaaatcgatcttattggtgattctttaacacaatcatcaaatgaaatatcatcggtaataatgggtgaaaaaccttatcataaaaatagtttaaaacccaataaagatttactcaaaataccaaattcagcgtttataagaaatattacattacctcaaccagaattggttgatattgaaggtataacggaggatgtatcccatattgccaaaaaactgccctttgcgggtcgatttgatacatgtcaattaaatccttggaataaatctgttgattcatttcttgaatcaagttattataaatggccctatttgtttaatgctgattatgcatttgaaaattcatttagaaaaccaagatatttgagtcaaactaatttagatggcagttatattgaattaacaaaagaattttacaataaatttactatgttcaatggagccaacttgatttgtcctcgtacttcaactacagcagtttatgaagtgttttggggagatatcaaacaatgcgaatacattgaagtttcagaaatttatcataccaagttttctaatgaatcgttaatggcaccgggtgatatttggataccgtctttgaacggattacgcgttgtattggaagaattggtacctgggaaagtagatacatttaataatgttgttactgaagaacagcttcttgcattacaggatagtaataataatgaagactataataacaataacgacgattacaggattagattagtaaattctggtttaagaattaaacgagtcaatggtgttgttattggtgaaggggtaactttatggacgctaccatttgaaccactggaacaatcgaatgaagaagacgggatgataggaataactgaagatgctagagtagttatacaaggtaaagtagttgaaaatttatttgtttggtatggatag

SEQ ID NO: 3108 - DNA, 621 bp, Candida albicans
agaagaatccaagatattcttaatgaaatgcaaaaataccttgttttcccaattgacagaaatgatgttttatctgcttggtcaggcattagaccattagttagagatccatctactattcctaagggccaagaagcttctggtaaaaccgaaggtttggtacgttcacatttgttagttcaatcaccaactggattggtcactatttccggtggtaaatggactacttacagagaaatggcccaagaaactattgattacgttgttaaacactttgattttggtgataaaaagatcctaccatgtcaaaccaacaaattgattttggtcgggggtactgattattcaaagaactattctgctagattgattcatgaataccacatcccattgaaattggctaaacacttgtctcacaactatggttccagagctccattgattttggatttgtatgctgaaagtgattacaataaattgccagttactttagctgctactgaagaattcgaaccttctgaaaagaaagctaatgaagacaatcaattgagttatcaaagatttgttcttcacccacgggagatggacggatccgcgcttgattctatcgccccccccgcc

SEQ ID NO: 3109 - DNA, 303 bp, Candida albicans
cacttttcaacaatgtcaactgcaagtattccttcaaacccaattcttatcgttggtggtggattagctggtctttctgctgctcatcaggcatatttacgtggtgctaatgttgttttattagataaagaaagttttcttagtggtaatagtgggaaagctacttcaggtatcaatggtgccttgacgagaactcaagttaatttgaaaatccctgattcggttgaacaaatttatcaagatacattagctagtgctaaaaaatcggctcatccaaaaattaaccaaagttttaacttataa

SEQ ID NO: 3110 - DNA, 390 bp, Candida albicans
ttccagtttacaactggtggcaagtcccttatttctttgctggttgtaaaatgtatgattggtttgctggtaaacaaaatttgcgttcctccactattttcctccactgaacaagctgctgccattgctcctatgatggataccagtaacttgaaagctacttgtgtttaccacgatggtagtttcaacgataccagatacaatgttactttagctttgactgccattgaaaacggtgccactgtattgaactactttgaagtcgaacaattgttgaaagataccaatggtaaattgtatggtgttcacgctaattattgtgaacctatgaattcttccaaattaaagctaaaagtgttgttaatgccactgggtccattggctgaataa

SEQ ID NO: 3111 - DNA, 597 bp, Candida albicans
aactatacaatgtcaagatttttaagatcaactttagcaaagtcagtattggcagctagtgctgctgttggtggtacagttgtttatttggattttattagaccaaaaaacgaacctcaccttgctacttcctataaaccattcaacaaagatattccaccaccaccatctcgtgaatcattgattggtaacttgaaaaaagtgccacaatttgatgttttggtcattggtgggggtgccgttggtaccggtactgccgttgatgcagctacacgtggtttaaatgtttgtcttttggaaaaaaccgattttggtgctggtacttcttcaaaatccaccaaaatggcccatggtggtgttcgttatttggaaaaagccattttccaattgtctagagctcagttggatttggtcattgaagctttgaatgaaagaggtaacatgttgagaactgccccacatttgtgtactgttttgccaattatgattccagtttacaactggtggcaagtcccttatttctttgctggttgtaaaatgtatgattggtttgctggtaaacaaaatttgcgttcctccactattttcctccactga

SEQ ID NO: 3112 - DNA, 2313 bp, Candida albicans
aaaatgcttagagcttttagaagtgctgtacctcgtacacagcttttaaaatcacgcttaactattccaaaaacttctgttattggcagacgttatcttgctaccgattcatttttgcaaggatccaattccaactatgtcgatgaaatgtacgaagcttggagacaagatccttcaagtgtccacgcttcatggaatgcctacttcaagaacattgaaaatgataacatcccaccatccaaggctttccaagccccaccaactattgtcccaactgtttcaggaggtgctgctggattttatccgggtcaaagcccaatctccgaagacgttgttacccatttgaaggtgcaattgttggttcgtgcttaccaagttagaggtcaccagaaagctaaaattgatccattgggaatctcttttggtgacaacactactgttccaaaagaattgactttagactactatggtttcactgaacaagatttggctaaagaaatcactttgggtcctggtattttgccaagattcgctcaaggtggtaagaagagtatgactttgaaagaaatcatcaacttttgtgaaaaaacttactgctcctcctatggtgttgagtacgtacacattccatcaaaggaacaatgtgactggttaagagacagaattgaagttcctcaaccatttaaatattctccagatcaaaaaagacaaattttggatcgtttgatttgggccacctcttttgaatccttcttgtcaagtaagttcccaaatgacaagagatttggtttggaaggtgcagaagccgttgtcccaggtatgaaagctttaattgatacctctgttgaatacggtgttgaagacgttgttatcggtatgccacatagaggtagattgaatatgttgtttaatgttgttcgtaaaccaaacggatctatcttttccgaattcactggttctaaagaatttgatgaaggttctggtgatgtgaagtaccatttgggtatgaattatgctagaccaacaacttctggtacacacgtcaacttatctattgttgctaatccatcccatttggaagccgaagatggtgttgttttgggtaaaactcgtgcaattcaacaatacaaacaagacattggttctttcaaaaaagcaatggctgtccttaaacatggtgatgctgcatttgccggacaaggggttgtttatgaaactatgggttttgctaacttgccagcctattctactggtggtactattcatgtcattgtgaataatcaaattggttttaccactgatccaagatttgctagatcaaccttgtatccatctgacattgccaaagccattgatgctccaattttccatgttaatgctgacgatgtggaagcttgtacttttgtttttaacttggctgctgaatggagagccacttaccacaccgactgtatcattgatgtcgttggttacagaaagcacggtcataatgaaactgatcaaccatctttcactcaaccactcatgtaccaagaaattgctaaaaagaactctgtcattgacatttacgaaaaacaattaattgacgaaggtacttttactgctgaagatatcaaagaacacaagcaatgggtttggaatattttagaagacaacttcaagaaagccaaggaatataaacctacctctagagaatggttgaccactccttgggaagatttcaagtcaccaaaagaattggctactgaagtcttaccacacttaccaactgctgttgacgaagctactttgaaaaagattggtaatgccatttccgaaactccagaaggatttgaagttcacagaaacttgaaacgtattttgaatgctagaaagaagagtgttgaaaccggtgaaggtattgattatgctactggtgaagctcttgcttatggttctttggctctcgaaggataccatgttagagtgtcgggtcaagatgtcgaaagaggtaccttctctcaaagacatgctgttttgcacgatcaaaacagtgaatctgtgtggacaccattatccaacttgagtgaagatcaaggtgctttcaatatttccaactcttccttgtcagaatacggtgttttagggtttgaatatggttactccttgacctccccagatgctttggttgaatgggaagctcaatttggtgatttcgccaacactgcccaagttgtcattgatcaattcgtcgctggtgctgaatcgaaatggaaacaaagatctggtgttgtattgtcattgccacatggttacgatggtcaaggtccataa

SEQ ID NO: 3113 - DNA, 681 bp, Candida albicans
cattcctcatccagactcgaaagatacttacaattatgtaatgaagatcaacgtttcttcccatcaccagaaaaattagaacgtcaacatcaagactgtaacatgcaagttgcttacccaaccaccccagccaacgttttccatcttttacgtcgtcaaatgcatagacaatttagaaaaccattgattttggtcttctccaaatcgttattacgtcatccattggcaagatctaacttgtcggaattcaccggtgactcacacttccaatggatcattgaagatgttttgggtgacaaatcggaagtgaagagagttgttttattgactggtcaagtttatgctgctttgcacaaaaagagagcttccttggatgacaaatcaactgctttcattaagattgaacagttgcatccattcccatacgctcaattacgtgatgccttgaatgaatatccaaaccttgaagacttggtgtggactcaagaagaaccattgaacatgggtgcttacaactttgctgccccaagagtggaagctgttttgggtgaaactcaaaaatacaaggacttgaaattgagatatgctggtagagatccaagtgcttctgttgctgctggttctaaggccatgcatgttgctgaagaagaagaattcttagaagaaacctttcgtcaataa

SEQ ID NO: 3114 - DNA, 930 bp, Candida albicans
ccaaattcaactcaattcaattcaattcaattcttaatgtctcctaaatacgctttattcactggtgcttcttccggtattggatataatcttgccattgaattatcgaaaaaaggttataaagtcattggatgttccccacaactggttttatttggtcaaaaacctttggaacaagaatatggtgtcatatctctcccattagacgtcacagatattgataatatcaagactgttttgaaaaaagtcgaagaaataaccggaggaagattagatgtattatataataatgctggtatatctatttcaggtccagcaattgaaattgatgaaacacaattgaataaagttttccaagtcaatgtaattggtcaaattaatatgacaaaatattttgctcctttgattatcaatgctaaaggaactatccttttcacaagttctgttgcagctagagttcccttaagttgggttagtgcatataatgccaccaaagctgccattgatgcctatgccttgacgttgcatggggaaatggcaccatttggtgtaagggttcacagtgtaataaccggtggggtcgatactgctatctgtgatggtaatattaaaacatcattaggtgattcattctatgatgttgatggtgtttatgaatcaatcagaagttcagcaatgatgagtcgtgatttaaatatatcaccggaacaatatgctaaagaagttgtcagagatattgtctcttggcgtgatccgggatttaatttatatcatggagccagatcttatttcttgcattgggttagtcgtttcttgccattatggcttgttgaatttggtgttcaaatccatttcaaacaacgcagagtattacaaactattgccaaattgataaaagttaaaaaatcacaggaaaagaagtatgtataa

SEQ ID NO: 3115 - DNA, 978 bp, Candida albicans
agttacaaaccactaattatagaaaagcatatttttttttcttcagtttcttcttcaaataataataataatatatttgcaacaatgtctcaacagaaatatgcattgattactggtgcttcgtcgggtattggatatgctttggccaaagaattttctttacgtggatacaaagttattggatgttcccctaaactggttttgcatttgcaaaagccattagaggacgagtatggtttgatttccattgcttgtgacatcactaatttggaagatattaaaagagtcaaagagcttgttgtgaaagaaacaggtgggtatttagacgtattgtacaataatgccggtatcgctattggtcaacctgctattgagatccctgaagataagttgaattggatattccaagttaatgtcattggacatatcaacatgacaaagcattttgcgcctttggttatcaagtctaaagggtccattattttcacaagttcagttgctgcaagggttcctttgtcgtggatttctgcttacagcgcaaccaaagcagcaattgatgcgtatgccaagacattgcatggtgaaatggagccatttggagttaaagttcatagtgtgattaccggaggtgttcaaacacaaattggagcagaagacaataatatcgaagaaatgaaaaatcaatttgccgattcgccatacaatgtggatggaatagtagaaagtggtattgcttctcaaaaaatggcagcggatttgggtatccctccacagaagtatgcgaaaaatatggttggccaaataactaaaaagtccagcaagtttaacctttacggaggatcgaattcctatcttttgcatattcttggtctcttttatccattctggttggttgaatacattatgcaatttactttcaaacaattaaagccctttgctcttattagaaagaaatatgctggtaaaaagaatagataa

SEQ ID NO: 3116 - DNA, 909 bp, Candida albicans
ctctatcaattcagagagtatatattaagcatgtcagaacgtcaaaaggttgcattagttactggtgcttcatcaggtattggttatgccaccgcaattgagtttgctaaaagaggatacaaagtttttgctggggcaagaagattggaaccaatgcaaaaattgaaagacgactatggtgtgatcatcttcaagttagatgtcagtgacttggagagtgttaagaacgccaaaaaattcattgaatcagaaactggcgcagattatttggacttcttatacaacaatgctggtcaatcgtgtactttccctgccacagatgttactgatgcacaaatgaaacaatgttttgaagttaacgtctttggtgctattagaactgttcgtgaattggtcccattgataataaacgctcaaggtgtcattgggtttacagggtctgttagtggaataatcccattcccattttcttgtatatattctgcctccaaagcagccattcatcaatatgctgcaactttgagattagaaatgaaaccgtttggtgttaaagtcatcaacattgtgacaggtggtgtcaaaactgacattgaagataagagagatttaccagagtcttctatttacaatgtgccaggtatccaggaagctttcaatgaaagaagacagatggcagctcgaaacaaaccaatgccggcagaggtttatgccaaaaaagttgttactgattttgaaagtgctaacttgggtggtgctttgaacatttatcgtggcacaatgagtacatttttgagtttcgtattaacttttgttcctagatttatagtagaggcagctgtcttctccaagtttagttccaacagtgtctcctattcttcatgccggggcacgaaaatattagcttgggat

SEQ ID NO: 3117 - DNA, 378 bp, Candida albicans
aatatatatattagcccgtcttcttttttttattacttttcatctttaaccaaattcaactcaactcaattcaattcaattcaattcttaatgtctcctaaatacgctttagtcactggtgcttcttccggtattggatataatcttgccattgaattatcgaaaaaaggttataaagtcattggatgttccccacaactggttttatttggtcaaaaacctttggaacaagaatatggtgtcatatctctcccattagacgtcacagatattgataatatcaagactgttttgaaaaaagtcgaagaaataaccggaggaagattagatgtattatataataatgctggtatatctatttacaggtccagcaattag

SEQ ID NO: 3118 - DNA, 612 bp, Candida albicans
  unsure (57): Identity of nucleotide sequences at the above locations are unknown.
gatcgggatttggccccttggggaagatttggcaatttgaaggatttgatttatggngaagatatcaagggtattcattttttcactagtttggtccagttaaaaagtttaactatgggattaaaatttgcacaattttataatgattcatttgaatttagacttgatataatgaatctgattgaattattgactaaatatattgaattggaatcagggtttatcaataacgaagatagtgatggcgatgaagactacgaacaacagttgttatcaaaatcatatataatttcatccccgaaattgttctataccaaatcaagaagtggattagatattgcttcaattcttgctgtattgtacacccacaataataacaatgctaatgatgatgatgataacgatttcccatttgatgtagataatggattggtattaacaacattaagataccttattcaagacatgacattaagatatccaataaatttccaagataattttcaaggagtagcattaggtcgataccctgaagatatttatgatggatatggtatatcagaacgaaatccttggtttataagtactgcaactgcaagtgaattgatttat

SEQ ID NO: 3119 - DNA, 843 bp, Candida albicans
aaaaattgtaatcagattcacttcatcagatttcaactaatcaatatactcattcatacattaattactactactacaatgacaaagactcaacaaccagctgttttttacgttcacgccgctttatttgactgtgatggtactttggttaactccactggtgctatttctgaattctggagagatttcggaaaaactagacctcatgttgatccagaagaaattatcagaacttcccatggttgccgtacatttgatgtcattgccaaatggtcaccagaagatgcaattgaagaacaagtcactgcatgggaaggtgctattcctgacacttttggccaccacgccaagccaattccaggttccgttgaattggtaaaatcattcgataaactttctaaagaagctactgaaaatggtaaacaaagatgggctgttgtcacttctggtactttgccattagccaccaaatggttgaaattattgtctattgaaaggccagactgttttataaccgctgaaaaagtgactaaaggtaaaccacatccacaaggttaccaagctgctagagatactttgggataccatgacgcccactacaaagttgttgtgtttgaagacgctccagctggtataaccgcaggtaaaggtgctggcgccatggttgtcggtatttgctcaacttacgatcctgaaaaagttagaaaatcaggtgctaacattgttgtcaaagatttatccagctttagaatcgactcatacaacaaggaaactgacgaattcaaggttgttgttgatgattatttctacgctgatgagcaatttttacaagaatctgcttaa

SEQ ID NO: 3120 - DNA, 684 bp, Candida albicans
cgcggattccgccagcctccgtggttgaagacagcatttgttgatctttcaccaactaccactaatcaagttaagggttccatttctgatagttcaataatcacattaagttcaatatttacatcatttgaagaatttattattttaaatcaacatattattccattaattgaattaacaaaatttttcaataatgaaagatataaattacatggaacatatttttttaaatcacctagtaaattaaaatatcgtacaactaaatttaatattggatttcatgaaattgcttcatttataaaaaatcaattaattcccaataaatttgataaacattatttcaatctataccaaaagggatcagaaaatggtgatgaggtaactattgatagatttttcaattatcaatttaataatttaattgattcatcattaataattttcaataaatcgaaaacattaagtggattattgattagtgggaattttgaatttttatatcatgatgatttattcaacattagaatcaataatacaccaacgaaaaccaaaatggattatttatggttaggacaatatatatctggtataaatgaacaaattatatttaatttcaattatgcaattatgccagggattttaactccatcacaaaatttacctaaagatctgattgaatgttaa

SEQ ID NO: 3121 - DNA, 405 bp, Candida albicans
agtgatgaaggttatcatacattactttggttcaattcgggatttcaattttgtaatcaattggagaaagtgaattatgaagatgagttttctcacaaagaaagatattctcagtttgacacgatcgataaatttaaaacgttttggcaaagttctttggttattgaaagtgcaattatcccaccggaaaacacaaatagtaatggaggggatggctacgaaccttctgtttcttggaaacatatggaaccatattgtgcagggtatacgtggtgtgcatacagttcaataggaaatggagatcaggccaatgatagagggttagtaattaattattcaccagaggaaatagaacattttaaaaagcttggggagatatggatgaggggatataattatttatag

SEQ ID NO: 3122 - DNA, 1170 bp, Candida albicans
tcctggcagctcccgtgtgaagacaacaaagttttagcaatgctttattcttcctttgaggaaatcattttatttgatgcagatgttgttcctacagtgaatccacaagaattttttgactccaaatattataaatcttctgggacttattttttccaggaccgatctttacgagattttaatgatttcatagagacaaatttctttagtacgttatttccaagtaacgaaaaatccattgaaacaatatttgatattcctagagttggtgagaaaactttcaataataagtatatgacaggatggagacattatcaggaagctggggttgttgcttataataagatgcaacatttcttaggaattttaatgatgttcccattagcactttggagtgaaccagtgcaatcctctatttggggtgataaagaaatgtattggttgggtttatcaatggctggagatgagaattatgaatttaataagtatgctgcagcttctgttggtgaaaaaaccactgaacaaaaatacaagtattatcccaattctgacagcaatgaagtgtgttcgacacatcctggtcatattgatgacaatgggaggttattgtggataaactcagggtttagttattgcaaaaagaatggatattttcgagataaaggaaaatttcctttttcaacttttgaactcaatgatttagtcgagctttataattcaccaataaaaattagagcaggacttgttccccctgatttacctaatcaaagagaaccaggaagcccccctgataccaaacctgaaatggaatttcgtaaatcctggaaatcacgtaaaaaggataccgacgaaatcaatgagaaattacccgagggtcaggaaccatatgactttattagtgaatggggacctcaaaaaggttgggtaaaaaatggaatttgttctggttattattactgtgcttatgataaaataactagttattcttcggagaaggagtttgatactgggacactttttgaatttgataccaaatcatgtgaattgtatgattatttgagtaaaatatggcacactggtggatccaaaatgaagccaaaagttaaattagaaactgagaaacttggaactggttcggataaagaacaacaaaagatgcaacaacagtaa

SEQ ID NO: 3123 - DNA, 576 bp, Candida albicans
atttggagttccaaattcaacgaattattgaacgtgaaattcaaaaaagctgttgcaaaagcaatgagtgcaatgttacctactattgcaccacattttactgtttcgtctccatcgagtgttgcttcagctaatggcactaccaacgaaacggtcgtcatccttcgtccagatttgacggacaatacggtcacttcagctccaagtaccgtcgcactgtccactagtcatcttgctaccaatatcatgagtcaaccacagtcatcaactttcactctttcagatgcacccgcatccaaattggttactattaggaagaggctccaagaccttgatcaaaaattagcaccaaaaagtgttaaattgaccgatatcgctcgaattcacaaacatttagcagtcattcatgatccaaattccaagattaaacaattatatgggaagtactacgatctcttatggtcaatctcagctagtgaacgctccaaggaggagaagaatgcacttaagcaattcgagatagggtctttaccttcgtacaggactattgactccagaattagtttccggatgtga

SEQ ID NO: 3124 - DNA, 1386 bp, Candida albicans
agaatatcttacacgtcgagtgttaaagttagcattagctctactatgtcatctgaaaatggaatgagtgctactcacacatttggcatttcaacaaatacaattccttcaagtactgaaacatctattaaatcggcaactgtcacaacaccagtttctgaatccacgaatactggaatgtcaatatttatgtcaacaactactgaatcaaaaacaactgacattaccactgaaacatctgtttctggggaggtgaacttgggatcagcaaccgttaaagtttcatcatcagaatttattagtaaaggaacggttactagaataatgcctactgaacttacaaattccgaatcaacatttactgcgtcaccatctttcgtgttgacaagtactgaatcaagcgttattgaaacaccagctacgatagaaatgagttccagatcatcatcttatagtgtgccattgtcaaaattacgaagtgaaggagaaactaccagagtaatacctactagctcaacagctactggatctactgtcattggatcaccatcatctgtatcgacaagtaatgaatcgataattactgggtcttcatcatttgtgtctacaactgctgaatcaattgctactaagactattgtcagtgaaacaccagttaccaaggttctcagttccaaatcattagctgctaatgcatcaccatcagaacctacaagcaaaaaagaaactgctgaaacaatttccactagatccatagttactgaatcaattgttgctggatccccatcattagtattgacaactaccgttttggacacaactgaaacaacaattacagaaacatcaattgtcggtgaactgagctccagatcattaactttcaaagcctcatcactaagcaaaggagaaattactggaactgtaacaccagaaatgtcagtttcaactagcaaagcaactactggcacgacttctgaagtatctattaaagagtcattaaccacaaaagttcctacttttacatcaacaacaattaaaccagagacttctgaaactcaacactctgaatcaagaactactcaaattccagattcagaaacaaagggttctcaattatctacagctaattcacaagtttctcaaactggaagctccaagtctctgatttttgaatccgcaatatcaaaagatgaaagttctttcgtttcacccactgtgaaatcaattaccaccccagctgtcgctcaatatcaaacttcattgccaaatcccgccagtttcagttttctgaagcatcaggcaagatactggtcatcccttgataacccaactggaaaattccgcaactccacattactatttactttgaaactattgaaacactga

SEQ ID NO: 3125 - DNA, 1665 bp, Candida albicans
cattctttaatacgcagacttagtgattcatgtaccgaagatcctcctattttgacatcaatacagtctagtcaaacgaaagacttccgatcaagtcccaacccgaaaccaaaccaaacattcatttccacaaacaaccagacatcaatttccaaacccacatacacttcaactgagcaaattacagatgtgattgttatagaaagtgacgaagaggaaactagcatagtgcagaaaattagtggaacttcaaaaatagtggcgtcaacgcggttaccatcgtctccagttagcattgcaaaccaagaaccagagaaaacaatgaatgattcaatagtggattctagtttttcgtttatgatggataatcttgtaacgacaatccgtaatggtggacctaaactatcatcatcaaagcctgtttctcagcctgtatcagctggatcgggattatcatctggcccaaaccctgtttctagtagttttaaaatgccaccgtttgtgaaatggctttctagtgacgacgacgacgatgatgaaaaagaagaagatccaattgtacctacatcacaaccggttccacatgaaacaaattttgatgctcaaccagcaaaaagatccagaactgtgcaagaaccacctcaactggcaccaaaaccagtaaagcgttctaaaactgttgatcaagtaatagatttgccgcgtattgataatttccagtatacatcaaaggatttaaaagaagctaacagagctacaagaaagaaagaagaacttttagcagaaatggaattacatatggcggagtctgtctattctagattggaagatttggtcaaagatttccaactgcgtgttataaaggcttcatatacgttaccagtgattttttggaaacgaaatataaatgcagcttatgataaagaaagagatatatttataccgtgccatcctagaagggttcttgaaaagacatttgttttgtattaccatgcatcagtattttttgaaaaactacgaaaccacactttgaaagttgatgtatctgcagcaaagcaacaagcattggcaataacaccaaatgaatataatgtaatacttgtggttgaagggtatgatatactcttgaacaaaatcaaagcatatgaacagagattatttaaaaatcaagttcttcaaggtttaaatgttgaagagcaaagaagacgaagaaaagatgatacggaaatgtctaaatacccgtcctcatcagagattgaacatttagtcaacaaggcccaaatagacttgaaggcaaacatttttatggtaagagcaaaacaagaatcgattatgtggctcaactcatttacacacatgattggtcaatcgctatatgacaaatttgaaagaaatcagggattggcaaatctcggaaatgttaaatcgggagcagataccaaatcaacttttttgcaatcaatgaaacaattcaatttgatgactcaagcaaaagcagatattttgtatgtactgcatcagtctctacatctgatgtacaccaagcttcgatctcatggaacgttgggcaaagataatttgaagagaaacattgtgccaccttcagtcgatagtagtatgaagaagtttttcactgctgatgatccagatatggtcattaattaa

SEQ ID NO: 3126 - DNA, 966 bp, Candida albicans
  unsure (957): Identity of nucleotide sequences at the above locations are unknown.
ttctttacaaacattgacaactctatttttctttctttactacagaaacctctaatgtcattttgggacaacaacaaggattcattcaagtcagctggtaaatcgactttcaagggtattactagtggtaccaaagctgtgggacaggcaggttacagaacctataaaaagaatgaagccaaaagaaagggtgttgaatatcatgacccgattaaaaatgaatcgaaaagcggagagacaaatgtcccttataacccaagtccattgccttcaaaagacaaattgagttcataccaacctccacctaaaagaaatgtgggcacttttggtgttccccaaaggggagaagcttctcactattctgctcctgcgcctacttcgggtcaaagtacatatcctgcaaatcaacaacaatatcaacatccgaatgaaattcaaaccagcagtggctatcaagaaccacctccggagtatctggtagattctaatagtgacatgcagggattttctgcgggaagtgagtatcagagaacagcacatccagctccggccagtactacttttacaccagctaatcaaactagttttattgcactgcctcagccaacttcaatagctacggacaatgcaattcagaatatacaacagcagtataatagtgtgctgaaacagccatcaccagcaccagggttaccaccattacagcaccaaccagggaacttggttaatccaccattgcccccacaagtgccccagaaaagtaatgttcctccatcacttccttcaagaacatcagttgccagtgtagcaagctccacatctcagcaaagtgttgggcaagggagttttgtgaatgcacaggaacaacccaaacctaagccagctttgcccgaccctggatcatttgcaccaccaccaagaagacgtgaccaacatattccccacgagggccgaagntccgcgtgc

SEQ ID NO: 3127 - DNA, 1800 bp, Candida albicans
agtaaggtcggaaaccccccaagggatttggactcgtttgactttggaatgtatggtgaaaacaatgatggaagtgataacgaaactaaggggggcacgtttgattcaccaaaatcagggactggtataactaatgatattattgctgatttggaaagtgatattgataatttcttaaaagcaagtagtgagagcggaaaagaaatgccagtggtgaccagaacaaattcaagtaaacactcgtcgccatttccaagtagttcaagtgacgttgctgacaatagctacataaatgatttgagtataagtagatcaaagcctgttatgggattagctgatattgtcaatgaccaggatcagcaaaatgaggatttcatcgaaccatcattgtcgaccccttatcccttggattccccattgattactcctataatttcacccgtggaatctccacaaattatccaaaatgaatttatgccaatcagcagcaacgacagtcctaatttgaaacatgaattttcaacttcgggacaaactagccctcccaatccattttcttcaccagttgcttctgggacaccttctatcacatcacctaggaaattacgaaaccttgatttatcaacaacaccggcaagccccgttgcaagcttaatatcttcgactgaaggaaatggtggggaaatttcccagttcccagtgtcgtcaacttcaagaaatacttcacaaaactacacaacttcaaggactccatcggctgcatctcgtatgcattcagcaagactgccaggaaacccgcaaccactgacacaaacaccactatcacgcacattaacagaaaattcgtcagcaccgattgcactttccaaatcttacacacaaaagacatacgccagtaatagatccaaccctagtcaacatcgtatgtcaagctcagttggatctatatacagttctaactcatatagaaatgtgaatttagctgcgttaaagaaaacattgaatttgaaacctggcgaaggagaaaggtctaattatgttttggcaattagaaaagcggcaggtacatcctataatgagctgacacgaatgaagtggaagttgcctgtgggtatattaccagttgacaagtctgcaactaaagaaaactctaatggtaaatatatgaaattggccggtaatctgttagcggcttcacggaaaaaaaccagtggtgtcgaattaaaacatggtcatttgaaaccaagattattggctgctgaaattgatgaaggtgatgattcaactgccataagtttggccaagacacctttgacccaatcctcagtgaacttgaaagtgacagaaactaattcaaacaaaactgtttccagtgaaaactcattaatgagaacaacaactgatgtttcagtagtaacgggtgatactaatagtatagttacgacaaccactgataccaatgcgagcggtagaggagaaagtagtggtaatggacttaaacgaaatgaatccatcgcgtcaagtaattcatctggcagtttatcagataaaaactttactaattttggatattaccaacaccgaagctataaagatgatgacgaagatatttttgctgacggtgtcaacagacaagcatccaatgatggtgatgtgacagacgaggaaagcaatcaaataaatggttatccaaaagtctcctacatggacgctaatagcattgaacaagaagaagaggacaacgatagaccaaggttggttttagccaatcctgattatgatagtgatgacagttcatag

SEQ ID NO: 3128 - DNA, 2460 bp, Candida albicans
actgcggatcttccagccgcgtgggcaagatctatccagataaaacaaatacctaaacctatgaatacttcatctataacaaatgagtcgaaacctatctcggctccggcaacgaaagaatcagtgtcggcgaaaccaacaccaacaccgacagcaccaacaacaggggtagcaccaaaatcaagtcctttgataacccctttgacagcttcacaatcaaatctaacgaaaacaacttctatatctccgcaactatcaaaagcaaaatcaaaccaaccttcgcaaccaccttgcaagcaaatcaaaactaatccaaaactactatctaatcctcaaccaaataaagctaaatcactgacacgtcccagtgttcaaccgatcgcaaccaaatatcataaaatccaaccagcgattgctcccaaaccaatgccagcatctatgtcccaaacatccaaattcaatcctatacctacggggaaactatctcttctgatgaaccagctgtcatttgcccgaccaaatgattccagtagtttaaatacatcaagaagatgggtattacctccaagaccaagaccaggaaggaaaccaactcatgattctcatgggaatattactattgacgacaagaaaatttctaaaaatggcatcgccaccaacaacaacactaccacccccatcactactaccgcaaatagtaatgctactgtcggtaatggaaatcacaatactcctataaatgctagcaccagtaatgggataaccaaaaagaaaacaaaatgtaaaaaggattcaacattggaggcaaaaattgcattaaattcaaataccgacttattgaatcagattaaatcatcagagaatacaacagttatatcaccagaggatattaacctaaagtcaagtaaaccaactcctttgaaatcattaacaccaaacaacaataagacatcttcgccaatcgtaccaatatcatcatcccaacaacagccaccacagcaacaacaagaaaagcaaccgattgcatgcaccaaatctaaagcaaaagcaaaatcaacaacaactacagcaagaaaatcgaaaacagcatcagctaaaggaacaccactggctgaagtaccaataccgataccaccaattgaagttgatccagaaaaacatttatcaaatatgcaaatgtcgtatttatctaaattgaaagaacaagaagtgattcgaaattatattgaagtattgactaatcaaataaaagaattaagtcttgttcaaaatggagtgattacatttgatgctttgaaaagtaatgttaaatataataataagaaaatattgaccagcactaccacatcaacgggcccaggtaccactggtgctggtggtattccaacatcatcaacatcatcatcaacttcaagctcaaaatcaatgtatgatcaattagaagcaattaataatttaaatgatttgaataaatttttaaactatttgactaaatcttcaaatatcattcaaagtgtcaagaaaaatcctggtatatcttccgaaacccttaataagcaagttgatcattatgtggaagtaagaaagaaattcaaagctattaaacgaaatgaacaaagtggtaaaaccttgaataatttgggacttcaaccaccacctccatcacaatattcattatctattccttcaatgacaaccggagctactattactacaacaacagctggctctacaaccaccccaataccacaagcaatgaagaatcatgctatgtttaataatgataaactttcaggaattttatcaggatcaacatttcaagatatggacatagatcccaacaataacaacagtactaatagttgtggtggtggtcgtgatagtggtggaggtggtgtcgttggtgatacactcaatgaatctggaatgggtcaatttgttcctgatttattgaaacctattaaaccagtcaatttgttttcagaattccaagatttacaattacaaactgaaactattgaagaaagctctagtcaaatatcccaattaagtggtattggtgagagtggtgaagaatatgatattggtacaactgttagtaatggtaatggcagtggaaccggtagcagtagcaataccaatagtagtggtagtaactttgcagtacctaataacttggatggtggtgatcttgaattatttatggatgaacatgattttcttaatcgattagtattagatgatcgacaaaaattgatgaatgatgaagaagaagtatttgggaaagttcaaatccatggcaatgacatgagtggctccagtaatgtgaataacgatactcattctattacaaacaatgataataatgatgagaataaaaatatgaatcgagtgaataatgaccttttattgaagaagaaatgtcttcaccacgcggtggaagatccgcacttgcgttac

SEQ ID NO: 3129 - DNA, 444 bp, Candida albicans
  unsure (17),(26),(31),(32),(34),(58),(406): Identity of nucleotide sequences at the above locations are unknown.
aacccaaatactccacntaatcaacnacaannancgggggggagggggaggggggagnagttggcaaataatatttatacccccccactcccccaaccttccaattttcctcttcctctgggaatttttttttttgaaatacaaatctcttttaaaaccaacttaaacctattaattatgacaattgaatatacttggtggaaagacgctactatttatcaaatttggcctgcttcatataaagattccaatggtgatggaattggtgatattccagggataatttctacattagattatcttaaaaatttaggaattgatattatttggttaagtccaatgtataaatcccctatggaagatatgggttatgatattagtgattacgaatcgtcttcacctacgngaactagccaggaaccgggcattgtgtctcccccattc

SEQ ID NO: 3130 - DNA, 945 bp, Candida albicans
aatggctttccatcaaatcacaagtttttgaagacacccagtcaatgtttaaaagggtttaaagaacatgaagatgctgaggacacagtggcattgatcaactctaatgtcaatccaaatgaaatccccaaacacattgagccattggttatttctgactccgtagatgcctcagattctacatttgtacgtatcaatgggagcgatcaaaacatagtcatcaaccatgtaactagtcatcttcaatccaaaatcatatactttgcccttaacttgaacaaacggaaaagagccatttggctctctcgtcatggggagtcagagtttaatttgagtggtcagattggtggtgatgctaatttgtcggaaagaggatgggcttatgctcgtaaattacctctgttggttgagaaatcatgtaacggggccaatttaactgtatggacctccactttgagaagaacccaacagacagcttcttttcttccctttcaaaaaaagcttcaatggaaggcattagacgaattagatgcaggtgaatgtgatggaatgacatatgaggaaattgaacaaaagtttcctgatgatttcaaggccagggacgataataagtatgagtatagatatcgtggcggtgaaagttatcgtgacattgttatccgtttggaacctattattatggaattggaacgacaagaaaatatcttgattattactcaccaggcagtgttgcgttgtctctatgcctactttatgaatgtgccccaagaggagagtccgtggatgtcgataccattgcacaccttgatcaagttggagccaggtgcttttgaaactatagttacgcgaatcaaggcagacatacccgctgtcagtacatacaaggaaaaagggattctcaattgggtgaatcaaccaccaacacctcgaaaagtagagatttaa

SEQ ID NO: 3131 - DNA, 1578 bp, Candida albicans
ctattctactttaccatgtccacaccaattgaattcaaatcgtccaattctgtcactaaggacgatcatttatataccaaatttacttatgaaaactctgttgttgaaaaagatgctaatggtaaattcatcgttacaccaactgctagtgactatgaattcaaagttgatttaaaagtccctaaggttggtttattgttagtcggtattggcggtaacaacggtactacattgttaggtgccacattagcagacaaacacaatatttcttttgaaaacaaagaaggtgttgttaaaccaaattactatggttctgttactcaagcatccactgtcaaaatcggtgttgataaagaaactggtgaggatgtttacgttccatttaactccattgttccaatggttaacccaaatgatttggttgttgatggttgggatattagtggtttgccattagaccaagcaatgaagagagctaaagtcttggatgttactttacaaaagcagttgtatccatacttggagaacaagaaacctttggaatcaatctactaccctgatttcattgctttgaaccaaagtgaacgtgccaacaatgtttttaaccaagtcaatggtgaagttaaaactgataataaatgggccgacgttgaaaaaatcagaaaagatatcagagatttcaaggccaaaaacgaattagataaagttattattttatggactgctaatactgaaagatatgctgatgttttgccaaatgtcaatgacactgctgacaacttgatcaagagtattaaagaatcacacgaagaaattgctccaagtactgtctttgccgttgcttctatcttggaaaaagttccatatattaatggttcaccacaaaacacatttgttcccggtgttattgagttagctgaaaaatacgactcattcattggtggtgatgatttcaagtcaggtcaaacaaaaattaaatcagtgttagctcaattcttggtcgatgctggtatcaaaccactttctattgcttcttataatcacttgggtaacaatgacggttacaatttatcatcaccaaaacaatttagatctaaggaaatttccaaacaatctgttgttgatgatattattgaatccaacgaattattgtacaacaaggaatctggtgacaaagttgatcactgtatcgtcattaaatacttgccagctgttggtgattctaaagttgccatggatgaatactattcagaattaatgttgggtggtcacaacaaaataagtattcacaatgtttgtgaagattcattgcttgctacaccattgattattgacttggtggtggctactgaatttgcaactagagttcaagtcaaaggtcctggtaaatctgattatgatgaattgtatcctgttgctagtttattgtcttactggctcaaggctccattagcaagaccaggattcaaacctatcaacggattaaacaaacaacgtcaacaattagtcaacttgctttcagtgttggttggtttaccaattgacaacgaattaagatttgaaagaattctcaaataa

SEQ ID NO: 3132 - DNA, 1170 bp, Candida albicans
agatttttaactcaaataaacaaatctatacaacaactacatctccactacttctttttctacttatatattcattacaatcagatgtcttttgcttatgccactcttttaataggggaatcctatttaccaggtgtattaactttgggtaacagattaaaacagttgggcacaaaacataaattattgatcttattagatgtcagttcaatttcattacaaagtaaacaattgattgagtcaatttatgatgaattgattcctatcgataatcaattgattttatctccattgcagaagttgagtgaacaattacaacgtcaagaattatcaattagttattcaaagattttattatggaatcaattagattatgattcgattgtttatcttgatgccgatgtattaccattacaaaatttagatcgattgtttattgattatgatgttgatgataatcaaattggtgctgcttctgattctggatggccagatatttttaattccggggtgtttaaattgaaacctaacaaacaaacatttgaacaattattggaatttagtgttgatccaaacaatacttttgatggaggcgatcaaggattgtttaatgaatatttcaagttggagaattggataaggttaccttatttatataacgtgacacctaactatcgtcaagattatcaatatttaccagcattcaatagatttttcaaggatattaaagtattacattttattggtcaagtgaaaccttggcactatgaaaatgtcttagcaagtgatttggccaactttcatcagtattggtgggacgaatttaataagcttattggagatgatgttgcattgaaatatacattgttgaatttacctagaggtgaagcaacaaagttgaaatttggtaaaactgtgaatgcatgggataaaaaagatattgaacaagacactgaattggtagaagaagaagaagaggaagaagaagtagtcagtcacagtccaattttcccttgggaacatcgtcaagagaaaagacagcctactcgtgttttccaaaatattcctactacttctactgtaggtaatgtatcgggaaaatctggtacaaaggaggaacaagagttggatagaagtactgaaactttgaaaagaactcatatctcctaa

SEQ ID NO: 3133 - DNA, 630 bp, Candida albicans
gaaaaattgacttatgatttgaagagaccggaattgaacaagacgtttaccaaggttgaactatggtctttgattcagtatgaaaaaattttatatttggattcggacactttaccgataattccagatgcagctaatggcggcactgttttggacttgttggcattggattttcccaagttcaaaattttggcagcaccggatagcgggtttcctgatattttcaattcgggtgtatttgccttgagacctaatttggatgactatacaaatctagcagcattggtgcaagagtcagttataaaccctaatgtatcttttgatggtgctgatcaaggtttattaaatcaatatttcaatgcccaacctgattgggttcaagctttattgacgaaacatgatgctacagttgatttggaaactgttagttatacccaagactctaattggatcaagataccatttttgtataatgtgactccatctgccgaataccagtatttgcctgcattgaaacactttcaaaacccaccaggacaaccgctgcttttagaaaacccacaagcagaagccgaattagttgatcaaggagcagaacaggtcttcaccacggcgctggaaggatccgca

SEQ ID NO: 3134 - DNA, 795 bp, Candida albicans
aaccttagtcgacacctcctatccaaccataccgcacatcaaacagcaaaaaaaaaaaagttggttgctgtgttccccttttttcttttttccaacatcaacatggttaaaccaattatagttccatcaatattagctgctgattttgcaaatttgggttgcaattgtaaaagagttgtcgacacgggggatgttgaatggttacatttggatgtgatggacggacattttgttccaaacatttccttgggtcctcctattatcagcagtttaagaaaacagtttcctcgtgaaggcgataagccaattgtttttgattgtcacatgatggtttctgaaccagatgaatggattgaagaaattgcaaaagctggcggggactcgtacacctttcattttgaggccaccaaagatcccgcaagagtcataaagaaaattaaggagcacggtttaaaggcagccatggctatcaaacctaaaaccccagttgaagaggtgtttccttatgctgaagatttagatatggtattggtcatgacagttgaacctgggtttggaggacaaaagtttatgccggacatgatgccaaaggtcgaaacattaagagaaaagtaccccaacttggatgttcaagttgatggaggattggggaaggatacaattcaacctgctgcagatgctggtgcaaatgtcattgttgctgggacctcggtgtttaaaccagaagacccgaaaccagttgtccaatatttaaaacaaactgtggccgatgccattcaagctagaaataagtag

SEQ ID NO: 3135 - DNA, 648 bp, Candida albicans
caagtgcggttttttcacgcgtgggcaagatctaatcctaaaaataccaatggcgagcttattgcttctattcggaaaatgtggaatgattcattcttatttaatcctttgtctaggcatcctattgtgggacaacatttttctcagtcgccattggtcaacagttctgctattgaaattgcatcggtggatactattcttgttaaaacatgtgcaccaaactcaactaaaaatgcctttgcatcccagtcagccggttctagtgcatcttctattttgaactttactcgaaaatcaacttggggacgaacttatgatctcttgtcgttcatggtagcacttgtcgggtgggaacacgtgatttcaattaaagagaggttgtttaagctgaatgtcgaaactaccactactgaaaataacaattatattgtgaaccatggagctaaggaaaagttagtgacatgtgaagcttggttagaacagttgttcattacaatttacgaagatctccgaacactaatgatcactattgccaacaacagcaatcaggaacggagtgcattagaatgggaaatgatacgtttgttacgatggctggtgaaacacaatttacgagactccatcagcctgttggttactagtattatg

SEQ ID NO: 3136 - DNA, 828 bp, Candida albicans
agaatatactttatctctccactgggatgtccaaagggacaagaaatgcaattacatatcgatgtcaatgccacagaaggtacaccagaccttaaaccaagagttgataaccaaacattgaaatatggtcctattgccgaagacattcaagctttaacattactgccaatgggattattgtatgatcataatcgtccagtaacaaaacccgtcaatttaaatagatctatttggttaccagcatctgatgtcaataaagtatccattgaagaatactatgaattgacccatgtcggtgctgccttggattcaggattttttcgtattgattggatgaaaggtagatacgaaggaactagaaaccattgggcattaagtcatttagaactccctttgttagatagagatttagatggttattattataccgataaagttggagttgtttcatctcacaaggttgttaaaaaccatctattattactgccaagatatccattatttggtggatggaattataatttcacttttggttggtctgaagatttatcaagatttcttcataaattacatgatacctctgatgaatatattatcaaattccccattttgaattcacttagagatgttacttatggtgatgtatatttagaattctatttaccagaaaatgccgaatttcaaaatgtatcatctccaatcccatttgaatcaatcactattgataatgaatcatcatatttagatgtttctaaaggacatactaaagttactgtgcattataataatttatttgatgatttacataaattggatgtatttgtctag

SEQ ID NO: 3137 - DNA, 732 bp, Candida albicans
ggatttgatgaaaaatatcgtgaaggtgaaagacaatgggcttataaaaacccaggatttgttcatgaattatttaatgatgataccgctcatactatgatcaaatatttatatagacaaatacctgaagttattaatgcttttgaagcattacctgaagtcattttaagaatggattttttcagatatttaatattatttgctaaaggtggagtttatgctgatattgatactttccccatacaacccattccaaattggatccccgaaaatgttagtcccttggatattggattaattgttggtgttgaaagtgattctaattcaccaaattggagatcagaatcagtgagaagattacaattgggtcaatttgtcatgcaatctaaacctggtcatcctattttaagagaaataattgctcaaattgtattatacactaaaaaattggaagttccagaattaaatggtaatccaaatgctaaggcaatagcaattatgaaatggactggttctggtagatttactgatgttgttttccaatatttaaatgattatatattatcatctatttatgaatcaataaattggcaacatttacataatttggaagttccaaaattattaggtgatgttttggtattacctcgtgtttcattttctgctgatgatgaaaaaaatccattatcatttgttaaacattacggtgataaaatttataaacaagtgtaa

SEQ ID NO: 3138 - DNA, 774 bp, Candida albicans
ccaaccatgtcaaatttaacttcatcaattcaattgactagacaatccacttataaattaaataatggtagccacattcctgttattgggtttggtacttatttattggacgcttctcaagctgctgatttgacttatcaagcattgaaagatggctacagacacattgatactgcccttgcttaccataatgagaaagaagtttctcaaggtatcaagagatttttgaaagatcatccagaagttcaaagaagtgatatttggtttactaccaaaatcgacactcagtccctaggatacgaagagacaaagaaggctgttgaaagaatcaagaatgatgttaaagataacatagaatatgttgatcttattttgattcattcgccattagcttctaaagctcgtcgtttgagcacctatcaatatttacaagaacttgttttaaaccctaatgacgcgccattgattgtaaaatctatcggtgtttctaactatggtgttgatcatttggaagagttgttcaattgggaaggatatttgatcaaaccagttcttaatcaattggaattgcacccatggttgccaagattagaattgagagaatacttgtataaacacgaaattttggctgaagcttattccccacttactcaaggatacaagttggatgatccagaattgttggctattagtaaagaatctggtttaaccccagctgaaatattgctcaaatgtcatccttcatcttcaccacgcggtggcgatccgacttgc

SEQ ID NO: 3139 - DNA, 474 bp, Candida albicans
aaaggttggaaagttttgcaggatgctgtggaaaaaggatggattaaaaacattggggtttctaattatggtaaacatcatattgaagaattgttgaccaatgcaacgatccctccagctgtcaatcaaattgaaattagtccttggtgtatgagacaggatttagctacttggtgtttaagtaaaggtatcaatgttgaggcatatgcaccattaacccatggtaacaaattacaagtcaacaatactgaatttcaagaaattatgcaaaagtataataaatcagctgctcaaatattgattaaatggtcattacaaaaaggttatataccattaccaaaaacaaaaactccatctcgattaaaggaaaatctttctgttgatgattttgaattgactaatgaagaaattaaggctattgatcaacctgatgcttatgaaccaacagattgggaatgtactgatgctccatag

SEQ ID NO: 3140 - DNA, 789 bp, Candida albicans
gatactggtattggtggcaaattgtcaaccaatatggaccatttagtttgcttttacggtggattgttagcccttggtgctactggaggattgacattgaacgaggctcaaagtttaaaatcatggaatgaacaaagagaagctgactttaaacttggtgaagagttgatttatacttgttataacatgtgccacgatgttagtccaactggattgtcaccagaaattgttgttttcaatgaagatacttcaaaatccaaagattttattattaaacctttggatagacataacttacaacgtccagaaacagttgaatcattgttttatctttatagattaactggtgatgtcaaatatcgtgaaatgggatatgaaattttccaaaattttatcaagtacactaaagttgttaattcggaaggtgaagtttcattttcctcgctttccgatgtcacttctttcgattctaatggcttaccgaaattcaaagataacactgaatcattctggtgggcagaaactttgaaatatttgtatcttttgtttgatgacaccaataagattccattgacagattatgtctttaatactgaagcccatccattccctagatttgatactaatgattatttcaaaactggttggagaagaaaaattgatgagaatgaaaaggcacaaatgagagaatccaaagttattgataaaagtaatcttccggaagctcaaccagttgataaatcagctgatcaagaagctaaagaaattattgaagaaattgctgggtaa

SEQ ID NO: 3141 - DNA, 972 bp, Candida albicans
tacaaagacaaagtaccagcattccacccagcccacacttcaaaaaataaaaaacgtattctcatgctattaaaaggttttatgttgtctttagtattatatgctgtgtaccatttagcatcaaatggtgggcaatttatgtttgatttctcgggtcaatcaaaatgggaaagagctcaactggaagttcgtcaagccatgttagattcatggcatacctatgaaaagtatggttggggttatgatgtctatcatccaattaagcaagaaggggaaaatatgggtccaaaaccgttggggtggatgattgtggattcattagatactttgatgattatggattgtccagaagaagtcagtcgagccagagattggatcaagaatgatttggattacacttttgattataatgtcaacacatttgaaaccactattagaatgcttggtggtttattatcagcttatcatttcagcaatgacgatgtctatttggataaagcggtacaattggccaatgcattacacggggcctatgatagtccatcaggaataccatatctgtctgtcaatttgaaatcaggtaaaggtataaagaatcatgttgataatggtgcctcatccactgctgaagctgctactgttcaattagaaatgaaatatttatcgaaattgactggagaaattttgtggtggaacttggcagagaaagtaatgcaagtgttagaaagtaataaacctcaagatggtttggtgccaatttatgtcaacccagatactggtaaatatcaaggccatttgattagattggggtcacgtggagattcttattacgaatatttgttgaagcaatacttgcaaacaaataagcaagaacttgtctattgggatatgtatcgtgaatcggttgaaggtgtcaagaaacatcttgtgagtgattcttatccttcaggattgacgtatattggggaatag

SEQ ID NO: 3142 - DNA, 1005 bp, Candida albicans
  unsure (945): Identity of nucleotide sequences at the above locations are unknown.
gccattggtgactcttacattgaaaataatgttccatatattgcatacagatctttactggctattcaaggtgccgcaattgtcccaattatgtttttaaccatgaaaactttaggtttctccgttgcagcttgtttgttttctagtataattgtgtgctttgataacgcccaagtcactgattcaagattgattttgttagatgctacattaattctcagtgttgcattgactatattttcgtattccaagttttcaacatttagaaaacagccattttcttcgaaatggtggacctggttgttagccacaggggtatctttatcatgtgttatctccacgaaatacgttggtgttttcacatatcttaccattggtattgctgttattcacgaattatggatcttgttagattataggaaagggttgactttgcaagaatttgcaaaacacttttttgccagattatgggctcttataattgttccattctgcatttatttgtattggttctacttacattttgccattttgactagatctggcccaggtgatgcattcatgtctagtgaatttcaagaaactttgttggagtcgccattagctgctcactccaaaccagtgcaatattttgatcaaattactatcaagcacaaagatactggtgcatttttgcattcacaccaacacgagtatccattgcgttacgaggatggaagaatttcttccaatggacaacaagttacttgtgtagtacaggaaaatgctgccaatgatccaaacaaccaatgggaaatagttccaactctggaaggagccaacaaaggcaccaaagtttacacaaatgacattgtcagatttagacacgttggtaccggtggttatttattaactcacgatgtggcttcacctttgaaaccaaccaatgaagagtttactgttgtntatgacgacgttgcccaacaaccttacaatgagacattatttagattgagattgcatgtt

SEQ ID NO: 3143 - DNA, 840 bp, Candida albicans
  unsure (290): Identity of nucleotide sequences at the above locations are unknown.
ggatttttacatgttgataatgtggtagctatggggaacccttatggtgaattattacccagatggcttttcaaccaaccaggagtcagtggtaataaaaaaataccggttaaggacaatatttggaatttcgatttgatcaccaatttgcaaagcaccgatccaagaaaccagtatgttcctaaaaaagtcaagactttaccatttttaagaaagtggtgggaattacaaatgttaatgttccatcatgacaatcatttttcatcagaacatccatttgcaacacaacntggtgaatggcctttggcattatctggggtttccttctacaacgacaacaccgagaaaacacagattttctttattggacacatcattgggttctggttagaagtttgtttcttgtcgatttatatcggtattttattggctgatcaaataacacgtcgtcgtaacgtacacgtgttaagcgacagagcaagatcaagattgtacaacactttgggatttttgtttgttggctgggctgcccattacttgccattcttcttgatgaaccgtcaaaagtttttgcatcattacttaccagcacacttggtggctgcattgttttctggtggacttgttgaattcatttgctccaacaactcagctagaccaaatggcaagcctgttggggtcaacaagtacaagattattgctgttgttgctgcttgttctactgctattatctggttcttcttctatttcagaccgcttacttatggtgatgtttacttgactcctgaggaagttaaagctagacaatggttagacatcaagttgcattatggtaaataa

SEQ ID NO: 3144 - DNA, 1056 bp, Candida albicans
  unsure (93): Identity of nucleotide sequences at the above locations are unknown.
tgggatatatggatcaggttgtcttattacagaaggaaacaagaggtgaagtggattttctatttatttccgagggtgagaagatttttgganagatatgcacctattgccaaggacttagcatgcagagacgtgttctctcgtgcaattacgatggagttaaatgaaggcagaggagttgtttctgagaaggaccatatgtatttacaattgagtcatcttcatgcagctgttttaaagcaaagattaccaggtatttctgaaactgctcatatttttgctggtgtcgatgtaacgaaggagccaattcgtatattgccaactgtacattataatatgggtggtatcccaactaactggcaaggggaagttttaaaaaagggtactgacggcaaagacgaagttgtccctgggttgcttgcttgtggtgaagctgcctgtgcatctgttcatggtgccaacagattgggcgctaactccttgttagacttggtagtttttggaagggcggtttctcatacaataagagataacctcacaccaggagctcccttacacgcatcaccagctgatttaggtaaggcttccattgaaaacttgcatagattgagaaatgcagaaggtacaaaatcaacagctgaaattagactagatatgcaaaaaacaatgcaaaagggttgtgcagtgtttagaacagaagaaacgttagaggaatgcgttgacaatatcaacgaggttgacaaatcatttgctaacgttaagaccactgatcgttcgatgatttggaattctgacttggtggagactatggaattacaaaatttgttaacgtgtgccacacagactgcagcatctgctttagcaaggaaagaatcaagaggatcacactctcgtgaggattatcctgacagagatgatgtgaattggtggaaacatactttgtcttaccaaaacagtgttggttctaaagtaaaattggactatagagatgtgataaaaaccacgttggataccacagactgccaaccggtaccgccagctgttcgtaaatactag

SEQ ID NO: 3145 - DNA, 1239 bp, Candida albicans
atttcaatcatgttgacttcattgcgtaatcaagtgaaaagttcagcagtgacaaagagattgttatcttcatcttctgttagatcccaagttattggatcaaatgtcaaaggtcaagatttcaatgctgccaagtatatgagtcaaaaataccacgtcgttgaccacgaatatgactgtgttgttgttggtgccggtggtgctggtttgagagcagctttcggtttagtctctgaaggtttcaaaaccgcctgtgtttctaaattgttccctaccagatcacatactgttgccgcacaaggtggtattaacgctgctttaggtaacatgcacgcagatgactggcattggcatttctatgataccgttaaaggttccgattggttaggtgaccaagatgctattcattatatgactaaagaagccccagcttctatttacgaattggaacactatggtgtcccattctcaagaaatgatgagggtagaatttatcaaagagcttttggtggtcaatccaaagaatttggtaaaggtggtcaagcatacagaacttgtgctgttgctgatagaactggtcatgccttgttgcactccttatacggtcaatctttgagacacgactgtcatttctttattgaattctttgccatggatttgatgatgaaggatggtgcttgtattggtatcattgcttataatgaagaagatggtactttgcacagattctttgctaacagaaccattatggctactggtggttacggtagagcttacttctcttgtacttctgctcacacttgtactggtgatggttacgctatggtttccagagctggtttgccattagaagatttggaatttgttcaattccatccatcgggtatttatggttccggttgtcttatcactgaaggtgctagaggtgaaggtggtttcttggttaactctgaaggtgaaagatttatggaaagatatgctccatcagccaaagatttagcttccagagatgttgtttctagagctatcaccatggaaattaacgaaggtagaggtgttggtccagaaaaggatcacatgtacttacaattgagtcatattccagctccagtgttgaaagaaagattaccaggtatttctgaaactgcccacattttcgccggtgttgatgttactaaagaaccaattcctatcttaccaactgtccattataatatgggtggtatcccaaccaattgg

SEQ ID NO: 3146 - DNA, 744 bp, Candida albicans
atcatgttcacaaaatgctctagacaagcagtaaatagactgggacgttttttcagcaacagttccattacttttcagacaattggcagaattaaaggaacagaagccaactcaaagaaatatttgcaacaaaaatacgttgtcattgatcatgaatatgattgtgtggttgtcggagctggtggagccggattgcgagctgcatttggattggcagagtcaggatttaaaacagcatgtatatcaaaattgtttcccactaggtcacatacagttgcagcacagggaggtattaatgcagcactaggtaatatgcataaagatgactggcattggcatttttacgacactgtgaaaggatctgattggctaggcgaccaagatgccatccattatatgacaaaagaagcgccagattctatctacgaattagagcattttggagttccattttctagaaatgacgaaggcagaatctaccaaagagcatttgggggccaaacaaaagaatttggtaaaggtggacaagcctatagaacatgtgctgttgctgacagaactggccatgctttgttgcactcattgtacggtcaagctttgagacacgattgtcattttttcatcgagttctttgctatggatttgctcatgcaagacggtgaatgtgttggtgtaatagcctacaaccaggaggatggaactatacatagattccgatctcataaatatttgccccaggggtcg

SEQ ID NO: 3147 - DNA, 1464 bp, Candida albicans
  unsure (54),(182): Identity of nucleotide sequences at the above locations are unknown.
aattggaggtttaaccgcaaacttggcccaacaacaaccaccatttcattcatnatggggcaaatttcagctgttgaattgggctttaatcccagtggctcccaggtgaacaaaattaaggaatttttcattccagagctttcttttgtgaaggagatttacctatgccagttgaattcttntaatgttcggatcgtgcatcagtggttcaacacacccaaaaaattttattttttagaagatgatgatattgctcatatctatgatggggaattacgtattcatagagcttcgactaaatctgctggggaatctactgttagaccaattcaaactttagaaatggaattgaatgaaattatgaaaggcccctatacacattttatgcaaaaagaaattttcgaacaaccagattctgcttttaatactatgagaggtagaattgattttgaaaattgtgttgttacccttggtggattaaaatcatggttatctacaattagaagatgtagaagaatcattatgattgcttgtggtacttcatatcattcatgtttagccacgagatcaatttttgaagaattgacagaaatccccgtttcggttgaattagcttctgatttcttggatagaagatctccagttttcagagatgatacttgtgtatttgtttctcaatcgggtgaaactgccgactccattttggctttacaatattgtttggaaagaggagctttaactgttggtatcgttaactctgttggttcttcaatgtctagacaaacccattgtggggttcatattaatgctgggccagaaattggtgttgcctcaactaaagcttacacatctcaatatattgccttggtgatgtttgccctttctttatctaatgattctatttccagaaagggaagacatgaagaaattattaaaggtttacaaaaaatccctgaacaaattaaacaagttttgaaattagaaaacaagatcaaagatttatgtaatagttcattgaatgatcaaaaatctttattattattaggtagaggttatcaatttgctactgctttagaaggggctttaaaaattaaagaaatttcttatatgcattctgaaggggtattagctggtgaattaaaacatggtatattagcattagtcgatgaagatttaccaattattgcctttgccactagagattcattatttcctaaagttatgtccgctattgaacaagtcactgctagagatggtagaccaattgttatttgtaatgaaggtgatgctattatttctaatgataaagttcatactactttagaagttccagaaaccgttgattgtttacaagggttattaaatgttattccattacaattgattagttattggttggctgtgaatagaggtattgatgttgatttccctcgtaacttggctaaatcagttactgttgagtaa

SEQ ID NO: 3148 - DNA, 207 bp, Candida albicans
atcatgtgtggtatttttggttacgtcaatttcttggtcgacaagagtaaaggtgaaatcattgataatttaattgaaggtttgcaacgattagaatatagaggttatgattcagcaggtattgctgttgatgggaaatcaactaaagatccttctaatggtgatgaagaatatatggattctattattattaaaactactggttaa

SEQ ID NO: 3149 - DNA, 1029 bp, Candida albicans
aaaaaaatggtcaaagttactgttgcaggtgctgctgggggtattggtcaaccattatccttgcttttaaaattaaatccaaatgttgatgaattggcgttatttgatattgtaaatgccaagggtgtggctgcagatttatctcacattaatactccagctgtcgttactggtcatcagccagcaaacaaggaagataaaactgcaattactgaagctttgcaaggaactgatttagttattattcccgctggtgtcccaagaaaaccaggtatgactagagcagatttgtttaacattaatgcttccattattagagacttggttgctaacattgctagagttgctccaacagctgctattttgataatctcgaatccggtcaacgccactgtgccaattgcagctgaagtgttgaagaaattgggtgttttcaatccacgtaaattatttggtgtcactactttggatagtgtcagagcagaaacctttttgggtgagttgaccaataccgatccaaccaaattgaagggtaaaatttcagttattggtggtcattctggagatactattgtgccattgatcaattatgatgctggtgttggtgtattgagtgactctgattacaaaaactttgtgcatagagttcaatttggtggtgatgaagttgttaaagctaacaatggtgcaggttccgccactttgtctatggcctatgctggttataggtttgccgattatgtgattagctcactaactggtggtgctactcctgctggcagaataccagactcatcgtatatctatttaccaagagtctcaagtggtaaagaatttcagcaaaatatgttgatggagttgaattcttttcagttccattcctgttgtcccaaggtgagatcagatcatttgtcaaccccctttgaggaatcaactgtaactacagaaaacataaatctggttgaaattgcatcgaaaaggttgaaaaggtcaatcactccatggttacccaaatacaaaaaaattttt

SEQ ID NO: 3150 - DNA, 1077 bp, Candida albicans
tttatttatttattcaatttatgtacttattttaatcaatcaatttatataaatcttacaacaatggtcaaagtcgctattttaggagctgctggtggtattggtcaaccattatctttattgaccaaattaaacccaaatgttgatgaattggcattatttgatgtcgtcaatgttccaggagttggtgctgatttatctcatatcaattctgattctaaaactcaatcatatttaccaaaagataaagaagataaaactgcattagctgctgcattaaaaggttctgatttagtcattatcccagctggtgttccaagaaaaccaggtatgaccagagatgatttattcaatattaatgcatcaatcgttcaaggtttagctgaaggtattgctgccaattctccaaaagcttttgtcttggtgatttctaatccagtcaattctactgtaccaattgttgccgaaactttacaagctaaaggtgtttatgatccagctagattatttggtgttactactttggatattgttagagccaatacttttatttctcaattattcctagatcaaactaaaccatctgatttcaatattaatgttgttggtggccattctggtgaaaccattgttccattatattcattaggtaactctaaacaatattatgatatattatctgaagaacaaaagaaggaattaatcaaaagagttcaatttggtggcgatgaagttgttcaagccaagaatggtgctggttccgccactttatccatggcttatgccggttatagattagccgaatcaattttagctgctgttaatggtaaaactgatattgttgaatgtactttcttgaacttggattcttcaattaaaggtgcttctgaagctagaaaattggttaaagatttagatttcttttcattaccagttcaattaggtaaaaacggtattactgaagttaaatatgatatcttaaatcaaatttctgatgatgaaaagaaattgttagaagttgccattgaacaattacaaaagaatattgaaaaaggtgtttcatttgctaagaaataa

SEQ ID NO: 3151 - DNA, 1002 bp, Candida albicans
aaaatgttttcaaaagttgctactagatcattttcctcttctgcttccaacgcctacaaagttgccgttttgggtgctggtggtggtattggtcaaccattatctttattattgaaattgaaccacaaagttactgatttggctctttacgatatcagaggtgctccaggtgtcgctgctgatgtttcccacgtcccaactaactccactgtcaaaggttacaacccagatcaaatcgaagaagctttgactggctctgatgttattgtcatcccagctggtgttccaagaaaaccaggtatgaccagagacgatttattcaacaccaatgcctcaattgtcagagacttggctaaggctgctgctgattacgctccaaacgccgctgtttgtatcatttctaacccagtcaactctactgttccaattgttgctgaagttttcaaatcaaaaggtaactacaacccaaacaaattgttcggtgtcaccactttggatgtcttgagagctgctagatttgtttctgaagttgccggtaccaacccagttaacgaaaacgtcccagttgtcggtggtcactctggtgttaccattgttccattgttgtctcaaaccaaacacaaagacttgtctggtgaaaccagagatgctttagtccacagaattcaatttggtggtgatgaagttgtccaagctaaagatggtgctggttctgctactttgtccatggctcaagctggtgctagattcgctggtgccgttttggacggtttagctggtgaaaaagatgtcattgaatgtacttttgttgactccccattgttcaaagacgaaggtgttgacttcttctccactaaagtcaccttaggcgttgatggtgtcaagactgtccacccaatcggtgaaatttctgactacgaagaagctcaagtcaaagaagctaaagacactttgatcaagaacatcaagaaaggtgttgactttgttgctcaaaacccataa

SEQ ID NO: 3152 - DNA, 507 bp, Candida albicans
tctaaattggcagttttgaaattgaatggtggtttaggtacttccatgggatgtgttggtcctaaatcagtcattgaagttagagatggtaacaatttcttggatttggctgtcagacaaattgaacacttgaacagaaagtatgatgccgatgttccattattgttaatgaactctttcaacactgatgctgacactgaaaagatcattaagaaatatcaaagccacagaatcagagtgaaaacttttaaccaatccagattcccaagaatttacaaagattctttacttccagttccagaatcatttgatgactctcttgaagcttggtatcctccaggtcatggtgatttgtttgaagctttggttcaatctggtgaattggatgccttgttagctcaaggaagagaaatcttatttgtttctaatggtgataatttgggtgccaccgttgactccaagattttggaccacatgattgaaactggtgctgaatatataatggac

SEQ ID NO: 3153 - DNA, 255 bp, Candida albicans
gcatttgacaacactgcaaccaatgttactgcctctcaaatgcgtaatgcattgaacaacttggctgatactgttgaaaacccagaacaaacaaccagattcgaaaatgaaatggacaatttctttactttgttcagaagatatttaactgaaaaggcatcaggatccactttggattgggataaaatcagatctccatcttccgatgaagttgttgaaatacgtgacttgaaaagtgccaacaactccggctaa

SEQ ID NO: 3154 - DNA, 510 bp, Candida albicans
gacgcttatctccattcccgcggtgaagacattccaaaccaaaagactatttctcatggcaaatcagatatcaatgtgttgcaattggaaactgccgttggtgcagccatcagacactttaaaggtgcccacggggttgttgttccaagatcaagattcttaccagttaaaacctgttctgatttgttactagtcaaatccgatttattctacttagaacacggtgctttggtattagatccaactagagatgggttctctaacccattgattaaattgggttctcatttcaagaaagtcagtggattccaatctagaattccttacattccaaagattttggaattggatcatttgaccattacaggtaatgttacaattggtaaaggcgttcaattgaaaggaacagtgattattgtttgtaatgatggtgacaaaattgatattccaaatggtgctatcttagaaaatgttgtggttactggtaacttgactatattggaacattaa

SEQ ID NO: 3155 - DNA, 615 bp, Candida albicans
acgcggaacttccagccctttgccgaatataagtttggttctgattcggatgggtataattttttcacccgtgaattatacgctgcaggtaatagtgcaaattcaatcagtagtgaccctcagcaacagcaacaatattatcagcaacaacaacaacaacaacaacaacaacaacaacaacaacaacaacaacaacaacaacaactgcagcaacagcaacagcaacagcagcaacagcagcagcagcagcagcagcagcaacaacaacagcaacaaattcaacaaattcaacaacctagtgcaacaaatactattgaaaaaatgaatttttggttcaataaaggatcattatttgccatttctaatattaatcatcttattggatttggtgatgcgaaaaatccatttgccaaattatttcaattaccagaagcattaaaagaacggaaagataaaaaggatcgtaaaagaaaatcaagaagtgcttcacaaactgaagatgccaatttagctactattggaagtgcaggtggtgtcgatggtcaatcaattactgctgctgatttaactacaaatgattggttttattgtcttcaatttattaataaatctgta

SEQ ID NO: 3156 - DNA, 477 bp, Candida albicans
tgtatttcaagaattacgagcattagaaattctccagaagccattatagctgatgctgccactagatcagtaattataattcgtgaattatatttaacgagagaagttgttccattgagatttgatggtacagttgcatctgatataaatgaaactacagaatttgaaaataattctacatggagatcaaatgttgatgaaaccattcttcatgcggttaatgaacatgatgaaatggggaaaagattgatgaaaggattaaatttacgattatcttctagtactagagaagattataagaaacgagatccaccagtattaaattctcgtatggccaaaacattcaaatattgtatattgataactgatgatagaaatatgagattaagagctaaaactattggattaacttcatttcaaagtaaatggttatttggtcaattggaaactgtattttctgatagatgtattgattaa

SEQ ID NO: 3157 - DNA, 1293 bp, Candida albicans
ttttactttagcaatcaatcattttccgtcccccattcactcccctttttgcaaaggatgaacaatacatttgatccgacactacattcatttgataattactcaggcacaccacaaaagagacagaatagtttatcttcacaaatggttcatacatctaataaacgaacacccaatccacttcaaaccccgttggcaatgcaaagtgcacaagaatatccatttactgtcaataacaataatctgaatttgaattcacctacaactgcacctcaagtgtcatcaccacgctataatgttcgatctagaaaaaatgtgattcaacacatgaaaacccccacaccgtcggcttatgaagttccgtcgagtcctaatatcaatcatttatcacacttatcaaatcataatcattctgatctgtctgattccaatgctgtgttagaaaatacccaagaggcaatggacactaaagtagcatcccgttctttttcacaacagcaacagcaacagcaatcatattcgcacctgacacattcacaaaattatcaacaacaacaacctacgccgcaaacttctgcaccgccaccatccctgcagcaacagcaacagcgagttatgtcggaagaagaacaacaacttgcaacaaaactcaaagaaacttacaagaatattgtcaactatgaagaaatcattcaaaataattgtgtggagataagtttaaaaataaaccaaataacttcaacgaacaatccaaatttggtttatggatcacctatggctgctcaaaatttatcaagttcattaaattcaaattcatcagtagcttctggtgtaactagaacatcggaattactgaatgatttatggactgtatatcatcaaaatataaccttattggataactattatgattttttagtcacatctttaaagccatcatcaaatcaaactcaatttaaaaccggtaaaaatattgttgacttatacaagattcctagaagaatgtgggtttatggagtagtggggtttcttgaagttttgaaaaatatcatgagtattttccaagatcatgaaatttgtctgtgttttatatcatattgctttaatattatttccaatttaacagacccaattttagaaatggaaggatggtggctggaaaaattgggtgatttatcaagaatggccattgccctttatgcatccaaattcattgattggaaaatcagtgctgaatgttggtattctgtggccatgaaaacactctatggacatgggaaaatatattatcat

SEQ ID NO: 3158 - DNA, 843 bp, Candida albicans
  unsure (44),(105): Identity of nucleotide sequences at the above locations are unknown.
aaattattgataagtattggtgaaagttttcaaaaatatcttantagtcaacccgatgatacattggttaatttaaaaacattttacccatgcgaatcattaatngatcatttgaattcgttattatcatttgttaaaaatagtccaaaattatgtgccatgtatactcaatatcttcaagttaattatgttcaatatttcaatcaaaatgaatttttacctgaagtttggaaatgttggggcacactttggtttgatttaattagtgaaaaacatgattatattgatctggaaactgctggagttaaaaataataatttatttgatttaccaatttgtggaacttatccagtgattaataatatgtcaggagataattttgatttaaaatcgaaaaatcaaatggaaaatgataatgatgaaaggattgttcgtattatattattgtcaagaactatagctgataattatggatttggattagttcgtactagggatgaatttaaatttgatcaaaatttatatcatcgagaaatcaatgattcatttgctcaagaatttatactcgatggaagatttctgcaaaataattttatgcaacctatatctagagaaaatttaacgtttgaaactaatcatcaattatcatcgattcaaaaagatgaaatatggtttggtggttttgatagtcatttatatgatgatgaaaatctcgaattaggtgaagatatcattgattgtgaagatgatcttgaagaagtatatgccaatgaatatggtcgagcatcttttaggtggtggtggtggtgctactattcttcacccacggggctggaagaaccc

SEQ ID NO: 3159 - DNA, 591 bp, Candida albicans
cattttcttctacaattaatcatgggtgaaattcaaaaaatcaaagttaaaaatcctattgttgaaatggatggggatgaaatgactcgtatcatttggcaattcattaaagataaattaattactccttatttggatgtcgatttgaaatattatgatttgggtattgaatatagagatcaaaccgatgataaagtcaccactgatgctgccaatgccattttgaaatatggtgttggtgtcaaatgtgccactattacccccgatgaagctagagttaaagaatttaatttgaaaaaaatgtggctttcaccaaatggtactttaagaaatattcttggtggtactgtttttagagaaccaattgtcattgataatattccaagaattgttccaagttgggaaaaaccaattattattggtagacacgcttttggtgatcaatataaagccaccgatattgttgttcctggtgctggtgaattaaaattggttttcagaccaaaagatggtggagaaatccaagaatatcctgtttataattttgaatcttcaccacggagtggcctatcagcggcaagttcgggggga

SEQ ID NO: 3160 - DNA, 921 bp, Candida albicans
ttcccaccaatgctatacttgttaactatattttcattattattacctgctttagctattaatgctagaagtaactccaatgttgctgtttattggggacaaaactctggtggttcccaacaacgattgtcttattattgtgattccgatgctgttgatattgtgattctttcatttatgcatcaatttccttcaccaattcaattgaattttgctaatgcttgtgaaggtacttatactgccaatggtattttacaatgtcaaacaatagctgaagatatcaaatattgtcaaaataagggcaagaccatattactttcattaggtggtgctgctggatcttatggatttagtgatgatgccactgccaaacaatttgctcatactctttgggatttatttggtaacagtaaaaatttagctactaatgatcgtccattttatgatgctgtattagatggatttgattttgatattgaaaataattggtcaactggttatccagcattagcaactgaattaagaactcttttccaaaaagatacttccaagaattattatctcggtgctgctcctcaatgtccttatcccgatgcttctgttggtccattattgaaacaaagtgaaattgattttgtttttattcaattttacaacaactattgtaatttaggatcttcatctttcaattgggatacttggttaaattatgctgaaactgattctccaaataaaaacattaaattgtttgttggtgtacctgcttcttctagagccgctggatcaggttataatgaccctagtgccgtgtctcaatatttgacaagtgatattttaaacagcaagtattttggcggtatttcaatgtgggatgtttcagctggttggagcaataccaattcaaatgggaactttgtttga

SEQ ID NO: 3161 - DNA, 1296 bp, Candida albicans
catcatcggtatttatattattgcttgaatttgttaaagcccttggttatttctaatccatttaaaccaaatggaaacttgaaattcaagagaggaggcggacataatgttgcttgggattatgataataatgttatcagaggtgtcaatttgggtggttggtttgtccttgaaccatatatgacaccatcactttttgaaccattccaaaatggaaatgatcagtctggagttccagttgacgaatatcactggacacaaactttgggtaaggaagctgctctgagaattttgcaaaaacattggagtacttggatcactgaacaagactttaaacaaattagtaatttgggattgaactttgttcgtattcctattggttattgggctttccaattgttggataatgatccatacgtccaaggtcaagttcagtatttggaaaaggctttgggctgggccagaaagaataatatcagagtttggattgatttgcacggtgcaccaggctctcaaaatgggtttgacaactccggtttaagagatagctacaatttccaaaacggtgataacacccaagttactttgaatgtattgaatactattttcaaaaagtatggtggcaacgaatactctgacgttgttattggtattgaattgcttaatgaaccattgggtccagttttgaatatggataaattgaaacaatttttcttggatggttacaactctcttagacaaactggatcagtcaccccagttatcattcacgatgctttccaagtctttggctattggaataactttttgactgttgctgaaggtcaatggaatgttgttgttgaccatcatcattaccaagtgttttccggtggtgaattatctcgtaacattaacgaccacatttcagttgcttgtaactggggttgggatgctaaaaaggaatcccattggaacgtcgctggtgaatggtctgctgctttgacagattgtgctaaatggttgaatggtgtcaacagaggagcacgttatgagggtgcttacgataatgctccatacattggatcctgtcaaccattgttggatatttcccaatggtctgatgaacacaaaaccgacacaagaagatacattgaggctcaattggatgcttttgaatacactggaggctgggtcttctggagttggaagactgaaaatgcccctgaatggagtttccaaaccttgacttacaatggtcttttcccacaaccagttactgatagacaattcccaaaccaatgtggctttcactga

SEQ ID NO: 3162 - DNA, 1167 bp, Candida albicans
  unsure (209): Identity of nucleotide sequences at the above locations are unknown.
gataggcccaggattccttttttattcaaagaggtggtggtttccggtttgaaattccaggttctttacatgttttctccaggttccgaacaagtcagagttacatttcccagagaggttcaattgaggacctttggagacttggtggtgtgtttcatggccaacgcctgtggtccatgtatttggtcaatggacgaacaagacatcanaaagggtgacaaaaacaccatcgtctcttcattcaacagaaacttcattgccagaatgaccggtaacccagctactcacgctttggttgcttctccagaaatggccactgtctatgctatctccggcgacttgggattcaacccaatcactgatactttagttggtgctgacggtaaagaattcaaattgaaagaaccacaaggtgtcggtttgccaccagatggttacgatccaggtgaaaacacctaccaagctccaccagaagaccgtgcttccgttgaagttgtcatctccccaacctccgaccgtttacaaaaattgagcccattcaaaccatgggatggtaaagatgctgagagattgccaattttaatcaaagctgtcggtaaaaccaccaccgatcatatctcaatggccggtccatggttgaaatacagaggtcacttggaaaacatttttaacaactatatgattggtgctatcaatgccgaaaacggtaaggctaacgaagtcagaaaccactacactggtaaatacgacggtgttccacaaactgctgctgcttacagagatgctggtcataaatgggttgttattggtgatgaaaactttggtgaaggttcttccagagaacacgctgccttggaaccaagattcttgggtggttttgctatcattactaaatcatttgcccgtatccacgaaactaacttgaagaaacaaggtttgttgcctcttaactttaagaacccagctgattacgacaagatcaactttgacgatgaagttgatttgattggtttgaccactttggccccaggtaaggatgttatcttgagagttcatccaaaggaaggtgaagcttgggaagctgtcttgacccacactttcaacagtgaacaactcgaatggttcaaacacggttctgctttgaactttatcaagagcaaatattaa

SEQ ID NO: 3163 - DNA, 1278 bp, Candida albicans
tttcttaaacattcaaacacaatgttgtctgcttcaagaaccgccttgagagccccacgttcagttcgtggtttggctactgctagtttaaccaaagattctcaagttaaccaaaacttgttggaatcccactccttcatcaactacaaaaagcatctcgaaaatgttgaaatcgtcaagtccagattaaacagaccattgacttatgctgaaaaacttttgtacggtcatttggatgatcctcataaccaagaaattgaaagaggtgtctcttacttgaaattgagaccagacagggttgcttgtcaagatgctaccgcccaaatggccattttgcaatttatgtccgctggtattccacaagttgccactccatctactgtccactgtgaccatttgatccaagctcaagttggtggtccaaaagatttggccagagccattgacttgaacaaggaagtttacgatttcttgtccactgcttgtgccaaatataacttgggtttctggaaaccaggttccggtattatccatcaaattgttttggaaaactatgccttcccaggtgctttattgattggtaccgattcccacactccaaatgctggtggtttgggtcaattggctattggtgttggtggtgctgatgccgtcgatgtcatgtctggtttgccatgggaattgaaagctccaaagatcattggtgttaaattgaccggtaaaatgtctggatggacttctccaaaagatatcatcttgaaattggctggtattactactgtcaaaggtggtactggttctattgtcgaatatttcggttctggtgtcgacaccttctcctgtaccggtatgggtaccatctgtaatatgggtgctgaaattggtgccaccacttctgttttcccattcaacgactcaatggttgactacttgaacgccactggtagatctgaaattgctcaatttgcccaagtttacaagaaggacttcctttctgctgatgaaggtgctgaatatgatcaagttattgaaattgacttgaacaccttggaaccacacattaacggtccattcaccccagatttggccactccagtctccaagatgaaggaaaccgccattgctaacggttggccattggaagttaaagttggtttgatcggttcatgtaccaactcctcatatgaagatatgaccagagctgcctctatcatcaaagatgctggtgctcacggtttgaaatctgtcttcacacaagacgatggaaggacaattgct

SEQ ID NO: 3164 - DNA, 1224 bp, Candida albicans
ggtagcctacagactaaaaggtatcagctcattagtcacttctatatccctatcactaccattaatacaagactacaacttcctcaaacctttatcaataaacaaacaactcatccatcaatgattacttggttggtgttttatctaatgctaacaatccccatgataaatggatcggatttatctttaagacttcaatctaaattcatgcctacttcattttcacctcgtaatatatttgatacacatgttccagccacaataaatagtaacaaagaagatagtagtagttctagtggtggtggtggcggcagtggattaccaccttctccaatgcagtttcatcccaaattaccatttcctaaatggttaagtgactttactggattacatgaatggccagatttagatccaccttatatcccattagattttattgattttaataaaattgtcaatatccccattcataaacaaggtcaatgtcatgatactggtagcaacaacaacaacaacctaacaccattatcgattttacgtacccctaaagcatgttcatttgattgttttaattgtgttgaaattgatgatgtttatacatgtcctaaattactgcaaacatttgatgatggaccatcaacatcaacattaaaattattacaatcatttaatcaaactggattaaaaactacattattcaccttaggagtaaatattgtgcgattcccagaaatttatcaacaatctcattttatgggtcatattatgggatcacatacttggctgcataaatttttaccaagtctaactaatcaagaaatcattagtcaaatagaatggtcaatttgggccatgaatgctactctgaatcatttaccaaaatggtttcgaccaccttatggaggtattgataatcgaataagaagtatattacgacaatttggtatgcaagctgtattatgggattttgatacttttgattggaaaatgcttggtggtggtggtggtgcgacaagcaatattcgtaaagaggaagatgttttctctgaagttgaaaaatttaaattgacgaaaaataataaaggattaatattacatcatgatgccatacaaaaaactgttgatgtggggattatgattcatgaaaaattattaaatcatgatcaattgacagtacctttatgtgttggtggtattgattatattaaaactttccccaaataa

SEQ ID NO: 3165 - DNA, 1689 bp, Candida albicans
tcactttcaaaaattatgtatcatcaagttccatctgaaattgaaggcaagagaactttgagagctccaactatctttgtttctcaagacgacaacaattttgaaacggaatttttcccaagaaattctgaagctgaaagaagaatttcatttttcgctcaatctttggctacaccaatgccagaaccattaccagttgataatatgccaacttttactgttttcactcctcattattcggaaaagattttgttatctttgagagaaatcattagagaagatgatcaattctcaagagtgacattattggaatatttgaaacaattacatccagttgaatgggattgttttgttaaggacaccaagattttggctgaagaaactgctgcttatgaaaatggtgatgattctgaaaaattatctgaagatggattgaaatccaagattgatgatttaccattctattgtattggtttcaagtctgccgcccctgaatatactttaagaacaagaatttgggcttcattgagatcccaaactttgtacagaactgtatctgggtttatgaattatgccagagccattaaattgttatacagagtggaaaacccagaattggttcaatatttcggtggtgaccctgaaggattagaattagctttagaaagaatggccagaagaaagtttagatttttggtttctatgcaaagattgtctaaattcaaagatgatgaaatggaaaatgctgagttcttattgcgtgcttaccctgatttgcaaattgcttacttggatgaagaaccggctttgaatgaggacgaggaaccaagagtatactctgccttgattgatggtcattgtgaaatgttagaaaatggtagacgtcgtcctaaattcagagttcaattgtctggtaatccaattttgggtgatggtaaatctgataatcaaaatcatgcggttattttccatagaggtgaatatattcaattgattgatgctaatcaagataattatttggaagaatgtttgaagattagatcagttttggctgaatttgaagaaatgaatgttgaacatgttaatccatatgcaccaaatttgaaatctgaagataataacaccaagaaggatccagtggcatttttgggtgctagagaatatattttctcagaaaattctggtgttttgggtgatgttgctgctggtaaagaacaaacttttggtacattgtttgcaagaactttggcacaaattggaggtaaattgcattatggtcatccggattttttgaatgctacatttatgttaactagaggtggtgtttctaaagcacaaaagggtttacatttgaatgaagatatttatgctggtatgaatgccatgatgagaggtggtaaaatcaagcattgtgaatattatcaatgtggtaaaggtagagatttaggttttggatccattttgaatttcaccaccaagattggtgctggtatgggagaacaaatgctttcaagagaatatttctatttgggtactcaacttccattggatagatttttgtcattttactatggtcatccaggtttccatattaataacttgtttattcaattgtctttacaagtgtttattttggtgttggctaacttgaattcattagctcatgaggctatcatgtgttcggtccac

SEQ ID NO: 3166 - DNA, 1185 bp, Candida albicans
ctttactcatattctaaagaaaacagtacggttttcactgaaagaatagagataattgaaaaaaaaatgacagatattccagaatctttgaagccctttgtcactaaaaaagtcatccattcaacttgggcaggaacttttttatgtaaaccacaagcaattttccaaccaagaaatgttgaagagatccaagagttaatcaaacaagccagattgcatggaaagaccattatgacagttggatcgggtcattctccaagtgatttgactatgactacggaatggttatgtaatttagataaattcaatcatgtattattagaagagccatattatgccccaaaatcacccaccgatgacacccctgaaatcaaattcgttgacttaacagtggaagcaggaaccagaatttttgaattgaatgagtacttgaagagaaacaatttggcaatccaaaatttaggttctattagtgatcaatctattgctgggttgatttctactggtacccatggatcaactcaatatcatggtttagtttcacaacaagttgtgtcagtgaagtttttaaattctgctggggaattaatcacttgttctagtgttgacaaaccagagtatttccgtgctatattattgagtttagggaaaatagggatcattactcacgttactttgagaacttgtcctaaatacaccatcaaatctaagcaagaaatcattaattttgaaactttattgaataattgggataatctttggttggaatccgaatttataagaatatggtggttcccatataccaacaaatgtgttttgtggagagctaacaaatcaactgatcccttatctgacccaagaccttcatggtatggtaccaagttgggtagattcttttatgaatctttattgtgggtgagtgttcatttattccctagattaactccattcgttgagaaatttgttttcggtcaacaatacggtgaagtagaaactttgggtaaaggtgatattgctgttcaaaattcagtagaagggttgaatatggattgtttgtttagtcaatttgttaacgaatggtcatctccattgaattccggtccagaaatcttaacagaattgaaaaagattattactgacgcgtctcacactggtgattttcacagaccgccgagatccatgaat

SEQ ID NO: 3167 - DNA, 351 bp, Candida albicans
agagaaaaagggttagcagataattttgaagtttatatagatggaggtgttagaagagctactgatattttaaaagctgtttgtttaggagcaaaaggtgttggtattggtcgtccatttttatatgccatgtcaggatatggagatgctggtgtcaataaagctatacaattacttaaagatgaaatgattatgaatatgagattattgggagttaataaacttgaagaattgaatgaattatttgttgatactaaatatatgcaaacaagatatgttcctgatgatgtgttgtttaacagagtttatgaaccggtaccattaccaagattcaaagatacaaaattgtag

SEQ ID NO: 3168 - DNA, 612 bp, Candida albicans
  unsure (31),(63): Identity of nucleotide sequences at the above locations are unknown.
tccccccgatatcattgggcggttctgtcgncttccccagatggtgaagacaggcaccaactngtagaagaacttaaacgtcgtcaacttgttaaaaacaaaccagatatttctcaaatttataacttgtatgattttgaatttgttgctcgtcatactatggatccaattggttgggcatattatctgtcactggcagatggtgaagctacattcagattaaatactggaagttatcaaagaattttttttaaaccaagagtaatgattgatgttactgaaattgatacatcaacgacaatgttgggaactaaagtttcagttccattttatattactgctacggcattaggtaaattaggccatcctgatggtgaaaaagttttaacccgaggagctcaaaaacatgatcttattcaaatgatccctacgttggcttcatgttcatttgatgaaattgttgatgaagctaaaccaaatcaaactcaatggtttcaactttatgtcaattcagatcgtgaaattacgaaaaagattgttcaacatgctgaagctagatgtatgaaaggattatttattacggttgatgctccacaattgggccgaagataa

SEQ ID NO: 3169 - DNA, 2241 bp, Candida albicans
agcaaaatggggtgggtattgttgcccatgccaagcgacgatgtgtcgctacgagttaaatctgaaatatcgcaaaaattgtcggcagactacgattgtgaagcagtgttcccagacgatgttacgtttgaagggcattacaagtctttctgtaaacaaatcttgtggccaacattacattaccagattcccgatgatcctaaatccaaagcgtttgaagaccattcgtggggacactatgtgctaatgaaccaattgattgcagataaaatagtggaaacatacaacgacgtgaatgatgaagagacaactgtatggattcatgactaccacttgttattagttcccaagatggttcgcgacaagttgcctaatgcaaaaatcgggtttttcttgcatgtgtctttcccttcttcagaagttttccgttgttttgctcaaagaaaccagttgttggaaggtatgttgggcgcaaactcgataggattccaaaccaacgaatatgttcgtcattttttgcaaacgtgtaatcggttgttattggccgatacaagtgaactgggagtcaattaccagggcaactttaccgtgacaagcacaatccccgttggtatagatgcctattccgtgagagaaaatgtccacacagaacaagtcacagaatggcggagcttgatcaaggaaagatggaaagatcagcatttaattgtcagcagagacaagttggacaagttaagaggaatcaagcaaaaacttttggcttacgagatgtttttgacagataaccccgaatacattgaaagtacagtattaattcaaatatgcattgggtcagctcaagatccggattacgagctggagattatgaagattgtttcaagaatcaactcgatgcccgagaacatttcggttacacagccggtggttttattgcaacgagacattggttttgatcagtacttggcgttgttatgcgaggcagatgtttttgtggttagttctatgagagagggcttaaacttgacctgtcatgagtttatcactgccactgaagataaaaagtctcccttgatgctttctgaattcacgggatcttcgaatttgttactgtgtaagggagaaggtgcaattttgataaacccatgggatattaaaaagttttcggaaaccatcaagaccctgttgacaatgcctactagtgaaaaagagttacgttggcacaactgcaatcaaattgttcttacgcatgattcgaaacattgggttaccagctgcttgaattcaattgtgaactcttggaagatcgatcataaaaagagtggcaacttagttccttttacaaaaaatgcattcaaagattggtgtagtgtgaatggtaagaggttgattattcttgcattagagatttcttcagcggtttcaaattcgagaggcaatagtgctggctctacatctggcaaggttaacgtgattgatccttcggggctcgtgagattattgtccgacttggtagaatctcaagacacttttgtttacttattgtcttatttgcaaaggtcggatttggacattatgttcaagagataccctcaaattggtcttattgcggaaaatggtaattttgttaaactcattggtgccaaaaattggatatcattagcagacaaagacgagttgaacagctggatgccagaaattgttaagcttgttgagtcaaaagtggaaaggttgccaggatcattttgtgaagctttagatgcaaccgttcgtttccatgctgggaaatctttttctgaagatcgagagagatctttggatacaatgggtgaaacaatccagcacatcaacacgttatttgagcacaatggagtacatgccactttggtgagaaacctggtgattgtgcaaaaggaccaaatcagtttgaaagccattcgacttgtactttcatgccacaactccaatctcgatcaaaagtatgtcgtgacccatataaacgagttccagcagcccatgaaggatgatattccttcaaatgaccatgaagttgctgctgtactttacagtggggggctcacctctattgatgaagcaaactacgagtatgtgaacagtttgaagaaagatatcggtaatactttgacagtaaccttaatatcgtcatcaaacgaggaaacaaagactgctgctacatacggagtaagaggtattaatgaattgctttgtatattaaatagttag

SEQ ID NO: 3170 - DNA, 1641 bp, Candida albicans
tgtgctccaagcttcccaagggttgttcaagtatttattgaaaagacaccaacatcaattgtaattggatacgatcacagattcaattctcaaagatttgcagagatcttagccagtgttgcactcactcaaggtgtgcacgtttattacttggggtcagttgcaaacttgtctgaagaaacaatgaaattgactaaaggtgatattgaaaacgatagttcaacagatagaggatatgtccatacgccattggttccatttgcaattgattactatggagcatcgggtggagtgatgatcactgcctctcataatccagcaaatgacaatggttataaagtatattatctgaatgggtgtcagattattccgccagttgataaagaaatagctgactctattgaagaaaatttgaccccatgggagggtgtttgggatgtgtatgataatatcaagaagggggtacaaaagggattattgtcacttgctggagatgaggttacaaaagagtatcttaagggagtgaaagagaagttaattcaagacaacaatttagatttcagttttgtttacacaccaatgcatggagttgggtacagaatattcaaagagtgtcttgatttattccatgccctgacttggaatgtggttcaagaacaagcagacccagatcctactttccgaactgttagtttccctaatcctgaagaaaagggtgctcttgatttggctattgaaactgccagaaaattgggttacaaattggttctcgctaacgacccagatgctgatagattcagtgttgcggtcgagaccaagggacagtggaatcaattgactggtaacgaaattgggtttttgtttgcaatgtatgtgattgaacaacaaaaggaacaagatttggaccgtgtatatttggtgaactcaacagtatcgtcacaaatacttaaggcaatggctgataaggatgggttccattttcaagatacgttaacagggttcaaatggattggaaataaagcaattgacttacaaaaagagggatttaaggttccgtttggatacgaagaggctattggatttatgtttgacttggtgcatgataaagatggtatttcggctgctacaatatttttgcaattgtatcagaaatggtttagtggtggcaaaatagatgttacagataaattagaagctgggtatgctaagtatggttggtttaaagattacaatggttattacagactagcagacatgtcaacattagataaaatatttaccaacatcagaggctcctttgatagtaaatccccagaaaatattggcgaattcaaagtaactagttggcgtgatttaacaattggatacgactcgtctactgtcgatcacactcccgttttacctgttgattcaagttcacaaatgataacagccctgttgaagttaccaggtaatgacaatgcagttgtaagatttacttgcagagggtctggtaccgagccaaagttaaaattgtatattgaagggaaatctactatcaatgaacagagtgctaaagaaattgctgttaaatgttgggagaccttaaaacaagaatggtttcaaccggagaaatataatttgacagaagttaaaccgtaa

SEQ ID NO: 3171 - DNA, 612 bp, Candida albicans
aaaatgtatttctctgcccaatggtactttgaacacgaatggtcaccgaaaatgaaaaaacgcaaggcaatatcttccgattaccagctttggttgtatcacttccaaaaatacacagaagaagattatgtctatcaggttgcactatatttgttgatatggggtgaagcaaataacgttaggtttatgccagagtgcttatgctttattttccaatgtgcgttggattgtaatggtcccaatcttcccaaattcaattatctaaaccgagtaataacacccctatatgagtttatacgagaccagctatactgtaaagtagacaacaagtggaaacggcgtgaaattgatcatgcctgtaccattggatacgacgacattaaccagctattttggagcccagaagggttatacaaattaattctttatgatggaactagactatatcaattaccacaagccgaacggtaccacaaactagaaaccatcaattggtcaaaatccttatccaaaacttatcgagaaagacgaacatggatccatgttttgagtaacttcagccgcatttggatcattcagttcttcaccaacagggctggaagacccgcgtcc

SEQ ID NO: 3172 - DNA, 1089 bp, Candida albicans
tcttcacggcttttgaaaacttcgtctaacgagaatacttggaataaaccaaaattagtttcttatgatagaaaacaaatcaatcctcatgatgttgttcttgaaaatgaagtttgtggattatgttattctgatattcatactttacaatccaattggggtgaatacaatcgtgatgatttagttgttggtcacgaaattgttggtaaagtcattgctgttggtgataaagtcaccgaattcaaaattggtcaacgtgttggtattggtgctgcttcatctgcttgtcgtgaatgtaatagatgtaaatctgataatgaacaatattgtgctaaagctgctagtacttataatgctcctgatgtcagatctaacaactatgtcacccaagggggttattcatctcattcaattgctgatgaacaatttgttttcccaattccagatgatttaccaagtgcttatgctgccccattgatgtgtgctggtatcactgttttctccccattgttacgtaacttgggtagtgatgccaaaggtaaaactgttggtattattggtattggtggtttaggtcatttggccttgcaattggctaaagctttaggtgctaaggttgttgccttttcaagaacctcaagtaaaaaagaccaagctttgaaattgggtgctgatgaattcattgctactaatgaagaaaaagattggtcaagcaaataccatgacacttttgatttcatcttgaattgtgcttcaggtgttgatggattaaacttgcaagattatttgagtgttttgaaagtcgataagaaatttatttctgttggtttaccaccagccactgaacaatttggtgtttcaccattcactttcttgaaacatggtgcttcttttggttcttcattattgggatctaaagttgaagtattggaaatgttgaaattggctgctaaacacaatgtgaaaccatggattgaagaagttccactcagtgaagaaaactgttctaaagctttgaacagatgtcatgatggtgatgttagatacagatttgtgtttactgaatttgataaagcttttgcaaagtaa

SEQ ID NO: 3173 - DNA, 1149 bp, Candida albicans
  unsure (859): Identity of nucleotide sequences at the above locations are unknown.
gacgcggattttccagcccttggggaagaatcagcggccagtgaatcttctgtcgagtcatcatcagccagtgaatttgttgtaccatcttcagctactgaaacctcagttagtgagtctgctagtgaatcttctgctgaaccatcatctgctagtgaatctgttgctagtgagtctgctgttagtgaaacctcagccagtgaatcagctgcaccatcatcagccagtgaaacatcagttagtgagtctgctgcttcatcttcagccagtgaactgtttgccagtgaatcttctgttgaatcatctgctgttccatcttctgcttctgaattttcaactagtgaatctgttgctagtgaaaccccagctagtgaaaccccagctagtgaaaccccagctagtgaatccgctagtgaacaatcttcaactagtgaatcatctgctgaaatatcgtctgccagtgaatcttcagctgaaccatcatctgctaaatcagctattagtgagtctgctagtgaattttctgctgctccatcttcagccagtcaatcttctgctagtcaatcttcaaccaatgagtcatcttcacaacaatcttccgctgaatcatcatctactgggacatcttcagttagtgcttcagcagcaacttctgaatacactgccacctggactaccaccaactccgatgggtcagtgtccactgaatctggtatcattagtcaatctggttcttcatttaccaccatcaccacatttgttccagatgctacttctgaatacactaccacctggactaccaccaactccgatgggtcagtgtccactgaatctggtatcgttagtcaatctggttctncattcactaccatcaccacatttgctccagatgctacttctgaatacactaccacctggaccaccaccaattccgatggatcagtttccactgaatctggtgttgtcagtcaatctggcacatcattgacaactatcactacatttgccccagatgtcacttctgaatacactaccacctggactaccaccaactccgatgggtcagtgttcactgaatctggtatcgttagtcaatctggttcttcatttaccaccattactacctttgaacctcctgttgtatgttag

SEQ ID NO: 3174 - DNA, 1839 bp, Candida albicans
tcaagtgccccaccgtcaagtacacaatctctgtttactgctgaaagctccaatagtcaattatcatcaactacacctagttcaagtactgaagcttcatctacagttccaagttctagtagccaattgtcttcgagtgttccacttacaaatagtgtgtcattgtccagtgtttcaagttccgataatggatcctcctcagcaagctcaccttcaagtagtcaatcatcaattgcctcgacagctgagtcttcgtctacttttccaagctcaagtgaccaacaatcctcatctattcaatcaccaagtagtcaagagtcttcggtatctctgactccaactagcagcttgcaatcttcaactaataccatatcaagtagtcaagactcttcctcattctcaccaacaactagtgataattcgtcaactaactcggcttcatcattatcaacactcagtagttcagatacatcagtatctaatccatcaactagtaatgtatcatcaactgataatactcaatctagtgttgcatccgcaacaccaacagattcagcaatttctgctacttcatctgatatcactactgaattcaccactacctgggaagtaaccaacagtgatggatctgtttcaactgagtctggtattgtcagtgaatctggtacctcattcaccacgatcactacgttcccaccaccaaccacctcatctgatatcactactgaattcacaaccacatgggaagtaaccaacagtgatggatctgtttcaactgagtctggtattgtcagtgaatctggtacctcattcaccacgatcactacgttcccaccaccaaccacctcatctgatatcactactgaattcacaaccacatgggaagtcactaacagtgatggatctgtttccactgagtctggtattgtcagtgaatctggtacttccttcaccacgatcactacgttcccaccaccaaccacctcatctgatatcactactgaattcacaaccacatgggaagtaaccaacagtgatggatctgtttccactgagtctggtattgttagtgaatctggtacttcattcaccactatcactactttcccaccaccaacctcatctagtgttgctgccgatgttactactgaattcacaaccacatgggaagtcactaacagtgatggatctgtttccactgagtctggtattgtcagtgaatctggtacttccttcaccacgatcactacctttgaacttccggttgtatgtaagagagatgatatttcatgtggacctgcaacctcagcaacaaattcggacactgcagcacaagatcccacaagtgatgccactgcaattgaatctgaattcacaaccacttggactaccaccaactctgatggttctgttgaaactaattctggtgttgtcagtcaatctggttcttccctcaccaccatcaccacatttgcaccagacgctacttcagagtacaccacctcttggaccactattaattccgacggctcagttgctactaactctggtgttgttagtcaatccggtacctcattcaccactattactacctttgaacctccggttgtatgtaagagagctgatatttcatgtggacctgcaacctcagcaatgaattcggacactgcagcgcaacaattaacaagtggcatgactgcaaccgaaactgagtttgcatgtacgtgggtagtcacaaagtcggatggatcggtttttagtgagtccggtattgtcggtcagtccggtacatcttcaccacggggctggaagaaaccgcgctacaaacaagagaggcgg

SEQ ID NO: 3175 - DNA, 477 bp, Candida albicans
ggccgttgtgaagaccagccagccacttcattagttgttcccccttatagtgtcattgaaactgagtttacatcaacttggaccaccacaaactcagacagctcagtggctactgaatctggtgtggttagtcaatcagacactttattaacaaccgtgactactttccctcctgcaccatctgctattgtacctgaattcacatcaccttggaaaatcaacacttcaattgagtctaatgaaacattaactgttagtgccagctcatatgagacagtgggtgaatcattggctgctgctacctcatcatccttttcttctgctactgttgttgttgctccctcagaatctgaaatcaatactagcagctcaatattgaataatgaagaaattgcttctgcttctgctccagtctccgacacaacgtctattgctgaacaccatgatggctcattatccatgaccacaactgaattt

SEQ ID NO: 3176 - DNA, 435 bp, Candida albicans
acaacttttataaaacatcaacaaaaaataataatgttgttaatatttttgtcgttactactaccagtatatgctgacagttggagtaaattgggatgttactcttcgataagtgtggccgaatcaaaaggaagttacatgtaccaaagttcgggatactgtgaacaacaatgtgctgggtatagagtggcagcattaaagaatggtaacgaatgttattgtggtgatgtcgatcctacttctcaaagtaatggatgtaatatcaaatgttcaggttggcccctggacacttgtggtggaagttctgcctatatggtgtacattaatgccgacgctgattcccaggcacagtcaagttcaacgtcatcaacatcaacaagttcaacatcatcatcaaaatctacatcatcatcaagttcatctacctcttcatct

SEQ ID NO: 3177 - DNA, 1182 bp, Candida albicans
  unsure (1176): Identity of nucleotide sequences at the above locations are unknown.
caatttttgaaccctgtcacttcattagctgtgccgtcatatactgtgattgaaactgaatttatttcaacttggactacaacaaaatctgatggttcaattgttactggatctgggattgttagccaatcaggtacatcgttaacaactttaactacctttgctccatcatcatcatcatcatctgaaattactcctgaatttacttcaacttgggaaattagctcttcaaatgagtccaatgtggttgaatctagtatcgtcaatcaatccaatgaaagtttgactaatagtgttagttcatatgaaccagccactgaatctgctattgttagcccatctgatcaagtattgactagtagtgctacctcatttgtatcagccagtgaattttcagctgttaccactaccactaccactgtcgattctgcttctgcttcttcttctactgatataaacaatggcgtcaccgttcttgtttctccatcagaatctgaaatcaatactagtagctcaatttggaataataaaaacaatgcttctggtgccgtttcaacttcagaatcaacttctactactgataatcatgatggttcattatccatgaccaagacagaattggaaataaatgggttttattcaactgaatcaagtactatgtttgtcactgctactatcactagttgtaacgaatctgattgttttgaaaatgttgtaacttatgtttcaaatgattcttataccaccgttactactggacactccaatgataacacttctgttgataacaataatgttcctagtactttgattgaaaatgtttccaatacagagactatcccagttgtaaccaatactgaggaagtttctactaccgtttataatcctttaacttcaacttcaacttcaaatattgttgaatcaagcaacacatcaattgttgataatgaaaataatggagttcacatcaattccgatgatatgactgctatggtaactgcagttgaaaccggtaatggtattacaaatggtacaaatttcgtttctccatcaactattcctaatgaaatttctgaaactggatcacctgctacttctattgttggtactttgccatatgaaaatggatctaatcaattatcaattgaaaatagttttcaaaccgccgtagagatncatgtc

SEQ ID NO: 3178 - DNA, 1824 bp, Candida albicans
gaagtaccacaatgtcttaataagaacaacgacaaaccgaagagaaagcattgttgtattgataatgatggtaaagtattgtacccaaaaccttgttctgtgacatctaaaggtctgactaccaaaactggtgatgataccattataccaacgtcactgattacaacggactcgagtagtacaacagctactagtacaattgatgatgttaagaaatatcctcaatgtttcaacaagaagaacgacaaaccaaaacgaaaacattgttgctttgataataatgatagagtgttgtacccaaaaccttgtactataacttccgaaagaacagcttcaactacagctgaaaacactacggaatcagaatcaagttctgcaactaccttaccagattccactactgaatcagaatctgtctcctcgacttttacatcagatgacaatatagaatcagaatcaatctcttcaactaccacatcagacgctagtgacagtactgaaactcatgatatcaataggtatccccattgtttcttcaaatatagcaatcagcccaacaaagatcgttgctgctttaacagtcggtaccaagtgttgtacccatggccatgtgatggttcatcccagagtacaactacaacagtactgataagcattagtggaaccgagtcatcatctgtcacaactactttcgatgaaaatcttggtacttcgagtgagttaacgatatcttccagtagtgaccttatttccacaagccaagatatacctcaagctactacaattaacaattccactaccagtattgaatcatcagcaaatggaagcacacttccgttgacccaaccaattttatcagtatctgaatttgagtcctcagtaagtgatgctactaattcaaatagcaatagcaatcctacatttaccgcggaaggtggtcattcatctgatgaaatgctcacaacaactgacaaaaataactccttaactagtaaatcggttgctactccaactgagactagttggctcaatagtgttgctggtacctcgagcaaggaagatatgagaacatccacaggaaccatcagctcatttagtgaagtagctactactgaaatgatatcttccccaagtgaaactggtaacccaaagaaatccagtgcaattgattatggaacgaatagtgatattacaacactgacaggtagatataccagcttaagggataaaactgtttcaactcttcaagaagatgcaggcattgaatcaaccacggttgaaggtattacaaaaactgtacacacaactgtttatgttaccacttcccctgataactcgattacgactgaaactgctgtggttgtagttgtaaccaacgactctactgctacaacctatactgaaatcattcaaactactgtcgttgaaggcaaaacgttgacaactgctattccaatccctcaagatgaaatcaacaaaataaaagtgatagaatacagtactatacttccaaccactttaccaaacggccaagtgactagtgtcattgaaaaagttgcagttgccgtcaatggtcaaggacaaaaagttacaaagacggctccaattgaattgggtgcttatactacgaaaggttttgaaatcattcaggacagcaatgatattggaaattcagtagcagaagggtataatccatctgctgggcttggtggctcaactctagttgctccgatagctgtcgtttcaaatgaaaattcggcgtcattgcctaaagttaatctgttattagtcaaattcttgcttttggtattattgattgtttaa

SEQ ID NO: 3179 - DNA, 2226 bp, Candida albicans
caagtaagggatcaattacatatgtttatttcaacatcaccaagtataataccttccaatcgctttgatatgttagatcctactgatcataaccaactgtttaacaatactcaattttccattcatgaatttgaagaacaacaagactttgaatctcagcaacaacaacaaccacctcaacaacaacaacaacaacaacaacaatttcaggaacaagaatccatttttaaagaagatgatgattcattgcaacaacaaatgcagcagaacttcccattgtttcaatatcaacaaccatttatgagcactaccaattatttattggacgagtctgttcaagaaaatgatgacaattatcagttgttaagtggaggtgatcttgacagtacctcttcattcactaccaattcacttgccaatatcaagagcaatagtttatatggaaattcagtcaatgtgaatttaggagcagttccaactaacttgagtaatccagataccataattgctggtcaattatcttcatctgtttcctcctcatattataacaccccttttaaccaacaacatcaacaacaagcactgcaaattaaccaaagtttgcaaggttttcaaccatttcaattaccaaacgactcatcaacatcgtcatcattatattcttatactagtgctagtgctagcgctagtgctccccaacagcaagtacattcaagacaagaacaaatgaacactggatctagttttggatttagtaacacaccaactcaatctacttttacccacacttcttccaatacccctttacaacaacaaaatgatttatatccagtttcaacttcgatgaattctttcttggacaattctaatcttgtttaccatcaagcaaagccagagatgtcacctagtgtgatcaatccaattgttcaacaacaagcattaaactataatttgtctcaaagttttccaaaaccaccattatcctcaacatccacaacttttgattctatcaattataatagttcaccaactatttctcaacctcagttcacatcccaatcattaccaaacttatcatcgggtactgcaggtaagaaaaaaccttccaaaagaaccaaatcaagaactccaaccactatctcacgtccagttcctctgaatataaagaaagaagaaaccaacacttttaaagtcaattctcacagtattgtcaaacaagaaaatgaattatcttcaacaccaggtggtaacaaaagataccgtgtgatacgaggaatatctgctggtggttgcaatactagaccaccaaaagaatcaatggagggtaaggcttgttattactcgatgaatctaaatttgaatggagcatcattaaaagatatttgctatcctaaatggaatcaatcagaaaaacaagatcgaagaagaatcatacgtattgagagaattcaacaaggtcctgtaatcactgccaatttctccattgttggtgctgctaatgagaaccctgtggttctacctccatcaaatccagatattgatgtcattgaagtgtcctgtttggagtgtgatgtgaagataaacaatagtcatatatcggaggggactaacttttacgattcacaatcatcggacgatgaaatgggtggtaataatggtgatgctgctggaatgggtggtgtaggtgctaaaaaatcacctaattatatcaagaatgagttcaatgatgattattatcaatattatattacatcagttgaagtggttgaaattgttgaattattgattggtaatcaatttagagatgctgctgaaagaagaaaagaaaggggcagagtcagatctaatttagttcccttctggtcaaagaaaccaattagttcaagaatgagtgaaacctcaacttcatcatcatccccacaaaactcttctgtaactcccggttcgagttcaagtgcactggggacaacaactactactgctacagttggtggtgctgggtcatcattaaccaaccatgattatcgtgttgagttggctaaaagaattatgggttatgaaattagaaaaccacgaggattcgataaagaagttagaatattaagatgggataaattggtgccagctttgcaaagagctttacaaagttactacactgaaattcctattaatgatccttatgcacagttatacagaactgaagccccagaaactcgcaataattaa

SEQ ID NO: 3180 - DNA, 1125 bp, Candida albicans
ctaaacacagatacctacttatacataatcaaatctttccttcccatcatggtaaaactacctttttttacaatcgttgtgtcaatattttacaccagttcattgttggtttcagcagcagattatactgctccagcctcaaatttgggttgttattcttcaatatcaggtggtgactccaaaggtgattatacttatcaaacatcaggatattgtgttaataatgaatgtcccaactcaccatacgttgctgttaaagggaaagaatgtatatgtttgaattcattaccacaatcatcatctaaagtgagctcaagtcaatgtgatcaaccatgtcctggttatcagtcagacatgtgtggtggatccaatgcatacaatatttataaaggtttagcaagtgctagttccagttctagttctaatatggggagtgcttcatcaagctcgccttcatcatctggatctccttcttccagtcaatcatcttcaataactggatctcctaacaatagcgatgattcagatcaaagtacggcgacagttgtatcaactattagtaattcaaatggtaatgttatttataaaacaattacacaggaagcatcagcaactacttcttcaggatcttcatctcatgcttcgacaacttcatcatcatcatcaacttcaacttcctcatcccactcaagtgactcccctgatgggaaatcagaaaagaaatcatcatcagttggtgccattgtaggtggagttgttggtggtattggtggtttaattctactagttgctggtgggttcttttatatgagatacagaaataatgatgaggatgaagatgaagaagaagaattttatgataataaacctcttaaacgatcaaatggttccaagattggttctaggagaagtccaaatgctttagaaatgccaatggctaatcctttccaacatccagccgatgatttagtaagaaataatagtgtacaaaagaatggatttgttgatcctcgattaaatccaataatgatgggtcgaagaagactaagtgaaggatcactagttgatgaagcagattattctcgaaaagtactacaagttgctaatcctgatgatacaaaataa

SEQ ID NO: 3181 - DNA, 1059 bp, Candida albicans
ccaatagaaatttatttaataatgaccatttcaaacagaccaaaagttttaagattaggcaaaatagaatttgctcaaaaaaaatgggacgaagttgctcagattgctgaagtcattgattgtgaatcgcagaaccgtgaagagttaatcaaggacttgcaaaccaagtacagtgatatcaccaatattgctagaacatatgcatctgttgaacaaactggtagatttgatgctgaattggctcaacacatgcccaaaaccttggtttccctcagtcataatggtgcaggttatgatcaaatagatgttcaaccttttaccgacaagggcattcaagtttccaatgtcactgttccagtggaaggtccaactgctgttactgctgtgtttttggtgttgtcgtgtttgagaaactaccaagaaggacaccaaatcttgtatgatggtggttgggatagcaaaaaatgtggaggtgctaaattgggccatagtccggaaggtaaagttgtcggtatcttgggtatgggaggaattggtagagctatcagagatagattgaagccatttggattcaccaaaatactttatcataatcgtaagccactcagttctgacttggaaggtggtgctgaatacgtttcaaaagaagatttgttcaaacaagctgatattatctgtatcagtgttccattgaatgctcacactaaacattccattaacaaggaggctatcagtcaaatgaaagacggtgtcatattaataaacactgctagaggtgctgttattgatgaaaaagaactccctgaattgcttaaatcaggaaagattggagcctttggtgctgatgtgtttgaaaaagaaccagaagtgtcacctgaattgtatagattgccaaatgttgtcagtttaccacacatgggtacacacacttacgaagctatcaaggatatggaagattgggtcgctgaaaatgtggagtcgtgtttaaaaactgggaaagtgaaaaccattgttccagaacaatacaacttggaaattaaacaaggtccattagtttaa

SEQ ID NO: 3182 - DNA, 501 bp, Candida albicans
atatttatcatgtcttcaattttcaaactatcaactcgtacaataatgacctccaccactactaattccattaaaccaaaagtgttgagattgggtatcactcattatgcccaacacaaatgggatcaattgagtaaaatcgccgagataattgattgtgaatcaactaatcgtgaagagttcattcatgatttacaaaccaaatataatgacatcaccaatatttctcgaacttttgcttcaatcaaacaaacgggaagatttgacaatgaattagctaaacatatgccaactactttaaaagccattagccattgtggtgctggatacgaccaaattgatgtcacaccattcacggaaataggggttcaaatctctaatgtcactgttccggtagagggcccaactgctgacacggccatatatttggttttagcatgtatgaagaattttcaaattgttaacaatatgttagtcaatggagggatggctccatactga

SEQ ID NO: 3183 - DNA, 492 bp, Candida albicans
gtgataggattaaaaccatttgggtttgggaaaatagtgtatcacaatagaaatagattatcagaagaattagatgctgaggcagagtatcttagtatggatgaattgcttaatcaatcagatattattattgtaagtgttccattaaatgctcatactaaacatcttgtcaataagtctttaattgaaaaaatgaaagacggggttattttaattaataccgctagaggtgccgttattgatgaaaaagtgctccccgagttgatcaaatcgggtaaaattggttcatttggtgctgatgtatttgaaaatgaacctgaagtatcacccgaattgtatgagttacctcaagttgttagtttaccacacatgggtacatatacagttgaagcagttagaaatatggaaagttgggttgttgacaatatcgaatcgtatattaaaactgggaaagtgaaaaccattgtaccagaacaatataacgccttttaa

SEQ ID NO: 3184 - DNA, 1095 bp, Candida albicans
ttgtatcattctgctgaatcatctgacaattgggaaaatatagcaatttttaacttaatttcgacaatgacaacaggtacatctaaaccaaaagttcttcttgtaggggaatttatttattcaaaacagaaatggtctgaattagaagaaattgcggaagtaattcaaagtgaatcaaccactcgagaacaattcattcaagatttgaaaacaaaatacaacgacatcacctgtattgcacgtacattttattctattaatgaaaccggacggtttgatgctgatttggctcagcatatgccacagaccttaaagtcggtcagtcattgcggtgctggttatgatcaagttgatgttgagccatttactagattggaagttcaggtgtcgaatgtgactgaaccggttgaaaggccaactgctgatgtggccattttcctagttttggcatgtatgaggaattttctacaaggtcgtcagattttgatgaatggtgagtggccatcaaacggggacaaggaggctgcaggtgctcctcttggacatacacctcaagggaaagtggttggtattttaggtatgggaggcataggcagggctattagagatagattgaaaccctttgggtttgacggaatcgtttattataacagaaaacagttgagccccgaattagaaaagggagctgaatatgtcactatggatgaattgttcaagcaatccgatgtaataatcattggggtcccgttaaatgctaaaacaagacacttaatcgacaaggaagccattcagaagatgaaagatggtgtggttttggtaaatatagcaagaggtgcaattatagacgaaaaacatcttccagagttgatcaaatcaggtaagattggggcttttggtgcagacgtatttgaacatgagccggaggtgtccgcagagctagttaatttgcccaatgtggttgctctccctcatatgggcactcattctgttgaagcgcttacaaatatggaggaatgggtagtttgtaatgtggaaacgtttatcaaaactgggaaattgaaaacaatagtacctgaacaacaaggaatattttga

SEQ ID NO: 3185 - DNA, 744 bp, Candida albicans
cccaccgttttaacatatacacacaccaatattatgtcatttgattcatttggagattatgctaccattgttgtttttggtgcttcaggagatttagctaaaaagaaaaccttcccagcattatttggattatttagagaaaaacaattaccatcaacggttcaaatcattggttatgctagatcacatttagaagatgaagaatttaaacaaagaatttctgcacattttaaaggtggtgatgaaaaaactaaaactgaatttttaaaacttgtttcatatattagtggaccttatgatactgatgaaggttataaaaaattagaatcaagatgtcaagaatatgaaaaggccaataaagataaaaatgatagttatactcccgaaagattattttatttggcattaccaccatcagtgttcactactgtttgtgaaaaagttaaaaaaaatgtttatccaccagaagaaagtaaaggtaaacttagaattattattgaaaaaccttttgggcgtgatttagatacttatcgtgaaatgcaaaaagaaatttccccattatttactgaagatgaaatttatagaattgatcattatttaggtaaagaaatggtgaaaaatttattggttttacgatttggtaatgaattatttagtggagtttggaataataaacatatttcttcaattcaagtttcatttaaagaagctgtcttcaccacgcggctggaagatccgcgtcgc

SEQ ID NO: 3186 - DNA, 243 bp, Candida albicans
tatttaggtaatcattctaattttgttagagatgatgaattggatatttcttggaaattatttactccattaatgaatgccgttgaagatccagctaaaaaatttgaattacaatattatccttatggttcaaaaggtccaaaagatttaagaaaatatttgaatgaacatggttatatatttagtgatccaggtacttatcaatggccattaactagtcctaacgttaaaggggagatttag

SEQ ID NO: 3187 - DNA, 210 bp, Candida albicans
ccagtcaccaaggggatgtttaaagaaattcaaagaaatgaattagttattagagtacaaccaaatgaagccatttatttaaaaattaattccgaaatccctagaatttatactgaaacttcattaactgatttagatttaacttatgctactcgttattctaaagacttttggattcctgaagcttatgaagcattaattagagattga

SEQ ID NO: 3188 - DNA, 333 bp, Candida albicans
acgaatgtcattgattccataacatttattcccaaagacatgaacaataagaaccaatttgaaaaggataaggtaattgaccttgaacattgccattattatgttgataattcacaactcaacagttacccacaattagtctatccaaacttgtctacaactggtaaatgggaggtaatcacatgtaataaaatgttagatccaaatgagaagcatagcacaattggaaagttattgtatgttcctacgtggctaagagggataattccgtatgatgttgggtatatggagttttgtcttttgaaaaaacaagacatagaagatacagtgtaa

SEQ ID NO: 3189 - DNA, 1002 bp, Candida albicans
gggggatatccacccgtgggggcacaatttatacaaaggagaattttgcatcaaatgacaacagaaggtgattccaatgatccagactttgacgatgaacgtgatgtaaaagagaaaaacttccaacaagcaggtatatttactagtaatatgtatttggcagaagatagaattttatgttttgaattggtggccaagaagaatcataattacattttacgttatgttaatgaagccaaagctgaaactgatgttcctgaaaacattgatgaatttgtcttgcaaagaagaagatggcttaatggttctatgtttgctgctggttatgctgttttccattggacaaagatttggcgttccaatcattctttgtttaggaaattatttcttcaattggaattttattaccaattagttacaattttggtgtcttggttttcattagcaagtttctttttggttttccgtattttaactgctaatttagggtctagtgacatgaatttcaatgttggtaaatatcttgccattatatttttatggttttatgttgggtctgttgtttgtacttttgttttagcatttggtaatacccctaggggaacgaggaaattctatcttgttattgctgtgttttttgctattttaatggcgtatatgatgtttgctgcaatctttttggcagtgcatacagtcaattcgattgttcataatcacaagactgatttcactattgccttagtgtttacaaacaccaaattccgtgatttggtggtatctatggtgtccacttatttgttatatttcattggagcatttatgtatggggaacctaactttatgtttacttcgtttgctcaatacgtgttgttatctccaacctatatcaatgtgttgaacatttatgccttttgtaacattcacgatgtcagttgggggatcaaaagggttgaacaagccaaagatttggggtcagcaaaatctttcggtaaagaattctga

SEQ ID NO: 3190 - DNA, 342 bp, Candida albicans
agacagaaaaaagacgatttggcttactatgcatttattagaaccattacggtgttggtatggatgctcactaatgctattttgattgctatagtgttagaagctggtggagtcgatattttaagtggtaataaatcaggtcaaacgaatgctgatggatccatttccggtaattctcaagtatttttaacaatcattttatggattgtcgctgggttagcattgtttagattcattggagcatttttattcttgatattcaagagtttccgtccacttaaatggaaattgagagctaaacgagaaaacaaacgtaatagaaatcaaaatagaaatgtctaa

SEQ ID NO: 3191 - DNA, 867 bp, Candida albicans
taccctttattcaacaacaaccgaaccaaaaagtatagaactccaactagctccaattcaaactcctcatacagtactatggttgataatgatgaattccaattgctgaggaagaaaactgttgctttcactgaaccagagtatcctccattgacttattccccgggtaaaaaaagagatactgccaccagtactaatgtatatgactatgatttagaagaaatggatgatggttctcttgttgccagcggaggtagtggtggaatacatgctgattttgctggtgacgattatatcattaatcctttgcaagatgctgatgatgacgattcattggatccatttggtgatgacgaatctttgttcctggacactggtgaagagattttgagacgtggtaccaccatcaagaagagacattctactcgtcgtggtcgtagaaatgggacattgaaaaggggtaagagtagaaacactgaatatggtggagaaaatgaaaaacttgtcaacaatgacaatggagatgaagaagatggcgatggtgatgatgatgacgatgatttcaagccaaaattaacttacaccaaaactatcaagaaagctaaattgattaatggtaattacgtaattgatgcaccagttccaaaaacgttattggaaacttatggtaagaaaatcaattatcatcaagataatgtatctagagagatgtcattcgttaggtatacagctgctacgtgtggaccttctaattatgttaaatttaactataacttacgtcaagaattatatgctccttctcgacaaacagaaataatgatttgtatcaccatggtctcaccagggctggaaggtccgcgtaccccc

SEQ ID NO: 3192 - DNA, 888 bp, Candida albicans
  unsure (283): Identity of nucleotide sequences at the above locations are unknown.
ttgaaaccattcccagtgtttttccaaatggatgaaattatttatcaattaagagaacacagtgccggtttgaactgtggtagatgggattacattttctcctacatcaagtgtttgagaaaccacccagactttattttgcctgatagatcccaagtcactatggctgctccattcatgtcctcatacgttaagttgttggtccacactactcacaagagaaaagtccatgcacttggtggtatggctgctcaaattccaatcaaagatgatgaagaaaganacagagctgctttggccaacgttactaaagataaattaagagaagtcactcttggctgtgactcttgttgggttgcccacccagctttggttcctgttgtgttgaaggttttcaacgaaaacatgaagggtccaaatcaaatctcattgccaccaaaggaaccattcaagccaatcacccaaagagacttgttgagtccatttgttccaaatgctaaaattaccgaacaaggtattagagctaatatcattattggtatctcctacattgaagcttggttaagaaatgtcggttgtgttccaatcaactacttgatggaagatgccgccaccgctgaagtttccagaactcaaatttggcaatgggttacccacggtgccaagactgacaccggtaaagttattgacaaacaatacgttaagcaattattggatgaagaatatgctaaattggtcaagagtgctaaaccaggtaacaagttcaagagagctttcgaatactttgctccagaagctcttggtgaaaagtactccgatttcgtgacaactttgatttacgacgatatcactactattggcagatctttaccaggtgaaagattgtaa

SEQ ID NO: 3193 - DNA, 804 bp, Candida albicans
tgtcttcccccattcccaaaaacagctgataagatcaaaggtgtccaaatattaggccctgtcccagaaagtgctaaacacattttcaaccaagaaactttagcatttgttgccactttgcaccgtggtttcgaagccagaagacaagaattgttgaacaacagaaaggaacaacaaaaattaagagatcaaggtttcttgccagatttcttaccagaaactgaatacattagaaatgatgctacctggactggtccaccattagctccaggtttagttgacagaagatgtgaaatcactggtccaaccgacagaaaaatggttatcaatgccttgaactccaatgttgctacttatatggccgattttgaagattcattgaccccagcttggaaaaacttggttgaaggtcaagtcaatctttacgatggtgtcagaagaaacttgactgctaacattaatggtaaaaattatgccttgaacttggacaaaggcagacacattccaacgttgattgtgagaccaagaggatggcatttggatgaaaagcatgtattggttgacggtaaaccagtttccggtggtatttttgattttgctgtctactttttcaacaatgctcaagaaaccttagctagaggctttggtccatacttttacttgccaaagatggaacaccacttggaagctaaattgtggaacgatattttcaactatgcccaagactacattggtttgagaagaggtaccatcagagcttcagttttgattgaaaccattcccagtgtttttccaaatggatga

SEQ ID NO: 3194 - DNA, 843 bp, Candida albicans
atgtatatatatcccccatgtggtaccgagtttttaatcaaacaagccaatttaaatcaacttcgatctaataaattattatacttggcacaattccgtcctgaaaagcgtcatgctttattattaaaagaatattccaattttttatcaaataatttccccaatgtgactcaaatcaccaacaaattccctacattagtatttgccggatcttgtcgaacggctgatgatactgcaactttgaaatttttacaagaacaagttgccaaattagatttatcaagatttgttgaatttagaattgatatatcttatgatgaagtggtagagttattatctagttgcaaatttggtctaaacgccatgtggaatgaacattttggtattggagtggttgaatatatggctagaggatgtacccccattgttcatgcttcggcgggtccattattagatatgataggaagaaacgaccaacaagaaaattgtttgaacaattggaaaactgatggtggatttttctttaaaagttatgatgatcctgatcttgatcccaatttacaaaaaaatactgaaactggttatattaaatttgaattatttgatcaatttattgattatcctacatttgaaacattattaaaagaattatatgtcaatgaccctacaattattgaagattctaaattacttaaaatgagacaaatcgatcaaaacagagttgcagaaaagttttctaataaagcgtttaataaaaaatggattgaatatattaatgatttgaatactttagaaaaacagtatagagaagagaaacggactaaagttgaacaagtttattga

SEQ ID NO: 3195 - DNA, 780 bp, Candida albicans
acaatgtatttaatactattggtggtattggccgtatatgtcacatataaactcataacaactgtattaccacatcatttactcattcctagtcaaaattggcgagagaaaatatcatacgttgttaaatatccaaaaccaatttatttaaaagttggaactaaacgatcaagttatcgtcgcagattgattttagccagtgaaaatcctgccttttatactaattttatcaataataaattgaaaatatcacctaatgattgtgaaaatggagatggatttcttaatgaaatgagtagaagagatattgatgatccaaaacgtcgtattatttatggatttttccatccatatgccaataatggaggtggtggagaaagagtattatggcaagcggttaaagcaacattattagctgatgataagaaaattggtgttcattataccacaaatattgaagctcaaccattagatattttaaacaaagccaacaaaaaatttcaaattgaaggattagatcattcaagagttgtgttcatttatttaagaaaatttaataatttgattgatggcaattattggaaacattttacattgattggacaattaattggtgggatattattaagtctggaaaccatttatgaattatcacccgatgtatggattgatactatgggattaccaagtagctatttacttgtctctctttcattgaaaataccaattcttgcctatactcctttccccatattacaagaagattgtgtggtaaattaa

SEQ ID NO: 3196 - DNA, 378 bp, Candida albicans
gttggtattgatttatgcttggtcagagaaagcactgaagatgaatatagtgtgctagaaaatcaattccatccaggtgctgttgaattcttgaaaattatgacaaaatccaagtcctacatatttgttgaatacgcatttgattttgctttgaagaacaacagagaatttgttactgctatccacaaagctaaattcttagaattaggttatggattggttaagactactttggtactgtggataatgcttttatacccgctgttcccaatccgtgacaattcattgttttggtcatatggttttatcctatccaacagtggtgctgcattaatagatgtcttggatttggttccagtgctagcttttggtagatga

SEQ ID NO: 3197 - DNA, 189 bp, Candida albicans
gttggtattgatttatgcttggtcagagaaagcactcaagatgaatatagtgtgctagaaaatcaattctgtccaggtgttgttgaattcttaaaaattatgacaaaattcaggtcctatagatttgctgaatacgcatttgattttgctttgaagaacaacaaagaattggttactgctatccactaa

SEQ ID NO: 3198 - DNA, 582 bp, Candida albicans
aactccattcgttctttggccacttttgcatctccagaagccgttttaccaaagaaatatggtggcagatacactgttactttgattccaggtgatggtgctggtcaagaaatcactgattccgtcaaacaaattttcaaatcccaaaatgtcccaattgactgggaagtcgttgaagtcagtggtgttgaaagtgaaaccggtaaaagtcatggtgttgacgaagctgtcgaatctttaaagagaaacaaagttggtttgaaaggtattttgtatacatccaccggtaaatctgccaaatcattgaatgttgcattgagaaaagaattagatatctacgcttcattagttttaatcaagaacattccaggtgtcaaaggtatttacgatggtattgactttgccttggtcagagaaaacactgaaggtgaatatagtggtttggaacatcaatcatacccaggtgttgttgaatctttgaaaatcatgacaagattcaagtccgaaagaattgctaaatttgctttcgatttcgctttgaaaaaacaacagaaaattggttactgctatccacaaagctaa

SEQ ID NO: 3199 - DNA, 528 bp, Candida albicans
aaaaacaacagaaaattggttactgctatccacaaagctaacattatgaaattaggtgatggtttgttcagacaaactgttaaagatgtcggtcaagactacccaggtattggagtaagtgatttgattgtcgataatgcttttatgcaagctgtcgccaaaccacaacaattcgacgttttggtcactcctaacttgtacggttctatcttatccaacattggtgctgccttgattggtggtccaggtttggttccaggtgctaactttggtagagaatatgctgttttcgaaccaggttgtcgtcacgttggtttagatattaaaggtaagaactctgctaacccaactgctatgattttgtccagtgctatgatgttgagacatttgggattaaacgatcacgctgacaagatttctaaggctacttacgatgtcattgctgaaggtaatgtcagaactgctgatattggtggtactgctactactactgaattcactgaagccatcatcaataaattggattaa

SEQ ID NO: 3200 - DNA, 309 bp, Candida albicans
gcatttgattttgctttgaagaacaacagagaattggttactgctatccacaaagctaaatttttcaaattgggctatggattggttaagactactttggtactgtggatcatgcttttataccagctgttctcaatccatgacaatccattgttgtggccgtatggttttatcctatccaactttggtgctgcattaatagatgtcttgggtttggttacaggtgctagctttggtagatgctgttctggttttgaccagattgccgtcactttactttggatatcaaagctaaaaattcagaattga

SEQ ID NO: 3201 - DNA, 1200 bp, Candida albicans
ggtggtatgagaggtatcaaaggtttagtttgggaaggttctgttttggacccaattgaaggtatccgtttcagaggaagaaccatcccagacattcaaaaagaattgccaaaagcaccaggtggtgaagaaccattaccagaagctcttttctggttgttgttgactggtgaagttccaactgacgcccaaactaaggctttatccgaagaatttgctgctagatcagcattaccaaagcacgttgaagaattgatcgacagatctccatctcacttgcacccaatggctcaattctccattgccgttactgctttggaatctgaatcccaatttgcccaagcttatgctaaaggtgccaacaaatccgaatactggaaatacacttacgaagattccatcgatttgttagctaaattgccaaccattgctgctaagatttacagaaacgttttccacgatggtaaattgccagctgccattgactccaaattggattacggtgctaacttggccagtttgttaggttttggtgacaacaaggaatttgttgaattaatgagattgtaccttaccatccactctgaccacgaaggtggtaacgtctctgcacacaccacccacttggttggttccgctttatcttccccattcttgtcattagctgctggtttgaatggtttagctggtccattacacggtagagctaaccaagaagttttggaatggttgttcaaattaagagaagaattaaacggtgactactccaaggaagccattgaaaaatacttgtgggaaaccttgaactccggtagagttgtcccaggttacggtcacgctgtcttgagaaagaccgatccaagatacactgctcaaagagaatttgctcttaaacatatgccagactacgaattgttcaaattggtttcaaacatttacgaagtcgctccaggtgttttgaccaaacacggtaagaccaagaacccatggccaaatgtggactcccactctggtgtcttgttacaatactacggtttgactgaacaatctttctacactgtcttgttcggtgtttccagagcctttggtgtcttgccacaattgatcttggaccgtggtatcggtatgccaattgaaagaccaaaatctttctccactgaaaaatacattgaattggtcaaaaacatcaacaaagcttaa

SEQ ID NO: 3202 - DNA, 1170 bp, Candida albicans
atgaattcatattattacaacacggtaagccatatactgtcatattccatttattacgtatatgacaatctacatgaggaaaccgagtctccaccgaaatctgccttgtcatcgtcattactcgaaccttcaacaaatcaacaaactagcgacttcaaaaaccatttactttacaaatcgttaataagcagtctattccagaacactaccaaacaaacaaaagatttaaactcaaatatctatgatgacattttcagcaatcataaacttgagacagttttgggaacattgtcattcaaagagagatgtgatttgtatttcaaaaatgttttcgctgaagatgtgaactggcatttcaaccctgatacaaggtatgatatgcattttgataaaaacactaaagagttcaaagactttatcaaagtgaaagaactagttatacaagaaaagtttgacaagatgaaagaaaaattcaaagaagaagattataatagagaattgagcaaattaaagaaatctatgtttactgatttcttgaatgaaaaatttgaacaagagattgtaaatcgattatcaacttttagaatcttcaataaatgctatataacaaacgacgaaactcctcaaatcaacaagatcaaccaatttatcactaatcaacaaaagttagtccaagatattcatcgtgatgaaagtggaaatttttacaagagtaaaatagataaattaaagttaacaaacaaggaagctttggttgatttgatggttactaaatcatcgacatttgaacatagagtttacccttggatatccaaggaatacccagtatatgaacgatggacaggcaaagtttatcatgagccaccaaattattatgaaattttgaatcatgatccaatgcaaaaaactcctaaaaaaatccaacaatcaaacaatgctgctcagccatttttaaaacaatttaaaaataaattcaatggtagagggatagttttaactattgggaatcaacattctgactatgctgtgagtttaattcatttgttacgagctttggataacaaattacctatacaaattgtttattatgacgatgttaatgaagaatcaaaacggaaaatagtcactgctccacaagaaagaattccgatctttaacacattcatttga

SEQ ID NO: 3203 - DNA, 1167 bp, Candida albicans
gatgcgattagtggcatttttagaaatgagaatgttcaagaaattgctcagtacccagatttagctgttgaaaagaataaaagtggaactgaatcagttggtcaaggagctaaatctttagaatcaccaaaacataaagatgccattagtcacggacacagcagtaaagaccatataaaggatcgtgacacccattcaactggtgcagctgttactggaggagttgctggtactgccgccgctgcagctgccgccgctgttactgcacatggaaagtctagaaatgaacctaccgctagcacacatggtcaaagcagctcacgtgctatatctgatgcaggaactggacaccaagacgaaaagaatgttgctaatactcctcaacatcattacggtaatcaaaatgttggatctaatagttattcaccagatacttatggttctgctattggtacactgggtgttcaagaaaaaactgcacctgcagtaactggaatacactctaaaggtattggtgctgccgcttatccagaactgacaaatgctggtaataccggtttagctaaaggtactgctcctgcttctacctctgctacttacggagagagtccttcagctgattactccaagtctggtgcaactggtgttgttccagctacttatttaaatacttcaggtgctccaactggatcattaaacactgcaggtgttgttggtggagctggttttggtgataattcaaacacttcttcttatcatcaaactggtagagagagagaatatgaagctccaagtttgcaatctgaatcaggtttgcacaccactcaagctaacaaagggtctccattaggtggattagctctgggagaaactaacatcagaggtaccaattttgctagtaaagattcaaactattctttgagtggaagtggagcacagagccagcatggccaagctgttggaaactcagagattccaaagtctattggtaccactaatgtgggcaatactaatagatactcggtgaataataagaatttatctggtagatcaactactggtgctggtgcaggtaatactattgctggtgatgcagatgacgcggattcttctttcttctcagttgccgaaacaagcacttactcgatgccaggttcatggaactaa

SEQ ID NO: 3204 - DNA, 2481 bp, Candida albicans
ttaactatcatgttggccaacgttaaattgaaccttgttacggcactttatgttttgtcatatgtctcagttgttaatgcctatcaacaagaaaatgaaataacaccagcagataatattgacaaaagagctggtgctattggtaattttttcagagatttcaccaatagtatttttggaaacgataatctggaagtcaaccaaccatcaacaaatggtgctaccagtactggacactttttcggtccatcaataccttctacttctactcaccaacagacaccgggtgaaacatcaaacaatgtgaacacaaaatcatcttctcagaatcaatcaccttccacatctcccacttctactgttgctgctgctgctgcaacttcttcaagtcctgttgctagtactcgtcctgcttcaacttctgaacaaaagcaacaagaagagagtacagctagacaatcaacttcaccagctacaacagctactacttccaatactcctccttctccttccacctccaaggaaaccccaacctcaaacactgctcagactagttctgccaacaacaatcaacaatcatcaaatacagcagctccatctactagtgttatccaaccaagtacatcagaagttcatgttcaatcacaacaaacttctacaacaccaaacactccaactagttcaccaaatactccaaccacttcagaagcagcaccaactacttcagcagcaccaaccacatcagaggctccagttactccaagtacttcagaagtagtaccaaatacaccaaccacatcagaagcaccaaatacaccaaccacatcagaggctccagttactccaagtacttcagaagtagtaccaaatacaccaaccacttcaaaagcaccaaatacaccaaccacctcagaagcaccagctacaccaaccacttcagaagcaccaaacactccaaccacctcagaggctccggttactccaaccacctcagaagtagtaccaaccacttcaactcaaggagatgctgtatcaacttcatcaactagtgttaccgaacagacaactttaacttcatctactctattacctccaactactgctctgactacacagactagtactccagaggcttccgattctcctaaaccaagttcaacttctattgaaacaccatcaacttcaacttttgaacaagatccaactactacttccagtgttggtaccccttcatcggagcaacctcaaccaactactacttctgaactggctgtaacatccaattctccaactcaagaatcaacttctttggttgaaccaacaactagttctttggaaagttccaacactccaacaccaaacccttccacttctgaagcccaaccatcaactagtgcaagtcaagctccaccagataccacttctagtgcaccagcaccagaactttcttcaagtaatgcagatttctccaatctggtattgcatagttccgaaaccacttcattagtgaaccctaccgattcccaaattgatagctcttccactactgatgccgtttcgcaagctactactgaaccgacttctgaaaacacacctactgctgcttcttctgtaactgccaatgacattaattcagcccaatattcagctccaacttctaatgctgacgccgaaactgcttcatctccagtttctgaacaaagtttagccactggaagtcaaaccagtcttgatactactgctggcgctagttcaactgccagtgaagcaactgctgagaatttgtctacttttggtactgatggctcttcagatgcttctcaaaccattgccgaaaccaccagcaattctcctgatcaatcagtggttacaccatcagctagtgcttctccagatgtatctacactcccaactggatctgaaagtggtacaagccttgtttctggatctgaaaccagtattgataccaatacagttgcttcaggatctactgttattccagaaagcagtaatattcccacccaatcaccatcacaatctgtagtatcatcagatgctgctgcttctaacgtctcaacaggttcagcaaccactgattctcttgctggaagtgaaaccggagtacaaccaatatcatcaagtgctacaggtactagtgaaccagtattttcaagtgagtataattcaagtgaaggtaccactagtttggtggttcctaccaattctgaacttagctcaactgttactggtagttctgaaactgctgctactgctattaattctgaatcggtcttaactggtagttctgatactgctgctacagttactggtagtgaatcaattttgactggtaatactgaaacaagtgctactgctattgcaagtgaatctactttaactggatccactactggtgctactgactccgctgcaactactattgcaagtgaatctgtgttgactggtacttccgatgctagt

SEQ ID NO: 3205 - DNA, 1407 bp, Candida albicans
aatttatacaatttcaactcaaattttgacaacaaccccaaatttttcaataataacttggaacaaattcatacatctaatcatttgaaaaaagaatttgttcgatttaaaaagaactcatgtacacgtccattgccaaaagattctacaccagtagtttattcactgaaaacacagctcggacaacaacaaccacatttacgttcaacttcaattttcaagaaatcaccagtgtatgatttatttcattattttgaaaaagcacctgatcaatggacagcaagatacattttaattcttactgccataatacttagagttgcagtaggattaggaagtcatctgggatatcataccccaccaatgtttggtgattttgaagctcaacgacattggatggaactcacgattaatttaccaatttatcaatggtattttttcgatttacaatattgggggttagattatccggtattaactgcttatcattcatttatatgtgggaaattgggcaattttattaatctgtcatggtttgccttgaatacatcacgtggattagaaacagatgatattaaaacatttatgagaattacagcaatcattagtgaattaatcatatatataccttcaattttaaaaattgctaatattttagggaaaaaatcaaatattaatcgaatggatcaaattataattgctcttataattattaatcaacctcatttaatcttaatagatcatggtcatttccaatataattctattatgcttggatttttcatttattcaataattgatttaattaaaggaaatttaattatggctagtgtttggttcattagttgtataaattttaaacaaatgggattatattattcattattcattttcttttatattttaagtcaattgaattcctcgagtaaattttttttagttggagtaacggtgttacttactcaattcatttatttattgccatttatttggtttcatcctgattcagttttacaaattgtttatagagtattcccattcaatcgtgggttatttgaagataaagtggcaaatttttggtgtacaagcaatattttgattaaatattgtgaaattcttaccgatgcttcacaattatcaaaattagcattgatagctacattattaacaacaattccaattaatttattgattttctataaaataaagactaacaacaacaccaccaagaaagcaaatacagaaataacccccctgtcatcatcatcatcatcattaccgttgaatattgttgcaatgatttatggatttgctttaaatgcattatcattctatttattttcttatcaggttcatgaaaaatcaatattaattgctttgatccctatttcattattactattgtaa

SEQ ID NO: 3206 - DNA, 798 bp, Candida albicans
tttgatggaaataaaataatggccaagaagaaaagtacaggaccacagccgtcattatcatcttctcccaatggtagggcaaaagtaactgcagaaacaatcaccaccaccacgaccacaaccaccgacacgaccaatagttattcacttctaaatatatgggtcatttcattagcacttaaaatacttcttttcattgggtatcattcaacagattttgatgtacatagaaattggttagccatcaccaataaattaccaatttctcaatggtatattgaaaacacatcacaatggacattagattatccaccatttttcgcttattttgaatatttattatcattattagtaccacgatttgttgccaatgatggatgtttagatattgttgaaattggtcaatatggattaccaacaatttatttccaacgattaacggttattattagtgaattggtattattttatgcattacaaaccattgttaaaacttcacctactctttcagcgaaaagaagaatgtatgtggctactgccagtcttgcattatctcctggattgatacttattgatcatattcatttccaatataatggtatgatgtatggaatattattattatgtataaatagtgctcgtttacaacaatatttgttatgtggattttggttttcagtattgttatgtttcaaacatatttatttatatttggctccagcagtatttatattccctcttcgaggttattgtttgaaatttaattggtcttcaccacgggcgctggaagatcccgca

SEQ ID NO: 3207 - DNA, 312 bp, Candida albicans
gcgcgtgtccggcagtcgcgaggtgaatacacagtgtggtcattagtacttggtggtcttacaaacaatgaattgttaaaacttgttaaaaatagaaagaccaaagtgttagaattgaatgatgaaaatttcgaaaacatattgaatggtcaaagagattatcacttgattgcattattaacttcagaagctcccaatctcaattgtgttttatgtcgtgaattggctcctgaatatactattgttgccaattcttggtttcaagatcatccaaatggtgtagctgaagttgaattgactgaacaagaataa

SEQ ID NO: 3208 - DNA, 729 bp, Candida albicans
ctgaacaagaataaaaagatgggaaaaaagcaacctaagaacatctactttttcaaatcagagtttaaagattctaaaaaattgttttcagtattacaattacaaaacattccgaaaatgttttatttcccacctacaaaacatttgggaccaaacaattacttgagagaaaaagtggaatatcaatttttccatggtgaccataaagaattgttgaaaaattggttaattgaagtgactgatcatagattcaatttgtacattcctgttaacaaaactaaaattgccattaatgccattggaacgtttatagtagtgttattgttaagaattttttcaaaacaggttattcaagtaattacttcaagagttatttggtgcgctgcttcaattatcagcgttatattatttactactggatacatgtttaaccaaatcagaggaactccatatgtcatggaacatcgtgacggtagaacagaatattttgccccaggccaacaatcacaatttggagtggaaacacaaataatgtcgtttttgtatggatttttaagtattttagtgattgttttagtcaaacgtgcaccggaaattaaaaaccaatcagcaaatttgttccttgttgcaactatcagttcattgatctttgttctgttcagtttgctcttatccattttcggtgttaaaggtgttgggttcccatatagatttatcaatttcttataa

SEQ ID NO: 3209 - DNA, 723 bp, Candida albicans
cttcaactattgatactaatgtatattgtgaactacattataggacttttgctatatattgaagtggccttatgtagctcgcattcagcaatcagattaacagaattggccaaagaaagtcaagattatattattgatgtttacaatagtgatttatcgattctcgaaggacctagagattatttcacagttttattatttacatcttcgaatgccgatcataactgtaagcaatgtgaaggattcaaaaatgttgttaccaaagtagcgaattcatggttttccgatcatactgattcccatttattaacatttatcaccattgacttaaatgatccaaagaatgggaaacttttcagtttaattggcttgcaaacagttcctcatatctggttagttgctccaaatccgtcaagagactatggtgatccaaacaaaattcttgaggatgctcaccttgaatttaaaatgcctcaagtatcacaggataagcagacattagaatttgctcaatttataagtgaacaattacagaaacctattttaataagagatacagatgctttgaccaagttcataaagacatttgtcattactttttcggttattataataatcagaaaaaagggtccaagcaggattactgcaactaaaaagaaaacgattgtaagtttagttgcaattgcaattgttcttttgtttacctatggggtcctcaccacg

SEQ ID NO: 3210 - DNA, 255 bp, Candida albicans
tggggtgatgctccagttcattccattgctgcagcattatttttaccaagagaaaaaatccatttctttgaagatgttggttattatcatgttccatttaccaattgcccagttgataaagaagtcagaaaggcaagaaattgtaattgtgatcctaacaaagattttacttggagaggctattcttgtactaccaaatattacactttgaataatttcaaaagacaaaagggttgggaaaagtacactgcttaa

SEQ ID NO: 3211 - DNA, 537 bp, Candida albicans
atcataaatatacatcctaatatggcgaaatcagcatctaataagaaatcgatccctaccacttcttcttcctccacagcaacttctgcagcttcatcatcagtggtattaaaagaagtgaaatcaactttaaccaccaccattaataattattttgatactatatcagcccaacctcgattaaaattaattgatttatttttaatttttttagtattattaggaatattacaatttatttatgtattaattattgggaatttcccatttaattcatttttaggtggatttattagttgtgttggacaatttgttttattagttagtttaagattacaaatcaatgatagtactacaactactacaaacaaagaaagtgatgatcaattggaattggatgaagataaaattgagaatggaacaactggtggtggtaatggtagactttttaaagaaattacaccagaaagatcatttggtgattttatttttgctagtttgattttacattttattgttattcattttataaattga

SEQ ID NO: 3212 - DNA, 831 bp, Candida albicans
  unsure (34): Identity of nucleotide sequences at the above locations are unknown.
tatatatgctcgggcttgccgcctcgtgatgaanacgcggcaagtcatggaaatgaagaacaagtcggtaaagccatcaaggactctggagttccaagagaagaattgtttgttactactaaattgtggaatgctgaccataaaaatattgaagaagccttagagacttcattgaaaaaattgggtcttaactatgttgacttgtacttgatccattggccagcttcaattgacaagtcaactaataaaccatatactgattttgattatgttgatacttatagaggtttacaaaaagtttataagaacagcaagaaaatcagagcaattggtgtttctaatttcaccaaaaagaaattggaaaggttattgtcttcggaaggtgtccatgttgttcctgctgtcaaccaaattgaagctcacccattgttgactcagcctgaattgtatgattatttgaaagaaaaaggtatcgttttggaagcttattcaccattgggttctacaaactctccattattcaagaacgataccatcgtgaatatcgctgaaaagaatggtgttgaaccagctcaagtcttggtatctcgggcaattcaaacaaagactgtggttttgcctaaatccgtccccgaatcaagagttatttctaacttgaaaacattccctttaacttcagaagaattcgaaacattgaacaaattgtctgaaaaagatggtgttgtccgaacttgtaacccagctttcacacaacttttgatgattaagcttattactattttacgttttaaaaacattattaaaagtcctctacctttattttcattgtaa

SEQ ID NO: 3213 - DNA, 873 bp, Candida albicans
actatgtccgcccaattaaagaccaacaacgaccgcattgctttgaataatggcaacaaaattccagtcattggattaggtacttgggaatccaataaagatgcatttttgacagcactcaaacttggatatagacacattgataccgccacgatttacaagaatgaagaacaagtcggtcaagcaattaaggagtctggaattccaagagaagaattatttattaccacgaaagtatggaacaatgaccacaaaaatgttgagcaagctttagaaacatcattgaagaagttgggtcttgattatgttgatttgtatttagttcattggccagtgtctattgataaaacaactaaagaaccatacccggactatgactacgttgatacttataaagagttgcagaaaatttataaaaccacaaccaaaatcaaatcaattggagtctctaatttcactaagagtcaattagaaagattgttatctgctgatggggttgatgttgtaccggctgttaatcaagttgaagcacatccattattgcctcaaccggaattgtatgagtacttaaaagaaaagggaattacattagaggcttattctccattgggtacgagcagttctccattgattaaaaataaaacaatagttgaaattgccgacaagaatggagttgatcctgctcaagttttgatttcatgggctgttcaaagaaaaacagtagttttgccaaaatcagtcaccgaatcaagacttgtgtcaaatttgaaaacattcgaattatctgcagaggattttgatactttaaacaagttatctgaaaaagagggtatcactcgaatcattaaccctttcaagaatttccaagattaa

SEQ ID NO: 3214 - DNA, 810 bp, Candida albicans
aaaatggcgtgggacaagaaaaaaaaaaaattctcaaccatagcaatcatggaatacggtaaatttgtgttgttcggtgactccatcacccagtttagttgtacccagtatggctttcatccagcattacagaatgtgtatatccgaaaattggatgttattaaccgtggtttcagtggctacaactcagagcacgctagacaaattcttccaaaaattttagagtcggaaaccaatatcaaattgatgacaatattttttggaactaacgatgcatacgactacatcaatgaaatccagacagtcgagttagacagatataaagataatttaagtgtaatggtacagatggtactagacaaaaatatcaaaccaatcattattgggcctggcttgcatgaccccaagatggcaaaggccatgcttgctgagagaggacgcccaatcgataaagatcccacaactaaccaaagactattgaaatattctgaaaccgctaaaaaagtcgcagctcaacacaatgtggcattcatcgacacatggaacaccttaaggcaacaccaagggtggaccaaggaccagttgtttgaagtttctgcaacaaaagacaaatgggaaattggagaaagtttagcagagatcgttagtgacggaatccatttcaccgccaaatcctacaagattctatttgaagaaattattcgtgttattgaggaaaagtaccctgaattggctcccgaaaacttgccctcgcaactttgtgactggaaacaaatcaaccccaacgacttgtcgtcgattttcaactaa

SEQ ID NO: 3215 - DNA, 1089 bp, Candida albicans
acagctccagttatcagaaccacccaaagactttttgctagatcctacattgccggtcaattcaccggtagcaagggatcagacggtaaatatactgttactttgattgaaggtgacggtattgggccagaaatttcccaagccgttaaagatatttacgctgctgctgatgtgccaattcactgggaaccagtcgatgtcactccattgttgattgacggtaagaccaccttgccacaaccagctgttgactccgtcaacaagaacttggttgccttgaaaggtccattagccaccccagttggtaaaggtcacacttccatgaacttgactttgagaagaactttcaacttgtttgccaacgttcgtccatgtaaatccattgttggttacgaaactccctacgaaaatgtcgatacagttttgatcagagaaaacaccgaaggagaatactccggtattgaacatactattgttccaggtgttgtccaatccattaagttgattaccaagccagcttccgaaaaagtcattagatacgcttttgagtacgctaaatctatcaacaaaccacacgttcttgttgtccacaaagcctccattatgaaattgtccgatggtttgtttgtcaacactgctaaagaagttgctcaagaatacccagatgtttctttggactttgaattgttggacaacacttcattaagattaactgccgacccatctcaatacaagaacgttgtcatggttatgccaaacttgtacggtgatatcatgtccgatttgtcctccggtttgattggtggtttgggtttgaccccatccggtaacatgggtaacaaggtttctattttcgaagctgtccatggttctgctccagatattgctggtaaaggtttggccaaccctactgccttattattgtcatcctgtatgatgttgagacatatgtctttgaactccgacgccgacagaattgaaaatgctgtgttgaagactattgcttccggtccagaaaacagaactggtgacttgaaaggtaccgctaccactacacgtttcactgaagaagtcattaaaaacttgtaa

SEQ ID NO: 3216 - DNA, 1107 bp, Candida albicans
cttaatgatcttaatattcagggaccagaaaaatatttagatatagctatggaatgggctactaaatataatttatttatacaaattgggattcatggattaccgggttcacaaaatgggtttgataattctggattatatactgaaactccaacatggttagaaaatgaattgaatatgaatttaacttatcgattagttgattatattttaaatacatatggtaatcataccacgattcattctattcaattagttaatgaaccattaggatttttattaaataaagaaaaattatcaaatttttatatttattgtcttgaaaagataattcaaaaaaatattaaagcaaaattagtattacatgatgcattttttaatattgaatcatggaaaaatttccctggtgaattcatattagatcatcatttatatgaagttttttcacaatggcaaattgatttaaatttacaacaacatttacaaagtattaaacatcaaggtcgaagtattgttaaatctggtcatcgtagtattgttggcgaattttctggtgcccttacagattgtgctaaatatttaaatggggttggtaaaggttcacgatgggatggtagtggtgattttgaaataattgatagaaaacccaatgatgataagaatcgaacttgtgaaggacatgatgatccaaataatataatgtttaaactggagacaatggattttttaaaagaacaattttatacatttgaagaaaaaggcaatggatggattttttggtgttggaaaactgaatctactttggattgggatatgaaaagattaaatgaattcaaaatgttacctgatccattatttcaatataattcaatgaatggaaatggcgtagaagaaaatgatggatttggtctactgaatattgattttcaagataccataccaaaagaatttagtgaacaagaatcttcagaacaaaaatttgactataatagtaatagtacaactactatgactacttccagtccaaaaaagaatggttgttcaattataaatgttggtgagagttggttgtggattatatttgtatattatttgctgattttttag

SEQ ID NO: 3217 - DNA, 834 bp, Candida albicans
cagaatagaagaaaaaaaaaaaaaagaggacaacaacaacaacaacgtcttacatcaaatcaaccttacaattataataattttcttgtactatccattccagtcatgctacctccaacattatcatcaattcctgaagttaaagaagaatatccaggtgcctgtttaattgaaagaaccgcaagattacctcaatttataaaattgggtccaccagatttatgtaacattcataaatattccgtcaatgctaaacgtgaaaatgaaattggtacatttttatatctcactggtgttgatacttcaaatacagcatcaattgctgctcatttacaaaatattgctaatttaatgactagtaaactgcaatattggtttggtgaaaaaaagcattggaaagtacctcaattgacttattgtacttttaatgccttttccaaaattgatttaagagtcactgttcatattcctggtaaatttgaaatgcaaattattggtcaagatgggaaattaataaatgataattttaatgatgaacaattggataaattatggtcagaaacttttcttacgtcgattgttagagctgttttagaaagtgaagatggtgatgacgtgaataaaattggtggattagttgaagttagaaagattaatccatttaataatggtattacatcaaaagaattattgaataatttcttactggcgtttgaactattattttttgaaggggttaaattgggttgtaatgtggaaatccctcaacctactttaattaataattatttagttgatgggtttattaaagttattcaattgactcaaagttag

SEQ ID NO: 3218 - DNA, 423 bp, Candida albicans
ttggctaaacaagcagtgaaatcatcaccattagattttaaaacttgggccatattagtacaaatttatactaaattacgagattttgaaaatgctttgttaactttaaattcatgtccaatgaattctcacaaggaaaaatattttttgaaaagagtagtaccaattaaatccaatgatgatttacatttaccttcgccaacagatgtaactttggatcaagtatctaatttacaaagtaatgaaatcagttatgaacaaagaaatttggatccttctttagttaatttaccagcagggaatttgaaatctacttttgctaaagcttatgatttattaactgaaattgttgtgaaaactggatgggaatcattattaaaatatcgtgctaaagtttttgtgatggaagaagagtatcgttaa

SEQ ID NO: 3219 - DNA, 933 bp, Candida albicans
gatcgtcaaggttctgcaactggggttaatggctcccatactcgcaagaattccacaacttcaacttcaacttcaaatgccaatggcaatggcaatggcaacggtactgaagcacaaacaccaactaataacccttcaactgcttcagcaactactgctagtactacaactccatcagattctgatgctgcctctactgtcgctatcaaatcaccatgtccatctaatgacactgaagatactacttcttctaccaatgtttcatatgatgacgagtttagaaagaaaagattatgtgaaagatggttagataatctttttatgttattatatgaagatttacgtgcttataccatgtggcaagcagaatccttacatttccaagcccaacaaatggaatataaaaagactacattggaatgggaaattttgggaagtattgcattcagattaaaacatttcaaagaaggttcaattgcatttgctaatgccttgagtgggagattttctgctaaatcacaacgtgaattattaaaatattatgtaatggaacgatctaaattattatcaaaaaattcttctaatcaaagcacaacatttattcatagttatacaaaaatgatgaatcaattgaatgaaaaaatattggaaagtattattaaattacttgtttggaatcatagatggtattctgatttttcatcatttttattgttgacattaagtgatttggttgcttgggaaggatcagtgaaaattaattcttcggtgactgcactctataatgaaaccaaaacaacaacaacttcttcatcatcatcaaccaacaataattctactgatcacattagtaatcatggtattattgaaatgatgacagatttggacaatgattatatcaaattgtataatcttcataatgctgatgaataa

SEQ ID NO: 3220 - DNA, 1134 bp, Candida albicans
cccacatatctgtcttcgccctgcggtgaagacccactaatatcaacagcaatttcaagttttgttcgtctttatcgtattgatgtggccaatagtgtcgtgtgggatgaagcgcattttgggaagtttggctcgcagtatcttaaacgccagttttattttgatgtccacccgccattgggtaaattattaataggattgtcgggatacttggccgattatgatggtaattttgattttgagagttcaaatgtttacccagacaatgttaattacgtatttatgagaatcttcaattgcttttttggaattcttgttactccgttggcctacaaaactgcagtaatattagggtataatcagttcacctgttggttgatcgctttcatggtgatttttgaacaattgtcattgacattatccaagtttattttattggattcaatgctactatttttcacagttttaacaatgtattgtttggttaaggtacacactttagccatagcccgtgttggtagcaactccaagactccactaacaaaattggaaatcaaatggtatattttgaccggtatttcaataggatgtgtgtgttctgttaagtgggtaggattatttgtcacggctttagttggattttacacaattgttgatttatggatcaagttttatcaaacttttgctattgacaaaaagtctcctaaaaaaatgtcggttgtcaattatttaatccattgggttgttagaatttttacattgataattatccccatgacaatttacgttgccactttcaaagtccattttatggtgttgaatcatactggtcctgatgatggtactttgtctactttattacaaggttcgttaattggaaatgacctacaatccggccccagatcagtatcttttggatcattggttactatcagatcgcaaggtttatcccctaatcttattcattcacatcctcataattatccacagggttcacaagagcaacaagtgactacgtatgggtttaaggacgataataatgaatttttgtttgaatttggtgttgatgcaggcttacgtaaccaacacccaacattagaaaatgaaaatagtactagagatggtggggaatga

SEQ ID NO: 3221 - DNA, 1134 bp, Candida albicans
agatggtggggaatgatgatgattattaccaatgtaataattcatgatggtgatactgtgagaatcaaccacaaaaacacagggtcttatttacgagccaatgcagtaggtgctccgataacttcaagtagttatgaggtgtcatgtttcggtgatgttgaaagcaatgactgggcagatgagtgggtgatagaaatccaatcacaagaccaatcaccagatccaatgttccaagatgaagacccgctggagatacattcagtttcgactagttttcgattgaaacataaacaattagggtgttatttggccactactgggaaatcgtaccctgcatgggggtaccagcagggtgaagttgtgtgcaaatattctgttttcagtcgtgataagaatacatggtggaacattgaaaaacatgttaatgataaattgccattacctgcaactgagtatgtcccaccgaaaccaaaattctggaaggagtttattcttttgaattatgccatgatggcatccaacaatgccttgatccccgatccagatcgatttgataaactcagttctgaatggtgggaatggccaatattaaatactggtctcagaatgaatagttggggtgatgcagatattaaatattttcttttgggtaatccattgattacttggatgtcaacaattgcgttgattgtttgccccctttatttgttggttgttggcatcaaatatcaacgtcaatggatattgttatcagcaacagacactagcaatgccaacccagcaaacagtcaatcattatcgttgttagcagctcgagcattacttccattggcggggtgggttttgcattatgtgccatttattttaatgggtagagtcaagtatcttcatcattacgtcccagcattatattttgccatctttgttgctgggtttattgttgatgccattttaaatttggatttttcatatcataacaataaatttcagtatatattcaaagtggtgatctactctacgttatacttggtgatttgcataagtttttggtactttaaagatctctccttcggtatggaggggtcatcggttgattatcgacacttgcgacttttatgctcatggatgatataa

SEQ ID NO: 3222 - DNA, 1935 bp, Candida albicans
atcagaacaaaaattctaaggaatacaccactgaatcgcgaggaggcatatgtacgagttggttctcataaacttaagccaaatcaaattccgttattgaaagagaacatccatgatttaattttcgcattaaattttgggaacaaaaatcaattgcgggtgtttttcactttatctaaggtgattttggactccggtatacctcaacaagttggagttttgcccgttataggagatgacccaatggatctgttactcgctgagaaattttattggattgctgagaaatcaagcacacaagaggcattagcaatattgtataaatattttgaatcaaacagtccagatgaagttgatgacttattagataaagtggaagtacccgaagattataaagtggattataatcatgtgttaaacaagttttctatatcaactgcttcggtcattttcaatggggttatttacgatttaagagcaccaaactggcagattgccatgagtaaacaaatatcccaggacatttcacttattaaaactttcttgagacagggaccaatagagggtagattgaaagatgttctttactctaatgcaaaatcagaacgcaatttacgtataattccattagaacctagtgacattatttacaagaaaatcgacaaggaattaataaacaattcaattgcattcaagaagctagataaagcgcagggtgtgtctggaacattttggctagtgtcggattttaccaagtcagaaataattactcaattgatagatttgttattgcttctcaaaaagaaagcaattcagataagaattattaatactggggatacagatgtttttggaaaattgaaaacaaagtttaaattaaccgccttaacaaatggacaaattgatgaaattattgagattttgaaaaaatccaacgcttcaagtgcaaataatgatgaattgaaaaaaatgcttgagactaagcaattacctgctcatcactcttttttgctattcaactctagatattttagattggatggaaattttggatacgaggaattggatcaaattatagagtttgaagtatctcaaagattgaacttaatcccggacatcatggaggcatatccggatgagtttaggtcgaagaaggtaagtgattttaatctggttttgtctggattggacaatatggactggtttgatttggtgacttccatagtgacaaaatcattccatgtcgacgaaaaaaggtttattgttgatgttaacaggtttgattttagctcattggatttttcaaactcgattgatgtaacgacttatgaagaaaatagtccagttgatgtattaataattttgaacccaatggatgaatattctcaaaaattgataagccttgttaatagcattacagattttctgttcttgaacattagaatcttactacaaccaagagtggatctgaaagaagagatcaaaattcacaagttttatcgtggtgtgtatcctcaaccgactcccaaatttgattccaatggcaagtggatccaacattattcagctcaatttgaaagtattccatccaatgtgacctattctactgaattagatgttccacataagtggatagttgttcctcaactgagttcgatggatttaaacacaatcaatttcagcgaaagccactctgttgatgcaaaatactctctaaaaaatatattaattgaaggatatgctagagatattcatactgggaaggcccctgatggtttaatctttagagcctttaataaaaattactcaactgatactttggtgatgacttccttggactattttcaaatcaaagggtatcctagtattttcaactttagtacgacctcaaatgacacattattgtctgcatcggcaaaacaaatatctggctaa

SEQ ID NO: 3223 - DNA, 1086 bp, Candida albicans
  unsure (988),(1035): Identity of nucleotide sequences at the above locations are unknown.
ttggattttattaattttgatttaaccaacaaaaaacatacaccaagaatcgcagcccattacgatcactattctgatgttctaactaagtttggcgatcgactcaaaagtgaatgtgcaaaagactcttttgggaatgcagtggaaacgaaaaatggtcaaattcaaacgtggttactatataacgataagatatattgttcggctaatgatttgtttgcattacgaactgatttgagttctcattctacacttttatttgataggattattggaaaatcaaaagatgcacctttggtgattttatatggaaacccgactgaggaactgactaaagattttcttaaaatattgtatccagatgcaaaggctggaaaattaaagtttgtatggaggtacattccactgggaatcaaaaaactgaactcaatttctggatacggtgtatcattgaaaatggagaagtatgattattctggtgcagaaggaaatacaaagtatgatttgagtcgagatttcaccagaattaatgactcgcaagaattggtcctagtcattggaaaacattcgtatgaacttggtgttaaattgacttcattcatattatccaatcgctacaagactactaaatacgaccttttagataccattttaaccaactttcccaagtttattccttacattgcacgattaccaaaattactaaatcatgaaaaagttaaatccaaagtgcttggaaatgaagatatagggctatctcaagactcctacggaatatatatcaacggttccccaataaatccactagagttagatatttacaatctaggtaccaggataaaggaagaattacagactgtgaaagaatttatgaaacttggatttgataacgtacaagcaaagctcttgataccaaaatttgctttactttcaactgttaaacaaacacaatttcgaaatgggattacattaatgggtaacaatgacnatagatctaaagtgtatgacaatgaatttaagaaaggtattcacaanagggtggggtcttgttctttcaataacattgaatcagaacaaaaattctaa

SEQ ID NO: 3224 - DNA, 1509 bp, Candida albicans
aaaactggtgctcttcctactggtttagcaatgacactcgacaactctatcgtttattcaaggcccttgagtgtttcagaaaactttttcagatgtcggacagctagtgggaactacagaaactttgtcgttactgcaacatacaatcaaagtttgaaaaagaagttgtatgttttggtcaaagcattaaggaaaactatattggaatatccaattcttgcgacgaccgttaagtttgacaaaacagttaatgcctttgcatatgtgcctttgaaaaccataaatttgagtgacattttattctttgaaggagacgaaaagtggctaacaaatggagtgattaatgagaattatatgaaatattgcaatgaaacacagttcaaattgtatgaagaaaatgtattgttcaagttgatattagttggcgattttcatttgtcagcgatttttgaacatactattggtgatggtttagttgcgaattattttcatgaagttttgctcaaaaacttggcagaatgtgaatctatagaagacgctgcatttgaaacccaatttggaccccttgtttttgaaaatatcaaagcagaagatgaaattttcaattttagcaaagataaactctacatcaagaattctttaccaccaccaattgacccgtttctagaggacattgatttagactacagttttggtgacccacacttccaagacaagattattccagaaggtttcccaagtaaatggaaaggaagatttgataccgttgacacacacgatattagtttcaagttaataaactttagcaaacaagaaacgaaaataatactatctaaatgcaaagaacataaagtaggaataacctcatatatcgaagttgttcatgcgttgacgttacagccaatttttggagataattcgttcaccacacacagaaccgcaatgacattaagaagacactatacccctgatttggcagagcctccttacaaaaagattttgtcagattccgaatacaaaatatttggaaccctggctcatatggggtttgttcagaattttccaccaataaaagttttttcttgggatttggtaaagaaagtaaatcttgatttgtcaaaagctgttaaaaataaacgtgctctcaatcaaatgaagctttggaaagatacaggggatttgctagacgaaaagaatatggctttcttcgacacacaatacaacaagccaaaggctgatgccgttaaaatttctaacttagggtttattgagttaccagaatatgccactaaaaatgacaagaaatgggtgattagtgatatggtgttttctcaagatatggcaccgtacgcctcagaattcatgttgagtgtagtgagcacacccattgggggcatgaattttgttttaagttactacgattattcctttgaagatggaaactgggaaaactttgacgaatttgttaccaagttgcatgataatatgctcaggtatgcgagtttttaa

SEQ ID NO: 3225 - DNA, 321 bp, Candida albicans
tgtttagtgtgtggtattagagatgttagagatactcaatgtggtttcaaaatgtttaattttgaagcagtgaaaaatatattccctcatatgcatactgaaagatggattttcgatgttgaagtattattattaggagaaattcaaaaattcaatatgaaagaattgccagttaattggcaagaaattgatggatcaaaagttgatttggctagagattcaattgccatggcaattgatttggtggttactcgattggcatatcttttaggagtatataaattggatgaatgtggacgaattaacaagaaggaacaataa

SEQ ID NO: 3226 - DNA, 687 bp, Candida albicans
gatataattcccataatgatatattatattctagcatttttcatatttataagtttatcaatttatgcaactgttatatttttcagtcataaacctcgaaaaccgttcccatcagaattaacttataaaaccaatgattccactgataaatcacatccattaccaccgagaataaatactaatagtaaattccaagatgatggaattgatataagtttagtaattccttgttataatgaaactcaaagattagggaaaatgttaaatgaagccattgaatatcttgagaaaaatcatcaatcaaaatatgaaatcattgttgttgatgatggatcatctgatggtactgatgaatatgcattgcagaaagccaatgagtttaaattaccgtctcatataatgagagtagttcaattgaaacaaaatagaggtaaaggaggagctgtcactcatggattattacattctcgtgggaaatatgtattatttgctgatgctgatggtgctactctgttcccagatgtagccaaattagttaattatcttgccaatgccaatggtcagccatcaattgccattggatcaagagcgcatatggttaatactgatgctgtagttaaacgatcatttattagaaattttttaatgtatggacttcatgcattagtgtttagtgtgtggtattag

SEQ ID NO: 3227 - DNA, 396 bp, Candida albicans
ctcccccccgagcgtggctccttccagcggccgtgtgtgaagactataaataaaatggaaagtaatgaaatcgatacctcaaaatttcacgatgcggttgcaaagatgtacagttggaatgatattgcaagaagaacagaaaatgtttataattcacttgatttagacaaactaaacgagtctttacttcaccgattacaaagatactattgttgtggtataatagcaggcaaactttatgctttatgtgtaatagtggatatttttattttcgtgatactagaatggttgtatcccgctgatcatatcgataaagcaacaaaatggccactggctatcaaggaagaagacgagctggaagaagaaacatttatttttccgaacaaagtaaattag

SEQ ID NO: 3228 - DNA, 213 bp, Candida albicans
aatatgggatacaatatagcaatggtaacagattttttttaccctcaacctggaggagtagagtttcatgtgtatcatttatcacaaaaactcattgaactaggacactcagtggttatcataactcataattattcatcaagaaatggtgtacgagtattaacgaatggtttgaaagtgtattattcttcaccacgcgctgagatcccactt

SEQ ID NO: 3229 - DNA, 354 bp, Candida albicans
  unsure (46): Identity of nucleotide sequences at the above locations are unknown.
cgggcgggcctatacgatatggcggtccttgcgcatcgtggtgaanatgtgctgagctatagaagctcagttttcccaactgtatttctgtgcttcccaatattgaggaatctcttcatacgaaaaaacattgagattattcacggacatggttccttcagcacattatgccacgaagctatattacatggccgaacaatgggattaataacagtcttcactgatcattcactttttggatttgccgagattggatcaattatggggaataaagcattaaagttcactttcagtgatgttggccatgttatctgtgtcagtcacacctgtaaagaaaacacggtttttttatga

SEQ ID NO: 3230 - DNA, 459 bp, Candida albicans
tcaatagaccccataaaagtgagtgtgataccgaatgcagttattctgaaagatttcaagcccaaatcgcattgtgtcaacaagaactatactaaagagatcaccattgtggtgatcacgagattgtttccaaataaaggagccgatctattaacggctgttatccccaaaatttgccagttgaaaccaaaagtgaaatttctaattgctggtgacggccccaagtttttagatttagaacaaatgagagaaaagtactttcttcaggaaagggttacattaatatgcgctattaaaccccacgaactaagagatgtaatggtccaaggtgacctatactttactccttcattaacagaagcgtttggtacagtttttgttggaaactgcctcctgtgggtcatatgtcgtccccaccaaagttggacgcattccccgaagtcttaccaatcgaaatga

SEQ ID NO: 3231 - DNA, 894 bp, Candida albicans
  unsure (886): Identity of nucleotide sequences at the above locations are unknown.
aacttcagtaagttttttttgcactttaacaacatgactatcaaacaaaaggtattatttttagaaaaaccaaacgtcgatgatctcaaacaatttgaagttaaattcgattgtatatattatactttgtcaactttagagcaacttctcattgatttccgaattagtcttaaagatattgaaggtatatattgtggttggaatgggtttggtgtgtttggagggtttagaggtaaattacttgttcacgctccccgacacttgaaaatagttgcaacatgttccgttggttacgatgcttttgacattgaaggattatcagaaaggaacattattcttacaaatgttccttcaccatttgcttttgaagctgttgcagacttggcattgtataatgccattactagttttagaaatttcaagttatatgccgagaatcttaataataatcaatatgctcactcaggaatttcaagaacatctatgcttcatggtgaatttgatcaaagttctggaaaggcaattgttgaaccagtggttggacatacttatgggtatgcctgttgcaaaagagataatttatcacctagaggacacaatgctgtaatagtcggttttggacacattggtgaactcattggaagaagattagcatgcatcggcatgaacattcattacgttaaacgaaccagactttcggaatctcaagaaaaatcattggggtatgaagtgacttatcatgaaagtttagaagaaacaaaagatattgctgacttgataattattgcttgtccaggaactccttcaaccagacacatgataaataaacagttaataagtaatatggagaaaccttttagaatcatcaatattggaaagaaggtcntgtattga

SEQ ID NO: 3232 - DNA, 1170 bp, Candida albicans
aacgtccaaaacaactcccacaatatcgttgaaaactttaaacacacaacaacaacaacaacaattagcttacttatgactaaaccaaaagtactttttattggagaattaaatcgacaactcccacaattcaaaaatttccaattgaaatatgattgtattttcattgaacttaccactagagatgaattcattaatgatttaaaaacaaaatatcatgatattgtagctatttatggagcatggcttgggtttttacccattggtggatttagaaccgttattaatgagtattgtccaccaccaaaactaaaaattattgcattttgttctgttggttatgatcatgaagatgctaaagtgttactggaccacggaattgccttgacgaatgtacctagtgatggggctgctggtcctgttgctgatttggtattatatttgacattgactagttttagacaatttcatatgtatggtaatgaattattgaagaatcctcatacggttgatttaagatatcaattgaatcaaaatgattttgattctcaacatgggaaagtaacaactagttctggtggtgtttctgggtatgattttggtcattatttgaatcatcgagctaatacatcaccaagaggtcataatgtaaccatcattggatttgggaaaattggtcaaacgattgggaaaaaattacatgatataggaatgaaaatcacttatgttaaacgaaataaattaacttcgttacaagaacataatttaggttatccagtggaatatcattgtaaaattaatgatgtacccaaaattgatttaattgttattgcatgtcctgcaaccccggaaacattccatttaattaataaatcagtgattgaactgattaagaccccatttagaattataaatattggtcgtggtacagtaattgatgaaaattcattagttgaaggattaaaactggggaaaattttatttgctggattagatgtatttgaaaatgaaccgaaaattcatccagaattgcttggaagagatgatgttgtattaactcctcatgtaggagcatcaacggtagaaaattttgattatactgctgctaaagcattagaaaatattgatcagattattactcaaggtaaatgcttaaatagagtcaattaa

SEQ ID NO: 3233 - DNA, 1143 bp, Candida albicans
ctttgcttcaacttcttgcttcatcaacaattacataaaaaaattctaaaccaacaaacttccaacaaaaaaaaaaaaaacatgtcaatcgataaatcaaaaatggttaccagattgggaaaatctggtttgaaagtcaatactgtcgccattggtactatgagattaggttcaaattggatgggttataatggtgacattgatgaatgtttaaaaattttgaaattttgctacgacaatggtttccgtacttttgatactgctgatgtttattctaatgggaaatcggaagaattattaggattattcattaagaaatataatattcctcgtgaaagaattgtcatattaactaaatgttatttcccagttaatgattctgatgataaaaattgggaagattttgatcctgttgatagtcttaatggtaaaggattaagtagaaagcatattttggctgctgttgaagattctgtcaaacgtttagggacatatattgatgtgttgcaaattcatcgtttagatcatgaagtcacttatgaagaaatcatgcactcgttaaatgatgttgttgaaaaagggttgacgagatatattggtgcttcctccatgaaggcttgggaatttgttgaattacaaaatgttgctaaagctaatggatggcatcagtttatttccatgcaaagtcattactccttattgtaccgtgaagatgacagagagttgaatgattattgtaagaagaatggagttggattaattccttggtctccaaatagtggtggtgtcttgtgtcgtccattcgattcagagaaaactcaaaaattctttgaaaacaaagattgggctagtgtttttggattgggtgaacctcgtgaagctgataaaactattgttaacagagttgaagaattaagtgttaaatacaatgctaccatgatgcaaatctctttagcttggtgtattgctaaaggtgtgattccaattgctggtgtctctaaatttgaacaagctgaagaattggttggtattttcaatgtcaacttgactgaaaaagatattaaatatcttgatgaaccatatcacgcccaaagaattagccaaaagaatttaattaaaaagacttttaatataattttctaa

SEQ ID NO: 3234 - DNA, 210 bp, Candida albicans
agaattgagtgtgaaatacaatgcatctatgatgcaagtgtcattgggcatggtgtattgctaaaaggtgtgattccaattgccgatgtctccaaatttgagcaagctgaagaattggttggtattttcaaagtcaacttaactgaagatgatatcaaatatcttgaagagccatatcacgccaaagacttggcaagagttgctgcttaa

SEQ ID NO: 3235 - DNA, 867 bp, Candida albicans
tttttgataccgccagatgcttattccaatggtaaatctgaagaattgttaggattgtttattaaaaagtatgatatcccacgtgaaagaattgttattttaactaaatgctatttcccagttaaagatactactgaagaaggtatgggtgaggttgatgaagttgatttcatgaatggcaagggattaagcagaaaacacattttggctgcagctgaggcatctgtcaagcgtttgggtacctatattgatgtcttacaaatacatcgtttagatcgtgacgttacatacgaagaaatcatgcactcgttaaatgatgttgtcgaaaagggatgggcaagatatattggtgcttcctcaatgaaagcttgggaattcattgaattacaaaatgttgctaaagccaatggttggcatcagtttatttcaatgcaaagtcattactccttgttatatcgtgaagatgacagagagttaaacgactactgtaaaaagcacggtattggattgatgccatggtctccaaatgccgggggcgtgttatgtcgtccatttgactctgacaagaataaaaaattttttgaaaacaagcaatgggcaagtatttatggtttagataatgtcaacgacaatgacaaagctattgttaacagagttgaagaattgagtatcaaatataatgtttcaatgatgcatgtctctttagcatggtgtattgctaaaggagttgtcccaattgccggtgtatctaaattggctcatgctgaagacttagttggtatttacaaagttaatttgactgaagaagatatcaaatatcttgacgaaccttaccatgctaaggatttggcaccacttattgaataa

SEQ ID NO: 3236 - DNA, 1074 bp, Candida albicans
tttacttcggatccttggccgggcccagttggtgaagacatgtcaatcgataaatcaaaaatggtcactagatttggtaaatctgggttgaaagttaacactgttgctgttggtgtcatgaaattaggctcaacttggatgggatctaatggtgatattgatgaatgtttaaaaattttgaaattttgctacgacaatggtttccgtacttttgatactgctgatgtttattccaatggtaaatctgaagaattgttaggattattcattaagaaatataatatccctcgtgaaagaattgttattttaactaaatgttattttcctgtcagagaagctgctgaagatggtttgggtgaagtcgatgtagttgatttcatgaatgataaggggttaagcagaaaacatattttagctgcagctgaagcttccactaagcgtttaggaacctacattgatgtcttgcaaattcatcgtttagatcatggagttacatacgaagaaatcatgcagtctttaaatgatgttgtcgaaaagggatgggcaagatatattggtgcttcctcaatgaagacttgggaattcattgaattacaaaatgttgctaaagccaatggatggcatcagtttatttcaatgcaaagtcattattccttgttatatcgtgaagatgacagagagttaaacgattactgcaaaaaacacggaatcggattgatgccatggtctccaaatgccgggggcgtgttatgtcgtccatttgactctgacaagaataaaaaattttttgaaaacaagcaatgggcaagtatttatggtttagataatgtcaacgacaatgacaaagctattgttaacagagttgaagaattgagtatcaaatataatgtttcaatgatgcatgtctctttggcatggtgtattgctaaaggagttgtcccaattgccggtgtatctaaatttgaacaagctgaagacttagttggcatttacaaagttaatttgactgaagaagatatcaaatatcttgacgaaccttaccatgctaaggatttggcaccacttcttgattaa

SEQ ID NO: 3237 - DNA, 666 bp, Candida albicans
ataataataaccaacaatcacaaaaaaatccaaacttctaaccaaaatatgtcaattgataaatctaaattagtcactagattgggaaaatctggtttgaaagttaacacatccgccattggtactatgagattaggatctagctggatgggattcaatggtgatattgatgaatgtttaaaaattttgaaattctgttatgacaatggattccgtacttttgataccgcagatgcttattccaatggtaaatctgaagaattgttaggattgtttattaaaaagtatgatatcccacgtgaaagaattgttattttaactaaatgctatttcccagttaaagatactactgaagaaggtatgggtgaggttgatgaagttgatttcatgaatggcaagggattaagtagaaaacatattttggctgcagctgaggcatctgtcaagcgtttgggtacctatattgatgtcttacaaatacatcgtttagatcgtgacgttacatacgaagaaatcatgcattcattgaatgacgttgttgaaaaagggtgggcaagatatattggtgcttcctcaatgaagacttgggaattcattgaattacaaaatgttgctaaagccaatggtcgcatcatcttcaccacgagtggccgatccgcggctatg

SEQ ID NO: 3238 - DNA, 1101 bp, Candida albicans
ttccaaatttcatcattaaaaacaactacaaataactacaacttaactttaactaaaaaaaaaaacatgtcaatcgataaatcaaaaatggtcaccagattaggtaaatctggtttgaaggtcaacactgttgctgtcggtactatgagattgggatccagttggagaggctttaatggtgacatcgacgagtgtttgaaaattttgaaattttgttatgacaacgggttccgtactttcgatactgctgatacttactcaaatggtaaatctgaagagttgttgggtttattcatcaagaaatacaatattccacgtgaacgaattgtcattttaaccaagtgctacttctcagtcaaagacgacgcagaagacagttcacttgaaattgatccaattgactatatgaacggtaaaggattgagtagaaagcatatcttagccgcagctgaagcttccgttaaacgtttgggaacatatattgatgtgttgcaaattcatcgtttagaccatgaagtcacatatgaagaagttatgcgttctttaaatgatgttgttgaacaaggattggcaagatatattggtgcctcatctatgaaaacatgggaatttgttgagttgcaaaatgttgctaaagcaaatggttggcaccaattcatctccatgcaaagtcactattctttattgtaccgtgaggacgagagagaattgaatgactattgtaagaagaatagtattggattaatcccttggtctccaaacggtggtggtgttttgtgtcgtccattcgactctgaaaaaactaagcagttcttagacaacaagcaatggtcaagtttatttggattagaaaatgtcagagacgcagataagattatcgtcgatagagttaaagagttgagtgttaaatacaatgcatctatgatgcaagtttcattggcatggtgtatttctaaaggtgtgattccaattgccggtgtctccaaatttgagcaagctgaagaattggttggtattttcaaagtcaacttaactgaagatgatatcaaatatcttgaagagccatatcacgccaaagacttggcaagagttgctgcttaa

SEQ ID NO: 3239 - DNA, 1062 bp, Candida albicans
caaacttccaacaaaagaaaaaaaaacatgtcaatcgataaatcaaaaatggttaccagattgggaaaatctggtttgaaagtcaacaccgttgctgttggtgtcatgagattaggttcaaattggatgggttataatggtgacattgatgaatgtttaaaaattttgaaattttgctacgacaatggcttccgtacttttgatactgctgatgtttattctaatgggaaatcggaagaattattaggattattcattaagaaatataatattcctcgtgaaagaattgtcatattaactaaatgttatttcccagttaaagattctactgaagaaggatggggtgatgttgatgaagttgatttcatgaatggcaaaggattaagcagaaaacacattttggctgcagctgaggcatctgtcaagcgtttgggtacctatattgatgtattgcaaatccatcgtttggaccatgaagttacgtatgaagaaattatgcattcattgaatgacgttgttgagaaagggtgggcaagatatattggtgcttcctcaatgaaggcttgggaatttgttgaattacaaaatgttgctaaagctaatggatggcatcagtttatttccatgcaaagtcattattccttgttatatcgtgaagatgacagagagttgaatgattactgcaaaaaacacggtatcggattaattccatggtcacctaactctagtggtgtgttgtgtcgtccatttgattcagagaaaactcaaaaattcttagaaaataaacaatgggctagtgtttttggattagataatgctggtaaaatggagaatactattgttgatagagttgaagaattaagtgtcaaatacaatgctaccatgatgcaaatctctttagcttggtgtattgctaaaggtgtgattccaattgctggtgtctccaaatttgaacaagctgaagaattagttggtatttacaatgtcaacttgactgaagaagatattaaatatcttgatgaaccatatcacgccaaagatttagcaaaagaagttaattaa

SEQ ID NO: 3240 - DNA, 1101 bp, Candida albicans
ataacacctttcacaagtcactaccaaagtatacaactttctatcgctgtcatgtcaattgaaatcaagtatagtaatttaggtgaatctggtctcaaaatttccccattgattgttggatgtttaacttttggttccaaacagtgggccgaatgggtcattgaagatgaagatgaagttttcactattttaaagaagtgttacgatgctggattgcgtacatttgatactgctgatagttattcaaacggtaagtcagaggaattgcttggaaaatttatcaaaaaatttaacatcccaagagatagaattgtgatattgagtaaagtttactatagtgttgaacctaatactggaagatactcattagcggatacctcaggtttcaaagaaatggactatgccaatagcaaagggttatctcggaaacatatattcgatgctgtcgaagcatctgtcaaaagattggggacctatttagatgttttccagatccatagattggatgaagaaacaccaaagaaagaaataatgaggactttgaatgatgtggtcgatcaaggacttgccagatacattggtgcctcatctatgagagcggttgattttgcccaattgcaatttattgctgaacaaaatggttggcataaatttatcagtatgcaaaattactataatttgatttatagagaagaagaaagagaaatgattccattttgccaaaccaactatttgagtaaagttgggatcattccttggtctccacttgctaaaggggttttggcccgttcacttggcgctgtttccaaaaactccagagagaagttagatcaggagcgattcaaaatattggggttggacgctttatcggaggctgaccaagaaattattcaaagagttgaaaaagttgccaaagaccacaatgtgagtatggctgttgttgctacagcttgggttataggaaaaggttttaatccaattgttggactttcctctgttaaaagagttgatgatattttgcaagcattaaaattcaaattaaccaaggaagaagaaaagtttttggaagagccatatgttcctaagaatgtcactgcataa

SEQ ID NO: 3241 - DNA, 297 bp, Candida albicans
tcaaggattggcaagatatattggtgcttcatctatgaagaatttgctcaactacaatttattgctcaactacaatttattgctgaacaaaatcattggcataaattcattagtatgcaaaattattataatttgattcatagagaagaagaaagagaaatgattccattttgtaaagataatttcattagcaaagttgggataattccttggtcacctattgcaagaggggtgttaactcgtccagttgataccagctctgaaaactcaagagataaattagataaaactttttag

SEQ ID NO: 3242 - DNA, 738 bp, Candida albicans
gttttgacaattatccaaaaatatttcattcaatcttttgtaattggaaaagtcatccacacaacatatcattatcacttcacaagcatatcaatcatgtcaattgaacttaaatataacaatttgggtgaatcgggattaaaaattgcccctattattgtgggttgtatgagttatggagacaaaagatgggctcaatgggtattagaagatgaagagaaaattttccaaatattgaaaagatgttatgatgttggattaagaacatttgatactgcagatgtttattctaatgggaaatctgaagaattaattgggaaatttattaaaaaattcaatattcctcgtgatagaattgttattttatccaaagttttcttccccgttgatcctcaaactcctggattttcattggcaacaagagataatttcccagttttagattattataattctcaagggttatcaagaaaacatgttttacaagctgttcaaaattcagttgaaagattaggaacatatattgatgttttacaaattcatcgattggataaagatactccgaaaaaagaaattatgaaaacattaaatgatgttgttgatcaaggattggcaagatatattggtgcttcatctatgaagaatttgctcaactacaatttattgctcaactacaatttattgctgaacaaaatcattggcataaattcattagtatgcaaaattattataatttga

SEQ ID NO: 3243 - DNA, 801 bp, Candida albicans
aacatatacttcagcctgccgcttagtaacgacaagtgtttgaaaattttgaaattttgttatgacaacgggttccgtactttcgatactgctgatacttactcaaatggtaaatctgaagagttgttgggtttattcatcaagaaatacaatattccacgtgaacgaattgtcattttaaccaagtgctacttctcagtcaaagacgacgcagaagacagttcacttgaaattgatccaattgactatatgaacggtaaaggattgagcagaaagcatatcttagccgcagctgaagcttccgttaaacgtttgggaacatatattgatgtgttgcaaattcatcgtttagaccatgaagtcacatatgaagaggttatgcgttctttaaatgatgttgttgaacaaggattggcaagatacattggtgcctcatctatgaaaacatgggaatttgttgagttgcaaaatgttgctaaagcaaatggttggcaccaattcatctccatgcaaagtcactattctttattgtaccgtgaggacgagagagaattgaatgactattgtaagaagaatggtattggattaatcccttggtctccaaacggtggtggtgttttgtgtcgtccattcgactctgaaaaaactaagcagttcttagacaacaagcaatggtcaagtgtatgtggattagaaaatgtcagagacgcagataagattatcgtcgatagagttgaagaattgagtgtgaaatacaatgcatctatgatgcaagtgtcattgggcatggtgtattgctaa

SEQ ID NO: 3244 - DNA, 3306 bp, Candida albicans
catcattccactccactaaatctgcacggttactccgccaaatgggtttttgagctgcatgctataaatatggcagcgaactcttcattctttctagcagataattgtgctccacataatcaatcatttatacaattttgcatacacgcagcatcaaaaaagaagggtaggatagcattaatgtgtttagctaatttattcctcttattcagttttcatttactatatgccaggttctgcagcggatttccctatgtagttccaagcacggccagatctacaaatcaaatttttcacacaaatctcgagcaattagtcaatagtccagagaataaacagatttttagccagctcaagttctccgatcaagcattttacgatccccacgataatgtcgttggaacaaccgagttcccagttttcaatcaataccaaagacagccctatgttgccaatggatacattggaagcagaataccaaacttaggacaagggtttacttacgaccagctcaccaactcactgacagcaaacgatgacgacttgttgaatggttggccacttttcaataagagatattctggcgcgtttgttgctggattttacgatttacaaaaaaacacaacaggaaccaattttgccgagttattagaaaatgggtatgaaagtgtaatagctgctgtgccacagtggactgctttgtcattgagtgtcgaaatattgggcaaaaagtatacgctcgacccctcgttagagcatgaagcaattggtgacatcaccaattatgtccaaaacatgtcattgtcggacggaattgttactactcagtttacttggctaaatacctttgatgtaaaatacgaaattcttgctcatcgtgagaatataaatttgggattggtcaatatgcaagtctacaatccaggaaatgaaagcgtacaagtcattgtttctgatgtgcttgactttaattcttcacaaagatgtcaattgaatcaaatttcacacgacaaaaatgggatttatgtcacattccatcctcaagggttgagttatattgatggtgcaatatactctacattatcagccaatggccagattaccagagaacaaactaacgaaacagtcttccaaaatgttgaacttactattgagccccattcatgtgtccaagttgccaaatatgttgggattgcgactacagatttggatccagactcttttaagactgcagatgacgtgttaaagtttgcaagaaaagtttcccaaaataaaaagcatggcgatgctactcaattagttaactcgcataggctggcatggtcaaagataatacaagatgctcctttggttacatttccaagtgactcattgttaaacttgggagcaagagcttcgattttccatttgttagcaaacacgagaccgaatgccgagggtgttacaggagctcttggtgtaagtggtttgagttccgacagctatggtggaatggttttttgggatacagatttatggatgcttaatggaatattaccatttgctccagaccatatcaaaagctttataaactatcgagtgcatcttcaccagcaagctattgacaatgtacctagggggtatcaaggtgcggtatacccttggacaagcggtagatttggtaattgtacaggaactggaccatgcttggattatgagtaccatatcaatatggcagttgctatggctagttggcagttgtacattagcggagcagccgatgatacatttttggaatctgtagcatacccaatcataaatgatgctgcaagtttcttagctgaatatgttgtccactacaatgatacccttggcaagtatacgacgaaaaacctcaccgaccccgacgagtttgctaaccatgtagacaatggcgcatacaccaacacaggcatagttttggtaatgagatgggcacagattgcgggcagcattctaggaaagcaagttcctaaaatttatcatgacattgaaacagccatgtttcttccaactgcagagaacacacaaaatataactttagagtactcaggaatgaattcttcagttggtatcaaacaggcagatgttattatgatgacgtatcccttagaaaacgagttgattgaccaagatcaagcatacataaacatggagttctattccatgaagcaagtaggatatggaccagcaatgacattcccaatattttcgatcgttgcatcaaacttggcattcactggatgtgcttctcagtcatacttgcataaggcaattcaacctttcctcaggggaccctttgcacaatttgcagaacaaaataatgacgattatttaaccaatggcggaacgcacccggccttcccgtttttaacagcacatggggggtttttgcaagcaatattacaaggcttaactggaatgagattcgattacacatttgagaataacaaattacagcgtttattaaaactagatccaattgcattgccttgtttgggtgaaggtgtaaggtttgacagtatcaagtatgacaaccatactctttcgatggcaattaacgaaacacatttcacaatcaaaaataagggaaaaacaacacccaatgcacgaaactatgtgacaattttattggcagaaagaaatgcaatgcacggaaagtacaccattaatgacgaagatgaacaatcctttcctttgtttgagacgagtgaaagcttccctgatagcatatctgaatgcaacaaagcaggcttttttaatattactgaaggtgcatatggagacgtctctatactgattaatgatggagacaatacaacaagctggcaagccaaatataacgatacaacaggtaaggttcttgttgatttgaagtcttttagaaatatttctagtggaacttttatttggggagacaaaccacctaaaagagtaaaagtttctaaatactcaggcagcagttttacagctgtcaccgactttttcgcacaagtggattttggtaacgagttgtttaatgagtataaatatgctaacccagaaggaaaattgcataaccaaagcgatgtgtttgaagaggtgtattccggggatgtgaagatttccgctccttttgaccccgaagagtatttccaggtttgggttccaacaagacacaacatcacggaagtggctgtgaatctacaaacccgttttttgctaattgaagttgatgagattcacaacacagaagccattgatggagattatggcggggcaaaactagctgaagttgttttttattaa

SEQ ID NO: 3245 - DNA, 2046 bp, Candida albicans
ctattatccaaaatgccttctcttgatgaattaactatcagtacaattagaggtttgtcagttgacgctgtttccgctgccaactcaggtcatccaggtgccccattgggtttagctccagctgcccatgtcgtttggcaaaaaatgaagttcaacccaaaagacccaaactggatcaacagagatagatttgttttatccaatggtcacgcttgtgctttgttatactccttgttggttttatacaaatttgaattgactgtcgatgacttgaaacaattcagacaattgggttctaaaaccccaggtcacccagaagccactgacactgctggtgttgaagtcaccaccggtccattgggtcaaggtatctcaaatgctgttggtattgctattgctcaaaaacaatttgccgccacctacaacaagccagatatcaccctttctgactcttatgtttacacttttgttggtgatggttgtttgatggaaggtgtttcttctgaaacctcttccttggctggtcacttgcaattgaacaatttaattgccttctgggatgataacagaatttccattgatggtgacactgctgtttctttcactgaaaacgtcccagatagatacagagcctatggttggaatgtcctcgaagtgccagatgctaacaccaatatcgaagccattgccgctgctgttgacgaagccaagaaatccactgacaaaccaactttaattagattggttaccaccattggttacggttctttgaaacaaggttcccatgatgtgcacggttctccattgaagccagatgacatcaaacaattgaagaaaagttggggtttcaaggaagatgttgactttttcattccagaagaagtttctgaatatttggccaaacacgtgtctgaaaaccaaaaagttcaaaaggaatgggaagccaaacttgctgaatataaaaagaaataccctactgaaggtgctgaaatccaaagaagattggatggtaaattaccagaaggttggaaggaatacttgccaaaatacactccagctgacaagccattggctaccagaaaattgtctgaaaatgttatcaatgccttgcacggtaagattccagaattcattggtggttctgctgatttgactggttccaacttgaccagagcagaaggctctgttgatttccaaccaccatctactggcttaggtaactacgatggtgtctacatcagatatggtgttagagaacatggtatgggtgctatcatgaacggtattgctgcctttggtgccaactacaagaactacggtggtactttcttgaactttgtttcatacgctgctggtgctcttagattgtcagccttatcccaccatccagttatctgggttgctactcacgattccattggtttgggtgaagatggtccaacccatcaacctatcgaaactttagctcatttcagagccattccaaacttgtctgtgtggagaccagctgatggtaatgaagtttccgctgcctatgctgctgctattgaatctacttctcatccatctgttattgccttgactagacaaaacttgccacaattggaaggctcatctattgaaaacgccttgaagggtggttacactcttgtcaagaaagacaacccagacgttattattgtttcttctggttctgaagtttcaatttctgttgctgctagtgaagaattagctaaacaaggagttaaggctaatgttgtttccttgccagactttttcaccttcgaccaacaatctgatgaatatagattgtcagttctcccagatggtgttccaatcttgtctgttgaagtcatgtccaccttcggatggtctaaatactctcatgaacaatttggtttgaacagatttggtgcttcaggtaaggctgctgatttgtacaagtactttgagtttactccagaaggaattgctgaaagagctcaaaagactattaaatattacgaaggtaaacaattgttgtctcctttagacagagctttctaa

SEQ ID NO: 3246 - DNA, 954 bp, Candida albicans
cggctgttggacaatgaaaaagataggtcctcgtgccttctaaattccaatataaataacatcaaagtcgacgtaccttatgactatgacagataccccaaaatcattggcagagtatcatcgagtaactcgttaaataatactagcaacactgccccctatcagtctgaaacaccatcaatatcatccaactcattcaataaaaatgtcaataatacattaaacggtagctacaacaacattattgattttagtccatttggtggctatcctgccagttcattcccacttaatatcgatgaaaaagaacctgatgattatcttcataatcctgacccagttcacgacgtgatttatgagaaaaatagattttggaatgatttgaaaactgctgatcgtaaatcatttggtgggattttgggcttcttatttttgattgcagcagcagtggcggtgtttgtcgtggtcccagcattgacttattcgggagtaaccactcatagtcctccacaggaatacgagattttaagccactattcatatccattactttcagcaattcgtacttcattgatcgacccggatactccacaggacgctttgaaaatgaaagctaaagacggtagtaattggtctttggttttcagtgatgaatttaatattatgggaaggactttctatgaaggcgacgatcaattttggacagcccctgacttgcactatgacgccactaaggacttggaatggtacgaccccgatgcagcaactacgagtaatggtactctcaatttacaaatggatgcatttaaaaatcatgatttgttttatcggtcagggatggtacaaagctggaaccagttatgctttactcagggtaaacttgttatctcggcacgtttagctaacaaaggtaccgtttctatcttcaccacaaggggcgggcatccgcgctaa

SEQ ID NO: 3247 - DNA, 360 bp, Candida albicans
  unsure (311),(320),(333),(353): Identity of nucleotide sequences at the above locations are unknown.
agacaaaattggtacgaactaggaggtaatggtgtacacaattttcaaacgtatggatatgaatatttaaatgataaagacaatgggtatttaagatggtttgttggtgataatcctacattgacagtttacccacaagcattgcaccctaatgggaatgttggatggagaccattgagtagagaacccatgtcaattgttatgaatttgggggtttcaaataattgggcttatattgattggcctagtttgagtttcccatcaacattccgtattgattatgttcgtctttatcaaccaccaaatcatanattttttanacacgctttgtgngggaaatttggtttcggggnaaacccc

SEQ ID NO: 3248 - DNA, 291 bp, Candida albicans
gttggttggagaaagttacctaaagaacctttaagtttgattttaaattttggtatatctaataattgggcttatatcgattggccaagtttagttttcccttcaactatgagagtcgattatgtaagagtttatcaacctaaagatcaaattaatgttggttgtgatccaaccgatttcccaacttatgattatattcaacaacatttaaatgtttatcaaaatgttaatttaacaaaatttgaagatggtggttatactttccccaaacataaattaattggatgttaa

SEQ ID NO: 3249 - DNA, 1878 bp, Candida albicans
tgtatcattatgagtagtgattcaagtaatatatcaggattaatatcttcttcatcaacttctaatgataatgataatgatacaactacaactacaacagcccccgtgattaatgaagaatcaggatcttcaactagtggattacaacaaaatttcaccattaaatcacattcacgatatttttctcctcaacggaatataacaaccaaaaaatttaattatttagataatccattttattatatggataaagaatttgaactgcaccaccacggccaacaagatgaagatccgagttatgtaacttcaagaaatggacaaatcaataataataacacgactggtgatggaaacagcagtaaaaagaaaaagaagtctggtgggaaatggcaatggcaatggcaatggcaatggagatttaaacgtattgatttgaaaaaaagtttccgatttattattgctattgtaacaatattagtaatatttgtattagcaatcatttttgctattatgagtagttttataattaataatccaattagaaatggtgataaaattgaaaaattgacaaatataaattatgctcaattgaaatcaattcgaactaatttgattgatcccgatactcctacagaattctacaatttaaacaaaactaatgagactgaagttattggtgagaatggtgattggatattggtattttctgatgaatttgaacttgatggtagaacatttcatgaaggtgatgatcaatttttcactgcggtggaactttattatggtgcaactcatgatttagaatattatttaccacaaatgatcacaacaaataatagtaatttagaaattttatttgataaatttaattattcttcaggattagaatatgtttccgggatgttacaaacttggaataaattatgttttaataaacatgttaaaattgaaattaaagctaaattaccttatgaaattaaaaatgggttatggccagcaatttggtcattaggaaatttagctcggccagggtttttagccactacagatggtatttggccttatacttataatgaatgtgatttaggtatattacctaatcaatcaaccttaaatgaagaaatgtcttatttaccaggtcaaagattaagtaaatgtgtttgtcaggggggagatcatcctaatcatggaactggtcgtggtgcccctgaaattgatataattgaaggattatttcaatatgataaattttggggggtacaaacattacaagtggctccatttgatgaatggtggagaccagattatgattatgtagaaattatagatgataatgtcactataataagagaagatataggtacagtttatcaagaatcaatttctttaggaacattaattgatgatgaatttccatttcaaattttcaccatggaatataaaagtgatagcaacacaaacaacaatagttatataaaattctcaattaatgatattacaacatttgttataaatggatcagctttacatcctaatgaatttataggatggagagaaattactaaagaaccaatgtcaataattttaaatatgggattatcttatatgtggaatccaagggtaaatatcgatgaattgaaattgccagcaaaatttttaattgattatataagaatttatcaacctaataatatgattgaaatgacttgtgatccaatagattatcctactgatgaatatattcgatctcattcaattgcttatgaaaatccaaatttaacttcttggtatcaagcaggatttgatttccccaaaaattctttatcgcatcaatgtaaaattccttggagtgctaccaatgggagagtcactacctag

SEQ ID NO: 3250 - DNA, 2232 bp, Candida albicans
gacctcaaaatggcgtctcaaagagatttaacttcaaataatcctcatttccatatatcgagttctcgtaacaataccaatgatgatttcaattctgatcataatccaagaaatccatttggtgatgaaccagaagaagaagaagaattagattcagcatcattttcatcctcatcacaaaataatcaaccccatcacccttttgctacatcaaatcaaaccctgagcactaataatcttcatagtaccaacagtattcgaaatgaagctgaatatggcaaaccattccaagcttatagtggctactattcaaatggtggtagttcactgtatttaaatcaagaaggtgtgatttctgatgaaagtagactattatcatcgggtaataataataataataataataataatcgagatgtatctagtgttggtggtggtggtggtagtggtgacaatagattgaatccaaccagtccagcagaatttgatagatatccatcaatggcaggttcaagagtagtatcatctacttcattagtgtcgtttaataatccttccaatatgatgcgtaaccaccatcgacatcaacctcatctcggttcatcttcatctccaatttctagtagcatgaataatgattctatatcagataaatcaactagcccctttcctaatgatttcagtccatttggtggataccctgctagttcattcccattgagtattgatgaaaaagaaccagatgattatttgcataatccagatccagtacaggatgctgaatacgaaaagaaccgatttatgcacgatttaaagaacatggataaacgatcattgggtgggttgattggatttattatattatttatagctgcattagcagtgtttatcattttacctgcattgacttattctggagctactaacccttatcatccagaaagttacgaagttttaactaaatatctgtacccaatgttgagtgctataagaatgaatttagtggatccagatactcctgaatcagcttataaaaagaaggctaaagatggtagtgaatgggtattagttttcagtgatgaatttgatgctgaaggtagaactttttatgaaggcgatgatcaatttttcactgctcctgacattcattacgatgccactaaagatttagaatggtatgatccagatgctgtaaccacagccaatggaacattaaatttacgtatggatgcttataaaaatcataatttattctatcgttcaggaatggtacaaagttggaatcaattgtgttatactcaaggtcatttagaaattctggctcgtttaccaaattatggtaatgtaacagggttatggcctgggttatggtctatggggaatttaggtagaccagggtatttgggatctactgatggggtatggccatattcttacgattcatgtgatgccggtattacacctaatcaatcttctcctgatgggatttcttatttgccaggtcaaagattaaataaatgtacttgtccaggtgaattacatcctaatcgaggtgttggtagaggtgcccctgaaattgatgttattgaaggtgaagtgatgactgatagtagtggtaaaaaagaaaattgtggtgttgcctctcaatccttacaattagcccctatggatatttggtatattcctgattataattgggtggaaatttacaatttttcagtttcaacaatgaatacttatactggtggaccattccaacaagcattatcagcaacaaccatgttgaatgttacatggtatgaatttggtgataatgcccataatttccaaacttatggttatgagtatttaaatgaccctgaaacgggttatttacgatggtttgttggtgatgatccaacattaacggtttattcacaagctttacatccagacggaaatattggttggagacctttaagtaaagaaccaatgtcattaattttaaatttggggatttcaaataattgggcttatattgattggccaagtatatctttccccgtcacatttagaatcgattatgtaagagtttatcaaccaccagatcaaattaatgttggttgtgatccaaccgatttcccaacttatgattatattcaacaacatttgaatctttatgaaaatgccaatataacttcatttgaagatggtggatataaattccctaaaaatagtttaattggatgttaa

SEQ ID NO: 3251 - DNA, 1107 bp, Candida albicans
ggcgactttcccaagagttggttgagacgagctaatcctaaattggcagctttgattgctgaaaaattagaagatccaaattatgattacttgaccaacttgggtaaattgaagaaattagaggcttttgttgacgattatgaatttttgaaaagatgggatgcgattaagtttgataataaacgtcgtttagctactttgattaaggaaacaactgatgttgatgttgatccaacagttttgtttgatgttcaagttaaaagaatccatgaatacaagagacagcaattgaacatttttgctgttatttatagatatttgcatattaaggaattgttgagcaagggagtcagtattgaagaaatcaagaccaaacatcacattcctaaggcatcaattttcggtggtaaagctgctccaggttattacatggccaagaccattattcatttgatcaataaagttggtgatgttattaataatgatccagaaattggcaatttgttgaaagttgtctttattcctgattacaatgtttctaaagcagaaatcatttgtccaggttctgatttatccaaccatatctctactgctggtactgaagcctctggtacttcgaatatgaaatttgccttgaatggtgggttgattattggtactgttgatggtgccaatgttgaaatcactagagaaattggtgaagaaaacatctttttgtttggtaacttggctgaatcagtcgaagaaataagacacagacatgtttatgaaggagttaaagtcccagaaagtttacaaaaagtgttccatgccattgaatcaggagactttggttcacctgaagaattcaaaccattgattgaaagtatcagagatcatggtgactactatttggttactgatgattttgatttgtttttggaagcccataagaaattggaaaaagtatatggacatcatggaggtgatgaacatgataagagtcatatgaatgaatgggtcaaaaaatctgttttgagtgttgctaatatgggtttcttctcaagtgacagatgtattgacgaatatgctgaaaacatttggaatgttgaaccatccaatgtttag

SEQ ID NO: 3252 - DNA, 1428 bp, Candida albicans
gaaacatctttaggtagatccatgtacaattgtgacaatttggctgcttatcaagctgcatcaaacactatcagagatgctttagtcattgattgggctaatacccaacaaagacaaaccattcaagatggtaaacgtgtttattatctttcattggaattccttatgggtagagctatggacaatgccttgatcaatttgaactctgagcaaaacacccagaaatcattatctgatttaggatttaatttggaagatgttttagatcaagaacctgatgcagccttgggtaacggtgggttaggtagattggcagcttgttttgttgattcattgtcttctaaaaactatagtggttggggttacgggttgaattaccaatatggtattttcaaacaaaaaatcattgatggttaccaaattgaaacaccagactattggttgaattattccaatccttgggttattgatagaaatgaaattcaaatcccagttgacttttacggttacgtttacgaagaacacgatccaaacaccgggaaggttaaaaagaattggaatggaggtgaacgtgttttagcagtcgctgccgatttcccaattcctgggtttaacactaccaacaccaataacttgcgtttatggaatgctaaaccaactactgaatttgatttcagcaagttcaatgccggtgattaccaacaatcagttgctgctcaacaaagagctgaatcaatcacttcagtgttgtatccaaatgacaattttgaaaaaggtaaggaattgagattgaaacaacaatatttctgggttgctgcttccttgcatgatattgttagaagatttaaaaagaaccataaatccaattggcagaaattccctgatcaagttgccattcaattgaatgatactcatccaactttggccgtggttgaattgcaaagaatcctcgttgatttggaaggtttagattgggatgaagcttggtccattgtcaccaaagtttttgcttataccaaccacactgtcatggctgaagccttggaaaaatggccagttgatttagttggtagattattaccaagacatttggaaatcatttatgatatcaattatttctttttgaagaatgtggaacacaggtatccaaatgatcgtgatttattaagaagagtttctatcattgaagagagtccaaaatcggtcagaatggcttatttggctattgttggttctcacaaagttaatggtgttgctgaattgcattctgagttgatcaaaacaacaattttcaaagattttgttaaagttttcggtccagataagttcactaatgtcaccaatggtattacaccaagacgttggttgagacaggctcatcctgaattggcatttttgatatgccacaagggtcgaatacccgtataa

SEQ ID NO: 3253 - DNA, 201 bp, Candida albicans
  unsure (123): Identity of nucleotide sequences at the above locations are unknown.
cgccatatttctttcgaccacataatttggctcttattatggggtattgcaaatgaagcagccagattaagagaaataagacaaatgagtgatggaataaaagtggatactaattttgttcanaatctagctctcacatcggtgcaaatggtggggtatatgctatacacttctttagtaccagacatacaagtgccatga

SEQ ID NO: 3254 - DNA, 1263 bp, Candida albicans
actttgaaacatgggttaattcctaatttattggatgctggacgtaatcctcgttataatgctagagatgcagcatggtttttcttacaagcgattcaagaatatgttacttatgctcctaatggtattgatattttggatgaaaaagtcactcgtagattcccattggatgatacttatattccagttgatgatccccaagctttcagttatgaatcttccattagagaaatcatttatgaaattttatcacgtcatgctaaaggtattaaataccgtgaagccaatgcaggaccaaatttggattcacaaatgagagatgaagggttcaatgttgaagttggagttgattggaccaatgggttaatctatggtggtaatcaattcaattgtggtacttggatggataaaatgggtgaaagtgaaaaagctcacaataaaggtatcccagggactccacgtgatggatcagcaattgaaattcaagggttattgaagagtgcattaagatttgttaataaattacacaaacaaggtaaatttgaatatactaaagttaccaaacctgatggctctactatttcgttagaagattgggaatcattacttgctgaaaattttgaaaaacattattatgttcctaaagatccccaacaagatgatcaatatgttattgatccatcaattgttaatagaagaggaatttataaagatttgtataattcaggaaaaccatttgaagattatcaattacgaccaaattttgctattgccatgtgtgttgcccctgaattattcactccagaaaaagctcttggtgccattataattgctgataaagctattcgaggacctattggtatgagaacattggatccatctgattggaattatcgaccatattatgaaaattccattgataatgatgattttgctacttcaaaaggtagaaattatcatcaaggaccagaatgggtttggaatactggatatttcttaagagcatttttattattccatcatttagaagaagaatccagcaaagcatcttcatcactgccatcgattaagattttgacattattgaatgatagattaccgggacatataaaatggatcacagaaagtccatggaatggattaactgaattgactaataaagatggatcatattgtcaagaatcaagtcctactcaagcatggagtggtaattgtttattagatttatattatgatctttggaatgataaacattttcaataa

SEQ ID NO: 3255 - DNA, 957 bp, Candida albicans
ggaagttatttttggggtgaattgtgtcaatatgagataggggaagcatttgaagactcaccagaaacatggaaaggtatgattgaatatattcaattgtctgccaagactttcaatgggtttagaattgacaattgtcatagtaccccattacacgttggtgaaagattattagatgaagcaagaaaagttaatcctaatctttatgtcattgctgaattgtttagtggttctgaagaaatggataaaatttttgtcgaaagattagggatcaattcattgattagagaagcaatgcaagcatggagtgtaggtgaattatctcgtttagttcataaacatggtggtagaccaattggttcgttgacttggttaccattagatgatttcacttatcctgctgctaatgaaccagtcaaggataaattcattgatggatataccgaattggaaattcctaaagtgttaacctgtcaagctcctcatgcaattttcatggattgtactcatgataatgaaatgccagcacaaaagcgaactgttgaagatacattacctaatgcggcattagtagcattttgttcgtcggctattgggtcagtttttggttacgatgaatgttatcctaaattgttgaatgttgtcagtgaaaccagacattatgatcttgatagtgataatggtattggtaaggttaaagccaaattgaataaaattagagatgatcttgttcaagaaagtgaggacgtcacccgtgatcatgaaatgtatattcatcatgaaggacaatatatcactattcaaagatataatgcaagaacaggtaacggttggtttttaattgccagaagcaaattttctgatcatgagtctgcccaaggcttatcaccatcaatccttggtggcactaaagtgaaacatcgtcttcatccacccggcgctggaagatcaagcgct

SEQ ID NO: 3256 - DNA, 771 bp, Candida albicans
ataatggcccttgaatttgattccaagcattggatttggatggggcattttttggagttttcccacagtttgcaagaattaggtttaccaacagtcgttgaatcagaggcagatttacaaaagttcatggacggtattcaaactcacgtgttggataaattaaaattatgggaatattatgttttcaataaaagacaaacaatcgtagacttggaaaaatcttttaatgacaataagaacaatatcaataaaatccaaattcctaatgatgtcgactctcaagatttgaaacaattgagtgattatgttttaaaagtggccaatatcaatccaacacctattataggcgacagatttgccaacaagttgaatgttgataaatttttaggggttttatttacagtatttgataacaatgttgaatttgaaaccattgccaacagggctgaagagattattgatgagataaatagtgatttgtatgctgcatttgatgatgataccaatagtatcaaacaacaagttgccgatcgtatcaaatatttgagattggctgataatgggcccaaattaggtgaaatcactgataaatcaccattgactgaaccatatttcaccagattcaccgatgttaatggtaaaaaacaagctttagccaataatggttggatttggggaggtaatccattagttgattttgcttcaaataaatcaaaggcatataatcttgaggaagttatttttggggtgaattgtgtcaatatgagatag

SEQ ID NO: 3257 - DNA, 897 bp, Candida albicans
tacacaccacaccacatacatatattctccttccaatttagtaaatttacaataatcttactaaaattcatattaagaattaaattccaacatcccttaataaagaccggaacaattttgtttttttcatttcattgcatttttttttttttacttaaatacattactatttccattcttcatttcgtttgtatttccaattcgttcgttttctcaaataaaaacagtacgaaaaccatgtccgaagcacgtactgttttatttcgattatccaatctaggtgagccggtcaataatgagaatattgctaatggagtgttgattttaccagtagtagaattaccatcaaattataaaccgggtgatgctttattccagcttagatttcaattaaatgctgctagtaaagtatcaagaaatgtgactttatacactaatgtgccctcaaagtatgaacaagattttgatagaaacactcattaccaatatccaattaaatcgtcgtttcatgaagatattacaattactgttccaatttataaaccaggtagttataactattatattgaatatgatgatgaagaagataataaaaaaaccactgaaaaatattactttaatgtcccgccaaatttgactatcaatggtaaatttgttccattcaataatatcaatgttgagaccgtggtttccaagtggattggtccttatgaaaactgggacaagtttttcaagattgtggcacaaaaggggtataatatgatccatttcactccattacaagaacgtggtgaatccgattccccttattcgatttatgatcaattgaagtttgacccgaagattttgccctggccagtgataaagatgctatacaaaaaatccataaagtgttaa

SEQ ID NO: 3258 - DNA, 534 bp, Candida albicans
tggggcatttgccatcccgaggtgaagaccactaaagtgaaacatcaatttagttacagtttgataagacaaccaggtgattatgaatcacaacaagataaattgacaggtattcctgtacaagttgaagctattcaaagtccatcgatcgaatacactgatgatggtgattcaataattactattgatgaagcctcgttcattcctggatctattgctgttttctccactgaaattcccggagttgatgtgaaattagacaattttgtgaaacaaggagccattgaagcatcgattgggttagatttatacgatttgaatgccttattatatcgtgcttccactgaagaattggatgctagtaatggcaaagatgatgtttatgatattccagggtatggaagattgacatatgctggattggaaggttggaatacagcattgaaacatgtcatttggcaaaataatttgggtcatgcaatctgtgatcatttacgaaatggtgattgggcttttgattatgtggttaattga

SEQ ID NO: 3259 - DNA, 2181 bp, Candida albicans
tacgtcaatcatttaaatatatattattcctccatctcaatcttttttccaatctttggttgtgccctcgtttttcatttccttaatttttttttctgccttttttccccctccccccacacagccttattattagtcagtccaatttgtggaatagaaagtcaccacttcggaattaataaacatttcaatcaattttttttttttaatcaccaaactatgctggaagtagacacagatgatacacaggaattattagccaccaatgctgcttctggctcctctactacaactggtgcacctagattcgaggtattgtcgtcattatcacaatcacaccaagaaaaatcatctacgaaatacaaaaaaatttcagaatttgttaaaattaatgtgctcggacatcctaataattttgaggaatatgtactacgcaatgaggcaagtgactgttccttgatagcaaaatactgtaagacaactacaattgatttatcaactcaaccaacattatcaatagactccatatctttgaacaccattcacatcccacatcctttaatcaatttcatgaaaaatgaagccaaccagcaattatctcccgatgatcaagttgatgtcagtaatgagttacaagaatcacctattgttgtttttttgcatggattaggaggacaaatgtcacaatttgaaccgttgatgggtttattatcccaatgtctggaaattttgtctttagatttacctgggtttggaaattcaaaattgcaatttgaagaaggctttaaatttatatccgaaatttctgattctgataaatcaaaaatatcttcaagtattcaaaaaatgaattgggacgacttttctaccgacaatattgttagaatagtgtatgaattcattagccagaacgtgcccctgagcaagaagattgtgttgatcggccactcaatgggaactcatatttcgatcaaacttgctaaaaaattgcctcaatcaaaagtcgaaggattaattttgttatcacccccagcattgacagactacattaacacgaacgagcaaaacacgaaaaacactcataatctgctaagcttgtttaccgtgtttacatatttcccctggttattcaattcttttagaacttgggatagattggagggattagatagtgcaagtgttgttagacaattatcgaaaactaataattctatttataataagctaagacaatttagatggaatttggatgttaactctgatattgtattaaaatatgctagcgggtttcaaagggcaacatattcagatttgatatctgcaattagtcggtttaatgataatcctgaagacaaacaagtttatgaaaaaaccgttttcatctgtgggaataatgaccaaatgactccagtttcgacaatatataaatgtgatgagtttttaacttccaattttggtagaaaagtatcagcagccattgaagttaagggtgttggacattcattattattactgaaacccgagtttatcagtggaataatcttgaatcatatagagctgaagttccctgaacgattgcatttatctcctgcttgggtattaaaaatcaaagcaaaagtatctggcgataaatgggggttgaaaaacgaacagaaatggctgaacatacaatccgtgtcgtataatattacaagaaaccgaggcaaagatattgcaccattgttaggaatgaagacattaagagaaagcgatccaattcattcaccatctattttagaaaagcaattttatggggacaattcatcaaatcaaataaaggggaacttgattgctataattgacatttccgccgacatccctccttacagccccaaatcctttgaaaaaataaagtattacaaatgtgctaccgtatcaaaagtagttccagatcaaagtgcgattcgaagatttatacaactagtcaatgatattttacatgaaaatacagtagcaaatccattgatagctgttcattgccattatgggttcaatagaactggatttttaatttgttgttatttaattgaggtattggggtggtcagttgaagaagcagtagaaggattcaaaatagcaaaacaacctggtatcaaacatcctcatttcattgatgcattgtatgtcagatatgaaaaatga

SEQ ID NO: 3260 - DNA, 261 bp, Candida albicans
gttcacagaggatttcatgattactatacaagaaccttatccatcatccatccgtatataatggaggagttgaataattgtatcgaggatgataattatgaactaattattttgggccattcattgggtggatctattgcctatctactagggttgcattatcttgatttaggttttgataagctaaccttggtcacaatgggacaaccattgcttgggaatgaaaattttataagttggggggggggggcaaaggtataa

SEQ ID NO: 3261 - DNA, 1092 bp, Candida albicans
aataaaaggaaaaccatctggttttttttttttttggttgcctggttgtttgtttgtttgtttgttttcaatttgttcaatttactattgatgcttatactaattatcattgtattatattgtctatcgtttgctcaagaatataaaactgataatgaaccagcacaagattataagaaaatagtacaattttctaatttggctgcagttgcctattgtgtgggtagagggttatctaaaggacggttaggagataaaggttcaggttgtcatttatctgcttgtaagaatgacattcttaaagatgttgaaattgtgaaaatatttgattttagtacacttaatgaagttggtacaggatattatgctttagataagaaaagaaaaaccataatattagtatttagaggatcagtttcaaaacgtgattgggccactgatattgatttcatccccactaaatacagacccattgttcaagatgataactttgaatgtgaagtatttattcaacaagaatgtattaattgtaaagttcatcgaggattttataattttttaaaagataattccggtgcaattataagtcttggaatcaaatttaaaaaaatttatccggattatcaatttttaattattggtcattcattaggagcagctttcactactttaagtgggattgaatttcaattattaggttatgatccattagttgtcacttatggtggaccaaaagttggaaatcaagaatttgccgatttcaccgatagattatttgatacagaagaagttgcgaattgtattacaatgaagaatgatttttcacgaggatttattagagtggttcataaacatgatataatacctttcttgccaccaatgtttactcatgcaggatatgaatatttcattgataaaaaacaattacctcatgaagaatgtgatatagataggcgagggatggagtattctggattgttgtggaaaagaagttcaggaatacgaccatcgacgttttggcccgatagtttggggaaatacgaacatacacattattttagaagaatcacaagttgtagagatgaagattag

SEQ ID NO: 3262 - DNA, 1299 bp, Candida albicans
acaacaacaaccccaaactcaattattatgccagttcatgaagaaatatctctaatatcaacattattcaatgtatccttattaatactgaaaataattttcctatatatatctagtttattaggagttgattcatttataacaactggtgatgttccaatttccaaatcttcatcaaatcaaccagacaataatcatcttaaaaccagattagttaatgccaaagatattaatgaaattgttgaaacacatggttacaaaattagagaacatgtggtcactactagagatggatatttattagttattcataaattagagaaaattcaaaacaactcttacagtcatcatcatcgtcatatttcaagtactgctaatctttccaaaattgcttattttcatcatggattaatgacaaattcagaattatttgttttgggtactaataaatataaaacattaccttatttgttagtggatttaggttatgaagtttggttagggaataatcgaggcaataaatattctagaaaacatttgaaattatctgcttcagaccccaaattttgggatttttcattagatgaatattcatattatgatatccctgatagtttaacatatattaagaattattatcaccacatcaataacaatacaagcaacaacaacaacaataaccatactggatcaccaacagtattatcatcttcaacttcaactttaacaaattcagatttacaaataatttatattggattttctcaaggttgttcacaattttttgctagtttaagtttatatccacaattgaattcacatatcaaaatgtttattggattatcaccagcaattatccctcaaaatttaaatcatccaatatttaaattacttgttaatcaagcagctaatgataattcttttttatttagtttatttggcagaagagcgattatgccatcagtatcattttggtatactatttttggtccttcattatatgaaaaagttgtcgataaatctttacaattattatttggttggacgggagctaatatttcgcagtcacaaaaggaaattggttatcctcacatgttttcaaattcatcagtgaaatcattattacattggtttcaaataataaaggcagggcgatttcaaatgtttgaggatacttgttgtaatggaatcactaaattatcatgtttatctcataaactgaaacaaaatggcaataaattatcaccattccccatatctgatcatttaaatgtgcctatggtattatttcatgggtga

SEQ ID NO: 3263 - DNA, 1656 bp, Candida albicans
ataatacaacaaaccttcaaatactatacgacaatgacgattccacttattggtagactcagtttactggattggccattgattattatctccttcactttggcatgggtcgagtttattatttcattgataacaactcttttgccaagtaaattcatcgatttttgtacatttgtcaccaaacaagtgtacaagttcacaccaaatccaatcaccctaattatcaaacagaaaaagattgatataaacgatgaagagaacattaaatatctgtatataaaatccgatattcccaagttcaccaagaagagttacgatttgactattgaattattgaattcggaaaatattgaacagatggtcagtttatttggatacgaaatagagagcagaatagtcagaactcaggatgattatcttttgaccatccatagaataaaaggtaagaatagaccatctaacgggaaagttatatatttacatcacggtttattgatgtgcagtgaaatatgggttactatgattgacaagtaccagaacttaccatttatattgtatgatttgggttatgatgtttggttgggcaataatcgtggtaataagtacagccaaaaacacttgttttacaatttgaattccaccaaatattgggatttttcaattgatgaatttgctttatttgatatccccgacactattgattacattttacaaaccaccaagaaatccaaattgacttatatcgggttcagtcaaggcagtgcccaagcctttgctagtgtatccgttaattccgatttgacggacaaaatcgatcagttgattgccatatccccagcaacaacaccgcacggtttgtattcaaaattcttagatattttgttgaaatcgtcgcccaatgtgatttacttgttgttcagtcgaagagtgttgatgccatcatgtattttttgggagagaataatgtacccaccattgtttgataatatgattgacatagccaactatttattatttaattggcgagccacaaatattaccaaattacagaaattaagtagctatgcacacttgtattctacaacaagtgtcaaatgtgttgttcattggtttcaggttatgtcttcaaaaaatttccaaatgtaccatgattcaaattcgaatttgtcgggattaaagccaataagttaccctttgaaaaacattcaagtccctatacgtttaatttacggaacaacagattcattggtggacatagacgtcatgaaatcacaattgcctaagctgacaacgaaagcttatcctgttgagaatcacgaacatttggataatttatggggtaatgatgtttacgaagtagtcttcaaaaaagtattgagatttttaggggaagacactgataaagtatatgcaaggttgttccgtcaaagtgaggacactaagtttattgaagatataattcagaccgatgagtcatttacagttgatgacggagaaacgttgaacaacagcagcggtaatgtcaatcaatcgtacctcaaatcagctggcaatgctagatcggcaagcaacagtggtaatattcaagttgagtcagatatagtaatagattatgaacgacaacaatcaataggaggcaccagtatatttttatag

SEQ ID NO: 3264 - DNA, 183 bp, Candida albicans
ttggtcaccaagacttttgctagattaatatacaatgattacgtttctaacccatctaaatttgctgatttaattgatgacaccaccagatcaaccattgaacgtttaatttatgatgaaagtttgactgataaaattttagaaaagacttttgttggttttgccccagtattaaccaattaa

SEQ ID NO: 3265 - DNA, 828 bp, Candida albicans
  unsure (658): Identity of nucleotide sequences at the above locations are unknown.
gaagcttccctcctcatttgttttccttccaagcatatattccaatcagatctaaaattacatatggtcatgactaactcaccacaaaacattggtatcaaaggtattgaagtatacattcctggtcaagctgtcaatcaatccgatttggaaaagtttgatggtattccacaaggtaaatacacaattggtttaggacaaaccaatatggcttttgtcaatgatagagaagatatttattctatttctttgaccgttttatctagattgatcaagaattattccattgataccaacaaaattggtcgtttggaagttggtactgaaacattgttggataagtctaaatccgtcaagtcggtattgatgcaattgttcccaggtaataatgatattgaaggtatcgacacagttaacgcttgttacggtggtacctcttcagttataaatgctattaattggatcgaatcatcatcatgggatggaagagatgctattgttgttgctggtgatattgctatctacgacaaaggtgctgccagaccaactggtggtgttggtgctattgccttattaattggtccagatgcaccaattgtatttgattctattcgtggttcatttatggaacacgcttacgatttttataagccagatntcaccagtgaataccctgttgttgatggtcatttctcattaagttgttatgttaaagctgttgacaactgttacaaaaattactccaaaaaaatcactggtgatgccaacaagactgttggtgtttatgatcattttgatttcagtgccttccatgttccaacttgttaa

SEQ ID NO: 3266 - DNA, 324 bp, Candida albicans
tactatgttggttcagataacttgaaaaacaaaagaatcagtattttctcctatggttctggtttggcatctactttattgtctgtcactgtcaaaggtgatgtgtctgcaattactaaagttttagattttgattataaattgggtgatggtagaaaaattcaatctccagaagattacttggcagccattgagttgagagaaaaagcccatttgcaaaagagctttaaaccacaaggttctactgacaacttgagccaaggtacctattacttgactgaaattgatgacaagttcagaagagcttatgctattaaagaatag

SEQ ID NO: 3267 - DNA, 1242 bp, Candida albicans
aatttaatgaagcattttgaaattgtaattactggtagacctgttccttttttagttgatttaccaaaagatgtcacagcatcaattttaagagaatcaattcctataaatagtacattaccatcaaatgcattgagtcaaatcactaaaaaagccgttagtgaattcacttcagaagctattaaaagagcggctaatattttaaataaagctaaaaaaccaatcatttacgctggtgcggggattttaaataatgaacaaggtcctaaattattaaaagaattagctgataaagctaatatccccgtaacaacaactttacaaggattaggtgcatttgatcaaagagatcctaaatctttagatatgttgggtatgcatggatctgctgctgccaatactgctattcaaaatgcggattgtattattgccttgggagcaagatttgatgatagagtcacgggtaatattagtaaatttgcccccgaggcaaaattagctgcttctgaaggtagaggtgggattttacattttgaaatatctcctaaaaatattaataaagttgttgaagcgactgaagctattgaaggtgatgtcaccgccaatttacaatcatttattccattagttgattctattgaaaatagacccgaatggttcaataaaattaatgaatggaaaaagaaatatccttattcttatcaattagaaacccctggttctttaattaaaccccaaactttaattaaagaaatttctgatcaagctcaaacttataataaagaagttattgttactactggggtaggacaacatcaaatgtgggccgctcaacatttcacttggactcaaccaagaactatgattacttctggtggattaggtactatgggttatggattacctgctgctattggggctcaagtagctaaaccagatgctattgtcattgatattgatggtgatgcttcatttaatatgactttaaccgaattatcttctgccgttcaagctggtgcccctattaaagtatgtgttttaaataatgaagaacaagggatggtgactcaatggcaatcattattttatgaacatagatatagtcatactcatcaatctaatcctgattttatgaaattggctgaatcaatgaatgttaaggggataagaattactaatcaacaagaattgaaatctggtgttaaggaatttttagatgctactgaaccagttttattataa

SEQ ID NO: 3268 - DNA, 801 bp, Candida albicans
attatttcaaattccttatttttctttttgttttacttcttcttcttcttctttcttctttacagattcaaactattaattcaaacaaatatgatttctcgtaatttgagaacttcatcaacgaaaaccttttatggttccattttaagatcacaaattagatcaatatcgaaaaataattctcaacaagctactgctcaatcaacttcacgtccacaaccatctcctgcttttaatactgctgatacatctactcaaccaatcataaatgatccaactcttaataaacacaaatcttccgctatttctagaaagaaaaaggaacaattaatggatgattcattcattggattaactggtggtgaaattttccatgaaatgatgcttagacataaagttgataccgtgtttggatatgctggtggtgctattttaccagtatttgacgccatttataattctgataaatttaaatttgttttaccaagacatgaacaaggtgctggtcatatggctgaaggttatgctagagctagtggtaaaccaggagttgttttagtcacttctggtcctggtgccaccaatgttataacgccgatggccgatgcattaatggatggggtaccattagtggtattttctggtcaagtgccaactactgctattggtactgatgcattccaagaagctgatattgttggtatttctagatcttgtactaaatggaatgttatggttaaaaatgtggcggaattaccaagaagaattaatgaagcatttgaaattgctactactggtaga

SEQ ID NO: 3269 - DNA, 390 bp, Candida albicans
ttccaattagcatattattttgaattgcatgtggggggaataaaagctagaacattccacaacaatcacaatttgaaattcaatgatcttgtgaatgataaactgatgcaagtattatcaaagactcataatactgtatacatagaaagtttcgctgtcttagaagcgtaccgcggtttagggattgggaagaagttattgaattatttaatcgaagagactaagaaaagatttattcatgaaatcattattcatgtaagtgtggccaatcatgaggcaatctcctggtataagaaacagggatttctgcagggtgagttagttcccgattattataaagaccaaggtttggaatcgccagaggcttatattttcactatagcagtatag

SEQ ID NO: 3270 - DNA, 696 bp, Candida albicans
tcgcgggtccttccagccccgtgggctgagacaggttggactcatcaggagactacttacttgaattatcgactaattaaatttcacttaatcgtcatcatatcataccagagtatacaaaatctggtctacaattggagaaccttttttttttctcagatgagtctaataacaactattaatgggttaccataccaccaatttgacatcaataatcaagatgaattcaaacaaatatctaatttgatttccctacatttatcagaaccttattctatatatgtatattggtatttcttaaacaattggccacaatattgttatactgttaaagaacctgaaactaagaaagtaatcggggttattatatctaaaattgaacctcatagaaatgttcgaatgagaggatatattggtatgctcgtgatagatccaaagtatcgcaaacaaagattagcttcaaatttggtcaaattaacaattgaaaatatgaaatctatagataaagttgacgaaataatgttggaaactgaggtgattaaccaaggagcattgaatttatatgaaagtgttggattcttgagaactaaaagattatatcgctattatttgaacactcacgatgcttatagattgattttaccattaggggagaaatcgcgaacaagaattgccttcttgccaccgcttgaataa

SEQ ID NO: 3271 - DNA, 1590 bp, Candida albicans
ttaggtttgcagcatgtaagagaaaaatttttttttattaatttttttttggttctctctccaccttgtaatcatatctatactaacagttattggacagtacaaaaagtagagagtttttcacactgtttagtttttcaattttttttttcatttctcttttttacacctatatttttcctcttttttaattgttttctaattcaatttgtttctatttatcaaacaatgttaagagctagatcagtattaagtgggagtgtgtcgagacgtgcgttagccactcaagcatttaacttttcagttcctccagaatatcaatcgaggactccaccatattctaaattgatcaacaacttatcgacggttaagaaaatattgaaaaaccaaccattgacattagcagagaagatattgtattcacatttatgcaatccagaagaaagtcttacttcatccaatgtaagtgatataaggggccaacaatatttgaagttgcacccagatagagtggccatgcaagatgcttctgcccagatggcattgttacaatttatgacatgtggtatgagttccacagcagttccagcctcaattcactgtgaccatttgattgttggtaaagatggtgctgaggaagatttagttaaatcaatagcaacaaataaagaggtttttgatttcttgcaaagttgtggtgaaaaatacggtattcaattttggggaccaggatctggtatcattcatcaaattgttttagagaactttgccgcacctggtttaatgatgttaggtaccgattcgcatactcctaatgcagggggtttgggtgcaattgccattggtgttggtggtgcaaatgctgttgatgcattgacaggtaccccttgggaattgaaagcaccaaagattttgggtgtgaaattaactggcaaattatctggatggagctcgcctaaagatgtaattactactttagcaggtattttgaccgtcagaggaagtactggttatatcgtggaatactttggtgatggtgttaaaacattatcatgtactggtatggctactatctgtaatatgggtgccgaaattggtgccaccacctcgactttcccataccaagaagcccacaagagatatttgattgacacgcatagagcaccaattgccgaagctgctgattcggtgaattccgaattcaaatttttgcaagctgatgaaggtgccgaatacgacaaagtcattgagataaatctttctgaattagaaccacatgtgaacgggcctttcactccagatttgtctactccaatttccaaatttggtgagaccgcccaaaaggaatgttggcctgaaacagtttccgctgggttgattggttcatgtactaattcttcgtaccaagatatgtcccgtgctgtttctatcattaaacaggctgaagcagttggattaaaaccaaaaattccattctttgttacaccaggatccgaacaaatcagagccccaattgaaagagatggtttgataaacacttttgaaagcaatggggccataatgttggctaatgcatgtggaacatgtatt

SEQ ID NO: 3272 - DNA, 336 bp, Candida albicans
aatcaaaaggagaaaaaaaaagtctacatcaaatactctttttctctttttctatccaacccagtatacctaacgatgttgagattatcaagaaactttaaagctgttgctcctttgagaacttttatcacttccactattaatttccaaaacacaagaattgaatcagatgcttttggtgaaattgaggtgccaaccgacaaatactatggtgcccaaacagccagatccaagctgaacttcaagatcggtggtgaagcagcacgtatgccagtcccagttgtcagagcatttggtattttacaaaagtctgctggttttcagacagccggcagg

SEQ ID NO: 3273 - DNA, 456 bp, Candida albicans
aatgaaccaggaagtctgatcatgcctggaaaagttaatccaacccaatgtgaagccatgactatggtctgtgcacaagtaatgggtaataatactacaatcaccttttcaggagctctgggtcaatttgagttgaatgtattcaagcctgtgatggcatataacttattaaattctattagattgttaggtgatgcttgtcaatcatttagattgcattgtgttgaaagtattaaagccaacaaggaaaagattgataaggtgttgaatgaatctttgatgttagttaccgctttaaacccaaaaattggatatgataacgcttcgaaggctgctaagaatgcccataaaaaaggcattaccttaaaggaatcctgtttggagttggaattattaacttcagaagagtttgacgaatgggtcagaccagaaaaaatgattggtccaaaggattag

SEQ ID NO: 3274 - DNA, 873 bp, Candida albicans
aacatgtcacgtattgaatctgacgcttttggtgaaatctcagtgccggctgataaatattggggtgctcaaacccagagatctttgggtaattttgagatcggcgatattaaaatgccaattccaataattaaagctttcgggactttgaaaaaagccgcagctatcgttaatgaaaaaatgggttccttagaccctaaattatcatctgctattcaagaagctgcttccgaggtaattgagggaaaattcaatgataatttcccattggtggtttatcaaactggttcaggaacccaatcgaacatgaatgccaatgaggtaatctccaaccgtgcaattgaaatattgggtggagaaaaaggttccaaaaaaccagttcacccaaatgaccattgtaatatgtctcaatcttctaatgatactttcccaactgtcatgcacattgctgctgttagtgaagttgaacagcagttattgccaaaattgaccgctttgagagatgcctttgaagctaaatcaaaagaatttagtgacatcattaaaattggtagaactcatttgcaagatgctactccattgacattgggtcaagagttttctggttacgttcaacaattgacttttggaatcgaaaggattaagctgactttaccaagattatcaaatttagcacaaggtggtactgctgtaggaacaggtttaaacaccaaaaaggggtttgatgttaaaattgctgaagaaatatccaatttaaccggtttgcaattccacactgctccaaacaagtttgaagcattggctgcacatgatgccatcgttgaaacattttttcaaccacgcgtgctggaagggccaacgcttcggtgcaac

SEQ ID NO: 3275 - DNA, 597 bp, Candida albicans
  unsure (27),(29): Identity of nucleotide sequences at the above locations are unknown.
ttgggttctggctgctccgtagtgaananaacggccggtgccttgaacactgttgctgcttccttgttcaagatcgccaacgatattagatacttgggatcaggtccaagatgtggttacggtgaattgtccttgccatcgaatgagccaggttcttctattatgcctggtaaggtcaacccaacccaaaatgaagccttgactatggtcgccactcaagttttcggtaacaatgctgctattacctttgctggtgcttcaggtcaatttgaattgaatgttttcaaaccagtcatgattgccaacttgttatcatcaattagattgattgctgatggtgctgcttctttcagagtgcactgtgtcgatggtattgaagccaacactgacaagattgacaagttgttacatgaatcattgatgttggtcactgcattgaacccaaagattggttacgatgctgcatccaaggttgcaaagaacgctcacaaaaaaggtattactttgaaagaatcttgtttggaattgggtgctttatcgtctgaggaatttgaccaatgggttagaccagaaaacatgattggaccaaaagattaa

SEQ ID NO: 3276 - DNA, 906 bp, Candida albicans
catataagaaggaaaaaaaaaaccaataagcaaaaaaaaaattcaccaagtctaacttttccttttctctctctttttaatcatagtatcattagaccattcaatccattaataatgttcagatccattcttcatcaacaaaaagctgttcaattcagcgtaagatccttagctactgcagctgctgaaaaggcaccaagattaaagaaatttcaaatttatagatggaacccagatactccagaagttcaacctaaaatgcaaacctatgaagtcgatttgaacaaatgtggacctatggttttggatgctcttttgaaaattaagaatgagcaagatgctactttgactttaagaagatcatgtcgtgaaggtatttgtggttcgtgtgccatgaacattggtggaagaaacacattggcttgtttatgtcgtatagatcaagatgaatccaaagacttgaaagtttacccattaccacacatgttcgttgtcagagatttagttccagatttgactcatttctataaacaatataaatccattgaaccatatttacagagagaatctaatccagctgatggtagagaacacttgcaaagtattgtagacagagctaaattagatggtttatatgaatgtatcttgtgtgcttgttgttctatttcttgtccttcatactggtggaatcaacaacaatacttgggtccagcagtcttgatgcaagcttatagatggttaattgattccagagatcaagccactgctaacagaaaggccatgttacaaaactccatgtccttgtacagatgtcacactattatgaactgtgccagaacatgtccaaagggattgaatccaggtaaagctattgctgaaattaagaaacaattggcatttgattaa

SEQ ID NO: 3277 - DNA, 465 bp, Candida albicans
ttcactcattctactcactcaccttacaccctcactcactcaaacaattatatcaacccaaaaaaaaaaaatcttcactacaccaataacaaagaaccaatagttcaatctaataaaccatccttccccctagcctgccacaacaacatgatttctcgtattggattattgaaaagacctaccgtgtccactttaaataactatgtcaaattacaatcgacattagcccttaaaagatacacatcaaccgtaccagcaacttcaaatcaagaacaagaaatattggttgcccaacgtaaaaatagacctacatcacctcatttacaaatttatgaaccacaattaacttggatcatgtcatcattccatagaatcactggtgtcgctatggccggtgccttttatgctttaacttgtggatttgctgctacttcaattttaaatattccatttgatactactaat

SEQ ID NO: 3278 - DNA, 768 bp, Candida albicans
attaatgactttttaatggaattactcatgattataaatgcttgtcgggttgctactgcgacaagaatcatagccgttattccaagtttcccttatgctacactagattttaatgacaaaagtagagccccaataactgccaagcttgttgcaaacttaatacagacagctggatgtgaccatgtaataaccatggatttacatgcatcacaaattcagggattctttagagttcctgtagataacctttatgcagaaccctctgtgttaagatacattaaagagaattataaacaatccgatataataatggtgtctcctgatgctggaggtgcaaaaagggttgcctctttagctgataagttggacatccaatttgcccttattcataaagagagacagaaagctaatgaagtctcgaagatggttttagttggtgatgttacagacaagatttgtcttttgattgatgacatggccgatacttgtggtaccttgtgcaaagcagcagatgtgttattggaaagcaaggccagaaaagttgtttgtatgatcacacatggaatattctctggtaatgccattgagcgtttgaacaattcaaaactagaaaaagtcatttgtacaaactcgttgccagtgcaagataagttaaagcaatgcgataaaattgaaatgttggatataagctccactttggctgaagctatcagaaggttgcacaatggtgaaagtgttagttatttgtttaataatgttccagaatag

SEQ ID NO: 3279 - DNA, 999 bp, Candida albicans
attagccacaatttcttcccatcttcctccccccacatgtctaccaattctataaaattattagcaagtgatgtgcatagaggtttagccgaactcgtatccaaacgattaggattacgtcttacacctagtgaattgaaaagagaatcaactggtgaagtccaattttccattggagaatcagttcgtgatgaagatatatttattatttgtcaaattggttctggtgaagttaatgacagagttttcgaattgatgattatgattaatgcctgtaagacggcgagtgctagaagaatcacagtgattttgcccaattttccttatgctagacaagatagaaaagataaatcaagagctccaattactgctaaattgatggccgacatgttaaccactgctggatgcgatcatgttattaccatggatttacacgcctcacaaattcaagggtttttcgatgttccagtagataacttgtacgctgaacctagtgtggttagatacatcaaggaaactattgattatagtgaagctataattatatctcctgatgctggtggtgccaagagagctgctggattggccgatagacttgatttgaattttgccttgattcataaagaaagagccagagctaatgaagtatctcgaatggttttagttggtgatgtcaccgataagatttgtgttattgttgatgatatggcggatacttgtggtactttggctaaagctgccgaagtattgttagataataatgctaaagatgtcattgccattgtcactcatggtatattatctgggaacgcaataaaaaatatcaacaattctaaattgaaaaaagttgtatgtaccaacaccgttccatttgaagacaaattgaaactttgtcctaaattggatacaattgatatttctgctgttattgctgaatctatcagaagattacacaatggtgaaagtatttcttatttatttaagaatgccccattgtaa

SEQ ID NO: 3280 - DNA, 1146 bp, Candida albicans
tcgattttctctctcaatcccacagtgtccacgttgtcttccctaaacatgcgtaaatgcaaaatttttgttggttcatcccatcccgagttgggtcaattggtctgtgatagattgggtgttgaaccggctccatgtactttaaagaaattttccaatggtgaaacatcagttcaaattggggtttccgttagagatgaagatgtctatattattcaaagtggatcaccacacattaatgaccatataatggagctcttgattttgatttctgcatgtcgtggtgggtcagccaacaagatcactgctgtgatcccacaattcccttattcgaagcaatcaaaaatgaaaaaacatagaggggccattaccgccagaatgttggccaatttattggtgatggctggtgctgaccatgtggtatcaatggatttacatgcatcgcaaatgcaagggtttttcagcaagcccgtggacaatttatttggtgctcctactttagcacgttggatccgtcatcatatcccagattgggaaaatgctgttgttgtttccaaaaacccgggtggtacaaaacgtgttactgcattagcagattcattaaagattaatttcgccatgattcataccgacagaagaagaactcaagatgaatatgccaagaagaaagagttgaaacaggcacaaataattgaagaaggtgaagacaatatcgtttctgaattgcaaactgcaagagtcgtgcaaggccatgttgttgatgatgattatcaagcaaatggtacttctgaacatctagccaaagagggtattttggacagtgacgttttgggaggtacttacgatgccactggttctgatgacgaagatgagactaccacttcaagcgaagagaaattgatcactttggttggtgatgttaaagataaagttgccattatattagatgatatgatagataaaccaaattcgttcattgctgctgcagagcatttaagattgaattgtggtgccaaagctgtttatgttgttggtacacatggtgttttcaacgataaatgcttgaaggacttgactgattcgaaatgtattgacaaaatcgttgtcagtcttcaaccagccaggctgccaggaaatacgtcaaag

SEQ ID NO: 3281 - DNA, 903 bp, Candida albicans
tgtgataagttcccaccaaacactcgtagtgacgaacaatcaagaggtattgccaaccatttgattgagttcttggaacacgaagtcaaacaaggtagattgccagccaatttgcacccattacaatctggtattggtaacattgccaatgctgttgttgaaggattggcttcatcaaatttcaaaaacttgactgtgtggacagaagtcttgcaagattcatttttggatttctttgaatctggctcattggattacgccactgcaacttcaattagattgaccaatgatggttttaagaaattttatgacaattgggatacttattctaagaaattatgtcttagatctcaagttgtttccaactcaccagaaatcattagaagattgggtgttattgctatgaacaccccagttgaagttgatatctatggtcatgccaattctaccaatgtcatgggatcaagaatgttgaatggtttgggtggttctgctgatttccttagaaacgccaaattgtcaattatgcatacaccatctgctagaccatctaaagttgatccaactggtctttcatgtattgttccaatggcttctcatgttgatcaaacagaacacgatttagatgttgttgttactgaacaaggtttggctgatcttagaggattagctccaaaagccagagccaaggtgatcattgataaatgttctcatcctgattataaaccacaattgcaagaatactatgatagatcagtattctatgccaccaagaaaaagactttacacgaaccacacattttgagagacgtgtttaagatgcatttgaacttccaagaaaatggtaccatgaaattagattcttgggatcagaacttgtacggatttttcacatcgcaatag

SEQ ID NO: 3282 - DNA, 504 bp, Candida albicans
  unsure (494): Identity of nucleotide sequences at the above locations are unknown.
atcatgtcagctattttaaaacaaagagttagatatgctccatatctcaagaaattaagaactggtgaacaatgtattgatttattcaaacacggtcaatatttaggttggtcaggtttcactggtgttggggcaccaaaagtcattcctactacattagtggatcacgttgaaaaaaataatttacaaggtaaattgggattccatttatttgttggggccagtgctggacccgaagaaagtagatgggccgaaaataatatgattttaactagagctcctcatcaagttggtaaaccaattgctgctgctatcaatgatggtagaactcaattttttgataaacatttgtcaatgttccctcaagatttaacttatggattttacaccaaagataaaccaaatggatctaatttggattatactattattgaagccactgctatcactgaagatggatccattgttcttggtccagctgtacgtgcctcttntttttcgtaa

SEQ ID NO: 3283 - DNA, 996 bp, Candida albicans
  unsure (969): Identity of nucleotide sequences at the above locations are unknown.
tatttatataagcccaaaattactggattaaaaaaaaaaatcgtaataatgttcaaacgattcttctcttatacaccaagaactttcaagatggcaacattcaacaattcctttttgatgaaccacacgtgtcttcgtatcaaagacccaaaggtttcaattccgttttatactgaaaaattcggtatgaaattgattgccacctttccattcgctgattttacattgtatatgttgaactacgaaactgaagctaacaagcatctcaattggtctgccagagaaggtgtgttagaattatgtcacaatcatggtgttgaaaacgattcaaattataaattgaacaacggtaacggtgagaaagatcgtggatttggtcatatctgtatgtcagttgataacattgaagcatttcaagatcaattgttgaagagtgaagtaaagttccaaaagaagttgagtgatgggagacaaaagaacattgcttttgctttggacccagatggatattggattgaattgattgagaacggaatcaacaaggttgcaaataaaaccgaggtttcctcctacaaattgaaccatactatgatcagagtaaaggatcctaaaaagtcattggagttttaccgcgatgttttaggatttaaattgttgtctactagtgaacatgagggagctaaatttaccttatactttttaggttacgaccacgatccaaactttaaacaagatacattggttcgtaacgaacaagccaagagagaaggtgttattgaattgactcacaactggggaactgaatccgatccagaattcaaaggctaccataacggtaacagtactgaaaatggtgctttgcaaggttttggacacacatgtgttagttgtgaagatcctgctaaattttgtcaagaattggaacagaagtctggtgacaaattaaattgccctttgaatgggaatcanggaagatcactaaaattgcctccctaa

SEQ ID NO: 3284 - DNA, 1323 bp, Candida albicans
tccaccatgcctatgttaaaagatccctcagtgaaatataagaagtttccaaatgtcaatttgccaaaccgtcaatggccatcaagaagcttggataaaccaccaagatggttatctactgatttgagagatggtaaccaatcattacctgatccaatgtcgatctctgaaaagaaagaatatttcaagaaattggttgatataggattcaaagaaatcgaagttgccttcccctcagcctctcaaattgatttcgatttcactagatttgccgttgaaactgccgctgaagatgtttcgattcaagttctttctccatgtcgtcccgaattgattggtagaactgttgaatctttgaaaggtgctaaaagagcaactgtccacatatatcttgccacttctgattgttttagaaatgttgtgtttggactttccaaagaagaatcaaaggccttagctgtgaaatgtaccaaattggtgagacaattaactaaagatgatccttcaactgccggtacagattgggattttgaattttctccagaaactttttctgacacagatttggattatgctgttgaagtatgtgaagcagtcaaagaagcctgggggccaacagaagataaaccaattatatttaatttgccagcaactgttgaaatggccactcctaacatatatgctgatcaaattgaatattttgccactcatattactgaccgtgaaacagtttgtatttcattgcatcctcacaatgatagagggtgtagtgttgctgctgccgaattaggtcaattagctggtgctgacagagttgaaggttgtcttttcggtaatggtgaaagaaccggtaatgttgatttagtcactttagcattgaacttgtatacccagggggtatcaccaaaattggacttttctgatttgaattcggttattgatatagttgaaaaatgcaacaaaattcctgttcatgctagagctccatacggagggtctcttgttgtttgtgcctttagtggatctcatcaagatgccatcaaaaaggggttcctggctcacgaaaagaaaaaagaaaaagcgggaggcaaagaagttcattggcaattaccttatttaccattggatccagaagatattggaagaacatacgaggctattattagagtgaattctcaatctggtaaaggtggttctgcttgggtgatcttgaaaaatttggaattagatttacctcgtggtttacaaattgccttctctaaagtggttcaagcacgtgctgaagttaaaggtcaagaattaactaacgaaagaattatgtga

SEQ ID NO: 3285 - DNA, 426 bp, Candida albicans
ctaacgaaagaattatgtgagttattcaagcaagaatatttcattgattatgatgatgaagccccagaacaatactttaaattagtagattactcgatatcgacaccaagcaaaggaatcaaggaaatccaagctgatattgaagtcgatggtaaagtcatttctatcaaaggtgaaggtaatggtcaattatctgcctttaataatgccattgctaaatatttgaatattgatattgacgtgaaacattatcacgaacattcccttggtgaagattcaaaagcccgtgccgccacttatattgaagtcttggtcgataaaaaagttgcaagatggggtgtgggtattcatactgatgtttctcaagcttcattcttatctttgatatctattttgaatggtttgcataaaaataaaaacatttaa

SEQ ID NO: 3286 - DNA, 1779 bp, Candida albicans
tttttcacttcaactaccctttctttttccacaacaacgatgcaaaaggttttccaaagatgggtatctagaatacccccagttaagctccaatataagaatatgcttagagacccttccaaaaaatactctccaccaaaacagatcaacttgcccaatagaacttggcccaccaaagtaatcactaaagctccccgctggctttccactgatttaagagacggtaaccagtccttgccagatccaatgtcggttccagaaaaaaaagaatacttccataaattaattgatattgggtttaaagaaatcgaagtttcgttcccctctgcttcgcaaactgattttgatttcacccgatacgccgttgaaaatgcgccagatgatgtaactattcaagtcttgacccaatctcgtgaaccattgatcagaagaacagtggaatcggtaaaaggggccaagcgtgctaccattcatacatatttggcaacctctgatgtattccgtgaagttgttttcggtatgagcaaacaagacgctatagacaaggccattgaaactacaaaattagtgagatcattaactaaagatgaccctaacatgcaagacactgaatggaatttggagttttctccagagtgtttctcagatacgccagttgaatttgccgttgagatttgtgaagccgttaaaaaagcttgggaaccaacagtggaaaacccaatgatcttcaatttgcctgccacagttgaagttgctggtcctaatgtttatgctgatcagattgaatacttttgtcaaaacataactgaacgtgaaaagattattgtctccacccatactcataatgaccgtggctgtggtgtcgctgctaccgaattgggtatgttggctggtgccgatagagtggaaggttgtgtgtttggaaacggtgaaagaaccggtaatgttgacttggtcacggtggcattgaacttgtacacccaaggtattgcgccaaatttggacttttccgatatcgagagcattattgaggttagtgaacgttgtaataaaatcccggtgcccgcaagatcaccttacggtggctcacttgtggtgtgtgccttcagtggatctcatcaagacgccattaaaaagggttttgctaaacaaaagggagacaaatgggctatcccatacttgccattagatccaaaagatattggcagaacttacgaagccgtgattagagtcaactcccaatcaggtaaaggtggtgctgcctgggtcatccttagatctttgggattggacttgccaagacacttacaagttgccttttcaggattggtgcaaaacactgctgacctgttgggtagagaattgaaggttgatgaaattgtcaacttgttcaacgaacaatacttggtgagtgcccctttaagcattcaggattttgaaatcaccaagaataaaaacgatgaaagagaaattgttgctcaattaaatgatggcatcaccattaaaggtcaaggtaatggtcctatctctgcttttattgatgcaatttctaacaagttcggtgttttgtttgaagttgtaaactatcaagaacattctttgggaggtggttctagtagtaaggcagcaacttatatcgaattatcatatgttaatgccaatggtgaaaaagttactagatggggttgtggtatcaatcacgatgtgtcacaagcctcaatcgaagccattcttagtgttgtaaactatttgattaaaaagaatgaattaactgtatag

SEQ ID NO: 3287 - DNA, 2079 bp, Candida albicans
tataaaccaatgaatcatacgtttagtctatatgtagaagaaggttttaactgttattgttaccttctcaatttagattatagattcattgaagatcaatcaataatgaaaacgttaaagaagaagaagaaagaaagaaagaataatgagtggaaaaaaaaaaaaactcaaaaaaaattcaaaaaaattcaaacaccgatattcccatcaatcaacaccaatccacgattaacacccattgcccctccattggtttcgatgattcttcttattgattcatacgattcttttactaataatcttgctcatttattaaaagaaagtactgggcaagaagtaataactattcataatgattcattcaaacctaatgaatatgaaactttttatacccaatatcttccattgtttcaattcatagtaattggtccaggaccaggacatccagcaattgaatctgacattggaattattagttggttaattaaaaagtttcaacaacaacaccaagaaaatgataataatgttgtacctatattggggatttgtcttggatttcaaagtttatgttatgaatttggtaatgatgtatcaagattacagaaagtgaagcatggtcaagtttatgatatttatcctgtatccaagagtgaattgtttcctgatgatgaatcaccatttggaagtgttagatatcattcattgtatgttgagaatactaatgatgagatcatccccttggcttattgttatgaaccactggaaactgattcacaagataagcagaaacagaagcagacaaataaaattttgatggcaatgaaacataagaagttcccattttatggagttcaatatcatccagaatctatatgttcatctaaaggttcagatttgatcaaaaattttaatgatattgcccaacaatacaatgaaatatatagaccaaacgtatttaaacaaaataaagtatcaaattggttggataatcatgccgttcatgaagattatttaattaaagatggtaaatttatttcaaatgaattacacaatatttatttccagaaattacaattggataaagaaatattacccattgatgtatgtgattatttttaccaacagaatagcgaccacaaatgtaatttcatattattaaattcagcgtcaatacctggtgaatggtcaattattgggttaccaactattggagaaagtgaaattatcactcattcagtcgatgatgagaatcacatttatttatcacaatttggatctaaaaccaatgaaaaacaaacgttagacggcaccgacacagtttggaatttcattgccaataaaatgcaaaaggcatatatatcacgtgaaacaatcaaactgaaattgaatgattatggcaagcgtgaattaccattttggggaggttatatgggtttaatttcatatgaagaaggacaacatgtgataatcaacaaaatatccaatatttgccaaaatggaacaacaacaacaacaacaacaactccagatttgaaaatggtgttcattaccagatttatagcatttgatcacgtgacaaagaattggtttattgttgctattaatgacaatgatggtactaattggggtcaacaaatgataaatgatttgcataaagttgagaagatcaaccttgataatattccagattcagtcaataaattggctacaaaaggtgatgaggatttaattgattttgaattaccaaatcgtgatatttataagaaacaattcaatcaatgtcaagaatatcttcattccggtgattcatatgaattatgtcttactactcaactgaaaattcatttacccctgtatatacaaccacgggatatttataaagtgttaactcttcataaaaatccttcaccattttcttgttttatggattttgatgattgttgtttgatttcttcatctccagaaagatttttatcttggaaagatgatattacactgggcaacaacaacaaaatagttcaacttagacctatcaaggggacggtgaaatatactaatgagcttttcaccacgggatga

SEQ ID NO: 3288 - DNA, 648 bp, Candida albicans
  unsure (634): Identity of nucleotide sequences at the above locations are unknown.
ctccttccaccccgtggtgaagacggcaccgacacagtttggaatctcattgccaataaaatgcaaaaggcatatatatcacgtgaaacaatcaaactgaaattgaatgattatggcaagcgtgaattaccattttggggaggttatatgggtttaatttcatatgaagaaggacaacatgtgataatcaacaagatatccaatatttgccaaaatggaacaacaacaacaacaactacaacaacaacaacaacaacaacaacaacaacaacaactccagatttgaaaatggtgtttattaccagatttatagcatttgatcacgtgacaaagaattggtttattgttgctattaatgacaatgatggtactaattggggtcaacaaataataaatgatttgcataaagttgagaagatcaaccttgataatattccagattcagtcaataaattggctacaaaaggtgatgaggatttaattgattttgaattaccaaatcgtgatatttataagaaacaattcaatcaatgtcaagaatatcttcattccggtgattcatatgaattatgtcttactactcaactgaaaattcatttacccctgtatatacaaccatttctcaacacggcantgaacggtcaagta

SEQ ID NO: 3289 - DNA, 441 bp, Candida albicans
gaagtttcccaattaatgacagttgaagaatataaaacggttttccaattggttagtgttattcaggggaaactttataaagaaggatatcatggaattgatcttttacatcgatcattaccaccaggatcaatgacgggggcaccaaagaaaagatcagtagaattattacaagatattgaatcgatgcaaaaaaattttgttggtggtagaagagggatatatagtggtgttgttggatattggtcaatcactgatgattccgattggtcagttattataagatcggttttccattattctaatgataaagaaaacaaccctaaaaccaaactttggagaattggagcaggtggtgccatcacggttttaagtgatgtggatgatgaatgggatgaaatgatgttaaagttgactagtgcattacaagcattcaaatag

SEQ ID NO: 3290 - DNA, 1155 bp, Candida albicans
gaaatcgaaataatgtctttcacaaagaaaaatgtcagtttggcagaaggtccagacccaagaagctcgattcaaactgaaagagccaactccaaattcaaccctgaacagatgaactactttttggaaggttctaaagaaagatctgaattgttcaaaggtttagctcaacaaatggaaagagacccagtcttattcactgatggttcttactacgatttaactaaagaccaacaaagagaattaaccgctttaaaaattaacagattagcaagatacagagaaaccgactctattgacacatttaacaagagattatcattggttggtgttttcgacccacaagtcggtaccagaattggtgttaacttgggtttgttcctttcttgtatcagaggtaacggtactgctgaacaattgaaatactgggcctttgacaaagaaacttctaacatcaaaggtatttacggttgtttcggtatgactgaattggctcacggttctaatgttgctggtttagaaaccactgccacttttgacaaagaaaccgatgaatttgtcatcaatactcctcacattggtgccactaaatggtggattggtggtgctgctcactcagctacccactgttctgtctatgccagattaattgttgatggtgaagactatggtgtcaaaacttttgttgtcccattgagagactctaaccacgatcttatgccaggtgtcactgttggtgatattggtgccaagatgggtagagatggtattgacaatggttggattcaattctccaatgtcagaattccaagattctttatgttacaaaaattctgtaaagtttctgctgatggtgatgttgtcttgcctccattagaacaattatcctactccgctttattgggtggtagagttatgatggttttggattcatacagaatgttagcaagaatgtctactattgccttgagatatgctattggtagaagacaattcaaaggtgacaatgttgaccaaaatgatccaaatgctttagaaactcaattaatagattacccattgcaccaaaagagattattcccatacttggctgctgcttacgttacttgtcctagtttttcacatacggacctgaccggatccgaatggaatagt

SEQ ID NO: 3291 - DNA, 582 bp, Candida albicans
cttatgacggttactattcctttgactgaaaccaatcttttcaaaccaatctctattggagatgttaagctaaaccatagaattgttcatgcacccacgtcaaggaaaagatctactaaggacaactatcctactgattttatgattgactactacaaatcaagatctcaatatcctggttcttttatcatatttgagtcctgtttggtgtcagagagaagcggtcttgtacctcataaaatatggttatgggatgaaaaacattgtcttgccttgaaacaaattgttgatcaagtgcattataacaattgtgttatcagttgccaaatcatggctaacggaaggacttcaaatgccaaactcatgcatagtaagaatttacctattttagctccatcaattacttatcctaatgaagctgctgagaaattacctactgaattgaatttcccaatcaagccgttaacagttgacgatattcataatatccaagactattttgttaatgctgctgttaattcattaaaaattgccgattttgattttgttgaatcacatgccacatcttggttttttgattga

SEQ ID NO: 3292 - DNA, 699 bp, Candida albicans
ccttttttttttttatctatcatgtcaaattctaacccattaaaagattcattagtatttcaaccaattaaagttggtgataataccctttccaacagaattgtgtattgtccaaccacaagattcagagctgcaaaagggaatgaagaaccaacatatcgtcatgtccctctggatttaatgcttaaatattattctgatcgtgctcaatatccaggaactttacttgttactgaagccacattaatttctaatcgggctggtggttatgatggatgtccgaaaatttccactcaagaagaaactaaagcttggaaaaaaattgttgatgctgttcattcaaagggatcatttttatcttgtcaattttggtttttaggtagagttggatatccaagtttattaaaacatcgtaaattggattatttggcaccatcaccaatttatgaaaatgaaaaacatcaaaaacaggcagaaaaagccggattaccattacgtgaagttactgaacaagaaattcatgatattatttataatgattatactattgctgctaaaaatgctattgctgcgggatttgatttcattgaattacatggagctcatggttattttattgatcaattcttacatgaatgttctaatcaaagaaacgataaatatggtggtagtattgaaaatagatgtagatttgtgttg

SEQ ID NO: 3293 - DNA, 1260 bp, Candida albicans
ctaactacacatatcaacaacatggatagattaaatcaattaagtggtcaattaaaaccaacttcaaaacaatcccttactcaaaagaacccagacgatgttgtcatcgttgcagcatacagaactgccatcggtaaaggtttcaaagggtctttcaaatctgtgcaatctgaattcatcttgactgaattcttgaaagaatttattaaaaagactggagtcgatgcatctttgattgaagatgttgctattggtaacgttttgaaccaagctgctggtgccaccgaacacagaggtgctagtttggctgcaggtattccttacactgcagctttccttgccatcaacagattgtgttcctcagggttaatggccatttctgacattgccaacaaaatcaaaaccggtgaaatcgaatgtggtcttgctggtggtattgaatccatgtctaaaaactatggtagtccaaaagttattccaaagattgacccacacttggctgatgacgaacaaatgagtaaatgtttgattccaatgggtatcaccaacgaaaatgttgctaatgaattcaacattccaagagaaaaacaagatgcctttgctgctaaatcttatagtaaagccgaaaaagccatctcctctggagctttcaaagatgaaatcttaccaatcagatccattatcagatccccagacggttctgaaaaagaaatcattgtcgataccgacgaaggtccaagaaagggtgttgacgctgcttccttgagcaaattgaaaccagcatttggtggtactaccactgccggtaacgcttctcaaatttcagatggtgctgctggtgttttattgatgaagagaagtttggctgaagccaaaggttacccaattgttgctaaatacattgcttgttcaactgttggtgttccgccagaaatcatgggtgttggtccagcttacgccattccagaagtgttgaagagaactggattgactgtggatgacgttgatgtgtttgaaatcaacgaagcttttgccgctcaatgtctttactcacctggacaacggtatgttcccgaaataaaattgaacttaaacggtggtgccatcgctttatgtcatcctcttggttgtcctggtgccagactatatgccactatcttgagattgtggaaaccaggtgaaattggttggacttctatgtgtttcggttgtggtatgggttgcgcctcccatatggatttaggaataggcgtcttatga

SEQ ID NO: 3294 - DNA, 810 bp, Candida albicans
  unsure (13),(34),(715),(790): Identity of nucleotide sequences at the above locations are unknown.
ggggacagaaagntagtgccttgcccattaaaangattggattcccaattaagaccacggttggatacggtcaatcgtcaatgtgctagttctgctcaagcgattacttatcaagcaggtagtttgcgtagtggggagaatcaatttgctattgctgctggagtagaaagtatgactcatgattattttcctcatcgtgggattcccacaagaatttctgaatcatttttagctgatgcatccgatgaagctaaaaacgtcttgatgccaatggggataaccagtgaaaatgttgccactaaatatggaatttctcgtaaacaacaagatgagtttgcccttaattctcatttgaaagcagacaaggctacaaaactgggtcattttgcaaaagaaatcattcctattcaaacaacggatgaaaacaaccaacacgtttcaataaccaaagatgatggtataaggggaagttcaacaattgaaaagttgggtggcttaaaacctgtgttcaaggatgatgggactactactgctggtaattcctcgcaaatttcagatggagggtctgctgtgatttcaactactcgtcaaaatgctgagaaatcgggagtaaagccaatagctagatttattggttcgtcagtagctggtgttccttcgggacttatgggaattggtccatcggctgctattcctcaattgttgtcgagattanatgttgacacgaaagacattgatatgtttgaattgaacgaagcatttgcatcccaactgatttattgtattgatnaaatggggtctcgattatga

SEQ ID NO: 3295 - DNA, 927 bp, Candida albicans
  unsure (847),(887),(888),(889),(900): Identity of nucleotide sequences at the above locations are unknown.
agaaaagttaaaataccaagtggctatagtagcaaccaaaaactttttttttttcgtttcaccctttccttttttttttcttctttctttgattctggtggttttatctctggttttcttattgtaattcagcatcacacacataccatgacggggaagaaatcaactttaagtatgctgttggaaaactctcaacaattggatgacaatgaaaacgtgttgtactctatgtcagatgaagatgaagattatcaacaccatttccatcaagacagcgatgaggacgaattgccaaaatctttcaactcagcacatttttcagtttctgaagacaggtttatgaaggatcatgatttgaaagtgaaggcttttgaagcattgcacaatagtggcagcaataacaacaatcataatcaagtccaaacattttcacctgtgtcacctaaactaacttcagttaaacgtagatcatctattattgacatgccacaaagattaaacaatttcaatccagcaatcccccaaaataagtttggtcagaattttgctacagaccccaatgccttgccggacgaatacccttcggatgagctaattgaattctaccaaaatgtgaaaaaatgtttagattttagacagaaatatctagatttatcgttacaaacaccagaactgcttaatcctaaaaaccaaccagattggaatatctatccaccacctccaaaacctacatataaatccaagaatcgattcaaccaattacctagagaatccgacaatgatgaagaagaggaatttgactttagcaagtgtgaaattccacatattagcgataatccctattatnttgcccttgatgacgaagatgtataccaagtgcatgaccnnnagaacgatccnaatttggtcagatcccaatttacatga

SEQ ID NO: 3296 - DNA, 1833 bp, Candida albicans
  unsure (198),(238),(239),(240),(251): Identity of nucleotide sequences at the above locations are unknown.
atttatcgttacaaacaccagaactgcttaatcctaaaaaccaaccagattggaatatctatccaccacctccaaaacctacatataaatccaagaatcgattcaaccaattacctagagaatccgacaatgatgaagaagaggaatttgactttagcaagtgtgaaattccacatattagcgataatccctattatnttgcccttgatgacgaagatgtataccaagtgcatgaccnnnagaacgatccnaatttggtcagatcccaatttacatgactactactcggacttgaataccatttcgaaaatatcttctgatggtccttccaaatcttttgcatacaagagattgcaatatttggaggccaaatggaacatgtattacttgttaaacgagtttgaagaaacaaagcaatccaaacgtaacccacacagggacttttacaatgtacgtaaggttgatacacatatccatcactctgcttgtatgaaccagaagcatttgttacgtttcattaaatacaagttgaaaacagaaccagataagcaagttattttcagagatgggaagattttgacattggcagaagtatttaaatcgttgaatttaacagcgtacgatttatcaattgacaccttggatatgcatgcccacaccgataccttccatagatttgataaattcaatttaaagtataacccaattggtgaatccagattgagagaaatatttttgaagacagacaattttgttgatgggaaatatttggcggaaataacccagcaggttatggaagatttggaaagctctaaataccagatgaatgagttgagaatttccatttatggtagatctatccacgagtgggataaattagccgcttgggtgattgataacaaattattcagtcataatgttagatggttaatacaagtgccaagattgtatgacatttataagaagaatggcaatgttagatcttttctcgatattatgaaaaatgttttcgagccattgtttgaggtctcactcaatccaagatcacacccaaagctatacgtctttttgcaaagagtaattggttttgactctgttgattacgaatccaaatctgaaaagccaatacaatcacgcaagtaccctccagcaagtgaatggaactcgatttctaacccgccttattcctattatttatactatctttatgcaaatattgctagcttgaacaatttgagattgaaaaataacatgaacacatttgtgttgagaccacattgtggagaagctggtgatccagaacatttaatcagtgcatttttgacttcatacggtatttcgcacggtattttattgagaaaggtgccattcattcaatacttgtattacttagaccaaattggattggccatgtcaccactttctaacaatgctttatttttgacatatgataaaaatcctttctacaacttctttaaaaaaggtttgaatgtatctttgtcgacagatgacccattacagttttcatacacaaaagaaccattgatagaagagtattcggttgcagcacaaatttacaagttatctggtgtcgacatgtgtgaattagccagaaactcgtgtttacagagtggatgggaggcaaatattaaaaaacattggttaggtaaaaactatatgaaaggtggtgtcgaaggaaatgatattgagaagactaatgttcctgatattagagtagcatttagagaagatgccttacaatcagagaagaatttggtgaaatattataatgggttgcacagaaaactgctggatgcaaattctgcgacgtaa

SEQ ID NO: 3297 - DNA, 189 bp, Candida albicans
  unsure (1),(11): Identity of nucleotide sequences at the above locations are unknown.
ngaccttccancggcgctggtgaagacgaaactggaatggtttggattaattcttcaaatgattcagattatcatgtaccatttggtggagtgaaaatgtctggtgttggtagagaattgggtgaatatgggttaaatatgtatactcaagctaaagctgttcatgttaaccttggaactaggttgtaa

SEQ ID NO: 3298 - DNA, 879 bp, Candida albicans
atgttcatcaaaatgtgtacccccagacatcattccaattattcaaggcacaaaattcaactcttgataacacccaattatgttaccacacttaatgggaaaattgtgtcttatttccatgatattgcattaaattttaataaagaaaccagagaagctaacatggttgtagagataccccgttggaccaatgcaaaatttgaaatcaatactaaaaccccaggcaatccaatagttcaagatatcaaaaaggggagagtacgttttgttaaaaacttgtttcctcatcatggatatattcacaattatggagcatttcttcaaacatgggaagacccaaccacaaagcatcatggtctttttggtgataatgatcctttggatgtttgtgaaattggatccaaaattttatcaactggtgatgttagaagagtgaaaatattgggctcaattgctttaatagatgatggtgaattggattggaaagttatcgtgataaatgtacatgatccattgtttaaagaagtcaatgatataaatgatttggatgaaaaatgtccaggattattggatacaactagacaatggtttagagactataaattagcagacggtaaaccacaaaacgattttgcatttaatggagaatataagaacgccaatgaaacaattgatattatcgaacaatgtcataaaagttggcaacaattaattaatggagaaacgaaaactgataaaactccagatatcaccaacacaaccgttaaaggtctgccagggtttaccgataccatttcagtgctgttgaataacccttcaagagcaaatgctgctattccagttgatgtcgaagctaattactttatcaaaacaagttga

SEQ ID NO: 3299 - DNA, 420 bp, Candida albicans
tttcttgatcaaaaacaggaaagggcaatttcgtgtaatggaataactaaaaattatcttgttgaaccacgtgttcaagcaagttgggatattgctaaagagaatcaagttggctcaaatgaatttattttgaaacattggaaggggaaagtaattagagcaggtacttatgctcatgaattaaataaaattaatgaagatattaataatgatagaactttaattgccttttcaagatttttcatttctaatcctgatttagtgaaaaaattacatgatgggatttctttgactccttatgaaagagcaacattttataatcatgataattttggatataatacttggattaaatatggagaaaataaagttttcaatgaacaagaagaaaagaaaaaattgggtaaacctttagcttag

SEQ ID NO: 3300 - DNA, 276 bp, Candida albicans
actacaatgacaatttccaattccaatttatttaaaccaatcaacattggtaaaaaaactatcagtcatagaattgcccatttaccaaccactagaaaccgtgctactaaagaccatgtccctactgatttaatgcaaaaatattatactgatcgtgctaaaacaggtggattattagttactgaagctactttaatctctttgaatcaaggaatttatccaaatgttccagtgtcttcccacgggcctggacggtccgcgattgcaatagggaca

SEQ ID NO: 3301 - DNA, 519 bp, Candida albicans
acggctgttgaaaagtgtcagtatattttgaagcaattagaggttagaaaatctcaaggaaatgaaatcgcctatgtttcaattgtcgagccaagagtatctggaaattctgatgttgatagttttggtgataaatcgaacgacgagataatcaaaagttggagtggtaaacttattcgtgctggtggttatgctactaattttaatgttgaaaatcctactttaattaaaaccaataaacaggttactaatgaaggtggtgaaattgttcattatgctaatttaattaatgatgtcaacaatgatgatagaacattaattggattttcaagaccatttacaagcaatcctgatttggtatatcgattggaaaacaatttgaaattagaatactacgacaggccaaccttttatactcaaacaggtgaaggttatttgactttcaagaattatgatgggtctgcggtgactaagttgccagagaaagagcttatgcgagagggaatcctgttgcaataa

SEQ ID NO: 3302 - DNA, 1197 bp, Candida albicans
ctgttcaaacaattaccaatgacaatctccaattcaaatttattcaaaccaattaaagtcggcaataaaactatcaagaatagaattgctcatttgccaaccactagaaatcgtgctactgatgatcatgtacccactgatttaatgaaaaaatactacacagaccgtgctaaaagtggatctttattaatcacggaagccactttaatctcattagatcaaggtgtttaccctaattttcctggtatgtggaataaacaacaaaaggatgcttggaaagaaatcaccgactcagttcattctattggtggcaccatagctatccagttatgggctttaggtagagttggtaatgccaaattgttgaaagatgaaggattaccattaactggagtcagtcctatttatgaacacgaaaaggctgaacaagatgcaattgatgcaggcaacccaattcaagaattgactcaagatcaaatcaaagatattgtttataatcagtttgccaacgcagtcaaattagctgatgaagcaggttttgattttattgaattgcacggtgccaatagttatttgtttgagcaattcattcatcctggaaccaataagagaactgataaatacgggggatcaattgaaaatagagccagatttttatttgaagttgttgatcatgtatccacaattgttgatcctgctaaattggcaatcagattatcacctttaaacaattttcaggttccatttgtaaacccagaaggacaagaagattattcttacatcgttgaaggtttacagaagagagcagatgaaggtaaaggtcttgcattcattgatgttgttgaaggacgattcacatctgatggaggtactgaaggttgtaatgtagattttgttggtgaaatttggaaaggtccattgttaaaaggaggcaattatacttatgatagaaagaacgagtggaaaacaattgaaaacgatgccaatgcagatgatagaacgttggttggctttggcagatatttcattgctaacccagatttacctgctagaatccaaaagggcaatgaattgaatgattatgatagatcaacattctacaatactgatgattatggttataatacctatccattttatggagaggaaaataaggctgaccctaatattaaagtattaggcgtggctttagcttag

SEQ ID NO: 3303 - DNA, 591 bp, Candida albicans
aagagaactgataaatacgggggatcaattgaaaatagagccagatttttatttgaagtcgttgatcatttatcaactattgttgatccttctaaattggcaattagattatcacctttaaataatttccaagttcctggcataaacccaactgcaaaggaagattattcatacattattgctggattacaaaaaagagccgatgaaggtaaaggtttcggatatattaatgttgttgaaggtcgtttttcacctgatggaagcactgaagcttgcgatgtcaattttgttggtgatatctggaaaggtgctttgttaaaaggaggtaattatacttatgataagaaaaacagttgggaaacaatcgaacgtgatgctaatgctgataacagaactttagttggttttggtagatactttattgctaatccagatttgccaaccagaattgaaaaagatttaccattgaatgattatgataggtccactttttatgccaatgatgattatggttataatacttatccattctacggtcaagaaatcaaggctgacccagaacacaaagtattcggtgttgctttagcttga

SEQ ID NO: 3304 - DNA, 285 bp, Candida albicans
attttaccaaaagcacaaaagaagattgatctttacactaaacaaggatttggtaaattgccaatctgtatcgccaagacgcaatattcattgtcacacgatgccaatttgaaaggtgttccaactggattcaaattcccaatcagagatgttagagcttcaattggtgctggttacttgtatgctttggctgctgaaattcaaaccattccaggtttaccaactcattgtggatttatgaatgttgaagtcaatgaagatggtgaaattgatggattgttttaa

SEQ ID NO: 3305 - DNA, 984 bp, Candida albicans
ttcccgtcaataatgtcaaagcctgctggtagaaccatcttagcatccacaatcgccaagcctttccaagaagaggttacgaaagcagtgaagcaattaaatttcacccctaaattagttggacttgtatcaaacgaagacccagcagccaaaatgtatgccaactggacaggtaaaacctgtgagtccttagggtttaagtacgaactacttgaggttaataaaaacgatttggagactgcattaatcaaagccaacaaggacgattctgtgaatggaataatggtttatttcccagtttttggtgacaaacaagatcaatatttacaacagttaatttcccctgagaaggacgttgaagggctcaactttttatactatcataacttatatcacaatgtcaggtttttggatcctcctcaaaaccaacaaaaatctattttaccttgcacaccattagcgatggtcaaaatcttggaatacttgggagtttacaacactatattgcactacggaaataggttatatgggaagaaggtgcttattgtgaacagatcagagattgttgggcgtccattggcagcattattggctaacgatggtgctactgtgtactcggttgacatcaacaacatccaacagttcactaggggcgatgatttgctggaacaaagacacaaggttgttgacttgagtcccgaagaatatacattagagaagcttgcaccccaatgtgacgtaatcataataggtgttcctctggaaaactacaaattcccatcagacttggtcagtcatggtactgttgttattaactttgccagttccaaaaatttcaatgatgacgttaaattaagagctggtttatatgtcccatccattggtaaagtcacaattgccattcttttgagaaatttattgagattgattcacaacaagcaaatcagacaaggtgaagtttctgatgcgacctcttcagcttaa

SEQ ID NO: 3306 - DNA, 249 bp, Candida albicans
cattccaggtgggtcattagaacaacccattggggtgcgaacaacaatccattgattttcgctggtgttaacggtttcttggacaatgttgctcttgacagaattggtgaattcgaagaagctttcttgggtcacttgaaatctaacgaaactggtatcttggatgctattaagaccaagggtgaattatctaaagatgaattagaaaaattgagaaaagtcaccgaagaattcgttgcttctttctaa

SEQ ID NO: 3307 - DNA, 225 bp, Candida albicans
gctcgtccaactttattaactgctcaaagatttgcctctgccaaggctgccccaactgaagtttcttcaatcttggaagacagaatcagaggtgtttctgaagaagctaacttgaacgaaaccggtagagttttatccgtcgggtatgtatcaattcaattgcaaatcaactattgttttccctcctccgcacattctgttgatggcttgtttcgtccacactga

SEQ ID NO: 3308 - DNA, 201 bp, Candida albicans
aaagcatatatactaactttatgttatttttttagggatggtattgctcgtatttacagtttaaacaacatccaagccgaaaaaatggttgaattctctcctggtgccaaatgtattgctttgaacttggaagctgaccaagtccgggttgtgttgtccggttctgataaattactcatagaaagtgaaacggcaagataa

SEQ ID NO: 3309 - DNA, 654 bp, Candida albicans
agagacttagctggtgatgttttctacttacattccagattattggaaagagctgctaagatgtctgatgcttacggtggtggttctttgactgctttgccagttattgaaacccaaggtggtgacgtctctgcttatattccaactaacgttatttccattactgatggtcaaattttcttggaagctgaattattctacaaaggtatcagaccagctattaacgtcggtttgtccgtctcccgtgtcggttctgctgctcaagttaaagctatgaaacaagttgccggttccttgaaattgttcttggcccaatacagagaagttgctgctttcgctcaatttggttctgatttggatgcttctaccaaacaaaccttgaacagaggtgaaagattgacccaattattgaaacaaaaacaatacaacccattggctgccgaagaacaagttccattgatttttgctggtgttaacggtttcttggacaatgttgctcttgacagaattggtgaattcgaagaagctttcttgggtcacttgaaatctaacgaaactggtatcttggatgctattaagaccaagggtgaattatctaaagatgaattagaaaaattgagaaaagtcaccgaagaattcgtcgcttctttctaa

SEQ ID NO: 3310 - DNA, 1464 bp, Candida albicans
ttcaagttgcggtcctgccagcgccgtggtgaagacaatttaggaataaaaaaaaaaattatttgggttgggaaatttggaaatttatcaaaccaacaaacgttcatcacacctattcaacaacaaattatttgtaataacataatgattcgtggatcttcagctttaaagagtttgacatctcgtcgtttatattcaactggtgttaagtacactaccttatccaatggtgtgacagttgcaactgaaaccaacccagcagctaaaacttcttcagtaggtttattctttggtgctggttcaagatcagaacattcacattccaatggtatttctgcattgactaccaatgtcttggcttcacaatctgccaaaggtagtttattaactgccaagaacgacagagaattcaacggtattattgctcaaaccaccaacgataacatcactgaagccggtaaattgattgcctccattgcttccaatgctgttgatattgttgaaaaaaccgacttgactaaacataaacaatatttgtctgcccaagccagtgcagttgaagctgatccaaaatctaaagttttgagtcacttgtactcctctgccttccaaggttattcattggctttaccaactttgggtactaccgagtctgttgaaaatttggaaaaccaagactccttgcgtcacttggccaagcacttggttaacaacaacaccgtcattgctgcctccggtaactttgatcacgataaattggccgatgccatcgaagctaacttgaagattgccgaaggggtcaaacctgaaatcaaaccagcatctttcttgggttctgaagttagaatgagagacgatactttgccaaaagcttatatttccattgctgtccacggagaaggtttaaactccccaaattactatttagctaaagttgctgctgccatttacggtgatttctacttgcattctaccattgccaaattcacttcaccaaaattagcatccatcgttcaagaatacaacattgttgaatcatacaaccattactccaaatcattctccgacactggtatttggggttactatgctgaaattgctgacaaattcaccgttgacgatttcacccacttttcattgaaagaatggaatagattgtcgatctcaatttccgaagctgaagttgctcgtgccaaggcccaagtcaagactgctttggccaaagaattagctgattcttccgccgtcacctccgatattgctgaaaaagtcttattggtgggtcacagacagtcattaagagaagcatttgaaaagattgacgctatcaaggtcaatgatgttaaagaatggggtaaatctaaggtctgggacagagatattgttatttctggaaccggtttgattgaagatttgttggattacaacagaaacagaaatgaaatggccatgatgagatggtaa

SEQ ID NO: 3311 - DNA, 240 bp, Candida albicans
attccattatacgccaatgaagaaaaaaccattttgaacatgattgttgaagttccaagatggaccaatgctaaattggaaatttccaaagaacaaaaattgaacccaattattcaagacaccaaaaagggcaaattgagattagtcagaaactgcttcccacaccacggttacattcacaaagtacggtgccttcccacaaacttgggaagatccaaaccaatcacatccagaaactaa

SEQ ID NO: 3312 - DNA, 624 bp, Candida albicans
tcagaaactgcttcccacaccacggttacattcacaaagtacggtgccttcccacaaacttgggaagatccaaaccaatcacatccagaaactaaagctaaaggtgacaatgatccattagatgtttgtgaaattggtgaaaaagttgctactgttggtgaagttaaacaagtcaaggttttgggtgtcatggcccttttggatgaaggtgaaaccgattggaaagtcattgtcattgacgttaacgatccattggctccaaaattgaacgacattgaagatgttgaaactcatttgccaggtttgttgagagctaccaacgaatggttcagaatttacaaaatcccagatggaaaaccagaaaatcaatttgctttctccggtgaatgtaaaaacaagaaatacgccgaagaagttattggtgaatgtgctgaagcttgggaaaaattaatcaaaggtgaatcagttgattctaaaggaattgatttgactaacaccaccttgtcttctaccccatcttactctgatgctgctgctcaagaaattccaagtgcttctccagctccagctgctccaattgacaaatctattgacaaatggttcttcatttctggtgctcattaa

SEQ ID NO: 3313 - DNA, 552 bp, Candida albicans
agacctgccagaaagagaactgaagaattaaatggtaatgtcgatattgtttgtattggtgataaagtcaaagcacaaattttgagaacttatgctgacaaagttaaattggcattcaatggtgttggtaaagaagaaccaaatttcactgaagttgccttaattgctgatgaaattgctaaattaggtaactatgaaaatgttgaaattctttacaacaaatttgtttctggtgtttcatttgaaccatctaaatttgccatttatgctgctgatgccattgctaactctccaggtttaagcaaatatgaattggaaaatgaagaaatcacttctgatgttgctcaattctctttagctaacaacttgttgactgctatggctgaaggttatgcatctgaagtttctgctagaagaaatgctatggacaatgcctccaagaatgctggtgatatgatcaacagttactctatcttgtataacagaactagacaagccgtcattaccaacgaattggttgatatcattactggtgcttcctcattggactag

SEQ ID NO: 3314 - DNA, 846 bp, Candida albicans
aacgggtctttggaaagaactaccttgttcttgaacttggctaatgatccaacaattgaaagaattattacaccacgtttggccttgactactgccgaattcttggcttatcaaactgaaagacatgttttgaccattttgacagatatgtcttcttatgccgatgccttgagagaagtctctgctgctagagaagaagtcccaggtagaagaggttacccaggttatatgtacacagatttgtcaacaatctatgaaagagctggtagagttgaaggtagaaacggttctatcacccaagtgccaattttgactatgcctaacgatgatatcacccatccaattcctgatttgactggttatattactgagggtcaaatcttcattgatagacaattgcacaatagaggtatttacccaccaatcaatgtgttgccttcattatcacgtttgatgaagtctgctattggtgaaggtatgaccagaaaagatcacggtgatgtgtccaatcaattgtatgctaaatatgccattggtaaagatgctgctgcaatgaaagccgttgttggggaagaagcattgtctacagaagataaattgtctttggaattcttggaaaaatttgaaaagaatttcatttctcaaggagcctacgaaaatagatctatttttgaatctttagatttggcctggtcattattaagaatctatcctaaggaattgttaaacagaatcagtccaaagattttagaagagttctacggtagagatagagaacaagatgatgatgaagacgaagacgaagaagacccagacaaatctggtgataaattaattgatgcttag

SEQ ID NO: 3315 - DNA, 747 bp, Candida albicans
caagcaataatgtcactctctgataaagaattgtttgaattaaacaaaaaagcagtcacagaagggtttaaaatcaaaccaagaattaattataacactgttggtggtgtcaatggtccattggttattttagataatgttaagttcccacgttataatgaaatcgttaatttgacattaccagatggttctgtgagacaggggcaagttttggaagttagaggaaccaaggcaatcgttcaagttttcgaaggtacctcaggtatcgatgttaaaaaaaccagggttgagtttactggtgaaaatttgaaaatccctgtttctgaagatatgttaggtagaatttttgatggttcaggtagaccaattgataaagggccaaaaatatttgctgaagactatttggatatcaatggatccccaattaatccatacgctcgtatttatcctgaagaaatgatttccactggtgtttccgctattgatactatgaattctattgctagaggtcaaaaaattccaattttctccgcctctggtttacctcataatgaaattgctgcccaaatttgtagacaagccggtttggtcagaccaacaaaagatgtccacgatggtcatgaagaaaatttctctattgtgtttgctgctatgggtgtaaacttggaaacatcaagattcttcaaacaagatttcgtaataaaacgggtctttggaaagaactaccttgttcttgaacttggctaa

SEQ ID NO: 3316 - DNA, 477 bp, Candida albicans
tttttcagcaactggtcttggaactctcaccggccaggtgtccaaggtggtaccacttgtattcctggtgcctttggttgtggtaaaactgttatttcacaatcattatcgaaattctccaattcagatgttattatttatgttggttgtggtgaacgtggtaatgagatggctgaagttttaatggaattcccagaattatacactgaaatatccggtagaaaagaaccaattatgaaacgtaccactttagttgccaacacatctaatatgccggtcgctgctaaagaagcttctatttacactggtattactttagctgaatatttcagagatcaaggtaagaatgtgtctatgattgctgattcttcatcacgttgggccgaagcattgagagaaatctctggtagattgggagaaatgccggctgatcaaggtttccctgcttacttgggtgccaaattggcttcttttccc

SEQ ID NO: 3317 - DNA, 504 bp, Candida albicans
catttcccatctatcaacactagtgtttcatattccaaatacaccaatgttttgaacaaatattatgattccaattatccagaatttgctcaattgagagataaaattagagaaattttgtctaatgctgaagaattggaacaagttgtgcaattagttggtaaatctgctttatcagattccgataagattacattagatgttgccacattaatcaaagaagactttttacaacaaaatggttattcttcttatgatgcattctgtccaatttggaaaacttttgatatgatgagagcatttatttcatattatgatgaagcccaaaaagccgttgctaatggtgctcaatggtcaaaattagctgaaagtactagtgatgttaaacattctgtttcatcagctaaattttttgaaccatcaagaggtcaaaaagaaggtgaaaaagaatttagtgaattattatccactatttctgaaaggtttgccgaagcttctgaatag

SEQ ID NO: 3318 - DNA, 1368 bp, Candida albicans
cagtacttttttcattttcaggccggagctttagaaaatgcaacaaaggaaattaaacgtctttcattagaagacacccatgaatcccaatatggacaaatctattctgtctcaggtccagttgtggttgcagaaaacatgattggatgtgcaatgtatgaattagtcaaagttggtcatgataatttggttggtgaagtcattagaattaatggcgataaggccactatccaagtttatgaagaaactgccggtgtcactgttggtgacccggttttaagaactggtaaaccattatctgttgagttgggtccagggttaatggaaactatttatgatggtattcaaagaccattgaaggcaattaaagatgaatcccaatccatttatattccaagaggtattgatgttccagctttatcaagaactactcaatatgatttcactcctggtaaattgaaagtaggtgaccatattactggtggtgatattttcgggtctatttacgaaaattctttgttagatgatcataaaatcttgttgccaccaagagctagagggactattacatctattgctgaatctggttcttacaatgttgaagatactgttttagaagttgaatttgatgggaaaaaacacaaatactccatgatgcacacctggccggtgagagttccaagaccagttgctgaaaaattaagtgctgattatccattgttgactggtcaaagagttttggattctttatttccatgtgtccaaggtggtaccacttgtattcctggtgcctttggttgtggtaaaactgttatttcacaatcattatcgaaattctccaattcagatgttattatttatgttggttgtggtgaacgtggtaatgagatggctgaagttttaatggaattcccagaattatacactgaaatatccggtagaaaagaaccaattatgaaacgtaccactttagttgccaacacatctaatatgccggtcgctgctagagaagcttctatttacactggtattactttagctgaatatttcagagatcaaggtaagaatgtgtctatgattgctgattcttcatcacgttgggccgaagcattgagagaaatctctggtagattgggagaaatgccggctgatcaaggtttccctgcttacttgggtgccaaattggcttctttctatgaacgtgctggtaaagccactgctttgggatctccagatagaattggttcagtttctattgttgctgctgtttcaccagctggtggtgatttctctgatccagttactactgccactttgggtattactcaagttttctggggtttagataaaaaattggctcaaagataa

SEQ ID NO: 3319 - DNA, 627 bp, Candida albicans
gagctctgttccacttccttcctatttgggaaggcgagaaccggtctcacacaaccaataaaattacagtacgtctcgcacaacataaatttttttttttttttggtcaacaaatttctctttctttcttcttcaccaacaatgttcagacaagttttccgtcaagttaccaaacaatcattcactggggttaagagaacttatgccaccgaggccgccgtgtctacagatgctttgaaattatccttggcattgccacaccaaaccttatacaacgactccgaagtccaacaagtaaacttgccatctgtcaacggtgatttgggtattttggccaaccacattccaattgtcgaacaattgagaccaggattgttagaaatcatttccaaaaacggagactctgaccaatactttgtcagcggcggtatcgccatggtccaaccaggaaacaagttgactatttccgccatcgaagcattcaagaccgaccaaattgatctctctgccgtcaaaaacttgattgccgatgcccaaaagagagctgaatctagtgatgaaaaggtcgctgctgaagccaacatcgaattggaagtgttagatgctttacaacattttactaagtaa

SEQ ID NO: 3320 - DNA, 687 bp, Candida albicans
aagaaaaagacaaagagaaagaaaatttcaacaaaagaacatatcaagagcatcaacaatacaccagcaatgatttctcgtgttttttcccgttcattagcatcagctgccaagtctaccaaaccaccaatccaattgtttggtattgatggtacctatgccaatgctttatactcagcaactatacaacaatccgacatggcccaaacctacaagtctttagaaaagatcgaaaatgttatcaagggggacccacaattaaagaacgctttaaccaacccatcattaaccaaggacgacagagttgccattgctaaatctgttgctaacgacttgagtttggataaaaccactgccaacttcttgactgttttggctgaaaacaacagattgggtaacttctccagtgttttccaaaaattcggattattgaacgatgcttacaatggtgttgtcgaagctaaagtcacctcagccaagccattggaatcaaaaattttaaaaagattacaaacttcaattggtaaatcttcctttgttggtgaaggtaaaactttgaaattgaccaaccaagtaaacccagaaatcttgggtggtttagttgttgaagtcggtgacagaactgttgatgtttctattgctaacaaggttgctagattaaaccaaactttgagagacaacttgtaa

SEQ ID NO: 3321 - DNA, 387 bp, Candida albicans
agaagtctctttagcaaacaacaaacaacaaacatatcaagtatggttcaatctatgacatctgtcgttaaggcagctaatttcattttagcaagaccaacattatcaaaaatcattacaccacttgctcaaaaattcactgcttatgcagggtatagagaaatgggattaaaattcaatgatttacttcttgaagaaaccccaattatgcaaactgctattaaaagattaccttcagaattaaattattcaagaaattttagaattcttactgctcatcaattagctttatctcatcaattattaccagctgaaaaagctgttaaacctgaaggagacgataattatttgattttttctaacaccgccgggatggaaaatccatgc

SEQ ID NO: 3322 - DNA, 576 bp, Candida albicans
ccaattatgtcgggtgcaggtaatcgtgaacaagttttcccaactcgtatgactttgggagtcatgaagagtaaattgaaaggtgctcaacaaggacattcacttttaaaaagaaaatccgaagcattaacgaaaagatttagagatataactcaaagaatcgatgatgctaaaagaaaaatgggtcgagttatgcaaacagcagcattttcattagctgaagttcaatatgccactggtgataatatttcttatcaagttcaagaatcggtacaaaaagctcgattcaccgtcaaagcaaaacaagaaaatgtttctggggtgtttttacctacatttgatagtcatattaatgaagatgttaatgattttaaattaacggctttagcaagaggtggtcaacaagttcaaaaggctaaattaatttattctaaagctgtggaaacattagttgaattggcttcattgcaaacggcatttataatcttggatgaagttattaaaatccctaatagaataattaaatgccatttaacacctttattattccaaggaacatacaattccctttgttta

SEQ ID NO: 3323 - DNA, 315 bp, Candida albicans
gttattaaattcattaatagaagagttaatgccattgaacacgttattattccaggaacagagaataccattgcttatattaatggagaattggatgaaatggatcgtgaagaattttatcgtttgaaaaaagttcaagaaaagaaacaagaagctgctgttgcggcagaacaagaagaagcccttgctaaagctaaagctgaaggtgccactgatgaactagcaatccaacaagacgttgaagcattggatattaaagcagacaaagaagaagtcgacattcttcaagaaaaagaggatgatgttatattctag

SEQ ID NO: 3324 - DNA, 600 bp, Candida albicans
cttttaggttctgttagagctttgtcaacaaccaccaccaccttatccaactatcaacaaccagattactcctcctacttgaacaacaaatccggtcaaggaagcagaaactttacttatttcatggttggatctatgggtttattgtcagctgccggggccaaatccaccgttgaagcttttctctcttcatttgccgcctctgctgatgttttggctatggctaaagttgaagtcaaattgggagctatcccagaaggtaaaaatgtgattatcaaatggcaaggtaaaccagttttcattagacacagaactgctgacgaaattgaagaagctaaccaagttgatatcaaaaccttaagagatccacaaaacgatgctgacagagtcaagaaaccagaatggttaattatgttgggtatctgtacccacttgggttgtgttccaattggtgaagctggtgatttcggtggttggttctgtccatgtcacggttcccattatgatatttctggtagaattagaaagggtccagctccattgaacttggaaattccagaatatgactttactgatgatgaaaccttgcttgttggttaa

SEQ ID NO: 3325 - DNA, 351 bp, Candida albicans
ccagttgaagacgtagaagttgaacaaccagaagatgctccagaagaagaagtttccgaagaaactgttgaagaagaagaagatgatgatgaagatgatgatgaagatgatgaagaagaagaagaaactgctgacccattggatactttgcgtgaagaatgtaccaagaccgctgcttgtaagccatttgatcaccatttccacgagtgtattgagagagtcaccaaagaacaagaagaaccagattatgaacacaaacactacaaagaagattgtattgaagagtttttccatttgcaacactgtgtaaacgattgtgttgccccaagattattcaacagattgaagtaa

SEQ ID NO: 3326 - DNA, 504 bp, Candida albicans
tgggtgagaaggacgaaaaaaaaaagaccacttaataaaaaaaaacttacaactgctgatatattagtttactattacaagcaacactatccatacataatgtttaaagctgttcaacaattaacttttagaagattcaattctcatcacttacaaccatctaaacttttaaatgagttagcttacaagcccaacaaacaagttggtgaagagttcatcaagaaatacgaagaaaaagttcatcattcagaaggtatcaccaacttgtggaaaagattaacttacttagtagctattccagctgttttgttagttgctattccagttggtaaagttgaattaagccatgctgagcatagaaagcatcaagctcatttgtcagatgatgaatggccacaacaatacgattatcaaaacattagactgaaaccatacttctggggtgatggtgataaaactttgttctggaactccgatgttaacagacatgttgtcaaagattaa

SEQ ID NO: 3327 - DNA, 492 bp, Candida albicans
atttatagattttcaataatgctttctcgtactacattcagaattgctagacaacaaactagattattatctacttccagagtcttattaagtgccaaagctgccccagaaactgccgttaaaccagccaaagatttagctgaagtcactggtgctgcctctttgattggtcctggtgctaaagaaggtactattccaactgattacgaacaagctactggtttgcaaagattagaacttttgggtaaaagagaaggtgtcgatgttttcgacatggaaatgccaatcagtgaaggtaaaggtaccatgcaagatccttacttggtcccaacttatattggttacagatatgttggttgtaaaggtactccagaacaagaccacaaaccatactggatgaaagtcgaagaaggtaaagtctctagatgctggcaatgtggtactgtcttgaaggccaaatacttgggtgaaccaggaatggctcatcattag

SEQ ID NO: 3328 - DNA, 495 bp, Candida albicans
aattgtccagaaaaaaaccaccgacataaaagaatcgaccaccttaccagctttctgccttatcatttattggataaacaaactttcacgacaaccaatcacatacatacaatcttgaatctaatcatgagtgaagctatggaaaaacgtaaattggtggcagcaattgctgatgaagataccgtgacgggtttacttctagctggaattggccaaatctccaacgaaccaggcaaagaatccaatttcttaactgttataccaggaaaaactacggttgaacaaattgaagaagctttcaccactttcacttcaactagagatgatattgctattttgttgataaaccaacatttggccgatttaattagatttaaagttgacagtttctccaatgcctttcctgctattttagaaatcccatccaaagaccatccgtatgatcctgaaaaggattatattttgaaaaaggtaagaaaattgtttggagaatag

SEQ ID NO: 3329 - DNA, 222 bp, Candida albicans
cagcgcgggtctttccagccccgtggtgacgattcacttcaactagcagattatattgctattttgttgataaaccaacatttggccgatttaattagatttaaagttgacagtttctcaaatgcctttcctgctattttagaaatcccatccaaagatcatccgtatgatcctgaaaaggattctattttgaaaaaggtaagaaaattgtttggagaatag

SEQ ID NO: 3330 - DNA, 240 bp, Candida albicans
atagagatttcaatcaattctacaataactaataatacaaagatgttgacagtccttggtcgtttacttgaaagaaactcaatctacgttgccactatctttggcggtgcttttgctttccaaggttttttcgatgttgcagtgaacaaatggtgggaggaacacaacaaagctaaattatggaaaaacgtcaaaggaaaattccttgaaggtgaaggtgaagaagaagatgacgaataa

SEQ ID NO: 3331 - DNA, 321 bp, Candida albicans
ggaaaaacaacttatactaaccagaataattatagatttgaaaaagaatttgaaaatgcttacgatttattcgaagttcaaagaattttaaacaactgttttgcttacgatttggttccagctccagctgtaattgaaaaagctttacaagcatgcagaagagttaacgattatccaactgccgttagaacttttgaagctttgaaattcaaagttgagactccagaacaataccaagcttatttggaagaattaaaggacattagaaaagaattgggtattgatttgaaagaagatttatatactgaagataaaatctaa

SEQ ID NO: 3332 - DNA, 345 bp, Candida albicans
atatcccatctttccaaatacaatactgtcttatcattaataactaactattcaataatggcaggtgcaccacatccacatacttatatgggctggtggggtagtttaggctccccaaagcaaaaatatattactcaatatactatttctccatatgctgctaaaccattaaagggggctgcttataatgctgttttcaatacttttagaagaaccaagaatcaatttctttatgttgccattccatttgttgttgtttggagtatttggactagagctagagattataatgaatacttgtacactaaagaaggtagagaagaattggaaagagttaatgtttaa

SEQ ID NO: 3333 - DNA, 1596 bp, Candida albicans
tacccaataatacaaactcagctttctattgaagatcaattgcctctcataattggcatgtccaatcagattttcaagaaaattttcgttttttttttccaacatttttttttctgtgcgagggacttccaaccaatagaattccatgattcagtacgatttataaaatatactaacattaatttcttttttttgtttagagccgttattggtgccgttgttgatgtccaattcgacgaaggaaacttgccagctattttgaatgctttgactttgaagaacggtgaccaagacttggtcttggaagttgctcaacatttgggtgaaaacaccgtcagagctattgctatggatggtactgaaggtttagtcagaggtaccgaagtcaacgataccggtgccccaatctccgtcccagtcggtagaggtaccttaggtagaatcatcaatgttgttggtgaaccaattgatgacagaggtccaattgaatgtaaggaaaagaaaccaattcacgctgaaccaccatcattcgttgaacaatccactgctgccgagattttggaaaccggtatcaaggttgtcgacttgttggccccatacgccagaggtggtaagattggtttattcggtggtgctggtgtcggtaagaccgtctttatccaagaattgattaacaacattgccaaagcccatggtggtttctctgtctttaccggtgtcggtgaaagaaccagagaaggtaacgatttgtaccgtgaaatgaaagaaaccggtgtcatcaacttggaaggtgactccaaggtcgctttggtcttcggtcaaatgaacgaaccaccaggtgctagagctagagttgctttgactggtttgaccattgctgaatacttcagagatgaagaaggtcaagatgtcttgttgttcattgataacattttcagattcacccaagctggttccgaagtgtctgctttgttaggtcgtattccatctgctgtcggttatcaaccaaccttagccactgatatgggtcttttgcaagaacgtattaccaccaccaagaaaggttccgtcacctctgtccaagctgtctatgtcccagctgatgatttgaccgatcctgctccagccactacattcgcccatttggatgccactactgtcttgtctagaggtatttctgaattgggtatctacccagctgtcgatccattggattccaaatccagattattggacgcttctgttgttggtcaagaacattacgatgtcgctactggtgttcaacaaactttacaagcttacaaatccttacaagatatcattgctattttgggtatggatgaattgtctgaagctgataaattgactgtcgaaagagcccgtaagatccaaagattcttgtctcaaccattcgctgttgctgaagttttcactggtatcccaggtagattagtcagattgcaagacactgtcaaatcattcaaggatgttttggaaggtaaatacgataacttgccagaaaacgctttctatatggttggtggtatcgaagatgtcgttgctaaagctgaaaaattagctgctgaatccaactaa

SEQ ID NO: 3334 - DNA, 369 bp, Candida albicans
aaaggagcatcatcaagatcattattcaccatcaccaccatcactaacaacaaaaatgtcactcctttgacttcatcaatgaactttattcgttgttatagtgccttcccagaattaactagagatattgctaaagaaagaattattgaattattagaaggttatgataaagtagatcaatctaaaggtgaaatcactgaacaaaactcatttacttctgatttaggtttggattctttagatgttgttgaagtgattatggaattagaacatgaatttaatattcaaatccctgataatgaagccgatagttttaaaactgttggtcagactattgattatattttagctcaaccagattcttgttaa

SEQ ID NO: 3335 - DNA, 336 bp, Candida albicans
agaatgtttaaattagctttccgttccattcgtgcaccagttgctagagcttcatttgtcaaaccaattcgtttttatgttgccccaccaatttccaaagatgaagttacttcaagagccattcaagctttgaaaaccgttgctccattacaagaatccaatatcacattagaatcttctttccaaaaggatttgggcttagattctttagatactgttgaagctttagtggcattggaagaagaattcgatttagaaattcctgataagatttctgatgagataaagactgttggggaagctgttgattacatttacaaagaagaatctaaataa

SEQ ID NO: 3336 - DNA, 948 bp, Candida albicans
caaatttgtagaaattttaaacagtatcattccacaaaccagtccgggagctcatcatcatcatcagggattgttcaatcaagatcgatatttgattatattgagaatttccaatggaatagttcgaaatatcgtttagataaaccaatcagtcaattagtgaaaatgatttctcaagaagcaattactttagataatgatgttcgtacaagttatcaactgtatcaactggccaaatccaattttttagcagctgataggaaaaaaaatggtgatttatcaattaaatcattacatgaaattgttaaaccagagcaatttgtattagattccgaacatttaacaacaattttaattgctgttcctaataatttattagatgatttccataaaaattatgaaacattaacttcatttgttattcctcgatcagcagaattgattgctaaagatcaagaatttcatttatttaccgtgactttatttaaaaaatatcaacaagaatttattaataatgctcgagaacatagatggcatccaagaactgatttcacttatagtgaagaaattttaaatgaattacgtaaggaatttgatttaactcaagctacggaattaaaattgaaaaatgatttgattagattgactaaaacagcttatctggatattatggctaattggtttcatattaaaattattagaacttatgttgaagccgttttaaaatatggattgcccccacaatttgataattatttgattaaatttaatgaatcaaatttgaaaaatgttgataaagctaaaaaggaattaattgctaaatttaattatcttggtggtaatggttatactactggtaataataacagttcaaatttacatgaatatgcttcattagttgatactgaatatcaaccatttgttttatatgaacttgaaattgtttag

SEQ ID NO: 3337 - DNA, 645 bp, Candida albicans
aagaagttagagagagaaagaaaaaaaataatcaaaatcttccaaccaacacaaattcttacaaccatttttacaaccacatcttcaatagcaatatccacatatacacacatacacacaatgtcatcagttgctaaacaagctgccagaaaagttgatttcaacaaacttgttaatggattaggattaactggaactactgcttcatctttaactgcattcaaaaaaagacatgatgaagctaaaaaagaatttattgatttatcaagtcaatctactgatattgatttcaatcattatagatcaattttaaaaaattctaaagttgttgatgaaattgaaaaagctgttagtggatttaaaccagttactattgatgtttctaaaaatttgaaaaatattgaaatttttgaactgaaagctattgaaaatgctaaattgactgaaaaatccgtattagaagaaatttctgttttacaaaaaactttgaaagaaattgaaagtgctagaccatttgatcaattaactgttgatgatgttgctgctgcttctgatttggaagaaaaagttacttatatggttaaaaatggtaaatgggaagttccaggttatagagaaaaattcggtgatttggctgctatgtaa

SEQ ID NO: 3338 - DNA, 267 bp, Candida albicans
acatattcatacataatgccagtcgatccagctacttttaaattcgaaactccacaatttgacccaagattcccaaaccaaaaccaatccaaacattgtgctcaagcctacgttgattaccacaaatgtgtcaatgtgaaaggtgaagaatttgaaccatgcaaaatctttttcaaaactttcacttcattatgtcctttggattgggttgaaaaatgggatgatcaaagagctgctggtaaattcccagtcaacatggacgcttag

SEQ ID NO: 3339 - DNA, 315 bp, Candida albicans
tatcatcgattacagcatttactactacacaacatgtttgctcaatcagctttaagaccagccagaacccttccatcaagaatccttactagaagaaacttccaagtttctgccagaaaattcgatattaacaccattgtttatggtactgcaaaagaaggtccatacgaaaatttaccatttaaaattaagaacagaaaattcgttccattcgctgtctggtactggggtgtattgggattcttctttgctttcccattcttgacctcatggtggcaattaaagaaatctggtgctttcaacaaaactgaataa

SEQ ID NO: 3340 - DNA, 1170 bp, Candida albicans
cggcctagcgagaagctgtgtggttacattttcggggtcgcgcactttgttcaattctctatctatatttctggatttttttctcaacgaaaaaatcaacaaccttatcatcaccaccaccaaatggaaggattattctttaacatcgactacgggtaccttgaaggtgttgtccgtggctacaaatccggcctcttaacttccaaccaatacgtcaacctcacccaatgcgataaccttgaagatttgaaattacaattatcatccaccgactacggcaactttttggcaaactattctggtccattaagcactaccgtcatccaggaaaacttgacaaaaaaactattccagcagtaccagtacatccaaagtcaatcgagtgggaagttaaccaaatttatggatttcataaactacgggtacatgatcgacaatgtcatattgatgattaccggtaccttacacgaaagagacaagtcggaaatcttgagaaagaccaacgccttggggtggttcgataccttgcctacattgtcgattgctaccgacatcgaaagtttatacctgacagtgttgatagacactcctttggccccattcttcaaaaactgtgtcagtgccgacgacttggacgacttgaacatcgaaattataagaaacagattatacaaaaactacttggaagggtttgttgactggtgtgacaaaaacttggacggacccgataaggagattatggagagattgttaactttggaggccgacaaacgtgtcatcaatatcgccctaaactcgttaaacaaccccgacttgtcgccagaagacaagttgtcgttattccccagccacggcaagttgtaccccacctaccacttggaattgtcgcaagtagacgacgtcgagcaattgaaatcaatcgtcgaactcgttggcgactacaaggacatcttctccgaaaccaacgaaaacttgaaatccttaggtgactggttctactacttggaaatgcaattgtgcagaaatgcattcacccagcagttcaccttggcgtcagtctatgcctggttaaagtcgaaagaacaagaaatcagaaacattacttggatcgccgagtgtattgcccaaaaccaaaaaaatacaattgaaagctacatacctgtatactga

SEQ ID NO: 3341 - DNA, 1956 bp, Candida albicans
aatcttcaaatttttttgttttatccgacaaagagaaattcggatataaaaataacaattgatttctttttttttttttcggtcataatgcgcagtgcgataaagccgataattatccgaaatctaggatggcgcacccacgcacagacgcatttccatacattagtgggttttaggttttgttatatccgatgggcatatttcgaatttcaattattgctctttgactttctacttccttctaaaggtccacaaaatctaaatataataaacacagattataaaaaaaaactgtttctttctacttctttttctttacttctttcttatagaagaatcaccttttcaaataaaaagaacaccatgtcatctaaaactgttcctcgatttccgattattcgaaaattttttaaatataccttatctggtgtggcattaactgtggttggtggaacttcctttattgcttataaagtatatcaagaatcacaaccagttgatcaaatcaaacaatcaccatatttccctaatggacaacctaaaaaatctattgtcattttaggatccggttggggtgctgtttctcttttgaaaaatattgatactagtttatataacgtatcggtggtatcaccaagaaattatttccttttcacgccattattacctagtgtcccaactggtacggttgatatgagatcaattattgaacctattagatcaatgattagaagatgtcgtggagaagtgaattattatgaagcagaagcaattggtattgatccagtgaataacaaattaacaattcaacaatcaacaacggttcattcaggacattctggagatgatacgtcatccaacgaccctaagatccatcaagaacataaaatggaacatatcactactgagttaaactatgattatttggtggttggtgttggtgcacaaccatccacttttggtatccctggggtggctgaacattcaacatttgttaaagaagtacgcgattcaattaaaattaaaaagaaaattatcgatttaattgaagctgccaatttattaccagttggtgatcctgatcgtaaacgtttattacatattgttgtttgtggaggtggaccaattggggtagaagctgccggagaaatccaagattatattgatcaagatttgaaaaaatggatgccacaaattgccaaagatatgaaagtatcattagtagaaagtcaaccagtagttttacacacttttagttccgaattagtcgaatataccaaccacatattcaaagataccaatatcaatttagtcaccaattcaagaatcgttaaagttgatgatactcatgttgatgttatgcggaaaagtgataaatcaatcgataaagtaccttatggaatgcttatttgggccactgggaattctgtacgtggattcaccaaaattataatggataaatttagtgaacaacaaactagtcctcgtggattattagttgacgatcaattaaaattaaaagggtccgataatatttatgctttgggtgattgtacatttactaaatatgctccaactgctcaagtagctttccaacaagggatatatttagcacattattttgagaaattacaaaaagttgaaaaattacgatacaaaatcaaacaagatccttcaattagtgaagtttacgtacatagattacaacgattagaaaactccttaccgaaatttgtttataattatagaggttctttggcttatattgggtcagaaaaagccgtggcagatttagcggttgggtcttggtctaatctttcttctggtggtaatttgacatttttattttggagatcagcttatataatgatgtgtttatcaatcaaaaatcaagttttggtttgttttgattggataaaagtttatttatttggtagagattgttctagagagtag

SEQ ID NO: 3342 - DNA, 591 bp, Candida albicans
ggtatagtgacgtatgttgtcaacgtcaacattcgttgccaactccatgaagaagaacaggcccttgcgatgcaagatcaaggattgaatcgtgatcccccagatgattcgttagagttgttacgtggtagtgatgaggaggagcaggagtttagatttcctaatgatgttgagccaatgttcccctcagctggcggccatggtggcgacgatgaagatgggtttaattttggtgacattgtcattcaccaggtgatccatactattgaattttgcttaaattgtgtaagtcatactgcgtcgtatttaagattatgggctctttccttggcacacgcacaattgtcaactgtattgtggtcaatgactatccaaaatgcatttggtaaaacgggaacggttggtgtaatcatgacagtggtattatttgctatgtggttcctgttgacggtttgtatattggtatttatggagggtacttcggccatgcttcattcgttaagattgcattgggttgaagccatgtcgaaattcttccaaggtgaagggtatgcctacgaaccatttacatttaaatctatagacatataa

SEQ ID NO: 3343 - DNA, 333 bp, Candida albicans
tataatagaaaattttttcttctacaaaattccaaccaatggaaattgatgaaaatgaaacaaccagacgaccaaaagtctgagagagagagagagaaaaaatttcggctcattattttcaattcacttttaatcctagttaatactatttactttctttcttctaactatccatcccaccatcctatctattcaattatgaatccacaaagaattattgaattacaaaaacattatcaaaatactcctaaaccattatggttaagaggtagacaatcggcatttttagtttatccattttatgctttatttgctgttagtactgccatccca

SEQ ID NO: 3344 - DNA, 315 bp, Candida albicans
gtgagagagagagagagagagagagagagagagagagagaaaaaatatcggctcattattttcaattcaattttaatcttcaatactatttactttctttcttctaagttcccatcccatcctatctattcaattatgaatccacaaagaattattgaattacaaaaacattatcaaaatactcttaaaccattatggttaagaggtagacaatcggcatttttagtttatccattttatgctttatttgctgttagtactgtcatcccattatattatagtgttagagctgttgctggtataaaagatgaataa

SEQ ID NO: 3345 - DNA, 528 bp, Candida albicans
tccccccccctcccccaacaagtattcaatatgtttatgagatcattacaaagagctgccactaaagccaacaccgcttctattactactagcattcttagattcaacagtactgttgctaaatcaacctctgctgctccaagagctttatccaatgcttatattggtaatttagaatctagatggacttcattaccaaaacaagatcaacaaactttaatagatgaattaaaatctagaatggaattaccatggcaagaattaactccagctgaaaaaaaagctgcttattatatttcatttggtgaatgggggccaagaactccattatatttaccaggtgaaagatctcaagtattttggattactactggttgtattgttgcttcagtagtattattctttggtattagacaatttgctagtcctccaccaattactatgaataaagaatggcaagaacaatctgatgattatttgaaatctaagaatgctaatccattcactggttattctcaagttcaataa

SEQ ID NO: 3346 - DNA, 1080 bp, Candida albicans
acacctagatcagtcatacaacaacttagatcgcaagaggttaaatttattgagaatagatgtgtgttgaatattttgaatgatttccatagatcaaaattgttcggaggagggtacgatgacgaacacacagaagacgccgattatgatgataatgcagcacttttaaatgaacaaagaaaccatagcttagagattgggtatgaggctcataacttggatgatatttcgttcaactcgttagcgggtacaattgctcgagacaaagtgccaattttaagaaatatattgtggagagttttacgtgggaatttatattttcatgatattgctcttgatgacgaattccctgccaccgagtcgtccatggacctagttcataaaaatgttttcatcatctttattcacggtgattttttacgaacccgagtacgtaagattatccaatctttagatggtatattatttgataatgccactggtggatcagttgctagaaatgagacattgacagaaattaatggcaaaatcgaggatttaaacaatgtggtacaaaccaccaaggatcaattagtgacggaattgatgatttttcaggagttgtacccggattattgttatattgtgcaacgtgaaaagcttatttacgagacattgaataaatttgatgaagacagcaccagaagatgtttagtgggagaaggttggatacccactaatgattttgataaaatacgattagcattgagaaatctaattagacaaaagacaagacgggacgggagtgacagagatttaaccgagagtgtcaacatttcagaatccatagcaactgacacatcattatttgccattgatgatagtgatcacgaattgaccgggtttgaaattgaagatgaagatgatgtggggtctttaattgcggtggtcaacgaattagcaactaaccgaactccaccaacattccaccagaagaataagtgtaccgctgcattccagctgattatagatgcctatgggattgctacttaccacgatgttaaccctggtcttggccacaattattacttttcggtttag

SEQ ID NO: 3347 - DNA, 537 bp, Candida albicans
tccagtctttcacaattcacgcatatcgatgcaaatatacaactagaacaattatacatatacaataaagtcatgtctcctataagactttccgaaaatagcgtgttatcctcaaacaacgaatcaaatgaggcgatattccgatcggcgcccatgacgctagttcaattttatgtcacaattgaattggcaagagatatggttggagtattagggaaattgggtaatgttcaatttcgagacctaaactccaaattgactccgtttcaaagaacatttattactgaattgcgatcaattgatgggttggtttctcaattggactttcttcattcgattatgatcaaacaaaatactatcaagagtgatctttacgtcaatttgcacgccgatatgaaacccttgcccacttcatcagagattgacaatatcaaaacccgattgagcgagttttatgaaagaattaaacacctagatcagtcatacaacaacttagatcgcaagaggttaaatttattgagaatagatgtgtgttga

SEQ ID NO: 3348 - DNA, 1161 bp, Candida albicans
atgcccatgaaaaaagatgaaatttttgatatggcttatactggtcgttatgttttattacttatgggggtattctcaatgtatactggttttatttataatgatgttttttcaatatcaatgtcaatcttcaaaagtggttgggaatggccagaaaaatttaatgtgggggaaaccatttatgctaaatatgttggtacttattctattggattagatccagcatggcatggaactgaaaatgccttattattttccaattcttataaaatgaaattatcaatattaatgggatatattcatatgtcttattcatatgtattttcattagtcaattatacttatttcaatagtatgattgatgttattggtaatttcattcctggtcttttattcatgcaaggtatatttggttatttatccttgtgtattgtttataagtggtcagtcgattggtttgccacagggagacaaccaccaggattattaaatatgttgatcaatatgtttttacaaccaggtgatgttcctgaaccattatattctggtcaatctaccattcaagttttcttattactcattgctttgatttgtgttccttggttattattagtcaaaccgttatatatgaaacgacaattggaaaaagaagcaaatcaacatcatggatcatattctcaattagccaatgatgaagaatcgggagtggcaggacaagaacaagaacaagaaaatgcagctgaagacgatgatgaagatcatgaagaacataattttggtgatattatgattcatcaagttattcatactattgaattctgtcttaattgtgttagtcatacggcatcttatttgagattatgggctctttcattagctcatgctcaattatctactgtgttatggtctatgactattggtaatgcatttggtcccaccggtttaattggtacatttatggtggtatttttatttgccatgtggtttgtattatcagtttgtattttagtggttatggaaggtacttcagcaatgttacattctttaagattacattgggttgaaagtatgtcgaaatattttgaaggtggtggttctgcttttgaaacatttacttttaaaggtttattaaaacagtgttttataagcctagaaacatag

SEQ ID NO: 3349 - DNA, 1275 bp, Candida albicans
ccgtcattctcttcactaatatacttctgttccccccccctctctcttatcccttatcaatacatttcaagaaaaaaaggtatgccggagaaggaagaagcagtattccgttcagcggatatgtcacttgttcaattgtatgtccctactgaagttgctagagatatcatttataaagtgggtcaattagatattattcaatttagagatttaaattctaaaattaatgaatttcaacgatcatttgttaaagaattaagaaaattagataatgttgaaagacaattcaatttatttaaacgagaattagatgtaagagatattcctattaaattgtttccttatgatttagataatgttccaccacaaacagaaatcgatgaattaattgaaggttctgatttattagaagaaagagtgattcaattacgtgattcagtagaaactttatatgaaaaggaaaaatatttaaaacaattcaaatatactattcaagcagttaataatttctttgctgttcaaggtgaaaccaccaacgataatgaagaaacagcattattatcacaattagaaagtggtggtgccactagtggtggtggtggtgatgcccgttcaggatcttcatttatttcaggggtaatcaatagagataaagttggagttttacaacaaattttatggagagttttaagaggtaatttatattatcataatgaagatttacctgaagaaatttatgattttaaaaacaatacttatgttgctaaaagttcatttattatcttttctcatggatcacttattcgtgaaagaattagaaaaatttgtgaatcattagatgctgaattatataatgttgattctacttcagcattaagaagagaacaattggatgatgtcaacactaaaaccactgatttatctactgttttaggagaatcggaaaatgcattaaattctgaattaattgctatttcccgtgatttggccaaatggtgggaaatcattgctagagaaaaagccgtttataaggccatgaataattgtgattatgataactctagaaaaactttgattgctgaaggttggacccctacggattctattacggaattgactactgctattcaagaatatgatgcatcacaatcagtccccaccattattaatgttttggataccaataagactcctccaacttatactcgtaccaataaattcacttatgctttccaagccatttgtgatgcttatggtgtacctaaatataaagaa

SEQ ID NO: 3350 - DNA, 561 bp, Candida albicans
tccatgtataccgggttgatatatgaggatatattttccaaatcgatggcaatgttgtcttgtggttggaagtatgtaattccagagaattatgacctaacgagaggtgccacattagttggtgagaaaattgatggtaaagtttatccatttggattggattgggcttggcacggaactgaaaataatcttttattcaccaattcatacaaaatgaaattatcggtgttgatggggtacactcacatgaactactcattgatgtttagtttagtcaattacttgtttttcaagagtcgagtagacataattggtaactttattcctgggtttttgtttatgcagagtatatttggatatttggcattgaccattgtttataagtggtcggttgactggtttggaagtaatagacagccaccagggttgttgaatatgttgatcaatatgttcttgtcgcctggtactattgaagagccgttgtatgctggacgaaagtatattcaagtgtttttggtattagtggcagcagtttgtgtcaccgtggttgttgatttataa

SEQ ID NO: 3351 - DNA, 660 bp, Candida albicans
gttaaatcgaaactctccaaaatgcaagctttcattgagaaggaagctaaggagaaggctaaggaaatcaaattgaaagccgacgaagaatatgaaattgaaaaggcatccattgtgagatcagaaaccgcagccatagatagtacatatgaacagaaattaaagaaagcaagcttagctcaacaaattacaaagtctactattgggaataaaactagattaagaattttatctactaaagatgaagtgttgcatgaaatttttgatgaagctgaagctgaattgaagaaaattaccaaagacaagaagcagtataaaccagttttggttggtttgattgaagaaggtgtgttggcattgatggaaccaaaagttagtatcaaagttagagaacaagatgttgatgttgccaaagaagccataactgaagccgctaaaaactttgaagaaaaggctaagtttaaagtagaaatttcaattgatgacaaaaactttttagctaaagatatcgctggtggtattgtggtagtcaatggttcaggtaaaattgaggttgataacactttagaagaaagattgaagatcttatccgaagaagctttgccagctattagattagaattatttggaccttcaaccactagaaaattctttgattaa

SEQ ID NO: 3352 - DNA, 780 bp, Candida albicans
aagaaagggagggaaaaaaaaaacttacatagtgttgaaaacttttcatatcacgtcaacgcaataactattcccacaatgtccatgatcaacagaattgcattgagaagtgctcgcccagccatgggaatggctttccgtccagccccaattggtttgagatacttgtctgctccagctgacccaaaacaaaaggccaattccatcattgatgcattaccaggtaacaacttattatctaagactggtgttttggctacttcagccgctgctgccatctatggtatttccaatggattatttattatacacgatgaaaccattttgcttgtcacttttgcaagtttcacagctttggtcgccaaattcgttgctcctttatacactgaatgggccgatggtgaaatcaaaaaagtcaacgatatattgaatcaatctagaactaaccatatcgaagccgttaacaagagaattgaaaccgtttcagaattaaaaaacgttgttgcaaccactgaagatttgtttgctttatctaaagaaaccgctcaattcgaagctgattcatttgaattaaaacaaaaattggctgtttctcacgaagctaaatctgttttggactcttgggttagatttgaacaacaacaaagacaattggaacaagaacaattggccaaagaagtcattgataaagttgacaaagtaattgctaatccaaaattccaagacaaagtattggctgaatctcttaacgaaatcgaaaaattgtttgctaaaaactag

SEQ ID NO: 3353 - DNA, 1407 bp, Candida albicans
ttaactatacagactccattagtaattgacagtacttttttatttgattctaaaaagataatcaaagaaagaataattccatgggaaggtttggctagatcaggagtagtttctgaagacgatgccaatcacatcaaattattggagaagcaatcaattgaaaatagaaacaacactgtcaaggcacaattggatttatattccaaatgtttattaaacgttttgaatcgtgttgatagtaaagatgatgttttgaaaaatattttagctttaattaatgatttgcttttagatgtaccagaattcttagatgcagttttaaaattatctgaagtcgacaagtcattaccttacattcctttcatcaatcatttagataataaagacaatttaattaaaagtttatcattatacaatcttgaaattttattgggcaaagttaagactatcaatgatgatgaaattttaatcaaaatatttagtgtgttgtcatatttaattggtgaatctgctgattccaattatcaattcattggtgttcaattattgcaggatcttttgattgttaaaccatttaaacttgtttatcaaaacaataaccttcttactaatttcaaaccaattaacaatttgattgaaaaactggccaaaaaccccaattccattggattacagctttcttacaacgttttattagtggtttgggtcttatcatacactgccccaatcaatagatcattgattcataatttcccacaattggtaggtaaccttttgtctattgccaaagattcaattaaattgaagattgttcgtgtggccgtggcaattttgaagaattttgttgacattaccatatcctcacaagaacagttcaaagtaatcaaagtgttattatttagtgatgccttaaacactgtgaacacattaaaggaaagaaagtttgcctccaatggtagtgatgaagaattatccaacgatttgaattatttatatgataatttacaagaaattgttactcaaaaattgacttcctttgacaaatacttgacagaattggaaaaccctaaacttataagttgggcttctcctacccataaatcaactgaattttggttagagaacagtggtaaatttaaagattccaattataagttagttaaaagaatttttgaaatcttgatttccaatactaatgatagcactactattaatgtgattctattaaacgatttacagtttttaatcaaaaacttaggaaaagatttaatcacatttataaacactgagaagggaggtcaatataaattattgatcatgacatttttggataatagccagggtgataatgaattgaaatatcaagctttaaaaactattcaattgttagttggtcacaatttttaa

SEQ ID NO: 3354 - DNA, 1149 bp, Candida albicans
accttcacatcatatagaaacaacatgttatctcgtgcatcaattcgtgcttacagctctataccaaactcagtcaaaattgcagccaaagaatctgccactgatttgactaaattgtcagttatcatcaacaatgctgggtccaaaactggtaaactgggtgtatctcatttattatccaaattcacttttttaaacaatggtgccaaatctgctttaagatttactagagaatctgaattattaggtggaactttcgaatccaaagttactagagatgctttgattttaaacactacatttttgaaacaagatttaccatattacgttgaagctttgggtaatgttgtttcaaacactcaatttgctccacatgaattcaatgaaattgttttgccaactgctaatgctgaaactaaattggctaatgctaacccagctttcaaaggtgttgaaaaattgcatgaaatcacttttagaagaggtttaggtaatccattattttataatgaatctactccaattaaattggaagaagttgctcaattttctaaagaacaattttctggtgaaaatatttctattgttgctgaaggtgctaatgaagaagatttgactaaatttgtttcagaatctgctttctgttacttaccatcatcttcttctaatggtgctaaagctcttccaaccaacactttcactggtcaagaagctagagttccatcttctggtgcatcttctgctttgattggtattccagtcaaaccagctgatttcggtaaatacgaagtcttgtccgctgctattggtacttcaactttaccatctacttccactccattagcacaaattccaggtgctacttctcacttgtacaaataccaagatgctggtttatttgttatttcagtttctggtgaagcttctcaagttgctcaaggtattaaacaagccaaatctgttgctgaatcagtttcttcttctgctttatctgaagctgtcaaagctgctgaattatctgttgcattacaatcaactgtcgactccccattaaacgtcaaagttgtcgctgaagaagccccaatttctaaattcaactatgttgctgttggtgatcttgatgtgttaccatatgctgatgaattgtaa

SEQ ID NO: 3355 - DNA, 369 bp, Candida albicans
ttggtggatttaagatcaagaaatattgatggtgctagagttgaagttgtttgggaaagagccaacatagctgccaataaaaacacgtttcctggtgatgtatcagctcttttcccatcaggtttaagagttggtactccagctatgaccactagaggatttgggccagaagagtttgataaagttgctgaattcattgatcaagccgttaacattgccattgaattaaaagctcaagaacaaggtaaagtaccaaaagaattattggcatcatttaaaaaattagctgatgaaagtgataaagttaaacaattagataaagaagttgtcagttgggtcagtaaatatcctgtcccaggtgaattgtaa

SEQ ID NO: 3356 - DNA, 840 bp, Candida albicans
cataacaggctcactaaacaaaaaaaaaatcttgaaatttctttggaaaaattttccatcaaatcccattcccaaccaaactatattctacccataatgctttcatctacgttacgtcgttctgtgagagctcaatccaagaatttgccagcttttgcaagaagaacctatgccgtttctccatctgctcaagcattaatttctaaatccgttcaagatgttgaccctgagatggcggatattttgaatcaagaaagaaccagacaaaagaactcaattactttgattccatcagagaattttacctctaaagcagttatggatttgttgggttcagaaatgcaaaacaaatattctgaagggtaccctggagaaagatattatgggggtaatgaaataatcgataaagctgaagcattatgtcaaaaaagagctttagaagcatttggattggacccatctcaatggggggttaatgtacagccattatctggtgctccagccaatttgtatgcttatagtgcaattttagaagttggtgacagaattatgggtttagatttacctcatggtggtcatttgtctcatggatatcaaaccaacactaccaagatttcctacatttccaaatacttccaaaccatgccatatagattaaatgaagaaactggtataattgattacgatactttagaaaaaaatgctcaattgtttagacctaaagtaattgttgctggtgcttcagcttattcccgtgttcttgacttccaaagactgagaccaattggtgataacgttgggaacttatttattgtccgatatgggccccttctctggggg

SEQ ID NO: 3357 - DNA, 621 bp, Candida albicans
  unsure (523): Identity of nucleotide sequences at the above locations are unknown.
acaaccatgtcaccagctgcccaatcatcttcagacaaaaaacaatccggtattgctagagttttaggttcagcaactgccggtattgctgaaattggtgtattccacccagtcgataccatttcaaaaagattgatgtctaaccacaccaaggttacttctttgcacgaattgaataaagtgatctttagagatcaagcttctcaagcattgggcaagcgtttgttttcattgttcccaggtttgggttatgctgcttgttacaagattttacaaagagtttacaaatatggtggacaaccatttgccaatgaattcttgaccaaaaacttcaaggacacatatgactctgcttttggtccaaaaacaggtaaagcattgatgagtgcaactgccggttctttaattggtattggtgaagttgtgttgttaccattagatgttttgaaaattaaacgtcaaacaaacccagagtccttccgtggtagaggattcttgaaaattattcaagatgaaggattangcttatataaaagttggggctggacaatggcaaaaaatgctccaggctcctttgccttatttggtggtaactcttttgccaaagaatatatctttgga

SEQ ID NO: 3358 - DNA, 291 bp, Candida albicans
ctttcaaaccattttgtcaacaaaatatttattacatctatttttggtgccaatgcttctttaattgtttctgctccattggatgtgatcaaaactagaattcaaaacagaaactttgaaaacccagaatctggttttaccattttgaaaaacatgttcaagaatgaaggaattactgccttctttaaaggtttgacacctaaattgttgacaactggtcctaaattagtattctcatttgccttggctcaatcgttgattccagcatttgataaattgttaagtaaataa

SEQ ID NO: 3359 - DNA, 627 bp, Candida albicans
ccaaagtttggccacacaatgaaatacccattgagaagatttggtaagttcactttgaatgaatacccaaagaactactttgctgaagttgaacaagctgctttctccccagcccacactgttccatacatggaaccatctgctgatccagtcttgcaatcaagattgttctcctatgctgatactcacagacacagattgggtaccaactatactcaaatcccagtgaactgtcctgtcaccggtgctgttttcaacccacatatgagagatggtgctatgactgttaatggtaacttgggtagccatccaaactacttggccagtgataagccagttgaattcaaacaattttctcttcaagaagaccaagaagtttggaatggtgctgccactccattccactggaaagccaccccagctgatttcaaacaagctcaagaattgtggaaagtgttgaagagatatccaaaccaacaagaacatttggcccacaacattgctgtacatgctgctggtgctgatgctgctatccaagacagagtgtttgcatactttggtaaagtctctcaagacttggctgatgctatcaaaaaggaagttttggaattatctccaagaaaataa

SEQ ID NO: 3360 - DNA, 963 bp, Candida albicans
  unsure (34),(35): Identity of nucleotide sequences at the above locations are unknown.
gaatattatattcccttatcaatctcaattgatnnagatcttttttttattttcaatttcctatttatatataaattatttattatggctccaacatttacgaattctaacggtcaaccaattccagaaccatttgccactcaaagagttggtcaacacggtccattgttgttacaagatttcaacttgattgattcattggcccatttcgatagagaaagaatcccagaaagagttgtccacgctaaaggttccggtgcttatggtgtttttgaagtcactgacgatatcactgatatttgtgctgccaaattcttggacactgttggtaagaaaactagaatcttcaccagattctctactgttggtggtgaattaggttctgctgatactgctagagacccaagaggttttgctaccaaattttacactgaagaaggtaacttggatttggtttacaacaacactccagtgtttttcattagagacccatctaaattcccacatttcatccacacccaaaagagaaacccagaaactcacttgaaggatgctaacatgttttgggattacttgactagcaatgaagaatccattcatcaagttatggttttattctccgacagaggtactccagcttcttacagagaaatgaatggttactctggtcacacttataaatggtccaacaaaaaaggtgaatggttttacgttcaagttcatttcatcagtgaccaaggtattaagactttgaccaacgaagaagctggtgctttagctggatctaacccagattacgctcaagaagatttgttcaagaacattgctgctggtaactacccatcatggactgcttacattcaaaccatgactgaagccgaagctaaagaaactgaattttctgtgtttgatttgaccaaagtttggccacacaatgaaatacccattgagaagatttggtaa

SEQ ID NO: 3361 - DNA, 1431 bp, Candida albicans
caaacttatccattaataatgtctgcttacgctttatctcaatctcatagacaattgactgaaggtcatttaaaagatactgatcctgaagttgatcaaatcattaaagatgaaattgatagacaacaacattccattgttttaattgcttcagaaaatttcactactactgctgttttcgatgccttgggaactccaatgtgtaataaatattctgaaggttatcctggtgctagatattatggtggtaatgaacatattgatagaatggaacttttgtgtcaagaaagagctttaaaagcttttggtttgactccagataaatggggggttaatgttcaaactttgagtggatctccagctaatttacaagtttatcaagccattatgaaacctcatgaaagattaatggggttggatttaccccatggtggtcatttatctcatggttatcaaaccgattcaagaaaaatttctgctgtttccacttattttgaaaccatgccttacagagttgatttagaaactggattgattgattatgatatgttggaaaaaactgctgttttgtatagaccaaaagttttagttgctggtacttctgcttattgtagattaattgattacaaaagaatgagagaaattgctgataaagttggtgcttaccttgttgttgatatggctcatatttccggtttaattgctgctggtgttatcccatcaccatttgaatacgctgatattgtcaccaccactactcataaatcattaagaggtccaagaggtgccatgattttctttagaagaggggtaagatcagttaatccaaagactggtcaagaaatcttgtatgatttagaaaacccaattaacttctcagtgttcccaggtcatcaaggtggtccacataatcatactattgctgccttggctactgctttgaaacaagctaatactccagaatttaaagaatatcaagaacaagttttgaaaaatgctaaagctttagaaagtgaattcaccaaaaaaagttataaattagtttctgatggtactgattctcatatggttttggtgtctttaaaagataaacaaattgatggtgctagaattgaaactgtttgtgaaaaaatcaatattgctttgaataagaattccattcctggagataaatcagctttagttccaggtggagttagaattggtgccccagccatgactacaagaggtttaggtgaagaagatttcaagaaaatcgttagttatattgattttgctgtcaattatgctaaggaagttcaatcacaattaccaaaagatgctaataaattgaaagatttcaaaaatgctgtttctggtgatctggaaaaacttaaagctgttagagatgaaatttatcaatgggctggttctttcccattagcagtataa

SEQ ID NO: 3362 - DNA, 594 bp, Candida albicans
tttctagacttatttattagttggtttgttagttggtggtttaatcttgttggaaatatctttgtctgctatatattttgctactattcggatgttgtacgaactcagctaatggtagtcggatctgttgaggtcgcagttcagaaagctgaatctacttttgtcgagacactcttaaaggctacagcaggaaatttctatgtgtgcttggcaatatttcttcagttaatggcaaagcctttacatgttaagtttttaatgatgttgttacccgttttcacattcgtagccatgggatttactcacctggtggccgacatgtttttagtgacaatgggattgataaatggtgcaccaatatcagtaggaaaagccgcgtggaaagttttcttgcccggagcgatagggaacattattggagggtcattttttggagttgttataacttggtatttgcatatttatgtcgtggaaagagacagagctgctttgaacttgccacaatatgagttaagagacgagcaacccgaattgaatcaagattcaagagttgtacggaaaaagaccccagaatggaggatgaagtggttcaca

SEQ ID NO: 3363 - DNA, 1260 bp, Candida albicans
ttcttgattgggatgatgaaaaatgctgaagtgagatatgaaccaatgggtgtagtgacttcaattgtgtcgtggaactacccattccataacctaatgggcccagtaattgcatctttattcactggcaacgctattattgtgaaatgttcggagaacgtcgtatggtcatcacagtggtttattaaatttgttagaaagtgtttacaagagttggacattgatgaaaacttggtgcaattgtgctgttgtttccccaatgatgcagaatattttgtttcacatccaggattgtctcatatcactttcattggatccaaaaatgtggctcatcatgtggtgagtcaagctgcgaaacaattaacgccttgtgttgtagaattgggtggtaaagatgcattgattgttttagatgatgtaaaggatgtgcaatccttgtcgtctgtgatcttgcgaggaactttccaaagtgctggtcaaaactgtattggtgtcgaaagggttatttgcttaccgaaagtgtatgaacaattggtggagattttcacggagagaatcaagtcatttagagttggatcggatattgaccaattggatgaaatagacatgggtgccatgatatctgataatagatttgctcaattagaaggtctaattgaagatgccgttagcaaaggtgctaggttaatccatggcggtaagcaataccaacatcccaattatccacagggtcactattttgagccaacattgttagtcgatgttgatcctacaatgaagattttccaagaggaagtttttggtcctgtgttgacaatgattagggccaatgacgctgaagatgcagtgaacattgccaacggaaccgagtttggacttggtaactctattttcggaagcaattttaaccaggtcaatcaaatcgcagatcaattgcaaagtggcaatgttgccatcaacgattttgcgactttttacgttgcgcagttgccatttggtggtatcaagcaatcgggttatggaaaatttggtggagaagaaggacttactgggttgtgtaatgccaagtctgtgataatggacaaacctttgttgagattgtttggagttgccacaagcataccacctacaatagattacccaatagagaatgataaaaaggcatggaattttgtgaaaagcttgaatatagcaggttatgatggcagattgtggaacaaagtcaaagctttaaagaatttggctacagggggatcttaa

SEQ ID NO: 3364 - DNA, 1248 bp, Candida albicans
gtctgcaaacccaaacctgggcttccgtccatcaagatcatgagctacaatatcttagcacagacattgatccgaagagaaatataccctacaaatgggaaaatattgaaatggtctgtgaggtctcaaatactattagacgaattgaaacactataatgccgatatcatgtgtttgcaagaagtggataaagtacagtatgaagggttctgggttagtcagttagaaaaattgggatattctactagattttatagtaacaataccaaaaatcatggttgtgtcatagtttttagagacaagctatttacttgtaaacatcagtcgttcatcagattagaccaagatttgaatcaagaagccagtgagaagctgttaccaccagcacgaattgcaactacaaacattgcattcatggcatatttggagtttacaccaacatttatcaaagaatacccatgtttagaagaaaccaatggatttatcattggtacgactcatttattttggcatccttttggaacttacgaacgagccagacaaacatatatgcttttgtataaattcagagagtttcagcgtgtattgagaattatagtaggaaattctaaaagattttactcgttctttactggtgatttcaattctgaaccatttgatgcaccgtatcgtgctattactgcaaaaccaatcaagttttctggtcggtccaggaatgttttagggtgttcgttggcatacacgtactcaaaggatagaagtttggatgaagacgatatagacaccgaagagttagagcaagaaagagacaacaaccctctggacccagaaccagaaacatttgaaacaacaccggaacaagacaaactcataaatgatttagaagaggcacacaatgatttagatgtgagagccatttcattatattcggttggatacaaacaagctcatcccgaaaatgcaaatacagctggacatagaaacgagcctgccttttccaactgggtcgacaaatggaacggaatgttagattacattttcttattggttccatggaacaaatctgatgatcgctcaaagaggatagatatgccagaagatttagctgaacaatataaaatcaaactaacaaagctacttagattgcctacaccagaagaaatggggtcaccaccgtcaggtcaacctcgcatgcatcagtacccctcagatcatcttagtattatggctgaagtacaacttgaataa

SEQ ID NO: 3365 - DNA, 564 bp, Candida albicans
  unsure (150): Identity of nucleotide sequences at the above locations are unknown.
ttttacttagaaattataattgaaggtcatgctcaagccactactaaaggtacttgggatattgctgctgttgccaaagatgaatttgatatggaaggtaaagtttttgccactattggtgttggtagaattggttacagaattttaganagattagttgcctttaatcctaagaaattgttgtattatgattatcaaccattacctgaagaaacaattaacagattaaatgttgcttctaaacttttcaatggtgttgataatattgttgagagagttgaaaaattggaagatttggtttctcaagctgatgttgttactattaattgtccattatatgaaagttctaaagggttattcaataaagatttgatttccaagatgaagaaagggtcttatgctatcaacactgctagaggtgcacttactgatccacaagctattgctgatgctgttaattctggtcatattgcttatggtggtgatgtttggccagttcaaccagcacctaaagatatgccatggagaaccatgcataatccatatggtaaagatgtcttcacc

SEQ ID NO: 3366 - DNA, 432 bp, Candida albicans
attaacaaaccaacaactataataacaactttgacaaacaaacaagcaaaaatgagtaaaccaaaggtattaatggctctttattctggtggtaaacatgctaatgaagaatccagattattaggtacggttgaaaatgaattgggtattcgtaaacttgttgaagaacatggttatgaattaatcaccactgctgataaagaaccatcttctaattctgattttgatgaaaatttacaagatacagaaatcattatcactactccgtttttcccagcttatgtcaccaaagaaagaattgccaaagctcccgaattgaaactttgtattactgctggggttggatctgatcattatgatttagacgctcttaatgaaagaggtattgctgttttggaagtcactgggtccaattgttcaatctgttgctga

SEQ ID NO: 3367 - DNA, 351 bp, Candida albicans
attaacaaaccaacaactataataacaactttgacaaacaaacaagcaaaaatgagtaaaccaaaggtattaatggctctttattctggtggtaaacatgctaaagaagaatccagattattaggtacggttgaaaatgaattgggtattcgtaaacttgttgaagaacatggttatgaattaattactactgctgataaagaaccatctcccaattctggttttgatgaaaatttacaatatacagaaatcaattatcactactccgtttttcccagcttatgtcaccaaagaaagaattgccaaagctcccaaattgaaactttgtattactgctggggttggatctga

SEQ ID NO: 3368 - DNA, 249 bp, Candida albicans
ttactactgctgataaagaaccatctcccaattctggttttgatgaaaatttacaatatacagaaatcaattatcactactccgtttttcccagcttatgtcaccaaagaaagaattgccaaagctcccaaattgaaactttgtattactgctggggttggatctgatcattatgatttagatgctcttaatgaaagaggtattgctgttttggaagtcactggatccaattgttcaatctgttgctga

SEQ ID NO: 3369 - DNA, 306 bp, Candida albicans
ttttacttagaaattataattgaaggtcatgctcaagccactactaaaggtacttgggatattgctgctgttgccaaagatgaatttgatatggaaggtaaagtttttgccactattggtgctggtagaattggttacagaattttagaaagattagttgcctttaatcctaagaaattgttgtattatgattatcaaccattacctgaagaagcaattaacaaattaaatgttgcttctaaacttttcaatggtgttgataatattgttgaaagagttgaaaaattggaagatttggtttcttaa

SEQ ID NO: 3370 - DNA, 555 bp, Candida albicans
  unsure (387): Identity of nucleotide sequences at the above locations are unknown.
cgaaaaacaaaaatgggtaaaccaaaggtattaatggttctttacgctggtggtaaccacgctaaagaagaaacaagattattgggtactgttgaaaacgaattaggtattcgtaaacttgttgaagaacatggatatgaattggttactactactgataaggaacctgcaccaacttctgcctttgatgaaaatttagaagatgcagaaatcatcatcactactccgtttttcccagcatatgtcaataaagaaagaattgctaaagctcccaaattgaagctttgtatcactgctggtgttggatctgatcattatgatttggatgctcttaatgaaagaagtatcgctgccattgaagttactggctccaatgtggtttctgtngctgaacacgcagtgatgaccatgttgattttaatcagaaactatggggaaggacatgcacaagctactaaaaggtacttggggatgttgctgctgtttgccaaacatgaatttgatttgggaagaacaagtaattgctactggttggtgcccggaaaaattggttaa

SEQ ID NO: 3371 - DNA, 399 bp, Candida albicans
aaatctagaggtttgtttaacaaagatttaatttccaagatgaagaaaggttcatatttggtcaatactgctagaggtgctattgttgatccagaagctgttgccgatgcagttaactctggtcatattgcttatggtggtgatgtttggccagttcaaccagctccaaaagacatgccttggagaactatgcacaatccatatggtgaagcctatggtaatgctatgacacttcatgtctctggtacttccttggatgctcaagctagatatgctaatggtgtcaaacaaatcttgactgaatatttcaacaagacttataattacagacctcaagatgttattgttattgatggtgactatgccaccaaggcttatggtcaaagagaaaaaaagtaa

SEQ ID NO: 3372 - DNA, 1182 bp, Candida albicans
caacttcaacaactactacaacaacaacttaacaacacaaaaatgggcaaaccaaaggttttaatggttctttactctggtggtaaacacgctaaagaggaacccagattattaggtaccactgaaaatgaattgggtattcgtaaactagttgaagaacatggctatgaattggttactaccgatgacaaagatccttacccaacatccacttttgataagaatttaccagatgctgaaatcattatcactactccgtttttcccagcttatgtcaccaaggaaagaattgctaaagcacctaatttgaaactttgtattactgctggtgttggttctgaccattatgatttggatgctcttaatgaaaggggtgttgctgttttggaagtcactgggtccaatgtccaatctgttgctgaacatgcaattatgaccatgttgattttacttagaaactatggcgaaggtcatgctcaagctactcaaggtacttgggatatcgctgccgttgccaaagatgaatttgatatggaagataaagtttttgccactattggtgctggtagaattggttacagaattttggaaagattgattgctttcaatcctaagaaattgttgtattatgattatcaaccattaccagaagaagccattaacaagttgaatgctgcttctaaacttttcaatggtgttgagaacattattgaaagagtggaaagtttggaagatttggtttctcaagctgatgttgtcactcttaattgtccattgtatgaaaaatccaaaggaatgttcaataaggaattgatttcaaagatgaaaaaagggtcctatgtcatcaacactgctagaggtgctcttaccgatccacaagctattgctgatgctgttaattctggccatattgcttatggtggtgatgtttggccagttcaaccagcacgtaaagatatgccatggagaaccatgcataatccatatggtaaagattatggtaatgctatgacagttcatgtttctggtacttcattggatgctcaagctagatatgctaatggtgtcaagcaaattttgactgagtattttgataagacttataagtatagaccgcaagatgttattattattgatggtcattatgctacaaaggcttatggtcaaagatctaaaaaatga

SEQ ID NO: 3373 - DNA, 348 bp, Candida albicans
cagcccgtgctggcagtaaccatcttgaatgatccagaattatattctcagtggcgtaaagatttagtgacaatgtcttctagaattggtgagatgagaaatacattgagaagcaaattggaaagtttaggaaccccaggtacttggaatcacataactgaacaaacaggtatgttttcatttactggtttaaccccacaaatggttgaacgtttggagaaacaccacggtatctatttggttagcagtggtagagcctctgttgccggattgaatgaacataatgtcgaccaagtagctaaagctattgatgaagtggttagacattttggtaaaagtaaactttag

SEQ ID NO: 3374 - DNA, 912 bp, Candida albicans
ttccataattttatcatcatgtacaagactcaattgattaaatcttcaactcaagctagatttttggctgttagacaattatcttccactagtcaattattgaagtggaatgatattccattggctccaccagacaaaattttgggtatttctgaagcttataacaatgattctaaccctcaaaaaatcaatttgggggttggtgcttatagagataattccggtaaaccaattattttcccatcagttaaaaaagctgaagaaattttattgggtaaagaaactgaaaaggaatatactgccattgttggttccaaaaatttccaatcaattgtgaaaaatttcattttcaacaattctaataaagatgccaatggtaaacaattaattgatgatggtagaattgttactgctcaaaccatctctggtactggatcacttagagttatcgctgatttcttgaatcgtttctattctaacaagaaaattttggttccaaaaccaacttgggctaatcatgttgctgttttcaaagatgctggtttagaaccagaattttatagttattatgaaactagcaaaaatgatttggattatgccaatttgaaaaaatctttaactgctgctccagaaggttcaattgttttattacatgcttgttgtcataacccaaccggtatggatttgacttcagaacaatgggatgaagttttacaaattgttcaagataaaaaattcttcccattagtcgatatggcttatcaaggttttgctagtggtaaaccatttgaagatatcggtttaatcagaaaattgactaaattagctaatgaaaacaaaattccttcatttgccttgtgccaatcatttgctaagaatatgggtctttatgggggaaagaactggttctaa

SEQ ID NO: 3375 - DNA, 867 bp, Candida albicans
tctacattaaaacttactaaaaactattacttcattatggctccatttgcaggtattaaagaattaccaccagatccattgttcggattaaaggcacgttacaatgctgattctcgtacaaataaagttgatttggggattggtgcctacagagacaacaacgggaaaccatggattttgccagctgttagacaagcagaacagaaattgatcaactcacctgattacaaccatgagtatctttctatcagtggatttgctccatttactgaaagtgcagccaaagttattttgggtgaaaactcattagccatcaaggataaaaaaattgtatcacaacaaagtttatcaggtaccggtgccttacatttagctggtgttttcattaaagagttttaccaaggtaaccacaccatttatttatcacaaccaacttgggccaaccacaagcaaattttcgaatacattggtttcaaagttgctagttatccatattggaacaatgacaccaagtcattggacttgagcgggttcttgaaagccatttccagtgctcctgatggttcagtgtttttgttgcatgcatgtgcccataatcctactgggttagatcctaatcaaagtcaatgggacgaaatcttggctgccttggaaaaaaagaagcatttcatcatttttgactctgcatatcaaggttttgccagtggagatttggaaaaagatgcttatccaattagaaaggcaattgactctaaagttatcacttctccaattattatctgtcaatcatttgccaagaatgttggtatgtatggagaaagaattggtgccatccatgttgatacatcaactgttgaatctaacgat

SEQ ID NO: 3376 - DNA, 567 bp, Candida albicans
gattttactagtggtgatttaattaaagattcttggattcttagatatatgtacgaagaagctgaaattgaatttgttgttgctcaatcatttctgaaaaatatgggattatatggtgaaagattaggtgcggttcatgttattgttcaagatgaaaattacgttgatcatgctcaatcaacattggtagctaatttccgtcatgaatgttcatttgctccttcatttggagcaagattagcacaaatcatttttgaaaatgataaattatatcaacaatggacaaaagaagttaatcaagtgacacaaagattacaaaatttacgtcaattggtttatcaaactttaattaaattggaaactccaggaaattggaaaactgtaatacaacaaaaaggattgttttggtatagtggattaactcctcaacaaaatgatcgattgatttctaatcataatgtttattcaactagtattggaagagttaatattgctggtttaaatgaacaaaatgttgaatatttttgtaaggcaattgatgaagtggtaagacataattatgaataa

SEQ ID NO: 3377 - DNA, 726 bp, Candida albicans
acgaagaattattaccaaacccttttagtactattagtacttattaacaaaatgacagttaaatcaaaattcactcatttaactaaagaagaacccgatccaatcatcaaaacattaacacaatatcatcaagatcaatcacctaataaacttgatgttagtattggagtttataaatctcctgatggattattatatacattcccatcaataattgaagctaaagaaatttatcataatgaaaaaaattatggtcataattatactaccatgagtggaattaaagaatttattaatggatcacaacaattattatttggtaaagatgttatcactagtgatggtgagaaaaaaattgcttcaattcaaactattgctggcacaggagctattcatatgggattattattttttatggaagcaggatataagaatttttatttaggtttaccatcatggctgaattatatccctatgattgaaactgttggtggtaaagtcaatacttatgaatattataataccgccaatggagaaattaattttgatactgttaagaaaacccttattgaagcacctaaaaattcggtatttattttccaaacatgttgtcataatcctacaggggcagattttaataatgatcaatggattgaagttgttaaattgattaaacaatatgatcatttagtattaatggatactgcatatttaggattttactag

SEQ ID NO: 3378 - DNA, 1581 bp, Candida albicans
aaaattagacaatcaataatgcttagagtaaattcacgattattaactactcgaaaatctcaatttatgttcacttctaattccttaaggtttttagcaacctttaaacctgcggatccattgactactcatgatatcaacccacaaacggtcgaggcaaaatacgctgtacgtgggaaaatcccaattattgccgatgaattgaatgaattgattcaaaagcaaccacagctgcatggattaccatttagcaaaatcattaatgccaacattggtaacccacagcaattggaacaacgtccattgacatggtatcgtcaagtattgtctcttttacaatacccggatttattgaaaaatggagaccctgaaaccgttaaatcactttatcctgaagatgtgattgagcgagcacaatcaattttgaaacacattggatcaataggggcatactctcattctcagggtgccagttatttccgacaatctattgctgaatttataactaaccgtgatggtggttatgtatcccacgccaacaacatttttttaacttccggggcatcaactgcagtgtcgtatttattacaaattttgtctgtcaatgaaaactccgggttcttaattccgatcccacagtatcctttgtatactgccactattgccttgaataatgccaagccaattggttattatctcgatgagtcgaaccattggtcaaccaatcctcaagagattagagaattgattgaaaccaatcaactgcaaggtattaacatcaaggcattggtggtgattaacccggggaacccaacgggggcaattttatcatcacaagatataattgaattgatagatattgctgctgaatatggaattgtattaattgccgatgaggtttatcaagaaaatattttcaaagggaaatttgtttcattcaagaagattttgtcggaattaattgagcaagaccctcaaacttataaacatgttcaattagcatcattacactcgacatcgaaaggtgttagtggagaatgtggacaacgtggtggatatatggaattagttgggttcaaaccggaagttaaagatgtggttttcaaattggcatcgattaatttatgttctgttgtctctggtcaagcattaatggagttaatgattaatcctcctcaagaaggtgatcctagttaccccttgtacaaaagcgaaaccgagtcaatccataacgatttggaatcaagagcagaatcactctatcaagcatttttacaaatggaagatatcaaatgtaataaaccaatgggggccatgtatattttccccactttagattttgatccagcccgataccataagttatattcgagagctaagaattccaatttacaaattgatgatatttattgtatcgagttattagaaggtacaggtatttgttgtgttcctggtaatggatttggtcagaaaccagatacttatcatttaagaacaacatttttaccaccaggtaaagaatggattgataaatggataaatttccataaatcatttattaaaaaatataaagatgaatag

SEQ ID NO: 3379 - DNA, 531 bp, Candida albicans
aagaaattgttgctgactctgtgcaattgttcctctggtgaccactctgttgaatacttggctggtgtccgtccatggactaaagttggtcaagtcgacgttgccttgccatctgctacccaaaacgaagtcagcggtgaagaagccaaagctttggttgatgctggttgtaaattcattgctgaaggttctaatatgggttccaccaaagaagctatcgaagtctttgaagctaacagagattccaacggtgtttggtatgctccaggtaaagctgccaactgtggtggtgttgctgtctctggtttagaaatggctcaaaactctcaaagagttcaatggactaacgaagaagttgatgctaaattgaaagaaatcatgtacacttgtttcgaaaactgctacaagactgctcaaaaatactccatcgaaaagaacgaaaatggtttaccatcattattgaaaggtgctaacattgctggtttcatcaaagttgctgatgccatgtttgaccaaggtgatgtcttttaa

SEQ ID NO: 3380 - DNA, 897 bp, Candida albicans
atacacatatacacaatggtcttacctcacgaaccagaattccaacaagcttacgatgaattagtttctgctgttgaagattctactttattcaaagaagaaccacaatacaaaaaagttattccagttgtttctatcccagaaagaatcattcaattcagagtcacttgggaaaacgacaaaggtgaaatcgaagtcaacaacggtttcagagttcaatacaactccgctttaggtccatacaagggtggtttacgtttccacccaactgtcaatttgtcaatcttgaaattcttgggttttgaacaaattttcaaaaacgctttaaccggattgtccatgggtggtggtaaaggtggttccgatttcaacccaaaaaacagatctgacaatgaaatcagaagattctgtgtttctttcatgagacaattggccagatacattggtccagataccgatgttccagctggtgatattggtgttggtggtagagaagttggtttcttattcggtgcttacaaacaaatgagaaacaactgggcgggtgttttgaccggtaaaggtttaacctggggtggttccttaattagaccagaagccactggttacggttgtgtttactacgttgaaaaaatgattgaaaaagccaccaatggtaaagaaactttcaaaggtaaaagagttgccatctctggttccggtaatgttgctcaatacgctgctttgaaagtaattgaattgggtggtactgttgtttccttgtcagactctaaaggttcaatcatttctaagaatggtatcactgctgatcaagtttacgccattgctgctgctaaattgaaattcaaatcattagaagaaattgttgctgactctgtgcaattgttcctctggtga

SEQ ID NO: 3381 - DNA, 369 bp, Candida albicans
ttgaaaagtccaacctttttgtctataaaatttcagtataaagtccaaccttttgcttcacgtataataaacaagaaccaatcactttttttgtctcatcatataatgactattgaatcaagcactaactattcttttggtaccaaggccatccatgctggagctccacttgatccttccactggtgccgttattgaaccaatctcactttcaacaacttttgctcaatctgagccatccaaaccattgggtatttacgaatactccagatcttccaacccaaacagagacaactttgaaattgctgttgctgcattggaaagtgccaagtatgccattgccttgtcatctggttctgccactactgct

SEQ ID NO: 3382 - DNA, 2760 bp, Candida albicans
gaattatttacaaatactcccacatacttaatcatgacttctgcatcacttgaaaacggagtttctcgtttaaacatttacagaaccacatcaaacacttcatcccaagttagtttgaaacacgactacattgactccccctttagtggtaaaaaggatcaatttgatcaggttttggatgttttggattccactggttttatccctgaatcgctcattgaatctgaagcaaaatggttttacgaatcgttaggtattgatgacgtgttttttgccagatcgctgccagaagatatagcttctcacatccacgctttatattcctgtaaagtgcaagcttattctagttttggtgaacagccattgatttcctacaagagagaagccgaagatcatgcagtcttctttgacactgttgatgctgaatcttataagagaaaccaatttgaagaaagaattgatgacaaatatattgacccttcaagcactactaccaatagttaccgtactgaatatttcagtgccccattgaattaccaatctgaccctattttgctgggggtttaccaacaaaataaggagttgcgcgaccaatatgttcgtttattttttgtttataaaaacaattacaccatactggaagctgctgcaaatgaaaccgatttagaaaaaattggtgacaagacttttttgaagattgcctctgataacaccaagcaattgtatacttctattgtcaaggatgtcataaatactactggtcctgtcatcaaacatttcccgcttgaagactctgaagaatatagagtggtcattggttacaaacaaaagacttctgctagatacaattcagctttgagtgatttggccaactactacaaattgcaagtcaccagaaagtatgttgaacaattttctaacggtgtcaccataatatccatgtatgttacttcaaaactgagaaaatcacctgttgacttgtcaatttaccaagtcatcaaagaagcttcgttgttgtattgtattcctcacaattacttccacgatagattcattcaaggtgaattatccttgcaagaatcaatctatgctcaatcaggtgttatctttgttactcattttttgaatcgtttgggtcctgaatataacaagctttcttcattgttagatccttccaaatcaattgaacatgctgaagtattaaacagtttaaagaagagattgagagctgaaacttacactcaagattacatcaaggaagtttttgacaacagaagagacattgttcgtaaattataccgtcaatttgctgatgttcattacattagatcttccatggaaaagacattatcctaccaaagattatcccaaattaccccggttggatctgaagaagaatttgagcaattgttgagcagagaatgttctcaaaatgagcatcatgctattgtcttgagagctttgtacactttcaacaaatccatcttgaaaaccaatttctatacatcaaccaaagttgctttatcattcagattgaacccatcatttttaccagaatctgaatatcctgaacgtccatatggtatgtttttcgttgttggttctgatttcagagggttccacattagattcagagatattgcccgtggtggtattagaattgttagatcaagatctttggatgcttataatgtcaatgctcgtaacttgtttgacgaaaactacaacttggccaacactcaacaacgtaagaacaaggatattccagaaggtggttccaaaggtgttattttgttggatccaggtgcagctcaagagcgcccacaagcttgcttcgaaaagtatattgatgctttaatcgatttgcttttgaaacaaaatattccaggtgtcaaggacaactatgttgatttgtatgccaagccagaaatcttgttcttgggtccagatgaaggtactgctggttacgttgactgggccacattacacgccagagaaagaggagcaccttggtggaagtctttcttgactggtaaatctcctgaattagggggtattcctcatgatgaatatggtatgacaacattgtctgtgcgtgcttatgtcaacaaaatctatgaaaaattggacattgacgatgcaaagatccgtaaattccaaactggtggtcctgatggggatttgggatccaacgaaattttgttatcaagaaaggaaaactatgttggtatagttgatggatccggtgttatttgtgaccctcaaggtttggataaacaagagttgattagattggccaaagaaagaaagatgattgaacattatgacaaaactaaattgtctccacaaggttatgttgtgttggttgatgatatggatgtcaaattaccaagtggagaagttgtcaccagtggtgttgcctttagaaatacattccacttgaaattgaagcaacaatttggagttgatggtgtcgatcttttcgttccatgtggtggtagaccagctgcaattgacaccaacaatgttcatgacttgattgacgaaaagactggtaaatcagttgttccatactttgtcgaaggtgctaacttgtttataactcaatcagcaaaattaattttagaaaaggctggtattattatttttaaggatgcttctactaacaaaggtggtgttacttcttcatctttagaagtgttggcttctttgtcttttgacgataaaggattcttggaagaacctttgtttggatcctga

SEQ ID NO: 3383 - DNA, 294 bp, Candida albicans
gccattaacaaattgggagatgagttggccaactccaaggaattatggaacgatgatattgaatttagacatgctgtattgttggattcattgccacgtttgttgttagaaaaagttggtattgaaaatgtgttatctagagttcctgaagcttatttgaaagctatttttgccactcatttagcttcaaagtttgtttactctagaggaatcgattctaatcctgctaaatttttggaatttatcagttctattagaaaggattttattcaaaagggattgctcaagtattag

SEQ ID NO: 3384 - DNA, 762 bp, Candida albicans
agtttttctttttttcaatttgttttcacaacttctctttcttttatttcgaattatttaacaactcaaactatcaaaaaaatgttaagaattacttctaaaagattatactcatcaactagcaacttattgaagactccattgcatgaagctcacatagaattaggtggtaaaatggtaccatatgctggtttcgaaatgccagtattgtataaaggtcaatctcatattgaatctcataattgggtgagatcaaaagttggtttatttgatgttagtcacatgttacaacataacattagtggtaaagatgctcaaagcttgttacaaaaaataactcctattgatttaagtaaattaccagttaacacatctagcttatcagtgttattaaataataatggtggagtaattgatgattgtattatcaccaaacacggtgaagatgaatattatatggtcactaatgctggatgtcgtgagaaagatgtcaaatttattaaagacgaggctagccaatttaatagtgttaatcacaatacgtttgaaggaacattattagctattcaaggtcctaaagcacaagaaatattacaacagtttaccaatgaagatttatctaaaatttattttggtcaaaccaaattcttaaaattatcaccaattggggcaacagttcatttagctagatctggttatactggagaagatggatttgaattatcaattccatcgtcttcactcacggggctggaaggaccc

SEQ ID NO: 3385 - DNA, 300 bp, Candida albicans
tttattttaataacttttctttcttttttttcaaatcatcttacaagtcaaactatcaaaaaaatgttaagaattacttctaaaagattatactcatcaactagcaacttattgaagactccattgcatgaagctcacatagaattaggtggtaaaatggtaccatatgctggtttcgaaatgccagtattgtataaaggtcaatctcatattgaatctcataattgggtgagatcaaaagttggtttatttgatgttagtcacatgttacaacataacattagtggtaaagatgctcaa

SEQ ID NO: 3386 - DNA, 540 bp, Candida albicans
caatccactatgacaccaccaaaaagaagagaatcatcttcctcaattacaaatattcttacattaaataatcttgaacttggagcaacagcaggagaagtaagaggtgctggagcaatctcggaagaaaatggccttgttcatcaccaacatcatctcgaagattcagaacattatcatactactcaagtagaaatagaaagtcatttttccactgatgatgaaattaatcatcctggtaataatttcaatgatgatcaaattagtcatttaccaacaattaaaataaaatatcatcgatcaaattcagttcatgctatttcatcagccaattcatttgatggtgctaacaacattagtggggatatttcgttgttaccgacaatcaaagttttaggtactggtggaacaattgcgtccaaaggagtatcatcacatcaaactgcaggatatgaagttgatttaactattgaagatttagtttctactatccctgatttatcacaaacttgtcaattagaatatgaacaagtattaaat

SEQ ID NO: 3387 - DNA, 543 bp, Candida albicans
tgtgtcaagcgagttaagaacttgcattatgctgattgtcttagagccaacaaatccaccatggcttggggattggaagccagagttccattcttggataaacaatttttggaagtttgtatgaacatcaacccagaagataaattgattcaaccaggtaaaattgaaaaatacattttaagaaaagcatttgataccagtgatgaaccagatgtcaaaccttatttaccagaagaaatcctttggagacaaaaggaacaattttccgatggggttggttattcatggattgatggattaaaagatactgctgaaaaaatggttagtgatgaagaatttgctcatccaaaaccagaatggggtgatgatattccaactactaaagaggcttactggtacagatgtaagtttgataaaatgtttaacggttcaaaagctgctgcatctactgttatgagatggattccaaaagctgaatggggttgtcatgccgatccatcaggaagatacgccgctactcatgatcataaagtcgctcaatag

SEQ ID NO: 3388 - DNA, 684 bp, Candida albicans
gcttcgaatcgagaaagtcgtggtcgtggagttttaattgctttgaatgatagaattggttctggattttatatcaccaaatcaaacgctaattctttagatactttcaaatctattggtcaaggttatgtgggaaattttgttaataatgaaattagatattttttccctccagcaaaacctttaggtttaaccatgtttcatataaatgatttattttcatcatcatattattattatgctattggcggtaacgacattataccttgtttacctgaagtaacaataatttatgctcatcaaggattaaataatgaaatatttaaatttgtcattaatgatctaaaatccaaggggattattttagctactatgggtgctggtagtatgtcagataaaactaatcaatatttatctgatttgttaattaataatcctaattatccaattgtttatagtaaacgatcaatggatgggatggttccaattggttcattacctaaagtactagcagtaataaaagacgccgctgacaatggtaaaccggcaaccaaaaaagttccatttgttaatgctatagctggtggatatttaaacccacaaaaagcaagaatattattacaattatgtttgaatgaaggtatggatttatcaaagattaaaaatgtattcaaaactgtataa

SEQ ID NO: 3389 - DNA, 1152 bp, Candida albicans
caactacaacaacacatatatataacaaaaatgactacttcccttacagaacaaactgctattttggctaaatatttggaattgtctcaaaatggtaaaatcttagctgaatacgtttggattgatgctgaaggtagcactagatccaaatgtagaactttatccaaaaaaccaactagtgttgatgatttgcctgaatggaattatgatggttcatctactggtcaagctccaggtcatgattctgatgtgtatttaagaccggttgctttttatcctgatccatttagaaaaggtgacaatatcattgttttaaatgaatgttggaacaatgatggtactccaaacaaatttaatcatcgtcatgaatgtgctaaattgatgaaggctcatgctagtgaagaagtttggtttggtttagaacaagaatatactttatttgatcaatatgattatccttatggttggccaaaaggtggattcccagctcctcaaggtccattctactgtggggttggtactggtaaagttgttgctagagatgtcattgaagctcattatcgtgcttgtctttatgctggtatcaacatttctggtattaatgccgaagttatgccatctcaatgggaattccaagttggtccatgtgaaggtattgaaatgggtgatcaattatggattgctcgttatttattacaaagagttgctgaagaatttgccgtcaagatttccttccatccaaaacctttgaaaggtgattggaatggtgctggttgtcatactaatgtttctaccaaatctatgagagtgcctggtggtatgaaagttattgaatctgctttgagtaaattggccaaaagacacaaggaacatatgttattgtatggtgccgataatgatcaaagattaactggtcgtcatgaaactggtcatatggatactttttcatcaggtgttgctaacagaggtgcatctatcagaattccaagacaagttgctaaagaaggatatggttatttcgaagatagaagaccagcttctaacattgatccatacttggtcactggtatcatggtggagacaatctgtggttctattccagatgctgatatggctaaagaattccttagagaaagcagtgatgataactaa

SEQ ID NO: 3390 - DNA, 1215 bp, Candida albicans
atcttatatatatacatatattggtggaaaaataaaccaacaaaaaaaaaaaaaatttttgaaaaatttgaaaaaaataattattcagtgttaatacttctttttcttttatacaagttatattcatattatacaaccatgtgtggtatttttgcagcttacagacaaccagaggttgaagatttcaaaagtaaagctttacaatattccaaattaattagacatagaggtccagattggtcaggaaatgttgttcaaaacagcaccatattatgtcatgaaagattggctattgttggtttagattctggtgctcaacctattgtttcaccagatggtaactttactttggccgttaacggggaaatctataaccatattcaattaagagaacaatttcctgattataaattcaaatctttgagtgattgtgaaccaatcattcctcttttcacaaaatacgacattgatgccccaaaacatttagatggtatgtttgcttgggttttatacgacaagaaaaatgatagaatagttgctgctagagatccaatcggtatcaccactttatacatgggtaaatcttctaaatctcctaaaacaagatattttgccagtgaattgaaatgtttgattgaagaatgtgacgaaatttttgcatttccaccaggtcatgtttatgattccaacactgatgaaataacaagatacttcaaaccatcttggtgggatgcatctaaagttccagaacaacacgttgactttaaaaaagttagagaaactttagaattggccgtgagaaagagattaatggctgaagttccttatggtgttttattatctggtggattggattcatctttaattgcttctattgcctctagagaaaccaaaaaagctgctcaagcttcatttaacccagaaggtatcgatgccaacaaggaattgtctggtgttgatgacaaaggttcattgcattccactggggtattcaaccaattacattcatttgctattggtttacctggtgctcctgatttattggctgctgaaaaagtcgctcatttcattggtaccattcatcactctcctactttcactttagaaaaaagtcttgatgccttggatgatgtccccctacatcgggaaacttatgatgttacccccattagagcctccaccacccatgtacttgttctcccagaaaaaatcaac

SEQ ID NO: 3391 - DNA, 3255 bp, Candida albicans
ttggttaccaatagaggagaaattgccgttagaataatcaaaactgtgaaaaaattgggggtaaaatctattgctgtctattcagatccagataagtatgttcgacactcattaatggcagatgttgcaattccattacatggtacaacaggtgctgaaacttatatcaacattgaaaaagttatcaaagcagccaaggagtcaggtgcagaagctatcatcccaggttatggtatgttatccgaaaatgcggatttctccgatcgttgtggtaaagaaggaattgtgtttgttggtccatctggtgatgccattagaaaattgggattaaaacattcaggtagagaaattgccgaaaaagctggagtgccgttggttcctggttcaggtttggtgaaagatgccaaagaagccagagcgattgctgccaaattggaatatccaattatggtcaaatctactgcaggtggtggtggtattggtttacaaaaagtagattgtgcaaaagatattgaaagagtttttgaaaccgttcaacatcaaggaaaatcctatttcggagactcaggggtatttttggaaagatttgttgaaaatgccagacacgttgaaatccaaatgttaggtgatggttacggtaatgccattgctgttggtgaaagagattgttctttacaacgtagaaaccaaaagatcattgaagagacacctgcacccaatttaccagaagaaaccagaaataaaatgagaaaagcagctgaatcacttggttcatctatgaaatataaatgtgccggtacagtggaatatatttacgatcccaagagagatgaattctactttttagaagtaaatgccagattacaagttgaacatccaattacagaaatggtcactggattagatttagttgaatggatgcttttgatagctgcagacaccccacctgatttcaaccaaaaaattgaagtcaaaggagcatcaatggaagctagattatatgccgagaatccagttaaaggtttcatgccatcaccaggtcaattgacagaagtaaaattccctgaatgggctagaatcgatagttgggttgaaaaaggtactattgtttctgctgaatatgaccccaccttagctaaaatcattgttcatggtaaggatagagatgatgccttaaagaagttacgtcaagcattgaatgaaactgttgtttatggatgtatcaccaatgttgactatttgagatcgattgctaattcgaaaatgtttgaggaagcagctgtagccaccaaagttttggactcttatgactacaagccacatgccattgaaattttacaaccaggtgcttacactacagtacaagactaccccggtagaaggggctactggcacattggggttccaccatcaggttgtatggatcaatattcattcagagttgctaatcaaattgttggtaacgatgcagcatctcctggtattgaaatcacattgaatggaccaaaacttttgttccatcaagattgtgttgttgctgttactggtggtaagactaaagttgaagttaaccaagttgaagttaatcaatgggaaccaattaacatcaaaagtggagataaattggatattggtaaattgtccactggttgcagagcttacttggccattagaggcggtgttgatgttgttgaatatttgggttcaagatcaacttttgcattaggtaatttgggtggttacaatggtagagtcttgaaattgggtgatgttttatttttgggacaacctgatgttacaagttgtactttaccaggccccatttcccaaccaactcctgttccagcatcattaattccaaattatgacaacaaagtttggaagattggtgttacctgtggtccacatggatctccagatttttttaaagctgaatcggttgaggaatttttctcttccacttggaaagtgcattataattccaacagatttggtgttagattgattggaccaaaacctaaatgggctagaaaggatggtggcgaaggtgggttacatccatcaaacactcatgattatgtttattccatgggtgctatcaatttcactggtgacgaaccagtcattttaacatgcgatggcccatccttaggtgggtttgtttgtgaagcagttgttgctgaatctgaattatggaaagttggtcaagtcaaaccaggtgaatcaattcaatttgtcccaataagttatgaatctgctaaaaatttgaaaaaacaacaaaatgctgcaattgaaaacttatctggtgatttgccatctttagaaaccgtttcattatcagctccagaaaacccaatcttgcatcaattcaaagtttcttcaaatgctccaaaagtaacctatcgtcaagctggtgatagatatattcttgttgaatacggagacaatcttcttgatttgaatttggcttacagaatccacaaattagatgcaatggtcaaagaatataaacctaaaggtatttttgaattatctgctggtgttagatcagtgttggttgaatatactgatgaaatcacccaaaaggaagccttggatactttagtttcttatgaaaaggaaatcatatttgttaacaaatggaaagtgagttcgagaattattaaattaccaatggcttttgaagacaagaaaacattggatgcagtcaaaagataccaagaaaccattagaagtgaggcaccatggttaccaaacaatgttgattttattgctaacattaatggaatcacaagaacagatgttaaagatatgttgtatactgccagatttttggttttaggtttaggggacgtcttccttggggcaccatgcgccgttccattagacccaagacatagattattgggtaccaaatataatccatcaagaacttttactccaaatggtactgttggtattggtggtaattatatgtgtatttataccatggaatcaccaggtggttatcaattagttggaaggacagttccaatttgggataaattgagtttaggtgaacactcaccaaacactaaaccatggttattgagtccatccgatcaaattgaattttatcctgttactgaaaaagaagttgatgcattttctgaacaaatgaatgctggtaaattcaaagttgatattgttgaatcagttttcgatcatggtaaatatttggaatggattcaagaaaactctaaattcattgaagga

SEQ ID NO: 3392 - DNA, 2004 bp, Candida albicans
aatccttttacagactcatctatcattagttgcatagaaccaaccaacaacatacaaagaaacacaaatcaatttaatccacaaaccatgtcatacttaggttggtcagtagaagattggaaaaagtttcattacgaatcaacaccagatgaatcttttgaattattatcccaattattaaaatcccaaaaagctgctccagaagatcctgcttggatatccttagcttccatagagaatttggaacaccaatggaaatttttacaatcaaaatcgaataaacgagatttaccgttatacggggtccccatagcagttaaagataacatagatgctaaaacatttgaaactacagcagcttgtccttcatttgcttactctccgtcaaaagatgccactacagttagattgttaagagatgccggtgccatagttattgggaaaaccaatttagatcaatttgcaacaggtttagtcggtacaaggtctccctacggaataactccaaatacattcaatccaaagtacgtcagtggtggatcttcagccggatctgcctcggtggttgctaaaggtattgttccaattgcattaggtaccgatactgctggatcaggaagagtccccgcagcattgaataatcttattggattgaaaccaacaaaaggtgtcttttcatgttcaggtgttgttccagcatgtaagtcacttgattgtgtttcgatatttgcattgaatttgcaagatgcacagcttacgtttaatattatggcagaagaagatgaacatgacgaattttcaagatcaatgccaaaaaatccattattgaaatttggcaaaaaacctagagttgtagtaccaaccaatttgttatggtacggcgagaaagaaaaccctaaattataccaagaagcagttgctaaatttgaaaaaatcgggtgtgaattggtatctttggatattgaaccattgctagaattagctagatgcttatatgaaggtccatgggttgctgaacgttatgttgctgttaaagatttctttgccacaaatacaccggaaaaggatttggatccaacagtcaccaaaattattaaaggtggagaacattattctgcagccacttgtttccaatatgaatacaaaagacagggaattgtgaagagagtcaacaaattgttagaaggcattgatgctattattgtaccaacagccccattgaatccaacaatcgaagaagtcaccaacgaaccaatcaaagtcaactcatgtcaaggtacttataccaactttgtcaacttggcagatatgtctgcactagctatcccagcaggattcagaaatgatggattacccttcggtgtcacattgttatcacacaagttcaacgattatgcattattagacttagccagtcgttacttgaaactcgacaatttacgtacatgtggtgtttcacaaaagaaagtgtctaccatccatgatgaattgtacttattaccaaaatctacccccgaagaaactgttaaattggctgttgttggagctcatcttaaaggatttgaattacattggcaattggaaaaagttgatgctcgatttattgaatcaacaacaacttcgaaaaactataaattatatgccttgccgaagacaggacccgttgccaaacctggtttgagaagagtggaatccgatggtgaacatatagctgttgaaacctatagtattccaaaagagaaatttggacaatttatcaaatttgttcccgaaccattaggtattggatcggtcgaattgaaatcaggtgaatggtgtaaatcttttatctgtgaagaatttggttacaaacaacctggtactgttgacattactgaatttggcggttggaaaaagtatcaagaacatttgcgtgcctccaaaaaaccattcaattcagttttggttgccaatagaggagaaattgccgttgtcttcagccacgcgggctggaaggacccgcgc

SEQ ID NO: 3393 - DNA, 378 bp, Candida albicans
aaatatggggaatggattcaagaaaactctaaatcaattgaggaattccaacaaaaccaaggaggtgagaaattagaagaattcaatagattgattcaaatctcaaacagtgaattggaaaaactgggaactaaagttcaagatgacgaaaaatttgatgataatgctgaattggtgtattctgaatattctggtagattctggaaatcagtagttgaagttggagataaagttactgctcatcagccattgattgttgttgaagcaatgaaaacagaaatggttgttaatgcaccaagagatggtaaggtgcttaaaatttaccacaagaatggggatatggtggaagcaggtgatttagtggttgttttagaataa

SEQ ID NO: 3394 - DNA, 1362 bp, Candida albicans
ttggtgttggtgctggttcttcatcatatggtcagacaaagccaacgttccaaattgcacttattattgaaacacaagaagccaaggaattccaccacgcatgttgtttgttggggtatgatgctgatgctatttacccatatttggcaatggaaacttttgtttagaatgaaacatccaggtttattgaaaaatgaaggcttactggaagagaaattcattcaaaattataaagggtccatcgatgctggtattttgacagttatgtcgaagatgggtatttccactttggcttcatacaagggggctcaaatttttgaagctcttggtattgataactcagtcattgatagatgttttgctggtactgcatctagaatcaaaggtgtcacgtttggatacattgctcaagatgcctttacattacacgaaagagggtatcctactagagacactatcaaaccaattggattacctgaaactggtgaatatcactggagagatggtggtgacgcacacattaacgatccagctgccattgcctcattacaggatgctgttcgtaacaagaatgaaagagcttatgaggcttatgccaaaaaggaaaatgaagctgttcgtaactgtactttgcgtgggttgttagattttgaatttgaatcttccactgaagttccaattgatcaagttgagccatggacagaaattgtccgtcgtttcttcactggtgccatgtcttatggttctatttccatggaatcacattctactttagctgttgccatgaacagattgggtggtaaatccaacactggtgaaggtggtgaagatgccgccagatcccaagttcttgaaaatggtgataccatgagatccgctattaaacaagttgcttcaggtagatttggggtcacttcttattacttggccgatgccgatgaattacaaatcaagatggcacaaggtgctaaacctggtgaagggggtgagttgccaggacacaaagtatctgctgaaattggtaagaccagacattctactccaggtgtgggattgatttctccaccacctcatcatgatatttattcgattgaagatttgaaacaattattgtatgatttgaaatgtgccaatccaagagctagaacttcagtcaaattagtttctgaagttggtgttggtattgttgctgccggtgttgccaaagctggatcggaaaacattttagtttctggtggcgatggtggtactggtgctgccaaattgacttccatcaaatatgctggtttgccatgggaattaggtttagccgaatctcatcacactgtcttcaccacggggatggccgtccgcgttgattaa

SEQ ID NO: 3395 - DNA, 306 bp, Candida albicans
ggaaggattcccaagggaacattacacccttgggtaggatttccccaggtgcatcttcaaggtatggcggaggatattccattcattatttgggaaggaggttgcaattttggtggaaagatacccatatgttgcataattggtgttggtgctggttcttcatcatatggtcagacaaagccaacgttccaaattgcacttattattgaaacacaagaagccaaggaattccaccacgcatgttgtttgttggggtatgatgctgatgctatttacccatatttggcaatggaaacttttgtttag

SEQ ID NO: 3396 - DNA, 1011 bp, Candida albicans
agacgacaaattagaactggtagagacattgccattgcttgtttgttgggtgctgaagaatgggggtttgccacttctccattaattgccatgggatgtatttacatgagaaaatgtcatttgggtacttgtccagtgggtattgccacccaggatccagaattaagaaagaaattcgaaggtacaccagaacatgtcatcaatttcttttactatttggctaatgatttaagaaaattcatggctaaattagggttcagaactattaatgagatggttggtagaaccgaaaaattaaaagttagagacgatttgagaaataccaagaatgccaatatcgatttgtcaccaattttaactcctgctcacactatcagacctggtgttgccactcattgtgttagaaaacaggatcacaaattgcatattagagttgataataaattgattgatgaatcagaattgactttggctaaaggtttaccagttactatcgattgtgaagttgtcaacactgaccgttctttgggtactacattgtcgtaccgtgtttccaagacttttggtgaacaaggtttgccacatgacactatccatgttaatgttactggttctgctggtcaatcatttggtgccttcttggcatctggtgtcactttagaattagagggtgatgccaatgattatatcgggaaagggttgtctggtggtagaataattgtttacccaccaagagaatccaagtttaaagctgaagatcaaatcattgctggtaataccgcattctttggagccacttctggttctgcttttatcagaggtattgccgcagaaagattcgctgttagaaactctggtgctattattgttactgaaggtactggtgatcatggttgtgaatatatgtctggtggtagagttgttgttttaggtgccactggtaaaaatttcgcttctggtatgtgtggtggtattgcttatgttttggatatggcccaagatttctcttga

SEQ ID NO: 3397 - DNA, 414 bp, Candida albicans
agaagtggtcttaaaggaataaaaaccgttagtgttgaatggaaacgttctgattcgggagcctggcagatggctgaagttccaggtagtgaagaattcttcccagctgaagttgttttgttatctatgggattccttggacctgaggctgacaatttggaagttcaaaagaccaagagaggtactattactactgttgatccaaatgtatacaaagttgacaaagacgataatgtctttgctgctggtgattgtagaagaggtcaatcattagttgtttggggtattcaagaatgtagacaatgtgctagagaagttgatgaatatttgatgggatctactagattgccaggtaatggttccgttgaacaaagaaactatatattattagaggaattagccgaagaggtttaa

SEQ ID NO: 3398 - DNA, 1590 bp, Candida albicans
tttttatttttaaaaaaaagaaatacaatgagtcctagtgcatcttatttaccccaagaggagtttagtactactaatgtttacgattatgacgaagttccagaaaacaaatcatgggcttcttctttgccagtggctaaaggtttatataacccggaattagaaaaagatgcttgtggggttggtttcacttgtcatttaaaaggtgttccatctcatgaaatagtgtcagatgccaaaagtttattatgtaacatgacccatagaggtggggaattgaatccacaagatggtgatggtgctggtttgttgagttccattcctcataaattcttgaaaagagaattccaatactactgtaatgttgaattaccagctaagggacaatacggtgttggtaatgtttttttcaaaaaagatgacgctgtatttgaaaaatcaaagaaaacatttgaaagcattgctgattctttaggtttaaaagttttgggttggagagaagtgcctcatgactcttcaattttgggtgctgccgcattatcaagagaaccatacatattgcagccagccgttgtttataaagaaatatggggtcaagaagtttcagatgacgaatttgattccaaatacagaaaagattttgaaaaaaggttgtttatcttaagaaaacaagcttctcacactattggattacacaattggttctacatttgttcactttccaataaaaccattgtctacaaaggtcaattggctcctaaacaagtttattcatactatcatgatttagtaaatgccgaatatgaatcccattttgctttggttcattcccgtttctccaccaacactttcccatcttgggatagagcccaaccattaagattggcagcacacaatggggaaattaacactttgagaggtaacaagaattggatgagagccaaagaaggggttatgaaatctaaattgtttggtgatgaaatggataaattattccccatcattgaagaaggtggatctgattctgctgcattcgataatgttttggaattattggtcatcaatggcgttgtttctttaccagaagctgttatgatgatgattccagaagcatggcaaaatgacgaaaatatcgatccaaagaaaaaggcattttacgaatgggctgcttgtttgatggaaccatgggatggtccagctttgttcacttttgccgatgatagatactgtggtgctaatttagatcgtaatgggttgagaccatgccgttactatgtcattgatgatgatcgtatgatttgtgcttcagaagttggtgttattgaaattcaaccagaaaaagtcatacaaaaaggtagattacaaccaggtagaatgttgttagtcgatactaaagaaggtcgtattgttgatgaccgtgaattgaaaagtaaagttgtttcaagatatgacttcacatcttgggtcttggctaatatgattagtttgcaagatttaaatgaaaaattggcttcgagaaaaatcgatattaacgctaaaccaattgatgtaaatgtcaatgtacaatctgatccatcttccccacgactg

SEQ ID NO: 3399 - DNA, 456 bp, Candida albicans
ttacataagcgcggatccgtcagtaccgaggtgaagagtcaggaaggtaatgtcaaaggaatcaaaaccgttagagttgaatggaaacgttctgattcaggagcttggcaaatggctgaagttccgggtagtgaagaattcttcccagctgatgttgttttgttgtctatgggattccttggacctgaagctgacaatttggaagttcaaaagaccaagagaggtactattactactgttgatccaaatgtatacaaagttgacaaagacgataatgtttttgctgctggtgattgtagaagaggtcaatcattagttgtttggggtattcaagaaggtagacaatgtgctagagaagttgatgaatatttgatgggatctactagattaccaggtaatggttccgttgaacaaagaaactataaattattagaggaattagccgaaaaggtttaa

SEQ ID NO: 3400 - DNA, 483 bp, Candida albicans
tatagatgtatggattgtggtgttccattctgtacttcagatactggttgtcctatttccaatgttattcctaaatggaatgaattggttttcaatgatagatggtatgatgccttacaaagattaatgatgaccaacaatttcccagagtttactggtagaatttgtccagctccatgtaatggtgcttgtgtcttgggtatcaatgaagatccagtcaacattaaatctgttgaatgtgccattattgaccatggttttgaacaaggttggatcaagccaactccaccagctcatagaactggcaagacagttgctgttattggttctggtcctgcacgtttagctgctgctgatcaattgaacaaggctggtcatttggttactgtctatgaaagaagtgacagaccaggtggtttattgatgtatggtattccaaacatgaagttagacaaaggtatcgtcaagagaagaaccgattta

SEQ ID NO: 3401 - DNA, 1089 bp, Candida albicans
  unsure (820): Identity of nucleotide sequences at the above locations are unknown.
ttggatttaataaagacccatataatttattattatcaagtggaggatattcatctggagaaggagcagttgtttcatttggtggcaagtgttttgggagttggtagtgatattggcggatcaattagatatccagcagcattttctggttgtcatggattacgtccaagcacaagaagaatctatggtagaggaatagatggtggggcagatggtcaagagtcagtaccaagtgtaataggaccacttgctagaagtattgatgatttggaactatggatgaaaagttatataaatgatggaaaaccctggaattttgatccgtggtgtttaccaattccttggcgtgatatgagcccaccaaaaatcaatcaattgactattgctgttgttagagatgatggtgtagttagggtatccccaccaattagacgagcattggatattgttgttgaaaaattgcaaaatgaaggtgccaaaatcattgaattaacgacaacaacacatccattaacgaattctaaattagcttatgattgtgctactaagttatcaaatgctgatgggaatcatctgatgtgtcaattattttctcaatcaggggaaccattaaaaaagttgacgaaatggtatttgaatcttggtgatggagccaaacattatactgtagctgagaatcgagaattgaatagattaagagatacattaagagaagaatatagtgattttatggtggaaaacaaagttgatgtgattcttggacctgcttataataatgttgctccacatagagaaaaagtttataatgaatcttatactntgatttataatttattagatttcccagcattggttttccaaacaggattatttcaagatcctgaaattgatcgttggaatgaatctgatttacaatatgaatatagaagtggaatggaagaattggaaaatgatagttataaacctgatgaatgttgtggtgccccaattgctttacaaatagctggtcggaggtattttgacgaagaagtggttgctgctggtaaatcaattgttgaattcttaggtgttgatttattgaaaaggtaa

SEQ ID NO: 3402 - DNA, 1311 bp, Candida albicans
  unsure (1221): Identity of nucleotide sequences at the above locations are unknown.
ctggttcattataaagacaatttcaatgttaaaggccatggtactacattgggtatggtaaatttttgttttaatccacaacaagttgagtatgattctacattagtagaaatgctccgccaattaggtgcaatattatatgtgaaaacaaatgtccctgtggccatgatgatgcctgaaaccacaaatcatgtttggggtagtaccgtcaacccaatgaatcgattattaagttgtggaggttcactgggtggtgaatcagcattaattaaattaaaaggttcaccaattggtattgggctggatattggtgggtctattcgtatcccggcatctttccaaaacttgtatgctattaaaccgtcattcggtagatttcctacatttgggactcgttcaggtttaccagggttagagtcagtcaatagtgtaaatggtccaattagtaatagccttgatgatttagagttttactgcaagacaataatcgatgctaaaccctggttgagtgatgctaaatgtatcgagattccttggcgacaagttgagtttggcaatgactctattgatagagaaaaagtcaatggcaacagtgcttcgtcacaagcatctccaaaattgaatattgccatattaatggatgatgggtttgttcgaccaactcctccaatacgtcgtggaatggaaattgttactgaagcattgaaaaaagatggtcatcatttaattgaatgggatcctcaagatcatgttcggttatcagaaatcattggtcagtttttcgttagtgatgggggtcaccacgttttggaggaaactactgtggtaaatgagccgtttttcccatatatggaaaactatggaaccagtaaagatattcccgtgtctcagttatggcaattacaacgtgaaagaacagttttgattgataaatatcttaaacgatggaattccactgctgatattactaccaatgggaagccaattgatgctattatcatgcctgcaactccatttgctggcaatccgttagggaaattccccacatatgttggctacacatccccatttaatgctcttgattatactgttggtgtgttcccggtgaccagggtcgataaaactgtggatgttggtgatgaagctcctggaaattacaatgaaattgatgtccaagtctggaaagactatgatcctgaagaaagtcacggtggtgctgtngctttacaattggttgcaagaagattcgaagaggaaaaagtaattgctatgatgaagatcatttcagagttaattaactatactgattaa

SEQ ID NO: 3403 - DNA, 471 bp, Candida albicans
ctactactttcaattatgactataacacgccaacacccagtttataaagatattgcagctaagaaaaaatctattcgtgacgataagtttaatcctgaatggttgattccacaacacgaattgcccgatgatgaagttactgatgttttaaactggattaaaaagacaaaccatttaactccagaggaaataattataactgaatcgaaggcagttggcattgtcaataatattaaatcacaaacttggacatctttagaagtcacattagcattttgtcatcgtgcctcaattgcccatcaattgactaattgtttgacagaaattttttttgacgaagcaatcaagagagcaaaagagttagaccactatcaattggtttcacctggtggcggtaaacttgctgttccctttcacggtttacctatttgtcttcaccacgagtgccaggaccggcatatgttacccaat

SEQ ID NO: 3404 - DNA, 1728 bp, Candida albicans
aacacaatgtcagtatcttatgaaacttttttaaacaaggatccacttgataaatacgaggattctgacatctatactaaagaatggttacctaaagttgaaaaatatagacaagatttcacagatgctattcctaaaaactacactattgaattaccaaaaccaattgatgatttaatcaaagatcaattcaatgctgttgattatttatactctcaaaaattattgacaccagaagaatttgctattacggatttatcagccactgaattagccaaaaaaattgctgctggtgaattgagttcagtcgaagtattcaaagcgtttgcgcaccgtgcaacattggcacatcaattcactaattgtgctatggaacttttcattgatgaagggttaaagcaagcagaagaaagagacaattatttcaaagaacatgggaaaactgttggtcctttacatgggattccaatttctttgaaagaacaaatgaattataaagataaaatcactcatggtggatatgtttctaaaattgtcaacattccaaactctcatggtgtaacaacatcaatattggaaaaattaggtgcagttttttatgtcagaacttctcaaccacagactttaatgcatcttgattctgctaataatttcactggccttactaaaaaccctttcaatttgttgttatcaagtggtggttcttcctctggagaaggtgctattgtagggtatggtggttctgcaattggggttggaagtgacattggtggttcaattagagctcccgctgcttattctggatgtcatgggttacgtccaacaaccaaacgtatctcagtcaaaggtggcgttagtagtggagctggtcaagaatcagtaccagccgttgctggaccaatggcaagaagtatagatgatttggaattgtggatgaaagcttatatcaatgaaggtaagccatgggaatctgattcaacttctttgccaatgccttggcgtgatgtttccactccaaaaattggtgatttaacagttgccattattagagatgatggattggtaagagtctcacctccaattagacgtgcattgaatactgttgttgaaaaattaaagggtgccggtgcaaagataattgaatttgatccaccaaacaccaagttagcatatgaaaccgttcataaaatgtacaattgtgatgggaaccacatgcaacgtaaacttttgtcaggttctaatgaacctttgaccaaattgaccaaatggaatttgaattatggtgaaggtgctaaacattatgatgtggcttcaaaccgtgagttgaatgtcacaagagatcagttgagggatcaatacaatgattttatggttcaaaataaagttgactttattttgagtccaacctataacaatgttgctcctcacagtgaagaggtttacaattggtcctacacttctttgtggaacattttagatttcccaaccttatccttccaaactggtattttccaagatccaacaaaagataaatggacagaagaagacacaaagtataaatatcgatccaagttagaacaattggaaaatgaaaactacgatccttctcagtttgtaggagctccagttggtttgcaattgtctgggaagagatactttgatgaagaagttttggctgctggtaaggccatagttgatcttttaggtgttgatttgtataaacattaa

SEQ ID NO: 3405 - DNA, 966 bp, Candida albicans
acaatggtacaccacaaagtcactattattggatccggtccagctgcccacactgctgctatttacttggccagagcagaaattaaaccaactttatacgaaggtatgttggctaatggtattgctgctggtggtcaattgactactaccactgatattgaaaatttcccaagtttcccaaatggtattggaggatctgaattgatggaaaaaatgaaggaacaatcacaaagatttggtactgaaatcatcactgaaaccatctccaaagttgatttctctaacagaccttttaaattatggactgaatggaatgaagatgcagaaccaatcactactgatgccgttatcattgctactggtgcctctgccaagagaatgcatttaccaggggaagacacttattggcaacaaggtatttctgcctgtgctgtttgtgacggcgctgttccaattttcagaaacaacccattagctgtgattggtggtggtgattcagcttgtgaagaagccattttcttgaccaaatatgcttctaaagtgtttttattggttagaagagacgttttaagagcttcgacaattatgcaaaagagagttaccaacaatgaaaaaattgaagtattatggaacactgaagctttggaagctaaaggtgatggtaaattattgaaatcattaagaattgtcaacaacaaaaccaaggaagaaaaagatttacaagtcaatgggttattctacgccattggtcacatcccagccaccaagatttttgctgaccaactcaagaccgacgaagctggttacattcaaaccactccaggaacagcttctacttccattgaaggtgtgtttgcagctggtgatgttcaagataaaatttatagacaagccattacttctgctggtagtggatgtatggctgctttggaatgtgaaaaattcatttccgaacaagaagcttag

SEQ ID NO: 3406 - DNA, 651 bp, Candida albicans
aaagtttctcctgatactttaattattgttgatggggtttgttctattgctgttgaagatttagaatttgataaatggggtattgattttgctttgactgcatctcaaaaggctattggtgttccagcaggtttatcaattttttatgccagtgaaagagctttagctaaagctttaaataaagaaaaggaatcaactttttttgcatctttaaagagatggacaccaattatgaaagcttatgaaagtggcaatggtgcttattttgctactccagctgttcaaaccattactgctttaaaaacttcattagatgaaattttgagtcaaccaattgatgaaagatttgctaaacatgctcaagtttctgataaattcaaatctaatgttgaaaagttgggtttaaaaatcttgcctgttgatcataaagttgctgctcatggattaactgcagtttatttccctgatggaatcaatggacctgatttattgaaaaaattatctgaaaaaggttttgttgttgctggaggtatccataagaaattagttggtaaatactttagagttggtcatatgggttattcagtttatgctggtcatgttgataaattaactaaagctcttgaagaatcattaaatgaattgaaataa

SEQ ID NO: 3407 - DNA, 477 bp, Candida albicans
cttaaataccctggtcccaatgaattttctgaagatgtttggcattcaatggcaacaccttcacaagctcatacttcaccagaattcatttctactttccaatcagtgttgaaaagtttgagaaaagtatttaaatccactgataccaatactcaaggttatgtattgagtggatcaggtactttgggttgggatgttgcttcaagtaatttgttgaatccaggtgaaaaagttttagttttaagtactggatttttctctgattcatttgctgaatgtcttaaagtttatggagctgatgttgatgtattgacagctgaagttggtgatgttgttccattggataaaattgagcaacaattacaaaaggaaaaatattctgccattactataactcatgttgatacttctacttctgtagttagtgatgttgaagccattagtaaagttgttaaaaagtttctcctgatactttaa

SEQ ID NO: 3408 - DNA, 1758 bp, Candida albicans
aaactaattgcggatcgtccagtccccttggtgaagaaaagattggctaaaaaccacaacaaattgtatgctattgacttttcaattattgaaaaattggatgaagctaatagtgccaccaaaggattttctggtgaatttttgatccaattggcattttggagaagtgcattacctgaattgggtggattcatcgtcaacaaattattacaagccaatggtaactcattcgagttgttaggcactgttttagataactttatcaattccgttgatgaaaacgaaggtatcaaagagattccagttgttcctgaatgggtcgatttgaaagatgaagtcaaagaagctgaagaaaagaaagagaatgaagctgaagaaaaagacaaagaacaagctgaagctgaaactgaagctgaagaacctaaagagttgccatttttccctattgaaacttccttctttgccaatcctagaaatcctattgaagctgctgaagaaattaacaatactggttacaagtctcttgcacaaaagattactttcccagaagcttacaatgtttctaaagatttgagaccagacttgccagtcaagaattttgtggtcaaagttcaagaaaacaagagattgactccaactgagtattcaagaaacattttccatattgaatttgatactactggtaccgggttgacttatgacattggtgaagcattaggtattcacggtagaaacaacagcgaagcagttgaagaattcttgaaattctacaatgttgatggcgattcacttgttgaagtcaccaataaagacgatagcaaaattgttgaaattagatcagccagacaagcattgtctgaaacagtcgatttcttgggtaaaccaccgaaaagattttatgaatcattagctgaatttgctactgaagaaaaagaaaaagctgctttgaccaaattagctagtgctgaaggtgctgaagaattgaaaaagagacaagaagttgattttgatagttatttcgacattttacaagagttcaaatcagcaagaccatcatttgaagaattgattaaaatcattgctcctttgaaaagaagagaatattcaattgcgtcttcacaaagaatccatcctaatgctgttcacttgttaattgttgttgttgactgggttgatccaaacggaagattgagatatggtcattgttccaaatatttatccgatttaaagattggcgatgagttggttgttagtgttaaaccatcacttatgaagttgccaccattgtctactcaacctattgtcatgtcaggtttgggtactgggttggctccattcacagcatttattgaagaagaaatttggcaaaaacaacaaggtatggagattggtgatatctatttgtacttgggatcaagacacaaaaaggaacaatatctttatggtgagctttgggaagcttataaagatgctggtgtcttgactcatatcggtgcagcattttcaagagatcaaccagaaaaaatctatattcaagacagaatcagacaaacaattgaagagttgactgatgctattgtaaccaaaaacggttcattctatttgtgtggaccaacttggccagtaccagatatcactgcatgtttggaagatattgttcgtaatggtgctaaaaagaatggtgaagaaattaaggatgttgctaaagttgttgaagacatgaaggaagatggtcgttacattttagaagtttattag

SEQ ID NO: 3409 - DNA, 579 bp, Candida albicans
gctatcttgaaccatttctactcgtttttcagtggtaaaccatccgtttatttatttgacggtccagaatttgtgaaaacttttaagaaatttgaaaatgttttgtctactaatgatattttccaattataccaaggtttattagactcagctgcaggtgaagtttctatcgacgctgctttcaatgccttgaataaagtcacaggaaagaactattctcaatttgaatatgttggtagtgaaaaccctaaaaccgtgtttgtcgtttatggtactcaccaaagtacccaattaagtcaaattgtcagcaaattagatgttgggttagtcaaagttagagttcctgttcctttcaatcaagaaaaactcgttcaagttattcctcaatcaaccaagaaattggtggttttatcttctaatgatggattaatggctgatgttactgccggtttattcttgggtgggagatatcactcattatcccttgatgaattcaattaccctcttgatttcaaatggactccagttaccgttacaaaattattgaacgaatttgtctcattagattttgaaaaaatt

SEQ ID NO: 3410 - DNA, 807 bp, Candida albicans
ttgaagaaaaaaaatgaacaatggcgattagtacttcgaaaatttggacaaacacaagattatatttatgaagaatttttcgataatgttgttgttgctagtggtcatttcgatgttccatttgttccggaaattcctggattacaacaattctctgaacttgatgatactcttgtgatccattcaaaacaatttagatctcgagatgattttaaagataaacaagtcgttgttgttggagcatcggtatcggctatggattcgatccgagacattcttcctgtcgcaaagcgggccatcacttcacaaaaaccaacaactgaacctcacgtttattttggtactgaagcatttgatcatgatggcattgaaaagcgaggacaaatagttaaaattgaggaccatacaattcatttccatgatggaacgtcaacatttgctgatgctattattttaggtaccggatttttatatcactatccatttttaccaaaattcccagaactcaaagaattaatatttgacgccaatgatccttcgcttgcatttgttggtcataataccccagggttgacattcaaacttttccaatggcaagcaatacttgttgcaagagtttttgctggaaaaggtaatgtcccaactacaataagaaatgatccaacgattcatcctgattttaatcaatattatgaaacattaagagacgcttcttgcggtgcattaccaaaatggaatcctgtttgggaagaagcattttatagaggacacttacgaagaagacaatattggttagacaacccttga

SEQ ID NO: 3411 - DNA, 846 bp, Candida albicans
acaatgacaaaagaacaaattgatgaaccacgctataaacgtatagcagtgatagggggtggacctactggactagctgctgttaaagcattaagtttagaacctgttaacttttcatgtattgaccttttcgaaagaatagatcgattaggtggattgtggtatcaccacggagacaagtcattagttaagcctgaaattcccagcctttctccttcacaagaagagattgtttccgacaatgcaacacccgctgacgaatacttttcagcaatctatgaatacatggaaaccaatattgtgcaccaaattatggagtattctggtgtggcattccctgccaattctaagaaataccccactagatcacaagttttagaatacattgacgactatatcaaactgattcccaaagatacagtcaatattagtataaactctaatgtggtgtcattggaaaaggtcaatgagatttggcatatagaaattgaagatgtaatcaagaaaactcgtgccaagttgagatatgatgcagtaattattgccaatggacattttagtaacccatatatccctgatgtgcctggattatcatcttggaataaaaattacccaggtacaatcactcactccaaatattacgagtcgccagccaaatttagagacaaacgtgtattggtggttggaaattcggcaagtggagtagatatttctattcaattaagtgtttgtgccaaagatgtatttgtttccataacagatcaagaatccccacattttgaagatgggttttgcaagcatattggaatcattgaagaatacaattatgatactcgttcagtgcga

SEQ ID NO: 3412 - DNA, 360 bp, Candida albicans
tcaagattactaacaatttcactgtgtttaggctttatttatgtttcaggtcaaattccttacactccagacaacaagccattaccagcctcagctactattgctgattatgccgagcaagccattcagaacgtttctaacattttagaagcatccaattcctcgttgaaccacattgttaaggctaacatcttcttgacagatatgggagcacaatttggagaatttaacaaagtttatgctaaatactttagtgaacacaaaccagccagatcatgtgttgctgtcaaggaattgccattaggggttcctttggaaatagaagttgttgctattgaaaaggatgacaccaaattataa

SEQ ID NO: 3413 - DNA, 555 bp, Candida albicans
ttttctttctcttatcaggcaaccatgtcacgagcattatcatcgactagagtgttggttaatgacacacttttaccagccaccatcattttttcggtagagtcaggcacgattttagagattgttgatagggttttaccgcccaatgatccgattttggcacgctataatgtttttcctatagactatagaaatgttacgccagcagtgattatgcctgggctagttgatgcacatgtccacttgaacgagcccggtagaactgaatgggaagggtttgaaactgggaccaaagctgctgcatcgggaggtgtcactactgtgattgatatgccgttgaatgccattcctcctaccactactgttgccaactttaacttgaaaattaatgccgccaagggccagacgtgggttgatgtggggttttggggcgggttgatccctgataatttgtacgatttgaaaccgttgattccaatgggtgtgcgtgggtttaaagcatttttgatcgagtctggggtcgatgagttgcccaggtcacgccagcctttataa

SEQ ID NO: 3414 - DNA, 1224 bp, Candida albicans
cacacgccgatcttggcaggggccgagcctacttttggtaagaatgccaggaaagtcaacacgcaccatctgcgctcatatagctacaccgaagaagacaccaaagtcaacaccccgttattgttggcgcaacaggagaacgccgagttggccaatatcgaccccactgcgtatgcaacgtttttggcatcgagacccgataattttgaaaccactgctattgctgagattataaactgctcgacactattgccaacggtgccactccatattgtgcacttggcgacccacgaagctgtgccattgttgcgtgctgccaaagccaaggggttgccggtaactgctgaaacttgtttccattacttgtcgttgtgtgctgaaagaattgggagctgttcgacgcatttcaagtgttgtccaccgattagaactgacgataatcgtaaattgttgtggaaagcacttcgaaacgatgtgataaccactgttgtttctgaccattctccgtgtacgccagatttgaaaggtatggaaaagggcgatttctttgaagcctggggtgggatttcgtctgttgggtttggattgccgatattgtacactgaaggccttaaattggacccgcccatcagcttggcggaaattaacaaatggtgttcatggaatactgctaagcaagtagggttgagtcattgtaagggcaccattagggtggggtacgatgctgatttgttgattttcgatactgacgccaagtatgtagtggaaaacaaggagacgtatttcaaaaacaagttgacggcgtatgatgggatggagtttagggggcgggtattggagacgttgcttccccttacttctgttctcctctattccttctcttctgttgttcacctctaccgttcctcccttctattcatccttctctcctacttctcttttcctcacctttctctcttggttgccacccttcatcctttcccccctcatttcctccaatctcttcttctatctctctcgcctccttctatctctttctctacctcctccggttactattctatccctccctccatcccctcccctttaacactatttactgatcttttctctacttccctcactttcaacctcctttcccacttcgctcctattctcctcaatccccatctcttttcccctctcctcttgcctccatctctcctcttcactacttccccacct

SEQ ID NO: 3415 - DNA, 561 bp, Candida albicans
acattatttaaagcattttcgatgaccaaaattctttctcaagacgactttcaaaagcaaattgtttcacaatatacagatgttattggtgaaaaactcggtggaaaagtgttatctttctcagatcagtggtttgctgatgctgagaatttaattaagccgaagccaccaatcagagatgcgactagattcacatatgctggtgcttggtacgatggttgggaaaccagaagacacaacgaagcagaagctgactgggttattttcaaattaggtgtcagttcagccaaattgatcgcttgtgaagttgatacagcttttttcaatggtaatcatgcgccacatatttctgtcgaggcattgcaaaatttcgatgccagtgacgaaaatttacagaatgttaaagaggaagattgggaagaggtcattgctaaagtcgaatgtggcccactgcaaaaacatttcttttctagaggctcgttgacaaacaagaattacacacatgctagactgagaatgtatcacggtcgcctaatcagccacgatatggaaagtaccctc

SEQ ID NO: 3416 - DNA, 372 bp, Candida albicans
ttaccaggacgtggccatgatatgtctgatggttgggaaacaaaaagatcaagacacccaggccacacagattgggttattatcagactaggtgctcctgcaaaattactggaaattgtggttgacacagcacattttagaggtaatttccctcaaaaagtcaatgttaaaggtataaatgttgatgaggagtcaaagattgaagcaaattctgatgcttgggaagtggttgttgacgactccaaaactagtgccgacaaagaacatgcattcaaagtcaaagataactcaaaagtatattcgcatattaaattgactataattccagacggtggtgttaaaagaattcgtgcttttggtgtgaaggcttga

SEQ ID NO: 3417 - DNA, 645 bp, Candida albicans
acaatggtattgaaaacattcaaagttgatgggatatctccaataaaggccgagactttgacaccagagagttttctgaaatatggaggtgtaatcagtgcagatcaccaacttgaaaaagtacaaagttcagaagcaaactacgggaccgctataaaaattcacaaggttgctcccatagttaacaattattcaaactgccctagtggcaaggaagcgacggcaaattggaacatttttagatgcaaagctccaaagcatttgatcaatcatggaagtttaaatagtgtttacacatcaaaagtattagagagacatccgtttagtacccaaacgtttctaccattaggtcaagatttgcataaagtttcttatttagtcatagtggccaaaacagatgagagcacggaagagaaattgcctgatccaaccctgattagagcgtttgtttgtaaaggcaaccaatcggttacatacggaataggcacttggcacgcaccaatggtggttatcgatgagaaagtcccacatatagattttgcagtattcattcacgaaaatggtgtggctgacgaagatgttcaagaatgttactttgaaccagggtatagcattgtgtacaatcagattgaagcaaaattgtaa

SEQ ID NO: 3418 - DNA, 1851 bp, Candida albicans
ttcaatattcatttctcccttttttttcaattaaacttttgtgttgtgcttcttctttggcccttaaatttctatcatccatcatatttaattaattctttaaaaaaaatgattggacttccattggacgaaaactttagatctaataaaagaaaatcaatcattattggttcggttgtatttgttgccttgttggtaactttattttctactaatttattcaattatttgaaaattgtaacaacaccaattccaaaagaaagttcattatgtccactctatgaaccaattgctccagaatcttattataaggacaattcaactgtgttggaaattttgcacgataaaaaatacaaaaaggaatccattaaaagattagctggtgccattcaagttgatactcaagtttttgataaacaacctgctgttgatgatgctccacaagtatgggcaaaatttgctaaattccatgattatttggaacaaactttcccattggtttacaaaaacttgaaagttaccaaagttaacacttatggtttggtttatcattggaaaggttctgataaatctttgaaaccagttttattgactgctcatcaagacaccgttccagttcaaaaagatactcttaaagactggacttatccaccatttgaaggtcattacgatggtgaatacatttacggaagaggtgctgccgattgtaaaaatgtcttgattgctattttggaaactttagaacttttgttagcaaaagggtatcaaccaaaaagatctattcttgctgcatttggttttgatgaagaaacttctggttatcatggtgctgctcatatcggtaaatacttggaagaaacttttggtcaagattctgtatatgctcttattgatgaaggtgctggacttaccgttcaagaattaaccaacactattgttgctcttccaggtactgctgaaaagggttacgttgatattcaagtagaattgactactccaggtggtcattcttctatcccacctgatcctacttctattggtattatttctgaattgggatacattattgaaaaggacccatacagtccacttttgccaccagaaaaccctattttgaattttgctcaatgtttagctcttcatgatccaaaaaacaatatcccatcttcttttaaaaaggcaattttaagagctggttacgacaagtttgccaattccaaattagtcgaaggaatctctaaaaatagattgaccaaatatttgatcagaacttctcaagctcttgatattatcaatggtggtgaaaaagctaatgccttaccagaacatgtcaagttattagtgaaccacagagttgctattggtaccagtgtagctgaagtccaagagcattttgtttctagagttgttgaagttgccaaaagacatggcttgtcagtttctgcttttggtaaagatgttctcaaagttaaaaatgattcgggtttgtttaatgttaccaactttgctgggttcttgaatgctgctcctgtcaccccaactaatgatactgtttgggaatatttgtctggtgttactaaacacgtttatgaagatttggttttcccagagattaaatatcctgtcatcactgctccagctattatgacaggtaacaccgataccagacactactggaacttgactagaaacattttcagattcactccagcttttattggtgatttcattggtgaaacccatattcacagtgttgatgagaaattaccatttgacagtcatttgcaattacaagcttggttctatgaatacattcaagctattgacagtgccaaggcaaacaataaataa

SEQ ID NO: 3419 - DNA, 687 bp, Candida albicans
gcatttgcattgaagaaaattaacaaatttggattagtatacacatggaaaggtaaggatacatcaaaaaagccaataatgttgactgcccatcaggatgtggtacctgttccacatgagactattgaccaatggacattcccgccttttgaaggaggatttgacggcaagtatctttatggtagaggcgtgagtgattgcaagaatttattgattgctttgatgggtactattgaacttttattagaagaggacaagttcaagcctcaaagaaccattattttagctttcggatacgatgaagaagctgctggtaaaggtgcagaggaaatatccgactacttggtaaacaaatatggtcccgattcaattttacaaattatcgacgaaggtgacgaaggatatcaagagattgaaggtgtaaagcttgtattgcctgccactggtgaaaagggccatttaaattcagttattgatctatttacacctggtggccacctgtcagtgccaccaagacacacttcgattggaataatgtcacaattgatcaccaagatcgaggataaagaatttagtccaatattgacaaacaataatccagttttaggccaattgtattgtctcgcagaacattcgaaaattttgaataaatcaattaaacgagacattttgacagctccaaattga

SEQ ID NO: 3420 - DNA, 399 bp, Candida albicans
attgataatcaagaaattattgaaccaacagaacatgggtatttcaactattccttgatagaaagtttggaacctgctcctgtctctcctataaatggggaaagttggaatatatttggtgggtcattgagatacttgtacgaagatttaattttcccagactcaaatgatacttttattgttgctccatttctttctaccggtaacacagatacaaagtcatattgggacttgacaagaaacatatatcgttaccaaccaagcattgttacaaaaaatagcaatatacattcaattgatgaaaagttggactttgaaggacatttccatattatcgctttctattattactacttgcaattggtagacggtaaagatgataaattatttgaaccttag

SEQ ID NO: 3421 - DNA, 1476 bp, Candida albicans
aatttagcacacacaaaaaatatcagaatacccaatgcaacttctcgacatcacataacccgtttgttgttacaattttccttccttcttttctctttttcatcttacacttttatgttaagacggctctttccaatacgacaattgtacacaacaactagagccatggccagcaaatcaacagacccaactagtttgcataatccgtatttttatcaaaaaccggggcaaaaagatatctggtcgttaatcaacgaaactgcggcccaggcacaacaagaatccggcgagccaattgtcaatttgggacaagggtttttctcctacaatcctcctgagtttgcgattaacgctgtcgaggaagcattgaccaagccgcaattcaaccaatatgcacatgctcgtggaaacccaaacttattgaaacaagtggcagagcactattcgcgatcgtatggacgtgctgtgggggttgacgaggtccaaatcaccacgggtgcaaatgagggaatgtttgccattttctttggtttcttgaccccgggcgatgaagtcattgtgtttgaaccattttttgaccaatacatccccaatgttgaaatgacaggagccaagatcaagtatgttgaaatcaagtatcccaagaaatttgacaacgaggttgtcacgggccaggattgggagattgactgggaaggattgaataatgccattaccgacaagaccaagatcatcgtgataaataccccacacaacccaatcggtaaagttttcaccgaggaggagttgtacaagattggcaagcttgccgtggaacataatttaatccttgtcagcgacgaggtttacgagaacttgtattatactgacaagttccctcgtccagctgcattaccacagttgcctgaattggctgaaaggacgttgacagtgggttctgctgggaaatcatttgctgccactggttggagagtagggtatatccagggccctgccaatttgattaaatttgtaacagcggcccacaccagaatttgtttctcgaccccagcaccattgcaacaggcagtatctcaggggtttgagcaggctgagaaatcaaactattttgagaacactcgaaaggagtatgaacacaaatacaaaatattcaccaaggtatttgacgacttggggttaccctacaccgttgccgaaggagggtactttgtgttggtgaacttgctgaaagttaagatacccgcagattatgagtttcccggaaccatcagcgatagaggcactttagatttcaaattggcgtattggttgatcaaagaaattggggttgtgggaatccctccaacagagtttttaaccgaatcgaatagaaaggggaacggcttagaaaattgtgtcagatttgctgtttgcaaagatgattctgttttagaagacgcggttgagagattgaaaaaattaaaagactatttataa

SEQ ID NO: 3422 - DNA, 849 bp, Candida albicans
agtatgctgacagatcttacttcacactttcagtacatggctataagcttgtttgtcggttacaaagccttactaaataatgagacaccagtgtcatgtatagtcgtggattcaaaatcagataaaatcattagcataggctacaattataccaaccactctctaaatggtacacaacacgcagaatttattgctttacaacgatttggggaacaaaaactgagtattgactataatgatttaattttgtatgtgacagtggagccttgtattatgtgtgcatcttatttacgtcagttgggcatcaaaaaagtaatatttggttgtgggaatgatagattcggaggaaatggtaccattttatcaatacatagtgacatcaccttgcctaacgcagcttattccagtatcgggggtatatgtaggacagaaggaatccaactattacgaaatttttatattcaacaaaatgagtcggcaccaaatccaaaaatcaaaaagaacacagatattgagagtaaggaatacccagagaatcagttttgtagcatttcaaaggatgaatttatagagttttacggaaatgaaagagtgcatatttacgatgggaagatttttgaaatcactccattacaaaacaagggttatgatataaaagaattgatatcgttggatatgatgcaaaaagtcccatttctagaggatgagttgggacaaattacagatgagcaaataattgaatttcacaacttatttttcaacataaatgatgatggaacggttaattataaaaaaccaataggcaaatataacagtaaaaagagacactttgcaaacgatgaagaatag

SEQ ID NO: 3423 - DNA, 1602 bp, Candida albicans
ataccctccccagaaaacatgcctattcctactcctcatggtggtaaattaagagatttggtcatccgtgatgctccactcaaacaacaattattgcaagaagctaaaactttacctgctttgactttaactgctagacaattatgtgatttagaattaattttaaacggagggttttctccattaactggattcttaaatcaagaagattataatagtgttgttaacgatttaagattaagtagtgttaagaatgaatcaaatggtaaaggtttattatggccaatcccaatcaccttagatgttgatgagaccacttctaaaaagcattctgttggtgatagaattgtattaatagatttgagagatgaaactccattggccattttaactattgaatctatttataaacctgataaaaaattagaagcagaaaaagtgttccgtggtgattcagaacatcctgctaataaatatttattagaaaccgctggcgattattatatcggtggtgaattacaagggatcaattatcctaaacattatgattatgttgatgctagaaaaacaccaactgaattgagacaagaatttgaaaaattgggttgggcgcaagaaaatattgttgcctttcaaaccagaaatcctatgcatagagctcatcgtgaattaaccattagagctgctcaagatattggtgataaagctcatattttgattcatccagtcgttggtttgaccaaaccaggtgatatcgatcatcatactcgtgtgaaggtatataaacaaatcttgacaaaattccctgatggtttagctacattatctttattaccattagctatgagaatgggtggtgatagagaagctttatggcatgctttaattagaaccaattatggggttgatcatttcatcgttggtagagatcatgctggtccagggaaaaactcccaaggagtggatttctatggtccttatgatgctcaagaattattagctaaatatgacgatgaattaaacatcaagattgttccatttagaatggtcacttatttacctgatgaagatagatatgctccaatcgataccattgatgtgaaaaaagttagaacagcaaatatttctggtactgaattaagaaataaattgaaaactggtgatgaaattccaagttggttttcttatcctgaagttgtcaagattttaagagaaactaatccaccaagatcaaagcaaggttttgctattttaattgataactctcataaattgggtgattatttatcatttgccttacaatctactttgaatcaattcctgggtgaacgtagaatcacaaaattaaatgctcatcaagctaatgattcatttattgttggtgaattagttaaagctgggtccggggttattgttccaacaacaaacccaactccaattgttaatgttgtgggtaatggtaattcattggtggtcaaccaaaagaataataacaatcaagcttctggtaatgctgatggtgaattcaatttgtcaaatgatgatttggttgctgtagttgatgaaattgtgaattacttgaaagatcaagggttttattaa

SEQ ID NO: 3424 - DNA, 888 bp, Candida albicans
ttatggtcaaagaaatcaattaaattatctgacggaattttgtcagagaaattggaaaatttgtcattggattccattgtctcgaagttcaatgtcaaaccatttgaagttgtaaacaaagcttcgagtcaaaaagatgctgttttgtttttgggtcagttaaacgatgaattggttaatgctgccaacaaagagaatgccttgttgatcaatatcaaaatttacaagcctttccaattgcagcatttgcttaatatcattccttcgagtgttcaaacaatctctattgtacaacaatctaccactccaattgttacatttgcaccattattgcttgattttttctcagaatattccaaatatcaagctttgaataacttcacaaaaattgtgtctgcaacttttggttttgtcacagattatactgctgctatttcacaattgttggctaacactagatctgataaccctaaacaaaacttatcttttggtaaggtgaataccgtattggctaccaaatcttcaaagaagaagtatgaggattatttagaagcagtctcagaagcccataatttagaacaggcttatcttaaagtattacagcaaatcaatctgaccaatttgaaagtgttgaatgagttccaagctgctaatgctggtcttgaagtcaatccagaatttggttttggttcctttttgtttgatcaagaacaacaagaaaatttggtttcattggtccaaaaatctataaaagaaaactccttccattcagtatataatggtaagttgattgaacttctttctcaatggctagtgcaaatacaagacagtggtgaagtagaaaatatattgccagtcgaaatagtagatttgttgaaaacatactaa

SEQ ID NO: 3425 - DNA, 183 bp, Candida albicans
  unsure (88): Identity of nucleotide sequences at the above locations are unknown.
aaaaattggttgattggttctgatgcttggtcttacgatttggggtcatctggtgttcacaatgtgataacctccgggaaaaacatanacatgttgattattgattctgaaccatattcagaaaatcttccgacaaggccattaatggttctcgtaaaaaagatgttggtttatatgcaatga

SEQ ID NO: 3426 - DNA, 2760 bp, Candida albicans
accatattcagaaaatcttccgacaaggccattaatggttctcgtaaaaaagatgttggtttatatgcaatgaattatggggactgttatgttgcctcagttgccatctattcatcttacactcaggtattacaggcttttattgaagcagaaaagtttaacggtccttcaattgtgttggcatacttgccatacaacagcgaattagacaataccttaactgttttacaagagaccaagaaagctgttgacagtggatactggccgttgtacagatacaacccaagagttcaaaatgaagccgatgcattcaaattggattcttccaatttaagaaagcagttatcagactttttagaaagagaaaacaaattgactttgttggcatctaaggacccattgttgtctagaaacttgactgctaatgctaacaccgaggcaaaaaccaaacaatctaagattgcagacgaatcattcgcccaattgttacaagggttatccggtccacctttgactgttgcatttgcttctgatgggggaaatgcagaagccgttgctaaaaaagttaatagacaagctttgggtagaggtttgaagtctgttgttttacaaatggatgacttgtcagttgaagacttgcctactgaaactaatgttgtttttataacttcaacatcgggacaaggggaatttcctactaatggtaaacaattctgggacggtgttaaaaacaccacagatttggatttatctggtatcaggttttctgtttttggtttaggtgactcccagtactggccaagaaaagaagacaaacattactataacaaacctgccaaggacttgtttgccaagttaaaactttatggtggtgttgaattggcagatattggattaggtgacgaccaagatgcagatgggttttctactggtttcaacgaatggattccaaagatctgggccgcattaggtgttgacaatgttgaaggtgttgaagaaccaaaaccaattacaaatgaagatatgaagattggttcagattatcttagaggtacgattgttgaaggattaaacgatcaatccactggtgccatttctgcggttgatcaacagttgacaaaattccatggtatctatatgcaagatgatcgtgatattagagatgagcgtaaagctcaaggtctcgaaccagcttacacttttatggtgcgtgttcgtttaccaggtggtattgctactccagaccaatacttgaaaatggacgagttggctgatgaaagaggtaatggtacgttgaaattgaccaccagggctactttccaattgcatggtgtggtcaagcacgacttgaaaccagcaatcagaggcatgaactcagcattgatggatacattggctgcttgtggggatgttaacagaaatgttatggtttcagctttaccacataatgctaaggttcatggtcaagtttctcaaatcggggctttgatttctgaatttttgttaccaaagacaacagcatatcatgaaatttggttacaaggtgatgatgctggtgataaacctggctacagagaagcttgggaaaaccgtaaagaaggaccaactaaaaagaaaaccttggttgctggtaatgtcttggctgatgtggaaccacaatatggagtcacatatttacctagaaagttcaagattgttataacagttccaccatacaatgatgttgatgtttatgcccatgatgtgggtttgatagctattgttgaagacaatgaagtggttggttttaacgttttagctggtggtggtatgggttctacacataataataaaaagacatatcctagaactgggtctatgttgggttatgtatccaaagaccaagttcacattgcttgtgaaaagatcatgttggtgcagagagactttggtgatagaacaaatagaaagcatgctagattgaagtataccattgatgaccttggtgttgatgtctttaaagcaaaagttgaggaattgttgggctataaatttgacgagccaagaccattcaagattgaatcaaacattgactattttggctggtgcaaggatgaattaggatacaaccatttcactgcattcatcgaaaatggtagaattgaaaataccccagaattgccgcagaaaactggtttgcgtaagatcgctgaattcttgaagtcaggaaatagatcaggagaattcagattgactggtaaccagcatattcttatatccaatgtttctgatcaagatttggatgaagtgaaaaaattgttagctcagtataaattggacaatactgacttttctgctttaagaaaatcttctgcagcatgtgttgccttcccaacatgtggtttagctatggccgaatctgaaagatacttgccggttttgattaccaagttggaagaagctttagaaggatatggtttgagacatgactcgatagtgatgagaatgactggttgtccaaatggttgtgctaggccttgggttgctgaagttgcattggttggtaaagcatatggggcatacaatttaatgttgggaggtggtcatcatggtcaaagattgaataagatttatagatattccatcaaagaagatgagattttggacattttgaaacctttattcaaaagatggagcttggaaagaaacgaaaacgagccatttggtgactggtgtattcagagcaggatgtcttcaacacgcggcggaaggatcctatct

SEQ ID NO: 3427 - DNA, 741 bp, Candida albicans
  unsure (649): Identity of nucleotide sequences at the above locations are unknown.
agacgcgcgattgaatacactggtccctcggatgccaagtcggccattttcatctttggctccaccggagtattcgttgatgttctcgcaaaggcggaagccaacagtgagctcgagaacatcggactcatcaccgctcgtctttaccgtccttgggtcggaggccagattgtgaattccattcccagctctgtagagaagattgccgttctcgagcaggttcgcaagactaccaagtggggtccgtcattcatggatctcttgtccagcttgaccccccctgctggcagaccaacccctcaaattgttgggtacagacttggatatgtcgagccgtctactgcagttcaggcactgcgcggtatcgttcaaaacttgaactcttcctcccctattcagaatctcgagatcggcagcgccaaagcccccgccactgagcattccctggaacagcctcacgttgagaacgcctacctgaagatcctgaaccaactatttgctgagcgcctttacattgcaaatcagttgggctctcaaaatgctggcatttcgtccactatcgcggcgagccctgaatatggattcggttcgctgatccccagaaaggagcgcccgtcgcgcttcgtccgggaaatcgaagaagcttcanagttcactgacttcacctcagaatccagatcatcgttgtcccattgggcgctgaatgtcaaggacgcttccaaagcgaacaagtgggctcca

SEQ ID NO: 3428 - DNA, 1428 bp, Candida albicans
atttctatacacacacaaaattattacttcatatcatatcatatcttgttttatcttttctcacccatgtctatgtccactcgattgaaacttgtatcaaaattaggaattgattaccccatttttttatcaccaatggctggagtatcaactattgatatgtcaataggtgttagtaataatggtggattaggttcgattccattagcatcaattgatttccggaaacaagattctattgaaaaattagagaatttgatcattgaatataaaaagaaattgatcaactcaacaacaacaaaaacaaaaacaaaaactaaggataatgatcagttggtggttaatttgaattttttttgtcatgaaattgaaaatgaaccaaatcaacaacaaattaataattggaaacaattatataaacaaagtgtgtttgataataatactgaagacgatgatgcatttaagttgttagacgagattcaattcattaatgggaatgtttcatttaaagaaattgaaaataatgaaaatcacattgatcaatataataaattaatggaatatttagaacaattaaaaccaagtattattagtttccattttggtatgccttcccctaaaaccataaagcgacttcaaaatcaaggaattatgatatttataactagtacatccttagaagaaacaatctacttaacaaataataataataataataataataataataataataataataataataataacaataacgacgacgacgacgccaaaattgatgggataattttacaaggttatgaagctggtggacatcgaggtaattttttaataagtgatgataaatttgatgaaaaattatctactcattcattatttattcaactgaaacaatatctagatgaaaatgttactactggctataaaccatatcttgtacctgctggaggaataattgatatagatactataaattattatttatcattaggtgctgatgccgttcaaatgggtacagcatttttagctacaccagaatgtatcaatcataaatttttcaacaccaataatatgagtggtcaacgaaaacctacaattatgattgatttggtttcggggaaatttgctcgaaccgtaacaacagatttcataaccaatttaatcaaaaatagtaataataataacaactactataccaaaaatgaattaccttcttatggatatgcatatcatggatataaatcattaaaatcaattattaaaaatcatacaaaaaatattaaagatattaaagatattaaagatattaaagatattggattttatttggcaggacaaaattattatcaaattgaaaaaaataaactgactcaagaaattatgaaaatattaaccaatggtatagatagagatgttttaaagtaa

SEQ ID NO: 3429 - DNA, 774 bp, Candida albicans
aaaaatattccacgatctttacttcattatacaccaataaccaagagaacccctttgataaccaccaccataagaaatctattcattcaaacttcagaaactcctaatgaacaagcattaaagtttttaccactgataaaaattttacaagataatcaaaccaaagagtttttaagtggtcgagaagctgcatcatctccattagcacttaaattattcagcattgatgggataagatcagttatgtttggaagtgatttcatcactattgaaaagtcaaataattttgattggtcacttttaaaaccggaaattttttccatattaacagaatatttaactaatggtacccctatactattagaagataatgttgatgagtatgggaattcattattaactaatgatatggcgataaatgaagatgatgatgaagttgtatcaatgatcaaagaattgattttcacgagaatcagaccagcaattcaagatgatggtggtgatattgaatttgtcaattttaatgaggaagatggtacagtatatttaagattgaaaggggcttgtcgtagttgtgattccagttctgtgacattaaagaatggaattgaaagtatgttaaaacattacattgaagaagttaatctggtggaacctattgaagaagaacaacaacaagaagagattaatgttgaatcatcaactattaaaccaataaatagagatgaaccatcatcttccgtttcttcgtcgtcgtcaccaccatcattgtaa

SEQ ID NO: 3430 - DNA, 801 bp, Candida albicans
atacttaacgatcttcaaattagtaatcgaagatattttttttttttttcaaacaactattcaacttctttcttcatcgactcaaccatgtttgtgaacaaacgcttactcgcatatattccaaaaagattgtaccatttcaagactttgccaacgccaaatcccaatgctttaaaatttatatcaccagagtgtaatatactacctatggatgacaaaacatttgaattcacaacgactttacaagccattcattctccattggcgttaactcttttcaaaattcctggtgtgaaatttgtaatgttgggacacgatttccttattgttaataagcaagattatattaattgggcaaacttaagaccagagattgtggaacaattggatgagtttttgacctctaaaaagcatccagtgattactaaagagctagtggacgaagctcaaagagaagccgaggaagagtctgaattaatttccatgattaaagagttgatagaaactagaattagaccagctatacaagatgatggaggtgatatcgaattgaaaggctttgatgaagaaacaggaacagtttttgtgaaattacagggagcttgtaagtcctgtagtgcaagtgaagatactttgaaacatggtattgaaagtatgttgatgcattacgtcgaagaggtcaaagaagtcatacagattttggatccagaagaagaaatagccgtgaaagagtttgaaagattagaacaaaaattgaaaaatggtaatagtcaaggcgaacaagctcctccaagtttgtaa

SEQ ID NO: 3431 - DNA, 1425 bp, Candida albicans
tcttggaaatggggaaaaccccaaccaactataaaagagaccatcaattcctttgttggaaaaatttttcatcagtcttctttttcaattaattatacaatcactacatcaatgtcttcaactccagattttaaagtttcctctgaaactgctcgtgaatacgaaacaaaatattctgcccacaactaccatccattgccagtagttttttcaaaagctgagggtgctcatgtctgggatcctgaaggaaaagagtacttggatttcttgtctgcatactctgcagttaaccaaggtcactgtcatccaaaaattgttgctgcattggttgatcaagcctcaaagttgacattgtgctctcgtgcattttcatctgacgtgttcggagtctatgccaaatacattaccgagtactttaactatgagatggtattgccaatgaacactggtgccgaagctgttgaaactggtttgaaattggccagaaaatggggttacgacaagaaaggtattccaagtggcgaagctattatattgtctgctgttaacaatttccacggtagaactttgggggttatttccatgtccactgacccagacgccaccacaaactttggtccttacttgagaggtgttggtcctcaaattcctggtgaaccagatggcactttgttgagatatggggttattgaagatgtcgaaaaagcattcgccaatgccggtgataaaattgctgctatcttattggaaccaattcaaggtgaaaaccggtattgttgtttccaccaccaacattacttgccaagagtccaagagttgtgcaagaaacacaatgtcttgttgatctgtgatgagatccaaactggtattgccagaacaggtaaaatgttgtgctatgaacattcgaaaggtgtcaagccagatattgtattgttgggtaaggctatttctggaggtgttatgccagtgtctgccgttttgtcttcgaagcaagtcatgttgactttagaaccaggctcacacggatctacatacggtggtaatccattagcttgtagagttgctattgctgctttggatgttgttagagatgagaatttggtcgaaagagcacaaaaattgggtgcattattgagagaaaaattagaagagttacaaaaggaaagcaacggaatgatcagtgaagttagaggtaaagggttattgtcggctattgttatagacgaatcaaagaccaatggcaggacagcttgggatttgtgtttgttaatgaaaaatcacggtgttttggccaaaccaacccatgacaatatcatccgtttggctcctcctttggttatttccgaggaagatttattgaagggtgttgacagtattagaaaatccttgaaagagttgccaaacgttgctaaaacagaacattag

SEQ ID NO: 3432 - DNA, 1368 bp, Candida albicans
actaaaactttaattatgaggaaaacattaacttcaatccgttttttgtctgacggtattcgtgtcaaagataaatggaatagtttgatctccgatctcgtggttgaacctacaaatagtacaggtccactctctggaaccacttatatcgtgaaagacaatatagccacaagccatggttataccactgctgcatctaaaatactatctaactatgaatcaccttttaatgccatgataatagatttgttgtcaagtaatggttcaaaactaatagggaaatcaaatttggatgaatttgggatgggatcagcaaattataattcgtatttcaacaaagttactaatccgtatgataatactaaagttccaggtggatcttctggtggctctgctgcgtccgtggctgggaaaatgtgttcattcagcattggaactgatactggaggatcagtgcggttgcctgcaagttattgtaacgtatttggattcaaacctacttatggtcgaatttctagatggggggttataccgtatgcacagacattggatacagtggggattataggtgaaaatgtaaatattataaagcgtgtttacgatgtgcttaacaagtatgacgataaggatcccacttgtttgcctgaagaagtgagacagaaaattcctaccactaaaaaagaaactttgactatcggtgttccacatgagtttgtgttgaaagagctatcggctgatgttagagaatcttgggaatatgcactttccaaaacatgtaaattgggacatttggtaaaacctataagcataaaaactatcaagaaggcactaccatcatactatactttagcaactgctgaggctgcatcaaatctttcaagatatgatggtataagatacggatataacaccaatgaattggttaattctcccatagaactaattgcaaccaatagatcaaatggttttggaagcgaagtgcagagacgtattttattgggaaattacactttgtcttcagactctggagaccattatttgagagccacgcaaattcgagaagaattgtgtgcagagttctcttccattttcaacaattctcatgtgttgcttcaggatgagcaatcgctggataaggtagatttgataatggcaccaacatcaacaagtactgcacctacttgggacgagtttgtttccgcaaatgaaaaaaatttcttaaacagttatgtgaacgatgtgctaacagtcccggcatcattagcagggattccagcaatttctgtgccagttaatgggatcggaattcaattgatgggacaatttggtgatgatgatttggtgttacaattggctgatcaaatttag

SEQ ID NO: 3433 - DNA, 1404 bp, Candida albicans
ataacaaaaagtaagtcgtgcaccacacaaataatgactaattcggtaattggacaattgaaaaattttttaaccgcgcttaacctattatccattcattcatcaagaaaagaaattttttttttcttaaactataaaagggatagtaaaaacttgttgaacgaaaatttcatatatcttttctttttctctttcttttcttttcttctctttttattccattcaatttatacacacacatatacacaaaacaccaacagaaacatgtcaaagggaaaagtttgtttagcctattcaggtggtttggacacctcagtcatcttagcctggttattagaacaaggttatgaagtcattgctttcttagccaacattggacaagaagaagattttgaagaagctgaaaaaaaggcattagccattggtgccaccaaatttgttgtggttgatgtcagaaaagaatttgttgaaaaagtttgtttcccagcaattcaatcaaatgccatttatgaaaatgtttatttgttaggtacttcattagctagaccagtcattgctcaagcacaaattaaagttgctgaagaaaatggttgttttgccgtttctcacggttgtactggtaaaggtaatgaccaggttagatttgaattgagtttctatgcattgaaaccagatgttgtggtcattgctccatggagagacccagaattcttccaaagatttgctggtagaaaagatcttttagattatgctgcttctaaaaacatcccagtggcacaaaccaaagctaaaccatggtctactgatgaaaacttggctcatatttcatttgaagctggtattttggaaaatccagatactactccaccaaaagatatgtggaaattaactgtggatccaactgatgccccagataaaccagaaactttctcagttgtttttgaaaaagggttaccagtgaaattgatcttggatgacagtaaaaaagaaattactgatccagtagaattattcattgaagctaattctttagctagaagaaatggggttggtagaattgatattgtggagaatagatttattggtattaaatccagaggttgttatgaaactccaggtttgaccatcttaagaaatactcacgttgatttagaaggattgactttagatcgtgaagttagagccatcagagatcaatttgtgacaccaacttgggccaaaatcttatacaatggtatgtacttcacaccagaaagagaatacgttcgttcaatgattcctccatctcaagtcactgttaatggagttgttagagctgctgcttataaaggatctgtcaccatattaggtagatcttcagacactgaaaaattatacgatgaaaccgaatcatcaatgggatga

SEQ ID NO: 3434 - DNA, 621 bp, Candida albicans
aattataaacaatcagaatatccaattgatggaaaccctccaccaattgaagaagaagaacaaaacaagggagaaatcgagaatcttgttaatccagttaaacttgatcaagatcaatttaatgaaaattataaacaacaagttattgaatatgaagaattattagacttggttacaaaaaaaaaaaataatggatatggattgaaagattatttacttttagatgctagatcattagatcgattcattggtaaagccaatgaaccaagaccaggattaagttctggtcatatccctggtgcaatcaatttaccattcaatacattattaactggtaataataatcaattcaaaaataaacaagaaattttagagattttccatgaaaaaaatattctaaatggtaatggtagtggtaatggtgatgataaaattgaaaatttattaacaaattatcctaaagggattatagtcatgtgtggaactggtgttactgctgttattttaaaatttggtattgaatgtattttgaaattaaatgttcctgttcgtgtttatgatggtagttggacagaatgggcttcaagagcaccttctgaatacattcaaaaagatatttaa

SEQ ID NO: 3435 - DNA, 444 bp, Candida albicans
accaccatcaacaacaacaactactatcactaccaccaccaccacttcatgtcgagatcatttttaacaacaattactccatcagcatatagagcattattatctacatccaatccatcaaaacgagtaatccccatagatgcaacttggtatatgcccaataatcccaaaaatgctaaacaagaattcattaaagaacgtattccaaatctgaaattttttgatttagataaatatattgatccaaccagtccatatcctcatatgttaccatcacatatatcaattatggaacaagcttataaagatttacaattgaatttaaatgattcaattgttgtatatgataaattgggtatatttctgagtcctcgtgccgcttggactttttcattatttggtcatcctaaagtatatttattagataattatttaaaattataa

SEQ ID NO: 3436 - DNA, 573 bp, Candida albicans
actcacataatgtttaccagaacgattttacctactacaagaagaattttaactcaacaatcaagagttcttgttccaagattagctattccaacatcaacattcactagatcatatcatgaaaaagtcatagatcattatgaaaacccaagaaatgtgggctcgctcaataaagaatcttccgatgtcggtactggtttagttggtgctccagcttgtggagatgtgatgagattacaaatacaggttgatgaagaaacggggaaaatcaaggatgttaaattcaaaacattcggatgtgggtcggccatcgcttcttcatcatatgctacagaattgattagaggtaaaactcttgatgaagctttggatattaagaacactttaatcgctaaagagttgagcttgccaccagtcaaattacattgttctatgttggctgaagatgctatcaaggccgctgtcaaagactatcaatcaaagagaaaaacaactactttgggtgctactgctgcttcaactgtttcaagttcaagtgctagtgccgctgctcctgctactgctactgcttaa

SEQ ID NO: 3437 - DNA, 486 bp, Candida albicans
gcaatgggaaacatagttcaattaacaccagagcatatttcgtttcttaacgagcacttgaaaactctttcggcatacaatattatcaaatgggcatactttactttccccaatttgtatcagacaacagcttttggattaacagggttggtgactgtcgacatcatatctaaattatcccaggaattggaaaaggatcacttgattgatttgatctttcttgacacattgtaccatttcccacaaactcatgaattggttcaaaaggtcgaacaaaaatatcgcccaaaattacatgtctacaaaccaaaggatgtgagcacggaacaagaatttgctgcaaaatatggtgaccagttgtgggaatcaaatgacgcatattacgatttcttggttaaagtggaaccgagccaacgtgcttacaaagaattgggaatttcggttgtgctaactgggaataaaaaagttctcaggtggtgcccgtag

SEQ ID NO: 3438 - DNA, 930 bp, Candida albicans
gagaccccgaaggaatctaactcattggtatccttaattataatgtcttcttcagaaacatcagaaataaaaggttcattacttttagcatggcaagttaaagataagcattgtcttgtaataggtgcaggtgatgttgcattatcacgtattcatcatttaattaaagctcaagccaaaatcacggttgtaacaggtgcatcaaaaattcatcctcaaatcattgaattaaataatcaagggaaattatataattttttccaaagagattatcaatctaatgatttaaccatttatgaaaatataaattctcgtatcaatgatttagatttaatcaattcggaaaattataatttaattgatcaacaagtatatcaagaaatgtttgctgttgtatgttgttgtattgatgattatgaattgtcaacaaagatttattatcaatgtaaatatcttcgtattcctgtcaatatcgctgataaacctccattatgtgatttttattttggatcaatgataaatcaagataatttacaaattatgattagtactaatgggaaatctcctagattatcaagaatgattaaagataatatatctaaagaatttgaaaatgttaatttaaatcaagccgtggaaaatttagggttaataagaagtagattaagagaaatgattttaattgatgatgatttaaatactatagatacaagaatgacttggattaaaaatttgacggattttttcacattaaaacaatggagtgaaataaatttgatcccaccaagttctacacctccttatgataatagatttcaatatgttgataatatcattaattatttcccagattatccacctaaagattatgaagaatttaaagatgccatagttttcacacacggcgactggacgatccaacgtgcaaga

SEQ ID NO: 3439 - DNA, 708 bp, Candida albicans
aagaatagaagaattagaataaataatagacacttagaaccaaatttcataatgaacaaggcattgcaaccattaaggacattgcgtcgaatagtgtggggtcaaccaccagacaatccagttgcaagaagttatttattcaaacttgatgcctttgttcttagttacgtttgtttattgtattgggcaaattatcttgatcgggcaaatttggccaacgcctatgtatctgggatgcaagaagacttacaaatgaagggtaatgaattaaacatcattaacacttgcttttacgttgggtacattgttgctatggtgccccataatttaatcttgctcaaagttagaccaagatactggatctcaatctgtgggttttgctgggcagtattgacattatccatgtataaagttcactcattcaaacaactttgtgttatcagattctttgaagccatgtttaaggcagtaacttttgctggtactcatttgattttgggtacttattacgacgaagaattattacccatgcgtactgctgtgtttacgagttctggattgcttgggtcgttgttttctggagtacttcaagcagcaatttataaaaatatggaagactataatggaatccgtggctggaggtggttatttatcatagactttttaattaccatccctattatcatgggctggatgtcttccacctaa

SEQ ID NO: 3440 - DNA, 870 bp, Candida albicans
  unsure (718),(746): Identity of nucleotide sequences at the above locations are unknown.
tcccctacgtggttccttgcagccgctcgtggtgaagacaaatatcttgaatatgccttggatcatttgaataaatcaatgtttgatagacctcatcatgatcgacaaatgattgttaatatgttagccacattaatgattttatgtgccgcagaaatttgtaaaggtgatgtcaagaattggtcagtatatttacattgggggtggaaattattatcaaataatggagggattttaagtttcaataaactgaaggaagaacattggttgatttcaaattttgcttatcacgatttattagcaagttcatctagtgaaagaggtacttatttcccatctgaagaatacgattttatatttagagatgatgatgggttttcattgggtaatttgaaccccttattgggaatttcgaaaaatttataccgaataattggtgatatatctacattgttatatgaaagtaaaaaacaattggacattttttatagtcgagaattcactggtacacctcctggagttgttgaaaagttgaataatgaggatgcagatggtaacgtggatgatgatgatgattgtgaatcacaacttagtgatcatggtaaggcaagtcaaatattattatcagttatttccaaagtaaaaaatttagagaaacaaattgatgaatccaagccagcagcaaaagatttggtgggattaacggatcaagaattanaattacaattaactttgtttgaagcatntcaattaattgccaaattgtttttaagacaatcaattatgaaatgtaatccttcaatgttagaaagtcaagtcttaaataatgaattaatcaaatgttcagatgtattaatgggggactcattt

SEQ ID NO: 3441 - DNA, 1344 bp, Candida albicans
gcgcgggactctccagacttgtggtggcagactcggcttaattcacatattttcgaacctttggaatatttgaacgtacaaggattatactttcttgatgggtttattgccaacgtcgccaaaaagttttccattggacacgagtcatcgaattacatattgaaaacattttaccaactaagtgaggaacacgaagcagtttcctacgcgttagcagcatggggtggtatatttatcgaaggaggattcacggaaaatgtcaatcattttcttggagaagccatcttcaaaatgtctcaagaatatcccaatttgaataatatatcgaaaaaagatgtttatattctactcaattactatttggtttacattggattgcaagtttgtgctggtgatgtttctcaatggcatcaaatattccatagaacaattgatttagtaaaaagacaaggaggtttgagcagtataattgaaatgtttgattgctccaatgaaattaaatggcttctttctgatatccagtaccatgacatattatccctgaatactttccaaaaaggtactatgttgccaatggaagaatacaattcagttttcaaagaggcaaaaatcttggagttagggaattatgggttagatccgttccaaggatgtatacaaccaatctatttggtgttgggtgaaatcacgtcactggcagtagacttgagacttcgacaacatgaaattgaaatcgacggagatattacactgcggttggagttttaccacgaagcagataaatgctatagagatttgagttacaaaataagtaactgcatacccaatatagaacagatgaagttaattaaagacgatagatatgagctagagttgcatctaacgttgtttgaagtgtatctgcttacatgccagttgtgtctaaactatcttatcaagaagttacctgccaatactttagatatgcaattgttggtgctaaattgtttagctctgattgatattttgatcgacacaaaaatgaaaagcgcattatcgtttctgttattggtgtgtgggattacctgttgttccaaaaatgacaggtctagtatgttgaatagatttaaaatagttagtgatgattacaaggcaggtaatgtaacactaataaagagtattgttgaaaaagtatgggaaagaaatcaaaatggtcaattgtgtgtcgattggttgaccatatgtcaagaaaaccaattggcacatctcattttgctaaggatttactttatgatttattctttggaacagaatatgagtgtaaataggtttatatggttgttatgttcggagatcattaagtga

SEQ ID NO: 3442 - DNA, 1482 bp, Candida albicans
  unsure (777): Identity of nucleotide sequences at the above locations are unknown.
attcaaaatctattattggtaacagaagtattcatgtcctcacaatccccaagatttaaaagacagagatctaaaacaggatgtaaaaactgtcgtttgaggaaaagaaaatgcgatgaacttcaccccacttgcacattttgtcatactagagacttgatttgtgaatataacgaaataaaaatactaaatccaacatcatttaaaccatctaaaagaatcaagaaagtgcaaaaaaacccactggtgtcatgttctgatttaatcccactaaccacagatttacatttcccggaacctatattttctccaatactaaataccaatgcattatcccccttgatactttatttggacgatcaaggtatagattatgttagacaatttgaacaaatcgccagtacactttctttgagtcaatctacaaattatataaaaagtactttcctaactttagcattttcaaatgaagctattctgaatttgttagcagcgtggggtgcactgcattatggtgatagtgatgatgttaacaaatatcttatgttagcaaaaggttctattaaaaatcctcatgacaggtgtgactatttcacaacttttgcatgttatttgattcaaatggccatctatataaataccggggacactcaaaactggtttcaaattttcggtaaatgtgaaacgatgatacgagaatatggggggttaatcaatttcattacggatttccaatattccaatgattgtaaatttctaatatcaaatttccaattntacgatgtgatgtctagtgaatcacttggacgagggacgacatgtaccatggataaatatttgagtttgttcaaaagaagacgtatacttgatgaaacttatggtgtcgatcattatcaaggctgttgtcaacccatatatttattattaggtgaaattatgaacacatatgtcgaattgaaaaaagatagacataatattgtgaactgtgaaagtgtcaatgtcagagtacaatactataaaaaggtaaatgaaaaggtcgatcatttaatccaaagtatagacaaatgtcagccgacaccaatacctgatggagatggcttacagttgaagttatttgaactatgttgtatcatcggccgaatgtacgttttattgtacatcaaacaaacacagccaaaatcaagtgaaattcaacttttattattagatgcaatatcgattattgatgagttgatatctacgcatttggctagtaatctaagtatggcattgttaatgtgtggtatcacatgtggcaataaatacgatagacagaatattaatgggaagtttaaaattgtatatgataaatttcgacaaggaaatttaaagagaatttgggagattgtcaaagaatcttgggaaaggaaccctttagggaacgtttgtatagattggttagatatttgtcatgatttcaattggaaaatatccatgatttaa

SEQ ID NO: 3443 - DNA, 237 bp, Candida albicans
  unsure (66): Identity of nucleotide sequences at the above locations are unknown.
gcaagcgtggttccttccagcccggtggtgaagaccagaagagaaccttcatgtagtcagtgtatncgacttcaattagattgtgattattccgacaaacgtccttcttacatgtcagatcctaatttacaaatccaaaaactaaaagaaataagagctatcacgaatcaaaacaaacgagccaattttttgagtagtaaggggaaagcaggattgagaactagtaatactcaataa

SEQ ID NO: 3444 - DNA, 2907 bp, Candida albicans
  unsure (50),(60),(61),(63),(89),(113): Identity of nucleotide sequences at the above locations are unknown.
caacaccagttacaacaaccagtacaacaaccgggtcaagaacagtgganagagaatagnnanagaaatcattctctgatgcaacaaantactcgagtagcagccacgtatcntaggaaacgagctttaacagcttgtgatacttgtcgattaaagaaaattaaatgtgataatgttcgtcctcgatgtggttcatgtatcaaaaatgagaatttaaattgtcattatcgtactgatgatcaacaaaaagattattctagttatgatcctgcatcattgaatattttgagtaaattagatgttattttaaaagatttaaaagaaatcaaaagtggtaattcgaacactggtactatatcaactaatagtacagataaaccatcacctgatgatccatcatcaatgtcttccacattttcacctgcaccaacacaacaacagcaacaacagcaacaacaacatccacagagattaacaaaagctcagggtaaaaaattcacatttgataaatgtatttgggatatgtcagttttatcaatattcaaatgggattttttcaaaaatacattcaatttatcatcaaaagatattgaagatattgaaagacaattgaaaaatgattatgataccgataatagtaaaaatattggtgttattcgtcacaattcattaattgaatccattaaacaatatgaaattcttgaaaaattggtatccaataattttttaaccataatgaattcatttttcgttaacgcttatacaaaagtgcccattttagaaagttatgaattttttgacattttggaaacttttcaaattttgttgcagcatttaccaaatatgtcattttcaagacttgttgaattatatattgatgataataccattccaccagaagtacaacaagtgttttgcattgatgatgatgatgataataataattcacaactgaatgagaagaggaaattaactgtggaacaatatatccgattaattaaatcgatcccattgatacttattatttctgccttgggaattattagtgttccggtacaattggataatcttaccaaatataagaattctcaagaggaagcgaaatcaatatcagttggttgtttgtctggtgataatgtatttaatgatattccggcagatttcccacgacaaagaaatgttattgcatttatgttaaaagattatgcccaattactttgtaatgtattttcatttattttagaaaataatactattgaatcagttcaatattatttatttttaagtcaattacatttacaacaaaattcgataatacttgctcaaagagcatgtttaactgctagtcaaaatgtcatgtatttacttgaaaaagctgatcttaccaaagtatctcaattgaaattagaagtcattaatcgattatattggacttgtttaaaattagaatgtgagttaaatgttgaattatcaccatttgttcccctttcaggcattactcaagtggatccaccatcaacttttcctaaaattcctgaatcaccaaaaaatgatgaattaaaatcaaaattcaattatagtgataatgctattcgattaagtcaatattataatgatagatattcttggtattattttttaacagaaattgctgttcggaaagttgataatgaaatgtttgatgaaatatattcattagaaaataatcttaatcatttatgggatagtcaaatttttgctgataaaacaatttggtcatcatttattgaatatttaaatcgttataatggaattattaattctttgactccagaaattcgaaattttgtcttgcatgaagttaatgttgaacaaatatttcatcgattgaaaaaaaaatatgaaagaaaacaattacaagaaaataaaaccaataatactgctactgctactgctgtgaatgcggatgaaataattgataatttagatgattttttaattgatgaagatttaatagttcgagctcaatcagaaaatatcatgttcattaaaaccagagtggtggtttcaaaattacttttattccgtccattagtttatttatttttacaagataaaattccattcattgatatagttcaagcagtgatttctgtaatgggtgattcaatgaatataaacccaaacccaaacacaaacacaaacacaacttctggtatatcatcatcaacatttgcaattgataattttaattttatggattctccaaattcatcaattggttcagcaacaggttcagcaacaggttcaaaatctagatcaagttcgacaatattcaatttaattaatgataacgaaagcaatggtgatttagaaatggattattttaatttaatcaatgctccattattttatcaaaaacaattccctgatgaagatttttccaaattgattgaatatgattatgattatgataataatgagcaacaacaacaacaacaaccaacgacaacaattactattaaaaatttatcattagttaaacaaagaatattaagaattttcatatcaaatttaatttcaataccaaaattaaatatacctaaattgggtactcatagacatcctggactgtggtattatataagaaatttatttattggtaatgttttccaatatttaatttataaaaaaattcaacaaatgatttataaagctactgctgatgttgaattacaatcaatattaaaatcacaacttgaacaagcacagaaagagaacaatgattcttcttcttcttcttcttcttcgagtcaacaacctaaatcgatggaggaaattattggattaataaatatggtgattgatgtaaaagggataattgcatctttagaacattctgtaatcttaatggaatattggaaataa

SEQ ID NO: 3445 - DNA, 1638 bp, Candida albicans
atttattttatacaatacaatccgttaatatcaacaggaaatggactataccccgccaaaatgaattcagaaatatcaacgaataacgatgatatcgatccactactatccttagatcaacaacaacaacaaatacgaaatccaaatcccaaaagacgcaaacataaccgagttcgtacagggtgtttcacctgtcgtaaacggaaaaagaaatgtgatgaacatcaacctaattgcgaaaactgtattcgaaataaattgaaatgtcaatatccatcacaatggaatgaagcattaccgttgaatttcaaacttgaaactttccaatatgatgaactagtgcctcttcattacaaaagaaagaaaatctcgaccaatttgaaatcgcaaaaagtaccccaagatttatttggtgtatttctcttgaatacgtcgtcccttgatgtatcaaattctaatcgaaaaaacaacgggataccagctattggagaaacggttgataccgaaaatgttgaggaagaagtaattgacaccaaactaggaaattcaactagttatgaaagcgtggaaataattactcaatcaccaataaagagcctgtcatcaacaccctcgacatccctctcattattgacgcacaatgataatcaagcagcagagcataaaacaattgaggttgatcacccagataatgctctatcttgggtatttgctggaccagtgacaaacttacatctatttggcaaatatattcctaatattgagttatctccacaagatgccgagttgtatgtccattgtgctcgcgactttatgcaacaggtttctttaccacatgctcatccttcattgagtccaccaaacgtatgggtcaacttagcgttagagtcatcaattttgattgatgtgtatttaagttgtggagcaacatatctagcatgtttgcatcagaacctgaaagttgacccattacacgaacagtcatcacaacagttgcaaataaatgacaatgaacaattgtcgcaaaaatatcgtgaattatcagaaattaaatacaacttggctgttaagtcgttaatgctggccatttcaaccaattcaattgatttggatagtgattggttaatgactgctggattaagtttgtgtttgcgtgatcgagccaatgggttgaatggttctcgctgtaccaaacatgtttcatttgtctataatttaatcaaacggcgaatcgacaaaaagagacaatctcaaagtttagggaacgccctgcccttattatccctgattactccagtggaacgattgttgattgatagctttttattcaattatacttgctcacttttaacttgtggtaggcaagattatgccagtcttccttcgccatactcatttttcccagatatcgaaaactggtttgatgcgccaattgtccaaaattgtgaagttaaatggatgaataatccagtgttaggggcagcgagaaatagttttcaaacattggcgaaattaatatatctattgcgtagtcattacgaatttgatggtgatgcggatgataattctcactacacgaatgatgacacattttgggcattgatattacagtgcccaacacgccgtaatggtcgggag

SEQ ID NO: 3446 - DNA, 1722 bp, Candida albicans
  unsure (182): Identity of nucleotide sequences at the above locations are unknown.
ataatgatttggaattcagtaatgcatcgtttgattctattggtggtgtcagtgttagtgctgctgcaacaggtgccggtgccggtgccggtgattatagtcatactaatatcacatcaaattttgcccaaactaatttgcattcttcatctcaacaaagtggcgtattaccaccaccaccnttttcttccaccaccaccaacatctttaccatcacaacaatctcagaatcaatatcttgatgttgtaccacctcaacaattgacaaataatgcattgaaaactgaagctaattcaccattaattactgatagtgctaattttactactagtcaaccacaatttgaaaatacaattttggagcaatcaccaatatttagtaatagtactattttatctggtattgatgaaccactgaaagaaaaatctccaaatatgcttaattccactttaccattatccaagtctactccacatcatatatatcaaccatcatcatcatcatcatcacacgtacgtcacaataaaatcacgaagaaatcatcattatcaagattgaatacttcttcaaagaaaaatttaagggcaaatttagttcattcattatcaacaccaactgaattggatgatgctaataataataataataatgatattgttaccccaccgaaaactttatctccattattacggaaaaaaacaagttttataaatgtgaaaaaggagaatgatattgatgattctcatgatattaattgtaaaaatttcagtattgacattgatgatatggatgatgaagatgtattatctgatttttctcaaccaccaccaccaattggaggtgtaagtaatgacaccatgagatctttggcaccagtcggaggagttggacttggaagtagtgggaatattactggttatagatcactttctaatgcatcatctacttcatctcatggatcacatcatggattaccagtgatgaatatattccgtcataatcctgattctacaaaaccatcaactccatcacctattttatctactgcatcatcttcttcaactttgtctaataagaaagtggtcaaaaaactaagaggcagaaaatcgaaaactaaaatgaataaatcctcaattaaaactgaacaagttgtctatgaagaaccacaagtcaagaattatcaagatgataatgataatgataatgataatggtcatggtcatgatcatgatgatgaaaatggtggtgtctcttctgatgttggtacaggttcaaattctactccttctactactactaaaggcaagaaaatgaaattaaacgttgatttgaacaatggtggtggtagtggtacaggatctggaagttgtagtgatgaaaataccagtggtaatggcactaacaccaatactgattctacttctacttctaatccaatggtgaagaaaaaacatacaagaagaagattattacctagatctaaaaaaggatgttggatttgtcgaattaaacatttgaaatgtgatgaagtcacaccaatttgtggaggttgtgctaaatttggattacaatgtgattatagttctgaaaaacctgcttatgttactgataaaattttaagacaaaagaaattaactgaagtttcattgattaggaaaagaaatcaagctaaaacaaaaatttctcggaaaaaatcaagtaatgatataaccaatgattga

SEQ ID NO: 3447 - DNA, 306 bp, Candida albicans
attagccggctattattgaatcaggtaatgttctacgtattcgatttaacatcaaatgaaactatagcaacagacaccctgcaagcgcatgaattacaacctaccaccacaccttcaaatcaacaacacatcaaattaagaacaattctaaacacactgaagagaagtagaactggatgccttcaatgtcgagcacgaaagaaaaaatgcaatgaagagcaccccgtttgtggttcatgcaaacgccgcaaagttaattgtagttggagagttacgtctaagtttaagattctcaaaaatggacac

SEQ ID NO: 3448 - DNA, 1755 bp, Candida albicans
atgcaaaatactaaccgtaataatagtaatagtagtaagaataatagtggtaatcatcaacaacaacaacaactacaacgacaacgacaagttaatcaatatcaatctattacattaccaccattacaatatcaatctaatactcacgaatcgatagtattaccttcgcaacaacctaaaagaggtcgatctgaacattttaattcacaattccaacgtaatataaattcaagaccagtgttattaccaagttctcgtgataataataacaccacaaatatacctatacctataattttaccaagtagtaccaattctaacaatccaattacttctagtagcaattcaagaatgttttcacctaatcctgtgagtccattatatcccgtggtcaccacaccatcatcagcattatcaccaccaacacaacaccaccaacaacaacagcaacaattacataaaaaattcaaaacatcaaattcaggttccaatactccgattactggtggtggaattggatctcctagtactactagttatttagctaattctgctaatatcagttatactagaagtcaaccattaaaagataacaaccaaacatcttccacaactaaggataataataacacgataattgaaaatgaagaccagaagtttttccgattagcaaaagaagcattagtagctactgccaagggagttaagacgaatcattccaataataatggtaaatttggtaataatacttctaagattgatattaataatcataataagaacaacaacaacaaaagtgatggtaatgaaaccatacttgattctacaattgcagatttattaagaagattacaatatgctagtgctcctcatggtaatcccattggccaaataagtggacttcaaactaattctaaaggattacttgaagtacaagatgaatactctaatttccctgatttacaaaacaataattttttcaaagttaataatggtgataataataatactactagtaatagcaagtttagtaataattatcatcatccatcaggtaatgaaccaggatggaattttttacttgatgaagcatcaacgaaaacaacatcaaacaatacacgatcaacaggaacaacaggaacaggaataggagcaacaaccaatataatatcagaatcagaatcggaattaaaagtgaaacgagaatcaagtattgccaatataatcaatccctcaacaacaacaacttccacaacaactaataagaataacaataacacttcatcatctactaaaactagaaaatattctcaagatccaacaagaaaatttccttgtgataaatgtcccatgtcatttcgtcgatcatcagatttaaaacgtcatgaaaaacaacatttaactatcccacctaatatttgtcaattttgtggtaaaggttttgctagaaaagatgctttaaaaagacatattgggactttaacatgtaaaagaaatgctgataagaaattatatattgaaaatttaaattatttaaataattcaagtcaagatgatgatgatgcagaggaggaggatgaagaagaagaagaaggattggaacaggatagattgtataagaagaggaggaagagtaataataataatcaaataattaaagaagaaggatttgaacataatgatgacgatgatgatgatgatgaagaggatgaagtgaaacgagaatttccaacttatggatatcaacagaattga

SEQ ID NO: 3449 - DNA, 1146 bp, Candida albicans
tcaaaaaaacccaaacaatcagtaaaggtggaaactagaaaaaaaaaaggatttcatgataatcgcatactttggacaaacagttcttgtgtacatggtattacaatggaaacatcagatggatttattcctatagtggccatattttattcagtattccatcccatagaaggtactaaaattgttcatcagtttcccgaaaattcactttcgactggacgatctccaaccagcatcggcgatggtggattatttgattttgacaccataaagaattatgttataccgaaacctcaattatgtaacaggcttatttcattgaagattgacaaatataaggtcattggatatcctgtgaatatggagagttctcattacgccagaaattcatttaatttcaatttctgctttgtgtttaggtatgatatgggagacgtttctccttatgaatcagcaattaagagaatgggccagatgtttcaagtgctagaagaacaaagctttatgctaagtagtttggacaaggacaattcattttttaaagacaaagcaattaaaagtaataaggctttaatatcatcttctttatcttcagatggaaccactagagagccccttgacgagggcggaaatgaaaaccattttcacccacacaatgttcaaaatggcacatcaatcagtactcctggttttgcaaaaaccaaaaaaattgcattatcatctattgaatcattgattcagcagatataccaagacttgaataactattcagaatgttgcataccattggatacttcaaattctgtggatatcaagctatttcctatattgccacctccaataaatataaaggcataccaggtaccgatagtaacagtgagattgaattcgctagttgatgttaattgggatccaacgatgatcaaaatactaccgtacattaatgggttaaattctgtgaagaagataagcgagctagctgatgcaaactacttgttaacaaaacaatgcatacaacatttgatgcattacaaatgtattgaagtgattgacattttccaatttggtaatatatatgctccaactaaccacattggggaatttttaaagcatgacgggaaaatgggggaagaatgttcagcttaa

SEQ ID NO: 3450 - DNA, 549 bp, Candida albicans
gtggtctccgctgatttcagtatggataacacctcatatgtgaacacaacgactcaaatgcacttgccctaccctggaagtgatgcacattcaccgacatataaatatcgttcctcatatggcacttcgtctgtttctccatacacaaagtatagttttttgtcaaggtcaccgaaaaatcctatggtcaatggatctgatgtcaaagttcctacaaagactacattgttttacttatacagatcgcttaatcaaggtcaaaccgttaaagaatggtacatgcaacataaaaaaatattgggaaatgttgacattacacgttttatcaattttggagttttacggggaataatttacagagtgtacacttatcctttactcaattcatatactggagcaatagaacgaaacgatactgaacagtacgatgaattgttaagcaatctcaaaaagaaaaaacccaagagaattgtatcgattggtcgcaatgaaaatttgttaaaaacaaaagttaacgagcaaactctcagaaacgacgttaaaagataa

SEQ ID NO: 3451 - DNA, 597 bp, Candida albicans
tttaatatattaatgcctacctcacctacagaatcaatacccaactcttctactaaagaacaaccaattctaccgaagatgttacctacggcgaaatcaccgcacacaacaccagcacaactgccacagaattccgatcaccatcaccaccaccaccagcaaacaccaccacagcctacagatggccaacaatgttctaattgtggaactaccaaaactccgttatggagaagagccccagacggcacactaatatgcaatgcgtgtggcttatattatcgatcaaataacactcatcgtcctgtaaatcttaaacggccaccaaacacaatagctgttgtcaaagaggaagaaggttcatgtaaaggtgatggaagatgtaatggtactggaggatcggctgcctgtaagggatgtcctgcttataataatcgtatagtggcgaaaaaagcgttggaaaaatcaccgaaaaacgattcatcaagagctcctatagataaaagtttgaaaagaagtacgagtactgacgctactactgaagatgaaagctctctagcgatcgcatgttgtaattgtggaacaacaataaccccataa

SEQ ID NO: 3452 - DNA, 1572 bp, Candida albicans
caatcatttaatatattaatgcctacctcacctacagaatcaatacccaactcttctactaaagaacaaccaattctaccgaagatgttacctacggcgaaatcaccgcacacaacaccagcacaactgccacagaattccgaccaccatcaccaccaccagcaaacaccaccacagcctacagatggccaacagtgctctaattgtggaactaccaaaactccgttatggagaagagccccagacggcacactaatatgcaatgcgtgtggcttatattatcgatcaaataacactcatcgtcctgtaaatcttaaacggccaccaaacacaatagctgttgtcaaagaggaagaaggttcatgtaaaggtgatggaagatgtaatggtactggaggatcggctgcctgtaagggatgtcctgcttataataatcgtatagtggcgaaaaaagcgttggaaaaatcaccgaaaaacgattcatcaagagctcctatagataaaagtttgaaaagaagtacgagtactgacgctactactgaagatgaaagctctctagcgattgcatgttttaattgtggaacaacaataaccccattatggagaagagatgacgcgggaaatacgatttgtaatgcctgtggtctattttataggttgcacggatctcatcgtccaatcaaaatgaaacgacccactattaaacgaagaaaaagaaatgtttcggacaaaaaatcaaaagatgaggttcagatgcatctgtctgatcaaagtcccattgttgcttcagacccgatatctccgactccacataataatgagaacaataataatgttacaaatattaccacaacaacgaaaactccgacaagatcacctcattattatcaaccaccaccacaatatccgtatcaacatcatccaataaattcgactacttcatcagccattaatcgacttcctccaatatcataccagtcaccatatcaaacagcaccgctctctcattcaccaatgcaatcatcgtcatcatattctccaggagcatcatcggtaattccttcatcatactatccgccatatagtggatctggaagaatacctaatggacccggacctgttcctggtccgcctccacctccaccaccgacgcaatcacaaccacatcatcaacaaatcacaacttctcctacttcacagtcgtacggctccttgcgtgctccaatacatataacaaagaagggttatacaccagaaaacataagattaccttctattcaattgacatcttcaacttcatctaacagtgaaacaaaattaccacctataaccaatcactcagagaaatgttgctcgaattgtgctggaccgaaatcattagcaccaatggctattgattttactgccagttatagatttaataatattaattcacaaactaaattgactaaagaagatcaaaatgatagtgagggtgtgtcacgtgacaacgacacaaaagatgaaaacaagccaatcaagcaagaagaacatcggagtgcactttctattgggaagttgttaaatggatag

SEQ ID NO: 3453 - DNA, 888 bp, Candida albicans
aatataagcgctatccggccattccggcggttgaagaccaaggaccacaatgtgggtggtaacaacaaccataataataacaaaaataacactaactttctttcgtcatacatttcatcactagaatcaactttgaaacaacaacaactgcaacaacaatcacagccgccatcacaaccacaaccacaatcactggctccagtgctgcaatctggtcaacccaaaaaagtattacagtgtacaaattgccaaacgcgaactaccccactttggcgtaaagccaacaatggtgacttgctttgtaatgcatgcggattattttataaattacatggtgttttaagaccaatcaatggagacaaaaagagaaagtataccaaacggaatgataaaatgatactgacagataataccaacatttttgcaggattgagtcaacaaaatcatggcagttctcaagacattgccaaactgcaaccaagcttacacagttttgtttcacaaaacgaacaaccttggggatttgataatggtgccattcctgatttcaacagtttcgatgcgcttgtaggatccaatataaatgccaataacacttccaataataccactaatgctaacaacaacaataacactgataataatgttgatgaaattgacaagttattgaatatgaacatattccaaactgatttctccctcaataataataatcatcatcagcaccacgacgagttagatttattggatccaaatggattaccaccaggtggcggtcactttaacaatgatcctgatagacaaaatcacacgacaactaatgattccaatgataattcaacaacaaacaactcctggaattggttagactttagtcccgctgcataa

SEQ ID NO: 3454 - DNA, 831 bp, Candida albicans
aatctttcgcaaactcctcctccccacacacgacgaacaataggtctgtttcacttttttttttttctcccgggacaaatgactacatcgaatagtcagtccaaacaatttgaaacagtaccttctatagtcgacttattatattccgctaagaaactattgaatttacaaccaagaattgataatttgcacctacgtcgatcgaattcaagaactcaattagtcatgcaatctcaggcccttagtatgaacaatcgtaacactgccagcaatggtaaggatgacaatcaaagcttttcaatttccccagtaaacaatcaagccttaggtgccacacatgataaagtattggatttactatcgccattgtcaatagatgacttaaagaataacaccattaccactacaactacaacaacgacgtcgtatcaccagaataaactgaatcaacgtttgaatggtaatgtcaataccaaccctacccataacactggtaataatagtgatactcgatccacacttttcaaacccagatctccacattctgaaaacacatctcccaagaatatcttgtcgtcgtcatcatcatcagcaacaacaacagtagttgctgtaccaaaagtgaacaacctcaatcataatactactaccaataatgatggaggtaattcagaattcaaatcgtccaattcttcattgccactgaaaaaagttaccaaatgctacaactgtaacaccacggcgacaccactttggagaagagatgccgaaggtaatagttcctgtagtcttcacctcgaggagcgccaggaccgcatagtttccgagaga

SEQ ID NO: 3455 - DNA, 1404 bp, Candida albicans
ttccagttgtttttccttcttaaattttgtattagtcttatagctttttttttttttgtcattgttgatctaatcatgaatggagcaaatcagaatatccctaacactttgccaagattaccatcatttcaacaattgagtgaaacaattcgcaaccccgattttccagacctgctgcaaaaaactcatcatcaatatcatcaacagcatagatttcaaaatacccccattgactgcaagtctctaatgttgttcccaataaattatacacctgtcaatgataatggtgttgctactgcagctgctactgctactgctactgctcctgtcaatggtattgttaccactaatagtttgaatggcaattccattatggaatattcttatggaccaacattacatggcagacatgaaagttatcctaatcaatatgtattccccaatcaagaatcaaagacaggaattccaatttctaatcgagtatcacctacttcaatggatagaactaaagcacattctttggacttggaattgactaatcgtgttaatacgaccaataatgatgctaaaacctattccaaaaaatataaggttgtgtttgatttaattcaatttttgaaaaaatttgaaatcaaatataatgaattgaaacattatacatttgatttagaaaatgataagaattcaaatgtattggagaaaatggttactgaattatcaatagatgatataaatgaagcattagttaatactaagaaacttgctaatgtttttgaaaatattaaaagtattaatgaaaatagtaccaagtccaccaatgatatgagaagaaagaatggattatttgtatatgagaatggtaataagaaacaacaacaacaacagcaacaacatggtgaaaaaagaaaaattcgaaaaaagcatcagcaccaaatggcaaagactaaatcattatctacaaatggtgaagctattcctatgcaaatgagtgtcagtcgcaataatggtagtattacttcaactgggtttttgcaactggttcaacaacaagcaccgcaaccgcaaccgcaatcacagccacaaacacaacaccaacaactacaaccagcactggaattagtcccaccacacacgcaagcacaaacactatcagcagtaacatctaatctcactaatgggaatttgaataccgagttgagtgcaaaaccagaaattacttgtcaacattgctgctctcaagaaaccccggaatggcgccgaggacctgaaggtagtagaacgttgtgtaatgcatgtggattattttattccaagttgattaaaaaatatggattacgagaagctgataaagttatgctacatcgtaaacaaaccgggacagtcaatgatagaagaattttttaa

SEQ ID NO: 3456 - DNA, 2160 bp, Candida albicans
ctgctaccattgcagcttaactcgttcacagccactacacccttatcacaagtgataagtaaagagcaagatcatattgaaaatgtatggaaaatgtactaccgtgctcgtcactcattgccttatcaaaaaagaatggagaacttgacttggaggatgatgtatattaacaacaaatcgattttcactaatactaacaatgcacctaaagagatttttgaacaaagtttggatcctgaaattgatgattttgattatgtggcacatataaaaaagattggtcaatttaatcagcaaaaaacacaacaacaacaagatcatttgcaatcaaatttagacaatcacaatagtatatttgctgataacactggtttttctaacaacaatgacagaggtagttcaggtggtggtatgacttccataagtagtttactgaagaaaagaccagctccattttcgccaatgattcaaccagaaaagacgacaatcatccccactgccactaatacaatgtcccaattatcacaacaattaaatgaattcaataaatttaaccaccccagtcaaacatccaattttaatgacgttaatcatcatatggaaatttcaacgtcccatatagcccctacttcttcggcttttgagttttccttagatccattggcatttgaaggtccaaatcaaaatttccaacctgaaccgcaccatgatttcaacaccaactcttttgattctatgacatcatcatatgagagacccttgtttgacgattttcttcctcgtgatcatcataatattcaaagctcaagtgtgcctacttcagcatcgtcattttcaacaattgtgccgaaaaatacccaattctcaacgtcagcatcaataacatcgccaacgtcaacattttccaatcaaggcaataatagcagtaatttccaccgattgaattctactgtcagtataacggcaaccccgggtaatttattacgtcaagaatcaatggtcagcttaccagattatgccaaccatttacgatcaatgtcgcaaactccaactatgaatagtagtaatgcaccattctcgcatagttttaatgatggtggtagctattttatgaataattttactggaatcacattacctagtcaaccgtcaccacaacctattcattttgataataaaccaaaagatgatcattttaatacttcgttatctgtgtcacaacagcaaccttctgccaaaaaactgaaacgaaaatcgaccattacaaaatcgaaaaagaaagctgcaagtcctgaaaccacaataaccagtactggaagcactattacgacgaaatcaacgaactcaaattcaactggtaagggaacagcgaccggaccagcagcactgaatactggtgtttcttgtacaaattgtggaacaaaaactactccattatggagacgaaatccccaaggtcaaccattgtgtaatgcatgtggtttatttttgaaattgcatggggtggtgcgtccattgagtttgaaaacagatgtgatcaagaaacgtcaacgtggtaacaataatggtagtggaaatagcagtggtacaacaaacaatagtaataattacaataataaatcaattagtaaaaagaatgagattgatgatggtgatgatttaaaccctacttcgataactaataatacgggtttgacaaacaataataatagtaaatctccggccaaatcaaaaaagaaatcaaattttgacaacaacagtaacagtgctcttaacaacttggataaatctaaattgaaaatcaatactaatgagatcacaaacatttctgagaccacatcgaatagctcatcaccagtgattaacttgaatcacgggggaagatcttctggagtgtttggtaataccccagattatttaaatggaataacttcacccgcagtgtcccttgttaaatctgagattgataatcctcatcaattaaataatagcaatagtaatggaatgttgatgacgatgcatcagtcactgcatcaactgtcgctactgacaacgtttgatcatgaggtagaatcaaataatgagggttccaattctagtggagtcaatacatcaactgctaataatcaagattgggattggttaaacatgaattattag

SEQ ID NO: 3457 - DNA, 1440 bp, Candida albicans
attgttaagattggagatattgaaactagggataaccagcaacaacgacataatcattcgagacatctgagtctacagcataatgatataactaatactactaatactactaatagtactactactactactagtaataccactgagaataatggtaggaataatattaagaatagtaatattaataaaaactcccctaatgtctcctcccctcatcataatgaacaatctttaaataataataataataataacaccaacagtaataataataatacaaattatcctaattatgagcaattatatctacccgaatctaattctacaaataatttttttcaacaaatggataatcaatcaccaaattttatggatcaaaattggaccccacatatgttaccacaaacagcttcttatttggccaatttggatttaccaaatatccccactacccatagtaataaccagtacaacaacaacaacaattcaggtttaaacccttcttataatacatcatcaattatgcaaactattcaaaatcaacataatgtacatgacgatcaagaaaatcaacaacaacaacatcatcatcatcaatatataaatctgaattctccttcatcatcatctcatcaagtcactcccaaccctacaatttcttcttcgtcttcgtcttcaaaatcaaataaacaaaaacgtccgtgtgatcaatgtcggaaacggaaaattaaatgtgtcttagtacccaatactaataattgtgtccaatgtgaagctaaacaagtaacatgtacatatactgatcaagcaccgaaaaggaaacttgctgaaacaactactcctgccaataatgatcaattattgaaacgaggaagaataatggataccagtttattatcaaatggatcaactattgttccacctgatgttgctattcgtgaggtatctcctatacaagattattcagccatgaataattcattattgaaaagaactttatcattgcaatttcctcgatcaagtttttatgttgggcccacatcttcagtatttgatatcaatttattaaattcaataatcaaatcccatgagcatcaaatggcaaatggaaatgagagcacgaccaccgcaagaaacaacaatagtaacaacaaaattgagcaagttagtctaaataatttagtttcattaagaaaagttagtgatacggttcaatttattttaaaagaagatcaatcacctcaatcttatcaaacaatgtcgaatgatgttgatacaattgaaaaatgtatatcaccccatggtcaaatattagttgatttatattttcgaattattcatccttcatatcctataattcataaaaaaatttcattgaaaaatattctcgtactcatcgagaatttagtgctcctttattggcagcagtttatgtattag

SEQ ID NO: 3458 - DNA, 990 bp, Candida albicans
  unsure (815),(818),(890): Identity of nucleotide sequences at the above locations are unknown.
aaaaatttcattgaaaaatattctcgtactcatcgagaatttagtgctcctttattggcagcagtttatgtattagctatacaatggtgggaatatgatcctcaattaaatcgtttcccaaaaccaaatgtccaaatgatacttaaaattgggttaaataattatatgttggaaatattaaaacgaccaaaattaagtgctgttcaagcaggattattattgttacaatgtaaacatattattaattgtaaatcatccaatgacgggctgcgacaacaaggtggaggtagtagtaattctaatcatagcaatagtgttgccactggagatgcggattattctgaatggattttatgttcacaaatagtatcattagcagaagaattaggacttggattagattgtaatgattggaaattacctaaatgggaacgaggattacggaaacgattagcatgggcagtatatttagaagataaatggttatcacttaaattggctcggccttcacatataaatgaatcaaattggatggtgttacctttatatgatcaagatttccccgagaaacatggtgatggagatttaaaagaaggttcatccgatattgataatgggaaaaaaattttcattcatttaattgaattatcaaaaattttatcggatattttaaatcaattttattctatgaaagctatgaaagaaatcacggaaattgatcaagtattaaaattagctaaacctttacaattaagattacgggattggtttagatctttacctattgaattacaaatgagttctgtacaacctanaanattatgttctaatggatttcttcaattggcatattttgccactgaattgacattacatatgaaaatcaccancataattttcaatcaaactaaagctggcaatccaacatcaccaaaaataattggtgtatgtcctaatgctgccaaaacaaaaataatggcatcaaattga

SEQ ID NO: 3459 - DNA, 591 bp, Candida albicans
ttttggccttgttcagcaacttcaaattttacattaattggtacatttgcggcaattttattaatgtcttcatccacaaaggaagaaactgatttttatcgtgatcaaattttaaattatcgttggattttaaaaatttcttcaaaaggttttgatcaagctgctgaagcattagcagatttagatttagttttgacaaatatcccgggattaatttatgataatattaacgttccttcacttcttcctaatgttctggatagtttatccctgatacaacattttcaaatgtcacattcaccggcaggagctagtccaccacaaaattctacatcaacaatcactactactactactgctactgctactactcaacaaagaataagagcgccaattagagaatcaccattaagttctcctcaaaatatgtatacaccaccattgaataataataataataataattctaatgtggggaattctaataaaggatcaccaatgtctaatgctcaaggattatcaccaaagaataagaatatgagtggtacaacttctaaaagtccagtaaaatcacccgaactaaccaaatga

SEQ ID NO: 3460 - DNA, 756 bp, Candida albicans
tttttttttgatttttcaagtaagcttcaacctcccaccagtattttaataaggccaatgacagtcaaaatattagttattaatccaaatagtttggaaaaagtgactaagaatcttgaaaaaacaattactcaaccggaaaatgttcaattgtttttttataccggtccatcagattcaccaaaagaaatcacccctaccacttcattacaatcagaaaaggctgtacttgaagattttaaagtaaatattgaagatagactcaattatgatggatatttagtttgttgttattccgatcatcctttagtgtattcacttggtaaactcaccaagaaaccagttatgggtattatgcaagcaacactattatttgcattactgcaaccaacaacaaaaacaacaagactgtttattttaactagtactagtgaatgggaactggtgttggatcaaagtattattgattttgttggggcagacaattttcctgttaaaaaatttgagaaaactagaggtttaaatgtgaatgttacaaatcttgctgatgaagaacaatttagtaaaatttataatgtgacaaaatctattttcaatgaatataaagatgtgggatgtgtgttgttaggatgtgctggtatggcggggttagacacaaaattaggagaaaaattccctaatgttcgatttattgatagtgtaaagataggtattgaacaattggtcacattaattagatttgatagacaagtgtaa

SEQ ID NO: 3461 - DNA, 618 bp, Candida albicans
atttacaatagaccgttatcaataatgtctatgagtgatatccaacaacgtcctcaaataccaactactactacagcagcagtagctgctgctgcatctaccaatgttaatactggtgcagctactactagcactgctaccactgggaatactcctactactacccctacttcaccaattgaaaacatttcaaaagtaccagttaaaccatcagtagatgtaccagtgaaacctaaacttgaacaacaacaacaacagcagtctgaacaatcatcaaaaccaccaccaccaccaccagagcaacaacagcagcatcaattacccacacccccaataaaaccacctaagacaggtacaacctccagttccagttccagttccactactacttcatctgctacttcaagtaaaatctccatgtctggaccagtttgtgggaattgtcaaactcaaactactcccttatggcgaagagatgaaacgggtcaagtgttatgtaatgcctgtggattatttttgaaattacacggacgtccaagaccaattagtttgaaaaccgacacaattaaatcaagaaatagagtcaaacaaaatggaagcaattctcaatcaacttaa

SEQ ID NO: 3462 - DNA, 1158 bp, Candida albicans
  unsure (62): Identity of nucleotide sequences at the above locations are unknown.
atattcactactattccagaaattcaaattatgtccagttcatcatctttatcttcatctantactactgcaacaacaaccagtgcacgtattcgtttaccatcaataagtgaattgacttcacgatcaaccattagtggaggtagtaataatggtaatggttctgctttgaaatcacagatatcgccaagattgtctgatacatcaagaatattaccaagtatacttaagaatactagtggatcatctacacctacttcttcatctacacccttcaaatgtccaccaataaagtctaccgttggcggtactttatcaagtggaaacactcaatcaaattatgttttgggtaatactaaaataaatagtttaccaagactttcttcacctacattgcccgccaaagtgcaacctcaacaacaaccacatttacctcctgcatcgtcacttagcccagtgacaagagtaatcaataccccaccacaacaaccacaatcagtttctgcttctacatcaccaaatacccaataccaatactatcaataccaacaacaatcttcaccaattcaacagcaacaacaacaacaacaagccaccccagctgcaacaccaactgtcatgcaaatggcacaaaatcaaccatcacaccctgccccattacaatacgccactcaacagtactatccacaaccagtatactatcaaagcccagctggtgtgccacctccaccaccatctgtaacacatcaaggtcatataatagcagtgcatcaacatccaggccatttaccacaagttggcgttaatggtatgccacctaatgtgggttacactatagtgcagccggaaatcgtcaacaaatcaactaacagatgtcacaggtgtggtactacagagacacctgaatggagaagaggtccaaagggtgtgagaacattgtgtaatgcatgtgggttattccacgctaaattggtaaagagaaaaggggcagcattggcagcagaagaggtattgaataataaagtgacaaaagggaagaacggtcgaagaataagtatgaagaaacatcttttgaatgagagtttaaaacaacaacaacaaattaatggtgtgggtattcacgatgacgtcttcaccacgaaatggaagacccgcgtc

SEQ ID NO: 3463 - DNA, 1530 bp, Candida albicans
gctttattagcagtactggcatttaatttacaaagtaaatttcctaaaaattctgaaccaatgagattttatttgaatttaggtattgctttaagaaatcaagctagtttatttattaagcaattattacacaacaaaagaaacaacaaaagaaacaaaaccaatgggattgaatattgtattaatcatgaaaaatataaagatgttttatgtgctgtattaagtatgattagtgttgatttagtatgggggacaatgcaagatacaagaatttatataacttggtgtgggaaagtaattatagcaaaaatgcaaaataaaaaaaaattatcaactaaagcaagtatattacatcgaatatttctgaatttaaaattaattcaagattctacttgtttagatattgatagtattaatgaagatttcgaaactaattattatggaattggaattggaactggaactggtattggttatgatgttagtggtgataaatatgttcaacagaaactagacaattctgacggggatgctactactactactactgcggttgttgatgatcataagaaagttaggaaaaccagaattgattttattgttaataatactttcaccaataaaaaacaaaccaaaacaacaacaacaacaacaactaataaactgaaaagttcaattacaacatcaccttcatttgtcaataaaaaattgattaatactatgaaaaatgatgaaagttttgctactgatgcattatatggattaccttattcattaattgtattatttagtgagacggtagaattattaagaacaaaaatttattatcgtgataatcctaaagctgcagcgagaatagcaatgaaattatcaaatcatgaaaaagaatttaatgatcgaattgaagaattgaatgaaaaattagaaaattggacattagattggcaattatatgaacaacaacaacaacaacaacaaaatatgaccacaaccaaagccaaaaccagatctacaaccccaacctcatccccaacccctactgatggtaaacctgaaaatgaagaacctactactgttggtgatgacaacgacaacgacgacaataatgaatttgatcataaattttattcaccaatgcataaagctacctatcatcatatcatgtcattttatcatgcattaatgatatatttcaatcgattaatcaaacaaatcccggctgagaatttacaaaatcaagttaaaaaaacattacaacatttaaatgctatacaaaaattgattgatgataaagaagccaatataattccattattttggcaaggatttatagctggatgtgaagctattgaaccagatttacaattggcgtttaaacaatggggcgccgatatagcgaaatatttaggtagttattggggggcaagacaaattatgatggaagtttggagaagaaaaagagctaatgaaattaaagatgattggattagtgttattcatgattgggaaatgaatttaatgttagcataa

SEQ ID NO: 3464 - DNA, 1920 bp, Candida albicans
ctgccagccggtggtgatgaaaatatatggcaagggagaaaacgtcgtacatttgaaggatgttggacatgtagatcaagaaaagtcaaatgtgatttaaccaaacctcaatgtaatcgatgtttaaaatcaaatcgaatatgtcaaggttatgaaattagattaggatggtgtcaaccaatgatatatgatcataatgatactaccaataatgatacttttaaatttttaaataatgaagaatttgaaaaagatttagataattttcaacgacgaaatgttgaattagtgaaatatcctaaacatatggaatatgaaacttatgaacaattaaattatattttgaatcaatttgataatctagaaatgatgaaccatgataatatgagtaagaatgaagataaagatagtgaaaatgaaaaggaatttactattggaccatttaaatgtatcaaatggaagaatataaatacaatgaatttcaaaaaaacttctaataaaattatgaaaaccccacagaaatcccaacctttaattaaaccccagaatgaaagtgttaccctgaataaatctaggataaaaacaaagacaaaacattcaactaacacaattaatgataccaaaatatctaaccttaagagtaataaaataactaatggtaatattaatgtttattcagatttattaaattttgccaaattaactattgttggtataaaaggtcctaaatataatataactgatcaaaccatttatcatatatttgaaccagaatttttccctaatgttgattctgatgatgattggttaattgatattaatgaatatcttgatcaattgttccaacaacaacaacaacaaaaacagaaaaacctaccaaatttatctaacggtaatgatggttgcagcggcggattgataataactccattattacaaaaattattaaataattttattaatcaaagtaatgaaattttgaattttaatcgaatgggatttcaatttaattatattgatatttttataataccatttatacaacgaatttttggagaattgatttgttgggatttcaatgatattaaatctactcaattaaataaatctttattaataccacaacatgggtcaactgatgataaccccaatgattcagaagaagaagaagaacaagaagaacaagatgatgatgatgatgagataggggataagaatattattaatatcgatgttattttccgaaatattaaattaattattgtttatttagttttatcattatcttcatttcaattatcaacaccaataaataatcgatttaatttggatgattatttattattaagtattcatttacggaaattagctatgaaaatgttgaattatcatcttgatgaatccgatacaataatagaacaacttgaacaagaacaagaaaaagaagaacaactgcaaaatacacgttggagaaggaattataatttagtgaatgattattcttgttatatattattagcattaatattacaaattgaaattgatacatatttatcaatatttgaaaattatgaattgatttatgccattggtgattttataattgaaaaaactaatcctaaatcaaaaagcagtagtactaccaccagcaacaccaccacccccaaaaagaagaagaaattgagtccattattgaaattattaattaatatatttaaaattaaatatattttttatgaaagtactcattcgataaatttatttaattatcaaataaatcaacaagatgaagaaatcaattatcgagatttgaatgaaaattatgatttaataagtacttcaagtttaagtgataatgaaaatgaggaggaggaagaagaagaagaagaggaggaagaggaggaagaagaagaagattaa

SEQ ID NO: 3465 - DNA, 2283 bp, Candida albicans
tcaatgcctctcgataatactatccagggtagtaccatcggtggccccactgctatcagtaaggggaaaaaaagtcgaaatgggtgtttaacctgcaagaagaaacgtctcaaatgtgatgaaacaaagccaaattgtctaaattgcaccaagaagaatatcgaatgtggcggatatgccaccaaattcaaatggaaatcatttaatgaagaaaagtcacacactagcagcagtactaaatcgttaaaacgacatcttgagttggcgagtttttctgtgacggggaaatctatagatgaagttaataaagaaaatgaattgatcgctaagggaatcaatccggaaacagtaaaaaatagtactatcaatagatcaagaactaatagtgtcagcacagtcaatacacagagaacaaaatcgtttgatagatctcatagcataccaataccgtccaatgagcatgcacagcttcagtctgcgtctgtttataaaagtgatttgaattctttggctgacgcggctatgaaacaaattgggaaaacccctgcatctatgtcctcaacaccaccagcattaaaagcccatcaccaacacccagcgcaatcttttcccggtgattctgccatgctgcatatgatggtaccacaaccaccacaaccaccacctccgtttacccctaattttgaagcaatgttaactactgaaaagccaactatcaaaagaaatggatttggaaattttgactctgaaatcaatttgacaccatctttgtcagcaatactaaactttgcattcaatcatgaggaagtggaagtaccatctgtggaaacactaagtccattaacattgaatcacgaagctagagtggatgcatcaatgacaaacaacaaaccaattaccgaacaagaacaaattttacatttgtttaatgagcatacttcgggtattatgtcgattaagaatggagttcatgagaatccttggagaaatttaattgcacctttggcaacgaaatatccttgtctatttaattcaattgctgcaatgacatcattccatatggcaggtagtaataatgtggtgcactctccagaagacctaagaacgaaagggtggtattatatgaaaaaatgtattttcgaactagcgaatgggttatcaaacaatgtgaaagatttaccacttgatgtagcccttgtgacatgtttgaatcttgcagtgtgcgagcaatgggatacacatacatctagtggtattgcccatttaaaaggagccaagagtatgattcagcaaatactagagttgttaaaagagcagcaacaatttatcaaacaaaagaaatttgaaaacattgactctatatcttcagttgacgaggatcaagaattgttgatgaatttgaaaaaaaaattggttttggtagatgatctcgattacgaagaaatgattcatgaaacaatcaaatgtccagaaaaatcagtggttatccctaaatcaattcagtttatattgaataattggatttactttgaggtgttggcgcaaatgacttctgattcaatgtgtgacgacaaaggtgttgatctagtagcagcaatcacctcaatgtcccagaacaaactcaataaagataaagatagaaatcccaaatcgccatcggaggctaatgatctgtctgacaaaacattccgtttttttgaaacacttaatttgttaaattataataatgaagttattgatccgttgctaagatgcactcaatcgttatttgtgattatgggtaaagttgctaatttgatcacaaaaatcaaaaaggctaaacataagagccaatcgaagaaaagaaatactttaacgacaattagtcaggcgtcggaattaaaacaagaattggttaattggaagccttcggttgtagcaagtataatggataacgagatttcaaatgaatcgtctacaacatgggatctaccactgtgtatagctactgcagaggcatataagtactcgacgttattgtatctacatcaagctgtaccggaaattccttccttttcagctcatgcgttggctgaaaaaatatttattttattagcatctattcccacttcatctaatctatcaattgtgcatattttcccacttttagttgcctcgagcgaatctgagccaggagaagaaagagaatggtgcgagaacagatggaaattgctttcacagcgtatgtggattggaaatatcgaatcgtgctttaaaaggtgtgaaaaaagtttggagacgtaa

SEQ ID NO: 3466 - DNA, 1275 bp, Candida albicans
agtatgaattatccttattcatcttttgaagatgatggacaatatcaaacagatttatctgaagttgcttcaagaaatgctgacgaagaagctgcagggcatcaacaacaacaattacaatatcatcgtcgagtacaaatagaagaagcaacaagacaacgtcaacaacaacaacaacatcatcaacaacagacatcaccatcatcatcagatgatttcaattttgaactgcaacgaatcaaaccaaatcgacccaaaaattcgcctcctaaacccatatttgttgataaagatgggaaatcaatgcttttttatattcctgaagatgaaccgaatcgaaataaatatcgagatctaataatccgttatggtggtgtaatagttgaaaaagggttccctacagttatcttattaagtaataatgaagatttgtatggattttccaaattaaagtttattgatgattgtattgctaaaaatcaattactttcagtatttgattatggaacttatggaacttataataatcctgaagatgctgcatttgatactacatcaataatcaatgaattgaatgatgatttgtcaagtaatatatcgtcactgtttagtacaatagaaggaacaagctccatggtggaggttcctgttgctgctcctgctgcgattcctcttcctcctcctcatcaacaacagcgtagtatagatgcatttcccaatcccaatattaataatgctagacgaggatcactgggtcatagatttacaatagaacaagatgaatttattcttgaacatattcgcaggaaacctcgatttagacaatcacaaaaattttatgctcaattagctttattagaaccattgagaggtcatacggggaattcaattcgttcaagatttagaaaacatttagaatcaagattaaattatatttataaaactgatgatcaagatcaattaattcgtgatgaagcaggaaatttaattaaaattggacttgatgaaatgccagggactcttaaaaataaattcacaccagaagatgattatcttctttgttgtgttgcattagaatatagggcatcaaataatattgattctataggattaggatattcattttttgatggtatgaacagaaaatatcgtaatcgtactttacaatcttggagagatagatttaggaaatataatcgtgataaatctgatctcgttgaatataaagaatattatgaaaattgtgaaaaagtaggtatggctcctagatgttaa

SEQ ID NO: 3467 - DNA, 426 bp, Candida albicans
acgcggatattcatcctcgtggtcagagtcgggggtggcttaagtaatgtggaggatataagtgaggcattggaagatgagattacagccggtgctaagcagaaaccttcaactactggtcaaaatggtgctactgccaatgggaaggatcacacatcaagtgaaacaggagcaaaccgtttattgttggctttaccagaagattgtagaagacttattggtcgtatggttgaactagctccagcttgtcgtatcactattgatgaagtgttgaatgattcatggttgaaatcggtaaatatgtgtactgttgaggaaagttcgcctggtgtatttgaagttattaaatgtgaagatcatgaacatactcaagtggatcaatctaaagcccatattgcagcttttgaaaagaataagaagaaatag

SEQ ID NO: 3468 - DNA, 1692 bp, Candida albicans
caaagatccaagtcacagagtgggttatcgtttttcttttctcaaaaaagtaagccagcagtgaaaagagattctacaactgacttgggtgcattttacaacaactcttatcaagaccgtgatgcaccaattgtttctggttcacctaattctttatcttcggcagaatctactgtgtcatatggcagtagtgctcctacaagacacaactcaatggcaaatttaaaacggtttttcaaaaaatcaacaccaacaacttcacaaccagtgggcaccctgaatttgtcttcatcgcttagatcggctagttccggtgcaagtggggcaatgaatattccaaattcattgaatggacaaactaacaatggttatcaatcaccatcatcattcagtgctagcacttccaatacttcatattcacaatctccaggcaccaattcttcttcagtgactcgtagttcaacattgcaaaacaaggtgaattatcatgaaagacgtcaatcggtgctgggaattgtcaacaattcacagcaattgcctttttctaaacgataccacagtaaaaatgctgaaagtttaggggctggtgctggaggttcagttcggttgcttacaagagtgagtgatggcttgacttttgccgtcaaagagtttagggccaaatatcaaaatgagtcgaagcgtgattatgccaaaaagatcactggtgaatattgtattggatctactctaaaacatcctaatattattgaaaccgttgaaatttgttacgaaaatgaacgaattcatcaagttatggaatattgtgattttgatttatttgccattgttatgtcaaacaaaatgtccagagaagaaatcaattgttgctttaaacaaattttggctggtgtccattatttgcattctatgggtttggctcatcgtgatttgaaattggataactgtgttattgataaacgaggaattgttaaaattattgatttcggatcagctgtggtgttttcttatccgttcaccaaaacattaattgaagcacagggaattgttgggtctgatccatatttagctcctgaagtttgtgttttcaataagtatgaccctagacctgttgatgtttggtcggttgccattatctattgttgtatgatgttaaagaaattcccttggaaagtgccgaaattgtcagattctagtttcaagttatttgcatcacgaggtgaatttattccaatttccgagatgttgaaaaagaccccaaatgatatggagaagtctaatagtaatggaagtagtgggggtggcttaagtaatttggaggatataagtgaggcattggaagatgagattacagccggtgctaagcagaaaccttcaactactggtcaaaatggtgctactgccaatgggaaggatcacacatcaagtgaaacaggagcaaaccgtttattgttggctttaccagaagattgtagaagacttattggtcgtatggttgaactagctccagcttgccgtatcactattgatgaagtgttgaatgattcatggttgaaatcagtaaatatgtgtactgttgaggaaagttcgcctggtgtatttgaggttattaaatgtgaagatcatgaacatactcaagtggatcaatctaaagcccatattgcagcttttgaaaagaataagaagaaatag

SEQ ID NO: 3469 - DNA, 954 bp, Candida albicans
ttatttctatcacacaaacaaacaaacaaacagagattattacaaagtataatgagtgacgaaccaacatcagcagcattattggagcagttagtgtatattgataattatatcaatggaaatgcttcaactgcaaccgacagttcgacagccacgcctaatcttgacatggatggacaactaagtttagatttagctgcatttgcggatgattcgtttatttttcccgatgaagacaagaaacacaacaacgacaacagcaacagtgatagtaattggaatatccaagaatttgacaaccaggaaattggcagtagccatagccatagccatagccaaagtcataaccatcatcaccaccaccataaccatgttgaagatcttaacaataataacatattaagacaacaagaattccaatctcatttaccatcactaacacaccagccacaccatctatcgacttcccttcttgcttcacaatctcatgcacatttgacgacacaagaaccggctacaatcgatttaatgaatccatcctcctttgtgaatttgactgatttacccaaattcccagttccaccaggggcaaaatcatcattatttgatgcaggattatcacaaaatcaaattgatttattgagtgctttggtggctcaacaccaagccagtttaggtaacccaataccttctgtacaatcaccaaatgcaacagctacaaccacaaccacaccattatcagtttcaccagctgaattaccccttcgaatcaataacagtataacaaccgttgcccccatcactacaacaaatgttaatgttaatgctaacggccatttacatcgatcactggtatcactgcaactgagcaataccacaatggcattattagatcctattccatcgtcttctagtgtatcaccatcatcggtaactggtgggaatactcaatga

SEQ ID NO: 3470 - DNA, 960 bp, Candida albicans
ataaagacctcatcaattcgatataaatatcatccagacaaaaaagcttctataataacagcaccattttcaggtggtcaaccaaaaggtggtgtaaaattgggtcctgattatattctcaaagctggtttccaaaaacaaattgaatctttaggatggacgactgatttaaaggaaccattggaaggtactgattacgaaaaaatgaaaactaatgataaggacgattttggtgttaagaattcaaaaattgtcagcgaatcttgtcaaaaaattcatgatgctgtcaagggaagtttggcagaaggtaagttgccgattaccattggtggtgatcactctattggaactgctactgttagtgcaagtttggtacacgatccatctacttgtgtcgtttgggttgatgctcatgctgatattaacactccaaaaaccactgattcaggcaatttacacggttgtccattgagttttatcatgggtatcgatagagacagctacccaccagaattttcttgggtgcctcaagtattaaaatccaacaaattggtttatatcgggttaagagatgttgatgatggagaaaaggaaattttacgtaaacacaacattgcagccttttcaatgtatcacgttgacaaatatggaataggaaaagttgttgaaatggccttggacaaagttaatccaaatcgcgattgtccagtacatttgtcctatgatgttgatgctattgacccatcattcgttccagctacaggtactagagttgaaggagggttgtcgttgagagaaggtttgtttattgctgaagagattgctcaaagtggacttttacaaagtttggatatagtggagactaacccaatgttagctgaaactgaagaacatgtattggatactgtcagtgcagcatgtgccataggtagatgtgcattgggtcaaactttattgtaa

SEQ ID NO: 3471 - DNA, 378 bp, Candida albicans
ttaattaatatggcaattaattggaaatcaacattacaaacctcggcatcagtgatatcattatttcttattgccaaagaattatataacttatatgttaccactaccaacaaagataaatcaaattctaaactaacattattaccaccacgaactcgaggcatcgaatcattaattggtaatactcccttaattgaaataaaatcattatcacgtcaattaggttgtaaaatatatgctaaattagaactttgtaatcctggaggaagtgcaaaagatcgagtagcattagctataattcgagctggggaatcatcaggtcaattgatccctaatgcgaataatttttcaccacgccgtacagatacatatctgatt

SEQ ID NO: 3472 - DNA, 840 bp, Candida albicans
gcgcgtctccttccagccccggtggctgaagacaatgcattagggtatatttgtcatatttgtttacctgatgatacatctttagaaaaattacaattattgaaatcattaggtgcagaattagaaccagttaaactggcaagtatagtagatcctaatcaatataccaatgctgctcgacgtggtgcattagccgtgaatcaaaatagagatggtcattctcaacgacgagcaatatttgctgatcaatttgaaaatgattttaattggagaattcattatgaaactaccggaccagagttattacaacaaatgggtcaagataaaatcgatgtatttataaatggtagtggtactggtggaaccattgctggtgttgggagatgtttaaaagaatataatccaagaacaaaaattgttttagctgatcctcaaggttctgggttagctaatagaattaattatggagttatgtatgattctgttgagaaagaggggacaagaagacgacatcaagttgatacattagttgaaggaattggattaaatcgattgacttggaattttaaacaagcagaaccatatattgatgaagctattagagtcactgatgatcaagcattaaaaatggcaaaatatttaagtattaatgatggattatttttagggagttcatcagcgataaattgtgttgctgctgtgaaaatggcattgaaaaatggtcctggtcaaaaaattgttgttattgcttgtgattctggtgctagacatttatctaaattttggaaagaagctgcaaaattacccaatgatcttacattagatgatatactacaataa

SEQ ID NO: 3473 - DNA, 798 bp, Candida albicans
gtcggtccagccgccgtgtgtgaagacaatgtttctgatcagcctaaaaaatctgtttgttttggattcccgtacgttgatactttgaatatattgaagaaatttggtcctggggtacatttccttggattaggggatgatgaatcgttagataatttagaagaacaattaagtcaaggattggatatattggcacttttctgtgaatgtccttcaaatccacttttgaaaactccaaatttgcatagaataagacaattggccgataaatataattttgccattgttatagatgaaacggtggggaatttcattaatattcatgtattaccatatgctgatatggtggcatcttcattaactaaagtattttccggggattcaaatgttttagctggatcattgatattgaatcctgattccaagtattatactattttgaaaacatttttcaataaagaatatgaagatttattttgggctgaagatgccctttggttagaacgtaattcacgtgattttgttgaaagagtacataaaattgatgatacctcagcaaaagttgttgaattattaccaaatactccattgatttcacaaatttattatcctaatgtttctgattccaaaaaatactatgatgttataaagaatgaaagtggtggttatggaggattaatatcatttttatttaaacaacctccacaagctgtcaaatttttcaacgccgtaaatcttcacaaaggtccatctttaggttaccaattttactttgggcgttttccttatgcctatatt

SEQ ID NO: 3474 - DNA, 213 bp, Candida albicans
tcttccaactatctttatcttcttagatttggtgcaaataattcttctatttcaaatatcttactcaaccagtattcagatatgccttcacaagaaatagggatgcctatcccaaatatgccacatgctgtttctgtgactttaccaacatgggaagcaacagtaggttatgaagaaggtgaagattgggtagtttcaaaaatgaattcaggt

SEQ ID NO: 3475 - DNA, 510 bp, Candida albicans
ggtgaaggtatttcatcaagaatgggggaatacattttaaaagaattatttgaaaaagataatgactataatgataattataataattccaatggtgctgatatttctaaaatgtcaggaaacctcaaacaagaactccaatctttacaaattcaaagtcgttctccatccatttcggcctctcgagcttctagtgctgctggatataatattgatgatgttaaccgtgattttgattcatttattgaacaaaaatatggtcgagttttagatttgaaatttgctaatgaagccaaagcagctttaagaagaagaattgctggcaaggcagataaatcaactgaacgagttgaagaattagaaagagcgaaaagaggtaaacatttaaatgaaaatgatgtatatttattcccctcagggatggcatcgatattttatgctcatcatccattactccatgtttctgaatgtccaaacggcgctagaggtcatagtccgggagcgcaacac

SEQ ID NO: 3476 - DNA, 1329 bp, Candida albicans
  unsure (904): Identity of nucleotide sequences at the above locations are unknown.
actacaatgccttctcactttgatactcttcaattacatgctggtcaaccagttgaaaaaccacaccaaccaagagccccaccaatttatgcaaccacctcctatgttttcaatgactctaaacacggtgctcaattatttggtttagaaaccccaggatacatttactccagaattatgaatccaacaaacgatgtgtttgaacaaagaattgctgccttggaaggtggtattggtgcattggccacttcttctggtcaatcagctcaattcttggccattgctgggttggctcatgctggtgataacattatcagtacatcctacttgtatggtggtacttataatcaattcaaagttgctttcaaacgtttgggcattgaaaccaaattcgttaatggtgacgccgctgaagattttgctaaattgattgacgacaagacaaaagctatttatattgaaaccattggaaaccctaaatataatgttccagactttgaaaaaatcaccaaattggcccatgaacacggtattcctgttgttgtcgacaacacttttggtgctggtggatttttagttaacccaattgcccacggtgctgatattgttgttcattctgctactaaatggattggtggtcacggtactacaattgctggtgttattgttgattccggtaacttcccatggaccgagtacccagaaaaatacccacaattctctaaaccatcagaaggttaccacgggttggtcttgagtgatgctttaggtaaggccgcatacattggtcacttgagaattgaattgttgagagacttgggtccagctttgaatccatttggaagttttttgttgttgcaaggtttagaaactttgtctttgagagttgaaagacaatctgaanatgctttgaaattggcccaatggttagaaaagaacccaaatgttgagtctgtgtcctatttgggattgccatctcacgaatcccacgaattgagtaaaaaatacttgaacaatgacgctaagtactttggtggtgctttagcatttactgtcaaggacatcaccaacacctccagcgacccattcaatgaagcctcaccaaagttggttgacaatttggagattgcctcaaacttggctaatgtgggtgactctaagactttggttattgctccatggtttactacacatcaacaattgtcagatgaagaaaagttggcttctggtgttaccaagggcttaatcagagtttctactggtactgaatatattgatgatattattaacgactttgaacaagcattcaagaaggtttataacaactaa

SEQ ID NO: 3477 - DNA, 804 bp, Candida albicans
ggtaacgctatcgcggatccttgcagccccgtggtgaagacgggaatgttggcattagaatacctggcaatttacaacaataccggatacgtacagaaagtagtcgcattggctactgcagccagaacttcagcatggtgcatatcttggaatgagacacaaagacaatgcattttcagtgatcctttttacgatgacgggtattactacgaaactggaaataaacctgattctggattaagtgccgcaagaatggccgctttgcttacttatcgttctagaaactcgtttgaaagtagatttggcagaaaattgggtccgagatctcctaatgatggtggtgccagtcctagaaccaaacacgaagagcattctttattgcataatgacgggtcaaagcttatcaatggagctcctgtaaatgaaaaatatccaccaacttatttctcggcacagtcatatatgcgttataacggttccaaatttatcaatagatttgatgcaaattgttacatagccattagtcgaaaattggatactaatgatctttctcgaggtcgagtcaatgcacccaacgacgctaatggtgatccattggttcatgttttaaaggatctttcaacccctacgttggtcataggaattgaatcagatcatctttttacaataactgaacaaaaacttttggctgacaatattccaaatgctatatttgagacgttggacagtgaagagggacacgatgcatttttgttagagtttgagaaaataaatagtttcatcactagttttttgaataattga

SEQ ID NO: 3478 - DNA, 1458 bp, Candida albicans
ccaaaatttaaattgaaagtctcaatgtttcaactattgaaatatatctttattggaggattcacctatttactttatttaattttggagatagttttcccaccattcaatttccctagaaatattcccacaataccattttatgtgtcgtttttaggggcttgcaccaatttggatcaagaagatatttacaaactatatctacgagaaaaattggaaaaatatggtgctgttaaaatgtactttgcctcgagatggaatattttaatcactaaaccagatttcttacttgaaatgtttaaaaatgaagatgtatttgccaaaagtggtaatcatgtcaagattccaaattcggttttagcaacttatactggggataatatcattagtgctcatggagaattatggaaattataccgagatgttgttgcccaaagtattcaatttcctgatttgaaaccaatttccaagaatacacaaaagttgttacgatttcttgataacgaaatgggatcagcaaatcaagccactatttcagtgacagatatattacagaaatattccttggccaatgtttgtgaatctgtccttggcgttaattttaatgtacttgatgataaacaatcacttatgcatgagaagattaaatatgttaaactgcaaattttcaatcccattttcttaaatttcccttattttgacaatttccccattccaagccgactcaaggcaagaagagaagtgattgggtttcgtaaatggtatggtcaaagccttatagaaaagtataatttacaattgccaaactcagcagctacaaaattggtggattctttgatcaaagaaaaattgacagaaaaacaatttttggataatgccataattttaatgattgctggtcatgaaaatccattactattgatgttatcattattatatgttgtttctaaatatccacaagttcaagaattaatacgcaatgaaacagaaacaacaaaaccttaccttcattcagttatttatgaaactctaagaatgtatccaccattgggattaatcataaatagatgcacaactagaatcaccaaattgggcaatattgttatccctaaaaatgtttattgcggttataataattttggtacgggaagggatagaaatgtatggggatcagatgcagatattttcaaaccagaacgatggggattggaaattgatgaaatcaacaagaaatttacgttagccaaaagatcagctgaattgcccgcatttcatggcatgaaaagagcatgtttaggtgaaaaatatgcattgtttgaagttaaacaatttctattggcaattctaggtgagtataaagtgtctctacacccaaattggacagaacaattgacacctgctgggccaattagccccttgcgattgaaattgaattttgaaaagcttacagtttcctaa

SEQ ID NO: 3479 - DNA, 426 bp, Candida albicans
aggcggatatctgcccgtggggcaggcacaataatttcatgtctcccgtattccttccatcgtacagaaggtgtattccctgaaccagacaagtttttacctgaaaggtggattatcaatagtgaacaagacaaatggcgagtcaaacaacaagaaaagtatatgatgccgtttgggaaaggagtcagaatgtgtcttggaatgaatttggcaatgattgaaatgaagatagctattgcgaaattgtactggcactatagctctacgattgatgaaacgtggtgcagagtcttaaacgatgcaaagccgattaaaatgggtggaggtggcgatggcactactgaccaagacaaaatgagaatgtacgactggtacactacgagaccattgtacgacgagtgttggttgaaatgggaaaggttatag

SEQ ID NO: 3480 - DNA, 234 bp, Candida albicans
cacataagcgcggtacctggcagcctcgtcggtgtaagacgcatttcgatggcagggaaaagagcatgtttaggtgaaaaatatgcattgtttgaagttaaacaatttttattggcaattctaggtgagtataaagtgtctctagacccaaattggaaaaaacaattgacacctgctgggccaattagccccttgcgattgaaattgaattttgaaaagcttacagtttcctaa

SEQ ID NO: 3481 - DNA, 1575 bp, Candida albicans
aactgttcattgatggcattaattattttttgtcccttagttgttacaccacagatcagtatattattaggggttccatttgtttacaacttagtatggcaatatttatattcattaagaaaagatagagctccattagtgttttattggattccttggtttggttctgcagcttcatatggtcaacaaccttatgaatttttcgaatcatgtcgtcaaaagtatggtgatgtattttcatttatgttattagggaaaattatgacggtttatttaggtccaaaaggtcatgaatttgtttttaatgctaaattatctgatgtttctgctgaagatgcttataaacatttaactactccagttttcggtaaaggggttatttatgattgtccaaattccagattaatggaacaaaaaaaatttgctaaatttgctttgactactgattcatttaaaagatatgttcctaagattagagaagaaattttgaattattttgttactgatgaaagtttcaaattgaaagaaaaaactcatggggttgccaatgttatgaaaactcaaccagaaattactattttcactgcttcaagatctttatttggtgatgaaatgagaagaatttttgaccgttcatttgctcaactatattctgatttagataaaggttttacccctattaattttgttttccctaatttacctttacctcattattggagacgtgatgctgctcaaaagaaaatctctgctacttatatgaaagaaattaaactgagaagagaacgtggtgatattgatccaaatcgtgatttaattgattccttattgattcattcaacttataaagatggtgtgaaaatgactgatcaagaaattgctaatcttttaattggtattcttatgggtggtcaacatacttctgcttctacttctgcttggttcttgttacatttaggtgaaaaacctcatttacaagatgttatttatcaagaagttgttgaattattgaaagaaaaaggtggtgatttgaatgatttgacttatgaagatttacaaaaattaccatcagtcaataacactattaaggaaactctcagaatgcatatgccattacattctatttttagaaaagttactaacccattaagaatccctgaaaccaattatattgttccaaaaggtcattatgttttagtttctccaggttatgctcatactagtgaaagatattttgataaccctgaagattttgatccaactagatgggatactgctgctgccaaagctaattctgtttcatttaactcttctgatgaagttgattatgggtttgggaaagtttctaaaggggtttcttcaccttatttaccatttggtggtggtagacatagatgtattggggaacaatttgcttatgttcaattaggaaccattttaactacttttgtttataatttaagatggactattgatggttataaagtgcctgaccctgattatagttcaatggtggttttacctactgaaccagcagaaatcatttgggaaaaaagagaaacttgtatgttttaa

SEQ ID NO: 3482 - DNA, 939 bp, Candida albicans
ataaccttaaaacaaaaccaaattatactaacgatggctcctactgctgttactcaagaaccagaagacgttcaagaaacaattaaaaggttagctggcttaaaagtcattggccattctaaaaactcaaagggaatcattactggatatgatcctgaatgggccgataagttaccagaaaccactaaacaaagatacgctaaatatggtgttgacatttccaaaggttatccttatgtccctgtaaatgaaaaagtaccaaagtttgttgacgaagttttcgctatcagaaacgaagaatatccttacattgaaagaggtaaaaatgctgacccagaaaagaagctgttatttgatgctgctgaagatgtcattcatttaactccttatattggtactgaaattgttgggttacaattgagtgaattgactgaacaacaaagagatgaattggctttgttgattgctgaaagagttgttgtatttttcaaagatcaagatttgtctcctcagaagcaacttgaattaggtcactattggggtcaagttgaagttcatcctcaagccacaagaataggtgaagagtatgatggaatatctgttatttggcaagagcaacaaagagacagatggggtttaaatttgacttttaaacaatccaaaaaaggcaattcacaatggcacagtgatttagtccacgaaaagcaaactgctggtattactcatttgcaccttgatgctattccgggtattggtggagaaacattgtggagttccacttatggtgcttacgataaattgtctccagctttgcaaaagttcttggatggcaagactgcaatttacagatctgctcatcaatatttagatagaaacgatccattgaaaggtcctaaatatgttgagtcttcaccacgcggctggaaggtaccgagcttg

SEQ ID NO: 3483 - DNA, 1293 bp, Candida albicans
tttattcaaaaaattgggcaccaacggcagggaattcaagaaccacaagaattacaaggaacaatcaaaaaattagtttatttaaacccaattggtcattccaataataaatcagcagttattactggatttgatcctaattggggtgagagattgcctgaaaccacgaaacaaagatttaccaaatatggtattgatatttctcaaggatatccttatattccacaaaatactaaaatcccgaaatttttagatgaagcttatgctattagagatgaagaatatccttatattgaaagaggtacaaatgctgacccggaaaaaaaactgttatttgaagctgctgaagatatcattcatttaactccttatattggtacagaaattgttggattacaattgagtgaattaactgataaacaaaaggatgaattggcattattgattgctgaaagagtagtagtttttttcaaagatcaagatttatcaccacaaaaacaacttgaattaggtcattattggggtcaagttgaagttcatcctcaagccgcaagagttggccctgaatttgatggggttacggttatttggcaacattatgctaaagaaagaagatcaatcaatttgacttttaaacaatctaaaaaggggaattcggtttggcatagtgatttagttcatgaaaaacaaactgctggtattactcatttacatcttgatgctatcccgggaattggtggtgaaactttatggagctctacttatggtgcttatgataaattatctccgggtttgcaaagattcttagatggtaaaactgccatttatagatctgctcatcaatatttggatagaaatgatcctttgaaaggtcctaaatatgttgaaagagaacatccaatagttagaactcatccggtaactggttggaagtatttatttgttaatcgtggtatgacagttagaattgttggattattaccagaagaatcagatttgattttgaattatttattttcaataattgaaaccaatagagatattcaagttagatggtcatggcaaaaggaattgggtagtgtcaaaaagaataacaaccaagatgaacaaccaaaacaataccgtggtgttagtgccttatgggataatagaattagtaaccatagtgttgtccatagtgaagaatcaattattggtagacatggtactagagtcacttcattagctgatactggttattataatccaaattcaaaatctcaaagagaatctttgggtttgtctttggattaa

SEQ ID NO: 3484 - DNA, 1227 bp, Candida albicans
tttcttaatagaaataataacttgactagcatagaaataacacacatactcccttactataaaataatggcacaaagatttggtaattcagatattcatttcaataaagattttgatgaagttgatgcagacggtgtattggtgatcaacaaacgtaacagagaacaagcaaagtatccagattttttaccatcctgggatccaagtgacaaattacctccattgaaatttgaaaaatacattgatcctggttcaagagctgatccttctttcccaaacttatttcctaaagatggttcacataaaatcaaaagaatcactccaaaattcggttctgaaattgatggtgtccaattatcacaattgaatgataaagggaaagacgaattggctttattcttggcacaaagaaaagtattattgtttaatgaacaagacttcgcagataaaggacctggttttgctgttgaatttggtaaatattttggtagattgcacgttcatccaagttcaggttctcctcgtggtcatcaagagttgcacattacttacagaagacctgaaaaaggtgaattacaaagagtctttgctcatcgtactacaagcgttggattccatagtgatgtttcgtatgaaatcacacctctgagatttacacttttccaagttttagaaagtggtgatggtggtgatactgttttcgttgatacagttgaggcttacaatagattatcaccagcattccaaaaacgattggaaggtttacatgtcttgcacacttcagaagatcaagcggccaactctgcacaccaaggtggtgttgaaagaagaaaagctgtttcaaatattcatccattggtaagattggaccctgtcactggagaaaaatctttatacgttaacaaagcttttggacgtagaattgttgagttaaagaaagaagagtctgattacttgttagatttcttacataaccatattgaaaagagtctggatttacagttgagagtcaactgggaacgtggtgaaagaaggaaggttgctttgttccacaacagtggtgtgtcccatacagcaacttttgatactgaagaaggtgaggttagacatgcttacagaatttcggttttaggtgagcgtccaattctgaatttggaagacttgaataaagaagattacactcctggagatttagctgatgccttgagtgcaatcaaacctatttag

SEQ ID NO: 3485 - DNA, 1173 bp, Candida albicans
ccaaatatgccatcacgttatactagaccatctgaagctcttggtggaggaaccgaatatgttagtgacaacaaagggtttgttcaagttgctcctaagtctgcacaaaaaataaacatcgagtcttctccttatctcccaacttgggacagaaatgagagttataagccatatgaatttttggagttccatgatcctgctttaagagccaataaagatttgccaaacttgtttccaaaaggtggtgattatacaacttccaatatatctcctaaattgggtacagaaattaaagggatccaattgtcacaacttaatgatgctgccaaagatgaggttgctttgcttgctgctcaaagaggtgttttagtgtttagagatcaagactttattgacaaaggtccagagtttgttacaaaatatgttagtcattatggtccgttgcatattcacccaaccagtggtgctccaaaagatcatcctgatattcatgttgttttgagtggagatactaaagagtatccatttgaaaagaaaactaaccttgttgcacttcactcagatgtttcttatgaattaaatccaactgcgctttcttttcttgctgctaccaatatccctcaatctggtggagcggatactgtttttgttgacaccgtcgaagcttataatcgtttatctccattatttaaagaaaaattggaagggttgaaggccgttcatagtgctgttgaacaagctaattttgccattttcaaaaagggtcatgtcaagagacatccagttgaaaatgtgcatccaattgttagaactactccgttgggccagaaagttttgtatgtcaataacggtttcactagaagaattgaggggttgaaagaagaggaatcttcctacttgttaaactttttacttgatcatatttggaaaggtcatgactttcaaattagagctcactgggaaccaaacacggtggttatatttgataacagagttgttggtcacactgccattcttgattttgatactactgattcaagattgattatccgcgcttctgccaggggtgagagaccagtttctgacttgaaggatttgaacaagcctgatgagaatttagtctaccacggtgcagaatacttgggagacagattagaaaacttgaaaatttag

SEQ ID NO: 3486 - DNA, 393 bp, Candida albicans
  unsure (5),(86): Identity of nucleotide sequences at the above locations are unknown.
ataantagaagagaaccggaagctaatatcattccgcttgttagagttaacccagtcaccaaacaaaaacacttgtatttgaacanagagtttggaagacgtattgttgaattaaaggaagatgaactggactatttgttgtcattcttgtatgaccacatagagaaggctcaagatttgcaaataagagttacgtgggaggagaatactgttgttttatggaacaactcaaccacaattcactctccatgtgttgactttgatgagcctgaaatccgccacgcttatagaataagtgtcatgggcgaacgaccagttggcgatttaaagtacttgaatgatgaaaattatttacaagaaaagtacaatgagcttggaattcaaaaaagttaa

SEQ ID NO: 3487 - DNA, 696 bp, Candida albicans
  unsure (683): Identity of nucleotide sequences at the above locations are unknown.
ttcactagattgttcagttgttgggatcaatacatcagaatggcaccagttgcagatactactaaatacgacgattctcaatttcataaagctcacgttggtaataccagcaaaggctcatttactgtgagtgatcacaacaaatctttagctttatacccgaaatttttgccaacatggaacccaaaccaaaagttcccatcttataagtttgaacagtaccatgataaagggcatgctgctgatcctttgttgtccaatttgtttcctgctggtggggattacaaggtcaagaggttgagccccaaattaggttctgtgataactggtattcagctttcacagttgtcagatgctgcgaaaaacgacctttctcgttttgttgctgaaagaggtgtggttgtgttcagagaccaagattttaaccaaggtgggccccaggctgctgttgagtttgcccaatactttgggccattgtacaagcatgccacgagtggctccccagaaaggttccctgaattgcatgtttgctttcgtggtgcatcacaagatgaaattgatagtgttttttctgacagaacgaattccatctcatggcattctgattgctcatattcgttgaatgcattgcacttgactttgttctcatgcatgccattgccagactcccgtggtgatacatnatttgataattcg

SEQ ID NO: 3488 - DNA, 861 bp, Candida albicans
tccccgatcattattccatacaccaaaacttggtacggtaagaaaattgctgatgacaccatgaaaatttttgagaattgtgctgctatggctaaaaaacatatcaacgaaaacaatggtacccctaaatgtgttatggatgaatggattcatttgatgaaggaagccagagaaaaacattctgaagacccagactctaaattattggttagagaattctctaatcgtgaaatttctgaagctattttcacatttttgtttgcttctcaagatgcttcttcgtctttagcttgttggttgttccaaattgttgctgatagacctgatatcgttgctaaaatcagagaagagcaattgcgtgtgagaaacaataaccctgatgttagattatctttggacttgattaatgaaatgacatacacgaacaatgtcgttaaggaatctttgagataccgtccaccagtcttgatggttccatacgttgttaagaaatccttcccagttactgaatcctacactgctcctaaaggtgctatgattattccaacattgtatcctgctttgcacgaccctgaagtttatgatgagccagattcttttattcctgaaagatgggaaaatgctagtggtgatatgtataaacgtaactggttggtatttggaactggtcctcatgtgtgtttgggtaagaattatgtcttgatgttgttcactggtatgttgggtaaatttgttatgaattcagacatgattcaccacaagacagacttgtcagaagaaattaaagtttttgctactattttccctaaagatgatttgattttagaatggaagaaaagagacccattaaagagtttatag

SEQ ID NO: 3489 - DNA, 783 bp, Candida albicans
ttaatagaaatttttttttttttttctatttttccttttttcctttttgttgactttcttcttcttcttttattttttttttacaaaaaccacaaaacattcactttaatgaattcaacaaaggtcgataacttaccttttcaacaacaactcacttcgtttgttgaattggccgtatccaaagcaactggctcaccaatcaccactttatttacaatcatctttcttattcttctgtacgatcaactttcctatcaaatcaataaaggttcaattgctggtccccgtttcaaattttaccctattattggtccattcttagaatctttggatcctaaattcgaggaatataaggcaaaatgggattctggtgaattaagttgtgtatctattttccacaaatttgttgttattgcttcatctcgtgatttggctagaaagatattatcatctcccaaatacgtgaaaccatgtgttgttgatgttgctattaaaatccttagaccaaccaactgggtttttctcgatggtaaacaacacaccgattaccgccgttctttaaacgggttattctcttcaaaagctttggaaatttacattccagtacaagaaaaatacatggacatttatttagagagattttgcaaatatgatggtcctcgtgaatttttcccggaatttagagaattattgtgtgcattgtcgttgagaactttctgtggtgactacattactgaggaccaaattgctcttgttgccgataattactacagagttacatag

SEQ ID NO: 3490 - DNA, 765 bp, Candida albicans
  unsure (43): Identity of nucleotide sequences at the above locations are unknown.
aacgattacagccccgagccttggatgcccgagttccgtgagntgatgtgtgccgtctcttgcggtactttcgtcggccactatatgactgatgcggccatcaagaagattgcggaggactataacatgattacagccgctttggagctggtcaacttccctttcatcttccctttcaccaaggcttggtacggaaagaaggcgtcggatatggttcttgaagaattctccaactgtgctgccaagagcaaggctcatatggctgctggtggagagatcacctgtatcatggacgcatgggtcaaggctcaacaggattctgccaagtacaacgagaagattgccaagggactccctgtggaagactccgagaagccttctcacttgctccgtgagtttaccgactacgagatcgcccagactgttttcactttgttgttcgcctcgcaagacgccaccagtgcggcttgcacttggttgttccaactcgtggctgatcgtcccgacgtacttgagaggatccgagaagagaacttgcgagtgcgcaacggcaatatcaatgctcctctcactatggatctacttgacgagatgaagtacacacgtgctgttgtcagggagactctgcgttaccgcccgcccgttatcatggttccctacttggtcaagaaggatttcccaattacggactctatcaccgtctcgaagggttccatgatcataccatcggtgtcttcaccacgggcctggcaggatccgagctta

SEQ ID NO: 3491 - DNA, 834 bp, Candida albicans
tttgctaattccattaacaacatgcttctttcattatggaaatccactaccaaaaatgatgttcccgattatgaattggaagaagaattaattactattccacgtaaattggaatgggatttaacacctgatttatcattggttttaagatttggtgaaactagattgtcggatttaatcaatcaaaatgaattccgtcatttagaatttaaaaattatggttcttctcaaattaaaaaaatgaaattttcaccagatgcttttgttcaaatggcgttccaagcaacttattatgctctttatggtaaagttgaatgtacttatgagccagccatgaccaaacaatattatcatggtcgtactgaagccattcgtacagtttcccaagaatcaaatttatttgttcgaaaattttttgattcaacagtatcaatgaaggaaaaattacaatatttatctgatgcttgtaagaaacattctgaaaagacaagaatgagttctatgggtcaaggtgttgatcgttacttatatgcaatgttttgtatttggaaaagatatttacaagattatgaagaagagcaacaacaacaacaacacccagttgaagaaggaagtggtggtgaacaacagatggaagcagtagggttatctagagatgataccatagttgttcaaatggatggtgaacatgacgatgatgattcaacaactgttgttggaaccaatggtggtaaaaaccttcatgcatctggatctcatggtaataacgatatctatgataattttgatttattcttcaccacccggggctggaaggacacgcgctgcgggtta

SEQ ID NO: 3492 - DNA, 2013 bp, Candida albicans
ttgagacaacctccatatacatacatatatatatttactccctcgaaaatgtcaacttatagatttcaagaaacattggaaaaacttcctattcctgatttagttcaaacttgtaatgcatatctcgaggcattaaaacctttgcaaactgaacaagaacatgaaaataccaaaattgccgtggacaaatttctcaatggtagcaattccaaaaccactaataatggagtggttacaggaagtggtattggtcattatttagatcgagaattgcgtcaatatgctaaaactagacctagttatatcgaacaattttggtatgattcatatttgaattatgattcccccgttgtattaaatttaaatccattttttcttttagaagatgatccatttactaatgaatcaagtagtattaatcctcaagttaaacgtgccaccaatttaactttatcatcattaaaattcattcaagcattgaaaaatgaaactttaagcgttgatacattgaaaaatgggaaaccgttatgtatgtatcaatatactaaattatttggtgcttcaagaattccatctcaagaaggatgtatgatgcaatctgatccattatcgaatcatattgttgttatgtcaaagtcgcaattttattggtttgatgtattggattctcataataatttgatattaaatgaagcagaattgaatattaattttaattcaatcattcgtgattctttaaatactccttcagatgaaattgctaaatcgtcgtttggggtattgactacggaaaatagacgtgtttgggctaatgtcagaaacaatttgattggtaataataccattaatcgtgaggtgttatcgattattgattcagcattatttattttatgttttgatgatattgccattgatgatttatcagaattgtcgaaaaatatgctttgtggattatctatattagataatggtatccaagttggtacttgtactaatcgttggtatgataaattacaaattattgttaccaagaatgctaaagcagggattaattttgaacatactggtgttgatggtcatactgttttacgatttgtaagtgatatttatactgattcaattttatcctttgctaattccattaacaacaatgctccttcattatggaaatccactactaaaaatgatgttcccgattatgaattggaagaagaattgattactattccacgtaaattggaatgggatttaacacctgatttatcattggttttaagatttggtgaaactagattgtcggatttaatcaatcaaaatgaattccgtcatttagaatttaaaaattatggttcttcccaaattaaaaaaatgaaattttcaccagatgcttttgttcaaatggcattccaagcaacttattatgctctttatggtaaagttgaatgtacttatgagccagccatgaccaaacaatattatcatggtcgtactgaagccattcgtactgtttctcaagaatcaaatttatttgttcgaaaatttttcgattcaacagtatcaatgaaggaaaaattacaatatttatctgatgcttgtaagaaacattctgaaaagacaagaatgagttctatgggtcaaggtgttgatcgttatttatatgcaatgttttgtatttggaaaagatatttacaagattatgaagaagagcaacaacaacaacaacacccagttgaagaaggaagtggtggtgaacaacagatggaagcagtagggttatctagagatgataccatagttgttcaaatggatggtgaacatgacgatgatgattcaacaactgttgttggaaccaatggtggtaaaaaccttcatgcatctggatctcatggtaataacgatatctatgataattttgatttattaaaaacagtaccagaattatttgctgattcaggttgggataaattaaacagcacaattatttctacatccaattgtggtaatccatcgtta

SEQ ID NO: 3493 - DNA, 789 bp, Candida albicans
cgctggtccttccagcccgcgtggttgaagattaatggagtggttacaggaagtggtattggtcattatttagatcgagaattgcgtcaatatgctaaaactagacctagttatatcgaacaattttggtatgattcatatttgaattatgattcccccgttgtattaaatttaaatccattttttcttttagaagatgatccatttactaatgaatcaagtagtattaatcctcaagttaaacgtgctaccaatttaactttatcatcattaaaattcattcaagcattgaaaaatgaaactttaagcgttgatacattgaaaaatgggaaaccgttatgtatgtatcaatatactaaattatttggtgcttcaagaattccatctcaagagggatgtatgatgcaatctgatcctttatctaatcatattgttgttatgtcaaagtcgcaattttattggtttgatgtattggattctcataataatttgatattaaatgaggcggaattgaatattaattttaattcaatcattcgtgattctttaaatactccttcagatgaaattgctaaatcgtcgtttggggtattgactacggaaaatagacgtgtttgggccaatgtcagaaacaatttgattggtaataataccattaatcgtgaggtgttatcgattattgattcaacgttatgtattttatgttttgatgatattgccattgatgatttatcagaattgtcgaaaaatatgctttgtggattatctatattagataatggtatccaa

SEQ ID NO: 3494 - DNA, 924 bp, Candida albicans
acacaattaaagatggtcgactcaaacttcttcgttgatttcatgatgggtggtgtttccgctgccgtttctaaaaccgctgctgctccaattgaaagagtcaaattgttgattcaaaatcaagatgaaatgatcaaacaaggtagattagaaaaaagatacactggtatcgttgattgtttcaagagaactgctgctgatgaaggtgtcgtttccttctggagaggtaacactgctaacgttatcagatacttcccaactcaagctttgaactttgctttcaaagataaattcaaggccatgtttggttttaaaaaagatgaaaactactggaaatggtttgctggtaacttggcttctggtggtttggctggtgccacctctttggcttttgtctactctttagattacgctagaactagattggctaacgatgctaaatcttctaaaggtgacggtaaaagagaattcaatggtttagttgatgtttacaaaaagactttggcttccgatggtattgctggtttgtacagaggtttcggtccatctgtcattggtattgttgtttacagaggtttatactttggtttgtacgattccttgaaaccagttgtcttggttggtccattggaaggttctttcttggcttctttcttgttaggttgggctgttactactggtgcttctactgcttcttacccattagataccgttagaagaagaatgatgatgacttctggtcaagccgtcaaatacgatggtgccttggactgtttcagaaaagttgtcgccgctgaaggtgtcggttctttgttcaaaggttgtggtgctaacatcttgagaggtgttgccggtgccgggtgtcacctccctggtacgatccaatggcaagttatcttggtcccggtaagaaattcaaattaa

SEQ ID NO: 3495 - DNA, 333 bp, Candida albicans
atcatgtcggtatttttaggaagctcagcccaattttctcaagctaccatagatccagaaaagataaaattggccgatatacaattcctggccatggcttttacttttaataaattattaagaagatgtgaacaaaaatgtttattacgtgaatatggtgaaggtgaattaactaaaggtgaacaagaatgtatagatcgttgtgtatcaaaatatgttaaagctaatgtgattattggagaacatttacaaaaacaacgattggatccttttaattcgatgccagaatatcgaaaagttcaagatatcttggcgagttctgtgaaatcgtga

SEQ ID NO: 3496 - DNA, 678 bp, Candida albicans
aagagaaagataatgacagaagaggaaaagaaacgtctacaagtattggaaagagatgccgaaactgcttatccatttttagcatcagatgaaaaatcctcaacttttaaaactgctgaagatcttgaaagtggcatcaatccacttgtttccattgcaactactaatgaatcacaacaaaaactagataatgtgagtagtatcagcaccactaccaatgagaaaccaaaacctaaacctaaaccatgggtacattttgttgctggaggtattggtggtaccgttggtgctgtagtgacatgtccattagatgttgtcaagacaagattacaatcagatgtgtatcattcaatgtataacaagattcctaaatcgggaaatcctataattcaagcatggcaacatttaagtgaaactggatcagtattaagaggaatgtatattaatgaaggtgcatcatcattattcaaaggattaggaccaaatttagttggtgtgataccggcaagatcaataaattttttcacttatggtgctacaaaagaatttttacttgggaatttttcgccaacaaatagcattcaaggtccaagacaagaagaaacttggatacatttagtatcagggataaatggtggatttgtaacgtctttcccacaggcgccaagtccgcgtcaa

SEQ ID NO: 3497 - DNA, 279 bp, Candida albicans
agaacaagatcgggtgctgctggtttagccaaatttatggcatctttaatcacttatcctcatgaagtggtaagaacaagattaagacaagcacctttagaatccactggtaaaccaaaatatactggattgattcaatgctttaaattggttattaaagaagaaggatttggtagtatgtatggtggattaactcctcatttattaagaactgtacctaattctataattatgtttggaacttgggaattggtggtaagattattatctgaatggtaa

SEQ ID NO: 3498 - DNA, 882 bp, Candida albicans
tttttttttaagaaacaagtggatccattgaaatcatttatagctggtggaactgcaggagcagttgaaggaataataacatatccatttgaattcgccaaaactcgattacaattaatatcgaaatcgtcaacagcatcaagaaatccattagttttaatctataatgttgctaaaactcaaggagtttcttcattatacgttggatgtccagcatttgttgttggtaatactcttaaagcctcagttagatttcttggttttgatctgattaaaaatttattactggataaaaatgggaaattatctggccctcgtggtgttattgctgggttaggtgctgggttattagaatccgtagtggcagtgacaccatttgaagcaatcaaaaccgcattaatcgatgataaacaactgattaaaccaaaatatcaaaatggtgtgatatcaggatcattcaaattggtacgtgatatgggtttcaaagggatttatgctggggttgtccctgtatctttaagacaagcagctaatcaagctgttcgtttaggaagttataatgctatgaaaacaatgattcaacaagcatcaggtcaaaaaccaaatgaaccattgagtggtactacaacttttgctgtgggtgcattaccaggaattatcacagtttatactactatgcctattgataccgtgaaaactagaatgcaagctttaggtgctgataaattatattcttcaacattgaattgttttgttaaaattttcaaagatgaaggattattgacattttggaaaggtgctacaccaagattagggagattggtactatctggaggtattgtgtttttgtgttatgaaaaaatcatgatattacttaactag

SEQ ID NO: 3499 - DNA, 2232 bp, Candida albicans
aagaaaatctatcgcactatgacacaggaacaattttacacttttgaaaacgaagctagcttacccaaattgccagtacccctgttagtttctacaacacaacaattgttggcttcattaaaacctttattaccacagaatgaatatgccactgttgttgatgaggcaacagagtttgttggaaatgatattattaatttaattcaaaaacatcttgttgccatttctgaaaatgaaaactacaccaactacttaaattttgttaatgacgataaaaccccatcaatatatggagagattagaggtgatatattacctagaaacccttaccttgtattggaagaagacccctattcgaaaacaatcaatcctccaaatcaagcccaacgtgcagcaaatttggtcaattcaagtttgaagtttgcgattacgttgagaaacgagactttgaaacctgatgtgaccccgaagaatggaaacgcattaactatgaaatgctatatggatttgttcggtactacaagagaacctgagcaagacgatcgtggctttgatattagaattaaaaaataccaacacattaacgattcgagacacattttaatcatttcaaataatcagttttatacacttgaggtgctcactgaatttgatgaaaatgagtaccaacaaaccaattcaaaacataatatctggttcaacgattcagaactttcaaaaattttgcaacacataattgacgagtcaaacaaagttgatgcagtaaacgcaattagaaactccgttgggtcaatcactacccagactttgaagtattggaagtttgctcgattagagttggaacaatcaaataccgaaaatttgaaactaattgatgatgccttgtttgtattgattttggactccaatactccggtcactgacggtgaaaagactcaggtcatatcccatggtacgtcggttttatccctggacaatgtgcaaattggtacttgtacatcacgttggtatgataagttgcaaattgtcgtgactaaaaactctgttgctgggattgtttgggaatcaatgaccatggatagcacagcaattttacggtttatcagtgacatttatacagactcggtgttgaaaatggccaagaacatcaatggttctgaatataccttatttgatcctaacattacttttgcctcaattggtaaagatggtaatggtgtggtgaaacctgaaccaaaactacttgaatttaacaagaccaaggcattacaacatgtcattcatctttccgaaaccaggttggccgacttgctcgatcaacacgagtatatgactcataccatcaaacttgattcatatttgacaaccaaattcaatctttcggttgattccattatgcaagtctgttttcagattgcctattactctttgtatggtcgaattgttaatacattggaaccaatcactacaagaaagtttcgtgacgcaagaactgaattagtggccgttcaaaatcaatcacttgccaatttggttaaactttacatcaccaatgctagtccactggagaaatttgaggcattcaagaaatgttgtgctttgcataaaacacagtatcatgatgccatgctgggtaaagggttcgaaagacacttgatgacaattgtccaagtggttaaaaaaccaaaagtaatagctcgtttaaatcaagttaatactcatttaccaccaatcccagaagatttatgtcaagctggaatcaatttgccattattgttaaatccatcaattgataaattactgagtcctgaattgttggtttcaaattgtggcaatccggcattacgattatttggaataacccctgctattgatcaaggatttggtattgggtatattatccaccgtgataaagttttaattactgtctgctccaaacatagacagacagcaagatatttggatactttccatcgcgtggttcatgatataaaaatccgcttacgtgccagtagcaactttttattatcaatcagtgattccgaacgaagaaaaaatgaacttcaaagattaagaattgaacatgaattgagtaatgtttctttggatatccccacaatgaaacacccaattccgttgacagttggtaaaagtgaaatttcgattgataatattgctcttgaaacagcccgtactggccgtgccacgagatcagaagagaagagtttagga

SEQ ID NO: 3500 - DNA, 1020 bp, Candida albicans
acaatggcaggaaatagtttagctgattcattaactcaaccattgaacgatcaattgaaaaaagcaaccgataaattgaccggtggtggtagtggtggtgccagttcaagttctggcggtagcaaaatcaagttgtttacccctgaatattatgctgcttgtaccgttggtggaataattgcttgtggaccaacccattccgctgtcaccccattggatttagtcaaatgtcgtcgtcaagtcaatgccagtatatataaatcaaacattcaaggatggaaaacaattttgaaaactcaaggagattcaattttcactgggattggtgccacattcattggttacagttttcaaggtgctggtaaatatggattttatgaagtatttaaaaagaaatacagcgatttagttggacctaaagttgctcaaaattatcaaacaggaatttttttggctgcttcagcctcagcagagtttttagcagatattgccttgtgtccttgggaaaccattaaagttaaaactcaaacgacaattcctccttatgccaattcggtatttgatggatggaagaaaatcgttgatactgaagggtttggtggattatataaaggtttagtaccattatggtgtcgacaaattccttataccatggtgaaatttgcaagttttgaaaacattgtcgctggtatttatagttatttgggtaaaccaaaatcagattatacaaatttacaacaaactggtgtttcatttttgggaggttatattgctggtattttctgtgccattgtgtctcatcctgctgatgttatggtatcaaaaatcaataatgaaaaactgcctaatgaatctatcggtcaagcaatctccaaaatttatagtaaaattggatttgctggattatggaatgggttgcctgtgagaatcgttatgattggtactttgactggattccaatggttgatttatgattcatttaaagtttatattggtttgccaacaactggtggtcattaa

SEQ ID NO: 3501 - DNA, 1137 bp, Candida albicans
ataaccataatattcacaaattatataatgattaataaattgaaaatagattttggaaaattcaagattgatttgaaacttttgggagatttatttgtattagctggggcaggattatcagtttattatattttgaacacaatactaaatgattatttagacaacacagtcaaaaataaagaaaacgagcagaagggaagtggaatattaaagaaaattcaagctgccaatcctcatttaaagaacttgtcatttaatcaatatgaaaaggcattattgaattcattagtgacaccagaagaaatagcagttacatttgatgatattggtgggttatcagatatcattgatgaattaagagaagctgtaattttgcccttaactgaacccgaattgtttgctgctcacctgagtttaattcaatctccaaagggggtattattctacggtccacccggatgtgggaagacaatgttggccaaggcaatcgccaaagaaagtggtgctttcttcttgctgatcagaatgtcaagtattatggataaatggtatggagaatcaaacaaaataactgatgcaattttctcattggctaataaattgcaaccttgtatcatatttattgatgaaatagattcgtttttgagagacaggtcttcgaatgaccatgaagttagtgccatgcttaaagcagaatttatgacgttatgggatggtttaaaatcaaatggtcaaataatggtcttgggtgctactaatagaaaaaatgacattgatgaagcatttttgagaagaatgccaaaaacttttgccattggtaaaccaaatgcgtcgcaaagaaccgcaatcttgaataaaattttgaaggatgcaaaattagatgaaaacgatttcgatttggagtatattgttgccaacacaagaggttttagcggttctgatttgagagagttgtgtcgtgaagcggccattttgcctgtgagggaatacattaaagaaaactataactacaagagtgggaagttgagtcgagatgaaaatgatgacttacctgttcgaccattaaggacactggacttcacaaaaaactcgggaactgtgaatggtgacattttgccaagtgttgctctagattaa

SEQ ID NO: 3502 - DNA, 534 bp, Candida albicans
attatctatcgatctcatacgtgttgtcacatatatatatatcatatcatgaacaaaggattaactataactgctattgcagcggcagctattgcaggatacgctgtatattttgattatcaacgtagaaattcagccgatttcagaaagtccttgaaaaagagagaagtcaaacaaaagaaattgaaagctaaaaaggaagccgaatccaaacaaaataaattggaagcagtcaaaaaggccttattggaagatttagctcaaaaccctattccaactgatttgactgaaagagaagcattttttatggaacaagttgctgttggtgaacaaaaggcaaaagttgatgccattgaagctgctatatgtttctataaggctttggcagtttaccctaatcctactgatatcttaggtatttaccaaaaaaccgtacctgaagaagtatacgaattggtcgtgatgatgatagctgtttatccaccagcttctctttttagtatgtcttcaacacggcggtggaagatccatgct

SEQ ID NO: 3503 - DNA, 783 bp, Candida albicans
acaactacatacatcgcaaatatgggtttcctaacgaatttcacaaacttcaagaccatcgtggcaagtataaaaaaatacatgcgatttattggaccggggctaatggtgagtgtggcatatatggatcccgggaattattcaactgccgtagcagctggctctgcttataagtacaatttattatttctgattctattgtccaactgtttagctattttcctacaaatattagctgccaaattgggtgctgtgacggggttggatttagcagcaaattgtaaagctcattttggttataaaacaaacttgatactttatgcccttactgaaatagctatcatagcaacagatttagccgaagtggtggggacggctattgcattaaatattttatttcatttaccgttatttgtcggtgtgatagtcacagttattgatgtgctcattgtactaatggcataccgtccaagaggtccacttttgttcatacggatctttgaatcatttgtatcggtattggtatcagctaccgttgtatgctttgggattgaattgtatcaagtgagtcatgattcatcaatacatttttctgtagcagaggttatgaaaggtttcttaccaaatgaagatgtagttgatatgtctgatagagaaggcggtaatggtttatttttaagtgtggccattttgggtgcaacagtgatgccacattcgttgtatcttggttctgggttagttcaagccagattgaaagataatgatatcagaaaaaaattgggg

SEQ ID NO: 3504 - DNA, 1233 bp, Candida albicans
  unsure (94),(195): Identity of nucleotide sequences at the above locations are unknown.
gaaaaatatgaagatgccatgtttgatttaactgctttaactatttatgtgggtttttctaataaatcaattgaacaagttttagaaagagttntaagaaaacattcgattaaaattgttgaactgacacctaaaaaattgattttaccatcagctgctactattggatcattttttggtgcttttgttgaaganacagaacctgaaggaattaatgaatctcatgaaaatgaaggagttaaagcattatatactgctttacaaaaaattaatgccaacactcaaaatggttatgaagaagctgatgaattgatttctaaagctgttactgaattggaatctgcaattgaatctgctacagaattaaaaccagttttggcaattgctttagaatatttagctgcattccaatttttgaaaaatgatccagttagtgctgctgaatcaattgaaaaagccatttcattaaaaccaagaccaagagcttatgtattccgtgctttaattaatgctgataaatcatcttatgaagcagcattaaaagattttaaaactgctgaagaattggatgataaatgtcctgatattttctatcatttaggtcaattattttatttaactggtgatttaactaatgctgaaattaattttaataaagctaaagaattacatccagataatgtttatgcttatattcaattagcttgtatcacttataaaaatggacaaattgaattagctaatgaaaaattcactgaagctaaattaaaattcccaacttcaccagaagttcctaattattatggtgaaattttagctgataaaggtgatattcaaggtgcttgtaaacaatttgaaattgcttctagattacaagaaaaactcgatagattttctgttggagcattaccattaattaatgaagcaacggttatatctagagaatctttagaaaaaattggtgaagctgaagaattattaactaaagcttgtgctttagatccaaaaagtgaattagcaagaatttctttagcacaaattaaattacaaaaagatgaagttgatgatgctattgtattatttgaagaaagtagtgatttagcaagatcaattgaagaaaaaattcaagctacttcatttgctgaagctactaaaatgcaaaaaagaattaaaaatgatccaattttaaataataaaattgctgaattaatgagacaaagtggtgccatgtaa

SEQ ID NO: 3505 - DNA, 963 bp, Candida albicans
agacttatatatatggagttgaacacaaccgacaagcaagtgcatactcgccgtttttcttcacgtgaaattgaagttatatcaggcttgcttgctggattctcaacaacaatcgtcacccaccccctagatgttatcaagatcagattacaattatctcgagatacacccaaaactacgcatcctttggaatcaataatatctgtgatcaaaaagataaaccaagatgcaaaagtagcatacaaattgaatcacaagcccaaggcattcaattatttgatccagtactatcgaggaatcactccaaacttgatcggaaacatttctgcttggggtatctattttgccttgtatgccgaatttaaaagtaaagttaagacaaacaatactacaatgaattattttgcctcgtcggtattagcggggttatcgacgtccattataactaatccattatgggtgttgaaaacacgaatattaggaagttcaagaaatgaatccaatgcttatagatcagttacagatggcataagacaaatgctagcaaaagaaggaataaccagcttctggaaaggaaccattcccagtctttttctggttgtacaagcaagtttacaaattaccatctatgaccatatcaaagtgtatttactgagtcctcatcataggtcagaaagtattggtgcaacgtctcatttgtcaacttggcagtacttgtattcttcagcatcgtcgaaaatcattagtatgttgattctatatcccacccaggtcgttagatcacggctacagtattcccaagactcttcactgagtattgtttccatagttaaagagttgtactataaagaaggaggattaaaggggttctacaaaggaataggtgcaaatattctaagagttctacctgcaacgtgtgttacttttgttgcttatgagaacgtcaaaagatatcttatgtaa

SEQ ID NO: 3506 - DNA, 348 bp, Candida albicans
ggcggattggcactcgtggtgaatacggaggcgaataacaaacaatttatccaacagggtcttttctctgatagcagagtgttggatatcaggggggttgaaattgtcacttgtaaaagcttgcaaccaaacgatgttccagttattgttgttagttgcagagcccaagagattcatctttatagaaaagccaaaaccggtgaaattgctgccggtactgaagaccacattcaattgagtacctacgccatggtgttgactagaatacctgaagaatttgacaataaggtcactgatgggtggaagatagttgaatttgcccgtggtggttcaagaccattccattaa

SEQ ID NO: 3507 - DNA, 447 bp, Candida albicans
aaaaatttttttgaccaactagttgtacatagtaatacatattttgtttttagagtataccaaaccatgctaagatcaggtataataaaggcccagcctgccacggctattataagaccgttatctagatgtttccactatacaaatattaactttaacgacaagccaccgtcgtctgactcacctttaaaagttttctttgacacatttaaaactgaagtgaaaaagtcgaacgaattaaaggaaaacataaaggcattacaggatgagtcagggagaatggcagaatctgaagcttttaagagagccaaagaagcctatgccaaggcacagttgggtagtactgctgccgggaaagttttaaagaaaggtgctgaaactgttggggatgctgcgtacaaggcatgggagtctcctgttggtaaacgtgtgagacccggtgtttaa

SEQ ID NO: 3508 - DNA, 513 bp, Candida albicans
  unsure (415): Identity of nucleotide sequences at the above locations are unknown.
aataatactcatactcatactcatacttatataaatatgtcagctgatcatactagagatccatgtccaatagtgattttaaatgattttggtggtgcatttgccatgggagtcattggtggttgtgtatggcatggtataaaaggttttagaaattctccatatggtgaaagaagttatggtgcattatcagccattaaagctagagcaccagttgttggaggtaattttggggtttggggtggattattttcaacttttgattgtacagttaaagcagtacgtaaaagagaagagcttggaatgctgtcattgcgggaatttttcactggtggggctttaacaattacaggtggttggaaacatacaagacattctgccattacttgtgcttgtttattaggaatttccgaancgtttggtatgatgatgcccacattacaagcccaacctaccatggctccagtttatcccaaaaacatactgctcttggtgcgtaaaaaattatattga

SEQ ID NO: 3509 - DNA, 945 bp, Candida albicans
atcattaataactattcaacaatgtcaactccaagtgaatataaactccctgaatatactgtcaaagattacgcttcatttgccttagctggtgatattggttgtgtgccaactcacggtgccatgactccaattgatgtcgtcaaaaccagaatccaattggaaccaactgtctacaacaaaggtatgttgggttctttcaaacaagttatcaaatctgaaggtgctggtgctcttttaactggtttgggtccaactattttgggttactccttacaaggtgctttcaaattcggtggttacgaattgttcaaaaagacttttattgaatacttgggttacgatactgctaaacaatacaaagattccatttacattggttcatctgctttagctgaattctttgctgatattgctttatgtccattggaagctaccagaattagattggtttctcaaccaacttttgctaatggtttgattggtggtttctccagaatcttgaaagaagaaggtgtcggttcattctacaatggtttcaccccaatcttgttcaaacaaattccatataatattgctaaattcttggttttcgaaagagccaacgaagccatctacaatgctatcccaactccaaaagtcgatttgtccactgctgctcacactgctgttaacttgggtgccggtatcattgccggttgtgctgccgccattgtttctcaaccagctgatactttattgtctaaagtcaacaaaaccaagaaagctccaggtcaatctactgttggtttattgatccaattggctaaacaattgggtgtttctggttcatttgccggtttaccaacaagattggttatggtcggtactttgacttccttacaattcaccatctacggttcattgaagaaagctttgaactgtccaccagccgttgctttgtaa

SEQ ID NO: 3510 - DNA, 780 bp, Candida albicans
  unsure (173),(176),(750): Identity of nucleotide sequences at the above locations are unknown.
attatgtctaaagctgttggtattgatttaggtacaacctattcttgtgttgctcattttgccaatgatagagttgaaattattggtaatgatcaaggtaatagaactaccctttcatttgttgcgttcactgatactgaaagattgattggtgatgctgccaagaatcaagntgntatgaacccagcaaacactgttttcgatgctaaacgtttaattgggagaaaatttgatgatccagaagttataaatgatgctaaacatttcccatttaaagtcattgataaagcaggtaaaccagtgattcaagttgaatataaaggtgaaactaaaacattttcaccagaagaaatttcttcaatggttttaacaaaaatgaaagaaattgctgaaggttatttgggttctactgttaaagatgccgttgttactgttccagcttatttcaatgattctcaaagacaagccaccaaagatgctggtactattgctggtttgaatgttttaagaattattaatgaacctactgctgctgccattgcttatggtttagataaaaaaggttccagaggtgaacataatgttttaattttcgatttgggtggtggtacttttgatgtttcattattagccattgatgaaggtattttcgaagttaaagccactgctggtgatactcatttgggtggtgaagattttgataacagattagtcaacttctttattcaagaattcaagagaaagaacaangaatcttcaccacggggctggaaggtcacg

SEQ ID NO: 3511 - DNA, 696 bp, Candida albicans
ttcaattcaattgataaatcaactaataaattaatcatgtctaaagctgttggtattgatttaggtacaacatactcctgtgtcgctcatttcgctaacgatagagtcgaaattattgctaatgaccaaggtaatagaaatactccatctttcgttgccttcaccgatactgaaagattgattggtgatgctgctaaaaatcaagctgctatgaacccagctaacactgttttcgatgccaaacgtttaattggtagaaaattcgatgaccacgaagttcaaggtgatatcaaacatttcccattcaaagttgttgacaaagccagtaaaccaatgattcaagttgaatacaaaggtgaaaccaaaactttctccccagaagaaatctcatctatgatcttgggtaaaatgaaggaaaccgctgaaggtttcttgggtaccactgttaaagatgctgttgtcactgtcccagcttacttcaatgattcccaaagacaagctaccaaagatgctggtaccattgctggtttgaacgttatgagaatcattaacgaaccaaccgctgctgccattgcttacggtttggacaaaaaatctgaagccgaaaagaatgttttgattttcgatttgggtggtggtacttttgatgtttccttattgtctattgaagatggtattttcgaaattaaagccact

SEQ ID NO: 3512 - DNA, 627 bp, Candida albicans
ttcaagtgtttgaaggtgaaagagctcaaaccaaagacaacaacttgttgggtaaattcgaattatctggtattccaccagctccaagaggtgttcccacaaattgaagttactttcgatattgatgctaatggtatcttgaatgtttctgctttagaaaaaggtactggtaaaactcaaaagattactattactaacgataaaggtagattatctaaagaagaaattgaaaagatggtcagtgaagctgaaaaattcaaagaagaagatgaaaaggaagcttctagagtccaagctaagaaccaattggaatcttatgcttactctttgaagaacactttgggtgaagaacaattcaaatctaaattggatgcttcagaaattgaagaagtcactaaagctgctgatgaaactattgcttggttagatgccaaccaaactgctactcaagaagaatttgctgatcaacaaaaagaattagaatctaaagctaacccaatcatgaccaaagcttaccaagctggtgctactccttctggtgctgctggtgctgctccaggtggtttcccaggtggtgctgccccagaaccatctaacgatggtccaactgttgaagaagttgattaa

SEQ ID NO: 3513 - DNA, 291 bp, Candida albicans
ttttgttgtggggacatttcttccaagattcaagaattgttgttgttggatgtcgctccattatcattgggtattgaaactgctggtggtatcatgaccaaattgattccaagaaactccactattccaaccaagaaatccgaaactttctccacttatgcagacaaccaaccaggtgtgttgattcaagtgtttgaaggtgaaagagctcaaaccaaagacaacaacttgttgggtaaattcgaattatctggtattccaccagctccaagaggtgttcccacaaattga

SEQ ID NO: 3514 - DNA, 477 bp, Candida albicans
ggaaacattggacccttgtttcccacctcaagtttcaaaatttcagagccagccattaggttacaaaatttacgtaattcacatctatgtgctaattgggaagacgacgacgatgaacaattacaacaattccatttgcaaaatgaagagaatagattgttgattggtgaaaataccactaatttggtttattcactgccaccaacatcgaatttaatgtctcgctcaaactcggtttctgccactaatggtgtaccagatagtctgtcgtcgtcttcttccactaccattgctgcacaacttccattagaagtatatgaagatcttaatcaagatatttttcgaatcaagggatataaagacttcagcaatagtttggatacgtcttttgtggcggtattggtttgggtatttgttgcctctttgaatttatacttgatcggaagcatgcttcttggttatgatgtaccattatag

SEQ ID NO: 3515 - DNA, 741 bp, Candida albicans
  unsure (456): Identity of nucleotide sequences at the above locations are unknown.
aagggtcgagattacgcagaatctccggatggttcattattgacaaacaagtatacaccttcgtatgcagcaatcaagtattgtttgaattactcgtatgttgaattggttctgtcgttgtttattgttgctgtgtttgtgaactcggcaattttgattgttgccgggtctactttgtatggcaaaccagatgcagccgatgccgacttgttgtcaatttatgaaatgttgtcctattatatctcacccgctgctgggttggtttttgcattgtcaatgttgttttcgggacaaagtgctggtattgtatgcactatggcagggcaaattatcagtgaagggtttatcaattggacattagaaccttggaagagaagaatcataaccagagtattggcaattgttccagttatagtggttgttggaatcttgggtagagagggtgtttcaaaagtnatgaactcttcccaagttgtattgagtttcattttaccaattgtcagtgcaccattaatttatttcacttccaaaaaagaattcatgacggtgatagatacatctctgacagacgagtctaccccacttttagaagaaaatgatcttgatgaacaaattccagtgaaaaaaatcagttttgaaaacggtagtctacttcgtaatgctagtattctcacctgggttatcattacaggtttgaatgtctatttaattattgcatttgccaatggggctgatatttaa

SEQ ID NO: 3516 - DNA, 921 bp, Candida albicans
tcatcacgaattatgaatcaacaacaacaacaaccactactaaaacgagttgctcattctgtgaaaaaatatgccacgtttataggcccaggtttagtggtcagtgtgagttatatggatccaggaaactatctgacatcagtatcatcaggatcgatgtaccaatataaattatgtttcattattttcatggccaatttgtttgctatcattttgcaagccttgtgtgtcaaattggggaccatcacaggtttagatttagcagaaatgtgccgattacatttaaacccaaagttgaaccttttcatgtatttctgtgctgaaatcgccattatagccaccgatttggccgaggttgttggaaccgcgatttcgttggagattttatttgggattcctttattatatggggttgtaattaccgttttggatgttttaattattttaatggcatatcacaaggatggaagcatgaaacagaccaaattctttgaaatattggtatcaatattggtggctgccacgtgtgtttgctttattttagaactttttaaatgtaactttgagccgggatctggctggaaaatatttaaaggatttttaccggtcaataaagaaatattcaaggagtcgatggcgttgtttttgagttgtgcgattgttggtctgacagtcatgcctcattccttgtttttaggctccgcattggttcaaccaagattgaaggaatatgatgagacacatggcaccaaagcaaatgttttgcccgttgaaaatgaagacaccacgagattggtgccacctcatcaaccagtagaagggtcgagattacgcagaatctccggatggttcattattgacaaacaagtatacaccttcgtatgcagcaatcaagtattgtttgaattactcgtatgttga

SEQ ID NO: 3517 - DNA, 309 bp, Candida albicans
cgtttatcttcaagaagattgttttcagttaccccaagaagatccaacttgattggtgatttgtacattcaacatatcaaagctttcaaaccaaaagctttgactcaagctgatattgacagtgcagttaaagctttccaattaccagctaaaccatctgttccacaagctgatgtcaatgctgaagccgtcaaagaatacgaagccagtgatgttgaaaccgcttctccaagcactgttgctgctgaacaaactaaacccgatgaagactggtttgtttttgaagaagttgaagaagcagctcattag

SEQ ID NO: 3518 - DNA, 942 bp, Candida albicans
atcatcagtttttttttttttttactaaccttattgaaatccagattttggtatggaggagcagcaagtatggcagcatgtttagtgactcatccattagatttagccaaagttcgattacaaaccgctactaaacctggccaatcattattatcgatgatttatcaaatcattactaaagaaggggttttcaaaatatattcaggattaaccgcttcattattacgtcaagcaacttattcaacgactagatttgggatatatgaatttttaaaagaacaatacatggaatcaatagcaacaactggaggcacagaacaaaaaaaaccttcaacggcagtattgttacctatgtcaatgattgctggagcattaggtggattagtaggaaatccatctgatgtagtcaatattcgaatgcaaaatgattcaacattaccaattaatcaacgaagaaattatcgtaatgcctttgatggaatttataagatttgtcaacaagaaggtataaattcattatttagaggattaacgccaaatttaattagaggtgtattaatgacagcttcacaagttgttacttatgatattgccaaatcaatattagttgatcatattcatatggatccttcgaaaaaatcaactcattttagtgcttctttaattgctggattagtggctactacagtttgttcacctgctgatgttgttaaaactagaatcatgaatagtaaaggaagtactggtggtggtagtggtggtgatggtgttaatgggaatgcaattctgatattaaagaatgctgtgaaacatgaaggtattggatttatgtttagaggttggttaccttcatttattagattgggacctcatacaattgtaacgtttttagtattggaacaattaagaaaatttaaattaggaatgagtcgatcagattaa

SEQ ID NO: 3519 - DNA, 267 bp, Candida albicans
cttggaaagttagaaattgaaaatgtaggaactgtatctaatgaatccaagaaatttgttgacacatggattaatcccaaagccattaatgaagaaaaagtttttactttccaagctgatgctaaacaacatgttgtttacttgtatgatgatgctgatggtaaaggtgttgatagtcacttgtttggtatgaaacaaatgttgcaaccaaatgaaccagttccagaaattttcactgatccaatattcagttattcacaaatttag

SEQ ID NO: 3520 - DNA, 1260 bp, Candida albicans
actcttttcaagaaaaacttccctttttgcttccagcttatttattttcaagaagcatttttgaaatctacaatgtctcaacagattaatccaccattaggctctactgacatagccaagttgagcatcccaacgttgcctcaagtgacaaccgaaccaccaaagcaaaatggattgtggtcatcaaacccagttttcagttacatcaacgatgtttatatcactataaacgaacaccgtaaatcattgggattaaccaacccgggaacaattgaaaacttgaacaaggaggttgcccgtgatgtgtttttgggtcaatatttcttcacagggttgagagctgatttaaacaaagccttttccatgatgccagcattccaaacatcccacactttaagtattggatccaacgttttaccagcctatgctttcagtgccttatatgccaccgatgattatttcttacaaggtaacattgacaatgatttatcattttctggtagaatcaattacggatgggacaaatcaaacatttccaaagtcacattacaattagctcatggacaaccatccatgatccaattagaacaagattatcaagctaatgattgttctatcaatgtcaaaactttgaaccctaactttttatcaggtaatgaattcagtggagttgttgttggatctattttacaatccttgtcatccaagttggcagtcggtttggaaaccatgtactccaagcaaccattagcaccaccagacacagctgtttcttatgttgctcgttataatgcaggcaactggatcgcctctgctcaactccaagctcaaggtgctttgattgcaagtttctggagaaaggtcactgataaagtcgaagctggtttagaaacccaagttgctgccactatgaaacaagttgctgatccattaatgggtgttggttttgaaccagtcattgaaggtcaaactactattggtgccaagtatgaatacagaactgccgttttcagaggtcaattggattcaaagggtaagatcagtgcatttttagaaaagagaatcatgccaactgtttccatattattttctggagaaattgatcaattcaagaatacatctcgtttgggtctgggtttgcaatttgaggctgctggtaatgaacaattgatgttaatgcaacaaggtttagtcgacgctaatggttatcctatcccatgtgctccagctccaggtgcttcgtttatccaagatgattga

SEQ ID NO: 3521 - DNA, 822 bp, Candida albicans
actggtgaattaaccgttggtgatttagtattaattaatcaattggtatttcaattgagtgtgccattaaatttccttggttcagtttatcgagaattaaaacaatctttattagatatggaaaatttgtttcaattacaaaatcaacctatcagaattaaagaaatccccaatgctccaccccttaagttaaacaacaacaacaacaacaacaacaacaacaacaacaacaacaacaatagtttacctggagaaattagatttgaaaatgtactgtttggttatcatccagatcgtccaattttaaataatgctagttttactattcctgcaggacaaaaagttgctattgttggaccttcagggagtggtaaatcaacgatattacgattaatattccgattttatgatataaatcaaggtcgtattttaattgatggacaagatattagtaaagttctgttagaatcattacgtaaattaattgggattgtgcctcaagaaaccccattatttaatgatacaatattagaaaatattcgttatggtagattagatgctagtgatgaagaaatatatcgagtgattaatcaagttcaattaaataaattaattgatgatttacccgatggtgttcaaactattgttggagaacgagggatgatgatttctggtggtgaaaaacaacgattagccatggcaagattattattaaaacgggctccaattacatttttcgatgaagcaacatccgctttagatactcatactgaacaagcattaatgaaaacccttagactggtttttaaacaaacaacttca

SEQ ID NO: 3522 - DNA, 702 bp, Candida albicans
atgtttattagaaatgttaaattgataaaaccatctcccgtgaggtttatatcaccaataccttttagttttcctatttctagatcaattaaaatatcaagtattagatatttcactaataaatcaacttctaatttcaaatcaacttcatcatcatcatcattaaaatcgacttcgacttcgacttcgacttcaaagacaacacccaaaacattactgaaacctccacccaaggtaaaaccaccaatacaagataatgatactactagtagtggtagtagtagtagcgaaaatagtgaatcatttatgttgaaatcattatttaaaaccatttggccgaaaaataatcttaatttcaaaattcgagtaatcattgccttatcattattagttggtgccaaaattttaaatgttcaagttccattttattttaaacaaattattgatacgatgaatattgattggactaatgaagtcggggtatttctgactgttataggaagtttaattttagcttatggtggagctcgatttggtgctgtattatttggagaattacgtaatgccatttttgctagtgttgcccaactggcaattcgtcgagttgcttataatacatttgttaaattattaaatatggatttacaatttcatttaagtcgacaaacttcttcaccacggggctggaaggacccacgctcc

SEQ ID NO: 3523 - DNA, 204 bp, Candida albicans
acaaaaatggcaggtgaatcatcagtatcaaaattccaaatcactttatccgatgaatcaaaggaaagaataatcaagttgttggactattctaaaactgttgctcattatgggtttattccatttgttttatacttgggttggtctgctactccaaataaaccatctatcttgaacttgttatctccattcccatcagcttaa

SEQ ID NO: 3524 - DNA, 822 bp, Candida albicans
agacgaggcgttaaatcgtcatcagtggtctcaaaacaatgctctacttgtaagggagaaggacaagttagaaaaataaagcgtgttgggcctggcatggttgcacagacatatgttgattgttctacatgtcaaggaattgggaagatatatcgaaccaaagataaatgtaaattatgccatggtgcaagagttattgaagaaacaaaaatattagagtttgagatccctaaaggttcccctgaccatgggcttatatacaaaaatggagaatccgatcaatttccaggaaaagttactggtgatgtcatattggaatacaaatgcaaaccacataaagtgtttaccagaaaagatgacgatttgtatatcaaagtcaaagtaccgttagtggactctatatgcgggttttccaagcttgtggcagttcacttggatggaagggggataaaaataacaactccaaaaggaaaggtgatcagacctggcgattatttgaagttgcctggcgaagggatgcctaaaagcacacccaaaaaatcatggttcaattctacggattcttctaaaggggacttatacttgaaggtcgagattgaattcccacgtgataactggtatgttgaaaagaatgatttaaccaaaatcagaaatattcttccaactaagctcactcaagaagaaaaagaggttgatgttccagaagcaagtatcgagttatttactgatttttcgattatagattccaatcagttacccaagtacaatcaggatagaaagtatgaacaacaggggtacgagcaatcatgtgcccaacaataa

SEQ ID NO: 3525 - DNA, 1194 bp, Candida albicans
atttatagagtaatggttaaagacacaaagttttacgatgccttgggggtatcaccaaatgcatctgatgctgaattgaaaaaagcttatagaaaagctgctttaaaatatcatccagataaaaatccttccccagaagcagctgaaaagtttaaagaactttctcatgcttatgaaattttgagtgatgaccaaaaaagagaaatatatgatcaatatggtgaagaagggttgagtggacaaggtgctggaggcttcggtatgaatgccgatgacatctttgcccaattctttggtggtggtttccatggaggtccacaacgtccatctagaggtaaagacatcaagcattccattgcttgttccttagaagagttatacaagggtaaaactgtcaagttggccttgaacaaaactgtcttgtgtggcgaatgtaagggccgtggaggagcagaaggtaaggttgcacaatgtcctgattgtcacggtaatggtatgaaatttgttactaagcaaatgggtccaatgattcaaagattccaaactgtatgtgacaagtgtcaaggtactggtgatttgattgatccaaaggatcgttgtaagaaatgtaacggtaaaaaaaccgagtcggaaagaaagattttggaagttcatgtgaaacctggtatgaaggatggagatcatattacatttgctggagaaggtgatcaaacacctggagtaacacctggtgatgttgtattcattatatctcagaaaccacacccagtgttccaaagaaaaggtaatgatttattgattgaacaagagattgaattggctacagcattggctggtggtgaaattgctttcaaacacatttcaggtgattgggttagaattgaaattccagctggtgaagttattgctccaggatctattaaaatggttgaaggatttggtatgccagtcagaactcacaaaggtaatttaataatccatttcaatgtcaaattcccagaaaataattttgctgatgaagaaagcttgaagaaattggctagtcttttaccaaaaccaacagaagtcaagatcccagccgatgccgatgttgatgactgtaccatggtcccagctaaattggaacaaagtaatccatacgagtcagatgaagaagctcacggaggtccaggggtccaatgtgctagtcaatag

SEQ ID NO: 3526 - DNA, 963 bp, Candida albicans
  unsure (937),(940),(946),(953),(957): Identity of nucleotide sequences at the above locations are unknown.
ccagtttcccaggtcatggttagagaaacttttttttacgatatactatcagtaagcacgtcagcaacaacagaagaaatctccaaatcattcaagaaattagcattgaaatgccaccccgataagacgaaccgtgatccagaattaactgaaaagttcaaacaaattacccgagcttacgaagttctacgagatccaaagcaaagagatatctatgacaaatacggagaagctggcatagatggtacggttcaagagtctacaagtaacacaacggcatcaaacacccgcaatcatagaagaacacactcatttgcgacagacatattttcccaagtgtttcatgatataaacaatatgtttgccacacataatgcaatgtttgaaggtccacaaatgtccggaggatttccgggattttcaagtaaccagcacatgcagaagcacgtagagcctttaggcgagccactagagaacactttgatccacggagaagacatattccacacatgtgaagtgaatttggctgatatggtgtatgggaaagtaataaagttatctttaccaaagaacatgaagtgtgtgcaatgcaatgggtatggtggagtgaatccaaaaacatgcagggtatgcttgggctcaggtaaagtgatgattacatactataaccagttttcacgatttcaacaaagcggcagttgtgctgcgtgccacggaaccggggtatttatcagagatgccgacagatgtgtgtactgtaacatggggtatctagagagcacaaagattctcaaagttgtggttccgccaggtgcaaacactggtgatagaataatcattaagggagaagcagacgaagggagaaatataataccaggagatgtggtaattaagttgaaacaacgacaacatcccccccccccccgcccccccccanganttgtanatggatnatanaattga

SEQ ID NO: 3527 - DNA, 582 bp, Candida albicans
cgcggattttccagcccgtggggaagacacacttctgtggttccaaatggtgctagaaatgctaaattgaatttcttttatcaacaatctgctgtcaatgctagattattctttgacttgttaaaaggtccaattgctactgctgatttagttgttgctcatgatggcttcactgctggtgccgaattgggttatgatatttcttctgctaaagtcaataaatattctgttggtgttggttacgctaacttgaactatggtttagctgctactgccacttctaacttgtctgttttctcagctgcttatttccataaagtttctccattggttcaagttggtgctaaagctacttgggattcaattaaatcttctaatgtcaacgttgaatttgctaccaaatacgctttggataacacttcattcattaaagccaagattgctgattctggtttgactgctttgtcttacactcaagaattaagaccaggggttaaattacgtttgggtgcttcctttgatgccttgaaattggctgaaccagttcataaattacgtttctctttgtcttttgctgcttaa

SEQ ID NO: 3528 - DNA, 675 bp, Candida albicans
cataacgacaacatcatcatgtcttggatatttggaaaatcatcaacaaacaacgacaataacactactaccaccacgaacgatcaatcatcaattaaacaaacattggggtttgatcctaaagaagttgccgatgtcaacaccattatatctacccctggagctatttctgccagtagattacaccctttagctggattagataaaggtattgaatatttagatttagaagaagaacaattaaatactgtcgaaggttctaaaggtttaattccaagtagatcatggactgatgatttatgttatggtactggtgcagtatatttattaggtttgggaattgggggattatatggttttcaacaaggtataaaaacattaccggaatcagctccttcaaaagtcaaattaaatcatattttaaataatattactaaaagaggtccatttttaggtaatagtgctggggtattagctttaacttataatttaattgattctactattgatggtataagagaaaaacatgatgatttaaattctgtcactgctggagcattagccggtgcgttatttaaaagtagtgctggtttgaaaccaatggcttattcttcagtaatgatggctggtgctgctggtatttggtgtggtttaaaaagatttttacaagaataa

SEQ ID NO: 3529 - DNA, 1614 bp, Candida albicans
  unsure (1532),(1613),(1614): Identity of nucleotide sequences at the above locations are unknown.
ttgtttgccttgatttgtcagttttttaaattccgctttttttttttcccactgtcctgcttgaagatcttcggattacaactacttttgttacgaattatttttttttttagatctaatacttgttctgtgaaaagcttttgggaaagggaaactatgttgagatttcgccaaattagattatctcctatttataaaagtcgattaatcaatttccgtagattcaactcaacaaactcgaaaaagcccaaggcagaagaagaagacaacaacaacaacaacgataaatctttgcaacaacataatgtaccagctaggcaagatgataaaactgatgttggatcatttaagataaaaccagcaacatcaagatcagcacctgctcccatggaaaatactggtattgaacaattaatgcataaagacaataaaccatatattcccaaattgcaacataaaagagtatcatttgagtatcccaatttaccaaatcaagatgaatataccaatttagttgaaaaaccaaaatcaataactcgatggacaagatatatacccaaaatattgacagtgattgtattagtatggtcaggttatacatatcatgtatggatgacagatactgaagaaggtgaagatagttctgatttattaaatcctaatgaattccataaatttattgttactcataaagaaaagattgatgatgatcattatataattgaattgactcccaagttttcttattgggaatatagtcatggaactgatccagaagggaaaagtttatggaatggggataaattttggtcagtagaaattaaacaacccgatattaatgtcgttagatcttatactccattaccgctatattatttgaaatcggaatatactcgatcgggtgaacgagaaccattattgaaagtcattaatcctgaaatagatgaatatgataaacatggaacaatgtgtctttatatcaagagatataatgatggtgaagtttcgagatatatcactgatcgtaatattggtgatgaattagaattaagaggtcctaatattgaattcaaatttccttatcatcctttacataaattacataaacgtccaattttcaaagatttaccatcaaaagtcgaagctgataatatgatagaaacagttaaacgagtaaataatttacctgatgttgataatattgtattttatgcagctgggaccggtattgccccaatattacaagtattattttcgaaaaaaccatatttgggccatgttgatattcattattctgctagacatccaggtgaattgggtattttacaaagatttttgtttttcttggataaattggatcgaatcaatattacttatcattatgatgatgatgatgatgatgatgaaccgaaaaccattttaaatgctaaagatattaatccaccgggtataccaaattatattactcccaaaactttggaagaaaaatctaaatttttaactggagatgaaattgaacatttagtattccncgcgaaacacccgatcccccacatgagaaatctttggttgggtcctgaaagaataaaaaattggtctcaaacccaaacatnn

SEQ ID NO: 3530 - DNA, 1080 bp, Candida albicans
  unsure (1038),(1046),(1057),(1058),(1059),(1060),(1061),(1062),(1063),(1064),(1065),(1067),(1068),(1069),(1070),(1071),(1072),(1073): Identity of nucleotide sequences at the above locations are unknown.
tattcccacacacttcaaaagacctatatatatatacccccaatttttagaaatattgataaacatcccattataaaaatgaatcataacaataatacttatcatggtcgatcatcttcaccaccacaggcaagagaactatgtaatctactaaattgtttcttatctcatccaatatataatgattcaacactaccactcaatgagaattcacagaaaaagaacaacacttcgactactagtaatcaaaccgtatcattatcagcagcaggtatgagagctttaatatatcaattacaatcaatttatcttcgtactccaataaaattatttcgaccatctagatttgattatttagcttatgttcgagctcttgctaataaacatgataatattgaaaataaaccttatcgtttcatgactcatagttcattaggaatgattataaatgttgttaggaaacaaggttggaaatttatcccggatcaaatattacctccattaattgcaaattctgctactggagttattttatatgccacttatttaacaacactagattattataccaaacaacatgaaaagaataaagtggaactgcacactactactagtggtggcggtggtggtactgctactactactactactactagtcgggcaaattttaattggtatgcacctatagatacttggagagccggatttgttgctggtgctgtccaatcacttgctgcagcaccagtggatgcaatatatacaagactgacagtagcagaaatgttagaaggatcacatgaaaatttatgggtgtttggatttaataaattacgaaaaattggattaattggagtatttgctggatatggatcttcattggttaaagaaagtcttggatttgcgttttattttctgacttttgaaatcatcaagactcaaggatataatttaacttataaattgattacttattataaacgactggaacaattgattaaatcaaatttgaaaaaaatcttccattgggatgatgataanatgatganaatggaaaatnnnnnnnnnannnnnnnaatgtga

SEQ ID NO: 3531 - DNA, 939 bp, Candida albicans
catcaccaaacacctcttatcatggaaatatttcatcctttgaaagagatcacatttggtgtaatatcaggaatgtggggtaaagtggtcggatttccattgaaaacaatcaaagtgcgattacagtcgactggtagcagtggcggtattacaactctacagatgattaaaacgacatatcacaatgaagggatattcaatgggtttaacaaagggttaaaagctcctatgattggtgcttgtttagcaaatgccatactttttagctcatataattttggatctacagtgataacaaattatttaaacaagaataacgacaaaaatcagtatactactgaaactttgccattcctggggaaaattctagctggtggatttgctggattcatggcgtcgtttgtgttgactccagttgagttggtaaaatgtcaattacaagtatcaaatctaagtctggataaatcacatcatacatacggcacaattatcaaatcaacaatacgagatagaggtacaattggattgtggaaaggtttgaattcaactattgttagagaagtcattggcacagcaatttggtttggtacttacgaatatgtcaatgattattacaaaaaggtcaaggaaccctgtgttagtaataaggatgtacaattgttgattgctggtgccatggctggtgtcacgttcaatttttcaatgttcccagtagacactatcaaatcaaacatccaaacccatgacttattcaacaacaatagaaactcaaacagcgtggggaaacacatgggattctggcaaacaacaagatcgataatcgccaaaccaggaggaatattgaatttgtataatgggttaggaataactatggttcgttgtataccagctaatgcccttattttctacacttatgaactactcaaacaaaatttttaa

SEQ ID NO: 3532 - DNA, 732 bp, Candida albicans
aacatgcatagagctttatataattcattgacaaaaacggcaaatgcttgttgtgtgtctcgttctgtgagatttgttgctccccaagtttcagtttgtaatcctcaaagattggccttccgtttcaattcaactaatgcttccaaagaagctgccaaggaagaagcccctaaagaagaagttaaatctgaagaggaacaatcctctggagctgaatcagaagctcaagaagctgatcctttggccgaattaaaagataaattggaaaagaaggacaaggagttggcttcaatgaaaaatcattatgctagagccattgctgatttccgccatttacaagaaactaccaagactgaagttcagaaagctaaagattttgctttacaaaaatttgctaaggatttgttggattcccttgataacttcaacttggcacttggtcacgttaaagaagatactttgaaattaaatgatgaagtcagaagcttgtacgaaggtgttgacatgaccaagactgtctttgaaaaaactttgaacaaatacggaatagagaaaattgatcctattgaccaagtctttgatccaaatttgcatgaagctactttccaaatggccaatccaggcaaggaaccaggtacagttttccatgttcaacaagttggttacactttgaacgaaagagtcttgagaccagctaaagttggtgttgtcaaatctgaagatgacaattga

SEQ ID NO: 3533 - DNA, 900 bp, Candida albicans
tatactaaatcatatccactgttacaatccacaaaagcaatgtctgaaccaaaacctttaccatttatttaccaatttgtatctggtgctattgccggggtttctgaaatccttgttatgtacccattggatgtggttaaaacaagacagcaattggccactacaaatgattacaacggtactataaattgtttgaaaaaaattgtccgtgaagaagggttttcacgtttatataaaggtatttctgctcctattttgatggaagcaccaaaaagagccactaaatttgctgccaacgatgaatggggtaaattctacagaaactattttggagttaccaagatgaaccaatctttagctattttgactggtgccactgctggtgccaccgaatcatttgtggttgttcctttcgaattgatcaagatcagattacaagacaagacgacaaaattcaatggtatgggggaagtggtcaaagatattgttcagaaaaatggtgtattagggttgtataaaggattggaatctactttatggagacatatctggtggaatgcaggttattttggatgtattcaccaagtgagatcattgatgccaaaaccaaaagattctactcaaaagactttaattgatttgacttgtggtaccgttggtggtacttttggtacaattttgaacactccatttgatgttgtcaaatcaagaatccaagcaggttcaacccaatatagatggacatacccttccattttgaaagttgccagagaagaagggtttagtgcattgtacaaaggtttcattccaaaagttttgagattgggtccaggagggggtattttattagtggtttttaccgcctgtatggactttttcagacaataccatgagaaatag

SEQ ID NO: 3534 - DNA, 1854 bp, Candida albicans
agcaatacattattaattattaatagagtccagttatttatttatttatttattcagttatttatttatttattgctaagtttaaaaaaaaaaaaaattatgagttctttgagttcagaattgaaagccaaagaaattttcaatcaatttgcaacagaaggtgcaaatgaagagaaaatcattactttacctgatttcatcaatgttttatccccatttactactgatatccctaaacaagcattttcacttttatatttgattgctgatgctgaaaaaaaggggtttgtcactgaagataattggttgaaatttgttaacactttgacttcacctgatggtgaatataaattgttgtatcaatttctttctggccaacaaaataccaattcaaaaatcacttattcccaatgtattgatattttgaataaaatcaattcatcaatagatccaagttatcaacagaaacttataaaattgaattggatttatttccccagattttttgaacctaatggatcgattgaatttaatgattttgttactttaattagttatttaccagtaaccaaattgattggtaattttgaaatcactgcttcgaaatcgaaaactgttaatggtgaagaattggttagattattatcaacaaatttaaatcataaactttccaataaattaaaaattaatttacataatgttacggattttttcggtaaacaacaagattatactttatccaatttgttatttatttatgatgctttaagtaaagttgatttaatcaatgaagtcattgtcaatactccaccaacaactaaagataaagatgatattttaatcaacaagactgatttatataatcatttgaatgatccattactaaaatctgccaatttcaaaccagtttcaagattagaacttgatttattattttatttaattaataaaaaaactgatgaagatatccccagaagagaattggtatcatttttaaatccaaattttaataataatttaaatactttggcaccaatttttgaacattctcaaagtaaacattcaacaattgatggtggggataatttttctttatggccactttatgattcattatattcatttttcttggggtctattgctggatgtattggtgccactgcagtttatccaattgatttggttaaaacaagaatgcaagcacagaagcataatgccttgtatgataattcattggattgtttcaagaaaattttgagaaatgaaggattcaaaggattatattctggattgggggctcagttagttggtgttgcccctgaaaaagccattaaattgacggttaatgatttagtacgtggaattggtagtaatgaagatggtagtattactatgaaatgggaaattttagctggtctgactgctggtggatgtcaagttattttcactaatccattagaaattgttaaaattagattacaaatgcaaggtaatacgaaaaatttaagtaaacctggtgaaattcctcataaacatttaaatgctagtcaaatcattagacaattaggattaagaggattatataaaggagctagtgcatgtcttttgagagatgtacccttttccgccatttatttcccaacttatgctaatttgaaaaaacatatgtttggatttgatccaaatgataaaactaaacatcaaaaactttcaacttggcaattattagtagctggtgctttagctggtgctccagcagcttttttcactacacctgctgatgttattaaaactagattacaagttgctggtaaaaacaatgacgctaaatataaagtctgcaccgccggatga

SEQ ID NO: 3535 - DNA, 1152 bp, Candida albicans
aataaaatgtattcaaaaagatctctctgtaactgtattggttggtatgacttttcaatattttccgtattcctcttggtaccaaatctttccccggttcaggtccataatttcctccgcaccggtgcagatctgaaaaaaaataaagaaaaacgtaaaagaaaacaaaaaatatccaataaccttaactataatcaaaatcttaatcgtttatccataaaaacagttgaaagtctattcagattttcaaatttacttgctttctgcctggtcatcctaataaatatgtctatagtggttcaagataaagaagatcaaattttgactcagttggagcatcctcagcccgacaccaaatccccaccaaaatatattgcatatctagcaggtgtttgttccggtataaataagaatttagtgggtcacccgtttgatacatggaaaagtcgattacaaacagctcccaaggggagatttaaaggacctattgattgtgcttggcaaacattaaagtatgaaggaccatttggattttataaagggtttactccacctttagtaggttgggtatttatggattcaataatgcttggatcattgcatacatatcgagagcttgtcaaagactatatatatccacaggaaaagaaattaccattggttggtcatatgatagcagggttgggaagtggattgacggtgagttttgttgctgccccaattgaacaatgtaaggcaagattgcaagtacaatatgataaaaaatcaagaacttatagtggtcctattgatgttgctaaaaaagtgtatcaagcagctgggataagaggtatatattcaggtttgatatcaacgatgattttcagaaccaattttatattttggtgggggtcatacgaaattttcactcaatattttgaaaaaaataccaagatgtcaacaccttcaatcaatttttgggctggtgggttatctgctactgtgttttggatatttgcttatcccgcagatgttgttaaacaaaatataatgacggactctcctattcaatcagaaaagaagttcccaagatggatagatgcggtaaagtatatttataaagaaaaagcttggcgtggattcactaaacgttttggtcccgccatattaata

SEQ ID NO: 3536 - DNA, 777 bp, Candida albicans
aaagtcagattgcaatcggccccagaaggtacatataacggatctcttgatgttataaaaaaacttttggctactgaggggccaagagggttctataaaggtacattgacaccgctagtgggtgtaggggcttgtgtgtctgtgcagttctcggtgaatgaatacatgaaacgttattatgataagagattaaatggacagccaatgtctattatagattactttgtctgtggtggtgttgcaggttttgccaatggatttttagctagtccaattgaacatatccgtattagattgcaaacccaaaccggaaactcaaagaatttcaatggtcctttggattgtgccaaaaagatttaccaaacagacggaattaaaggtatttacaaagggttagtcccaactttgattagagaatctgttggattgggaatatattttgccacttatgaggcattgattgccagagaattgaagacacatcctaaattaacaagaaatgatatttcagcatggaaattgtgtactttcggtgggttatctggatatactctctggattggtatttatcctatagatgtcatcaagtcgaagttgcaaaccgattctataaaggatccaaaatataggagttcattggcggtcataaaagatgttttccgaacacagggtataaggggcttctataagggattcttaccgactatattgagagctgctcctgcaaacggggcaacatttgcagtgtttgaagtaacaattagactattgggatag

SEQ ID NO: 3537 - DNA, 918 bp, Candida albicans
aaagctaatatgtccaatgcagaaactgttttagatacggaaattaccaaatcagttgacaattctttgacaagaaaactcaaagatattgcagctggttttgtgggaggagcaacacaagtgttaattggtcaaccagccgatcttgttaaaataagattgcagacaacatcagctacttcttcttttcaggtcatcaaaaatgttatcaagaatgaaggaattttggctttctacaaagggaccttgcctccattatttggggttggtgtctgtgtgtcccttcaattctacggattccatgagacaaaacgacaaattttacaatacacaggtcagccaagcttgaatttgtggccacaaacttatattgccggggcaatggctggtgtggtgaatacccctgtcacagctccagtggagcaattgcgtatattgagtcaatcgtcagggaaaccagtttccttacgtgaaactgttagcaagatatatagagaacagggtattgtcaatggtatttatagaggatttgggataacattgattcgtgaaatacaagcctatggtgtttggtttttgacatatgaaactttgattcaaaaaataatagacttgcaacattataaaagccgtgatcaaataagtacaccagaattattagctagtggagctattgcaggaaacgcattgtggcttctgtcgtacccactagatgttataaagtctaatgtgcagagtgacgggtttgggaaagatagcaaatttggtggcagctctttaaaggctttgagatatatttattcacatcacggattaactggtttctggagaggtattgtaccatgtcttttaagagctgtaccttgtagtgcaggtacatttgctagtgttgaattagcgttgcggttgatgggatga

SEQ ID NO: 3538 - DNA, 471 bp, Candida albicans
tcacatttccacaaacaatccaatcaaacactacgaatcaatatgggttggttttgggcagataaaccaagccaggacacagttaaagctacaagcttttttaccaccccctcagcatgtcctatagatcattcgaaactcgcttcttcttctccaacatgccccgtcaaacttaacaacgacaatgacgaagttttaaatcctttgaacaacatgcctatggcaatatcatctgaaagagcccctggacagcgtatcaaattatcaaccgaaagaactatatcaactattcctcgtggtgaatcagaagatcaaggactatgggaatatccatcaccacaacaaatgttgaatgccatgttactgaaggggaaaggtgatggtgttcctgaagatgccgtagagagtatggttgaagtgcataacttcttaaatgaaggggcatggcaacaaattttaacttgggaataa

SEQ ID NO: 3539 - DNA, 1845 bp, Candida albicans
caccttgccatcagtattttaatcacaacatctactatggcacctcgaattagacgtaggataactacttctaaacgagaagagattgaaaaagaacaagaagaattatctaaaaccataattcgtccttatgatgttcttcaatcattaccagtatcatattctcaaccaccaacatcaacatcatcaattttcactcatccattaacaataaaagatacaggtactttatattattccttaataaaatctcgtaataattatcttacaatgtgtcccatgtttaaacttttttgggtgaaacaatcatcatacgttaggaaattattagaattagataaaccattacctaaatccatggaaaatgatatatatttaaatcgagaaatggtattaaataatgattctagtgctagagatatcatggtgaaattatgcgatggtggattaagttttagttctgggattcattcatttgaaatacgaatatttatagctaaagataaacgatcagatattaatgaaatcaaattaattaaacaacgagaaaaagaattgaaaaaaattaataaattaaaggaaaaagaattgaaagataaattaagagaagaaaatcgattgattaaagaacaagaacgattggaacgattgaaagagaaggaattggaaaaacagttgaaacagaaacaaaaggaagagaaacaaaagcaaaaggaacaaagagaaaaggaaagagaattggaaagagaaaagaaagagaaggaaaagaaagaaaaagaaaaggagaaagaacggaaagataaagagaaggagaagaaggataaagaaaagtcatctcaactgaaaggaactggaaataatgtcaaggatactttaattgttggggttattcaaaaatctagtataggaaatcaaaaagaagttggaactggagatgctagtacatctaagacactgcaaagtaagaagaaacagactgccaaacaattaaattccaaagacacgtcaaaacaacaaccatcaatttcaactaatcctaaaatcaaactggaaattacaacttctcaatctgaaaatgttaaacaaaaacttaaagtactgacaggaacgcaaactggagaagcggccaaaaccgtcaacaataatcctccaaacatggccacaagtaacaactccgccgtagctggttctcaaactacaccaaaatataatataaactcagaagaaaatcaattaatgattaaaaatttaaatctaatcgctgccagagattcttcattgaatgcacttatgcgtacggtagctctaggtcaagcatcaatgcaacaaattgatgtatttaaagaatatattaaacgtgctaaagccatgggtcctccacctcatgatgattcagtatgggaagaagtttttagaacacctgtttggggaagtgccatcaacaatgaactgcaatcttcacaagaatcaaaaccatcatcaagtgaaaataagaaagataaagatagtgtcgaatcaaaagttaaagaagaagctggtaagacaacacaatccaatgacaaggaaaaattaccaaaggaaacttcttcaaaaaatgaagaaaaagcagaagaggcggaaggacaatccaaagatttggaatcaacagagaaaaaagaattaaatccaaaagataatgtgaatgtgaataagaatgagaatgagaaaccgggattgaaggataaagttgaaactaatgagaaagaatccaaaccaaaggagaaggaggagattaaagaccaagaggaacaaacgaaaaagaacagtcaagaattaaagaaagataaagtagaaatagatggctaa

SEQ ID NO: 3540 - DNA, 1728 bp, Candida albicans
  unsure (157),(170),(175): Identity of nucleotide sequences at the above locations are unknown.
gaagagaaggaaacagataagctgaagatagaaaagaatgaagagtcagaaaaaaacaaagctgaagaaccaaagaaagacaagagtgaagagtccacaaaaagtaatgaagaatcgaagaaagatgaagaatcgaagaaagatgaagaaactctgnaggagaaagacgnagatnaaacacaagcaaacgaagattcaacaaagggaaagaaagttgaaatagatgttaaaaaagaagacacaaatgaaaaagagataccaccagaaactaaactggataaagacttgaaagatttaccatcaaaagagaaaaagaaatcctttgaaaaacctccaaaagtgaaaaaggagaaactaccaaaacaatcaaaacactctaaagcagaaataccagatgatcaaaaattgacagcatttcaagaacgatacttggaagatgctacattattgtttgaatttgttgaaaatccaaatgtaagatttttattacctaaagatgcaatatgtgaagttcttcctgctagtactatgattaatgctgaaaatgggaataattctgataatagagatatattgatgagttttatttggatacataatcaaaaggaggttgatgaatatgaaaagaaattggaagaatataagaagaaaaaagctgaagaagaagagaaaaagagacaaaaagaaaaagaggaagaagaagaagaagaaagaaagaataaagaacaactagagaaggaaaagtcaaatgagaagaataaagaaggtgatgagctgaaactggtccaatcccttgatgaagtacaagaaggacaatcaaaagatgtcgaaatgggagacaacacaactaatactgtaaaatctgaaaatgaagtgattgaaatttctgatgatgtacaagccacagaagaaccagaagaaatcaaacaagtaattgaagaaattgaagaaactgaagaaactgaagaaattgaagaaattgaagaaattgttcctgccaagagaagagcaccacctagacgtggtaaaaagaaacgtagagtcccacctccaaagaaacccactacccctaaaccattagaacctccagtagaaccagaatatagattcacaacattatcattcaccatacatggaataccatcaaaattagttccaatatttatgaatagtgtgaatcctataaaggaagttcaaacaaaaatgaaacatatacttgaagttggaactagaacttcatcattttatttatggtatcaagtagatgggaaattagatgaagaattggcagaaaatattcgagttctgcttaatcaagaagaaaagaaaatgacgggtattccaactattcaacatgaaactccatcagaaccgaaaaaataccctaaaaagagaaagattaaagaagaatctaaaactggtaatgaacaaggtgatgatgatttaggtgaaaataataataataataataataataatagtaagaaaataaaagtggaatctatagaagataatgatgaacaaaatgaaagtaataaaagtgaaaatgaccgtaaagtaagagatgagtcgaatgaacttgtactgaaagatcatgacaatgatgaatctcaaccacaaaatgaagatgttaaagaagcacctgttgctactgatactgtggattctttaatcagtgatcaaattgaacaaactccagaacccattaaagaaaactcctcaacataa

SEQ ID NO: 3541 - DNA, 1563 bp, Candida albicans
ttcatattcgaaatgtcaccacacgatataattgaagataaacataaatcatttattcatgcatcacctattgaatcaacttatccaactccgaaaaatgtacctattatatcaacagcagaaattttcaaaaaatctgatcctaatgcaaattttataacgccaactaaacccagtagaagtgctggatcaaatgaagattctatgagagaaaatgatatggaacatgcgaatgaacatgtgaatgggaatgcaaatattaatggacatgtgaatggaaatgcacgtcaagtgtctgataattctgatagattgagcttaaaaaacgatcgagcaccaagtactgctccaacaactcctaaattgaattctattggtcaaaataaggagaaccttgattttttccacgattatgtaaaagaaatatcatcattgaaagcacaaaatgaagtttggaaaactaaatttgacaatttgaatgaatgttatcaacaagaattacaacaacgtgaaaaacaacatattgaatatgataaattgaaagaaatgtatagaaaagaaattgaggagaaaaatcaacttaaaaaagaaatacaattaatgaatacaagaatacaaatattggaatatggagaagaaaatttgaaattgttagtagataaatataaggatattgctacacaattaaaagagaataataatcaatcaccttcaaaaatgcaacgatcaccatcaccagttgataaacaagactctaaacacgcagaacatcctgtaagtgatttgatttcatttgataatttggaagaagttaaaacaagcactttgcccaagaaaatcaaccatgccgtacaaactgaacttaggaattttaatataactgcgccggtatcaaaaccaagctgtacgtgtaattctaataaagcaactcaaactttgaatacttcttcaacgaaaataaataaagctatacaaacaattcaaatacaagaaaagacaccacaacaaccatctgaacagatttccaaaccagaatttgcatcacaaacagaaaataaattaacacctgaacaaacaacaattcaagtagcaacaacatcattatcattaccaccttcacaaccagccacagcttctacggccaataatgaaacaattaataaagaaactcatgaatcatcaccagtatcagttttccccgaattttcattatcatcatataatagcaaatttcataattattataaacaattacatcttgatcaaattgatgaattgaataaacgtgatttacaatatttaattaaaacaacaatgtgtcaattcatgattgattattataatattgatgcatcattaattagatatgcgagatttttatctatagtgtatcaatttttgaatgatttacatttgattatttatcctggacaaattttaaagagttcagattactatcgtggaagagtttatcgtgatggtaaaattgatgaagaaatgattggattaaaagaatgtcttaatggtattcaaaacaaaattcgagaaactcttggcgaataa

SEQ ID NO: 3542 - DNA, 669 bp, Candida albicans
tttaattcaactggtttctttttttcggggttagtttttcaaatgtatacatatatggaatacttacagaaatgtttttataaatcaactaattggaatgaagacaatatatattctaatattactgccacatctcaagctttattagatttccccatacccaatggatttaaaattgattcttcttcgaaaactacagattatctggcttcatcattcacattatctaatcatcatcaaataaatgggtcattagcatatttatattcatccattccattaactaataccatggggactaaagatgtttcattacaagatgcaattgctggatttcgaataattgaacctctggttgggttaagatctaaattgaaaaacaatattatgtcaaatcgaagttctttattatatggtagaatgtatttccctggttcagctcttgaagcaatgataatcaaacttcttacgaaaaacagtcaattgttaattaaatgtgttaataatccacatctagaaaagaatggaaccatgattgtatatttacaaaacaatacagcaaaatatctgagagaattaatttattctactaatgaagcattaattggattacgatgtttatataatcttggtgatttcttaaccgccgggctggaagatcatgcgctc

SEQ ID NO: 3543 - DNA, 843 bp, Candida albicans
tataatcttggtgatgccacatcacataattttaccaatatcaaccctgctgtgattcccaaatttgataattctgtggtatcgataggaacagaaatatggtatgccgcaagaacaatgagtcctggattatcagcagcattaagatattcaactcgatcaacatcaacggggaaacctcttactatgacattagctataaatccaattgttggtcatgtttcatcaacttataccgttaaaacttcagtggcatctactttttgttcgaaatatgatttcaatgtattttcttatgccagtaatttatcattaggatttgaattatacagttatgccaataaaaagaaaaattcatttcctagttttgaacatcatgaaatccattcttctagtgaagaaaataaatatcttaaaaaacatccagaattacaaagacatcataatcttcatcataatcttcatcatcagcgtgttccaataaaatctcataaatatgaaggtaatagaaccataataaatccaatacaaaacttggataatgtatatcatatcaaccctacattgttatcatctaatggtagcacttctactaccaccaataatgaaaacaccaacaccagcgagacagtgacagccgcatttcaaaatttggttaatgaaagtgatttctcaagtgtttttaaattttcaactagtctaaatgataaagtagtaaagattttatgggaaggtagattaaaagaatttttagttagtacaggagttaaattatctttaaatccaattacaaatactcctgaattcaacaaattaggtatatctttttcatatgctctttaa

SEQ ID NO: 3544 - DNA, 672 bp, Candida albicans
agaggattcgtttttactgtgaaacaaggcatgttcaaccaattcaaatcagcctcagtgttcaatagcatatttgggtctttcagaagattcaagcatgaatatgctcctagatttaaagaagtggagaaggcccaaaagggaagggtgtctgttagaactggtggttcaattaaaggaaattcactagaatttggtaaaataggattgagattaaaatcccaaggtatcagaatgcatgctaatcaacttcaggcagctgataaagttttaagaagagaattgagacctactaaatccaaattgtatacaagatttgtgtgtgacttggctgtgtgtatcaaaggtaaccaaacaagaatgggtaaaggtaaaggtgctttcgatcactgggcaagtagaatgccaacaggtaaagttttgtttgaaatagatggaccaatacatgacaaggttgctagagatgctttgagaaaagctgcagataaattgcctggactatacgaaattattactccagaatccaaagttagagtgagtttgactcacttgattgataaaccagaaccagtggattacgtcgaaaaacttaatgccaaacctacaaagaaatgggcaaatgtccaggcatatcacactgttccaatgtataaacaatacagtggaagataa

SEQ ID NO: 3545 - DNA, 2517 bp, Candida albicans
ggcggtcttccaccccgtggtgaagatgtccatgaagttggtacattatgtcaaattatcaaaacaactgggagcgaaattttggtgtatcctcattatagagtcaaattagtagatatcagtactccaaattctagaagtgaaagtattgagaaggaacaagacaattctcaaacgtcttatttaaagaagtttgaggtatcgtatgctgtaacacaacagttaaaggatgagccttacgacgagcaaagcataaccatcaatgcatggactcgaagaatcaaagagttgtatgaaaaacttgccccaaagtatgatcaacctgaaaacaaagaagagattatgagcaatccttccatgcttgctgattttattgcaagtaaagttcacgcaaagcctgaacagattcaagaaattttggaatcactgaatgttgagactaaattggagctttctttacaattgttgcaagtagaagcagacgccgatgaaatgagacaaacagctcttaaaaatataagagagcgtacagagaaagcttatgcacagagtttaatcaaagaatataccaaggaattgttgaaggcagctggtattggtgagaattcaaaagtgcacaagtttgatgaaagaatcaaacatctcaaaatgcccgaagaggcaatgaaagcgtacaaaacagaaaaggaaagattgggaacacaaagtgacatggagcaaaacgttgttgaaagatatttggactggttaacccagattccatttggtgtttacactaaagattcctttaatgtaaagaaggcccgtgaaattttggacagagatcattatggtttgaaagatgtgaaagaccgtattttagagtttatctctgtaggtaaaatttccgggaatgtcgatggtaagattttgtgtttggcaggccctcctggtacaggtaaaacttcgattgccaaatctattgctgaggcattaaacagaaaatacactagaatcgctgtcggtggtgttcaagacgtacatgatgttaaaggtcacaggagaacttatgttgcatctattcctggtaggattgtgactgcattgactcaagctaaaacttcgaatccattgatgttgatagatgaaattgataaattagatactacatcacatggtggtgctgcgagggcatttttggagattttagatcctgaacagaataattcttttgtcgataattttattgaagtgaaagtagatttatcaaaagttttatttgtttgtacagcaaattaccttggctccattccgggcccactaagagatcgtatggaaataattgaagttaacgggtacacaaagaatgacaagattgaaatcacaaagagacatttaattcctgcagccgcaaagaaggttggattggatgaaggtcgcgtagtgatccctgatgaaactatttccagattaattgacaagtactgtcgtgaaagtggtttgagacatatcaagtctttgatcaatagaattttcagtaaagcttccagaaaaattgtagaagaattggaagaaactgatgttgatagtcacaacaaagatacagtcgaaggaactcttgttgctaaagaaagtgagaaagtaatatccgacaaagccaagattgatactgaaaacttaccaatagaatatatccaaagcaatactgaagttaaagcagagacaacaacagaaagccaacaagaaaaagaaaaagaaaaagaaaaagacgaagaaataaagaaattggatttgccagcagatttgaaaatagaagttaagccagagacattaaaggattttgttggaccagaaatttacataaaggacagactttacgaaactttgaatccaggtgtagcaactgggttggcctataatacatctggagatggtgatgcattgtatattgaatccattttaacagattccattagttccgaccttggaaatgccggattacatgttactgggtcattaaaggatgtgatgaaagaatctgcatctattgcatattcttttgccaagcagtttatggtaagacagttccctgataacagattctttgaagcagctcacattcatgttcattgtccaggaggagcaattccaaaagatggaccatcagctggtattgcctttacttcatcattggtttctttggctttgaacaaatcattaccaaacgatactgcgatgactggtgaaattacgttaactggtaaagtgttggctataagtggtttacgacaaaagtcgttaggtgccaaaagagctggttataccaaaatcatttttcctaaagattgtgaataccagttggatgagatcccagacgaagtaaaggaaggacttacttatatccccgtggaatggtacagcgaagtttttgaacatttgttccagggaatctctaaagaagaaggaaactcagtttggaaagaagagtttgccaaattagaagacaagaaaaagagtaaaaaaacaaataccaaataa

SEQ ID NO: 3546 - DNA, 1074 bp, Candida albicans
ttcaggtttgattggccacttcatagtgtaatgataacacctatttatttatgtcgtggggcattttcacattatcgacgatacatatctcaatcaactcatgaccctttgaaaattgcattttttggtagtgataattttagcgtggccagtttaaataagctcattcaatatcaaaagaaaaacccagacaaggtcgatagcgttcatgtcatcacaagaagccttaagccacaaggaagatatatgaaaacagtgcaggatcttccagttggcaaattttctagtcaacagggtctatccataatgagagcggatacttctcaggaaataagacagctttcagaacaatatcttttcaatcttgtgatcgctgtatcatatggtagactcattccttcaacattcatacaacattgcaagtatggtggacttaatgttcacccgtcacttctaccgaaatattgtggctcgtcaccattgcagtatgccctattgaatgatgataaatttactggatgtaccgttcaaacattacatcctacaaaattcgatcatggtgatattataatacaatcttcggaaatacttatactggatgatgacaattctgtttcattattcaaaaaatttggcgagattggaggtgatcttttagttaaatcaatagaccagggcttgtttgtcaacccgaccccaatagaaaacaattatacacgttcaatggctcctaaaatccctaaagccaaactgcaagttttttggaacaaatatctggctcgagaaatcaagagactatacgatgcattagggccgatctttacgtttctaaacgttaatgtaatcagaaaaagaaaacaaatatgtgaaaagcaacgggtgatattatcttgcgtcaaagagtatcagttaacagactcatttgaacaattgaaagaaccaggagattttatgttggtagaagaaggacttcttgttaaagccaaaaaaggtggggttttagttgagagaataaaaatgcaagcccaagaagaggaaagcccagaaaaatttataggcacatattccaaaaaa

SEQ ID NO: 3547 - DNA, 816 bp, Candida albicans
agagatatcttatttgggagagtttcagtggcgattgctcgattaagaaatcctgaagtaattgaattattatcaactactattgctaatttagttgaaggggaatttatgcaattgaaaaatactgtattacaaaataataataatgatgaaatttttaatgatggtgatgttaaaagtattccacaaccaactggaaaagtaccaactaaacttcatcaatattctgtacagcaacaacaacgaacaacaaatggaggaaatggaggtgattctgctgatgctgctgttgttgttgatcatgaaattaatgtcgaagcagcatttgaatattatttacacaagacatatttgaagacagcatcattaatgtccaaactgtgtcgtgcagccgcagttttaagtggagcacaagatgatatcattgaaaattgttatcaatttggaagaaatttaggattatgtttccaaattgttgatgatatgttggattatactagtagtgataaaaccattggtaaaccaagtcaagctgatttgaaattaggtttagctactgcaccaatattatttgcttggaaacaagaaccaaaattaggggatttgatagctaggaaattcaatcaaccaggagatgttgaaatagctagaagagccgtggaaaaatatgatggagtagctcaaactaaagaaatggcaaccatgtattgtcatcaagctttaaaaaatttaagagttttaccagaatcagaagctagaagtgccttggaattgttgactaattctgttttaaattacgtcaccaaggggtcgaag

SEQ ID NO: 3548 - DNA, 552 bp, Candida albicans
ccaatagtcatgctttcgtttaaacaattccgagtatctacgtcatcattactcacgagaagaataagatcaagacatcattcatcttcaacatttaaaactgccgtagaaaccgcagaaaaattagtaacaccaccaacatcaaaatttctggatccattttctatagttagtcatgaaatgtccaatttagctaaatcaatagctaatttaattggatcaggacatccaacgttaaatcgtgttagctcatattattttgaagctgaagggaaaaatgttcgtccattaattgtcttaattttatccaaggcattactgaaaatccctcttgaacaaagaaatagaattccgattgatacaattgatgtcactgaacaaaaaagttttaatggtacaccaacaaaacagaatagtaccattgctgggaaatctattgatgattcattatctccattggcaattttacatggaataaatcccaaagtgatattagatcctttatctaaaccaatggataaattaccaattattaatgggcataataaacct

SEQ ID NO: 3549 - DNA, 342 bp, Candida albicans
acaatgtcatcgaaacaagaaatatctaagaagataatatcattattaaacacattaccaaaggagaagttaaagcactactcttcattcaaagattctcagataaagagattttccgatttacaaaaggtcaaccagatatctgaacaagatttgaagttgcaatacattgctttgaaaaacttgtgtaacgacaaatacaagagatattatgaattggacgataaattactaagaccaaagggtaacccacactattatgaacgtttaatgaatgaaatcaatggtgaaaagaaggaaaacttgtttagtgctcttagaactgtggtatttggcaaataa

SEQ ID NO: 3550 - DNA, 648 bp, Candida albicans
ttaatagaagttattatgttgactagaagaataatatcattaaaaccatttccggtatctatatctaccaggtctaaagcaacgtctgcttctcccacatccaattcaacttccccttatggtgatgtcaatttatcaaatcgtcgtgttatgaaacgtattgttcaagggaaagctagaccggcaattttctatcaatttgaaactttggttgaaatgagtgatggcagtgtaattaaacgatattcacaagcacctaaagatgaaattagaatgattaatgatcaaagaaataatttaatgtggaatcctaataataatgatttaagaaatggtggaattggtggtcttggtggtgatttacaagctaaaggtaaaatcaataaatttaaacagaaatttgccaattcattcgaagaagaagaagaggaggtaggaaaacaatctaaagaaggtaaagaaggtaaagaagagaagaaagttgaaggtgaaggtgaagttgatgaagaagctattagacgtaaacaattagaattacaaaaagctagagatgaagaattatttgaattaatgggagaaaatgctgaagaagttgttggtggtgggaaattatatgataaaaaagctgataaaaagagattcaaatag

SEQ ID NO: 3551 - DNA, 450 bp, Candida albicans
cacgccgtggcagattcagtgagtaaaattgttcaggtatctcgtgaaaaaactttagattgttttggtagagctaaaactcaagccaaaagaaaactgtcaattgcaaaaatttatcttgttaaaggtgaaggtgaagtattagttaatgggaaatcattaattgaatttttcccaaatatttatgctagaaaaaatcttctttatccatttcaagtagttgaacaagaaggaaaatataatgtatttgctcaagttactggtggtggatacactggacaaagtgaagctattatgtatgctattgctaaggcattagtggtgtttaaccccttgttgaaaccaagattatctaaggctggattaatgaagagtgatacaagaattgttgaaagaaagaaaccaggtaaagttaaagctagaaaatctccaacttgggtcaaacgttag

SEQ ID NO: 3552 - DNA, 492 bp, Candida albicans
aacgtcgctccttccagcggcgtggtgaagactaaggcatcccgtttaagacgtaaattggaccattcttgtgggaaacatttaatcgaatcattgagtgcaagaagtttatcattccctgaagattctaaattgaattgggaattgaaaagcattcaaaataatcctaaagttgtgttattcaatataatccctgatgccgatgggattgcttgctttgttcaattcattttaaaattgaaaaccaatcaaaagatttcaattgttaaggatcaaaaagttgtcaaagaacaagaaagctctgttgaagactatttggtttattccatgaatccaatcagtaaagaacttcttcttgtgggtaaattatttgagagtgatcatatcagagggttgaagccagaaatggatgtttttgaccaaaaattgatgcagcgtttcttgaaaacttcaagtgatatttatagaactgatccaaagcaaaccaaatga

SEQ ID NO: 3553 - DNA, 807 bp, Candida albicans
gagagagcgacagagagaaggaaaaaaatttttaatattgaaagaaaaatcgtaagtgatagagcagtcaagccaacagcatcattcaatattaaccacataatgttgaagaggacattacaaccaatatctgttttgaaaagatgtttaaccacatcaagaacagcatttgcatcagaaaccggaagtaagagttctaatcaatcaacaaacaacaaaatcaataaacatactgaatttttaagtaaatactataacccggaagtattacagagtattcaggctgctgaatcgcttgttacaccagaacaatatttgaatttacaattgaaaggatctgatgccaagtctaaagtgggaccaacagatgaagaatttgattattcatttaatgatccagaatgggaagagcctataatatatcctaatcaaggattaggaagagctccatatcccgagattcctcaagtaagttctcctgatagaagtgctttgaaaatacgattttctgatgcaccagttgccacacaaaaggatgaacctacaggtataaaaaccccacagcaaattgctcaagaattatcagatttaactgggttggatgaaagatatattaaaagattatatgtacgtccattgatcatgaaaagagtttcattgaagacagcaaaaagtaatattgcccatttctttgttttatctgtggcaggtgacaagaatggtatggttggtttaagtattgggaaatcaagaaatggtatccgtactgctgcccaccaagccccatggaatgctgtaaagaactga

SEQ ID NO: 3554 - DNA, 534 bp, Candida albicans
tatctagttgctttctttctttcaacattatacctaataaacaattacccaactatgacttcagaagaccaatcccttaagaaacaaaaattagaatcaacccaatctttaaaagtgtacttgcgttcaccaaagggtaaagtaccaaccaaaggatcagcacttgctgctggctatgatttatattccgctgaagcagccactattccagctcatggccaaggattagtttctaccgacatttccataattgtcccaataggtacttatggtcgtgttgctccacgttcaggattggccgtgaaacatggtatttcaactggtgctggcgtcattgatgctgattatcgtggtgaagtgaaagtagtcttatttaaccatagtgaaaaagatttcgaaattaaagaaggtgatagaattgctcaattggtattggaacaaatcgtcaatgctgatatcaaagaaatttcacttgaagaattagataatactgaacgtggtgaaggtggttttggatctactggtaagaactag

SEQ ID NO: 3555 - DNA, 381 bp, Candida albicans
acaaacatatcattcacaatgtttagaagtatatacagagtaactttaaagagggcttctccaataataaatacaagacaattgacagtgtcatcaattagatttaatgaaactactactactacatcaacaacaactactactactcctaaatcatcatgccctgccggtactgtattgaacttgaaagtattcaaaaaaggtgatgaaccagttgctaaagaagattcagaatatcctgaatggttatggaccatgcttgatccaaaagataatttaaaagctattcaaaatgaagattttcttagatggagaagaatcaaattaagtaaagaaaacaattcaacaatcaaaaataacaactttttgagtaaattatag

SEQ ID NO: 3556 - DNA, 432 bp, Candida albicans
agatggtactttgtaatatggtcaataaaatctggttcaaagagacatgcattaagtggtaaacagggtaacaaacattactacaaaggtactgtttctacaggtatagttagctggatttctagaggtagatatcatatcaactgggaaaaggtgagaacgtatgtggttccagaaggcttgaacaatactgaattgaaggcattggtatcaccaaaatcaccaaaattcattcaacaagtggtaggttaccgtgatcattttaaaagtcctgaattggcatttcataatgcaaaggatttcattgaatatggtgccaattatagcgatgtggacttggaacaggaaggctacatacatagaattgtgcatcctgatatattagaagcagaaagaaaagaaaacatggacgtcgaaggtataaagaactag

SEQ ID NO: 3557 - DNA, 279 bp, Candida albicans
ttgttagtggcctggaaagatattgctttgagttgtgggtcagcatgtacttcggcatctttggaaccatcatatgtttggcatgcattgggagctgatgatgccttagatcattcttcaattagatttggtattggtagatttacaactgaagccgaagtcgactatgtcattcaagcaattaatgaaagagttgactttttaagaaaaatgtccccgttatgggaaatggttcaagaaggtattgatttgaatacaattgaatggagtggtcattag

SEQ ID NO: 3558 - DNA, 1008 bp, Candida albicans
  unsure (98): Identity of nucleotide sequences at the above locations are unknown.
atttttgacttctattatctgaggggcaacatgtataaatcaattttcaaaacgactggcaggttggggaaaacagtttctagtcgtaactttgttantacattacctaaaccattggccaccagatcatcgccagcaacaaatgccccaaataaaacatcaaaccccaaaacaggggaattacatgtatcaactccagtagacacagcaaagatttccatcgagccacctgaaggatcgagcatatcattaaaatctgcttctcgtgatgcatcattgtttggaacccgtccgatttatttggatgttcaagccacaactcctgtagatccaagagttttagataagatgcttgaattctacactggattatatggtaacccacattcttcaacccatgcatatggatgggaaaccgacaaggaagttgaaaaggcaagaacctatattgctgatgtgataaacgctgatccaaaggagatcatattcaccagtggtgccacagaaactaataacatggcaattaaaggtgtgccacgtttctacaaaaagacaaagaaacatatcatcacgactcaaactgaacacaaatgtgttttagatagtgccagacatatgcaagatgaagggtttgaagttacatatttacctgttagttcagaagggttaatcaacttggatgatttgaagaaagcaattagaaaggatactgtgttagtttctattatggccgtcaataatgaaattggtgtcatccaacctttgaaagaaattggtaaaatatgtcgtgaaaataaagtgtttttccacactgatgctgctcaggcgtatggtaagattcctattgatgttaacgagatgaatattgacttgttgtctatttcttcccataaaatctatggtccaaaaggtattggtgcctgttatgttagaagaagaccaagagtgagattggatccaatcattactggtggtggtcaagaaagaggtttgcgttcaggtacttaa

SEQ ID NO: 3559 - DNA, 645 bp, Candida albicans
ctactttatcatcagtccacgatgtcgttagctttaagatttgggactgttgcatcaattcaagaggctttatggggtgtggttccacgtttaccttcaataactatacgtcttgggttgcagaacaggcttggtaatcaaagtacaactgatgagagattacaagaattgaaagaaaaaattgaagaatcaggaggtgaagctccttttatgatagataatggtacaattttaaaggccgtgccaaaaaagaaattatcaagagcaagaagaagaaagaagttgtatgctccagggaataagcaagtccatccaataaataatattgtaaggtgttcagcatgtggaagtgttaaacgttcacatttcatgtgtatgaattgctttgctgaaatcaagacatttttaaagagcttaaagagaaagaatggaataatcaaagacactgtcaacccacaaagtgatttaaatccattagatgaaagagttatatatcctggtaaatttgaaaccgaccacgaacgacaattgaaggctaaggaatgggtgccaaaaagagaaaaaccaatgccatatgacaacactcaagttagacatcgcaaagtaaaccccaaaaagggtaaagtaatggttgaactcgagtaa

SEQ ID NO: 3560 - DNA, 528 bp, Candida albicans
gaagatgttgtgcagtcgatatggtcaaatatattgagtgctgaaagatggccacgcatgacatacactgaagcaattgaatatttgaacaaaacattacctcaggatgaacaacttatatggggggattcattacaattgaaacatgaaagacttttagcagaaaaaagtccaatatttataactgattatccagaatcacaaaaaccattctatatgttgaaatcggccaattataacgctgaaaacccaacagtggcatgttttgatttattagtacctgaatttggagaattagctggaggatcgatgagagagcatgattaccaagtgttattggctaatatgaaacaagaaaatatgaatatagaagacatggaatggtatttgaacttgcgtaaacaaggaactatcccccatggtggatttggtttaggatttgagagattaatatcttatttggctggttatgataatgttagagatatatctgcttttccgagagctcctgaattgtgtaattgttaa

SEQ ID NO: 3561 - DNA, 987 bp, Candida albicans
tattcaagaccagtcgcccaattaactacatcaatgcttatacagtcaaggttccctctcaaagctctacagcaagtactgtcgaaacgctttaatagcagtagtctcaaccctaccattaaaaaccaattatcaaatcctccaccaataggatcaataatagaagctagagggtttgttaaaagtattagatcatctaaaaaagttgggtttgtcgatataactgatggttctattagtaataatctaaacattgttcttcaaggtccagatcaaccaaaatttaaagttggacaaagtatagtcgtgaaaggagattggactgttgggaagggcaaacaaccatttgaattgaaatataatcctgaaaatccacaacatgctattactattttaggtgatgtgactgatgattacccattacaaaaaaaagccacttcaatgtcatttttaagaaattttcctgaaatcaagcatagaactagtacattagggtcatttttacgattacggtcacatttggaattcaaattgatggaatttttccaatcaagagattttattaaagttacacctccattaattaccagttccgattgtgaaggtgctggagaagtgtttaaaatagaaccattgaatgataataatcctaaggaaccatttttcggtaaaaatgcatatttgactgtgtctactcaattacatcttgaatgtttagcattggcattaaatcgtgcatggacattaactccgtgttttcgagctgaaaattcaaatacaacaagacatttaagtgaattttggatgttagaagcagaaatttctcatgttaataatgtggatcaagttacaaccttcactgaagacatgataaaatttgtcaccaaatcattggttgaaagtagtcatagtactgagcttagcgatcttggtgctggtaatggtaatgcctacttgaatgttttcaacaggcgtggaaggaccatg

SEQ ID NO: 3562 - DNA, 297 bp, Candida albicans
  unsure (19): Identity of nucleotide sequences at the above locations are unknown.
tctgaactagtccgtctanctcgtcattgtgaagacagaagaaatggggacggtgtaatgccatatttacataaacaattattacaaaaacatgatccaacgggtaaaagacgagcattagttgaaaacagtaatactggattacgtgctggtgatattattaaagtcacctatcttgatagatccgatgttactggccgagtcattggaattaaaagagggtttttgaacttgggtactaatattttaattagaactaaattgaataaagttggatctgaattgagaatcccggtt

SEQ ID NO: 3563 - DNA, 264 bp, Candida albicans
tttggtttctatttattatctcctatatgtgtgatgtattatgttgggttagatactgataaaaagttcaatttaccagggttctggccagatccatcaacattaaatcaaatccctaaagaacctcatgaaattcaagcagaaatcgcccgtattaaacgagccagattagagaaaagaaaacgattagaagaaaaagcaagagaattaggtatatctgaagaagattttgaagaagaggaacaacaagaaatattgtcttaa

SEQ ID NO: 3564 - DNA, 465 bp, Candida albicans
tcaatgattaaaagattggtgaaattgttatctaaaatgtcaattcctccatcttcaacatcagcaatggaaacaaccacgacaaacatagttcaaccaaactcaactatttctcaagaattcaatactgttcaagaagggaaagccacgatattgactcctaaacaagatgaagtattctataatcctattcaacaatttaatcgagatttatccatcatggcgattaaagcatatgatgaaatacgacacgaaaagatacaagcaataaagaaaaagagtaagaacaaaaggactaaattgaatggattgaaaattttggaaagtttagcggcatcgggtttgagatcatgtagatatggattggaaattcctgaagcagggaaaatagttgctaatgatatgttggccgaagcagttaaatctatcaataagcatgttgaatattataaactaacggactaa

SEQ ID NO: 3565 - DNA, 744 bp, Candida albicans
tgtactgatgctggagtattagctggaagtgggtatccagaaaaatgttttgcattatatggagggaataattttggtaatgcatatgttaatggagaatcaaaccatgaagttggaattcgattgattcttaatttaattgccagtactgctgccaagtataaaaagactattgaaccgatgttgagtttatctattgattattatttccgtgttttcgtgaaagtgaaaactagtcccataaatgttaaaaatcatgctagtgaaacaatgttaacttatggatgtaatggttgtggacataaaattgtgcaacctttaggaatgaaaaacaataccaaattccaatatccaaaattacaaggtccaatatcttccaattgtcaatattgtggtacatcatataatgttgccggacctatgtacgctggcaatttgcataatcgtgaatttatagacaaagtattgaaaattaatgaatcgagtgataaagaaatctatgtaaccaatgaaagaatcaaaggaatgttgactttggcgtataatgaacttgatgatgcaccatttttctttaatcttaatcaattgtgttctattttcaaatctccaccaatatcaattgaacaatatacgaaagcagtgggtaatttgggttataaagtaagtttaactcatgctaaaaagaattgcgtgaaaaccactttaccccggttttcaacgcgccctagcgcaaagagctcccaa

SEQ ID NO: 3566 - DNA, 2013 bp, Candida albicans
cgcattatgttaaaacagttgagcagatcgttgggaatacgatcaagccccatagtggcaaatttaattagatccaaacaagtttgtacacgtggatttcatatttcccttgttaaacaaaatactagttctaaggtaaatgaaataactgacatcacgagtgatagtcttaaagtaaaggaagatgctgccggatctgatcttccatcaaccaaaacagataaaaaatcaaaactggaatcattccaacctgttaaatttgaagactttaaaggaaagggatatattcatgatagtataatcaactcattacataaaaatgattttaaagaattgacgccaatccaacaaaaatctttagtgcgtattttcaacaccgaaaagggtttggtgtgtagagcaaagacaggtacaggtaaaactttagcatttgctgtgccaacattacagtatgcctataaaaatagaggtaaaggtgtcagcaccgtcgttttggttccaacacgtgacttggcttttcaaattgaagaggaatacagaaagcttatctcccatttgaaatataatgaaagacctaatcttgaattgattataggaggtcagaggacatcgtttaaccctagacgtccagcagaaatcgttattgctacacctggtcgtttggaaaaagaattacaaacggatcgtaaacttgccaagtgttttagcaatgtaacataccgtatttatgatgaagctgatagattgttagatgttggttttgagagtgtcttgaatgagattgatggccttctttataaagtaagaactacccctaaaccaatcaaatcattattgtttagtgcaactgttgatgaagctatttctgagttttccaaaaaacatattcatccagaatatgagttcttaaacactgttaccaaagatgatttagagatcccggagaatatccatcaacagttgattgagtgtactgatggtattgataaagttaatgtctctcttctggaattacatggtattatgaagcaacacaatgattataaagtgattgtatttttacccaccaagactgctgttgattggttttatgaatatatcacaaatgcattagatgatgaattatttgaattattttcaaagccaccaagagttttcatgttacatggtggaagaagtgtccgtcaacgttctgctgccttgaaaggatttaaggtggcaaaaaaagggattttaatctccactgatgttgctgccagaggtattgacgttaaagatgtaaccaatgttatgcaaatgttcccttctgtggaaattgctgactatattcataaagttggaagaacaggaagagcaggaaagaaaggaaaggcatcattgtttgccactcccgctgaattaccatatgttctgttattgaaaagaaagagaaaagttaagtttcaagaggttatccaatctgagaagttaaacagttcaaacattatcgatcaaattgaatctcctttggattcaacaaaggaatttttagccacaatggttggttatttacaacagttgcaaagtgctcatcgtcttgattatgatctgttagtgattgagaatatggaactataccgtaagctcgttagagatgataaagctatgttggaaagcagaattttgagtaggattggaaaaggcatcagtgctcatgtcaaacgtagatattttacaagaacaaggtatcaaagtcatgatgatgctgaatttgattcttattctgatttctcaagatctggtatgtcacaaagacctagaagcaatgatagaagtagtaaaatgacatttaacgggagaggcaaatatggaaacaatagaaataacgattggtctcatcaaaataagaacaggtataataataataataataggcaaaccgaaagatcgtacgacagtgataggaaatcccataatgactggaaatatgaaaaaaagtttgagcatagaagaattcgtgatcatgacgaataa

SEQ ID NO: 3567 - DNA, 564 bp, Candida albicans
cattgtatacatatccgggagagtttaaagttaaatgatttcccggcatttattcaatgcattctagaaactcgtaattggaatgcaaatcattacgagtatccaaagtttttattaatgcaattggaaaaattaattgtgaattgttgtgtgaatccttttactgctctttttgattgcagaaatggtgaactactttatggcaataatttaacgtttacatggaaaaggattatcaatgaggctaaacatgtttttgtcaaagaatatactatcctaaataccataccagacgccgattcatttttgaatactgatcgacttttaaagagtgttgttgatgtttgtaaaattactgccaaaaatagttcctcaatgaggcaggatgtacgaaatttgagaaatacagaaattcaaaatttaaatgggtatatttcatttttgggacgcaaattgaaagtcggtacaccggtcaacgatatggtaacaaatatgattcttagtaaaatcaatatagacagaggtatcgatcgacaagctgcagattccttgtcaaaattataa

SEQ ID NO: 3568 - DNA, 711 bp, Candida albicans
agctgggaattgaacgcccctgaaatcaccaccgttatgagcagagttgatatggttactggtactttgggtaaagcctatggtgtcgttggtggctatattactggtaagactaatttgattgattggtttagatcttatgctccaggttttatttttactacgtctttaccaccagcaattatggctggttgttctgcttctattcgttatcaaagagctacattgaaagaccgtattgctcaacaaaagaacactagacttgtcaaaaacaatttgaatgaattgggtattccagttattccaaacccttctcatattgttccagttttagtcggaaatgcagctgatgccaaacgtgcttcggacttgttgttaaacaagcacgacatttacgttcaagccatcaatttccctacagttccaatcggtgaagaaagattaagaatcaccccaaccccgggtcacggaccagaactttccaaacaattggttgaagctgtcgattccgttttcaccgaattgaatttgaacagaatcaatgactggaaaaaacttggaggattagttggggttggtgttgaaggtgctgccaaagttgaacacatttggactgaagaacaattagctttgactgacgctgatttgaatccaaatgtcgttaatccagccatttcccctcttgatgtctcttcaggtatttctacataa

SEQ ID NO: 3569 - DNA, 930 bp, Candida albicans
  unsure (128): Identity of nucleotide sequences at the above locations are unknown.
agccaaacttctggtgcattggctaaccaagctcgccaatgtccaattgctggcaatgcaatcagggctaaagaaatttcaatcagatcttattcttcagctaccaaaccagccagagccaccgctgntactccttctacaccggaggccactttcaacgttacttcatctttcgaacttggaagtaaggaaaccgcatttgattataatggatatttaggaaatgaattggaaaagaaaagatccgacaagtcttatcgttatttcaataacatcaatcgtttggctaatgaattcccaaaagctcatcgtactcaagaagaggacaaagtcactgtttggtgctccaatgactatttgggtatgggtaaaaatgaaaacaccttgaaagaaatgaagcgtgttttagacaagtatggttctggtgcaggaggtaccagaaatattgctggtcacaattcccatgcgatcaagttagaatctgaattggctgcattgcacaaacacgatgctgcattggttttcagctcttgttttgtagccaatgatgctgtgttatcattattgggacaaaagatcaaagatttggttattttttccgatgaattgaatcatgcctcaatgattcaaggtattagaaactctcgtgctagaaaacacattttcaagcataataatttggctgatttggaaagcaaattagctcagtatccaaaatctactcctaaattgattgcctttgaatcagtttattcaatgtgtggctcaattgctcctattgaagccatttgtgatttagctgaaaagtatggcgctttaacctttttagatgaagttcatgcagttggtatgtatggtccccatggtgctggtgttgctgaacatttgaactttgaagctcatttgaagctgggaattgaacgcccctga

SEQ ID NO: 3570 - DNA, 1158 bp, Candida albicans
caactttatcagtcttcgtttatccctttaaatttcttggaggatacggtttcgaaaaaggatttggaggaagaacatacacgagagttacaagtcgaacaagcatacaaattatttcaatctgcattaaaactacaaaagcaaaaacaatatgaatcagcttacaaggtatatgaagaattgtttaaattagatattgtttcaaatcactactttgaagaattggactttatacgcggattgcaagatggatctcaaaacactgatactgatgaattaacattattatcccccaatgtgaattctttgcgatacttaatatttagaaatagagggtttttatacttggacatgcttaagagtaacacagagaacaagtttgcagaaaaagtaaaagagatgttttaccccttgttggacgatttttgtattgcccttttgtacaatgaacctgacgaaaagttgttggaaaccttacatgagatattcagttatattgggtcagaaaggctatcacgatttgtcttggaatattccttaacttctcggaaagaaagtgacgatttgtcgggattacttcctattgaccaaaccgtactctcacagtataagacaatgctagaacacttgctgtcaggaaaatttcccaaacttgatttaaaacatctactgtttttagaaccaataagactagacatctttgctcagcaagaaaaactagcaagcaaaaaagtggccgttattaaaagcacatccactaaatgggtagatctactcgatgccatcaacatacatttgaaagagaatcaagatgagagcaaaattgaagatgcaaatcgacctagaataagaatatttgaaccgtatgtgttgacagaagagccactagatattgtcagaatagagttcacaaagaggggggtggctgtacctgccaccgaaactgaggtgactaaagcacagccagaacagattgttcaggaaaggaaaccagaagaagataacagagtacagagatcatctaaaagattatcaaaagtcgaggacgagataccggctgttacattagaaagttcacatttcctaaatatggattattttagaaaccaaatgaatgaaactatccccaatttcgagaattttggaggtttgttctga

SEQ ID NO: 3571 - DNA, 1977 bp, Candida albicans
  unsure (5): Identity of nucleotide sequences at the above locations are unknown.
cctcngagactgatcttccagccgcctgtcgaaaacgtgtacagtggtgatgatgtcaccatcaaaccggctcattgtatgtcccacgataattcatggccggtagccaccaaatttatgaatttaggagcatctaaagtgaaagacaacagacaaattgtgtgtacattggatcatgatgtacagaataaactggaacaaaacttaaccaaatatacaaatattgaaaaatttgccaaatctcagggaatcgacttttacccagctggtagaggtattgggcaccaaatcatgattgaagaaggttatgctttcccattgaacttaacggttgcctcagattctcattctaacacttatggtgggattggtgcattgggtacaccaattgtacgtactgacgctgcatcaatttgggccacaggtcaaacatggtggcagatccccccagtggctaaagtcgagttgattggccaattgcctaaaggcgtcacaggtaaagacattattgttgccttgtgtgggatatttaataacgatgaagtgttgaatcatgctattgagtttgttggtgatgatgctatatctaaattacccattgattacagattaaccatagctaatatgacaaccgaatggggtgcgttatcgggattgttccctgttgacgaaactttggttgaattttatcaaaacagattgaagaaattgaataaaccagatcatccaagaattaataaccaaactatcgatcaattgattaacaacaaattgaccctggataatgatgctgtatatgctaaacatttacaaattgatttatcttcattatctccatacatctcgggtcctaattctgtcaaaatttctaattcattatacgacttgtcccaacaaaacattgccattaataaagcttacttggtttcatgcaccaattctcgattatctgacattcaagctgctgctgatataatcaaaggtcacaaggttaatcccaatgttgaattttacgtggcagctgcttcatcattagtgcaaaaggacgcagagcaatcaggggcttggcaaaccattttggacgctggggctaaaccgttaccagcaggatgcggtccatgtattggattgggtactgggttattgaaagatggagaagttggtatttctgccaccaacagaaacttcaagggaagaatgggttcaaaagatgcattggcatatttggcgtcacctgaagttgttgctgcatcagcagttttggggaaaattggtggtcctgaagaattgaatggtgaaccagtcaaacaggcaccacgaattattaaatctatagaaacagagagtaactcggccaatgaagcagaatcaaccagtgaagaagcttctggatcaattgatatattaccaggattcccacaatccattgaaggagaattaattttgtgtaatgccgataatatcaacactgacgggatttatccagggaaatatacctatcaagatgatattaccaaagaacaaatggctaaagtgtgtatggaaaattatgattcacaattttactcgaaaaccaaaccaggtgacattataatatctggatacaattttggtactgggtcatcaagagaacaagcagccacatgtatattggctcgaggcatgaaattgattgttgccgggtcatttggtaatattttcagtagaaactcaatcaataatgccttgttgacactagaaatacctgatttgatcaataaattacgtcaacaatatgaagggaatgatgaattgacaatcagaactgggtggttcttgaaatgggatgtgactaaggcgcaagtaacagtggttgatggtgacgataatttgattttgacacaaaaagttggtgaattggggactaatttacaagatattattgttaaaggaggattagaaggttgggttaaaagtgaattgaaaacaaaccaataa

SEQ ID NO: 3572 - DNA, 2328 bp, Candida albicans
agattaactacacgacaactttttcacacaatgttatcatctagaataccaaaaggtaaattattaaaacaaacttctgccacaagctacttgaatctagctaaaagtatgccaataacaactgctagatacagacccaaccagtattatgcaaatgaattagctaaacctaatgtatttaccattcacaacataccatcaccatgcttttcacaagttagaaatttccacctgtcatttcccaggaaacttcatatgcaacagaccgaacaaggtgacaatcgaccagcgttagagaagtttggttctgatttgacccagttggccaaagaaggcaagttggatccagttattgggagagatcacgaaatccgccgtaccattcaaatattatcacgtcgaacaaagaataatcccgtcttgattggtaatgccggtactggtaaaactgcagtaatggagggtttggcacaaagaattattcgtggtgaagttcccgattcaatgaaagacaaacaaattattactttagatttggctggtatcattagtggagctaagtatcgtggggatttcgaaagtaaactcaaatcaatattgaaagaagtcgaggaaaagaatggcaaggttatcttgtttattgatgagttccatttattgatgggtttaggtaaagccgagggatcaatcgacgcttcaaatttgttgaagcctgccttggcaagaggtaaattgtcgatgtgtggagcaactaccatcgaagagtatagaaaatatgtggaaaaagatgctgctttagccagaagattttctcctgtcactgtgaatgaacctactgttgaagataccatatcaattttgcgaggtttaaaggaacgttatgaagttcaccatggggttcgtatcatggactcagcattagtcactgctgcattatattccaatagatatataacagacagatttttgccagataaagccattgatttagttgatgaagcaagttcaacattgcggttgcaacatgaatctcgaccagatgcaattgcaactttggaccgtcaaataatgactattgaaattgaattagaatctttgcggaaagaagaggatcaactttctattgatagaaaacacaaattggaaaaggaattggaggtgaagaaaagtgagttgaaggaattaacagaccaatgggagtcagaaaagcgtgcaatcgatgcagtgaaaaacgcaaagtctgagttagagaaagcaaaatacgagttggaacaggctacaagagaaggagattacgccagggcttccagaatccagtatgctagtattcctgaattacaagacaagatccaagagttgagcaaaaatgaacttgctgccaaatcatcgaatcttttgcatgactctgtgacgtccgaggatattgccggtgttatatcaaagatgacggggatccctgtgaacaatttgttgaaaggtgagaaggacaagttgttagatatgaatatacttttacgccaatcagttgttgggcaggacgaagccattgatgcagtctccgatgcagtcagattgcaacgtgcaggtttgaccagtgagaatcgtccaattgcatcctttatgtttttgggtcctactggtacaggaaaaacggaattgacaaaatcattagcacaattcttgtttaacgataagaacgctgtggttagattcgatatgtctgagttccaagaaaagcataccatttcgagattgataggttctcctcctgggtacgtgggatacgaagaaagtggtgagttgactgaagctgttagaagaaaaccatattcggtagtcttatttgatgagtttgagaaagcacacccagatctttccaaattattattacaagtattggatgaaggttcgttaacagattctcatggtaaaaagattgatttcaagaatacaattattgtaatgacatccaacattggccaagagattttgcttgctgataaaaacacctatgaggatggtcatatcaacagcgaagtcaaactgcaagttttagaaaatttgagacaccattatgctccagaatttttgaaccgtattgatgatatcgtggtctttaacagattgtcaaagacagctttgaaagaaattttagacatccgtttgagagaaatcggtgatcgtttggtcgacaaacgtattatattacaattaactgatgaagcaaaaacattgttgtgcgacatgggctatgatccaacttatggtgctcgtccacttaatagagtattgagaaagaaattgttagatccattggctatgcgttga

SEQ ID NO: 3573 - DNA, 1215 bp, Candida albicans
gtgaaaaaaaaaaaaatgacgaccatattagcactagcatataaactagaaatacacaacccagatatgtcgttaaggtcaatacatacattaggccgatgttctaggccattaaccacagctgctggaagttcaagcacagttcaggaggttagtcaaaataagccagtgattccttccaactcaacagttttctcgatgattcaaccaactggtcgaattcatttaggtaattatttgggagcagttaaaagttggagaacattatcggaatcaaatactgatcctagtaatagattcatatatggtatagctgatttacatgccattactattcctaaagatcccatagaatttaaagagtatcgatatgcagccattgccagtttaatagccagtggattagacacatccaaatgtatactatttttccaaagcagtgtacccgaacattctgaattgaattggtatctcacgtgcatgacaagtatgggggcattgaatagaatgacacaatggaaactgaaggcacaacaactggataatagttccatattggaggataatgtattggaaaagaccaaagcaggattattttgttatccggcattacaagcagcagatatcttgttatataaatcaactcatgttccagtaggggatgatcagtcacaacatttagagttgtgtcgaagtattgctaaaacatttaatagtacttataaaaccaatgttttcccacttccgaaaacactcttgactccagcgaaaaagatcttgtcacttaaaaatccgcaaaagaagatgtcgaaatcagatccggtggccacttcatgtgtttatgtgacagattcacccgaggacattcaatttaaaatcagaaaggcaaccaccgactccatacaagggtcaatctattatgatccaattgaacgtcctggtgtttcgaatttgataaatattgtttcaggtatttccaataaacctgtagatgaagtggttaaagatatgtctagttttgttaaccataaacaattaaaagattatgttagtgtagttattattagtgaatttgatgataagagacaattgtatgaagaattaatgaaagataaggtttatttagatagtatttgttctcaaggaagagacaaggcccgagaattatccctggttaatttacatcaagtgaaaagcattataggtatggattag

SEQ ID NO: 3574 - DNA, 1047 bp, Candida albicans
atttttttttcttcaccccaagagagtaatcgatacttaactgttggagcattacaaattgggagttcagtagcagacatgttcaagtttaccacccgttttttatctacaagtcgtctgttgcttagtcaggctggagaatccacgtcaagtgcaagtgtaagtgcaacaattcctcgtttccacgtgaaatttggagccaaacagttcattgaacctggtaccaataaacgtagagccaaaagattaagaagaaaggaaacaagaatcaagaagcagatcattcgtgatgtaaacactttgaagcaacatgaagtcaaaaatgtctcacttaaggtagatccagtattgggagacccaaactgtgggtttgttgaaagaattatgaagaaagttgagaaccaagagctaactctagcttatggtattgacagagtggaatttgaaaaacttttatatgcagctgagaagttgtcacttgaaaatgcttccaagaacgaagctttacgagaatccgttattcaaacagaagaaaacaaaagaaaagccgttatgaccattctcaatttaaaaaacaccaacgtaccagacaaaaagaaaatggcaataaagtttgctcgtgaagaaatgcaaagaagtcctggcgatacagcttctccagaagttcaagctgccatagctaccatcaaaatacattatggtatgcaacaagttaaaaacatgccaaaagataaaataaatattcaaggagtaagaaagttagttcaatacagacaaactattttgaaatatttaaaaagaaaaaaccccgaactgtattattatacgatagcaaagttgggattgaccgatgatgttatagttcgtgaattcaacatgggtaaacagtacatgcaagatttcaaggtctggggtgacaaggttttggttaaggaaaccaatagtgttgctaagaaaaacaagaaaattaaagatcttaaagatagagtggccaagtataacgaattggcaaagaagaattatgagattatgtacggtactaagtag

SEQ ID NO: 3575 - DNA, 1077 bp, Candida albicans
  unsure (440): Identity of nucleotide sequences at the above locations are unknown.
cctcatacctttaaccatcacaagcttcacggaattatgattagaggatcctcacttatattcactaggtctatatcgacatctttttctttaccggtgaataaaactttagaaattcttaaggcaacaaacgccaattttgaagggctattcactaacaatgccataaatcaattatggtttcaaagaggtcaacaattggttcaaaatttaaatcaacatttagctcaaaccaacaatggattacttagtgatagcaacaacatcaacaacaataccagtagcaccagtgacaatggtaatggtgatggtgaaaatgttgttaattactctttaaatgaaatcatatccatcaccatgaataaaccagaattatttcatattcataaaaatgccactaatttatataatttacaatttttttttgaaaatattcgacnattagaacaacaacccacagaaatcatacctagtggatccgaagttttattacaaacaccaaaagatcaatttaaaaatgttccactggataaagaattagttgattggattgaacattcatttggatctattcaagaattaagaaatttgattataaattccgccaaggggataaaaggtgatggtacagtatggttagtagctgaaagtaccatgagtgaaaattatttgagtaaaagtaatttttcatcaccattatttcataatttggcaattgtcaatacatataatggcggtaggattgatgattctgaaagatcaggtcaattaagaagaatgaaaagtgtattgcaacaacaacaagaacaagataaatcaacagaaaataaacaaaaacacaacaactcaactagtgaatttgaattgggatctgttgaacaagctgaattggaaacagctttccataataaaagattggtacctgctttagctattgatgtttctccaagaaattatttgattgattatggtgcatacggtaaacaacaatatttagaaaatgtttgggaatgtattgattgggatatcgtttcaagaagattaccaccaagatctaaacaagtcattactgtgtaa

SEQ ID NO: 3576 - DNA, 627 bp, Candida albicans
aaaacgtatcacgaccgtggtataccttacagaagatgctatttgttatatggtccacctgggagtggtaaaacttccttcatacaagcattggctggggagttggattacaatatttgtattttaaatttatccgagaacaatttgactgacgatagattgaatcatttaatgaatcacataccgaatagatctattttattattagaagatgtcgatgcagcgttcaataagagggaacagaccaatgatcaaggttttaacaatggagtaactttctctggattgttaaatgcgttagatggtgtggctagtgctgaagaatgcattacatttatgaccacaaatcatcctgaaaaactagatccagctttgctcagaccagggagagttgattataaagttatgatagacaacgcaactgagcatcaagttaagcgcatgttcttaagattttatgaaaatgaagaagaactttgtgagaaattcttagccaaatatagaaagttgaacatgcaacatgttagcacagcgcagttgcaagggttgttcgtatacaacaagagagatccagaggcagcaattgccatgatagagacattacaaaacccaaacacggtattttaa

SEQ ID NO: 3577 - DNA, 309 bp, Candida albicans
tgcagaatggctcagacacctcagtctattgattttgaaaaaataaaggagtcttcagatggaactttaaaggggatgttaacccaggggttcaatgaaattgttgttaataatccatattttgctgctggtggtggattgatgttgcttggtacaggattggcattagcaagactgggagtagtaaagggttcagggttcatttatcgtcagctattagttgatttaaaaatcccttcgaaagaaaaatcttatccatcgttttgggaatggattttcccttttaaacctaaaacttcccttccttaa

SEQ ID NO: 3578 - DNA, 813 bp, Candida albicans
agagcaccgtcaaacatgtgtagaatagtcgccagaagaagtgttttggagtcagcgttctctaacaaggaaataagggaattactagaattgcctgctaaattcgtaccattaccaaaggatttattagattttgatacaaaaaaattgggaagagttgataaacgaagagtatcacttctagaaaaatatagtaagcaacaaaaagaacatactaaccgttcatgggaattggaatactataaaagcccaaaagagtttataccaggtgaaaacgaccttttaaaaagtacaaagtttgttataaataaaccggcaaatgaccctttagctcctcacaaagttgagcctacggacgagactgtgacagaaaataatgagctagttattttatccataggataccaaggatcaccaatccaaggttttgaagaattaggtatttggtatgaaaaaaatagacttcaaaataaaagtggcagaatactatccactaaatcaaaggagaaagacgaacataatgctgttttcaaacctggtgggtatgctgctggatggatcaagaatggacctcaaggtgcaattgcttcaacaatgatggattcgtttgacacaactgataagattttagaagatttagcaaatgatgcgtatattaagaccaactcagacaaggagttggagttctcaaacgctgtggattggggtaattgggagaaattgaacacttatgaacttgaaagaggtgaggcattagggaaaactcgtcttaaagtgtgcaacaaagatgaaatgttgaaattgatgaaataa

SEQ ID NO: 3579 - DNA, 609 bp, Candida albicans
ttctccacacaaagaatggatggaaatactagaagtggtagattagttgcttctatttggaagtcattcaccagaagtatacattataaaccactagcaccaaataaatacccaaaagttaatgttaatgatgttgatttgaatccaccaagatatgggtttagaagaattcgaccaccaattatagcacaatcaccaaccaaaacattattccccagtgttgaaatagccaagaaatatattgaagaggggaaaagagtacctaatagatttatggatcaatttggtcctgatcatgctcgtaaagaatttgaagaatttcaagagaaattagcattagaagaacctcattttaaaattggtggtaaacaaatttatttccctcaagggagaatttgtttattaagatctaatgctaaacatactccatatcaagcaaaatttttggttcctaaaagtatgaatcaaatggatttaagagattatttatggcatatatatggattgagagcattaaatattacggttcaattacagccagcaagatggaagagaagtccttatcctttaggacgtgttttcacaacggccggccgatcccaaatgctg

SEQ ID NO: 3580 - DNA, 495 bp, Candida albicans
aaatttttagtatttgttagatccattccccatcaatccaataacagaacaatgtttaacccattaaacaagccaacaaccacatcaaatgtgataaaacactttgtgcgtgggaagagacaagcaactgagctcaatattgcaactcaaaaaatagtcaaccaattatcagttttatcagcaagtagaaaacaaccaaagctcttgaaattgtgcaatgaagatttcatcaaacataaaaccattatgaacgcttggaagttgttacaacgaagaagaataacccaacaatctgaaaaattgtctaagcaatataaaagcattgtcaatgccatggaagatttgaagcaaacaagtcccgaattgttcgaagctgcaaatgctaaaaaccctaaacgtttcactaccttcccaatagagatgagagtgcctaccgattatccacctaacaagccatggacttacaactttgttccttcaaaaacccatcattag

SEQ ID NO: 3581 - DNA, 960 bp, Candida albicans
tggaaacatattttcaaatcccaatattcaaccaagaaaaaagaggtaccacattattcacaagaattacacacatacaatcagttaatgtctcccaaagcggaattgttgactgaacaaaaaacattgaaacagtaccctatgattaaattgcttgatggaatggaaaccttacctaaatatttagctgaatatttaatcaacgacaccaacacaaagatcagatataatacttctatacaagatatagatgctgtgacagggaaaatcaatggtgaatcatatgatcatatccgatccactattaatacccatgatttagcaaaaacattaccaacgacagatccattagtacctgaattgaaatccatagaatacgtcagtatctttttaaccaatgtttattcaagatcgtcaaatttgatacctaaaggtaaaccagggtttggatttttatcaccacgatatggaaatgtttggaaaaatcctgatgcattattaggaacaatttatgattctgatattgaaaataatgtcgaaggactctttgttgatactaaacctgttcataatccaaataataaaatcaccattatgatgggtggtcattattatacaaattggacaattccttcgaattcagtgaatttgaaaattgttaaagatgtattgacatcaaaattaaaagttgatttatcaaaattcaatctaaaagtgattaaagatggtgaaccattacaaatagatgaaattaatgacaatgatcttgtgatttcatatagtttccattcaaattgtattccccaatataatttgggttatcaagaaacaaaagataaagtaaatcaattactcgataaaggttataagctttcatttggaggaacggtgtttgctgatggtgttggtgttcccgattgtgtgttgaatgggttcaaagatgccttgaaattgaaatag

SEQ ID NO: 3582 - DNA, 621 bp, Candida albicans
ctttttttctcctacaatcactatccacctccccatttcaatcaattaatgactttgacaactctacctcaaaatgcaaaagtggcagttttaggagcaggaattctgggattaacattcacatatttcctttctaaactacgcccagatttacaattcacaatatttgaaaaactgaaaagaccaggtggttggatgtcatcacctaaattacacgtcaataataccaatgaatcgattctttttgaaaagggaccaagaactttacgtggagttaaagatgggactttattaatgcttgatattttaagaaaattggatttggattctcaaatagaagtaattaatgaaaaatgtaatgccaataagaaatatattcttgattcttcaggggaaatcattcaagtgcctaattcaattggaacaacaattgaatttcttaaaaatgttaaatgtgtcgatagaaaattaataactgggataataaaggaaccatttgtgaaaccaatcaaagtagatgaaacgattgaacaatttttcaaaagaagattaggtagtaccgtacttacagataatgttgccagttctattattcatgggccttccccacggacaagcgat

SEQ ID NO: 3583 - DNA, 855 bp, Candida albicans
agaaaaccaaagaaggatcaaaacaaagatgaagaagaacagcttcgtgaagaattaaagaagaaatttgccgcaaaacatcctggaactaacccagataatcttaaaatttataaatttgatttgaggactttgggcaattacgtattattatttggttcaacaattttgacattctatcttataaacaggacatcagaatcggaaattcaacaattgacgttccaagattttatcaccaattatatcgagaaaggattagtaaccaagttaactgttgttaataaggctgttgtcgaagcggaattaatccctggtgctgtttccaatataagtcataatagaaatggtaaaccttatgtcgtattcactattgggtcattagaattttttgaagatgaaatgaataaagtccaagatagattgaaaatccctataaatgaaagattaccagttgtatatgaagatcatacatcctggttaagttacataatgccaattttgccaacagtgttgttaataggaggattgtactatttgactatgagaagaatgcctggtggtgccggcggtgctggtggtgctggtggtccaggaggtatttttaaaattgggaaatcaaaagctaaattgttcaaccaagaaaatgaagtcaagatcaaattcaaggatgttgctggatgtgacgaatctaaagaagaaattatggaatttgtcaagtttttacaagaccctcacaaatatgaaaaattaggtgcaaaaatccctcgtggggcaattttatctggtccaccaggtactggtaaaacattgttagccaaggctactgccgtgagtcttcactacgagcgctag

SEQ ID NO: 3584 - DNA, 1209 bp, Candida albicans
  unsure (232): Identity of nucleotide sequences at the above locations are unknown.
gaaagaggaaatgggagaatgggtgttaatgatgaacgtgaaaacacattaaatcaattgttggtggaaatggatgggtttgatacaactgaccatgttgttgttttggctggtactaatagaccagatattttggataaggctttgttaagaccagggagatttgatagacatatttcaattgatgtacctgatgttgaaggtcgtaaacagatttttaaagtccatttanataaactcaaattgaaaagtgtccaagatattgatgccaaacaaaaagatgttgatttttccaaataccaacaattgaaaaatgaagagattgaaaaattggcaggaagattggctgcgttgactccaggttttgctggtgctgatattgccaattgttgtaatgaaggggctttgattgctgccagagaggacgcacctgccgttgatacttatcattttgaacaggccatagaaagagttattgctggattagaaaagaaatctcgtattttgtctcctgaagaaaagaaaactgttgcttatcatgaagcaggacatgcaatttgtggatggtttttgcaatacgctgatccattggttaaagtgtctattatccctcgtggtcaaggtgccttaggatatgctcaatatttgccaaaagaccaatatttgacttcacaggagcagttcaagcacagaatgattatgactttgggcggcagagtgtctgaagaattgcattttgataccgttaccagtggtgcttctgatgatttcaaaaagatcacccaaatggctcaacaaatgatcttgaaattaggtatgtcagataaattgggtcaaatttgttatgacactagcagtgataatggtaatggattcaaagttcaccataattattccgaaaccacagctcgtattattgatgaagaagttaaacgattgattgatgaatcatatgaagcttgccataaattgttgactgaaaaactagatttagtagataaagttgctgaagagctatttaagaaagaagtattaactagagaggatatgattaagatttgtggtccaagacctttcccagaaagaaatgatgcctttgacaaataccttcaaggtgaagatgcattcaaggggaaaccaaaatcaaaagaccaaaatagcaacgatgatggtgcgtcttccccatcgtctgctccagaaaccgcataa

SEQ ID NO: 3585 - DNA, 687 bp, Candida albicans
tctcctattccctcgaaagatgacttgccaaaacccgattccaaagaatatttgaaattcattgacgataatagacatttcagtatgattagaaacttgcacatggccgactttatcactttattaaatgggtttagtgggttttattctattatttcatgtttaagatacactttaactggacaaactcattacgtacaaagagcacattttttcatattattgggattattttttgatttttttgatggtagagttgcaagattaagaaataaatcatcattaatgggacaagagttagattcattagctgatttggtatcatttggggtatctccagcaacaattgcctttgctattggattcagaacaactgtcgatgtgttatttttggccttttgggttttatgtggattaacaagattggctagatttaatatctccgtcaataacattcctaaagataaacacggtaaatcacaatattttgagggattgccaattccaacaaatttgttttgggtcggattcatggctttattggtgtacaaagattggattcatgacaacttaccatttggaatagttttccaagatactctgtttgaattccatttggtcacaataggatttgttttacaagggtgtgctgaaatctcaaaatctttaaaaattcctaaaccatag

SEQ ID NO: 3586 - DNA, 306 bp, Candida albicans
ctcaaatcatcaatgtcaacagcatcaaaaatcactcttggggcatcatgtgcatttgccgtaggtgcatttgttttcatcaattattcacaacaagctgaaagacaagcattaagacaaggaccaattaaagatgctgcccgacaacaagctaagcaattggaaaaactgaaaaagcaattagccaatgaacttgaacataaagaacaaaccgaattaagagagaaatatttgaaattacaaccattaagtgatgagattattaaaggtgaagaagggaaaattattcctcctaaggacgcttaa

SEQ ID NO: 3587 - DNA, 924 bp, Candida albicans
  unsure (890): Identity of nucleotide sequences at the above locations are unknown.
acaacattagttctcacacccttaccaagtttattttgtattaaaattatgacacgagtagtagttacaggaatggggatggtcagtcctcttggagttggattatcacgtaactggaaacaattaattgccaataaatcaggattaatatcaacaacaacattacccgattatgaatcagctggatgggacaaaatcccatcaaaagtaattggtaaagtaccgcatggaactatcctggagggtcattggcaagttggagatcatatacctgcaagtgaagcacgaagaatggctacatttagtcattatgcactagcatctactcatgaagctttacaggatgctcgattattaactgaagataataatgctttaaatatggatacaaataaggttggagtagcagtaggaagtgggattggatcatttgaagatatttataataattcaattgcttataatgcatccgggtataaaaaagttcaaccattatttatccccaaattgttaaacaatatggctgcaggaaatatttcaattaagtatcaaactaaaggtcccttacattcagtatcaacggcatgtgccactggtttacaggccattggtgatggatttaattttttgaaaatgggatatggtcaagtaatgatttgtggtggtacggaaagttcaatacatccattagcattagccggttttgctagagcaagatcagtagtcacagattctgaatttaattctaatccaacgaaagctagtcgaccatttgataaatcaagaaatggatttgtgttaagtgaaggatgtgggattttagttttagaaactttatctcatgctttagaaagaggagttacacctgagcacatttatgggaaaagttntttcgaacacgccgcatgcggaccgcagtttggg

SEQ ID NO: 3588 - DNA, 282 bp, Candida albicans
agagcaaagtatcatcgaacgaaatcttcaattggtcatttattaggtgccgcgggtgccgttgaatcaattttcacattaaatgccatcaaaacaggtcaaataccagcaactttaaatctcgataatgtaggacaacatgaaggagatgaacaatcacaatttaagtttgattatgttgctaataagagtattactatggatgttaattatgcagtatgcaattcttttggatttggcggtgtcaatagtagtttatgcttcgcaaaataccacaattga

SEQ ID NO: 3589 - DNA, 2598 bp, Candida albicans
ttgagtcccttatactgtcttataatgatcagacaagtgaataaaaaggctatttcaaacagtcttttcaaaagattatcgctcagtagtagtgcttttgctaatattacagccaataaaaaatcgtccactcatcaactcaaccaaaagactcaattaacaaatgttcgtttctattcaacaaaatccactgttattcagttattgaacaacattggttccaaacgtgaagttgaacaatacttgaaatatttcacttcggtatctcaacaacaatttgctgtgatcaaagttggtggtgcaattatcacccaacaattgaacgaattagcatcatgcttggcatttttgtatcatgttggtttgtaccctattgttttacatggtactggtccacaaatcaatgaattgttggaaaacgaaggtgttgaaccagaatatattgatggtatcagaatcaccaaccccaaaacaatggaagtagtacgtaagtgtttcttagagcaaaacttgcgtttggtgacagctttggaaaaaattggtgttcacgctcgtccaataactgctggtgtatttgaagctgaatatttggataaggacaagtatcaattagttggtaaaatcactagtgtcaacaaatccccaattgaagccgccatcaatagtggatacttgccaattttgacatctttggccgaaacctctctgggtcaattattaaatgtcaatgccgatgttgctgccggagaattagctcgtgaatttgaacctttgaaaattgtttatttgaatgaaaaaggtggtattataaacggaaacactggtgagaaagtttctgctatcaatttggatgaagaatatgaagatttattaaaggaaagttgggttaaatatggtactaaattgaagatcaaggaaattcacgatttattacaacatttgccaagatcttcttcagttgccattattgatgtcaacgatttacaaaaggaattgttcactgactctggtgctggtactttgattagaagaggttacagattaataaacagaaactccttgcgtgattttggtaacccagacttgttaagaaacgcattattaagagacccagaaatcaaaactggtaaagtgtctgttgcttcatacttgaagtttttggattctgttcaattcaagagttatggagacgaacctttggaagtattggctattgtggtagaacaaaatgacaaaattcctaaattagacaagtttttgtcatccaagacaggttggttaaacaatgttaccgataatattttcaatgctatcaagaaagattacagtcaattatgttgggttgttaatgaaaacgatgccaacttaccttggtatttctccaaatcagatggttcatttgccaagaatggccaaatcttgttttggtacggtttaaacattgacgaagctagtaaattgattaaagaatttgattcttcatctattggatcatcgttgtcatcttctaaagaatctggcgtattcacatctgctcaacaaaagcgtggtttccaccactctacagtccgtagaaacaccaatcctaatcctccattatctgaaggtaagcaaaccgagagaaaaaaagttgctttgattggtgctagaggttacactggacaaaacttgattaaattgatcgacaaccatccatacttggatatttcatatgtgtcgtcacgtgaattggaaggtcaaaaattacaaggttacaacaaggataacattgtttactccaacttgcaaattgaagacatcaagagattagaagaaaacaatgaggttgatgtttgggttatggctttacctaatggtgtttgtaaaccatttgttgacactattgatttagttcagaacccaaattctaaaattgtcgatttatctgctgattatcgttttgacacaactggtgaatggacttatggattaccagaactaaatgatcgtaagaccatagctcaagctaagaaaatttccaacccaggttgctatgccactgctgctcaagtcgccattgccccgttaaaagaatatatttctggaactccaagcatttttggagtttctggctattcaggtgctggaaccaaaccatctccgaagaacgacgtcaatttattgtcaaataatttaattccttactcgttaactgatcatgtacacgaaaaagaaattagtagtcaattaggtttacaagttgcatttaccccacacgttgctcaatggtttcaaggtattactcatactatcaacattccaattaaaaaaggatctttgacttctcgtgaaattagaaacatttaccaagatagatatcaaggtgaaaagctaatcaccattagtggagaagcaccacttgttaaagacattagtggcaaacacggtgtcgttgttggtggctttgctgtcaactctaatgaagaccgtgttgttattgttgcgactattgacaatttgttgaaaggtgcagctacccaatgtctacaaaatataaatttgagtcaagaatttggtgaatacgatggtattccaaccgaatccttgatcagaggctaa

SEQ ID NO: 3590 - DNA, 660 bp, Candida albicans
agaagcccagagattgaccacagagataagacatatgttccagttttgtctggtgctaatatgaattttgatagattaaggtttgttagtgaaagagcagttttgggtgaaggaaaagaagtctcattggctgttaccattcctgagaaacctggtgagtttgccagattgcaaaaagttatcaatccacgtgctatcactgaattttcatacaggtacaacggtgaagaaaacgccgatatatttgtgtcctttaatgtactggacaagaaaaaagaaaagtcttcagttatagcagcaatggaaaattgtggatttgaagttgttgatatttcagaaaacgaattggcaaaatctcatggacgttatttagttggtggtaagtcacaatctacaaaatcctcaaatgaaaaaatctatcaatttgaattccctgaaaaaccaaatgctttgtttaactttttacaagcattaaggagcgactggaatatcagcttgtttaattatagaaatcatggacatgatgtcggaaaaatcttgtgtgcatttactcttcctgaaggatctgaggaagacttccaagaatttttaaagaatgttggttacacttttgttgatgaatctgataacatcttttacaaaaaattcttgagaagctaa

SEQ ID NO: 3591 - DNA, 582 bp, Candida albicans
atagtacaacgaccaaaccccttacccctattacaaaaatggccggaacttttggactctgatttcatagtgaattctcaaggtgaaaaacaacccgattatgtcaaattgatattaacttcaagagtgtacgatgttgtggacgaagccggtacaccattaaccaatgctatcaatttatctcatagatgtggtgccaatatctatcttaaaagagaggatttgttaccagttttttcgttcaagttgagaggtgcatataatatgattgcccatttgcattcaaattccccacaacctatatcaggggttattgcttgttcggcaggaaaccatgcccaaggagttgcattttcttcgagtaaattaaatatcccagccacaattgtcatgcctactccaacaccttctatcaagtacaccaatgtttcaagattaggtgcccaagttgtattgtatggagacgattttgattcagcaaaacaagagtgtgaaaggttgagcacagagcaaaatttaatcaacattccaccttttaaccatccttacgttattgctggtcagggtacgattgctttatag

SEQ ID NO: 3592 - DNA, 1245 bp, Candida albicans
attcaaattttcattaaaactgaatttgtcaagtctaccccacctccggttgatctccaaaaatctattggatattggttattaggaacttctactttggtttccggtattgttgttttaggaggattaacaagattgattgaatctggtttatccattactgaatggaaacctgtgactggagcagttcctcctttaaatcaacaagaatgggaagaagagtttaataaatataagaattcccctgaattcaaacaattaaattctcatattactttaaatgaattcaagtttatttttggcatggaatggggtcatagattggtaggaagatgcataggggcttttttcattttacctgctttgtatttttgggctaggggtagattcactcctcagttgacaaaacgtgtggtaggtcttactgggttattaggtttacaagggtttatcggttggtggatggtcaaatcaggattggatgaagagcaattagccgaaagaaaatctaaaccaaccgtttctcaatatagattgactacccacttgggtgctgcatttttaatgtacttgggggtattatggactgcatttgaaattttcaatgagaataaactcgccaacttggctaaaaaatcgccagaagctgtgcaagcaattctcaaacaattaaataaccctgccttgaaaaaaaccaaaatagtcggtttgagtttattagcattgacttttgtaacagccatgtctggtggtatggtcgctggtttagatgctggtttaatctataacactttcccacacatgggtgatgattggattcccaatggaagtgaacttatgtctccagtcttttccagaaaatcagatcaatcagatctttggtggagaaatttattggaaaacccaaccactgttcaattagtacatcgtatttttgcaactaccactttctttgctgtcttgggagcacatatctatgtcaacagaaacaaaggtgttgtacctattgctgctaaaagaataatgcatggtgttatgggggttgttacgttgcaagtagcattgggaataactacattgatttatttggttccaattccattggctgcattgcatcaagcaggtgccttggctttattaaccgcttcattagcattttcagctaaattgaagaaacctagaccgcaatttgtacaattcatcaattccaatatgaaaagcaaattattaaaaacgagagtttga

SEQ ID NO: 3593 - DNA, 909 bp, Candida albicans
ttcttttttattttttttttttttcatttttttgatcaaactgtaaatctaagaactattactataactataataccacccataatgcttagattagggttgacccgctcatttagagcaacttcagcatctttgaaaaccgttagggttggaattccctctaacatagccacccggtcacctttaatatactcatcaatcagattcaattcatcgacaacaactagtgggactgaaatccaagataaattgacttcatttgatgataccaccacttctgctatacttgaaaatgttacaaatttacattctgatcaattgggatatttgcaatccatcggtctagctcaaggttggggaccaacaagtttgattgaaagattattagaagttactcatgtttatactgggttaccatggtggggtactattgttgttgctaccattgctgttagacttgttttgtttccattatatgtcagagcatcatctaatgcaactaagatgtctaaaataaaaccacaaattgacgaattattacaacaaattaagactggtgatacagttgaccaaatgagagctatggaaaaaagaagacttattatgaaagaaaatggtgtttccacattagccactttatttcctgccgtccaattaccattggcatatgggtttttccaagctttgagaaaaatggctaatcataatgttgaagggttttctgatcaagggtatgcttggtttcaaaatttgattgaagttgatccatatttgggattacaagctatttctgctgctgccatcattgctgttgttagagtgggtggtgaaactggtcaacatgccatggcagcaggtatgaaaaaagtcacgactggtcttcacgacgggatggcatcatgcttggtc

SEQ ID NO: 3594 - DNA, 1644 bp, Candida albicans
atgtttagaaaaggactaatcagatttcaacatactctcacccatactatgacacgtccagttagtaattccatagtgttaaccacaactgaggaaaagattcgtaatgttttggttggttactgtgattattacaacaagactaataatgattcacttgaattgagaattaccggaggctgggttagagataagttgttgggcaatgaaagtcacgatattgacatagctgtaaatcatctaactggtgaggagtttgtcaatggacttcacgactatctacgtcagcatgaaccagaattatcaatgaatcatgttcacaccatcaaaatgaaccccgaaaaatccaaacatttggaaacatgcactacaaagttatttggagtagacattgactttgttaatttaagatcagaagaatatacccatgatagcagggtgccatctattgagtttggaactccggaacaagatgctgttcgtagagatgccacattgaatgcattattttacaatttgaaccaaggagaaatcgaggattacacgaaacgaggcttatctgacttgcaaaatggtatattgaaaactccattggctcctatcaagacatttttggatgatccattgagaattattagattgataagatttgccagtaagttcaattttgttgttgaatcagaaaccttgaatgcaatgaaagaagaacacaataagtcggcattactgactaaaataagtaaagaaagaattgaaattgaattgagaaaaattttaaccagtaacaatcccggttatggattacagttgataaactacgttgatttggcaagtagtatattctatgttcctgagttagcaaaagagtttgataatgaatcattggaggaagcacgttcccaacttgcttgtcacatggaaattgccagtttaatctacccaaatttcaagcaaactatcaataattcaactgagaagtttaagaatgagtttgccgcgttaatgaccaatgatgactataaaaatgttttctggttatctgtcatattgcacccatacactaatgtcaagtcatgcaaaccaaacagagacattttcaaccagtatttgaggttgggtcttacttcgaaaaagagtgatattgctaaagtttcagctatcaatatgaactctgctgagctttcgagatttttcagtgcacctgaacttgttaagagatcagatattggtctttatttaagaaaatttcctgaatttgcatcattgaatttgattgtcaatgctcttttggattgtgtgagaaaagttgatcaatttactcaattaccaaaagagttgcctgttccatttcctgaagtaggagaaaagattttaggagatgaaaatatcaataaagttatttcagaaattgttagtagatacgagaatttgtttgttcagattgaaaattgggatttgactaatgttcatttggtgaaacctttaattgatggaacaacattatcgaaatcattgggaatgaaacctggcccatggttgagaccaactatagaagaaatactagtatggcaattagataatcctcaatcaagtgtggatgagtgctttgagtttgtaaagtccattattccaaaatacaaatag

SEQ ID NO: 3595 - DNA, 588 bp, Candida albicans
  unsure (21),(22): Identity of nucleotide sequences at the above locations are unknown.
gcccgcccgcttaatttttcnnccggcccgtctggtgaagaacaaatacgtctggggtcagcaattggcggggaagcacagacgtatataaaaaatgggtcgttggtccctgacaatataatggttggtcttattactgcagagttggaaaagaaaaagtggttaacccaaagttctagctggttattggatgggtttcctaggactgtcaaccaagcaagggagttggatcgtgtgattcacgatcgtgctaattttaatttggtggttgagttggatgttgaccagaaagttattttacagcgaattgaggccagatggatccatgaggctagtgggagagtgtacaatttagactataacccgccaaaagtgccattcaaagatgacgttacgggcgaggcattgaccaaacgccaagacgatactgcacaagtgtttcaaaaacggttggaccagtataatgaggagattgagcctctcaaagtgttttacaagcagcaagggttgttgtatacagttagtggcgacacttctgatataatctaccccaagttggagaatttaatagtagataaaattatgtag

SEQ ID NO: 3596 - DNA, 2058 bp, Candida albicans
cccccccccgttcatttgtccttcggcccgccttgtgtgaaaacagatttgagcaggattattggccagcttcaatataaatgtaaattcaagaccaatactcgaactgaagccattattttagggaaaatgttgaatgacagtgataatgcacaatcgagcataagtgagttttttggaaacatggaaaaacaaacaattgttgaaattttgagaaacatggatgttattggagtcgacaatttgtacaaagtgtttgactgtgactcgattgatgcctctgtcattccaaaagaattacaagaaatttatcaggaacataaactgaaagaccacgatgatgaaatcgccgaagacattctcaaattacaagaaaacaaacaaattaatccgttagacaaaaaaagtcttgaagaattattgccagtggattcatttggattgcaagttattagacacagtttgctaggcttgaagccagacctggaagctgctttaaagtttgctgatcaagtagagaaaatcattgaagacgttgacgatgaagtgttgaaccaagatatcatgagtggtaaaataaattatttcgaaatgtacagcaagttgaaaaccgaagaacaaagacaggcttttaacgaggcactcaatgttttcaatcttgagagacaaaaacaaattgaaattagagggattgaaggtgcaaaggaaaaatggaaacacgatttcgaagaactgcaaaaacgaggggatttgaatttgtcgaaagggttgaatgcacaatgctataaatggcttcaagatgtcttaccagtattggaaaaggaatacaaactatgtgaagcattaatcaatggcaataactctgtcattgaaaaagatgacccaaatgccaaagatcgtgcaatgtacgccccatttatattgaaaatatccccagacaaggcgatcatcataacaatccttgagttattcaaattgcactccacaggaggagttgttcgtgggttccgtgcctataaagctattcaaagtgtaggcaaagccatagaggcagaatatcgaattggattgcaagcaaaaaaagaaaataaattgttttctcaaaaacatttatcaccacaattgcagaagttgatgagaagaacaatgcaaaagggtaatgaatcaaccccagaatgggatgatgccacacgtgcaagaatcgggggtgttttggtatctatcttgatgtctgtagctaaagtgaatgttagaaaggaaacacctcagggattaattgaagattttcatcctgcattttatcacggtatgcagtttattgctggtaatcgtgttggggttatcaaggtgcatacagacatttcaaatattttgagtggaacatcattaaccgaatcaattcaaccacaggcattgccaatgttagttgaaccaaaaccttggaattcattttatggaggtggaagcttatattcaaaaactcctttagtaagagtcaaagattcacctgagacagaagcgtatctcaaggctgctaacgaacgcggaaacttaaccggagtgtttgaaggcttgaatgttttaggaaacaccgcttggactgtgaataaaaaagttttcaatgtcatttctcattattggaattctggagaagagtttttgagtatacctcctgtgtcagaagagccacaattacctcaagatatacctggaaattctgacccccaaaaattattacaccacacaacatcaaagtatcaagctcttgatgaatacatatctaacaaatctcaaagatgtgacaataattatagattggaaattgctcgtgcatttatcggtgaaaaattgtttttccctcataatttagattttagaggtagagcttatccgatttctcctcacttcaatcacttgggtggggacttgactagatcattgtttttgttttgggatggtaaagaattatgtgaagaaggattgaattggcttaaaatccaattggccaatgtatatggtgtcgacaaagagtcacttgctaaaagagttgaatttgtc

SEQ ID NO: 3597 - DNA, 1014 bp, Candida albicans
gacgcggattatctcagcccgtgcgtcaagactacaaatgtttacggtgtcaccgttatcggtgctattgaacaaatcaggaaacaaataatacatttattccctaaagacgctgatcaccacgcggctgccaggtatgtagctgttcaagtgtatgcttctattagagaattatttgagaatgcccatttcattcaagcttggttaactgaatctgctaaaagaattaccaaatcagttacattagattttggcgaatctcaatattccgaacaggaacttttgtcaacggttatttggactaccccattaggattaccttgtgttcaaccatatcgtttacacaaaaagaaacaattgaaaactgcagtgcaagatttaaatattgtgatgccgtcaaacaccagtgccgttgattccagaaagcaacaaaatggatttccaccaaactttattcattccttggatgcaacccacatgttgatgacagcaacaaaatgtgcagaatttgacttgaatttagcctctgttcatgactcgttctggacacatgctgcagatgttcctcagatgaatagaatcattagagaacagtttgtcaaattacacactaccaatttaatagaattgttaaaagaagagttttcggagagatacaaagacaattaccaagttcttccaatacctaataatcacgaattagcccgcaaagtaaaagccatcaaaaaagaatgggcagaggcattgaacagacctgttcaaatagccgacgagttgtatatggagcgtaaacgtttacagatgttggagtctgaagatccagaagaagtcgaagtcgccaagaatatggaaactactataagtataacgatgaattataagccatatgaatttgcaaaccgtcaagtttataatagtttccaaattttagttcctatacagttcccagaagttccaagtaaaggtgagtttgatgtgaatttggtcaaaaaatcgcaatatttcttttcataa

SEQ ID NO: 3598 - DNA, 834 bp, Candida albicans
gaacccaatggattttattggataaaatatcaattagcttcattgtttggacaaaaaaattgtttagagttttatgaggaaaattatgataacattattgattcagcccgtaatccaatgacggggaagaaatggtggatgaaagctgataaaccattttcagctttggcagtttgttttgaaatcaaaaaaatattagattataggatgtctggtggtaagattgaagattataaatgccgtcttccgattcatcaagatggttcttgtaacgggttacagcattatgcaggtttagctgctgatgaaactggtggagcagccgttaacttgattagactggaaacaaagcaagatgtgtataccaaagttttagaaattgtgaaaaagaaaattgaacaagacatactggaacagaatctcgggacagtaaatttggaaactgctaaattttttttaccgattttaaatcgaaaattagtgaaacgtccagtgatgacaacggtatatggggtcactttagctggtgctagctcacaaataatgcaaactatcaaagagattgttgaagatcatcgtaccaatccttccaaaaccacttttagtaacgagacattacataaattaaaatccgttcaactaacacaaacatcgtatcttgccaaaaagattttggattctattgatgaactatttgtccatgccaaacaaattgagaaatggttattacaaaatacaaaacggattcttacttcatacaatataaaaaccatagaccacttgctcaacaacaatccaagctcatttgaaactattttcactacaccaatgagt

SEQ ID NO: 3599 - DNA, 2190 bp, Candida albicans
agctactatcttgcaacaaatgatgttatcatgcaaatacttagactactgggaagacacttatgtaatataacactaaaatgcttgaaaagacaaataactacattatctgtaccagatcgatctgtgagtgatatcacctcatcgatatttgaagttaccaaagatatcaatcatggaccaagaagttcaacaaaagtcatgaaatatgtcagtagcttctatcaaaatgttaaaatcatgaatcttgaacagatttctcgaattttaacagatatagcgaatgatatgttgaaacgggatgataatgtgataaataattgtgaattttatttcaattgtttaaagattggattgaactgtttttcagaatcaacatctactgaagcattatatttactaagaaataatattgaagattataggaaagtgatagtgaaatttagaggacttggaacagtgcctgaaacagtgccgtattcagaaatgaaaaatattcagaacttgtttctaaaaacaatattacatctttactcagtgtcaaaacaatctgggaaatcaagaattatcaccaacccgattacggaatactttttacataatttaaaaagttttgacaccgatatccaagagtttgccaatgagttgacacaagaagaaagtttgcaaaaagcattgacagaaatttgcttctcaaagcaaattagtttaccagttacaaaaacatcgatagagagagaaccataccatctggtgtccattgaccaatacttggatgagtatggagggatagactatgaaaacatttgtaaatatatatcagattacaaattcacatggcgtggtcaatatatcaatgacaaattattcaattattatgatacactttcaactgaagagaaatcacaattcatggaagcatacttggattttaacaagtcgaaggaattaataatagaaaagtataccaatagaattgtgcatgtttcactggaagcatctaaacaatttgaaaaatctttcaaatttggcatgagtgaaaagaatttgattcacaagtggataacagacacaactgaacagattgaaaaaatattagaaattgaaaccagtttgtcaaatgaagaagttattattcatcactttaagccatttttggaaacagtgacaattcaatcgattataaattatattattttttcaattttaggctcccccgatgggaaattaaccacagttatagaaaagatgaaatattcgtttcctagtgtgttatcacaacatgcttctccaaacttgaaaggtgaagtattccaatatataaacgatgatgcttatattaaattgacccatcaattggtcaagttgataatagagaattgcaaagtccccatcacaagtaaacagatggaacaacttcagaattctttaaaattagaaaacaaagaaattgctgatcaattcttaatctccagtggtggtaatgatgatgaatatcttgccttttgtaaagaaacaaaacgaataactaatacaaaaaacaaaacttatattatagtgaaaatgcatccctatatagaattaaaactacaatctttgaagttggggactcatttacattatttgccaatgttacatccaccaaaaccttgggtgaatcctcaaagtggtgggtatctaacaataaaaacaagttttgtgtcaacaaatgattccattcaagtggaattattgaacagggcaggtgttaggggtcaattggataatgcatattcatgtcttgatcaaatggggaataccgcttgggcgataaacccattaatgttggatgttttcaataaattaatgggaaaccccgatgggttcttaagtatcccgccactggtaccagatgaaactttaccacagaaaaccaaaacagaattgaaaagtcttcgaataacttttgaaataatgaataaactcgccaatgcctttggtgaaaatggagatttgttataccattgctacagtttagattttagaggtagaatataccctttttctcccttgactcattatggaggtgatttagcaagatctttatttatgttttggtatagtgagccattaggaacccaatggattttattggataaaatatcaattagcttcattgtttggacaaaaaaattgtttagagttttatga

SEQ ID NO: 3600 - DNA, 720 bp, Candida albicans
aagattatgagaataccctcagcaagatttgttagaacaggtttatgttcctttaagcctagatcttttgcatcaggtagattaccttacacttacttggccacaagagcatttcactcatcaaaaataagagccattaattttgatccttataagacattgggagtagacaaatcagcagatgatagacagattaagaaagcatactatgatttagttaaaaaataccatcctgatgtgaacaaggagaaggatgcagaaaagagatttcataagatccaagaaagttatgagttattgcgagacaaagagaagagagcacaatacgatcagtttggagcttctgcctttgatgcaaatggaaatgccaatccgtttgcaggacaaggaggaaacccattcggtggattcgggggaggatcagctggaggcaacccattttcaggtatgggatttgatttcgaagatttgtttagggaagcctttgcaggtggaagaggcggagcaggtggcggtagaggtggtagatcctttgtaactgaacatgttggtgacaatattgaagttttaaaaactattccctttaaagattctatatttggtacatctgtgacaatcaattacaaggcagttgattcatgtacaacatgtagtggaagtggattgaaagcaggagctaaaaagaatacttgtccaacatgtcatggtgctggtcaaact

SEQ ID NO: 3601 - DNA, 267 bp, Candida albicans
ttgttcaatactaacattatggttttttcctttcacatttttaaagaaccacatgcagcaggacctcatccattggccccagaagggttggtacctagtggattaaactcaaccaaatcaagcacatatcacaacagtaatccagttgagcctcaaaacggggaattttttgcaagaagtgaattatctgctagatttagatacagaactataaaggcagaagagattgaacaggttgaaagtggcggagctgaatttgtgttttag

SEQ ID NO: 3602 - DNA, 1860 bp, Candida albicans
tgtagaaaattttcacacgttcttcaaatcaataatataagaaaactaacaaatcctgccaatcttattttcgtggttgcctttttgcttatttctttctctgttgttgtttctgtttatcattatcctttttattcattcttgtttgttaaaacccaaatgtcgataagcaaaagtatttacgaactagccgtgatagctaactcattgggtaaagtactcgagggatcttctaaaattgttcagaatgaagcttaccaatggtacaagagtagttttgtctctaaaatcatacaagactcatgtgataattctcaacccatgtatgaagagatgcaaaatatttccactactataagaaaccaagtttcccctaatataaatcaaaaggaaaatccattccaaagccagtctcaaaaacgtagttactccacaaaatcctactcacctggcgatgaagttgaattggaaactgaaagcacgagctctaacactgttccagacatcaaaccaaagttaacgaaaacctttgaaatgtcccagagtgaagttccaagcagcagattggctcgtattttccattatggttctttggccgcagggattggattaaatgctgctacccagggacttaggcattacgcatcgggaaactcagacgcaatcaccatgaaatcattggtgttatctccacaaaatattgaaagaatggccagaaagttttccaagatgagaggtgctgcattaaaacttggtcaaatgctttcgtttcaagatgcttccattttacctaaagagattcaacaaattttgttaagagttcagaattcagcccattacatgcctcctggtcaattggaaagagtgatgtctaaagaattgggtttgaattggcgtgaacgtttatttacttcttttgatgatgtacctattgcagctgcatctattggtcaagtgcatactgctgttgcagaagatttaaccccagttgttgtcaaggttcaataccctggtgtggtggactcgattgattctgatttaaacaatattttgatgttattaactgcgtcttcattgttaccaccaggtttatttttggataaaaccattgccaatgccagagttgaattgaaatgggaatgtgactatatcagagaagcaagaaatttagttagaatgagaaaatttttaaaagatgacgatgcattcgaggtcccaagagttttccaccaactttgtggtgaacatgttttaacaatggaaagaatgagaggaattgaaattgttaaaggggattggggtcaaagtaccaaagattggatcgcgactaacattatgagattgtgcttattggaaattaaagaattcaaatttatgcaaacagatccaaattgggctaatttcttatataacgaaaagacccataaaatcgaattattagattttggtgctgctcgtgattttggcgatcattttatcgacaactacgttaaactcttgagagctgcagttaaaaaagaccgtaaaagagttgaagaaatttccaaggatttgggatatttgactggtctcgaatccccacaaatggttaaagcacatgttgactcggttatgtgtcttggtgaagcattttccccagttgataataacggtgagccatttaatttcaaaaaacaaactatttcggacagagtcagaggcaatgttggattaatgttaaacgagagattaactccaccaccggaagaaacctattccttacatagaaaattaagtggagtatttttgctatgttccagattaaatgcaactgttccttgtgaagatttattcagagaaattatcggttacgaagattga

SEQ ID NO: 3603 - DNA, 219 bp, Candida albicans
  unsure (31): Identity of nucleotide sequences at the above locations are unknown.
gggctatcgcaatcgcggatgcttccagccnccgtgtgtgaaaaacaaaaccaaagaattattaaagaagtcaaaggaatgttaggtttatcgttggtcgaatctaagaaatttgttgaaagtgctcctaaagtattgaaagaaaatgttgccaaagaagatgctgaaaaaatcaaggccactttagaaggattaggtgctaaagtttcattggaatag

SEQ ID NO: 3604 - DNA, 543 bp, Candida albicans
tcgaataaaaaaaaagaaaaatttttctccaaaaaaaaaagacacaccccaaacaacaaccaaaccatgtctttccaactcactcccaaagaggcattcgccaaactcccccagaagttgcacaactttttcatcaaatacccaccacgaccatttgcacagtacaaggatggcccatcaaccaccacagacccgttgagaaacccatttttcccaaacaaaaaccaagagtccggcaactggcaaagcgcaaagttctcccgcagaaggtctgcagacttgttcaagctagctaagaagtttggtatccacgacttgttgccgcctacgccaagaaagttccatgaagacaagtacaccaacaaactgtggttacacggaatgatcaaccctgccagcaaagccaaacaagaagagttggacgccaaattaaaggccagggccgaagccatcgctaatatggataacatcattgtcgccacaagaccaagctacaagaagttattggaaaagagagaaaaacgtaaaaagacatggttctaa

SEQ ID NO: 3605 - DNA, 945 bp, Candida albicans
aataagatttatcaagctactaaatttgttttggggagattagttcaagattatattccaccaactacaagtgaattaactggtaaagaatcattagttgaaaaatggattttacataaattatctcatgctgccaaattaactaatgaatctttagaagctcgtaatttcggtgatgctactaatcatatttataatttctggtatgatttatgtgatgtttacattgaaaattccaagagtttaattcaagatggtactccagaacagaaaaaatctgctcaagatactttgtatacttgtattgatggggctttaagattaattcatccatttatgccttttatcactgaagaaatgtggcaaagattaccaagacgtgaaccagaaatcactggcaaccttaaaactatcatgaaagctccatatccagtttataaatctgaatttgatgatattaaatctttagaagcttataatttagttttagatatcaccaagggagcaagatcattattatcacaatataatattttaaagaatggtcaagtttatgttgaaaccaataatgaagaaatttataaaattgccaatgatcaacaagattcaattgtttctttgatcaaaggggtggaaaaaattactgtggttaaaactttagatcaagttccttccgggtgtgctttacaagccattggacctgaatgtactgttcatgtattagttaaaggacaaattgatttagatgctgaaattgctaaagtggaaaagaaattatctaatgttttagaacaaaaaaagaaaactgatgaatcaattagtaaattcactgaaaagactaaaccagaagctaaagattcagcttataaaagattagaaaaacaaactgctgaaattgaaggttatgaacaaactattgccattttagaaaaattgaaactttaa

SEQ ID NO: 3606 - DNA, 1284 bp, Candida albicans
  unsure (53): Identity of nucleotide sequences at the above locations are unknown.
atttatatgctttatagcagaaatctactcttatcagcatcatcaatattatntagaaaaagaattgatttttgtatgagaagaaagttattatcatcatcatcaattgttacaaataacatgagtgactcatcaactaatccaccaccacctccacatccagctgctgctgctgctgctgctgctgctgctgcagaacaaccagttgcaaccactcctcaagaaggacaaccaaaacaaaaaactgctaaagaattagaaaaggaaagaaagaaagctgaaaaattggcaaaatttaatgctaaaaaggccaaacaagcagctgaagccaataataaacctaaaaaggatcaacaaaaagatgacaaaaaaaccaaaaaagccaatactccaaccaccaaaattcctgaatttgttgataaaactgttcctggtgataaaaaaattttggtttcattagacgatgaatcctttaaagcttataatcctaaaaatgttgaaagttcatggtattcatggtgggaaaagcaaggattttttgaaccagaattaactgctaatggagaaatcaaaaaggaaggatgtttttctattccttgtccaccaccaaatgttactggtgccttacatattggacatgcattgactgttagtattcaagatactttaattagatggaatagaatgcaaggtaaaaccacgttattcatcccgggatttgatcatgctggtattgctactcaatcagtcgttgaaaaacaaatttgggctaaagaacaaaaaactagacatgattatggtagagagaaatttattgaaaaagtttgggaatggaaagaagaatatcatcaaagaattaaaaatcaatttaaaaaattgggtagttcttatgattggtcaagagaaaaattcactttaaatcccgatttatctcaagcggtcactgaagcatttgttagaatgcatgaagatggaacaatttatcgtgcttcaagattagttaattggtcagttaaattaaataccgccatttctaatttagaagttgataataaaactattcctggtaaaactttattatcggttccaggttatgaatcaaaaattgaatttggtactttaacttcattttcttatccagttgtcgatagtgaaactaatgaaaaattgacagttgccaccactagaccagaaatatttttggtgatactgcagttgctgttcatcccaaagatccaagatatactcatttacatggtaaatttgttcaacatccatttttag

SEQ ID NO: 3607 - DNA, 1155 bp, Candida albicans
  unsure (1128),(1144),(1148): Identity of nucleotide sequences at the above locations are unknown.
accagaaatatttttggtgatactgcagttgctgttcatcccaaagatccaagatatactcatttacatggtaaatttgttcaacatccatttttagatcgtaaattaccaattatttgtgatgctgaaaccgttgatatggaatttggtcctggtgccgttaaaatcacccctgttcatgatcaaaatgattacaacactggtaaaagaaataatttagaatttattaatatttacactgatgatggattattaaatgaaaattgtggacctgaatggaaaggaatgaaaagatttgatgctagatataaagttattgaacaattgaaacaaaaggggttatttgtcgatcaaaaagataatgaaatgacaatcccagtttgttcaagatcaggagatattattgagccattattaaaacctcaatggtatgttgatcaaaaacaaatggctaaagatgctattgaagttgtcaaacgtggagaaattgttattaatcctaaaacttctgaagcagaatatttccaatggttagaaaatattcaagattggtgtatttctcgtcaattatggtgggggcatagatgtccagtttattttgttaatattgaaaatgaacaaattcatgataaattagataataattattgggttgctggtagaactgaagaagaagcttttaagaaagcccaggaaaaattccctaataaaaaattcactttagaacaagatgaagatgttttagatacttggttttcatctggattatggccaatttctactttgggatggccaaatgaaactaaagatatggaattatttaatccaatgtcaatgttagaaactggttgggatattttatttttctgggtttcaagaatgattttaatgtcaattaaattaactggtaaagttccatttaaagaagttttctgtcattcattagtcagagatgctcaaggtcgtaaaatgtcgaaatctttaggtaatgttgttgatccattagatgtaattaatggtattccattacaaggattacatgataaattattaactggtaatttagatcctagagaattgaaaaaagccactgagggacaaaaattatcttatccgaacgttattccnagttttgccaaacgancggnattttag

SEQ ID NO: 3608 - DNA, 486 bp, Candida albicans
ttgaaacctacccaattaataaggattctgttgaagggccttttatcttcttcaagcaaattgacaacagatttaaatgatttatataatcagatggatcattatttcacaaattttgactacattagagctattcaatgctggtggtctgttattaatcaagccaaccaaatcttccagagtgcagagccatggacatacgttaagttaatccactctcctgagaaccccgctgaattaaaggaaaagtacagaatccttaataactattttgtttacttatgtgctgagaccacgagaatatcatcaattctcatacagccagttatgcctcagttgtcaaagaaaattcttgatagattaaatgtttctggacgtacatcagagtttactacatttggtgcagatttacaatatggctctggtgccaattccaagtcacataaagtccctctagaaaaaattgctccaagagatattaaatga

SEQ ID NO: 3609 - DNA, 444 bp, Candida albicans
atatcaatcatgtcagcggtgaaaccattgtggtacagatgggcacgtgtttattttgcaggaggatgtttagtgggtacaggtgttttattctggtataccattcgaccaacagatgaacaattaatagccaggttttctcctgaagtaaaagcagattatgaaagaaataaagagttacgacaacaagaacagaaaagattgatagagatagtaaaagaaacttcttcatcaagtgaccctatttggaaagctggcccaataggatctccgtttgaaaaggaacaacggaacttgagtatggagttggttgatgccgagttattccacaagacaaagcacgaggaacaacagaaacaagagatagatagagcaaacgaagaatctaaggaagcagaaaggttgatgcaacaaaataaaaagccatggtggaagtttttttaa

SEQ ID NO: 3610 - DNA, 618 bp, Candida albicans
cgagaaaataataaagatttagtagaagacattcatgcggtatcaattggtccattaaaatcacaagacattttacgtactgcattagctaaaggagctgataattcaacattaattgaaacatcaaatgattcagttaataatgatgttgaaccattacaagttgctaaattgattaaaaaaattgttgaaaaagataattctaatttagtcatattagggaaacaatcaattgatgatgattttaatcaaactggacaaatattagcaggattattaaattggcctcaagctaccaatgcatcgaaaattgaaattgaaattgataatgataatgaaaataatcaagttttagttacgagagaaattgatggtggtgaagatattttgaaaagtaaattaccaatgattataactactgatttaagattaaatgaaccaagatatgcatcattacaaaatattatgaaagctaaaaagaaaccattaacaaaattgaaacctcaagatttaggtattgataaaattgaaaataaattggaaattttgaaaattgaagaaccaccaattagacaagcaggtgttgtcttcacacacaggggctggaaggtcccgcaa

SEQ ID NO: 3611 - DNA, 528 bp, Candida albicans
actgcattagctaaaggagctgataattcaacattaattgaaacatcaaatgattcagttaataatgatgttgaaccattacaagttgctaaattgattaaaaaaattgttgaaaaagataattctaatttagtcatattagggaaacaatcaattgatgatgattttaatcaaactggacaaatattagcaggattattaaattggcctcaagctaccaatgcatcgaaaattgaaattgaaattgataatgataatgaaaataatcaagttttagttacgagagaaattgatggtggtgaagatattttgaaaagtaaattaccaatgattataactactgatttaagattaaatgaaccaagatatgcatcattacaaaatattatgaaagctaaaaagaaaccattaacaaaattgaaacctcaagatttaggtattgataaaattgaaaataaattggaaattttgaaaattgaagaaccaccaattagacaagcaggtgttgtcttcactctacggaagtag

SEQ ID NO: 3612 - DNA, 702 bp, Candida albicans
aaattattattggaaaggccaggattatttgcaattaaacgaggaatgattacttggtttaatgaaaaaggtgaacatatcccggcaactgttttagaagttgactcttgtgaagttttaggctataaattatttaaagattttggttatactgctgttataatgggtacgattgataaattgaaaaatgtcaaatcaaccaatgatttaagaatttttgaaacagctaaagtttcaccaaaacaaaagattggtgaatttaaaattcgttccattgataatgatattgaatccaaattaatccctgtgggcacagaattaactgcagattatttctctgtaggacaaaaagttgacgttaaaggtgtaaccaaaggtaaaggttttgctggggttatgaaacgttggggattttctggtggtagagctactcatggtacttcaaaagctcatcgtactcctggtgctactggggggaatcaaaaccctggtcgtgttttccctggtaaaaaaatgccgggaagaatgggtcatcaaaataatactgggttcaatttagaagttttacatactgatggtgaagccggaatattgattgtcaaggggaacgttcctggtcctaaaaaatcaatcattaaagtttcagatgctataaaagaatatggtaattctataaataataccatccctcaagaaaagtaa

SEQ ID NO: 3613 - DNA, 522 bp, Candida albicans
agtaatggaagagtcgttgaaaaaggtggtgttgttttatatgtcggtactcataaaaataattcatcaattcaagaagcattagttaaagctagtgaaagatctcatggttattatgtcaataagcgttggatcccgggtactataactaattacactgaagttacaaaacaatatggtcaaattaaaactaaaatggaagttgatatgaaagatcaaaaaattactaccaaaaattctaataaaattattaaaccggatttaatggtattattaaatccagtagaaaatagaaattgtattaaagaatgtatttctgctggtattccaaccattgggttatgtgatactgatatggaaccttctttattgacttatccaattccatgtaatgatgattcagttagatcagttaatttgatgttgggtattatgagtaaatcagctgaatctggtttacaaaaacgtatttctgctgttaaaaaattagaagaaaacgatgggaaagtagttaaagcttaa

SEQ ID NO: 3614 - DNA, 885 bp, Candida albicans
tcgtgtgcgtgtgcgattggttatttgagaatattcaccaaaatttttcaaagaggtttggttcaaaaaaaaatttttttttacaacaatactaatactagtctggcaatacaaaagtatcacttaagttgggcaatgataagatcaactacagctacaactacaacattgagatattgtgctcgtattttcagaaatctcagtagaagttattttactgaaaattctcaacccaacccaaatgaacaaccacctttggaacatacattatctcataaagaattacgtgaacaagcaattgctgaagcattagctagagaagaagaagccattttaaaaacgaagaaattgagagaattaactcaagaaagtcaaaatttgatatcagcattaaataaaactccaacaactttaattaatgaaagattaaataaattaaatgaagatttatcaaaattatcccaagataaaatcaaacaattagatgaagaattgaaagattatttaaatcaaaatatgattttacctgatcatttaaaagctaatcgcccatggcttagatcaagtgataataatgaggatatatccaaaaaattgaaaacttcaataaactctgcttcttcttcagattcaaatcatacatctactacaactactacgtcatctcgatacactgaacaattcccaaatttgaaacctactcctgattataaaccttattctgaacaagaattatatattagacaattaaatcataccagaataaatggaagaataggatctcgtttaactcaagtttataaacctcaacgtgatatcaataatccaccaaaatttgataataccaccatagctaatcttcaccaccgcctagcagacacagag

SEQ ID NO: 3615 - DNA, 687 bp, Candida albicans
ttaacaatgttttctatcagatcatcatctcgtgttttattaaaggcttcttccgcaactacccgtgctactttgaacgccgctgcttccaagactttcactagatctaaatatagtttaccagaattggactatgaattctccgctactgaaccatacatttctggtcaaataaacgaaattcactacactaaacatcaccaaacttatgttaacaaccttaatgcttcaattgaacaagccgttgaagccaaatctaaaggtgaagttaaaaaattggttgccttacaaaaagccatcaatttcaacggtggtggttacctcaatcattgtttgtggtggaaaaacttggctcctgtctctcaaggtggtggtcaaccaccaagtgaagattccaaattaggtaaacaaatcgtcaaacaatttggttctttggataaattgattgaaatcaccaatggcaaattggctggtattcaaggttctggatgggcttttattgttaaaaacaaagccaatggtgatactattgatgtcatcaccactgctaaccaagatactgttactgatccaaacttggttccattgattgctattgatgcttgggaacatgcttattatttgcaataccaaaatgttaaagctgattacttcaagaacctttggcattttatcaactgggacgaa

SEQ ID NO: 3616 - DNA, 204 bp, Candida albicans
aagcccattgccagttctctgatactcaatttctcttctcttatcaaccacgccatgattaccgaaaacgaaaagatatccttacccaagattgattgggctcttgatgccttggagccatatatctctaaagaaattaacgatttgcatatcaacaaagtatgttctgccatgcaccgaaaatgtacaacgccaacttactaa

SEQ ID NO: 3617 - DNA, 516 bp, Candida albicans
caccatgttgcttatgtaaacgggtacaatgccgctattgacgcacttgaaaaagctgttggcaagagggatctcaagtcggtagttgagatccagcaaaatatcaaattccacggtggcggacacaccaaccacagtttgttctggaagaatttggcccctgtatctaaaggtggtggcaaacaccctgataccagttccgctttgggtaaacaaatcgttgctcagtatgggtctgtttcaaaccttattgatatcaccaattccaaattagctggcatccaaggatcaggttgggcatttatagtcaaaaacaagcaaaacggaggggctttggatgtggtcactactgccaatcaggatacaatctctgcaccacatttggttccaattattgccatcgatgcttgggaacatgcgtactacttgcaatatcaaaatgtcaagcttgattatttcaaagcaatttggaacgtgatcaactgggctgaggcagagtcaagatactctgcgtaa

SEQ ID NO: 3618 - DNA, 543 bp, Candida albicans
gtttcaatcattcttatattgatagtggtattttgcggtataacattatctttagtccctgaagctgctcatgtttcatcacaaatcattgctcatgaattgagtcaattgttagtcacagaagaatcaccatgcggaatgaatgcaaaagatgttcaacgtgctaaaaatccattaattagttcattattaatgaatgttgaaagtaaattggcaagattagaagatttgggtcgtcaaatacaatgtcaagggaaaatcactactattgatgaaatggttgataaaattaatcgtttaactataaaagatttacaaaatgttgcagaaaaagtattgacaggtaaggttataacttctaatggtggtactagtttgggtcttccatcaattgttatgcaaggagaaagagaaacttttggtgatgtggaatttattcttcgaagatatggattaggtaattacaaaggtccagaaatcacggaaccaagagatttcagtagtaatcaaaatgaaaagaagaaaaagagtcgttggttttag

SEQ ID NO: 3619 - DNA, 1137 bp, Candida albicans
tcaagtttaacctttttttttttacaagtttcaagacatccaccatcaatgctaagtagaagaacaataactaggaaactaaataaaggtgtttcaaaatctttactatcatttgcaagatataatcattccataaccagtaccacaacaccggcatcactgcaaccccatattgaattaaccacatttgccaatggattgagattaattactgattctacaccgggacatttcaatgctgttggagcgtatattgatgctggttcaagatacgaagatcctaaggcaccaggattatcttatttgcgcgatagattatcctggaaatcaacagaagattttacggggcaacaaatgttggaaaatttatcgaaattgggtggtaattatatgagttcggctcaaagagaatcaatgatttatcaagcatctgtttttaataaagatattgatagaatggttggtatgattggacaaaccatcagatatcctattttcagtgatcaagaattccaagaagcattacaaaccgctgaatatgaagtagcagaattggcatacaaatctgatttatatttacctgaagaattacatactgtggcgtataaggaaaacactttaggactaccattattcatccctcaggaaagaatccccttggtatctaaatcagacgttattgattataataataagtttttccaaccacaaaacactgtcattgccatggttggtgttcctcatgaatatgcattgaaactaattatggaaaattttggtgattgggcaaatacaaccacaacaaaaccaaatccaggaattaagaattatactggtggtgaaatttcattaccttatactccaccattatatgccaatttacctgaattatatcatattcaaattggattcgaaaccacgggacttttaaatgatgatttatatgctttagccactttacaaaaattattaggtggtggctcttcattttccgctggaggtcctggaaaggggatgttttctcgattatatactaaagtattgaacaaatatccatttgttgaaaattgtatgagtttcaatcattcttatattgatagtggtattttgcggtataacattatctttagtccctga

SEQ ID NO: 3620 - DNA, 1257 bp, Candida albicans
caactacaatacagacatacatattcatttataatgttaagatcaactactcgtaatacattacgtttggctactagatatactaaagtttcatcaagtatcattcgtcacactttaccaacagtgtttggtagtagtactggtggtagtggtataagatttgcatctcaattggctcatgttaaaaccccaccaaacttacaaaatgaaccagttaaaaattttagtttcaaagatactaaagattgggatttattaagagcttcaattactaaattcactgatgaaggtgctttaaaagtcccattggttgttggtggtaagaagatttatcgtgacgaaatcaaaactcaagtaaacccagctaaacactctcaagttttagctgacgtttctcaagctactccagaagatatcattgctgctattgatgctgctaaagctgctaaagccaaatgggcaacaacttcttggactgacagagctgctatttttttgaaagctgctgatttaatttctaccaaatatagatatgatatgtgggctgcaaatatgttgggaacaagtaaaaatgtctatcaagcacaaattgattgtgttgctgaattgattgatttctttaaatttaatgttaaatatgctgaagaaatgtatcaacaacaaccaatacaaacttctcctggtgtttggaaccgtgctgaatatagacctttggaaggttttgtttatgctgttactccattcaatttcactgccattgctgccaatttggttggagctcctgctttaatgggtaacactgttgtttggaaaccatctgctacagccgcattatccaactacttgttgttgacaattttggaagaagccggtttgccagctggtgtcattaattttatccctggtgatccagttgaagtcactgatattgttttaaacgataaagaattctcagccttacatttcactggttctactgatgttttcaaaagtttgtattctaaaatcagtaataatgttgctgctgataaatatcgtgacttcccaagaattgtcggagaaactggtggtaagaatttccatttgattcatccaagtgcttcaatcaatcattcggttttatctacattaagaggagcatttgaataccaatgtcaaaaatgttctgccacttcaagattatacgtaccagaatcaatttggccagagtttaaagatcaattagtgggtgccatgttcacagatcactattggtaa

SEQ ID NO: 3621 - DNA, 1170 bp, Candida albicans
aaaacaatatttcttcttgaggaagtctccgatagcctatatggccacaattactgtatgatactaagaagaaatagtataataccactccgccatttgacttcaggttgtcggctctttgctaaaaaagcagccactaaaaaggcaccgtcacctctacttgaggaatgggatcgcggggggagaaatcaagatacagggctttcccctttattagcatctatgaagcgattgatagatctgaatcctgggtgtgttagcttaatccaagttgggagtttttatgaactttatttcgagcaggcggaggaatatggtcctaaattgggactaaagattgcaaaaaagaaaaccctgaatcatgttgttccattcgccggatttccaactacacaattgcgaaaatttacagaaatgctaattcatgaacagcaagttaacgttgccattattgatcaatgtgaccaagggtccaagacaaatcaaaatttggtgcatcgtaagatttcaagaatcattacacctgggacattaattgacgagtcgtttctaaatttcaacgagaataactaccttgttgccatttcgtttgctcccagctcattgagtcttccaccagacccacaaatgaaagttggactatcatggactgatatttccgttggtgaatcatttgtacaactaaccacattaggtgaattgagttcagatattgccagaatcaaccccagtgaaatattgctacctaaggagttccaagaccacaatttacatttgggtcaatggtatagccccttacaggaattgaaacgctatatcatcaggtatcatagtactaccaactataacgagttgaaattacaatatcatgacagtattcaaaaagttagaagacatttggaaactttttctccacgagaacaagctgccttaaatatgataatgtcgtacatgagtataaacttacctgatgttgatattttgatgactttgccaactagatatttcaatgagacttgtttacagatggattcaaggacaagagaagctttagagttaaccgagagaacgatagctggaagaacctcttctgttggttcattggtttctgtcattaagcgaacatgcacatcttcttcaccacgggactgccggatcgcgttatttaaa

SEQ ID NO: 3622 - DNA, 264 bp, Candida albicans
gttaacaaatgtagaaccttgtttgctacacattttggaaaagaattggaacagcttttggttgccaataatatagaccaaaaaaatattcgctattttcgtacaagagtattagagaatggcgacaatgagaaaggctttgttatcgaccatacattggagccgggaatcagtgaacgttctcatgcattagatgttgcccgaatggcagggtttcctgaaaacgcactaaaggctgcagaaaaagtactagataatttatag

SEQ ID NO: 3623 - DNA, 717 bp, Candida albicans
ccaatatacctaccaatgtttacggcgacgaagacggcaaccaccacaaccacatctatttgtcggttattttctacctccactaaaacattatctaatgttggtaaaaaacccatcagattatatgaaggagtgaattattccattgaatcgatcccagtagaattttgtaaaaaattcactaaacgaaacaaaacatttattttagataggcaaatcattactagtggaccattaggtaaattaagagtagaaatccctgaattcatcaatatttcagaaaacaacaccaatgaaaatgataaatcaatcattgtatctgtgaaaaaacccgaaaataagattcaacgatcattatggggtacatatagatcaattttatataataatatcattggtatcactgaaggtcatttatcaattgttaaatttgttggtactggttatcgagccattttagaaaaagatccacaaactggtgaggatataattagtttaaaaattggtttaccttttacaccaaaattgaaaataccaaaagggttaaaagtttcatcacctaatccagcaagattggtcattgaaggttctgataaacaacaagttaaactatttgcagcatttattagagaacataaaaaacctgaaccatataaagggaaaggtatatttgttgatgatgaaaagattgtgttgaaacaaagaacagttaaataa

SEQ ID NO: 3624 - DNA, 972 bp, Candida albicans
catttgatttttttttcatcatcaccaacaacttacaaacattcttctttcttctttcttctacttctacttcttcttttaatctttattcaattccattcgttgaaaaacaaaaagagaacaagaaatcttaataaaacaattatgtctgaaactactactgttcctcctattgaaactgtatctgaaccaaatccatttattgtttttgctacggtcgctactattattagtgcgtttatcggatactatttccttcaacaatcgaaaaagcataccccagttttaaaaccagatgaatttcaaaaattccctcttattgaaaaaattagagtcagtcataattcagcaatttatagatttggtttaccaaaactgactgatagattaggattaccaattggtcaacatatttctattggtgctactattgatggtaaagaagttgttcgttcatatactccaatttctaccgatgatcaattgggtcattttgatttattaattaaaacttatgaaaatggtaatatttctagacacgttgctgggaaaaatgttggtgaacacattgaaattagaggtccaaaagggtttttcacttatactccaaatatggttaaaagttttggtatgattgctggtggtactggtattgcaccaatgtatcaaatcattactgctattttgaaaaaccctgaagataaaactaaaattcatttggtttatgctaatgttactgaatcagatattttattaaaagaagaattggacaattttgctgctagacatccagatagattaaagatccattatgttttgaatgaagccccagctaattggcaaggttcagttggatttgttactccagaaattatagacactcatttaccaaaggcttcaaatgacactaacttgctattatgtggtccgttttcaaccgaggcggctggaaggaacagtgtccccgtaaat

SEQ ID NO: 3625 - DNA, 342 bp, Candida albicans
gacggaaagtatagagtgacctacgaagtgattggctctcctccaaatatcgctgtgccaactcatttctttaaattggtggttggtgaaacccaaggttctgaaaaaattagttgtgctgcgtttgttttaccaaacgatgttatagataatagtaccccattgacttcttttcaagtaccaattgaagcattggaaagatcaagtgggttggatttattacaaaaagttccttactacaacaaacaggatttgtgcaaacaagtaaaatgtgaaatcattgttagagaatttccaaaacaagttgacaaagtattagctttacctgctggaaagccatag

SEQ ID NO: 3626 - DNA, 519 bp, Candida albicans
tctgcaatcaacccacaaggatttttcaagtttgggtttcctggtcccatccatgatttggctaatagaactgagtttgttagttgctatgatagatctacaagaaacccttattgggtcattgaacatataaccaaagcctcattagccaaggcagaactgaatggtgatagaaaaagatcagtctttaaagaagatgaagcgattcctttgaaattcagaaaccgtttgcgtgattatttccgtagtggatttgatcgtggacaccaggctcctgctgctgatgccaagtttaaccaattggccatggacgaaaccttctatttgactaacatgtgcccacaagtaggcgatggattcaatcgtgattattggagtcattttgaggactttgtgagaagattaaccaacaagtacgatgacgttagagttatgactgggcctttgtatttgccaaaattaggtgccgacggaaagtcttcaccacgagccgccggatccgcgtattgtccgcgccgc

SEQ ID NO: 3627 - DNA, 594 bp, Candida albicans
atcaaacgaaatatatcttaccatccccccccctccaaaatgcttagatttactaggactactgcttggaaattaagatctattccaattgccactattcaatatagacaatttacttattccactatatgttatcaattaaaaacccttactccatctttaggaataaataataccattgaatccaatataccttcagaaactaatagattagctaaaactggtactagattttggaaaaaaggtgaagttaaattcaataatgaaactcaaaaatatgaaattcaattagatgggaaaactctacgcacaccacttggattcccattagaattaccaatcaataaaaaacaattggcatatttaattgctcatgaatggactcatttacctgatattaaagtgaaatcaagtactttaccattaacagctttagccactagagctatagatttgagtcaacaacatttgagtgatttgaagacagaaaaagctgaagaaatgttagcattggaagatattaaattacaaatgttaagatatcttgatactgatacttgtgttctatttgctgcccatcttcaccagccgtga

SEQ ID NO: 3628 - DNA, 951 bp, Candida albicans
  unsure (900): Identity of nucleotide sequences at the above locations are unknown.
tacaatactatcataatggagcaccaacttcaatttttaccaaaagactcagttgaaatagactacgaggcattacctgatgatgcttcattagcggcacatttaactgccggtgcattggctggtataatggaacacacagtgatgtttcctatcgattctatcaaaacaagaatgcaaatgaatctatcaaactcggaaatatcacggggcttgttaaagtctttgtctaagatcagctctaccgaagggttttatgcattgtggaaaggggtgtcttctgtggtattgggcgcgggtccagcccatgctatatatttttcagtatttgaatcgactaaaacgtttttggttaataggttgaccaactcgccacatctgaacaggattgttactgatgaaaaccatcctcttattgcaagttgcgctggtataacgggtaccaccgcgtcagatgctttgatgaccccatttgatatgttaaaacaaagaatgcaagcaaatgctgcctatcaggatggtaaatcaacatcagtgagattgttcaaattagcatcagatatctataaagcggaagggttaagtgcgttttatatttcatatccaaccacccttttgactaatattccatttgctgcgttgaattttggattctacgagtactcatcgtcattattgaacccatctcatgtttacaatccatacttgcattgtgttagtggtgggattgctggtggtatagctgcagcattaactacgccgtttgattgtatcaagactgttttacaaacaaaaggaatatcacaaaaccagaattttaggcatgtcacgggtttcaaatccgctgctgtcgccttattgaaacaagaaggtgcaaaggctttttggaaaggtttaaancctaaaatcatatttaatattccaagtacagctatatcgtggacagcatag

SEQ ID NO: 3629 - DNA, 2220 bp, Candida albicans
atcacgctcatgttttgtcgaaagtatgtttttcaaacctggaaacagctttccagatcttattcgactgtcaatagcattggagctgcaaagacaagaaatattggtatcatagcccatatcgatgctgggaaaacaactacaaccgagcgtatgatctactacagtgggagaaccaaaagaatcggaaatgtggatgaaggtgacacagtaacagattatttgccttctgagagagaaagaggaataactattcaactggcggcaattacccttccatggaaccaacacaaaatcaatattattgacaccccaggacatgctgatttcacatttgaagtcattagatctttgagagtactagatggggcagttactattctagatgcagtggctggagtagaggcacagacagaaaaagtttggaagcaagcaagcgcattaaacttgccaaaggttgtatacgtcaacaagatggatcgccctggtgccggtttcagcaggactgtgcaagaagtcattcagaaattagaaacaagagttgtactttgtaacctaccatactttgaaacaaacaaagagagtgatttggaattcaaaggggtgattgatgtgatacatcaaaaattgttgaaatggaatgaaacggatgccaatggcaacgaaatatcagtagtaaatattgatgaaacaacaccagatttgttacagattttagaaaaatcccgagaatctatggtggagacacttggcgagtatgacgaaagaattattgattcgtttttagagcatgatgagaactatttaaagataccacccatgttgttggaccaagtgatcagaaaggccacgattgacaattatttgacgccagttttttgtggtgcatcattcagaaatataggtgttcagccgctaatggacggaatcacaaaatacttgccatctccattggaaacaagtttaccacagataaccaagaacggcaaagacgtgacaaagaaagttgatggtgaaaagggcctcgtggttgcaaatgataacaacttgactcttgcattggcattcaaagtgatgacacattctactcgtggcccaatgacatttgtaagagtatacagtggcaaacttaacgcagcatcaaacttgataaatacaagaacaggcaaaaagctacttataagaaagctattggttatgcatggggacagtccagaagaagtgaagagtattagtgctggtaacataggtgtcattcccggttacgagactgattttcaaaccggagacactcttgtgtctagtgcagtggcaaaacggaactttacggcaaaagattcggcttataggttgttgcccatcgatatcccacctcctttatttaatgctgccattgaacctcatacggctggagatgaggcatacatgaaacaatgtgttgaaacactcattcgtgaggatccttcattgaaagttcatttggataaagagatgggacaagtagtgttaagtggaatgggtgaattgcatttggatattgtcagggaaagattggttaacgacatgaaggcaaaagtaaacttgaaggatgtcgttgtatcgtacaaagaatcatttgttgggaaaagagaaaaggaggctgttatcactaatgaagaaattgaagtggccgtgactttatcacatattgaggatgctagagattatgttggccaagaaggtgcattagtgattgaagaagacaacaatgtcatactattgagtgagactgcgctgtccgaacacgtacgagccactattgatgaaagaaggtggaagtgtgagaataatctagaagaattaaaggaagccattttaaatggttgtttgacagctcttcaaatgggaggtcctattttgggtttcccattgcattcaacattggttactgtaaaccgctggaatgtacctgtggaggtagctcaagaacaagctttgaatttgatgaatgcttcgcgtcaagcagttcagtctctcaaagatgaaaaaaaagacttttctatacttgagcctataatgagcacaaaagtgtatgtggattccaatgacttaggtgaagtgtcacatgatttgactcaaaggtgtaaagccatgattgtggagatacaggaccagtccactcaaaacttggaaactgctgcgtgggccaaagatgatgcggccaaagtatatgtaccaccg

SEQ ID NO: 3630 - DNA, 843 bp, Candida albicans
  unsure (437): Identity of nucleotide sequences at the above locations are unknown.
aaatttttatttcaagcccaagtcgttgaaatatttatagacctttctcttttaatcaaccctatcaccacaaagatgcccaaggtattcactattcaaaaaaatgttgcctcccacaagaaaatgatatataaaaacttgtgtgccaatttgattcgtcatgagtacatagtgaccacttctgccaaagccaaagcagctcaaccatatatcgaaaagtttttggccaataccatcaaacagaataaagaattacccgaagccgtcaccaatttagaagacaaattgaagagcatcaaggcactaagctatttacaaccaccagacagagtagagtgtggactgaaaatgcttgaagacatcatcaataggtatccacaaagaactcatgggtttaccagggtgataaaattagaaccaagattaggagacgacanagctcctatgagtgtaatagagcttgtggattccaattatgagatcaaattgaggtatactgctaaaactgtggccagattggaattacaaggaatcgaattagatgatatcactgaattgaacattaaaaaattaacgcaatatagagtcaacggggaacaagtatttagggaagcagttgagacatgtaaaaaagaatttttcaatgttgctgaagaaacgggcgaggttccagaagaaattaagagtgacttgtccaacttaccaaacatgtcaagacacctgggtgaattaaagggtaaattattagtgtctaagcagtttaaaaccaaaccaagaccagaaagacaaagcattaatatcccacaatctccatttttgaaacaacaacaagaacaaaaatag

SEQ ID NO: 3631 - DNA, 1806 bp, Candida albicans
aaaatttcttattctgactcattcttctcttcaccaatgagttttgtcaaatcttgcagagggtgtcttaggacatttgctacatccacaatcaagcatgagaaaaagttaaacaagtactcgtctattgtcacaggcgacccatctcagggtgcttcccaagcaatgctttatgccactggtttcagtgatgaagatttcgatcgtgcacaaatcggtgtcggttctgtttggtggtcaggtaacccatgtaacatgcacttgatggagttgaacaacaggtgttccgaatcagtcaacaaggccggcttaaaagccatgcaattcaactccattggtgtgtcggacggtatcaccaacggaactgaaggtatgaagtactctttacagctgagagaaattatcgccgactcctttgaaaccatgaccatggcccaactatatgacggtaacattgccattccttcatgtgataaaaatatgcccggggtattgatggctatgggaagacacaacagacctgccattatggtctatggtggtactatcttgcctggatctccaacttgcggaacccaaaaccctgctgtagccgacaaaatcgatatcattagtgctttccaatcctacggacaatacttgtcaaaacaaatcaacaacgaagaaagaatagatattgtcaaacatgcctgtccagggcccggtgcatgtggtggtatgtacactgccaacactatggcctctgcctctgaagtcttggggttgaccttaccattttcgtcctcgtcgccagctgtctccaaagaaaaagccgaagagtgtgccaacgtcgggttcgccttaaagaatttgttagagttggacttgaaaccaagagatattgttaccaaaaaatcatttgaaaacgctattgcttatatcattgccactggtggttctactaatgccgttttacatcttattgccattgcctcttcatttgacattactattactgttgacgatttccaaagaatctccgacaacactcccttgttggccgatttcaaaccatcgggtaaatacgttatggccgacttgcaaaatgtcggcggtacacctgctgttatgaaatacttgatcaaagaaggcattatcgacggtacccaattgagtgtcaccggtaaaaccatcaacgaaaacttggctaaacttgctgatttgcctgagggccaagacattgttagaccagtatcaaacccattgaagccaagtggccacttacaaatcttgaaaggtactttggctccagggtctgctgtcgctaaaatcaccggtaaagaaggtacttatttcaaaggtaaagctagagtattcaacgacgaaggtgcatttattgttgccttggaaaatggcgagatcaaaaaaggcgaaaaaacagtttgtgtgatcagatacgaaggtccaaaaggtggtccaggtatgccagaaatgttgaaaccttcgtctgcattaatgggttacgggttaggtaaagacgttgctttgttgactgatggtagattttcgggtggttcccacgggttccttattggccacattgttcctgaagccgctgaaggtggtccaattgctttggttgaagatggcgatattattgtcatcgacgcagacaataacaaaatcgatttgttggtagagccagacgtcttgaccgaaagaagaaaacactggacgcctccagaaccaagatacaaaagaagtactttggccaaatacgccaagttggtcagcgatgcatctaagggatgtgttacacatttataa

SEQ ID NO: 3632 - DNA, 1965 bp, Candida albicans
  unsure (196): Identity of nucleotide sequences at the above locations are unknown.
atgggttgtaacccgcaaattccattaattaaaaaaacttcaactattgttagaacaaaactttgcccgtataaacgtttagaaggttcagcacccatgtacttggaattgacttgggaaccattaattctgctgtgccagttatgggatcagatcaagagccacagatcattgaaaacgaagaaggcaaacgtantaacaccatcaatggtggcattcagcaaagaaggcgaaaccttagttggtcttcctgcaaagagacaagctgtagtaaaccccgaaaacaccttttttgcaacaaagagattaattgggagaaagtttgaggataccgaagtgcaaagggatttaaacaatgttccttataagattatccctagcaaacaaggtgatgcaatgttgagctcgcatagtggacaaaccatatcaccatctgaaatcgggggacttattttgcaaaagttacagaaagttgctgaaaatcagttgaaagaaaagatcaacagtgctgttgtcacagttccagcatatttcaatgactctcaaagacaggctacaaagaattctgggaaactagtaggcttggacgtattacgagtcatcaatgagccaacagcagcagctttagcctatggctgtgacaagtcaagagaggatgggataatcgcagtatttgaccttggaggcgggacattcgacatatctattttggaaatagatgaaggtgtgtttgaagtaagagcaacaaatggtaatacacatttgggaggtgaagattttgacattgtcattatgaattatatcttggaaaatttcaaggcagaaacaggaattgatttatccggtgatagatttgctgtacaacgtattaaagaagctgcagaaaaagcaaaaatagagctagaccattcggacgagattgaaataaatataccattcgtgtcccaagacaagcacattaagcagactttgacatcgcaagagttcaccaagatggtgatgcctattatagaaaagacgatcgacccagtcaaacgatgtgtgcgagacgccgaattaaaattcaaggatattgatgaggttttgttagttggtggaatgacaagaatgccccagatcaggaaaatggtacaggacttgtttggcaaaaaaccgagtactgctgtgaaccccgacgaagcagttgcgttaggtgcagcaattcaaggtgcagtattatccggacaagttaaaaatgtggtattattggatgttacaccattgtcattagggatcgagacttatgggggaatttttactccactaataccccgtaactctgctgttccaattaaaaaggagcaaatgttttccacagctgtagacggccaaacgggtgttgaaataggtgtttatcaaggagaaagaacattggtcaaagacaacaagcatattggccaattcaagctttcaaatatcccgcaaggaccaaaggggactccacaaattgccgtgtcctttgaaatagatgccgatggtattataaacgtcagtgcaacagacaagacaccatatccaaaggatctggaacactacgggaaaccaaataccgtggcaatacaagtaactgaagttggcttgaccgatgcggaggtcgaaaaaatgatccaagaaagtaaccggaacaagaaagccgacgaggaaaagaaaaggttgtatgaacatgcttctcgtgcagaaattttatgtacagatacggagaccgcattgatccaattcggggaattgatggaggacgaagagaagaagacaataaaagagtatgccaataccatcaaagaaatgattgatgaaataagatcaggagagaaattacatcatcccaatatcctaaaccaaaaagtaaacgaaatgcaaaagacttgcatggaggcaatacagaaagtagcattaaagcagcaacaagataaagagagtaaaaattag

SEQ ID NO: 3633 - DNA, 1551 bp, Candida albicans
aaagctagaggtggacaatattccccacaacaaattggtggtttcattttgaacaagatgaaagaaactgctgaagctgctttgagcaaaaaagtcaacagtgctgttgtcacttgtcctgcctatttcaatgatgctcaaagacaagccaccaaggatgctggtaaaattgttggtttgaatgttttgagagtcatcaatgaaccaacagctgctgccttagcctatggtttggaaaagaaagatggtgaagttgtcgccgtttttgatttgggtggtggtacttttgatgtttctatcttagatattggagctggtgttttcgaagtcaaatctaccaatggtgacactcatttgggtggtgaagatttcgatattgctttggtcagatacattgttgatgccttcaagaaagaatctggtatcgatttagaaaaagacaagatggccattcaaagaatcagagaagctgctgaaaaagccaagattgaattgtcttctactgtttcaactgagatcaacttgccattcatcactgccgatgcttctggtccaaaacacattaaccaaaaaatttcaagagctcaattcgaacaattagtcgaaccattgatcaagaaaaccatcgaaccatgtaaaaaggctttgaaggatgctggtttatccacctccgatgtttctgaagttatccttgtcggtggtatgtcaagaatgccaaaggttgttgaaactgtcaaatctatttttggtaaagaaccatctaaaggtatcaaccctgatgaagctgttgctatgggtgctgccatccaaggtggtattttagctggtgaagttaaagatgttgttttgttagatgttaccccattgtctttgggtattgaaaccatgggtggtgttttcgccagattgatttctagaaacactactattccagccaagaaatctcaaatcttctctactgctgctgctggtcaaacttctgtcgaaatcagagtgttccaaggtgaaagagaattaaccagagacaacaaattgattggtaactttactttgtctggtattccaccagctccaaaaggtgttccacaaattgaagttacttttgacattgacactgatggtattattaaggtttctgctcgtgataaggctaccaacaaagatgcttctattaccgttgctggttcatctggtttgtccgatgctgaaattgaaaaaatggttaacgatgctgaaaaattcgctgaatcagacaaagccagaagagaagccattgaatttgccaacagagccgatcaattatgtaacgataccgaaaactcattgaatgaacacaaagaaaaattgtctagtgaatcagttcaaaaagtccaagatcaaatccaacaattgagagaaattgtcttgaaagcacaagccggtgaagaagtttcaccagaagaattgaaacaaaagactgaagaattacaaaacgaagccatcaaccttttcaaagacttgtacaaagacggtggtgaatcatctggttcttctgaacaaccaaagaactaa

SEQ ID NO: 3634 - DNA, 363 bp, Candida albicans
tttaatttaatctatatacatatcattacaatgccagctccatttgaaaaaggttcagaaaagaaaggtgccactttatttaaaactagatgtttacaatgtcacaccgttgaaaaaggtggtccacacaaagttggtccaaatttgcatggtgttttcggtagaaaatccggtttagctgaaggttattcttatactgatgctaacaagaagaaaggtgttgaatggactgaacaaaccatgagtgattatttggaaaatccaaagaaatatattccaggtactaaaatggcttttggtggtttaaagaaaccaaaggacagaaacgatttagttacttatttgaagaaagctacttcttaa

SEQ ID NO: 3635 - DNA, 921 bp, Candida albicans
atattcattatgtcttctacacaaaaacaaaagaagggtgctgttgatttcgttgctgggggtgttgctggtttattcgaagctttgtgttgtcatccattagataccatcaaagtgagaatgcaattatacaaaaaatccggtcaaaaaccaccaggttttattaaaacaggtgtcaatattgtccaaaaagaaggatttttgtcattatataaaggtttgggggccgttgttattggtattgtgccaaaaatggctatcagattcagttcatatgaattttaccgttcattctttttagacgaaaatggcaaaatttccactggtaagactttccttgctggtgttggtgctggtattaccgaatctgtcatggttgttaatcctatggaagttgtgaaaattagattacaagcacaacatcattctatgaaggacccattggacattccaaaatacagaaacgctcctcatgctgcatatcttattgtcaaggaagaaggtttcagtactttataccgtggtgtttctttaacttgtgccagacaagctaccaaccaaggtgctaactttgctacatattctaccatcaaagcatatcttcaaaaacaacaaaacactgaattattaccagcatggcaaaccagtattgtcggtttgatttctggtgcagtcggtccattaaccaatgctccattggataccattaaaacaagattacaaaagagtaagtttaccaacaaggaaaacggattggttcgtattgtcaaaatcggtaaacaattagtcaaagaagaaggtattaacgctttgtacaagggtatcactccaagaatcatgagagttgccccaggtcaagctgtggtattcacagtgtatgaagccgtcaaacattatttgacaaatgaacctactgcttaa

SEQ ID NO: 3636 - DNA, 813 bp, Candida albicans
aaaattttttttttctctttgcacactgaaagaccatacaatcaacaacagcacaatatgtccttgatcagagcttttactgctgcatctcgtgtgcctagagcttctttattgtcttgtgtggctgtgagatttaatagtacatccaaagcttcaaaacaaccattattggctgagatatatcctttgaacaaagactccattactgaaaaagatttagacaactggatagatgcagttaaacagttgaagtctggtaaagcttcacatgaaactccggaagaaatctatttgggtcaattaagtcaacctcaacagtttttaaaacagacatatgaacctactgttgaccaaattgaggaaactaaaaagtatgccaacaaaaaaatcccattacgatccgatccaactgttgacaacttaaccaaccttattatgagacatggtaaaaaggcaaaagcccagaaagttgtgagccgtgcattgtacattgtgcaattgaaattaagaaaagatcctattgaagtcttgagagaaaccttggataaattgggtccattggtgaacaccaaaaccatgtctactggggttgctaaaaagagagttgttccaattccattaaatgaaaaacaaagaaacagatttgctatcaaatggattttagaagcatctaactcgagaaagtcaaatgatttttcagtcagattagccgaagaaataataaatgcataccaaggaaaatccagtggctacgacaagaaggcgcaaatgcataaacaagctacacaacaaagagcttatataaatctttaa

SEQ ID NO: 3637 - DNA, 774 bp, Candida albicans
tcaagtattgcagggaatcaaggtaaagtgtattcgcttactaacaaaagggctggaccagtaacggaatcctcaacaagcacgtcaagatccatttctacagatgcatcacctgaatcttcttcacctccaaaagagagttttagtgacattgagccaagctcggaagttccagtaaaatccactacttcttatatcttacatgatgccccattggaagcttcaaacaaaaataatggtgaaaccatcaattggtcggattcattccacgggttaggtgctcaaccattttccaaagaaattgctgaaattttgttagctcctgtggcagaagaggatattgaaattaagcccgatgggttattatatttacctgaaatcaaatatcgacgtgttttgaatcgcgcctttggacctggtggttggggtttggccccaagaacagagtcacttgtcacatctggacaaataagtcgtgagtatgggttgatttgtcatggcagattggtcagtattgctcgtggtgaacaagattattttggtggcgaagagaaattgactactgcattggaaggttgtaagagtaatgccttgatgagatgctgtaaagatttgggaattgcaagtgagttatgggacccttcgtttattagacgttggaaaaagaaatattgcgaagaaatctttgttgaacatgtcaacactaagaagaaaaagaagatatggaaattgaaaagcatcaagactatagattatccatataagatgacataa

SEQ ID NO: 3638 - DNA, 561 bp, Candida albicans
  unsure (504),(540),(549): Identity of nucleotide sequences at the above locations are unknown.
ttcactcagggcatttaccgattcttgtctacaaagacaatagaagcagaatcatcaactcagtccaaccatgtgatatcatcaaaacaattgttgtatacaacagatccaacgtcaccaggatctatcttttttttgccccatggtaccagaatattgaacaaattgatccagtttatgaagaatctacagactaaatataaatatcaagaagttgtcacacctttgattttcaagaccaaattatggaaaaaatcaggtcattgggacaattataaagatgacatgtttaaagttgttggtaatgatataacaaaggaggagtatactgacaacatagaggaacacgagtatggcttgaaaccaatgaattgcccgagtcactgtatgatatttgccaaatttgatcgatcataccaggaattgccagtgcgatactccgatttcagttcgttacttagttacgaagggagtgccgccccctcgggattgaccagggtcagnagattccaaacaagaagtcttacttctttgggatcnaggccaccnaatttctggtaa

SEQ ID NO: 3639 - DNA, 984 bp, Candida albicans
caaccacatttaaatttttttttcccctatcaattaactctttctttctttctttttctaacaaagacaattgacattatgttgactcatcatttatcgaaattggctactccaaaattcttagtaccattcgctggtgccactgctttgtcaattggtttggcattgcaatattctacttccaacaattacattgctaacgaaactggtaaaactttcactgatagcaatgaatgggtggacttgaaattatctaagtcaattgatttgactcataacaccaaacacttggttttcaagttaaaagatgagaatgatgtttctggtttgatcactgcttcatgtttgttgaccaaatttgttacaccaaagggtaacaatgttattcgtccatatacccctgtctctgatgttaaccaatctggtgaaattgatttcgtgattaaaaaatacgacggaggtaaaatgtcaagtcacattttcgatttgaaagaaggtgaaaccttatcattcaaaggaccaattgttaaatggaaatgggaaccaaatcaattcaagtccattgctttgattggtggtggtactggtattactccattataccaattgttgcatcaaatcacttctaatccaaaggacaacaccaaagttaatttgatttacggtaacttgactccagaagatatcttgttaaagaaagaaatcgatgctattgcttctaaacacaaggaccaagttaaagttcattactttgttgacaaggcagatgaaaagaaatgggaaggtcaaattggtttcattactaaagaattcttacaaaaagaattagaaaaaccaggttctgatttcaaggtttttgtttgtggtccaccaggtttatacaaggctatatcaggtcctaaagtttccccaactgatcaaggtgaattgactggtgctttgaaagatttgggtttcgaaaaagaacatgtctttaaattttag

SEQ ID NO: 3640 - DNA, 612 bp, Candida albicans
gcaaggcggaacaataaaaaaaaaaataaatctaacaacaccactttcttttctctaattttcttatactttaacaacataataccaacaattatcatgtctgaactttccaaattaaatgaggctaaagcaaaagtggctgaattggaagctttagtcaaaaaacaggccagcgtaatggttcaagcgagacaaaagttagttgacgttgaattgagaaataagaaaaaccaagctgctcagaatatcaatcaacaacctgcattggatttaaccgattatgtgaacaacgatgatattgttcaattggtcacagaattacaaacccaattggatgctttagaggctagaactatgcgtcgaacttacaatgcaaccgttcaaggagacgacgaaaagttggcacctattacaaataaagatggcgatttgcccgactttgcattacctgtcactttgaaagagtttaagctgttggaaaaaattgatttgataagattaggagtgttttatgagatcatattgccagatggagaagaaatagaccatgctttgcaacagactaatagtaaagaagcaattttagatatcaacaaaaagccagttttataa

SEQ ID NO: 3641 - DNA, 1800 bp, Candida albicans
catttaacaccagaagaaataaaggtcggtgaatacttgagacaggattttgaacgatccggtatacatatggatccacaaacaagagaaaactttgttactataacgcaagaaatatcgttgttgggatctcaatttggaaaccagataaatgggctaaaatcatactggtgtccggtgacagttgccgagtgggaaagcattgaagacccccagttaaagaaagaaatcaagaactatcagtcaaaatatgatggtattagacaatcagagacaattcagattcctctcgttgcaaacattccttatacaattttgacaaactgtagttctgacacgttgcgtaaaaaagtatgggtcgctttgcacaattcacctgacgaacagattgaaacattgaatagatttatttcctacagagccttattgtcaaaaatgttaaactacaagtcgtttgcagactaccaattagaacacaagatggcgaaaactcctgaaaatgttattacgtttttatccaacctacaaaagtcattaatcaaaaaaggtgtggtggaagagttgagccagttgtcagaaatcaaacataatggtagcggctcagcaagtgtcaacgatattgttaatgacattaaaccttgggatagagattacttattggcaagactccaacagagaatgcaatccgaagtgtcagctggtaatgttaaagaatatttttcggtaggaaccgtcattgctgggttgaatgagttgtttactagattgtacgatatttcttttgtgccaatggccgcattgaaaggtgagacgtgggattcgcatcaagtgcgcaaaattaaagttgttgataatgctgcaaacaagactttagggtttctttatttggatttctggtcgaccaaggttttgccatctcatttcacaattgtgtgtctgagaagattgaacacaagtataggtagtgaaacaattgagggtatggaaaagcttgtccagttggatgaagattatcagttgccagttgtttcacttgtgtgcaattttgccagttcaggacactttctgtttgggagatttgctggtgttgagaatgaaaagccaacattgttgaccttagatcaggttgatacgattttccatgaaatgggacacgccatgcactctatgattgggagaacggagttgcataatttatcgggcactcgttgctccactgattttgtggagttgccttctgtgttgatggagtcttttagtaaagatccaagagttatatgccaaattggccgtcatttcgataccgatgagaagttacctgaaagtctccttggacaagcacacgagcatagaatcatgttagatgcatgtgaaacatttatgcaatccaaaatggccatgttggatcaaaaattgcacaatgaagagatggtcaatttactagccaaggggttatatgaagttgattctacaaaggtgtatcatctggttgaaaaggaattaaaagtctttgcagacgaatggtctacatggcacggaaagtttcctcatttattttcgtatggagcagtgtattactcttatcttttggatagagcaattgccgacaagatttggcaggggctatttgccaaagatccgtggaatggagaagctggtaagaaatataaggaaagtgttttaaaatggggtggtactagagatccatgggaatgtcttgctgatgcattaggaaatgacgaattaaagcaaggtgactcacgagccatggaaattattggtcagaatagcaatttatag

SEQ ID NO: 3642 - DNA, 519 bp, Candida albicans
  unsure (430): Identity of nucleotide sequences at the above locations are unknown.
aaatctctgattatataccagtgttgtcccctcgcccaaaaaacagctacaataatgaaagcgggtataccactactgcgatgtactcaaagattacctttgttggtggcacgccaggtctccagaaacatcacaaccacaacaacaaagttcttactagctccagaatataatcatatcagaaaagtgtttgatagtcaaaagtattttaatcatttcactaaacagggttctcatgcaaccttattcagctctccacaaacagggttatttcataatgagtatttgactactccacagggattagttgatttttcccagcaatcgcttagccaagcaaaacagttggttagcgagatgctttcacaagtcaacactgttgacgggaaacttaaatttatcaagaaactagatcagttgtccgatatgntgtgtaaagtaattgatgtggccgagtctatacgtgttgttcacccaagtgtcaaatggataaatgcggctcagcaaacacacgaaatg

SEQ ID NO: 3643 - DNA, 1053 bp, Candida albicans
atgagtcagactgaaagaaagctaataattaacactgctggaggggctgcagctaatatgaaacaaaaggaaatcccttctacaaagaatgatgctcaaaaagtgtccactttgggtgggtttttggcaggtggagttgcagcgtgcatggcagtcacgttcacaaaccccattgaattgatcaagacgagaatgcagttacagggtgaactagtcaaaaaatccaaagatgcagttgtgttgtataagaatccgttacaagcttttgcggtgatctatagaaatgaaggtataagagggttgcagcaaggtttggcatgtggttactattaccagttggcattaaacggatgtagaattggattctatgagccaagtagattttatttgagtaaagcatttgctccttcacacattatgccagatggtcaagtcaagcaaagtttgtctattaatgttctagctggttttgtgagtggtgcttctggtgctgttttggcttccccgatgtttttgataaaaacgagaatgcaatctttcagcgcatccaatactggtggagcagctgtgggtcaacagactttttataagaatacctgggatgggttttcccagatttaccacagtgagggtattaaagggttgtatagaggtgttgatgctgcgattttaagaactggtgctggttcagctgctcaattgccaacttattatttgaccaaatccttcttgttgaaacatggtttagctaaagagaattcattcagtttgaattttatttcctccataatggcaggattgggtgttgccattgtgatgaacccctgggatgttgtgttgacgagaatgtacaatcaaaagggtaatttatatagtggcccaattgattgtttcaagaaaactatagcagccgaaggtgcaatggcattatataaaggattctgggctcaattatttagaattggtcctcatacaattttaaccttattatttatggaacagtgtatgaaaggaatggtcctgattgaaaagaaattgagatctttcaactga

SEQ ID NO: 3644 - DNA, 795 bp, Candida albicans
  unsure (111): Identity of nucleotide sequences at the above locations are unknown.
actcctctgttatactatgcgtacttacaccccccaccacaccaatataatttacttcaacccctaatgtctaacgtgaacaacctaaatgtccggtggatcattccactnagaagctcctggttatccaaattaaccggtgataaaaaagaacaacccaaagcagcaccacctccagtttcggaagaaccatcttgccccgttgatcacaatgctagatccgtgtgggccaatagtgtatcggttcaagtaacggctcctgaagctattgaaaccacgggtacatgtgattcatccaagataccaaatacattagaagacacaacaactacaaatatagatcttcctggagaaagagaacttagttccatacctcgcacatcatcaaatactaattggatttatccttcccaaaaacaatttttcgaagctatgaagagaaagaattgggatcctcaacaagaagatatgaaagttatagtacctatacacaatttagttaatgaaagagcttggaaacatatattgatgtgggaaaaaccttatgccgaagacacacaacaaaaatgtggtgggatcactttaaccagtttcaaaggagatctgaaaaagttaactcctagagcttggttgaaaagtatatttggatatgataaaccatttgatcgtcatgattggttaattaatcgttgtggagttgaagtagaatatgtgattgatttttatactgggtcaaatagtccagtttacttggatgttacacccaaattaaacacttttaagaaaggtatttaa

SEQ ID NO: 3645 - DNA, 1116 bp, Candida albicans
tacattcaaacaacaatggctacatttgctccacatattagtaagattaccaaatcttcaaccaaattcaattatggtagaattgcaaagacatttcttggggtagctggttctgccgctattgccacttacttctataacaatggtaatccattcaataacaacaacaataataataacaacaatgggggttctaaaaatgctgctaaggcattatttggagccagtgctggtgccaatgtcaaaattgctaaagtccctgaaggtaaaagtgctagtgattatcaaaaagtttataatgacattgctaccaagatttctgaaaatttagaatttgatgagaatgccggttattatggtcaattgttaagattggcatggcatacatcaggtacttatgataaatctgataattcgggtggatcatatggtggtacaatgatttttgctccagaagaatttgatccagaaaatgctggattacaagttggtcgtgaatttttaatggaatttttagtgaaatatccatggatttcaagaggtgatttatggactttaggaggtgttgctgctgtacaagaatccggtggtccaaaaattgaatggagaccaggtagagttgatgacaatactgcatctaaagtcccaccaaatggtagattacccgatgcttcaaaagatggtaaatatgttaaagatttgtttgctagaatgggatttaatgaaagagaaaccgttgccttacttggtgctcatgttttaggtagatgtcataaacataattccggatatgatggtccatggggtccatcatttaatcaatttactaatgttttttacaccacattattaggtgattggcacgttaaaaaatgggatggtaaaaaacaatacgaagatgatgaaactggtgaatttatgatgttaccaactgatatggctttgaaagaagaactgtattttttgaaatatgtcaagatgtatgctgatgatcaagatttgtttttcaaagattttgctaaagcattttctaaattgatttcaaatggtatcaaatatcctgctgatagtaaaccaatattgttcaaaacattagatgaacaagatgaagaataa

SEQ ID NO: 3646 - DNA, 936 bp, Candida albicans
aattgtattgggcgtttatttattcccttttctgttgaaaccatattttggctgccaatcatgattcgaagttatatcagaaatatcatacttgccattctatcaccattactaacaaccccacctccactcattctccctcctccatatgagaaaataatccaggaaatcaccacagtactttcgatcaacaattacgacgacggttccttagcgccaattatccttcgtcttgcttggcattgttgcgctacatatgacatgactaccaacactggtgggtctaatggtgccacaatgagattcgttcctgaaataactgatgaagggaactatggattggacatagctcgtgcagcattagaaccaataaaacaacggtacccagcaatttcgtacgctgacttgtggacattggcaggaaaagttgctatagaatatatgggcggcccgacaattatctggaaaagtggtagagttgattatacaaacgatagatgtacaccttccaatgggttgttgccatttgctgataaagatgcaaatcatatacggaaaacatttacaagattaggatacaatgaccagcaaacagtggctctaataggcgctcatggtgtaggtcgatgtcataaacggtttagtggctgggaaggtaaatggaccagaactcccaaaaccttctcaaaccaattttatgtggtattgcttaatgaaacatggagtcagggtgaagtcccagaaactggcaagacacaatactttaatgccgataaatcgcttataatgctaaacaccgacatggagttgataagagataagtcgtacttgcactgggttgaaatctatgcaaaggacgaaccaaagttttttcacgacttttcctccgctttcgcaaagctattagagttagggataaaacgggaaacgttataa

SEQ ID NO: 3647 - DNA, 921 bp, Candida albicans
agacaatcagacaagaatgctggaataactttcaattctaaaaatattgaaaactatctcttgaatgagaacaagaatctaatactgaaacaacaattgattacattaataatctgcactagtttgaagctcaatcgtggattgcagtatactgaaagagactatacaacacagctatatttgattgaaaattttatggcatggaccaaaatgatagaaaacaatgaatggttttgtaaccccgatgctactcaatacgatgaagtattgaaattgattggcataccaccaggtgattatcgaatcgaaaagtacttacaagatattttaaaattagtggagcaggaatatcaaaccaagaatctgtacatattcatcacttcaataatgagaacattggttgataaggctccacatttgacatataaatacttttatttcaaggatgctcaaatcagacagagatctttaaatcgatcaaatgtattgatacaggacgatttgacttataccatgcaggcatgtttaaaatttgatagccaaaagctttttgatttatacaaaaacaaccaagatttgcatgatggtgacgaaggtggtcaagaatctttaatacttgaactatccaaagtgactaaagactggaatgcattgcaaaagaatttcgaaaatatgtacggtagaggaaacttaccattaactgtccattacggtattgcaatgcaagccttgaatacattacgagcagatgaagaattaggcagattatatgatcaattacagaaacgtggattacatttaaattctacagttatggatgcattaatacgatcaaaaattagactacttgatcaaacaaaagttattgaattgtttgcagtatatgccaaatctcaccaggcggtcgaaggtccaaagtac

SEQ ID NO: 3648 - DNA, 804 bp, Candida albicans
gcttggtattttttatttttcaatttcttgatttctattgtacttgtgtttaagcattactcttcattcattaccatggcaagtgttcttcgtggagtttttaaaactcatttaccaagaaccttaacccgtcccaaatgtgcaagaactttccaaacaactacattccttcgaaatgaacaagtcaagttgcctcaaacttacgacgaagaaaaagttattattgatgagattaacaaaagtttgaaacctgatgatttacaagcttcaagtagattaagaaatattgggatttctgctcatattgactatggtaaaaccacattcacggaacgtgtgttattttacactggtagaattataaccattcatgaagtgcgtggtaaagattctgttggtgctaaaatggatcatatggatttggaaagagaaaaaggtattactattcaatcagctgccacttactgttcttgggataaagatgacagatcttatcatttcaatttgattgatactccaggacatattgatttcactattgaagtcgaaagggcattgagagttttggatggtgctgttatggtggtttgtgctgttgctggtgttcgatctcaaactgagactgttgactgtcaaatgcgtagatactatgttccaagagtcacttatattaacaaaatggaccgtatgggtgctaatccatggagagctatcgaacaaatcaatgccaagttaaagatcccagctgccgcaatccaagttcctattggtgccgaagaaaacctacaacgtgttgtcaatatt

SEQ ID NO: 3649 - DNA, 630 bp, Candida albicans
cgtttagtgagaatgcactccaatgatatggaagatgtcgctgaagttggtgctggtgaaatttgtgctacttttggtattgactgtgcttcaggtgatactttcattggtcaaggtacccaacaacaaatcaccatgagttctatgtttgttcctgaagctgttatatcattgtctatctccccaaagacaaaagataacggtgcattttccaaagccatgaaccgtttccaaaaggaagatcctacatttagagtacattatgattccgaatccaaagaaactattatttccggtatgggtgaattgcatttggaaatttatgttgaaagaatcaaacgtgaatatggtgttgactgtgtcactggtaaacctcaagtttcctaccgtgaagccatcactgttccttctgcattcgattacacacacaaaaagcaatctggtggtgctggtcaatatggtagagttattggtgaaatgaacccaattgaaagtgaaaacaaatttgaaactcaaatcattgggggtaagatccctgaaaaattcttgtttgcttgtagtaaaggttttgaagattgtttagaaaaaggtccattgattggtgttcacagcgggctggaaaacgcaagt

SEQ ID NO: 3650 - DNA, 2271 bp, Candida albicans
  unsure (62): Identity of nucleotide sequences at the above locations are unknown.
acaaaaaccaaaaacaaattaccaactcaaacgcaaaggggcgacaaggggaatggtgttgntggtggaatactgtcacgagatctgggggataaattattaccaattattgatcgatcatttttcatggattttaaaccaacagacaatgaagaaggaaatgatatttataattcgatagaaacatataaaccacttgattctgtaataggtattaagaagtttgaaaaattggtcaaaactatgaataatgcttttactaaaggacaattaaaacaatattacgatcatcaacaatctcttaatccaggaatacgatggaaaagttcgagttctttagtgaaaacaaaattaattgaaggtattatattagatgtttggaatatcagtaaaagtaaaaaattgattgttaatgatatgttagaagatcgacaaatattattaaaaccttggcaacggtatttattgggattaaatcaatcattattatttaaaaacatgttaagattaaaagttaaaggtaaatttagtaaaaataaattacaattaattgggtcagaagctgatttgaatttcattgaaccggaattaaataaattattacaagattatactatggaaagtattgatttatcattaattgttgataaaaatattgaaattaattttgaattgattcaagaaatagctaaagtatatttccataaaacaaaaaagacaagtaatatttatgaaatttatggtaaaaatattgaaggaatttcattagctaaaagattattaatttggtcaatcaattctaatcctcatattaaagatgaaatttttacaacaaaatcattgacatcagaatcttcatctttaccttttgtaccatttcttaatgaagaattgtttccatggtataatcgtccatttaattattttgttccacttaaaaaggatcatagatcatcaaatgatttaattttcgataaatttgataaaatgagtaattattttattgaactggatgaattggaagaattaaatgatgctagattttctttaaatgaagatataccccaagacaatagtaataatgctgaagaagaagaatttgatgatgatattgataaattattaaatacaaccaccattacaaccaccaccaccactaaaatggatttcccagatatgactaaaattcttgataatcaagaaaaggcaaaacaacaacaacaacaacaatctcatcaagatttagaagatttacgtaaagaattaggtaaattttcaaatgaagatgttgatgttagtgaattccctaatatagcaaaattggtagaagattttgaaaatgctgattcaacaagaacaaatcaatctgaaaatcttaatttagaaaatttaagaaaagaattaaatcaatttagtgttgaatcatctaatgaagaagaatctaaaaaaaatgatattaaatttgatgtgattgataaattgaaattgattgaactggaaactgatgaaaaggtacccttatttactacagatacaaacaatattgatgaacatttaacaccaaaacaaattgatgaattatatgaacaagtttcagatttaaaattcacatctgatttaaatggagtaaatgaagataagattattagttctgcttatacattacaatttggaaccattgttatgaaaaataaaaaaactccctcatctaatggattaattcctaaaccaatcattaacagtggagatttccaattccaatttgttaattctgcaccatttatgaatgatttaattagttcatatccagtgattcctcaacctggttgtcgtcaacaatttaatgaacaaccatatgccaatagtatggcaattcgattaattccatcaatgtatcaaatgaaaaagaaaaataataataataataataataataaatatgaaatcactgataaatatttgaaatatccaccagtagaaattcaagctcaacttgatcgtggacaaattttacattatacattacaagtattatcacttgaagccgtaaaaaatgtcgccattccattacctaaattaccttgtgatattcaagtatcaagattattactcggtagtctattacccatgaataacgaggaggaaaatctgtcagtatcagtatcagtatctccaaaagtccgattatctaatcatcaaccagatttaatcaatttttttggaagaatcaaaattgaatttcactgggaacagaataatatcaatgtttaa

SEQ ID NO: 3651 - DNA, 1446 bp, Candida albicans
  unsure (1357),(1393): Identity of nucleotide sequences at the above locations are unknown.
atacattcaaaaaaggtacatttataccccttaatactattggtagggtttaactggctattaactagtactcaatttagatatttccctgacaccccaaataaacaaaatgtcactgtcaataatatgatgccaagagttactaaaccaaccccaaccaacacttttactacatctccacaattaccttctacagaatatttaaaagcatttaataataaagaattgatttcatttttcatgattggattagccacattaaataaaccaattttacaactttgtattaaattatttccttatgtacccatgtcaattattaaagctcttgtttatcgtatttattgtggtggtgaaaccattgatcaagttaaaaaaactggcttaagattgcatgaacgaggtattaataatatgatgatttctttaaccattgaagcttgtgatggtaatgataatgttgatcctaaatatattgttgaagaaactgccaaatcaattgaaaccattttagttcctcatactgtagccatgattgaacaagccaccgatgacattaatgatataccaccagggtatgttgcattaaaaccaacaggatttgctaaagatgcagcaaatgtattgaaaaattataatactactatgattaaagaatttgatgaattggttgataaagcaattattgtttgtcaaaaaatttatgattccaataaagaattgagtcaaaaatatcctgaaagagtatcaccatttgttgttggagttattgatgctgaaaaacatgaattacaagaaggtgtttatgaattacaaagaagattatatcaaaaatttaataaattaaatcaaccaatttcaattgttggtactttacaaatgtatctttctgattcagccaatttattaactaaagaagaaaatttagctaatgaaaataattatcgtttaggtttaaaattagttcgtggggcttatattcattcagaaaaaaatcgtgatattgttattcataaaactaaacaagatactgataataattataattccgggatttcttattgtattgattctattttaaatcaaaatcaaaatcaaaatggctctactattggtcatttagttgttgcttctcataatgctgaatcaatgagattagccagtgataaagtttataatccaatgaatgaatccaataaaaataaaactaatgttgttttaggtcaattattaggtatggctgataatgttacttatgatttaattactaataataaaattggtaatgttatcaaatatgttccatggggtccaccattagaaactaaagaatatgtattaagaagattagaagatnatggtgatgctgtcaaaaatgataatggttggcctntagttaaagcttcatttaaaatgttaaccaaaagattatttggaagtggttaa

SEQ ID NO: 3652 - DNA, 1449 bp, Candida albicans
atactgtcttctttctttttgattaaccaacaaaaactcaaaaatatgtttaaacgacttagtgcattgaagaaatacaacggtggtataaagtatcgtggtttcaacactgctgctgtgccatctccgacctatcagacatccattttgcctaatggattaactgttgctagtgaatcgatgccaggtaccagaacggcgacagtaggtgtttggattaatgctgggtctagagcagacaaccccaaaagtagtggaactgctcactttttggagcatttggcgttcaagggaacacaaacaagaccacaagcagctttagaattagaaattgaaaacattggaagtcaaatcaacgcttatacatccagagagaacactgtttattataccagaagcctggcatccgacataaaacaaaacattgatatcttgagcgatttgttgacgaaatcaaaattagaaaacagagctatagacaacgaaagacatgttattttgcaggaaagtgacgaagtcgacaaaatgtacgatgaagtggtgtttgatcatttacatgccgtcgcctttaaaaaccaagacttgggaagaactatattgggtccaagggaaatgatcaaaaccataaacagacaggatttagtggattatatcacaacaaattataaaggcgatagaatggctcttgttggtgttggatgtgtagatcaccaagagttagtgaaattaggtaaaaatttttttggaaacatcgtaaagtcggaggaaccttttaatcaaagtggcggtactttgccattattttatggcgacgaaatcagaattcaagatgattctatgcctactacacatgtagcattggctgttgaaggtgtcagttggtcagctccagatttttttgtagcctcagttgcaaatgggattgtgggaacatgggatagatcggttggtattggatccaactctccatcgccattggctgttactgctgcaactggaggaccaggaaaaaccccaattgcaaattcatatatggcttatacaacatcctacgcagatacagggttgttgggggtttattttactgccgataaaaacgcaaatctaaaattacttgttgatgcaattcaaaaagaatggggtaggttgagtagaggagacataaccgatgaagaggtagaaagatcgaaatcacaattgaaagcctcattgctcttggcattagatgattccagtgctattgctgaagatattggtagacaggtagttaatacaggctatcgcttatctccagaggaagttttttcaagagtggaatcgataacgaaagatgacattgtcaattgggccaattatagattaaaaggcaaaccaatagctttggctgcagtggggaacgtgaagaccttaccttcacacaaagaaatcagcgaaggaatgtttttctag

SEQ ID NO: 3653 - DNA, 468 bp, Candida albicans
cagcgagaaatgattaataacaatacgacattgagaacagaaaggttgattggctgtaaacaacatattccgaaatggttatcgtttgtggtgggaggcgcaactatgagttatgtgcgtgaagtcagtgaggttgacttggttaataggaccctagtgatgaaatccatgaatttgactatgaataatttattattggtaaaggaaactgttatttataaaccggacgacgaattacctcataacaaaactgtattccatcaaagtgctgagatcactgcatttgcttcgttaagcagactttgtgacaagttggaagattggtcagtggaacggtttggccagaatgccaaatctggtagattagcgtttgaaaatgttttgaataaattgacattgaagtgggaagaaaatgggatctttgagaataacaagatcttgcaggaggttaagaatttactgatttag

SEQ ID NO: 3654 - DNA, 240 bp, Candida albicans
acgcggattttccattcccgtggtggcagacgttaccacgaacaagaattaacgaaagacattgaatggttgaagaatcacgaattatacccagaaatggatataatcttgaatgatactccaaataaatttgcttgtacaaaatacgatataagagtaactgaccctacgaatcctttgaatttgaacagtagacttttcggtttcagaggtaagagatatcatgctattcaaacataa

SEQ ID NO: 3655 - DNA, 300 bp, Candida albicans
gccggaatcaaccaatttcagacgaccatgcggcggatattggattccaagaacagaccatggataatctttttgattggaccaatattggaaggattgtcgccaggctacatatggaaacaatttggttatttattccctaacactgaatttgaaattcctttaatgggtccagaagcttactatgataaaaagtggcaaaattccctcctggttcgcgaatcctattggaagggccatattttcaattattggactacctatttacattaccctaccaccctcaatttttccacatga

SEQ ID NO: 3656 - DNA, 672 bp, Candida albicans
tttatccttttggctatgctttcaacccaccattgtataatacctaggttggctaaatcatcaatatgtaccaaaagacaactctcctttttctggaaaatgttagccatggatgattcaaagaataaagtgattgaacgtccgttgtatacatgggatgaatctccatatgaagatattcgtgaacgtgcagcaatgattagagcccaagctttatgtcccgtcacctcaaaaccagtcaactttgtttgcccatattcaggtattcctacacatcactcgaaggaagcatgggagcaagacaaacaatatcacgagtcaaaagtatatgaaaaattgaaaaaagttaacctttacgaacatgacttgaggtcagggagaaaatttgctgaatttgcctttcccaaaaaacaagaaagagattttatggttaatattagtgactgggactcatttttttacacaagggatttcccacccatgaatgatgaattcaatttagcagcagcaactaaagttttgacgtatccaattactattgcctcgattttacataaattttcacctttacaattggaaccaaagggacctttgacattaaaaggggccaagtctttgggggcattgaaatacaccttgtatcccccacaacttggaaaatcatcaacttaa

SEQ ID NO: 3657 - DNA, 567 bp, Candida albicans
tctgaagaaattgctcaagttgccaccatttctgctaatggtgataaacatattggtgatttattagctaatgccatggaaaaagttggtaaagaaggggttatcactgttaaagaaggtaaaactttagaagatgaattagaagtcactgaaggtatgaaatttgatcgtggatttatctctccatatttcattaccaacactaaaactggtaaagttgaatttgaaaacccattgattttgttatcagaaaagaaaatttctagtattcaagatattttaccatctttagaactttccaatcaaactagaagaccattattgatcattgctgaagatgttgatggtgaagccttggctgcttgtattttgaacaaattaagaggtcaagttcaagtttgtgctgttaaagctccaggttttggtgacaatagaaaaaacactttgggtgatattgccattttaagtggtggtactgtattcactgaagaattggatattaaaccagaatatgccactattgaacaattggtatcgtgttccaccacggggacgataggtccgcga

SEQ ID NO: 3658 - DNA, 834 bp, Candida albicans
gaaagaattactcaattccgtaatatttattctacattaacaatgtctttcagaactacttccatgagaatggctagattagccactgccaaagctactttgtccaagagaaccttctccttattggccaatgctaccaccagatacactgctgcttcatctgctgctaaagctatgactccaatcacctcaatccgtggtgttaaaaccatcaactttggtggtaccgaagaagttgtccacgaaagagctgattggccaaaggaaagattattagactatttcaaaaatgacacctttgccttaattggttatggttcccaaggttacggtcaaggtttaaacttgagagataacggtttaaacgttattattggtgttagaaaaggttcttcttgggaagctgccgttgaagatggttgggttccaggtgaaaacttgtttgaagttgacgaagctatttctagaggtaccatcattatggacttgttatcagatgctgctcaatctgaaacctggtctcacattaaaccacaattgactgaaggtaaaaccttgtacttctcccacggtttctccccagttttcaaagacttgactcacgttgaaccaccatcaaacattgatgtcatcttggctgctccaaaaggttctggtagaactgtcagatctttattcaaagaaagtagaggtatcaactcctcatacgctgtctggaacgatgttaccggtaaagctgaagaaaaagctattgccatggccattgctattggttctggttatgtttacaagaccactttcgaaagagaagtccactccaatttatatgggtga

SEQ ID NO: 3659 - DNA, 210 bp, Candida albicans
cggatctccacccgtggtgaagatttgaaaccagttttcgaagaattgtacgaatctgttaagaacggttctgaaaccaagagatctttggaattcaactctagatctgattacaaagaaagattagaagaagaattacaaactatcagaaatatggaaatctggagagttggtaaagaagttagaaaattgcgtccagaaaaccaatag

SEQ ID NO: 3660 - DNA, 510 bp, Candida albicans
gaattcaacagtcaagagctcgaactttataatactatacaaggttacgttcaatatattgcttcctctattgaagttaagttttcactcaataccattgtgtcagatttgatgaaaatgacaaatactataagtgaagccattaaaactaccaacacttacaatcaagatttgattttcgatagctatcaaaaattattgatttgtatgtctccagttacgcctgcaactgctgaagaatgttgggaaagatttgcccttaaccaaggaaaaccagcaccaaaatccatattgtatgaaaaatttccaaccgatgttcctattgaatccaatttgaccatgtataatatatttatcaatggtagacatagaggaacaatggaagcacctaaatcatttgccaaagaatctgaaactgaaatcgtgaaacaaatctcaggtgttgaaaaattcaatgatctcataactggaccagttagaaaagtgattgcacattcttcacctacgtga

SEQ ID NO: 3661 - DNA, 372 bp, Candida albicans
atgataaaacacgttgaaataattcaccgagtacggtattcaacggcctctaccattgctaaaaaaatccaattctctaaattggatgaaaaatggaaagcaaaatggaaatcacaatcaccaactggttccctacatccaacaaaacatctaataccagaaacaaatgaaaaattttactcgttagcaatgttcccatacccttctggtgtacttcatattggtcatcttcgagtatataccatcagcgatgtagtggcacgatataaacgatccaaaggttttaatgttattcatcctatgggatgggatgcctttggattacctgcagcaaatgctgctgtagtaagaatgtgtcttcaccacgggtag

SEQ ID NO: 3662 - DNA, 1515 bp, Candida albicans
  unsure (1441): Identity of nucleotide sequences at the above locations are unknown.
agtggagccattgttgaaaaacggaatttagaacaatggtttattggaatcactaaatacgctaaagaattgaatcgtgatttgaagaacttacctgattggcccgaaaaagttaaaactatgcaaaagaattggattggcgaatctaatggggttgagattaatattccagtgaacttccctgggttagaacatgtaacggtattcacttctcgtccagatacattatttagtatgcaatttgtagcattggcattgaatcatcccatcgtggaagcagcagcaagggaagatcaagaattagcagcatttattgaatctgccaaatcaatcgatgatccaacatcgaaagcaggttacatgttgaaaaatataaaggcatctattccaatcgatgttgataacaatattaagaaatcatttgatataccagtttttactgcaccatatgtgttagggaactatggacatggggcagttatgggatgtcccggacatgatgaaagagattttgatttttggaaattgaatggtccaaggggtgtaccggcaattcaaatcattactcccaaaaaacaaaatgcaaaagacgattatccatatactttgaaaaagggcacattagaggactcatcagtattaactcatggattgaatgatattggagaatataagggtaaaacaattgaaaaagcgacccaaatgattactgactgtttaaagtcccattcattaggtgattatactacacaatttaaaatcagagattggcttatcagtagacaaagatactggggtgccccgattccaattgttcattgtcacgattgtggacccgtggcagtcccagataaagatttacccgtaatgttgccaggtgtcaagggtaaaaattttggcaaggggaacccattagggaatattgaagaatttgtcaactgtaaatgtccatcttgtggcaaagatgctagaagagaaactgatacaatggatacatttatggattcctcgtggtactttttccgatacttggattcaaagaatgaaaatttacctattggacctgaagccagtaaacaaatgccagtagacttatatgtgggaggcgttgaacatgcaattttgcatttattgtattctagatttattgctaaattccttagtgattgtggattgtgggatggtgagcctcatcacaaggaacctttcaagaagttagtcactcaaggaatggttcatggtaaaacatttagtgatcctataactgggaaattcttaatacctgacgaacttgattttactgatcctgccaatccacttatcaaaaccactggtaagacacctgtagttacttttgaaaaaatgtcaaaatctaagcataatggcgctgatcctggtgaatttattgaaaggtatggtgctgatgtcatcaaagcccatntgttattcctggctccagtttccgacaccctcaattggcaagaatacaaatttccggtacagatagatggttga

SEQ ID NO: 3663 - DNA, 621 bp, Candida albicans
aaacaactagactacgatttgaaacactcgccaatttatgaagtcaagtcatttgagaatacaaaggggaaaatatttactcctcctgtttcgtactttcgacaagacaaatctttgtatttcccggattttatagcgaaaacattggcaggtaatcagagaagtttgtacgactcattagacaatagattaagcattgtcaaattgttttcttctgttgctggtgagcagtgtacccgttcgtactttaaggttgaaaacaaagattactattcccaggattatgatacctttgtggaggaatatccccatacccagatacttgatgtgaatatgccgcaaagttggatcaaggggtttgtgacaaacttgagcacaggaaatttaagaaagactttgaagccagctctgagatacgagaattatttcatcttgcctggccacataatgtcagcggaaattagagaacagttgtactgtgataatcaatgttccgggtatatttatattgttgattcgatggggaagataagatgggcgacaagtgggtatgcaactcctgaggatttgaaattgatgtggaaggttgtgaaaggggtgcaaagagaaatgaccaagtaa

SEQ ID NO: 3664 - DNA, 513 bp, Candida albicans
agagtattgttggaaagacaggttgccgtcgaacgtgctcaagcaactatgcaagacgacattcaaaagtatttagacgatttcaagactcgatatgttaattgcgaggccgacgaagttgaagattatcacgaaaaattagtcagattacagtacgctatatttggtataaatcctaatttgtcgttggagttgttacaagatgaagaaacgatagatgtgaattttgttaaaggactctcgtacattgccaatttgaaagtggaaagacatttgaaattgaatcctcaaaccgaatttgagttgccattaaacggtccggttgaagagttaccatttttcttgaatgatgtcgaagttgccatttcacaagtgaaacaattgagagattcaggcaaatcacgtatgttgcacaagattgaagtcattccattcttgaaacaagccatcgaaagtcatatgcaacaagaagaaaatattgggggatacgaggaagaacaaaacaagaattaa

SEQ ID NO: 3665 - DNA, 675 bp, Candida albicans
gagagtgagaatgcgggcaaagacaaagagttatttttttcaaacaaattttccaattctttattctccaaccatattatccataatcgatcaaaaaccatgtttaagactactttaacaaaaccattgaccttcaaatctgctagatttttttccaccacaccaagagcttggggaactaaagtttttttcaacacttctatcaatggtgaaaaacaaccaccaatcacttttgaattatatgatgatgttactccaatcactgctgaaaacttccgtgttttgtgtactggtgaaaaaggtgtaggatacaaaggatctattttccatcgtatcattccacaattcatgcttcaaggtggtgattttgaaactggtaaagggtatggtggttattctccaactcataataacgataagttcaatgatgaaaacttcatcaagaaacacgatagaccaggtttgttgtctatggccaatgctggtccaaacactaatggatcccaattcttcattactactgttccatgtccttggttagatggtaaacacgttgtctttggtgaagttgttgatgggtttgatgttgttaaaaagattgaaagttgtggtacttctagtggtactcctagtgctagtgtcgtcattgaagaaagtggtgaagctgaaaaataa

SEQ ID NO: 3666 - DNA, 846 bp, Candida albicans
ctcataatcatgttcaaacaatccatacgtagtctagctaccaagtcaccaatttcaagtgctgctgccacgaccaccaccgctagtaccaccagcactaccaccacagcttccttgaattttgcaaaaccaccatcttatacattagctcaattacgtgaattcccaagtttagaaccaaaaacatttattccattaccaacgacatttttcaacaccgaaaaacctattcgtagagatatattatggagttgtgttacatatgaagccgataaggcccgagtaggatcaaattatgcaattttaaaatcggattcaccttattctaatcgtaaattacgtcctcaaaaaggttcaggtcgtgctcgtttaggtgatgccaattctccacatatggataatgaaattaaagctcatgctataaagggacctcatgattggagtactgatttacctagtaaaatatattctcgtggtattcaaaatgcttttactatgcattataaacaaggaaatttaaatgttgttgaaaatgaattagatttccaatatggatatgatattataactcaactgtttgtttcagtgcataatttgaataaattgaatttattatttataactaatgaaccaagagataatttaatggaaagtattaaaaaattctacattaatgaaaaagaatttaattcattaaataaaaaggaaaaaccaaaatatttacagaaattaaaaggcaaagtattgacaaaggaagatgttgaagttagagatatattaagagctcatagagtattcattgaatcttctgctttacaatggttcatcactaaacatactgtttaa

SEQ ID NO: 3667 - DNA, 645 bp, Candida albicans
tacgtggtccttgcccggctttgtgaagattcgtggtcagatttgactccattaccgaatgtcaagtgtttaattttaggccaagatccttatcataattataaccaggcccacgggcttgcattttcagtattggagccgacccggccaccaccatctttggtgaacatttacaagacattagcaattgattatccccaatttcaaattccagattacaacaaattatcaaaagagggcaagcccggtgggggtaatttgacaaaatgggctgaaagaggggtattgatgctaaatgcggttcttacagttgaagcacataaagccaacagtcatgctaatcagggatgggaattatttacggaacaagtaatcaaggtcgccattgattatcatagcaaaaacaacaagggttttgttattatggcatggggatctcctgcccagaaaagggtcgcaaaatatagcaaacagctaagtgatagcaatcattttttggttttgcgaactgttcatccttcaccattatctgctcatagagggttttttgatctgaaggtttttttcaaatgtaacgaatggctagctaaacataaaaaagacaaaatcgactggggcattattgacgggaatataatacaatga

SEQ ID NO: 3668 - DNA, 405 bp, Candida albicans
attgtattgaataagcaagacttgtttgcaagcagatctgaagaaatgatttcaaactactctcgattgcttgacttacccaagaactattttcatgtagtttcatgctcaactggatcaggaattgacaatcttcaaaaactattaattgaaaaattcaaagacttatctcagtcagaaacttctaatcctattattgtttcttctcgagtacaggatattttggaaaatgatattttattcggattcaaagagttttatcattgggctgacgctgaggatgttcttgtagcaacagactgtctccgccaatcggttgatggaatagggaagattactggacaatcgatcgacttagaagagatcttggacgtggtattttcaagcttttgtattggtaaatag

SEQ ID NO: 3669 - DNA, 1227 bp, Candida albicans
acagttctgatgagattttggatttggaattttgtttcttcaattttttttttttcctatcctgagaagatcattatcgtcggttaccttgaaagtctaatgttccgtcaacttctacatgttggtaaacgatccttgtcgactgacaatccattaaaaccaactgtatttgcgctatctaccaaatttggcaaatctgcaatcgcagttgttagaatttctggtcctcaatcaaagtacatctaccacaagttaaccaactcgactaaaccacctaagaatagaattgccagtgtccgtaaattatactcccctgaaccccattccaataagaagtcggtttttctagatgaagctttaacattatttctacctggtccgaaaacatacactggagaagatttattggaattgcatttacatggtggtgttgcaattatcaaatctgtgttacaatcgattaaaaaactacatgaccccaataatggagtaattattagacaagcagatcgaggagagttttctaaacaagcattttacaatggccgactagatttaactgaattagaagggataaatgacatgattaatgctgaaaccgaactgcaaagattggcgagtttagcatcactgtcaggacagaccaaaatagaatttatgaagtggagaaatgaaattattaatcaaatggctaatttgacaatgattattgatttcggtgaggatcatgatatcgaagaaactgatcgaatgatacgagatgtgaaagagaatattgcaaaaattgaactggaaattaaagcttatttgtcaaaagtaaagtcactgcaaattttgttgaatggtattcagttggcattattgggaccaccaaatgctgggaagtcgtctatattgaacatattggcaaacaaagatgctgctattgttagtgagattgcagggactacgagagatattcttgatataccattagagatcggaggatataaagtagttgtaggtgacactgcagggatccgatcatttgaagaagctgactctattgaacagggaggcattaaaagagctaaacagaggtcaatgttggcagattttgtgattgtagtactagatcccatgtcagtggaaaaagaacccttggaattgaaagaacatcttaaaactttagttaaggcaaataaacaaatgctaattgtattgaataaacaagacttgtttgccagc

SEQ ID NO: 3670 - DNA, 1266 bp, Candida albicans
tcttattgctggaaaggggaggaattagtaaaagaataccaactatcaatcatgttaagacttctgatacaaagaacatattccaaaacaacaatacctcaaatatcgagaagttgtgtttcattctcttcaattcgtcataataccactacatcttctaccaacactagtagttccaccaccccgatcactatcaagactaactcatccaaatctaaaacaaatggaactttagtagattcaaacaaatttttgagaacaacttatgaatctatagatgattatggtagttataaacataatatattcactcatagattacctgaatcatcaggtaaacaatcaccaccattagttgcattacataatcgtttacaattacctaaatcatttaaattagctacattatcacaatgtcttaatttaattactaaaccagaagaatctgatggattagctaataattttggattaaatacattaggtaaatctttattatcatattatgttactgaacatttattaattcattatcctcgattaccgatgaaaatccatcaagctgccgttgattcattaatgggtaatttagcattactggaaattggtaaaacttgggggattgaaattgatgaagttagtaaattggatagatttttaggtcaagaatcagaatttatgaaatttggtagattaagatatctttatgatcaagataaatctgataaattttataataataatggtaattataaaaatgtttccgggatagaagaagttatagatgaacaaggtaaattatcacaacaagatttagcttatgcttctgcggttaaagctataattggtggattatatactcattgtggtgaatcagcggctaaagatttcattaatgatcatattttatcaagaaaaattcctttggatcaaatgtttgaatttaaaagaccaattagtgaattgattagattatgtgataaattagaatttaaacaaccagttagtattagattaattgctgaaaccgggagattatcggctcatccacaatttttggcaggagtatttgttggtaatgataaaattggtgagggaattggatcatctttgaaagaagcacaaattagagcttcaattaattcattattgggttattatttatattcaccaattagtgcaaatggtgaaccaataaaagaaccaagtgattcagtggattataaatttgaaggtatgattggacttggagatgttgctgtttaa

SEQ ID NO: 3671 - DNA, 498 bp, Candida albicans
  unsure (187): Identity of nucleotide sequences at the above locations are unknown.
acacagataatgggaatatctagaggagtgaaaaccacattgttaacattgacatggtttccagtactatattcattcacaaatcatggatatcaaccgtatcaaataaatggatcatcaatgacaccaactttcattcccggtacgtcaacaatgacaaaagatattgttttagtaccaaaatatnatattaagaacccggattcgctatcaagaggagacataattatgtttcgatcgccagaaaacccagacaaattattgactaaacgagttgtgggtatacaaggtgatattatacgacgtaaatcaccaccttatcctaaatcagaagtgaaaatccccagaaatcatttttgggttgaaggagataatagtttccattctatagattcgaataagtttggacctgttagtcaaggattggtgattgggaaagtggtgactataatatggccaccaagtaggtttggaagtgaattaaaaagaaatttatag

SEQ ID NO: 3672 - DNA, 774 bp, Candida albicans
atcttaataatagaacaaaccaacaccatgacaaacacatttgaaatagtatttgctgtgcctatggaatgtgactcttgtgtcgactcaattgctagtgtattaaaaggcttggatggagttgaaaaattcaacatcaatttgaaagataaccttgtcagtactgagggatcattgccaccgagtgagatatcaaaagccatccaaagcaccggtaaagatgctataatcagaggtactggaaaaccggattccgctgctgtctgtatattagagtcttttgatcccaatgacattcaacaccccgtgaaaggattagcaagacttgtcgaggtctccccaaacgatttatttgttgatttaactgtcaatggattacctaaaggtgtctactacccttctattcgagtatcagggaacttgtcacagggtgctttatctacaggtccaagcttttatgaattgaatccaattgaagtgaaaacaccagtgaatgcagaaaccaccattagttcaagaggtgcaaaattagaggaagattcaactttatatgctggccaagcttttcttcatgctaaacttaatattaatcagttgattggtagaagtatcatattgtcgaaaatcaaagaccaagtggcaccagattctttgtgtggagttattgccagatcagctggagtttgggaaaacgataaacaagtatgcagctgtagtggcaagacagtatggcaggaaagaatcgacgccagagttaaaggggtacatgtataa

SEQ ID NO: 3673 - DNA, 1155 bp, Candida albicans
tttaatcaagaaactgatgttaaaattaaattcaaagatgttgcaggtatggcagaagctaaacaagaagttatggaatttgttaaattcttgcaaaatccagaaaaatatgaaaaattgggtgctaaaattccccgtggagctattttatctggtcccccaggtactggtaaaacgttacttgccaaggcaactgctggtgaagcaggggttccgttttattctgtttccggttcagaatttgttgaaatgtttgttggtgttggtgcgtctagagttcgtgatttgtttaaaactgcacgagaaaatgccccttcaattgtgtttgttgatgaaattgatgctattggtaaacaacgttccaaggggaatgctaccggtgccaatgatgaacgtgaaacaacattgaatcaattgttggtagaaatggacgggtttgatactagtgaccacgtcgttgtcttagctggtacgaatagacctgatattttggatagggcattgatgagaccaggtagatttgatagacatgttcatattgacaatcccgaattattgggaagaaaagagatttttgatgtgcatttgcaaaaaatcaccttacaaaaagatattgatcccgatttatcaggcagattagctgctttaactcctggattttctggagcagatattgccaatgtttgtaatgaggcagcattaattgcagccagatataatgctgaatttgtcactttgaggcattttgaattagctatcgagagggttattggaggtgttgaaaagaaatcgaaattattgaatcccgaagaacagaagattgttgcttatcatgaagctggacatgccatttgtgggtggtacttgaaatacgctcatccattattgaaagtctcgattatccctagaggtcaaggtgcgttagggtatgcacaatatttgccacctgatcagtacttgatgtcaactttacaattatacgatagaatgatcatgactcttggtggaagagtctcagaagaattacattttgcttcagttacaagtggtgcccatgacgatttcaaaaaagtgactgggattgcacaatctatggttttgagatttggtatgtctacaacagttggtatggtgaattattatgacacacgctct

SEQ ID NO: 3674 - DNA, 315 bp, Candida albicans
gcttcaatttgcggatcggcccggccccgtggtgaagacgacgagaccagtagaataattgacagtgaagtacagagaattgttagtgattgttatcaaaaatgtaaacaattgttgactgaaaaatcaaaagaagttgaactagtggcccaagaattgttgaagaaggaatttatcactcgtgaagatatgattagattattgggtaaacgtcccttcccagaaacaaatgatgcctttgataagtatcttgatggtaaacctgccttcaaaaatgaacaaccagaaaatgaaaaaaaggattctgcaaattaa

SEQ ID NO: 3675 - DNA, 555 bp, Candida albicans
tcaatgacattctttgaatcacttaagtttgtcggatcgacgttatcctggactttgagagcaggctgcatagcacacttgatacatgaaaatgtctatgaattcactgaaactcgaggcgaatcaatgttgccaacattacaaaaccaacacgactatgttcatgcgttgaaaaaatacaaatatggaagaaatttaataatgggagattgcattgtcgcaatcaaacctagtgaccctagtcatagaatctgtaaacggattactgggatgccaggggatatgattttggtggacccatccagctcatctgaactaaccaatagcccaaatgaaataatacaacatgatggatataacaagtacattcgaataccagaaggtcatgtgtggtgtactggtgataatttatgtcattcattggactcacgttcctatggtgtggtgcctatggggctcattacagggaaaattgttgctgccaattctatgagtgagggaatctccacattatacaatttcagatggataacaaatacgctacaggatgagtga

SEQ ID NO: 3676 - DNA, 3006 bp, Candida albicans
gggaccttccagccccgtggtgaagataggactgtcttgaggtctttggcaacaaaggcaaacacgtcgtcagaaaactttgctaaagtccttaacccaaaagtgtcgtttgataatctcgatgtatttgctcgaagacatataggaccaacgcccaaagaggtgcaaaaaatgttatcttcattggggtacaatgatttggatgagtttttatcaaacgttgttccggaacatattttgatcaagagaaagttaagtgtgcaaccagaaaagggttttactgaatcagaaatgttggatcatttgcataaattagctaataaaaacaaaataaagaaatcattcattggtaaaggttatgcgggaacacttttgccacccgtaattcaaagaaaccttcttgaatcccctgagtggtacacttcgtatactccttatcaaccagaaatttcccaaggaagattaaactcattattgaattaccaaaccatgatctgttcacttacaggaatggcaatggctaatgcctccttgttagatgaaggtactgctgctggtgaagccatggctttgtcattccacaactcaaaagacaagaaaaagatctacgtggttgatgccaatcttcatcctcaaactgtggatgttatagaatccagagccgaaaatattggtgttgaaattgttgaaatacctttagctactaaacaaggggttgaagaattatctagaattgctgataaattctgtggtgcattggttcaatatccagaatacaatggagaaataactgatttcaccgaactcggtaatattttgcattctaataaagctcttttcgccatggctactgatttattggctttgactgttctcaaaccaccaagtgaatttggagctgatattgcattgggtacttctcaaagatttggtgttccatttggttatggtggcccacacgctgcatttttcgctacttcatctaaatatgccagaaagattccaggaagaatagtgggtgtctcaaaagacagattgggtaatccagctttacgtttggcattgcaaactagagagcagcacattaaaagagaaaaagccacttcaaatatttgtactgcccaagctttattggccaatatttctgccaattatgctgtttatcatggtcctcaaggattgaaaaacattgccaacagagtttatggtttcacaacattattagctaatgaaatctccaaaaagcatcaattggtcaacaacaaatggtttgataccttgactgttaagttgaatggtgtttcttcagatgaaattttagctaaagctttgaatgaatacgatatcaacatgtttagagttgatgaatccacggtatcattgcaattagatgaaacagtccaaaagcaggatttgatcaatttagtcaatgttttcactggtcaagaaaactattctccagatgaattgccagctattcctcaagaattattgagatctgatgaaattttaacaaatgaagtttttaatgcccatcattcagaaacagcaatgttaagatacttgcactctttacaaagaatggatttgtcattggctgatagtatgatcccattgggttcttgtactatgaaattaaacgccactgtggaaatgcagactttgtctattcctggattcaattcaattcacccatttgccccaattgaccaagctcaaggttataaggaattaattgatgaatttgaaaaggacttgaatgacatcactggtttcgatggaactacttcgatgcccaactctggtgctcaaggtgaatacacagggttgtctttaattagagaatatcatagatctcgtggtgaacatgaccaaagaaacatttgtttgattccagtcagtgctcatggaaccaatccagcatcagctgctatgtgtggattgaaagttgttccagtcaaatgtttatctaatgggtccattgatttggaagatttagaggcaaaagctgccaaacatgctaaaaatttgtgttcaatcatgattacctacccatctacttatggtttattcgaaccgggtgttaagaaagccattgatattgttcatgccaacggtggtttggtttacttggacggtgccaacatgaatgcccaagttggtttaacttctcctggtgatttgggtgctgatgtttgtcatttgaatattcacaaaacatttgcattaagtcatggtggtggtggtccaggtcaagcaccagtttgtgttaaagaacacttgaaaccattcttaccaaaacatcattttgtcaatactccacattcgaccagtgaatcgatcaaagccgtcaactcagctccatatggtagtgcatcggttattcccgtttcatattcatacatcaagatgttgggagcacaagctttaccatatgtttctgctattgctatgttgaatgccaattatattttaaccaaattagaaccacattataagatcttgtttgttgaccgtgatgcctcatctgaaagtggtaccaagcattgtgcacatgagtttattcttgatttacgtgaattccaaaagattggcattgaagccattgatgtggctaaaagattacaggattatggattccatgcaccaaccatgtctttcccagttgctggaactttgatgattgagcctactgaatctgaaaatttgggtgagttagacagatttattgattcattgatttcaatcagaaaagaaattgaagcctaccaaaataaggaaccattaggacaagtcttgaaaaatgccccacattcattggaagacattgttagctcagaagattgggatgcaagaggctacactagagaacaagctgcttacccattaccattcttaaagaaaaacaagtgttggccaactgttagtcgtttgaacgatacgtatggtgatttgaatttaatctgtacatgtccttcagttgaagaagttgctgctgaaagttag

SEQ ID NO: 3677 - DNA, 474 bp, Candida albicans
  unsure (260): Identity of nucleotide sequences at the above locations are unknown.
cacattaagggttccttgacccaaatgttccaatggacaaaattgtgttcagaaaatttgaacaagagattacgtttacgtgttcccaccagagtattaaacaccatatctaaagaaggagggttagatcaatatttattgaaaagcaccccagccagagttaaaactatgggattaaaagcgtggcaattaagatacagaatattacaagaaagggaacgaagacagagaggaaatgtcaccgtactggatggtacaantaagccaatccaatatatcagctccaatggtttgaaattccatgccactaaagatgctatgttatctgaattatatgaagctgtccaaagagattcatattacccaattaaaccttttcatttcgaaagagactacagttggttgtcgtatgaagaaattgttaagaaattagaacaatacaattgggatttttccgaattagctaccaaataa

SEQ ID NO: 3678 - DNA, 375 bp, Candida albicans
acagtgaaaaaaaaaatagacagaaaaaaaacttcaccaattacagacgattcttcacacccaatacaacacatcttcaccttcgtacctacttccataatgataactaaatactttgctaatgtgctggtgaaattcaaccccttttccaatgctggtaaaagtgcgagattgtttctttcaagagtcccaaccggtacaaaaattgactgtaaagtcttgaccaaaccatcagatattcaagaaattaaagtcacttttaaagataaacatgtaatgactgccaatccagctacaatgagattagcagatttatctgaatattttgatatacattccagaaagttagctattaaagattctattcaagattaa

SEQ ID NO: 3679 - DNA, 579 bp, Candida albicans
ggtccttccagccggctggttaaacattgtggacatagaaattggttaatgaaatatggtaaagtcagaatggttatatttgctccttcagtatcagcaatgaaatttttgggtgaaccaggatttaagaaaagaagaagaaccgggttaaaacgtgatttatatactgattctagattgattggtgttgtgaattcagaaaaggctccaggattgggatatgatgcaagagttttagttcgtgatcaaccagtattacttgaaccatctagtgctcatagagatgaagattattccgtgattgaaatttctccagggaaatatactgcttcacaaatagaaaatattgaacattttttactggcaatttatttaaccaataagaaattggttgatattcttcctactttagctccaggggctatgtatatggctaaagatttgccagaagaaatgttgcaaaaatcttcttatgagtttacttgtgaagatattattaaattatcaaaagcatacgagaattggccattcaaaccatcagtggcagatctatatgattttgatattactttttcataa

SEQ ID NO: 3680 - DNA, 912 bp, Candida albicans
ctccattctttgactaaaatcagcaaattaactttatccaatcttttaaatttttcttttcaactcaatttaatgtactttcattcatttattatctcatcattgataacttcagcctttgctaatccaatcaagaaatgtggttttcctcaggacgaagatattactaacgtcggggccaatggttgggcaatgagtccagatgaaccatgtacaccaggaaaattttgtcccttcgcttgtcctccaggaaagttaatgaaccagtgggaccctgaagctgtatcatatacatttccaaaatccatgaatggaggtttgtattgtaatgaagatggtaccacttcaaaaccatttattggaaggtctttgtgtattgatggtgtgggtactgtatctgttgttaacaaagctagcgatgttgtttccttttgtcaaacagttttgccaggaaatgaggcaatgttaatccctacagaagttggggatggtgatgaacaagtgcttgctgtccctggtcctgggtattgggcaggaacagcagcccattattatgtcaatctacctggtgtttccagcaaagatgcttgtgtatggggcactccagaaaaggctattgggaactggtctccatatgtagccggtatgaaccaggatagtaacggtaatacatttgtaactattggctacaatccaaagtatattgatgatttttcaggaaacatacctaactttggaatcagaattgtttgtgacaacccagatgaatgcaatggtttagaatgtgaaattaatccaagacaaggatttaataaggcaatgggtccagcatctggaaattctcttggtgctgattactgtattgttacagccaaaaatcacgcccacgcaagaattgaagttttccaatga

SEQ ID NO: 3681 - DNA, 204 bp, Candida albicans
  unsure (13),(83),(144): Identity of nucleotide sequences at the above locations are unknown.
ttttcgttaggtntgaaaaggagatatcaagtcacttatgttaaagtcgatcaaatttctgctcatcagttagctatggttanagaattagttaaagttgaattaagtgaagacaaaaaaactagacaagaattaaatcaaganagaaaatataaaactggatttgaattgattaaagatggaatgaagaaaagttatgcttga

SEQ ID NO: 3682 - DNA, 1911 bp, Candida albicans
tatacaagacctactcccccacctccatatttagtgaccgattcaatgttgagacttcaagaagttcatatacgaaaatgttatgggtctaaaataatactaaaacataatcttcatatatcttctactttattatataataaaccttcgattccatcaagtcgacgatcaagactgaaacaaaagttcacatctaaatctaaatatgatgattcatttttcaaaaatatattccaagaaaataaggataataaatcgaaaagtattgaaacccaatctcaagatactcaccaagaagttaaaacttcaggattggagaaaattcaaaatcttgttaaatccaaagttaaatcacgtagtatatttgattcttatgctaatttaagaatagatataactaaaccaaatgatgaattagtacgatcaataattaaaaataccaaaactatgaataagaaaagatttactgatcctgctacttcttggttaagtaatttctcccaaaagcaaatacaagaattacaagattttttaaataatgatttacctattaatggaacaattaatgggaaaactatggaaactccaattaaaattggtgatttagtaactttaggatcagaaagtttacgtttatatttagttacatccgtacctaaaacttttaattcaagaatttgtacttttttaagtgatagaggtgaaattatgtttgctccctttagtactattggttatcgattttctggattaatacctgataaatatcataaaattattgaaaaatttgttgtattggaacaaaaatatttaaatattccgcctattggtatacctgatgcagttttttcaaaatcaaattcagctttacctaaagaacttcaagatcgggaaaatggaacaaagaaagtggcaactgaagaaaaagaagaggttgtagatgttgatggtaatggtgatcctgatgagtcggcatatttggatccaaatgattttattgtccaacaggcatcttcacaattattatctaatactgatgtacaaacatttattgtaccaaccacagttcgacaaatatatgttccagcattattgcaaatttctaacgaagcattttggaaaatgggaccaatgtatcggaaattagaagaattacatagaagtttacaagttgatgacaataatggagaattcaatactccaagaatagtatcaatatttgaaatattgagcaaactcaaacagccaacatctgaacaatcaacatcgactataaaattaggtaaatcaccaactaatctgatagattatgatcaacgacaatataagatatcagatgttatggcagtattatcattattgaaaaagcaaagtcatttgtggacaattttaccatgtaagctgtcattcacccctacaaaagtaacaatatggccgcttgcccaaactaaagaagaagaaagaacggttgaatatttaaataatgatgatggattaactgaaattactaaatattgtggtcaagttgctttaggtcaaaaaccagccaatactaaaccaatattttataataatgttgagaaaatgttaagagaatatgtgaatgggaaatataaagatgatgcatcaatatctactactttagtatcacttttacggaaagtagataaatattttgttgaattgggaataccacttaaagaagaagcttataagaatgaatattcatatggtaaagcttatgatttgctcactaaattaaacaatgatgttgtggtcaatccattattatgttcggaacaagttaatttaccaattgaagaaaatgcatcgcccaaaattttgacaaaacaaaaattttataattatatggatcaagaaattgccaatgaaacccctaatgaaatttaa

SEQ ID NO: 3683 - DNA, 1575 bp, Candida albicans
caaaatactattgccaatgaaatctataatgaagatccattacaccatttaagacaagatatgagagaaacccctatatattgtattgatgatccaacggcccatgaaattgatgatggtatttctatacatgaagatcaacaagattatattgtttccattcatgttgctgaacccagttcatatattaaacctaattcaataataagttctttggcatttgaaaaaacttcaactagttatatgccagacactgctttccccttgttacctaaattagtatcagatattgctggattaggaatccctgacaaggatactcgaacatttgtgattcaatatcgagttgataagaaaactgtcgatgaatatatttccaataaagtgaacgataaaaattataaagttgatcaactgttattagatcaaataatttctcaaatcaacgaaagtagcaatattgtttttgccacagtttctaattttcgacaagggttcacttatgataaagtcaatgaagtattgaatgatgaaataaaaatcaatcaatataaatcaatgggtcaatccaatgatcttgatttcaataatttgataaaacttcaatatatatcttcattactttgggaaattaggaaatctaatcatgcatatacaaatagtggtaatactaaattaatggtcaaaaaaaataacactagcaatacaaattgcgatactgaattcatttatgatgcaaatgaattacaaatgaaacttgccaattcaaataatacgatttcaattggatttgctaatttagaaagtgcatcaattaaattagttacagaaaatatgatcattgccaattatttaacagcaagatttgccaccactaacaatattaaaatattatatcgataccttgatcctaaatttaatgatgaattgttatccgaatatcaaaaattaatgaaattatcagatactaataacaatacgtcaatccccacggatcaattaacacaaatgttcccatatttcactagaggtttagtcactgataaacctcaaaaacatttacttatgggattatcaatgtattctaatataacatcaccattaagaagatatatcgatttagtgaatcaatggaaaattcaagatttctttttaggtaaacaacaacaacagcaacaacaatctagaatagatgataaaaatattcctgctattgccagtaatttaaatggtcaaggtgaaatcattagaaatattcaactgagagcaaatactttttggcaagggttatttttaagaaattatcaagatttgaaaaacaactacaaccacaaccacaaccacaacccaattgattttaaattgaaattaattactaatccaacaatgggtcctacagttggtgtctatataccatatgttagatttattaatgctcatgttgaagtatcatcagaaatgttggaagatttcaaactgggtcaattgaaaattggtggattaattgattctaataaattacatttaaaacaagttgatttcttggaaaatgaagtgatatttgaatataaatag

SEQ ID NO: 3684 - DNA, 2124 bp, Candida albicans
  unsure (29): Identity of nucleotide sequences at the above locations are unknown.
ccagtttactattccccgccatgtcgtanctactcaactgatcttgagaaattgaaaaaggaatctgacaccaccgagtccgataactcggcatccgccacaggggttattgataaaacacacaacgaagtgttgttgtattacgaccacatatacccatttacaacatccagaaatgttgttaaacagtatttgtctcgattcagtttaccctggagcaccgcctacgacaatgagaaattgaagcagaaagtatgggacttgtcttcgccattggcaacaactgccaaaatcactgagtttgtcccgctaaggagagattctggggcgtttgtcaaattcaagtatccgccagaagtccctgccaccaaattcattgaagaaatacgagagaacgttgagagaaatgaacaagaaagagtaaatagcaacatactcacaagactctaccaccagatctggcgaaatgtgccaaaggtgtactccgtaaaaggtacaccatggattgaagacttgcgccggttccccagtcccaaactctcagtcaaattcgaaggtgatccgttgaccgaagaagaattgtatgtgttgttccgtcgatacggcttgattaatgagattgaacctggtgccactgaagcgtttatatatttccatagcacgagagcggcaatcagtgctaaacattgtatcacaggcatggtgttgaatgggggcaagaccacgcttcacattcaatttgttgccattaagagatcgaatttcttggttctgttgatctcgaaccacacaaaaattgccatcccagtgttgattgcgcttttggccacatttgctgtgttgatttttgatcctattcgagaatggtttattgagtacaagatactccacaacaggaaatcgtttgaccagtttaaggagagcagatggttcaagtatctctacattccatacagaaccatcactggatgggtgtatagtagttacgactacattgacagtcaaatccaagaggttaccgggctgagttgctctgaggagggcgacagcagcaacggctcaaacattgttgatgggcaatcggttcgtgacctcaagaatgaaagcaacatgttttggatagaaaggtacgaaaagtcaaagcaactccagttatggattatggagaatgctaacacatttatcattgtcaaggggccccaagggtctggtaaagaggagtttgtgttagagcacagtttggggtcagacgaacggttaagtaaaaaagttttggtgcttgagtgtgaccagttgggcaaagcacggtcagacaacaatttgataaacaccactgcatcgcagttggggtatttcccagttttcacatggacaaacacggtgtcacgttttgttgatttgggagttcagggattaaccggacagaaatcaggtttaagcgagagcaaggagacgcaaatcaagaacatgtttctgttggcgacccaagccattcggaaaatcacaaccaatgagtacaacaaatatgtcaagagtgttgagagaagaaacaagagattgaaggacgatgagaaaatcgaagtcctcaaagaagaacaattcttgcaacagcaccccgaagctaaaccaatcattgtgttgaacaagtacagccgtcgtgcagatgtgctgctgaatgattttattcctccattagttgcagattgggcgtctgggttggtgcagaacaacacggcacatgtgatatttttgacagcagacgttgggtcgctccagctcttgaatgatgccttgcccaaccaggtgttcaaggacatttcactttccgatgcctccatgtccagctcaagacagtatgtctgtgatgtacttaaggtcaaagatactagcactttggacgaatgccttgagcctttgggaggtagaatgttggacttgcagtcgtttatcagacgtatcaagtcaggagaaagcccacaacaggcaatcaacgagatgatttcccaggctgctgagttgataaacacatttttcttgaacagtcatcacaaatttggtgctggtgatagcaactgggatccatcgcaggtgtggctcattatgaaattgtggtctgaatgttga

SEQ ID NO: 3685 - DNA, 459 bp, Candida albicans
aattgtggtctgaatgttgacacattaattatagtgagttgggtgaaactgcattggttcaaagtatcgaaggaaacgttagagattttgacgacattagaaaagtacgatttgatatctttgaagcgtgataagggggtgttggataagatatctacgggtagaccattgtttaaagcagcgtttgccaatatcattagcgacttgcgaatttggaagttgtatgagactgagtatattggacggttgatatcgcttgaggcagccaagattcagaaattggaagaggaattggagaagatctacaagattggtaaagtagatggcataatcgattatgtatcacagaaaatcgaagcatctaataaaaagattttggatttggaaaagcaagctgctgatgttgcaagctatacgggtaaacccgatggcaaatcatttttaggtatcaagttttga

SEQ ID NO: 3686 - DNA, 783 bp, Candida albicans
caacaattacaaaagaaagctcgagaattagggattccattaaatgaattaagaatcaaatttcaagataaaattgaaaaagtaaaactagaattaggtgggattgatccaactgaagaattgaaacaattttttgaacatgaaaaacaaaagaaacaacagaaccaaaacgataatgatgatggaacgattaaaattagaggaattaaagatcgtgatgcacccaaattaccatataaagtattagataattatattaatttatctaaagctaaagaattacctcgtgatgatatcattaaaatttggacagcaagatttattaataatgatcgagcattgcatgccatattaactcatttacaatttgctcaactttatactaatgcattcaaatatcctcaatttgtattaccattaccaaaacctcaacaagatggttatgaattagaatttgttcaatggcaatttgttggacccaatactattaattgtatgtttaccacattagcggaatataaattacatggagaatatgcttctcctcatacaactttaactttccatttagaattggcacaagataaagatcttgtattgatgaatggatttaataataaagaaagtgggatttctatggatgaagctcatttattggtggttatgttacaaagattttatagtggtaaaaacccacaaatgactcaattattacatgaatttaataaaggtaacgctgaatttgatattgatgctttgattaaacaagcaactagtgtgtaa

SEQ ID NO: 3687 - DNA, 870 bp, Candida albicans
tatcaaagtaccgtcaatatgagagggtcgacgtttcacaaggttataagaacctattccacaactcctgcatcgacatcttcaagtatctccctgacattggttttatcaagattgcccattataactcccgacgtaccaaaatttgatcaacaattctacaattatcaaacagaattatggagaagattgatgtggacatttcctaaatggttttattttagacctgggacattatctgaacaaaaattcaaagaacttaatgaaaaccccgtgagttatgaccctaaagtaatttatccaagggggaagccagatttaaaacataatcgagatcgtagattcagacaatatataagattaccaaaaacttataaagaagaaagtgaattggttgaaggagaagaaaatacacaactggatcaagatatcgctagaaaaattgtacccaattcaagaattactgaagctgacaaaaagaatgattcaactagtttggaaagaaaattgagtagaacattatatttagtggttaaacaaagtgaatcagatggtgaatggaaattcccaaatttcaaacaaccagagaacggtgaattggtacctttgcatgaattagctgaaactggattatattctattggtgggaagaaaattaactatttcaatgtttctcgtgtgccatgccatgtaattcaagattccaaagatttctccaaacaatactttataaaatctcacatattatctggggcatttgaagctcaagaaaaagatgttgaatttaaatggttaacaaaagaagaattgggagaatgtttatcagcagagtattataaagacatagagcatttgctaaatgatgtttaa

SEQ ID NO: 3688 - DNA, 1641 bp, Candida albicans
aatttttcaactttcaaaccctatagacatctttcttatcttatcaattgtatacatttaatcaatttacttactattaacaaccacaaaaagatgactaaacggtacatcaattcctcatggtgtctaataatcttatccctgtttttattatcattagtcagtgctgatgaagatggcatgtcaatggatatgggtgatccttcatcaagaccagaatttcatcctataaatcctggatcaaaaacattccattggttattaacattatttatattattaatattaccatcaattagtacttcattagcaatagcaaataaattacattggtcattatttttacaatatatatctactggttatagtatatttgaatcaatgtttttagatttcccagataatattgataatcatgaaaataaaacatcaaaaggtacaagttggtttttatctatattattaggattgacgatttttttggggacatttattaatggtagtaatttaattattaataaattttatcctcatttacaaacaagacaaaattctaattctaattctaattctaattctaattctaattctaattctaattctaattctaattatgaatatggaataagttataaactttataaaattttatcatttttaacggtattaacaggatgggttagagtatgtatggcaccagtggcattatttggattttgttatggtaaacatactggtcaatgtattgctcatggtataatggaatcagcattcatattatattcatttgtattatcattagtattggttataccttggattagaaaacatcaactattgcacacttctgatggtggtggtggtggtggtgccactggtacatcgcaagaattttatgattctacagtgatgatggtttggggtgttgtcaatacatttactgaacatcgttggggtcgtgaaagttggagtatgggagattatcaacatactgccatggggataatttggtggggtggtggattattaggaatgtatttatcccggaaaaatcatcgatcatttattccagctttattattaattttcacgggttattcaatgtctcaacatgctcaacatttaattatatctactaaagttcattcagtatttggaatttcattaatgggggctggtataacaagaattattgaaattctgtttttattaaatgataaatcttgtcattcactgggtcaaattttatcatttcaatatttaccaccattttgtttgactttagctggagtattatttatgggggctactgaagaacaattacaattggttcatgatttaggttcagatcattcagcgtatattttggtggtttctgctgctgcattcacgattttcctttggattcaacttgtaataatgttttatttacgattagttggatataatgaagatggagaattgggtcaacaacaacaacatcatcatcaatatcaaagtgtagacgttgaagaatttgaattaggtgatcttagtgaagaagaagaagaagaagaagaagaagaccagagtggtagtactaataatcatcatcgtgaattggatactcctccactgtctgatgatagaaataaagattaa

SEQ ID NO: 3689 - DNA, 972 bp, Candida albicans
tttttctatagagatattaaaccagatgcaagaccaattgctgatggcgatttagtgtctcctgcagatgggaaagtattgaaatttggtgttgttgagaatggtgagattgaacaagtcaagggaatgacttattcaattgacgcattgttgggtattgacactggcaaactcgctgcacctacccattcattaaactttgactacaatagtgatgacgagacgatagtgaagcgtgatgaagaatttgctaaaataaatggaatctcctactcaatggatgatcttgttggagggaattcgaaatcaacttaccacatgaatgaattgacatacaaagacgaacacgatggtactgcggctggagaaagggcgtcattttccaaggagttacgagttgcagaagagttgacaccaaatccggttgaatatttccgtaaaaagaatttgtattttgcggttatctacttagccccaggtgattaccatcattttcattcacctactagttgggtgactactctcagacgtcattttatcggggagttgttttcggttgccccatttttccaaaagacacttcaagggttatttgttttgaatgaaagagtggcattgttaggatattggaagtatggatttttttcaatggttccagttggtgccactaatgttggtagtattgtggtcaattttgataaagacttaaagaccaacgatatttatgaacatgaggtttattcctctgcctcttcagtaaatgagagtactccattgttggatcaaaaagattactctgctaatgatattttgacgataactaacagtgaatatgaagacacaaagcgtaagaaattaagaaaaaacactgtttacgaggcaacatacacaaacgccagtagattgttgggcgggtatccattcagcaagggtcaattttcacaaccgcgctggacacatccgcattatgca

SEQ ID NO: 3690 - DNA, 1392 bp, Candida albicans
  unsure (458): Identity of nucleotide sequences at the above locations are unknown.
tccaaaatgccaagacgtatagacaaagtcagtagtatgaccaaaggtcatattactatgtctatgaataaattgaatttgtttaatatttacagaaaggatccattacagtattttggaaaaacattgtaccaacaaaaatgggcagccaaaacagaaaccagaaactatcatggccaacaaattaaggaaaagaggttcaaaaatgtcttgtttgattcaaatttgaaaacatattctcaattagacgcttcattaaaaggtcacgatgttgcaccaacccctattactttacaaacatatggaactttggaaaagagattagaaattgctttgttcagaagtatgttcgccagttctgtcagacaagccagacaatttatacttggtggatacatcaaagtcaatggtgttgttataaaacacccatccttcgccttacaaagcggggatgtgtntagtgttgatccaaaaaaagtattgtttgcccttggtaaaactaaaccaagtctagaaaaggccttaagcgttgataaaaaacagattaaaaaatggaacaattatgtttttgaagccaagaagaatccagagaaaatatgggatttaaagcaaaataaaccagatctgttggacactttaaagcaagttgaagatttcgaaaaacaaaagaagtcagttcaaaatgctcaaaaattaatgaaaatccaacaaaatcaagttacaagacagtcaattttgcaagaaattattcaacttggaaatgctgcctctgaacctgcttcattggaaacctttaataaatacggtgacgtagcacgtacaaagtgtttacaaatatatcagacattgacaaataagaaccacccaataacaaaagatccttccactaagaacattgagggtttcttggccaaggacgaaaataagtcaccagaagaaaaacacgaagtaagattaatcaattctacattgcgtgaattacaaagcagtgaatgggagagaattcgtatacaatttgaaaattttgaagaaggcactgacaccaaattttttcaaacttcatttgccaaggctttgagaggtgtacccaaattgaataaggaagagattttggaagatgaatctaaagcaaaagttcaattgccttggcaaaaacatctttttggaagaaaggacccatcaagatcatatttcactccatggacaccaagaccatttttgggagcatttgcaattttgccatctcacattgaaatatcttttgatacatgccatgcaatttacttgagagaccctgttgccagaccaggacattcagaagttatttcaccattccctgatcatgttcatgaaagagcatatatgtactacgtgagaaaaggtaaatcgtaa

SEQ ID NO: 3691 - DNA, 309 bp, Candida albicans
actgtaaagatggttactactgttcttatgcttgtcaagctggtatgtccaagacttcaatggccatctgaacaaccaagtaacggtatgtctattggtggattatactgtaagaacggtaaattgtacagatctaacactgacaatgattacttgtgtgaatggggttccaaagatgtcaactttgtttctgaaatcagcgaagacgttgctatctgtagaaccgattacccaggttccgaaaacatgaacattccaactttgttatctgctggtggtcttcaccacgcggctggaaggatccgcgca

SEQ ID NO: 3692 - DNA, 1050 bp, Candida albicans
atcatgctagtttttagacgtccagtataccagctctttacaagagggtttgcttattcaagaataattcgcaatgaagcaaaagttcccaaattttctccagtagaattggaggcagctcgtttggcacgagaagcagggttaggttggttgaaacatttccctcgtaaagtgattccctatttagagttaatgcgtttggagaagccagtgggtacgtggttgttgttgcttccttgttattggggtataaccatggcatcgtactctatagcagcaccgttgtgggtgactaccaaagcaattgcattgttttctgtgggtgcgttagtaatgaggggtgctgggtgtaccatcaatgatatttgggatagaaatttggataaccaggttgcccgtactatggagagaccaattaccagtggaagagtttcagtcccacaagctgttgcgtggttgggcgtacaatgttttgccgggttggcagtgctattaagtttgccatttgaatgtttttatttaggtgcgttgtcgttgccgtttgttgccgcatacccgttgtttaaacggtttacgtactatccacaggcaatgttgtcgatttgttttagttgggggtgtctcttggggttccctgctgttggggcgccattgaatttatgggttgctgtgccattgtttatttccaactggatttggtgtttgacatatgatacgatctatgcacatcaagataagaagtttgacatcaaggctggtataaagtctactgcattggcatggggcgacaaaactaaacctataatgaaagggttgacggttgcacaagccggtttttatggttttgctggttttatgaactctatgggtcctgggttttatattgctggtgcatatgctattgcaagattgtacaaccaaattcttaaagtcgatttggacaatccaaagagttgttggagtgcatttacatcgaatattggtaccgggtttatcttttggtatggaattgtgtttgactatatattgttgctacttggatacatctaa

SEQ ID NO: 3693 - DNA, 1494 bp, Candida albicans
tatctttcgttgatgaaacaaaaaaaaagggcaagacagacaaaaaaaaattttcaacataatggattactttctcttcttattgatttagataaccatatttactatactttgggcctattaacaatgttgagaacatatagtaaatcattgttgaagacatcaactaccataaagaaatcgttcctgttcaacacagcaactttatcgttacccacctacaaaaaatattcaacttcagttcctgatgctaatgatgaatcacataccgggaaatttatcaattcgatttctaaaccttattcagtaaccacttatgcacgtccgaatctagtgttaactcatggtaaagggtcatatatatatgatttagaagatcgtaagtatattgatttcacatctggtattgctgttacttgtttaggacattcttatgaacccatcacgcaattaattaaagatcaaagtgaaaaattgattcattgttcaaatttatattataatttacctgctggagaattatccaataaattaattgttaaaacaaaagaatttgatgggatgaaagatgctagtcgagtatttttatgtaattctggtactgaagctaatgaagcagcattgaaatttgcccgtaaatatgggaaatcaataaatccggaaaaatatgaatttataacttttgaaaattctttccatggtcgatcaatgggggcattatcagtgacaccaaatccaaaatatcaagaaccattttctcctttgatcccaggggtcaaaattgctaaacctaatgatattgaaagtgttaaacaagttataaataaagataaaacttgtgcagtgataatcgaacctttacaaggtgaaggtggagttaatattattgatgaatcatttttaattgaattgcgtaaattatgtgatgaaaataatgtattgttaatttatgatgaaatccaatgtggattgggtcgtaccgggaaattatgggctcattcatggctatctccagaggctcatcccgatatagttactattgccaaggcattaggtaatggtttccccattggtgcaactatgatcaccgaaaaagttgaaaaaagtttaaatgtgggtgatcatggaacaacatatggtggtaatccattagcttctacagttggttcatatattgttgatcatattggtgataaagaatttttacaacaagtggaaaacaaatcacaaattttccttgaaggattaaataaaatagctgaagaaaattctaatttgattgaaaaagttaaaggtaaagggttgttattaggtttacaatttaaagaaaatgttgatattggtgaaattgttgctaaatgtagacaacatggtttattgattattactgctgggatgaatactattagattggttccagctttaaatattcctgatcaaactatcaaagatgggcttgaaattttaactcaaagtatcaaagaagttaattaa

SEQ ID NO: 3694 - DNA, 1002 bp, Candida albicans
  unsure (976): Identity of nucleotide sequences at the above locations are unknown.
aatcaaattttcaaaattatgatggtgtttcttgtttcatttattagtgtagagatgaaaagtatgcattgtgcacctttgtttaggcaattggtgttttcccgatcccttcattattctaaaactattttccataatggtagagggttgacttcaacttcagagtcagaaatgtcacatttcaacgccttagcctccagttggtgggatgtcaatggaccacagagaattttgcataaaatgaacttattgagaatggattttattcatgacacaatccgacaaaacttgaaactcaatgaaaatactgacgacgaggtttatataccaccttttagtgtggatttgttgcctcagggaattaaaaataaaattgatgaggaccaagaaatgaggagagacgagatcttgaatgattccagtttaactgttttggacgttggatgcgggggtgggatattatctgaatccatggctcgtttgagttttgttctgagtgtgaaaggtattgacttgtcagcagatgtgttggaggcagctaaattgcataaacaaaaggaccccatgttaaaagacaaattatcatacacattgaacgccattgaagatattcctgaaaccgaaaggtttgatattgttactatgtttgaggttttggaacatgtggattacccttctagagtcttgcttgagggattgaaaagattagagagtggaggatggttgtttctctctacaatcaatagagattttgtgagctggttcacaactatatttatgggtgaacatgttttgagaattgttcctgttggaactcatactttagaaaaatatatcaaccaatctgaaattaaggattggttgcaagaggattcaaatagaaaatcagagtttagagtagctgacacaaagggatgtgtatatttgccagcttacggttggaagtttacctcttgtccagatgttggtaattatnttatggctatacaacgtgtcaagtaa

SEQ ID NO: 3695 - DNA, 1626 bp, Candida albicans
attctcttgagcttgaaaaattcagatcttcttggtgtttatctgaaaaaatactcctaccctttttccgtatcaccagcgggtccaaatgcatatatgaagttatcacttcccattatcagaaactattccaaagcagggtctttattgaaggactcgctagcagaacttgcagctaactcttcacacttatcaagacaacccaaaactcctgcaagaacaagatttgccccttcaccaacggggtttttacatcttggttcattacggactgcattatataattacttgttagcgaaaagtacaggaggagaatttattttacgaattgaggatacagataaaaacaggctagttccaggagcagaagataatatcatcaacactttaaagtggtgtaatttacatatagacgaaggtccagtagaaggtgggccatatggtccatatagacaatcagacaggaaacatatttatcaaaagtatgcgaatgagttgttatcaaaagggctagcatacaaatgttattgttcaaaagaacgattattggaattacgtgaatcagcccagagactaaaaccaccaacaaatgtcacatatgaccggaaatgcattctggaaagtgaacacgagggattgccatatgtgattaggtttaagtcacccaacaactatccaccattcagagatttattgcacggcgaattaagtttacaacctcaatataatgacaaggatagacgatttgacgattttgtcattgtcaagaatgatggcatgcctacatatcattttgcaaatgtcattgatgaccatttaatgaaaatcactcatgtagttagaggagaagaatggcttccgtcaactccaaaacacattgcaatgtatcatgcaatgggatgggagcctcctcaatacatccacattccattacttacatccttgaaagataagaagttatccaaaagaagtggtgatttgaatattttgaaattgaaagatgaagggatcctcccggaggcattagtcaattttgtggctttgtttgggtggtcgccagtgagaagcaacggtgagaaatttaatgaagttatggatttatctgacattattgaattgttttccattgaccagttaactaagggcaatgctaaagtgaatgatctgaagttatactatttcaataaacttcatttggccaaaaagctagagagtgcagaaggattagaaactcttgttgaagagtattatccacactttaaacagttcagtaaccaatccaaggagtatctttacaagttgttaaaatttatgggtcccaatcttacaagtatccatgaaatagaaacagatcaccagtatcttttccaagaaattgattacagcaaggtgaaagtacccaatgaccaaacaaaaagtgttttagaatatgttttggaaaatggctattatgatgcaattaataaattacctcaacaaggtattcccaaaaagaatattttcatgagtcttcggtatgctttaagtggtgggaaatcaggtttagccatccctcattttatagagttattgggtgagatcgaattcaacagaagattgagcaatgctctcaaaactgtaatgtaa

SEQ ID NO: 3696 - DNA, 429 bp, Candida albicans
ggacgcgggttttccagcctcgtggtgaccattagcgatgttttcaaaaaattggaaggtttgggatttgaagatatcagacataactatattttggatagagaaaatgctgcaatggtggcagatgaatacggtattgaggttgaggtggtagaagacagtggtgatgatttatttcctgcgccaatcaaaccggatttgcttgtggaaaggccaccagttgtcaccattatgggtcatgttgatcatgggaaaacaactattcttgactacttgagaaaatcgtctatagtatcacaagagtttggtggcataactcagcatatcggtgctttctctgtgacaactcccaaatctaaaaagagaatcacctttttggatacacctggacacgctgcatttttgaaaatgagagaaagagtgccataa

SEQ ID NO: 3697 - DNA, 1449 bp, Candida albicans
aaagagaatcacctttttggatacacctggacacgctgcatttttgaaaatgagagaaagagtgccataattactgatattgttatcttggtagttgcagcagatgattcggttatgcctcaaaccatcgaggccatcaaacacgccaagaagtctggtgtgccaatgattgtagcagtaaacaaatgtgataaaccgggagtcaatgttgagaaagttttgggtgacctctcgctgcacggcgtggatatcgaagactatggcggtgaaactcaaacagtacaagtgtcagggaaaaccggtttaaatatggataaattggaagaggcggtcatcactttgagtgaattgtgtgatttcaaggctgaaccaaaggggattcatgcagaagggtggattatcgaatctgaagtagtcaaaggaatgggtaatgttgctacagtattggtccgtagaggctctttgaaaaatggagatatcattgtggctggtaaaacattttgtaaaataagagggatgaaagacgaaaataacaaaatggttaaaatagcaggaccatcaacaccagtgagaatttggggttggaaagatttgcctgatagtggagatcagattttacaggcaaattctgaacagattgccaaaaaagtaattgattatcgtattactagatcgcaagagattcaggcaactagagatattgaagatatcaatgtgaaacgtctagaggaaattaaagaggctgaaagattagagaaaattgccgaattaaagaaagccggtttggatgctagtactttagaaaaagctgaacaggataaaaagacaataaaatgtaattacattgttaggtcagatgtgtttgggtcagctgaggctattaaggagagtattgatggattgggcaatgaagaagttgaatctgttgttatatctcatgaagctggtcctcctaccgacagtgatatcgaacttgccaaaacatttggagctactattttttgctttaacatgaaggtgccaaaacctattgctgttcgtgctgacaaagaaaaagttaaagtcaaagaacacaatatcatttacaggttgattgaggatgttacagatgaattaagttcccatttgaaaccaagggtagaaatcaaaacattgggtgaagttgatataaaggatgtgttcgtggttactgttaaaaaacagaaagttaaaattgccggttgtaaagttacaacagggtccataaaaagttcatcacaagtgaaggtattacgtaatggtcaagaggtttactgtggtaaactttcatctttgaaacatgttaaagatgatatcacggaagctacaaagggtaaagattgtggtatagcatttgagaaatggcaagattttgaagcgggtgacaagatacaggtttatgaagaaatcctacataagagatatttgtaa

SEQ ID NO: 3698 - DNA, 1287 bp, Candida albicans
atgtcatttgatattaattggaatcaattaacaattgatgacacgatcaatcaatcgataaaagagtttttggatcagcaattcaaaaatatctcactcccatcatttatttccaatcttgcagtgactgattttaatttaggagaaatacctcctgaagttacgatccgacatattggtgatccatttgaagagttttatgaagatgaaaataatttaggagtaatgaatgaggctaataatgattcaaaagatgaacatttgaagaaccacggtgatgggatcaataaagatagtggatataatagtcagaatcttgatgacgaggatgaagacgatgaggatgacgacgaggatgatgaagacgaagaagcagaagatgaagatgactacgacgatcacgatttaggaaccattaatgaagggattagtttgttgaactttaatgaaaactcaaccactccttctgctaactcatttgcaggtctggctgcaccaccactaccaccacctctaaacccttcacgagattctttccattcaattcttcatccatatggtgttaatagcataataggggccacaggtgctgggtcggaaacacctacaaatatactaaatcaaaattatctatcttccagagtattaccaaaaatatctgtaaaacaaaaacaacctcatcatgatgataatgacattcaacttattgtggaaataaattataaaggtgacatgcatatcaacttgttggtgaatttattagtaaattatccatcacccaatttcatatcattgccgataaagttacatattactgacatagtgattcattcaattgccactattgcctatttaaagaaatcagtgtttttgtctttcctatgtgatgttgatgatacattccctgattttgatagtaatgtacaaactcctacatctactactggtggaaattttgttgattattactccaatgacgcaactatcaataaagaaagaattgatattgttaaaaagattaaaattgaaagtgaaattggtgaagttgagaataatatactaagaaatgtggggaaagttgagaaatttttagttgaacaattgaggaatattttacgtgatgagattgcttggccaagttggatctgtattgacatgaatgatgatgatgatgaggaggaggaggaggcagaactggaagacaatgatggtggtaacagtgatttaaatgataatgatggtaaacatggagatggaaggactgatgagacagaagctggagaataa

SEQ ID NO: 3699 - DNA, 756 bp, Candida albicans
agatcaactgaaccattcttcaaagacaagtcaacagataaatatttaacgagtaacaacatcaagaagcacaatttagaacaatttgttgcccctaaaaatgaagatattgcaagactagctcataatttagatcgagtattattttcaccaggagtccattttttacaagaccctagaactcgaatatataatttttccccatttttgaaaaaagtgatccattataaagatttcaattttaaagctattgagaattatacaccagtatcgaaacatcaacaattgttggaaaactcccaaaaatttgaaaaacaattctattcgtcaacttcttccatgacatctttattatcgaaattttatcattttttgaataaatatgatagatataatgttaaacggtttggtccgattccattcacagggatgagtaatgacttgccaactaatttgattctaaaacctcaaggtgagtttatggattcaacaacaaaggagaagaaaccagtctattctattcaagctgataattcgtgtgatttagatactttacttagtgccatggggatgtgcatggaaacattattaacaaacccacaaaatgaatttgtcaagtaccataaggatagtggtgttgagtttaatgaaccacttggtaatacttataactatgcatcttatggggactttttattgagatcacagttggattgctatgatgaaagattacaggaaatggtacttttgatttga

SEQ ID NO: 3700 - DNA, 783 bp, Candida albicans
  unsure (62),(239),(280): Identity of nucleotide sequences at the above locations are unknown.
aaatattcccaaagtgaatctttagagaggaatgatattcagatttggagattgattgcaanttatgaatcctacgcacaggagttcagagatatgataagaactggacccatgttgaagtacttattccaggcaaggataggccaaatggatggtattttcattgcttatcatagtatcaataccatatttggtttccaatatttgccgcttgaggaattagataaattgttttacantagagacaccattagtgaattccctgacgttagtgtcaganatttgaatgaacatagattgcctgacaagttaccatccttgattggggaaacacaatttaagttttcgttggaaatctggcaaaagttattacaagaacatattttgaaagatttgaacaaagaattcaacaataaaccaactccatttagattgagtgtgaaatatgacacattagcacatctattaagagtgtttgttataccagctactgatgaagagattgatgtgttacaatcatttccagaaagattcaaacgtgattttgctgaagatgagaatttgggtgaggtgaagaaacacgccagggagttaacaaagttcaacgaaaaatgtcttgaaacaaaggaagtattctcctatgttattcaaatggattcatgtatgattgatggtaaaattagacaataccatcaattaccccgtgactatttcaaagattggcaattaatatataatatcaagagaacgagcaacgctcctaagtcttcaccacggggctag

SEQ ID NO: 3701 - DNA, 318 bp, Candida albicans
tcctcaatactcagatctgctaaatctttacaaccattgttcgatagagttttggttcaaagactcaaaccagctaccaaaacttccactggtatttacatcccagaaaaaaaccaagagaaattgaaccaagccactgttattgctgttggtccaggtatcaccaataccactactggtcaagttattccagtttctgtcaaggccggtgataaagttttattaccttcattcggtggtaacccagttaaagtcggtgaagaagaatacttgttgtacaccgacaaagaaattttggccaagattgaagaaaattag

SEQ ID NO: 3702 - DNA, 429 bp, Candida albicans
agttgcccattcaaggtgcttattccacaagatttgtcattgattgtgaaagccagacacggtggaagtgattatatcttctccttgttgactggttacccagatgaaccaccagcgggtgttgtgttaccagaaggttccaactataacccttacttcccaggtggtgctattgctatgggtagagttttgtttgatgacttggttgaatacgaagatggtactccggctaccacctctcaaatggctaaagatgtcagtactttcttgaactgggcttctgaaccagaacatgatgacagaaagaaatggggtttgaaagctcttgttgtcctttcttcattgtacttgttatccatctgggtcaagagattcaaatggactccaatcaagaacagaaaattcagattcgacccaccaaagaaataa

SEQ ID NO: 3703 - DNA, 549 bp, Candida albicans
tacaaatcctacaacaatatgtctcaaagaattggtattacagcatctgcgctcacaagagtatggcatcacgttgacgttgctgctgacaacagatccttaggtcgtttggcttcaagcatagcaattacattaatggggaaacataaaccaacatacactccaaacagagatcatggtgattatgtggtggtcacaaattgtgcccatcttaaagttactggtaacaaattgaaagagaaaacttactggagtcatactactcgtccaggtactttgagacttgtaccaatggaaagaatgattgataataaaggttatggtgaaattattaaaagagcagtcaaggggatgattccaaagaataaacatagacttgttagaatggacagactaaaacttttcgatggagatgaccatccatataaagataatttgattgctttcgctgatgaaaatcctgatatgagaaacaaacttgctgaattggaaaagaatgaaaagaatagagctgaattaagagaaaagtatttatctcatcaacaataa

SEQ ID NO: 3704 - DNA, 693 bp, Candida albicans
ggaaaaggactctccaccaatagacttcaactacataaatatatcaacttttttagcaagatgggtagaaacgtattaaaatatggaggtaaatcagggatattaccaaaagtaagaccaattttcagaaaaccaatccgtccacccactgaatacgaacaagcaaaagaacacagtatagagactgggtatgctgaaggtattcctttaccaaaaattaacgggaaagaagtctctcgtaaacaaccaccaaagaaatatgtcactgttgaacaaagaataaatcagattaagtttccagaattgacattaaaacagatgaatgagttacccgaagaagaaagagacgcttataaaagacaatattatcgtgctcaattcttgaaagatgcatacttacaagaagagaaaagattaaatagaattgatgaattgaaagaaaaagtgcatcaacaaaatttggaacgtcaagcacgtttgcaacaagaagaaaaattggaacaccaaaataaaaacattgaaggattaccgaccatgcaagcattattagataaaggtatgatgagaagacgaactaaagaagaaattgaattattaaaagagcaaagaaatttgaatagaaaattgaaggagttaccagataaggaaaaccaagcacagaaggtgttagaattgtaccatgccgcctgctaa

SEQ ID NO: 3705 - DNA, 1206 bp, Candida albicans
attttgtattgtattctctgtgctacgctacatttagtattattgatgatgtttagaagtactttcaaacccacttgcattgccagaagaggattcttccggttcaattcctccaacagttcaaaacctccaaccgggattgtttttatgaatatgggaggtccttcaaaggtggaggaaacatatgattttttgctcagattattttccgatggagatttgattccgtttggacgattccaaaatatattggccaaattcattgctaaaagacgtacaccaaaaattgaagagcattatcgagaaattggtggcggttcacctatcagaaaatggtcagaataccaatgtaaaaaagtctgtgagattttagacaaaacgtcacctgaaactgctccacataaaccgtatgttgcatttagatacgccaacccattgactgaagaaaccttgaatgacatgaagaaagatggtgtcaccaaagctgtggctttttctcaatatcctcaattctcctactcgacatctggctcttccatgaatgaattgtatcgtcaaacattgatccatgatcccgaaagaaccattgattggtcgtttattgacagatggccgcaacaaccaggtttagtaaaagcatttgccaataacatcaaagaaaagttggctgaatttccaccacaagacagagacgacattgttattttattttctgctcattcgttacctatggaaattgtcaacttgggagattcgtatcctgctgaagtggcagcaactgtttataaaatcatggaagaactcaaattttccaatccatatcgtttagtttggcaatctcaagtaggtccaaagccttggttgggtggacaaacttctaagatcattgacaaacttgaaaaaagagacgacatcaaggggattgttttagtgcctgttgctttcacttccgatcatatcgaaactttgcatgaattggatattgagatcttagaagatgccacaaatccacacaagataaagcgtgcagaatcattgaacggtaatgagacatttattgaaggcttagctgatttggttaaatcccatttgaaaagtggtgaaaaatattccaagcaattggaattggattgtattttaggtagtgaaagagcacaaggaacgtttaaacatcctaatgaaatatttggaaataggaaaaattaa

SEQ ID NO: 3706 - DNA, 663 bp, Candida albicans
cggctggtggaccatgctttaatggcgttggaagacaagaaaccagaaattggtaaggaagctatcttgaaattgttagatgctgtcgatgaacacattccaactccatcaagagacttggaacaaccatttttgttaccagttgaagacgtgttctccatctccggtagaggaactgttgtcactggtagagttgaaagaggtgttttgaagaagggtgaagaaatcgaaattgttggtggttttgacaaaccttacaagactactgttaccggtattgaaatgttcaaaaaagaattagactctgctatggctggtgacaactgtggtgttttgttaagaggtgttaaaagagatgaaatccagagaggtatggttttggccaaaccaggtactgctacttctcacaagaagttcttggcttccttgtatattttgacttccgaagaaggtggtcgttccactccatttggtgaaggttacaagcctcaatgcttcttcagaactaacgatgtcactaccacattttcattcccagaaggagaatgtgttgatcattctcaaatgatcatgccaggtgacaacattgaaatggtcggtgaattgatcaaatcttgtccattaggaagtcaaccaacgtttcaacttgagagaaggtggtaa

SEQ ID NO: 3707 - DNA, 480 bp, Candida albicans
ttcaggattggatgtttaagtttcataatttggaaactggggaagtttttaacccttcatatcagagacggtcgtgtaacttaccgtcaatcattggctgttttagagagggccaaacaaacaaattcatctttgatcactaaaacttcgttgatgcttggatttggtgaaactgatgaccaagttttgcgaacattaagagatttacgtgagattggttgtgacgtggtaacttttggtcaatatatgagaccaacaaagagacatatgaaggttgttgagtacattaaaccagaaaaattcgattattggcgtgacactgctttagatatgggattcctttatgttgcaagtggaccattggttagatcatcgtataaagcaggtgaagcttttatagaaaatgtgttgaaaaagagaaaacacaatgttggtgaaacaccaagattagcacaagaaattaagccaagcatatactaa

SEQ ID NO: 3708 - DNA, 1275 bp, Candida albicans
aaaaatttacgtcaacccaaaattgaattaaaactttgggaaaaacagaatatttcaaaagattcatttttcaaaaagaaaattatggtaatatatcacctcaagacaggaaaagcattgaatgaaaaagttgaacgacaacgaagatttagagctatgaaaattgctcatgaaaaatcacttcaagaaaaagcttatcaagaaagagaaagggcaagagaattagctcgtgaagccaaaggtaaagggaaaaattttaaatccggtggttcttctaattatgacactggggttatggttgatagaaatgatacgatttttgattatgtgtttgggactcatccagttaaagcagtattaatggcaggaaaacgtcgtattcttgatttatacacttttaataatgaagatcctgatattgttaaacttgccatggaaaaatatggtattattcctaaaagattaaaagataaaaatgcattgaatatactttgtaaaaatggtgttcataatggtgtggtattaaaaacaaataaattggatattccttatattaaagaagttggtcatgctgaaaatggagaatataaattggcaattgaagaattagatgatgctgctgctgttgatgatgatggtgaggttaaagttaaaacaaagaaggttattagagatgatgatattgaacaaattgaagaattatatccattatcattatatttagatgaaattactgatccacaaaatatgggatctattttacgatcagcttatttctttggtgttgattttatagttgttcccaatcatagtacggccaaattgggtcctgtggcaaataaagcttctgccggtgcattagatcttattgatatatatcaaacgggttcaagtttgaaatttattgattctgttcgtcaaaatggatggcatgttattagtactagtggtagaccaacaggtggtacaaagtctaaagaaattacccatgttgagaatgatgctgagaatgatgctgatgttgatgttgatgttgatgttgatcaaccacatttaaagaataaattcattgaattacaagatttacgtactatattgaagaaaaccccagttatgttgattattggaagtgaaggttcaggtgtaagaacaaatatgaaaataagatctgattaccttgttggtattcctaaaatcagacgtaatgataatattgttgattcacttaatgctggtgtagcaactggtgttattttacaaaattgtctagattaa

SEQ ID NO: 3709 - DNA, 1065 bp, Candida albicans
acgcaagcgttgatcctccagttcgtcgttaagacgacaattaaaccatggacattaggagatgtaggtgtcataacaaaggctccacaccccaaggccagcgcaagtggattattttccagaaaacaagtgacagggtatcaggcgtttgtggcacaacagaattttgaacatactttcttgaaagaaaacaaagaagcgttttttgggtgtacagttggtacgagaaatttgaagaagaagttaatgaaagtgttggaaaaaaccatggctgcttctttaagaccaactcatttggcaatacaacaggaattggaagaaacttcataccaatttaaagttgaatttaatgatcgtccattaacaccacaaatgtatttggctaataatatcgatatgctcaagttaggaactaaagatttgagtcataacttttcaagaaatgaattgaaagcaatcttgaaaaatgcattagatcaaaaagttttggacttgatggcagaaagatattggaacaagccgtttgaattgaaaggatcttccgtggaacctgatttgcgtgaattaactcaaataaacatggataatgatatttactggcacaaaaagttggacttgactacatcatcattaactaagcttggggttgggagattatcaacaaatttgattacaaatgctttgcttacagaaattgacaatttagtggacaatactcaattacgaaaccaccctatggcaaaatctgcagtacgcgatgcagcaagatcagttttaggaaataaatattactccactgccgatcaagttgaaaactgtatcaaaccatacaagtatgagattgaattggaggatcgtgaatggctaacatccaaagaaaatgcagttactttgttgaaggaacaaatgcgacaatgtgaagaagtttaccatgatttaaagagtcaggttggtggaagaaaattgcaacaagttgtgacttaccttgagaaattaaagctactgaacaactcacatgttgatttaaccacccatgaaacattaagtttttcaccaactttaatt

SEQ ID NO: 3710 - DNA, 1026 bp, Candida albicans
aaatggggtcgttttttttatcacaccatctctacttttaacccaatttttttaactaattctttcaaaaacacaactcaatatatcatgatccctagaaatggacgactaataatgaaaagcagggcattgccattgcgaacatttgtcttattaagatcttctgcacataacacccactttaaaaatgtatcaacatttgttcctacaagaaatttgggattcctcaaggttctaactagagcagtcaaaatgcctgcttatataggaggaaccatggcagccggaggtacttatgttgcttataaagttgaacaagcaagtagctacacacaagacaagttatctgctttcaaggatttcgcggatggcgtttttgataaaaccggcgatttctttaaaaaccttggtggaactgatggcgcaacaggtggcaatggtgccgaagatggggcatcatcaggtggtgctgggggagggggaggaggcggcggtggtggaaatgatactgctactgcggtaggagccactgcagcagcagtcggtctcacttccgatgaagatgaatcaaccgaagcagaaacagatattgaggaagaagatgaagaaacattgattgaagatgacagtgacgacgatgatgatcttgcaaatgatgagacagacgatcatatgcttaatttaacaagacaaatgattgaaataagaaaccttttatccagtttaaaccacgatggaattaaattgccttcaattgttgttattgggtctcaatctagtggtaaatcctcagttttggaaagtgtagtgggtcaagaatttttaccaaaagggtccaatatggtcactagaagaccaatcgaattaacattagttaatacaccagaagccgctgctaatgtggcagaattcccagcattgaagatgtataacttaactgatttccagcaagtgcagagcattttatttgttgttttcacagcgggccatggaaggtaccgatattgcgttacaacgcagaaatcc

SEQ ID NO: 3711 - DNA, 372 bp, Candida albicans
ttgagagcatggatggcgcctgcggtcgtgtgtgaaaacagggagtcacaaggtccagaaatattcttggatgcagtggcttcaaaaataacttctacttcaatattgtttttaaacgtcgagttgttgagtgatttctattacaactttcctcgtgaattagatttaaaatttttcaataatttaagtaaagacgaaattgaaaaatttgccaaagaagatccaaagatcaaaaaacatattgaattacaagaaagaaaagatttattggaaaatgctttaagtaaagtcgaaagtgtcttagctgtacaaagaactacccaaaaggataatacagaggatcgtaataagaaatctgtttttggctggtaa

SEQ ID NO: 3712 - DNA, 1161 bp, Candida albicans
tcattggattatgtgccatgggatgaagtttatcatataaataaattcattcaagatgcccaaatgtttattgacgatatacacaatagaggtaaaatccccattgtagttggtggaacccattattacttacaaactttattattcaacaataaaaccattgatgattcgaattccaatttaaaagagttaacggcagaacaattggaaatcttagatggtcccgttgacattctatttcgtactttacaagaagtggatccaataatagccaaaaaattccatcctcaagatcatcgaaaattacgtcgagctttggaaatattctatacaaaaggtgaaaaagcatcagaaatttatcatgaacaaaaacttgacgagttggattctagttctttgaaatataatacattgtttttctgggtatattgcgatccagaaattctcaatgatagattagataaacgagtggataagatgatggaaaatggggctattgaagaaattaaggaaatgtatgacttttataaatctaaacaggagcaaaatcttacttgtacatcagggatttggcaagttattggatttaaggagtttttgctttggttggaagataaccaactggataccaaattatttgaacatggtattgaaagaatgaaaattcgaactaggcaatatgcaaggtatcaagtcaaatggatcaagaaatcgttattgacggaactagaaaaggaatcaaagtttgattttgtaaatggtgggaaattgtatatattagatgccacaaatttagacaattggcacgaaaatgtggatgacatagggattcaaattgctcaagatttcttgtccaaaggtgcaaatggggtttcattaccacaagctccggatgagctaaaacatttttttgaagcacccaatgaaataaagtctaaccgaagactagaatcgcaagaaaattggaaacattttgtttgcgatatttgtaaagacaaacaaggcaatgctttagtggcggtgggtgaagatagctggagtgtccatgtaaatagtcgacgccacaaaaagaatgaagagtctatcaagaagagaaaacataatgaagagatgattagattgaaaaaaatgagatcaaatcaagaaggcgtgattaactga

SEQ ID NO: 3713 - DNA, 963 bp, Candida albicans
caactatccatacaaatacaatgtcaaacaggcgattactactacgaggggataacaagatctcatcgtagttttgtcacatcgcttcgaagaagacaacaacaacaacaacaacaacaactgctgcagcaactacaacaacaacacccactacagcaatttactgaggaaccaagagtaaatcaattaggtatacagtacttatctaatgatcttcataaaaaggttttccccaccacatcaactaaggattatctatcaccacaacatccacaattattagaaatatctaaaaaacatttacaagaaaatgaattattaggtaaaaagactcaaataactgaaccaataacgataaagaatttcccctcattagtaggtaaatcaatggatgaacattttaataagttgggacaaaaatcttctgatccttatttagctatggccacaaattttttaaaaaaagagctaccttgcaaacctcccaaatcacaatggaaatttcaatctggttggacaagatacactaaagatggtaaccctccagagcaagttccatatccactagaagatacattggtatttgatgttgaagtaatgtataaaatttctaattatccggtaatggcgacttgtgcatctaacgaagcatggtatagttgggtctctccagcgttacttgattgggaaaaacaaaaaaataacagcattactaccgatcaaatagattggaaccatttgataccaatgaattgtgccaaaaaaccaaaagttattattggatataatgtaagttatgatcgtgcaagaattttggaagagtataatattaaacaaaccaaagcattttatctcgatgggatgtcgttacatgtggctactagcggcatttgttcaagacaaagacccaaatgggctaaatacaacaaagttaagaaattatcccaagaaaaatgtgaataa

SEQ ID NO: 3714 - DNA, 2232 bp, Candida albicans
  unsure (45): Identity of nucleotide sequences at the above locations are unknown.
atcccgtcccaacaattaattcggatcctgctgccggtgatgaanacattaagggcgactagagatgcattattgacaaaggggaaatcatatgttttattcaaagtgccacatccaaatggcccatcactgagatgtactcatattttatcaaaactatacgtgagaaattttgaagatggcacactcacttcagaatatgattatgcaacaaagattttaaatttaaataatgaggcatcatattggttaggaaatcgtaaccgaatcaaagatcaatttgttgtttataaccaacaggggaaaaataaattttttgacacaataaagaaaagtaaagaacattcatctatggggataatcattcctaatttagccactatggggacaattactcgacgtgccacagaaaacacttggcttaccgcatccaatgccaaaaagaatcgaattggatcggaattaaaatcattggtcgaagcacctaaaggttattgttttgttggtgctgatgttgattctgaagaattatggattgcatcattagttggtgattcaatgctacaaattcatggaggtaccgctttagggtggatgacattagaaggagaaaaatctcaaaaaactgatttacattccaaaacggctagtatattggggatttctcgtaatgatgctaaagttttcaattatggaagaatctatggagctggagtcaaatttgctacgagattattaaaacaattcaatgctaatataactgatgaagaagcagataaagttgctcgacaattatatgatagtactaaaggtcgtactgcagtatccaaatatttaccactgagaatatattatggaggcacagaatcaatcatgtttaatgcattagaagccattgcacaacaagaagaaccgaaaactcctgtgttaggtgctagtattactgatgctttgaatgttaaaaatttaaataccaaccagtatatgacatcacgagttaattggactattcaaagttctggagttgattatttgcatttattaattatttctatggaatatttaattgagaaatatggaattgatgcaaggttggccattacagttcatgatgaattacgatatttggttaaagaaaccgataaatacaaggcagcactattattacaaattagtaatatatggactagagccatgttttgtgaacaattaggtattaaagaagtaccacaatcttgtgcctttttcagtgaagttgatattgatcatgtattgagaaaagaagtttctatggattgtgtcacaccatctaatcctacaccaataccattgggtgaatcattgaatattggccaattattactgaaatgtcaacatggagatatattagctgataagaatactaaaccattgacattaagaaccacgaaatatagtcctcgacaaccgattattaatcaattagataagaatttgactattgcggagaaaattgctaaaattgaactacaaacatcaattgataaagatgaatggaaaaaaaatttatacaatttagccaaagtttcacgtaataaacaaaatgggaaaaataattcaaccgagaagcctcaacgagtaataaaaagaaaacctattgttgaatatgatttacaagaagataataacaagaaaagagaaataaagtataagaaagatccaccaaagtcaaaaattgcaactaccaccaccaccaccacaaaaaaaaaggcaagctctaacaattcgaaaactaaatccaatgtaaaagttgacgagtccaaaagtgcaatgactattttggatttgaaaactgatcaacaacgccctacttataacaatcgaaaaatagtttatcggaaaacctcaagcaaattgaattcaattagaaagtctactagtggatccacaacaacaacaatagcaacaccaccatcaccaccaattacaaccagtaacaatcgtcaaccgagttttttacaacaacaacgtcatttcaaaactagtacaagattagaatcgttggtcaataaagattattcatcacgaccgagaaattattatcttatatcagaacagaaattaatggtttctactgatttatctaatatgatgatggaaagcattgaatcaaagcgacgacgacgacgacaacgacaacaacaacgacaacaacaatcaaaaataggtgatgaagataatttttatgattga

SEQ ID NO: 3715 - DNA, 1155 bp, Candida albicans
attcatagaagacaaatgtatcatattcatcgactattagctcctatacgatcaaatagtgtgtttttttctttggcacaactaccgaaaccatcactaataggatgtcgttataaatcaaacaatgtcggaagtcaagacagcaaaagaactctgaaaaactcgatccttcacaatttgggctcatattccaacagtgctgaatctgaaattttaaacaagcttaaaccgataacacctaatgacttgtatgtttcatgcacgagttttgaccgaataggtaatatcacagccgtatccagaaagtaccctaaaatgcaatttcttaaggaaaaccatttgtttcctagagatttgaggaaaatagatacttcgtctattgatgttgtcccggtgattatgattcgaccttcaagtgcaatattagtcaatcttttacatatcaaggcaattataaaaaaagacaatgtgatggtgtttgatacatccaagagcgaagtagcaacaaagttgggaattttcatgtatgatttggaattgaaattaaaatctccagctaataatgtttgttatgaatttagggcattagaatcaatattggttagtgttactagttatttagaagctgaaatcaaattacatcgacagcaatgtgggattattttagcagaattggaagatgaagttgacagagcaaaacttcaagaattattaatccgtctgaaaaaattactgagttttcaccaacgagcaattttaattcgtgatgtattggaagaattgttagaaaatgacgaagatttggcaggaatgtatttgactgacctcaaaagattcgagcctgaagaagagaattatgaagaaattgaactgattttagaaagttattacaaccaatgtgacgaatatgttcaacaagcgggaagtttattgagtgatatcaaagcaacagaagaaattgtaaatattatcctcgacgccaatagaaactcgttaatgttgtttgaactaaaaataacagtttatactttgggattcactgttgctacattagtgccagcattctatggaatgaatcttaagaattatattgaggaaacaaattggggatttggtttggtcttagtggtatcattattgcgtatcccagccacg

SEQ ID NO: 3716 - DNA, 1482 bp, Candida albicans
caaaaaaaaacaacgaaagagaaagtaaaggaaaagtatatcgaactttgcccctcttctgattattaccattttggaaagaaaaaaaaaggaataaaaaaaaacaacttaaatatggctactccggaaactgtacctattgcagatgaaatcatgagtgatttcgaagatgtaagttcaccaaattccccgtcattatctttagaacaatctactcgtggatctactccgcctacatcgacgtcatctccaccttctactcagaataacgattcaaagtccaaagagagtcttgagacagatgatgtacaagatacggttgacaataagaaacttctggacgatgttaatgaatctcaagaatctaccgattcaaaagacaatcaagatggagaagaaaccagaaaagaatctactgatgcaaaagatatcaaaagcaatggtactaagaaaaatcaagattctaaagacactaaggaatcaaagaaaatcaaaaaatcaaaaccaatttctcgagcaccaattgctaccggtatttctactgaaattgaagtcacgggagaaaaaccaaaaccaattcaagaaggtgatccatctttagaagatgatgttttatatgccatttttgttattctttatgaagaagatctgacggaaaaaggaatgaccgtaaaacatattactgatgttttagatgaaaaatatcctcaattcacgaaaaatactggtaaagtgtcaaatttagtttctgccaaaatcaattcatatattaaacgtttagaagctggtcaaactagtctacgttatgcaatttcaagagattggggcaccaatactcccaaaagaatgttgtatagatatcgtgggattctagctcctggttgggaagtcaaattgaaagagttgcagaagcaacaagagagtaaacaacaacaacaacaacaggaacaacaaagtgaagaacaacaaaatgagcaacatagtgatgattctcaggagttaaatctggaacaaattgaacaacaacaacaaaatgaatcaaaggaaaaatcaagatcaccaggttctgaatctcctaaatcacgtaagaaagtttctcgagctcaatcagtatcaacaaatttcaaagatcattttgccgaacttgataaacaacaagatcaattttcgctgccactgccaacaacagcaacttcaacttcaacttcaacttctaaaacagccacaaagagaagagctaccatgtttgatttaggacgtccaacatttttaaccaatggcgaattttgtgatcaaccaccaccatatttaactaggaaaccagcgaaaattgaagacgtgcttgatgaagatgtgttagaagatgatgaagaatcactaacaacattatcacaaaaagatgatggttgtaataatatcctcaggattaagaagagaagattgactggggcttccattagagaaactggtgatgatgattaa

SEQ ID NO: 3717 - DNA, 183 bp, Candida albicans
cgcggatttcgacccgtggtgaagacagcttttggatttggtaaattcaagtttgtgcctcctgatcaagtggttgaacctatctctcttgaacaagaagaattaattaaacaaaaaacaaaagaagaatttgccaaaatgacattaccacctcaacaaagtgttttatctatggatgaatag

SEQ ID NO: 3718 - DNA, 1008 bp, Candida albicans
ccttttttatttatcttgtttcatcagatgttgagagctacaagtaaattaacatacccgtcggtgaggtttttgtctcaaacaagcaaagtgacatttcaacaaagacagtcattcttggacaaatacagaacagatcaagaatcaattgaagcaccaacaaaattagcatctgaatccacattaccagttatcgaacaagatttaaaaatcaaaccacgtcaacctaaaactaaagcaccttttttatcagaagatgaagataaaaaaattgaattacctagttggaaagagaaaatcggacaatttgtcgtttctacatttggagtcgatatggataaatctagaagtggtccagtagctggtggtatatatttttctgaatgcaaaagacaagcattagtttatcctaatgaacctatgagtgataccgccaaattttattatgaaactttgagattacctaaatctttttcacaacaagtacaaataactatattacactattggattttatcagtaagaatgagagcattaccgtttaaatatagtaaagaatatcaacaaaaattagtcgatagaatattcaatgatttggattacagaatgagtactgaattaggtatcaaatccaacagaactatagaaggatatttaaaagattatcatactcaattattaggttgtgttttaagttatgatgaaggattaatgaccgatgatatcactttagcttcagctttatggagaaatgtgtttaatgccaatgagaatgttgacatgagacacgtggaggctttgcttgtttatgttagatcacaattgtatgtgttgaataagatgaccgacagagcttttggatttggtaaattcaagtttgtgcctcctgatcaagtggttgaacctatctctcttgaacaagaagaattaattaaacaaaaaacaaaagaagaatttgccaaaatgacattaccatctcaacaaagtgttttatctatggatgaatag

SEQ ID NO: 3719 - DNA, 639 bp, Candida albicans
aaaacaacatcaaatccaactactagatctagatcaatcatgtcgtgggtgacgagaactttcaggtttgaaagaaatgttaataaataccctgaaaacttgagaaagcattttcaaaagaataaagaaatcaccaatttaccatcattcaagaacttttttccaaccactctaccacgatcacaacagaaaactaatgttgaagcagggataatggaaggtgatttggcctatgtcacgactggttcacataaaggcaaaattgccgaagtattgtcatactctccagaatacgatgcagtgtccttgagtaacatttcctcaaagaaacttattccaaagattttttggccagaaggtcaaacatcacatgtatttgacttccccgattacattccaagaaaccaagttagagtagtaggaaaagataaagatgaaaatgggaatgtatcgtatgtcgtcgctgaagatatcgaattgagggataaatattatgatgacagattcaaaaattcatgcctatacggtgtgttaagtttcccgaaaaacatgaaatttcatggggcaaaacctcagggcttaaaaatatggtccattgttccacaccagaaaaattttgcaatggaaaacaaattttga

SEQ ID NO: 3720 - DNA, 336 bp, Candida albicans
  unsure (25): Identity of nucleotide sequences at the above locations are unknown.
ttcccccggacattgtcccttccancgccgtgtgtgaaaactggcgttaccgactgggtcttcccgttcgactctgctattgccaatggctggttgacttatttggcgtatgttttctggcaacaacaagagaagaattacaaaaatggagctaaaccaactagtgaagggttagctttggctggggtgcacgccaaaaagttattctggtgttctgtttggcatttgccagcagttttgatattggcaatgttgcataagaaagatcaatggaatagattatttgagcatattggcttgaaaactagaaagatcgagggtcgattggaagtctaa

SEQ ID NO: 3721 - DNA, 1167 bp, Candida albicans
actgaacacaggtacattattatgtcacatagagttgtaacagttccacggttacactctgtgaacaactttaactattttttccacaacaccaagaggaacttagttatagaccaaaattttatcaacaaccaatacttacttcgtaaagtgttgttaccaagtcttagtggaagagttcgacacttgacttcacatacatcgcgaatttctgataatacaagtattggtggtttactgtcatctctgtcagttattgagaatgttgcatccaaagtgttgacatgtcaagagcccgaggctcagctgtctcaaaaaacggggattgaccccagtgataacactactaataaacatattccatttaaaataactccgaaggattcacaagctttaaaaactcaaccggtgactctttttccaaaatccaaagcacaattaaagaacacttgtaccgcatatttaaagttaacgaaaccaaacctaacggtgctagttacactaagctcaatatgttcatacgctatatctcccttgtcagtctcgttacaagaattgatgtttttgactgtgggtacggcattatgttctggagcagcaaatgctataaatatgggtcgagagccagaattcgataagcaaatgccgagaacagtgggacgaccagtcgtacgagggttgattactcctacacaagcgtatcagtttgctgctgtcagtggacctattggttgtgggatgttgtggtttggtgtgaacccaacggtgtcgttgttgggattttccaacatagtgttgtatgcatggctatacacatccatgaaaagaaaatcaatcattaatacatgggtgggtgcagttgtgggagctataccaccgttgatggggtgggcagcctcatcttctttggcacatcctgcaatctggtgtttggcacgacttttgtacgcgtggcaattccctcatttcaatgctttgtctcatggaattgcccaacattataagctggctggatatgttatgacggcagcagaaaatcctagactaaatgcaatattggcgtttcgatattctgtgctcatgtgcccgttatgttttgggtcaagttactttggcgttaccgattgggttctcccgttcgatcctgctttggccatgggtggttga

SEQ ID NO: 3722 - DNA, 825 bp, Candida albicans
actatgaatagattaaggatatacacaccgatttttaggtctacaatagttaagccggctgttttcagaccatatgcttttattgtatcgagaggcatacacaccacaggcaaattatttcagatgcaacatcaacaacagccatctgttccagaccaatcatctattgaaaagcaaagggaatgggtagatagacttgcaagagaaagagaagaacgtcaaaagtatagaaatagaacagcaacgtattatactgcatcattagggattttctttttggcattagcattttctgcggtgccaatttatcgagccatctgtcaacgtactgggtggggtggaataccaattactgatagtacaaaattcactcctgataagttgatccctgtcgataccaacaaacgtatccgtatacagtttacttgtcagtcatcgggaatattaccatggaaatttacccctttacaacgtgaggtttatgttgtacctggtgaaactgctttagcattctatcgagccaagaatatgagtaaagaagacattatcggtatggcaacgtattctatttcaccagataatgtcgctggatatttcaataagattcaatgtttttgctttgaagaacaacgattgagtgctggggaagaagtagatatgcctgtgttcttctttattgatcctgattttgctaaagatccagcaatgagaaatattgatgatgtggttttgcattattcgtgcttcaaagcccattattccgatggtgagttggcagcggcacctattgggaatatggaaatgaaagccagtgtggttagttaa

SEQ ID NO: 3723 - DNA, 1683 bp, Candida albicans
ggtaaagagcaacaatgggaattggttgttgaaaattttcaaatactaaactcatctaatttagatgctgctcaattggacaagttaaaacataacaatcctcaggatatcccacctcaatttagatatttgcaattaagaacaccatattatcaaaagtctcttagattaaggagtgaagcagcaagacttattcgagatattttcattaaaaaccacgaatttgttgaaattgaaaccccgttattattcaagtcgactccagagggggcacgtgaattcttggtgccaacaagatcttttaataaattttatgcattaccacaatcacctcaacagtataagcaaattttgatgagttctggtttcactcggtatttccaagtagctaaatgctttagagatgaggatttgcgatctgatagacaaccggaatttactcaaattgatttggaaatgagttttgtgaataattctgatcaagttgggattgttgtagaagatgtgatccataatgtttggaataaagttggtggtaaactcacgtataaagtgaacgatgaaggttttttggtagaagctgatcttgctgaggttggagaatctttacaatttagtaaattaaactatattgacgttttagttaaatatggaattgataaacctgatttaagatcaaacttgtcattcatcagtcttgaagatttttttattgctaaagaaaatgctgatttcccagttgtggaagtctgtgttttgaaaggagcattcgatgcttcttccggtaaatataaattacctaaaagttttattaatgatcataacttttcatctagaagaccttatgtatgggcaattcaaagaaatgacgacacattcggttatttcaaaaaattaattgatgcaaatataatagccactaccaacacatttgatgaaagcaaattgcaggagttgttaaatttacaaccaggtgatattcttgccgtgtctacaagagcaaaattcccatatgaaaatccaacaccattaggaaaattcagacaattggcgatagaagaattcccacataaatggcagcgtcctattgtcatggaaaatggccaattaagtgttgattatgatcgtaatgatatagtggttgggtcatgggttgttaatttcccattatttaacccagtggaggaatctgggcagacttctcatgttacggaagaaagctctaaacctaaatatccagtttataactttaaaaaatttgaatccacacatcatccattcactatggcaaagattgaagattatgatttgttggagtctgatcctttgaaagtacgtggtgaacattacgatttggtcataaatggagttgaagttggtggtggttcaagaagaatacatgatcctgcattgcagcaatacatttttgaagagattttacaaatttcaaatttccaacaattgttcggccatttattgaaagcattgagtatgggttgtcctccacatgctggtttggcattaggatttgatagattgtgtgctatgttgatgggatccactagtattagagatgtaatagcatttccaaagaaccaatcaggagttgatccagtagtagagagtcctacaggagtgaaagaggcaacgctcaatgaatattttataactacaaaaaactag

SEQ ID NO: 3724 - DNA, 255 bp, Candida albicans
ttgtttaaaagaaataagccttcacctgatgaagaaatcaaattgagtgcattattagctgatattgttggtaaatcaaagggtgaaatgagaagattgattaaagctggtggtgtatacatgggattggacagaaatcaaattgaggatccagatgatgttatattatttgatgttgataatcatttgattgatggtaaattgttgttggttagagttggtaaacagaattattacgttgttgagtttgtataa

SEQ ID NO: 3725 - DNA, 537 bp, Candida albicans
aagaaaaaattcaatcgaagaaacgacaaccagaagttcaaccagacatcaagtaatatgttgaaaacacataccagaaacatacctttgattagaaggcttgctagatttaattcaacaattgcaagagatccagtcactatcattcctaccatctatgaattgactgaagccaaagatttaacaccagaaaccaatcccgacaattcattattagaatatttacaaagtcgacatttaattgaatcaataaccgatgataatttatataaattgactaaacgtggttctaatcacaaattcaaattatattgtggtgctgatcctacggcatcatcactacatttaggtaatttattaccattaatggtgttattacatttcaaaatgagtggtaatgatgttgttggacttgttggaggtgctactggacttgttggagatccaagtgggaggaaaacagagcgtaacaagattgatgaagttgaagttgaagataatgtcttcaccacgaggagccggctccgcgtatggatc

SEQ ID NO: 3726 - DNA, 1164 bp, Candida albicans
cagatatttattttggaaggaagtgatcaacatagaagctggtttcaatcctctttgttgaacaaaatcatttattcaggctctaacgggacatcgtttcagccaatggcgccattcaagaaagtgatcacgcatggatttattactgatgcaaaaggccagaaaatgtcaaaatccttgggtaatgtattttcaccacgagaagcaattgaaggatgtaaaaaacctttaacgccatatcttggtacagatggtttaagattatgggttgcttcttcgaattacaagcaagacgtcagttttagtcctgaagttcttacacgggtatctgaagttgctaaaaagtacagggttacttttaagtacttattgggtaatttacatgacttcaaggaccctgttaattatgaccaaatgagtgcattggacaaatatattttgcatacattatttcagttgcagcaagcctgtcttgaattttatcaggattttaacttttcacgagtggtaagctcaataaacacacatgtcaactcaatttctagtgctatttattttgatgtttccaaagactgtttatatacagattcagccaactcagttagaagaagatcgatccaaactgtgcttaatgaaatgatgaagacatatttagggttattggcacctattcagccccttttgactcaagaagcgtggtcagagtatattagaatagctagtttaaaggaggattccgtgttcaaggtagatagcaaatttttcattttaagtgagaagtacgagaatgaaaccgtggaaaagtcttttaatgagtttttagaattgagagatgatatatttagaactgtcgagagtttaaagcaacagaaattcttcaaaaacaaattggaactagagatattattatctgtcaaagaaaacacaaatatattccgctttttgaaggaaaattcatcatacctcgatgacttgtttttggtttccagtgtgaaattagttgacggtgatttggattatacattcagagtgaatgatgaacctgttctgataagaattcaacactcctcgaaatgcaagtgtcctacatgttggaaatacacttcagagtctccagacattttatgtgagaaatgtgacagcgttgtagaatcgttcaactag

SEQ ID NO: 3727 - DNA, 1821 bp, Candida albicans
aatagacgttttcttcaacaacatataagtttatacatgctacgattcaaatctaaggtgagaacatttgctacatcattggttgagcttgagaagaaaaatttttctaaaacactcttacttcccaaaacaaattttggtccaaaaatccccaaaggagatatacgagaagtattgatcaaacaactgtctcaagatatctacaaatggcagaaagaaaacaaggcaaatagacgtgagtttgtattacacgatggtccaccgtatgctaatggtgatttgcatttgggacatgccttgaacaaaatcaccaaggatattatcaatcgttttgagttggttttccatgatcgattaatcaaatattcaccaggttgggactgtcatggattgcccattgaaatgaaagtggagacattgggtaaaaaatatgaatcggctgttgaaatcagaaaggcatgcagagattgggctaacgcaatgatagataaacaaaggcaactgttcaaagaatatgccattatgacggatttcgacaaaccttacattaccatgaatcatgcctatgaaataaatcagctaaaaatattttctaagcttatagagaatggtttgttatcacaacaactcaagcctgtttggtggggatgtgatacacaaaccgctttagcagaagctgaattggagtacaatgacaaacacaaatcagttgcagtacatgtcaaatttcccgttgtaagcgagaatctttataaatattccgaactgaagggtcatgctgttgagtttgggaaactaaaactcttgatttggacttccactccatggaccattccattgaatagagcaatttgtgtgaacgaaaatatgacgtatacgttaatacagaacgtgactgagactttggttgtagctaaaagtttagcagagcaagtattgaagatcgacccgagctacaaaattgtgaatattgatattccaggttctgtcttaacgggcactttttacactaatcctgcttctgatgattcaaaggaatacccagttttgcatggagatcatgtgattgaaactgcaggtacgggcttggtccataatgctccagcacatggtcgagaagattatattgttggtaggaaacatgggttgagtgtggaatcagcagttgacaataatggtaaatacattgccaaattcttaccaccaggctttcaaaaattgggagatgcaaaggtgacagatgttaagaccaacgtaatttgtgctaatatattgaatgaaagtggcatgcttttccatcttgacaagaaatttgttcattcttatccctacgactggagatccaagacaccagtaattcaacgtgcaacccctcaatggtttgtaaatgtcgaaaaaatcaaaccgtatgccaaagaagcactttcgaaggttgaattttacccacaatcaggtagcaatagattgacactgtttgttgagaatagaagcgaatggtgcatttctagacaaagagtctggggtgtgccacttccaattgtttatgagcgagccacaggagatgctgttctagacttgaaattaattaattatattattgaaaaaattgatgagtttggaactgacgagtggtttgttgaagaaactgacatttctaggtggcttcctgatgagatggatggcctgaaatactttaagggaaaagatactatggatgtatggtttgattcgggaacttcttggagcactttaaagtcgtcactccaagaatgtgccaccactaacgaaccattagcagatatttattttggaaggaagtga

SEQ ID NO: 3728 - DNA, 2166 bp, Candida albicans
  unsure (332): Identity of nucleotide sequences at the above locations are unknown.
ataatgttgttgtgtcaaaagccaacatatagactactaagatatagtgttaagagatatgtggcaagtctatatagtctacgtggtgtttcaacaagagtaaacttgatccatcgtacttatgcaactacagtagcaaaagataatatcgatcataatgatctgtcacctgtttttaacaataatgaggtacgatttgaaaatattaatgccctgatacatccaatacttttagatttgaagaataaactaattaaaggtaaatttgattcaccttacaccattctcaatgatcaaccatcagatgtgaaaactgaaatattccagtcatntgaacaacaactttcaaaagcattactgtcgaaatctacacctgagaacaaaataactttagtagattatttaaatcatacccttgacaatatatccctgttattgcatttaatttccaataatacataccctaataattttcttgaattcagtaacttatcatcgaataatgatttgattatgcaattattcactcaactactacacaagatatttctccaatatagaatagaaaatgcctcatttgaaaaacctaaagttgatttttctaaccctgctgaatggttccctgaagccagaaaaatgaaacggaaaataatcatgcatgtgggtccaaccaatagtggtaaaacatataattcattaataaaattatctaaaagtaaaaccggttattatgctggtcctttaagattacttgctcgtgaaatttatgaaaaattcaattcgcaggggattggatgtaatttaatcactggagaagaagttgttccttcaattgataaatatgggaaagtgagtggtattgcctcaggaacaattgaaatgatcccattacataagaaaatggatctttgtgttatagatgaaattcaaatgattgctgatccattaagaggatcagtatggaccaatgctgttttgggtgttttagctcatgaaattcatctttgtggagaagaaagtgccgttccatttatacaaaaaatggtggaaatcactggtgatgaattggaaattaaaaaatttaatcgattaggaaaattgacagtggaaaaactgaatactagtttacaacaattgaaaaaaggtgattgtttagtggttttctctaagaagaaaatattgaaatttaaatgtgacattgaacggaatactagattgaaagttggggtcatatatggagcattaccaccagaaattagatcacaagaagcatctcaatttaataatggagaatatgatgttttggtagcctctgatgctataggtatggggttaaatttgaaaataaatcgtattgttttcagtggagtcaataaattcaatggttctactgtagaaaaattatctgtcctgcaagttaaacaaattgctggtcgagccggaagatttagtgcacaacatggactgaaagaagggtttgttacagccttacatagatcaagtttggtttatattgatcaatgtttgaaaacaccagtttcagaaatatcaaaagcttgtatttggcccacaagtaatatttggagacaatatatggccaatgatcctcgcaaaagttcattatcatctgtctatgaaaatttcctaaccaatgtgttgaaatttcaaagtgataattttttcatttctgaattagaccaaaaagttcaacttttgaatttagttgcgaaaaaccgattattgtcaaccatgataatagatgatcaattaactataagtgaaactcctattaattttagaacttcagttaatcccaaattgctcaaaaatactgttataaagttctatgagactattgtcaaacgtgattgcaaatcgatattggattttgactttttagatttagaattgttatcacagaattcatttgttggtacagatgttatggtaccattacaaaaagttgacaaactcgaagatatgcataggttagtattattatttctttggttaagtcaaagattcccaactttattcattgataaagatagtgcaatggaagtcaaagctttagttgaaaaaagaattaatcaagaattagttaatgtggaaagagcaaatagttttttcctggatcgatcaaatgggtatgaacctagaagataa

SEQ ID NO: 3729 - DNA, 630 bp, Candida albicans
ttaaattttttagtagcaggttatttatacttcgatgttgcaaaacataaaacaaattcaggtcgtgcaaaatggtacgatttgtatgctttttttttcaccatcaatatggacttgttaaattttttttttcggtttcatcacctactattctatcaaatcaatactatcatagcattatttactcaccacaaccaaatgtcatctccaataatgtcagttgccgaaaagacggcttataaacgtaatatggttaaaataagattggcacgttttggaagaaaacaccaaccaatatataacattgttgtgatgaaggctaagaaagctcaacaaaaattaccaatggaagtcattggtacatataatcctattccagttcctttatcaggtaatgactcgggtttgaaaataaaggatgtgtcgttggatttacacagaacaaaatattggttaggtatgggtgcagttcctactcctcgtgttacatggttacttaagaaagttgggttattaccacaattctggccaaagacgagtgcattaagtcaacatattgataaacctgtggttgaagaaatcagagaaactcaagaacttccagtggactatgtgagaaagagagattag

SEQ ID NO: 3730 - DNA, 1302 bp, Candida albicans
  unsure (609),(611): Identity of nucleotide sequences at the above locations are unknown.
caaccaagccgaaaaactgctcttttttcttttttagcttgttttaccaacaatactaaattcatatcacgaccaatgaattctttgagcaagatagcacccatatccaggggtattatatacagtcaaagcagtataagaagcttgtctacccaaatattacgatcaacaaaccaacattatctcagatcaagacaaggttcaaatcccgtggcaaattctagaagatttgcatcacactcaacgataaacttgttacaacaacaagaacagatagcaaacaatgaattaaataaccctcaagcacagttagaattctacaaaacattattggcttataattatccacacattttggttcagaggtttgaaacccaaggtatagcctcatccccagaatgtgtacagttgtacatcgatgcattgaataaagttggacaaactgccaaagcagccgaagtagctagacaacaacaacaacaccagacacaatatcaaaccaacggggggaatataggtgttggattaccatatgggtttggttcgagacaagaaccagttcatgttgttgttagtgaatcattgttgacgattttatcaaaatggctnanatggttgatccctattgccttgttaacctatggggccactaatgcatttaattatttggtggaaaatggaactattttcagaaatagtgaaactagtgataaatcagttgatgtttcgcaaagtacagttagatttaaagatgtccaaggttgtgatgaagcaagagccgaattagaagaaattgttgattttttgaaagacccttccaagttcactggattaggaggtaaattaccaaaaggagttttattaactggtcctccaggtacaggtaagacattgttggccagagctactgctggtgaagcaggagtaccattttttttcatgtcaggatctgagtttgatgaattatatgtcggagttggtgctaagagaattagagaattgttcagtcaagcacgtgacaaggcaccagctatcatatttattgatgaattggatgccattgggggtaaaagaaatcctaaagatcaagcatatgctaagcaaacattgaatcaattgttagttgaattggatggattcagtcaaactgagggtattattattattggtgcaactaacttcccagaatctttggataaggcattaaccagaccagggagatttgataaggaagttattgttgatttacctgatgttagaggtagaatagatattttattcttcaccagccggctcgaagga

SEQ ID NO: 3731 - DNA, 909 bp, Candida albicans
agaggtagaatagatattttaacacaccatatgcagtatgttgatacagccgatgatgttgatccttccattatagctagaggtacccgtggattgtctggtgctgaattaatgaacttggtaaatcaagctgcagtgcatgcatcacaactatctgcaccagctgttgacatgaatcattttgaatgggccaaggacaagattttgatgggtgcagctaagaaaaagatggtcataactgaagagagcagaatcaatactgcataccatgaagctggtcatgcaattatggccatgttttctaagggtgccacaccattgtataaggctacaatcttacttagaggacgtgcattgggcattactttccaattgccagaaatggataaagtggacatgagtaaacaggaatgttttgctagattggatgtttgtatgggaggtaaaattgctgaagaaatgatcaatggcaaggaaaacgttacatctggatgtgcctctgatttgtcgaatgcaacaagtgttgccagagccatggttacatcgtatggtatgagtgataaaattggacctgttagattaagtgatgactgggaaagttggtcaccacaaattagaaatatgtccgataatgaagttagagattatttgttggatagtgaaaaaagaactagaaaattgttatatgataaaagactagaattgaaacgattggcagaaggtttgttggagtatgagactttgactaaagaggaaatggagaaggttgttaaaggtgaacccataaacaaggctaaaacaatgagtaatactgtgatcaagaagtcaagtaaatctagtgagataaaagatatactcaatgacccaatgccaacagcgttatctaaccaggcggctggaagatccagc

SEQ ID NO: 3732 - DNA, 606 bp, Candida albicans
acactgaggatccttcctggcggtctttgtgaaaaactcaaccatcgttcgaataaaccattaaaagaaatcgatactgatgaatcagttgaacaagaaccaccaaaaaaacaacaacccaaggtagttgatgtacttgaaaataaagaaaaattcactgaaataccatttatgcccaaaatggctaatgaaacattgaaagctcaattaggcaatgcatcatggaaattattccataccatattagcaagatatcctgatgaaccaagtgatcaagaacgtaacactttggaaaattatattcatttatttgctcaagtttatccatgtggagattgtgctagacatttcactaaattattagctaaacatcctccacaaactaaaaatcggaaaactgcggcattatggggatgttatgttcataatattgttaatgaaaaattaaataaaccagaatatgattgtacaacaattttagaagattatgattgtggatgtggtgatgatgaaaaagaaaaagattatactttgaaaggagaatcaatggatcatttgagacaaatcaaaattgattccaaaaaagataaacaaagaggtggataa

SEQ ID NO: 3733 - DNA, 357 bp, Candida albicans
cccataatcaccaagaattccaaccaaaagatgttgaaattgccctatagacctgttttctgcacattgaagcagtttcggttgtattctagtactcccgtgaaagatatagtggcaaatgggaagacatataaaggtgacaattggacaaatgttcctccatatattcttgagttaacaaaacggaagctttacaaaaaccctaatcaccctattggaattcttcacgatttaataaagacgagtgtaaatggtatgggatatactgtgtatgaagacttcccacctatagttaccaaatacgaaacttttgattcttcactacgaagctgccgaatcgccgcttatgtgtggaat

SEQ ID NO: 3734 - DNA, 918 bp, Candida albicans
atttttccagatttttttggaaaagatgagattgatcgaacccattatcctgcgttccatcaattagagggtgctagggtgtgggatagaaatgatcctaaccttttggagaacatacgcaaagacattgacgagatcccaaagacagatataattgtggaagatgaatttagagaaaacccagtcaccgaaaacaatccaaatcaaaaacatttgaaagaagaagaagttagacttgttgctgaacatttgaagaaaactgttgagtttattgtttatcaagtttttgaaaaggcaagacagtctgcaaaagaacaaggattgactatggcgtaccttgacgaacctttgaaagtacgatgggttgaggcttattttccatggacttcgccctcttgggaaattgaggtttggtggaagaatgaatggttggaatgttgtggatgtggaattgtacagcaacaagtgttattgaattctgggattggcgaaaacaaaataagttgggcatttggaattgggttagatagaatcgccatgttattattcaacattcctgatatcagattgttctggactttagatgaaagatttcataatcagttcagacaaggacaaatcaatacatttgttccatatctgaagtatccaggcattaaacgagatgtgtcattttggttggatagggatttacatgctaatgaagtcatggaaattgtgaggctgcacgctggtgatttagctgagagtgtaagtttggtcgatgaatttgttcatccaaggactcaaagaaaatcactgtgctttagaataaattaccagtcaatggatagaaacttgactaatttagagataaatgaaattcatgataaagttgaaaatgaattggtggagcaatttaatgttgaaattagatag

SEQ ID NO: 3735 - DNA, 528 bp, Candida albicans
gatctgctagccggctcgctagatagaggagcaatggcaataaatggcattgataaattgttgaaatcacaacaattattatttgctatggtgtcaataagtccgtcaattttaatattgtaccaaatgtacagacttttaaccaatagtggcaaaggaaatggcagcggtgctgcctcgataatgatcaatggtaagcaattgaatattgtatgtttaaaatgtttaaataatattgagaatttattgatattgttgcaattacaagagaagaaacctcaacagaaagaacaaaacagtagatctacggaaaacgttagtaataagcatcatcaagagttttatgaaggggaattattaattgaaataatcaatttgtttgttttctcaagttatttaatacccattgatttgaaagatgattggatcgatgatttaaatgaattgaataataagcaatttgatgtcactaccaagcttgacttaattcgtaagatatggaatatgtatggtgcttattttagatga

SEQ ID NO: 3736 - DNA, 1605 bp, Candida albicans
catttttatttattatttcggtttggtactataagcaaggaagatatcgaagaagaagggacaatggatttaatatcattaggattgacacctcgtaaatcgaaaaagatattgcaaataatcaataataatagggtttcacgagatattgaactggaattcaatcagcttaactcatatacaaaagcatttttagtcaaccaattgtcaattgattcatcacaacaggaagaacaagactatgaagggcatcaattaaacggtgaagttaacgataatgttttacaagttttccaagaattgtattttttattagatgttgaaaatttcaaattcaatcatgtttacacagacattgatttgaataaattgaaattgatttatatgaaactcactagtattggtggtgatggatcgttgaatgacaatacgaaaacagttttagaaattatagagaagtatataatattgataacgacattgagtttaaccaattccctaatctataaaactttgattttgaaaaaccaacaggtttattggcaagcattgaataattcatccacaattaataaattaatatactttatgcaaacatcacccataaagttgtataattttggttgtgacacttttgcaaaaaccagaagaatgctattccataacagtaatgatgatgggagcaaggtctatcaattgtccagtcaatcaggagggaaagaagaagataatattttttctcgttatttattagtcatcaagaatgtttgtaaacttgcatttaatgggttgataacttttgtacgtcaacaatcactgccatcaattggttttatatttttgtccaatgatagaagtgggaagaagcacaaaaaaaagcaaagaacattatcgatcaaatggtatttgcattcaattaaacctgtgatcaaattcccaatcaacttggttgtcaaggaagcaaagtctaaattacgcaaaattgatcatgaaattgcccttaatgttgaaaatattgataaattaatcaaaactaatccaaaagattacttggaaacgttgagcgtaattttacaattagactcaactcaggaccacccaacatcacaggaccttaatacagtttatcagaaaaagaagaatatgatattacaagcaatggaacatgttgttaaatttgataaacaatcctatgatttaacctctgctccagggttcttgacaagatattggataattattgcattggttattttttatggaccttcgcaaaccaaaaaagtttatgctaatcgtcaggaaatcatttattgggttaagtataatggtattgaaccagttgttgggtttttcaaaaactgggtgattaaaccagtgtacgacatgttggatattttgagaaatactagtagtgatagtcaattatccatcactagtaaagattcattgaattctgaatttgattcgttaaactcaatgatttatcaatttgctcaagataatcatatcgatgttagtgaatcacaaattactgatgatattaaaaatggtgatttgaaaattataatgtcgacttatgaaaaacgaaatcaaatcaccccataa

SEQ ID NO: 3737 - DNA, 387 bp, Candida albicans
aaaaaaatccaatcatatccctaccatctatccataacaatgccattcagattcccagtcaagtttgaaatacctaagcatgctcacttgaatgccagagtacttagagatcaattcaaaagattacaagttgcagaacacgaagttactagaaacgctttaaaatacattgctagaaatgaagagttaccagccagagcaagagttgaagcccagctacagttagcatccatgccaaagtatacttctgccatacagatcaaggatagatgtgttgccagtggaaatgccaaatcagttatccgtgactttaaattgaatagaactgagtttagaaatagagctcgagctggattgattcctggtgtcaaggtcgcttcttggtag

SEQ ID NO: 3738 - DNA, 1242 bp, Candida albicans
tatccacacccaaattggatagaggattggctaaaaaaaaaaggtagtaaaaaaaatttggtgaaaaataaaacaccatctaaaaaacgtcagatattccaataccatctacacaaagtcatgatacgccagtttcttcggaacgctagctcaaatgcaacgaaagcgactatttccactacatcttctttatctacatcaacaaacaacaactacgtaaatactcccgaacaacaacgacaagaacagcgaccagaattattaactatcctaccgtccaagagaattcttaatcgaatattatttgatattgattcacaattgacatataaacaaatgatcccaatattgaatcatatatacaaaaatttatcaaccccagaatctatcaatttaaatcaattgaaaatccaatcatcatatgacttgatgaaatttaaaaaattattacaagagattagaaaggtgaccaattcaatagatgttcatttattagatttagaaaatgaattaattgaacaactggcagaattgggtaataatgatgctataactattcttgcctttgaaaccgtaagaaaacgacaaatattgaaagaaatagttgatgaagaagattatcaacatgcaaatgaattaattaaacaattaattgatattaatcatcctttggtatttaaaatggctggtgatttatcatgggaattaaatcaacctaatcaagcaattgaatattggcaaacctatattcaacttgccagtaacaaaaattctggtggtgacgattatgatgatcatttatgtcaaatatattataatatgggatattattattttacttatttaaaacaccccaatttaacattagcgaaattgaatttccaaaagtgtataaatcatggatttggtggtggtggtggcagcagtggaggtaattcaaatgaattcattgtcaaatcacatttttatttaggacaattatatgtcaatactaatccaaaattaagtaaatatcattgggaaatttcatcaagttcaggattaaaggattctattataaatttgggatttttagaaatgaattgtttccaaaattataatttagcaatcgaatggtttaaattaggtgtcgaattgaaccctaatgaagctcaatgtttaattggattatttgatgcttatattgccttacagaattggaaactgtattcatccacagaggcgcgagaatccgcgctatcg

SEQ ID NO: 3739 - DNA, 1452 bp, Candida albicans
cagaatttttttttaatcatagatcgattaaccattgataaatccagacctgatttcaattatgaaacagacgaggatttgattgatattacaaaagaaatatttgcttccctagagagtattaccaacaataaagtagtcaaatctccgtactttgaattattggaaggaaccagagctttggaagttctcaatccaagattggacactggattaataaaattaacaccggaagaaatcacgtttgattgtagcaaaccacaagaagtaaatgtcattatcaatattcaaactaagctattatccaatttggtaaactggttagaaagtaatagtttgcctgttacggtgttgagttgtcgatatgttcaaacattattagtcaattatttgaatcatgaaaattccgggctagggaaattctcattttacaattccagattacctgcagttgattatctgaaagataatttaaattatcaatttgttcatcgagtattgaaaacgtttaccatgggattatgtaagtttattggatttactatatatttgtcaagaacggtattgtatgaagaagaagatttgaataccaaatcgatgaatttaaatttttttgaagacatatctcctgtttactttattgaagaaatcaatgattgtattgaatggatactaagtaacgatgagattattgaagctgatactttgatcacccaattaaaaattgttgccaacttggtcaaatttgaaaatactttcaaaaccacacagcatacaagttttatggatggaaagaatgatatagcaacttctgattctaaatttgatttttgtctagatgcaattaatcaaataactaaattacaaaacgtcaaatttgatgacacggttatcccaatgggttcattctcaaaatttattcaagttgatttagtaaataaaagcattcctgaaaaattgactagcattgatttagaaactacttgggattgtttaactaatatttttaaaactattcacagattcaccaaccaagcaaattccatcaaatcaattaatcaattatacgattttttgcattataatattaaattccccattgaaaaattttcggtgttcgctagagggtttttccaattgtattttatacgtgataacaaatcaatatttggttcaaataatgtcaatttaccaaatttagttattgattggattgaaaatgtaattggtaaaagcactattatgttaggtaaatttgaaaataatttatcccaaattaaagataatgtcaaagcagaaattattaaagtgcataatgcaaatctcaatgatttagaaagtggcatgtatcattatttgacgacatttgccagtaatccttgtcgactggcacaattattatccaaggggttaattttgtgggaacccttggcaagttggttgggattcatt

SEQ ID NO: 3740 - DNA, 579 bp, Candida albicans
aaaaatcaagattatttgatcaaatcattgaaagctatgcgtaatttaactcaatgtcaattaaaatatctttcggtattatcgaaattacaaatcattgactacacaaagggacccatcaataatctcacatcaatggagaatctatattatcttataatgaaaccatggtcatcaataggagttccaatgttcccaacttttgaacaatatcaatctgttttaactactaatacagcacctggtctgaacaataaattaactttaatgaaatgtcttgaattgttggcaagtgcaaaaaataatcttgttgttgttgaaaaagaatatcatcaattgattgattatattaaacgagacaccaaaaataattttttacaagattcattaattattacttggtatgaagaattgatttctgcaattgaacaattaaatgataatatatcacaaatttcaaagattatttcattaaataaagatgatttgaaattgaaaaataaatataaaataaatatcacccaagggtgtcataaatatttcccaaacatttccattattccatgtataggtaagtaa

SEQ ID NO: 3741 - DNA, 528 bp, Candida albicans
  unsure (27),(112): Identity of nucleotide sequences at the above locations are unknown.
gaagtggtgtacaattttggaaaaatntttttctacttgcatttcaagttcccattatggataatgatgtcaataaccatgagagatttaagtggtggttcatcttgggatnatactcataataaagcattggatccgagtttatatgaagaaggtatactttggtttcaagatttatcaattgccgatcccatgcatgttttcccagtgattttaggtattacggcattatgcaatatagaatggactttaaagacattagaactactgcggttgactaagaaattgaagtttcgtccaactttgacagatgcgtttggaaatttaactaaaatgtcgattgtatttatgatggcaatatctttacatgctcctgctgcgttgactatatattggataagttctcagctttattctttattgcaaaatgtcatgatggatttgatgttgccaattagttttacaccaaagaagagaatcaattatgccaaaataaaaaacgacaatgcagtaaatgttattaattga

SEQ ID NO: 3742 - DNA, 525 bp, Candida albicans
agaaggctagaagctgggagtcaaacaacttgtacaaaacaagtgaagtataagataacaatgttttcaaataaaatcaatcgactagggccgttagttattcaaaattccagccacaagtaccctggtgttagaaatttttcaatagatcataatgcaataattaacacaatgacttcatcattccaagcagtacatgaattcagtggtttaccttggtgggcacttataccattgacaacttttactttgaggtctgtctggactctacctttggcaatattacaaagaaaacgaattcaaaaacaaagtcaattacgtccgctagttagtgcaatgaatcccatattgaaattaaacttggcaagacgagttcaacaggccaaaaagaaactcgaaaataattccaacaccaaagaagacattacttcaattcaagccagttcaacattgatcaatatgaaatatgaacaaatttggttcttgagttcttcactccgaaagcgagcaggatccgccaattaa

SEQ ID NO: 3743 - DNA, 246 bp, Candida albicans
  unsure (203): Identity of nucleotide sequences at the above locations are unknown.
aaaatacaatttaacgccacttttttttttccctattcgttattattcttccttttaaagtatttcttttacttattcaaccagaaaccttttactccatttgctgataccaatatcttttcattaattatcatgtcttctgaaaacaaacaaaccgaatccaaaccaaaaccatgttgtgtttgtattgaagaaggaaaaanaagagatgaatgttctttatttaaaggtatagaaagtgaataa

SEQ ID NO: 3744 - DNA, 519 bp, Candida albicans
agaagtcatgtgcggatcctggctgtccgtagtgaagacaaatgggaacaatttgagttgttggataagacattaattgcccccatgacatcgatttatcgtttcaaattaagaagagaagatgaagtgttagacattcctactggacattctttagcttgttgttttaatgttgatggtaaagatgaagtcagattttacactccgatttctaatcaatttgataaagggtttttcgatattttggttaagcattatgaacatggtgtcgttacaaaaaaattggctaatcttcaagttggacaaacagttcaatttagaggaccatttggaaaattacaatatgtaccaaatctggctaaagaattggctttagttgcaggaggcactggtattaccccaatgttacaagtcattactgctattatcactaatcttgaagatgatactaagatcaaattattatttgctaataacaccgaaagggatatattattgaaagatgaattggataatatg

SEQ ID NO: 3745 - DNA, 660 bp, Candida albicans
agtcaacctctcttgttagtttattgttatatccatcgacaagcgacaacacacaaaactacacaaatgacatctagactagacgagttgaacaaaaaactacagcaaaatagcaatcaaggattagcatcatcatcatcctcctcctcctcctcctcctcccgatcatcattaaaaccaccaacttcaagttcatctctacgaccacctccaactatgggttcaaacaggggtttgttccccgctataaattcagctcaacgagcagctaatgcaacaaccacatctagtgctgcagcaaaccaacggaagaaagtaattttacaaccaggtcattcgccacttgattgggctcaattaaatagaactcaaccacgacacaagttacgaggagttcctgccaatactccaccaccacaatatatttcgataaataaacaagaattacaaaaacacaagagtttacaagattgttggacttgtattaatggtaaagtttataatatcactccatatataaatttccaccctggtggtgttgaaaaaatcatgaaatgtgctggtaaagatggaaccagtcttttcaataaatatcatagttgggttaatgtggatagaatgtcggaaaattgtattgtaggagtgtgtcatacagattaa

SEQ ID NO: 3746 - DNA, 852 bp, Candida albicans
ggaccaacgggtgttgaagctgctggtgaaattcaagataatattgaccaagatttgaagaaatgggttcctgaagttgccgatgaattgaaagtctccttggtggaagctttaccaaacgttttgaacacatttaacaagaaattgattgactataccaaagaagttttcaaagacactaatatcaatttgatgactaataccatgatcaaaaaagtcaatgataaaagtttgattgcaaaccataaaaaccctgacggatctactgagtctattgaaattccatatggtcttttaatttgggctactggtaatgcaccaagagatttcactcgtgatttgatcgccaaagtcgatgaacaaaaaaatgccagaagaggtttattggttgatgaaagattgaaagttgatggtactgataacatttttgccttgggtgattgtacttttaccaaatacccaccaactgcacaagttgccttccaagaaggtgaatatttagccaattattttgacaaattgcatgcggttgaatctttgaaatacaccattgctaacccaactccaaaggacaatgttgaaaaattgtcaagaaaattagctagattagaaaagaatttacctcatttcatttacaactaccaagggtctttggcttacattgggtctgaaaaggctgttgctgatttggtctggggtgattggtcaaatataagttccggaggtaatttgacctttttattctggagatcagcttatatttacatgtgtttatcagtcaagaaccaagtgctagttgttttagattgggctaaagtctatttctttggtagagattgttctaaggaatag

SEQ ID NO: 3747 - DNA, 582 bp, Candida albicans
gcattatacccaagagatatgcaatacgttggaaaagtaggtggttatgtttacaaccaatggaactcattaaacccagccacattatccggagcaattgatgttatagttatagagcatcccgatgggacattacacacgtctccttggcatattcgatttggtaaatttcaaataatcaaaccatcacagaaaaaaattgatctatatgtcaatgacatcaagactaatttgccgatgaaattgggtgatggaggcgaggcccattttgtttttgaggttgatgacaagaaccatgccttatcgcacagtgtgttgacttcgccaatcatatcgccagtatcgtcaccgggatcttcaccagttagtacagctgcagagccattggacgatttggatttgaatgaaaacaccaatgtcgaagaaagaatcaaattgagtgatatccatagtccaagatcaaagagtcctacaccatctttgaaaaccaaaaaagcgtttgaaaacgccaaaaaaattacccagaaattaaacatacctaccaagtttgatttaaacggtgatatgcttattgatttggat

SEQ ID NO: 3748 - DNA, 1203 bp, Candida albicans
  unsure (118): Identity of nucleotide sequences at the above locations are unknown.
ttatcttccattgaaagaattatgtttcagattgaggaagcacaatggttttatgctgactttgttcgtcagttgaatcccgatttgcaaagcatgaagatgaagacgttcagtacanagattttagagaaatgcccgcttatttggaaatggggtgacccacaggaagcattatctaaattcggaaaatataaatcgaccataccggttcgtggtgttgcattattcaataaagatttgaacaaagttgtgctagtcaagggcaccgaatccaactcttggtcgtttccaagagggaagatttcgaaagatgaatctgacattgactgtgcagttagagaagtagaagaggaaacagggttcaattgccgacaccttattgatgaaaacgactgcattgaaagaaacataaggggaaagaactacaagatttatttggtcaaaaatgtgccggaagatactttattcgaggcacctacttatgagatatcgcaaatcaaatggtttgacattaaaacaatccaaaagaaatgtaagacaaacccaaacacttttttcattgtggggactattttgaagccgatgactaaatggattaacaagaacaagggtgtattgaacgaggaagaaattatgttacaggttgagttgaaattgaaggagttgttgggacttaatgctaaagaaccagaagaaaatgtggatgcaggtagagaattgttgaatattttgcaaaaagttggacaaaaggaaagccaatctgcaatatcaccaagctcttcataccaaaataacgatcaacaaccacagccaccaatggttaatgtacctgttccgcaacatctccataaccaaatccctttttttgcaggagcacacgctgctttcccattttacaatcagccttttttcaatcctatgtcgtttatgcctccacaattcatgcctcatcatcctgcatatgttagtccacataaccaacaaccccctaaccctcaaagctttcagaagcccaagactaactcgaaagagttgttatctattttgacggctaaatcagacaagaaaagggatgacgagaactcaaaacagcgcaagccggtggaagatgacaatatccgctccagagcacaacaattattgagcgtatttcctaaaaagcacatcaaagagactaacacgtcagcaggagtcagaggttga

SEQ ID NO: 3749 - DNA, 1905 bp, Candida albicans
  unsure (707),(716),(787): Identity of nucleotide sequences at the above locations are unknown.
catactgtaaattatactcttatgttgattcaatcattgttaccaagagtaggaagtaggcgattgtttcctcgttcactaccaccattgagaaattctatcaattacactccatgtatcagaagattccatcaatcatgtacaagatacaatctaacgtcggaacaagaagaaattttacatcaagaacgtgccagagactatgtggatgtatgtatagtaggtgccggacctgctgggttatcgactgctataaagttgaaacaacttgataatgaacaaggtaatggggatttacgagtcattgttttggaaaaagcaggagattttggtagtcatatagttagtggtgcggttattgaaccacaagcttttaaagaattattccccgaaagtgaattgactgaagaaaacgggatcccattaccactggatattataacaaaagtaacatcggatcatatgaaatacttgactcctaatagtgcattcccattgccagaacctcctcagttaaccaataaggggaaaaactttattgttagtttaaatgaagttgtcaagtatctagctgaacaagctgaagagttgggagttgaattgtatccagggatttcagtgaatgaattggtttataacgaagataaatcagccataaaaggtatcataacccaagatatgggggttgatcgtaatggtgcaccaanagatagttntgaaccgggtatggaattttttgcaagattgactgttttggccgaaggttgtcatggatcattgactaaanatgccattagcaactttaacttgagagaaaattctgaacctcaaacatatggacttggaatcaaagaagtttgggaagtttcacccgaaaagtttgataaaggttatgtaggacattcattgggatatccattaacttcaaaggaatatggtggaggttttatttatcattttggtgacgggttagtcgccgttggtttggttattggattggattatgccaatccatacatctcaccttatcaagaattccaaaaaatgaaaactcatccattttatgccaatgtgttaaaaggtggtaaatgtatttcatacgctgcaagagctttgaatgaaggtgggtaccaatccattcccaaattacatttccctggtggtattttggttggttgtgctgctgggtttgttaatgtgccaaaagttaaaggcactcacactgctgtgaagagtggtatagttgctgcagaaacaatcatctccactttcaaacaaatggaattggatccttgtgatgaagaaaactttgaagaattatccacaccaatagatttaagtcagtatgaagagaatttcaaagattcgtgggcatacaaggaattgtacgcagtgagaaatgtgcgtccttcattcaactctccacttggtatggttggaggtcttgttcactcaggtttgctgactatgatcacacagggtaaagaaccatggactttatctcaccatggtaccgattcaggggcaactcaagatgcaaacaagttccaacctattgaatatccaaagcctgataatgaattgacttttgatattcttacctctgtgtcaagaactggtacataccatgacgaagatgaaccatgtcatttaaaaataccagaccaagattgtcgaaaacatgctgaattaaactggaccaaatacagaggtgtcgaacaaagattctgtccagcaggagtctacgaatatattgaggatgaactggaaccattgggagtcaagttccaaataaatagtcaaaattgtattcattgtaagacgtgtgatattaaagtcccatctcaagacattacatggtctgtacctgaaggtggagatggtccaaagtattacatgtcctga

SEQ ID NO: 3750 - DNA, 336 bp, Candida albicans
  unsure (335): Identity of nucleotide sequences at the above locations are unknown.
cttgactcaacaaccacaagcatggcatcgtacattgcaaagagattgttttcaaggactactgttagattaaatacacttgcattggttgaaggtgtgagtaatggtatttctcctgcatcattgtctacaattactgctgccacacaaattggggaaccagtgacagccatagtttttggcagtaatggcgattcagttgcagaagcagtcgccaaaaccgagggtgtttccaaagtgttagttgccaaagatagcgagtacgaccactatttggcggaaaaagtttctcctttgctcaaaaagatcattgaagaccaaaagtttacccattna

SEQ ID NO: 3751 - DNA, 861 bp, Candida albicans
acctgcaatactggtgaaacaaaaaaaaaaaacaagggcaggagggaaaagaaaatttttctagttatgacaggtgaaataactatattatacggatccgaaactggtaatgcagaaaaatatgccaagtacttgaaacaaagattaagatcttacaatttgaaaccaatcaaccttgcatcactaaacgattatcctttgaagcgattagtaacacacacttcgtatttaattataatatgttctacaacaggacaaggagaaatccctagaaatgggaagaagtttatgaaatttatcttgaaaaaaaaattacctctggatttattccagcatttgcaattaacaacatttggtgtgggagactcgtcgtatgttaaatataattatgctataaaaaaaattcacactagattaatgcaactagggtgtcagcttttatctcctcggtgtgaggctgacgagatttcacctgaaggtgttgatggatactatattgaatgggaggctgaacttattgcagcattattaaacaaatttccaagtgccagtaaaattagttctgaggctgttccaatgcctgaatatagaatttctgtttcaaaaagtgacacgacaatagatccaaaagaggttattgacaatcccattgtgtcacgacttggaaaaaatgggctcaaattaggcactgtattagaaaacaaccgactcacaagttctaaccatttccaagacgttcgagattttaagttttccagcaatgggttgaactatctaccaggagatactgtttcattgtttccatgtaacttcgatgaggatgttgacgcgttattacaactgcagccccaatggggttaa

SEQ ID NO: 3752 - DNA, 1068 bp, Candida albicans
actatctaccaggagatactgtttcattgtttccatgtaacttcgatgaggatgttgacgcgttattacaactgcagccccaatggggttaaaatcgcagataaaccattaaatttgaaaaattttccacatttagagggcgggtttgctgacatcttaacattgagaacgctattcaagtaccatctagatataatgtctattcccagacgaagctttttcgctttattatggcattttgttgacccatcgactgaagatggagaaagagaacaagcaaaattaaaggagtttggcagcttagatgaaccagaagagttgtatgattacgcaaatagaccaagaaggctgatattggaaactttactagaattcgaaaataatttaactataccggtttcgtatattctagatttgtttcctttgattagaccaagaatgtttctgattgcatcatgtccatcatccaaagaagttgaattggttgtggcaattgttgaatacaaaacaatcataagaaaaataagacgtggggtgtgtactaggtggcttaagaatttgaaaccgggagatcaattcctattctcgatacaaagatccagtttcaagtataaagacgataatagccctatcattatggtggctccaggtactggtatagcacccatgaagtctttgattgatgaagtgatacaaaacaactctaagcaagagctttatttattttttggatgccgcttcaaagagaaggataatttaatcgaatcgttttggcatggaaatgaaaatcaaaatctacatttagtcagtgcttattcaagagactcgaattccaaatataggtacgttcaagatgcgttgtttgcccattcagaactaattggaaaattgttaattgaacagaatgcaaaagtgtttgtatgtggatcgagtgggaaaatgcctaaagaagtaaagataacttttgttgaaatagtaaagaaattcacgggaatggacgagggagatgctcaaaagtacattatcggcttagaggacaatggtaggtataaggaagatgcttggtag

SEQ ID NO: 3753 - DNA, 2067 bp, Candida albicans
  unsure (109): Identity of nucleotide sequences at the above locations are unknown.
aggatgagacatccagtgtatgacacatttgacggttccgacttccaagcactcaaggaaccaataattgaccgtgttgtcaagttgattactgaattgccagttcatngggaagaggccaccaaccacaaagctacccatattttagatttcggaccaggtggtgtttctggattgggtgttttgactcacagaaacaaagaaggtactggtgctagaatcattcttgctggtactcttgactccaaccctattgacgatgagtatggtttcaaacatgaaattttccaaacttcagccgataaagccattaaatgggccccagactggttgaaagagttgagaccaactttggtcaagaactctgaaggcaagatttatgtcaagaccaagttttcgcaattgttaggtagagctcctttaatggttgctggtatgactccaaccactgtcaataccgatattgttagtgcttctttgaatgctggttaccacattgaattggctggtggtggttatttctcaccggttatgatgaccagagctatcgacgatattgtttccagaatcaagcctggttacggtttagggatcaacttgatttatgtcaacccatttatgttgcaatggggtattccattgattaaagatttgagagaaaaaggttacccaatccaatcattgactattggtgctggtgttccatctattgaagttgccactgaatatattgaggacttgggtttgactcacttgggtttgaaaccgggttcagttgatgccattagtcaagtcattgctattgccaaagcccatccaaccttcccaattgttttgcaatggactggtggtagaggtggtggtcaccattcctttgaagatttccatcaaccaattattcagatgtactccaagatcagaagatgttcaaacattgttttggttgctggttccggttttggttctgatgaagacacctatccttacttgagtggttactggtctgaaaaattcaattatccaccaatgccttttgatggggttttgtttggttcaagggtgatgacctctaaggaatctcacacttcgttggcagctaagaaattgattgttgaatgtaaaggtgttccagaccaacaatgggaacaaacctacaagaaaccagcaggtggtattatcactgttagatcggaaatgggagaacctatccataagatcgccactagaggtgttatgttctggaaggaattggacgacactattttcaatttgccaaagaataaattgttagatgccttgaacaagaagagagatcatattatcaaaaagttgaacaatgatttccaaaaaccatggtttggtaagaatgccaatggtgtttgtgacttgcaagaaatgacttataaggaagttgccaatagattggttgaattgatgtatgtcaagaaatcccacagatggattgatgtttcgttgagaaacatgtatggtgactttttgagaagagttgaagaaagatttacaagcagcgctggtacagtttcattgttgcaaaactttaaccaattaaacgaaccagaacaatttactgctgacttctttgtgaaattccctcaagctggtaaacaattaatttctgaagaagattgtgattactttttgatgttggctgccagaccaggacaaaaaccagtgccatttgttccggtgttggatgaaaggttcgaattctttttcaaaaaagattcactttggcaatctgaagatttggaaagtgttgttgacgaagatgttcaaagaacctgtattttgcatggtcctgttgcttcacaatatactagcaaggttgatgaaccaattggcgaattctggaactcattccgtgaaggtcatatggccagattgttccaagaagaatatgcaggtggtgaatccaaattcctgttggtggaatactttggggtaggaaacgtgcaagtgtatcaggtacatctgtcaatgttactgacggtgaccaagttgtttatgaaattgactccgaactcccaaacaaacaagagtggttag

SEQ ID NO: 3754 - DNA, 1185 bp, Candida albicans
  unsure (1146): Identity of nucleotide sequences at the above locations are unknown.
cctataattatttatatcctgtttccatattacacaatgtcaactcatagacctttccaattaactcatggttcaattgaacataccttattggtaccaaatgacttattttttaactattcacaattaaaagatgaatttataaagacgttgcctgagccaactgaaggttttgctggtgatgacgaaccatctagtcctgctgaattatatggtaaatttattgggtttattagtaatgcccaattcccccaaattgtcgaattatcattgaaagatttcgaatcacgctttttagacaacaacaatgacaatattcattcgtttgccgttaaattgttagatgacgagacatatccaactactattgcaaaagttaaggaaaatattgttaagaattactacaaagctgtcaaatctattaacaaagtagaatccaacttattgtaccattgcaaacacgatgctaagttagttgctatatttggtggtcaaggtaacaccgacgactactttgaagaattgcgtgaattgtacacgttataccaaggcttaattgaagacctccttgtgagcattgctgaaaaattgaaccaattgcacccatcatttgataaaatctatactcaaggtttgaatatcttgtcttggttgaaacacccagaaaccactcctgaccaggattatttgttatcggtgccagtaagttgtccagtgatttgtgttatccaattgtgtcactacacgattacttgtaaagtacttggtttgacaccaggtgaatttagaaactcgttgaaatggtctactggtcattcacaaggtttggttactgccgttaccattgctgcgtccgattcctgggattcattcttgaagaattctttgactgctgtatccttattgcttttcattggttctagatgtttgagcacctacccaagaacttcattgccacctaccatgttgcaagattcattggacaacggtgaaggtagaccatctccaatgttgtcagttagagatttgtcgatcaaacaagttgaaaaatttattgaacaaaccaactcacatttaccaagggaaaaacacattgccatcagtttaatcaatggtgctagaaacttggttctttccgggtccacncacgaatcccccttattgggtttcaattttgaattttaa

SEQ ID NO: 3755 - DNA, 909 bp, Candida albicans
cctaccaaagaagttattcaagttggatctgttgactatgaagctggtacctcatatggtaatccagttaccgattacttgtccagaaacggtaaaacgattgaagagtctgttatttttgaaaatgccattcctttgtcttctggtgaagagttgacttcaaaagctcctggtaccaacgagccatatgctattgtgtctggtgattacaatccaattcacgtttcaagagtttttgctgcttatgctaaattgccaggtactatcactcatggaatgtactcgtctgcttcgatcagagcattggttgaagaatgggctgccaacaatgttgccgcaagagttagagcattcaagtgtgatttcgttggtatggtattgccaaatgatactttgcaaactaccatggaacatgttggtatgatcaatggacgtaagatcatcaaggttgaaactagaaatgttgaaactgagcttccagttttgattggggaagctgaaattgaacaaccaacaacaacctatgttttcactggtcaaggttctcaagaacaaggtatgggtatggagttgtacaactcttctgaggttgctcgtgaagtttgggacaaagctgacagacactttgtcaataactatggtttctctattttggatattgttcaaaacaatccaaatgaattgactatccactttggcggtgccaaaggtagagctattagagacaactatattggtatgatgtttgaaactattggtgaagatggtgctttgaagtcggaaaagattttcaaggatatcgatgagactactacttcttacacatttgtttcaccaactggtttgttatcagcaactcaattcacccaacctgcattgactttaatggagaaagctgcttatgaagat

SEQ ID NO: 3756 - DNA, 1209 bp, Candida albicans
tttttatttctcccccaattaacaatgaaaccagaaattgaacaagaattatcccacactttgttaactgaattgttggcatatcaatttgcttctccagttagatggattgaaactcaagatgtctttttaaaacagcacaatactgaaagaatcattgaaattggtccttcaccaactttagctggtatggccaatagaactatcaaagccaaatatgaatcctatgatgccgctttatctttgcaacgtcaagtcttgtgttactccaaagatgctaaggagatttactacaagccagatccagcagatcttgctcctaaggaaacaccaaagcaagaagagagtaccccatcagctcctgccgctgccactccaacacctgctgctgccgctgccgctgctcctactccagcacctgcaagtgctggcccagttgaatctattccagatgaaccagtcaaggctaacttgttaatccatgttttggttgcacaaaaattaaagaaacctttagatgctgttccaatgaccaaggcaattaaggatttggttaatggtaaatccactgttcaaaatgaaattcttggtgacttgggaaaggaatttggctctactcctgaaaaaccggaagacactccattggaagaattagctgaacaattccaagattcattcagcggtcaattaggaaagacttctacttcattgattggtagattaatgtcctcaaagatgccgggtggattttccatcactactgctagaaagtatttggaatcaagatttggtttgggtgctggtagacaagattctgtcttgttgatggctttaacaaatgaaccagctaatagattaggttctgaagccgatgcaaaagctttctttgatggaattgctcaaaaatacgcatcaagtgctgggatctccttgtcatcaggagcagcctccggtgcaggcgccgcaaatagtggtggtgctgttgttgatagtgctgccttagatgctttaacagctgaaaacaagaaattagccaagcagcaattagaagttttagcaagatacttgcaagtcgacttaaacaagggagccaaatcttttatcaaggaaaaggaagcttctgctgttttacaaaaagagttagatttgtgggaagcagaacacggagaattctatgctaagggtatccaaccaacttctccgcattaa

SEQ ID NO: 3757 - DNA, 1242 bp, Candida albicans
agatccagtttacaaagatgttccagaattactggtccaaagactaaagtcagtgctaagggtaacattgaatatgaggaaactcaaaaggattcagttagaaaatttgaacaatatgtgtatgaaatggcccaaggtggtgctatgaccaaagttagtcaaccaactattcaagaagatttagctagagtttacaaggctatttccaaacaagcttccaaagatagcaaattggaattgcaaagagtttacgaagatttattgaaggtggttgaaagttccaaggaaatcgaaactgaacaattgactaaagatattttacaagctgctacagttccaacaaccccaacagaggaagtagacgatccttgtactccttcttcagatgatgaaattgcttctttaccagataagacttctatcattcaacctgtctcgtctactattccatctcaaactattccatttttgcacattcagaaaaaaaccaaagacggttgggaatacaataagaaattatcttctctttacttggatggattggaatcagctgccattaatggtttaactttcaaagacaagtatgtcttatttactggtgctggtgctggctctattggtgccgaaattttgcaaggtttaatcagtggtggtgccaaagttattgtcacaacctctagattttccaagaaagttaccgagtattatcaaaatatgtatgccagatatggtgctgctgggtctactttaattgttgttccattcaaccaaggttctaaacaagacgttgatgcattggttcaatacatttatgatgagccaaagaaaggtggtttgggttgggatttggatgcaatcattccatttgctgctattccagaaaatggtaatggtctcgacaacattgattctaaatctgaatttgcccacagaatcatgttgaccaaccttttaagattgttaggtgctgttaaatccaaaaagaccactgacactagacctgctcaatgtattttgccattatctccaaatcacggaacttttggttttgacgggttgtactctgaatctaaaatctcattggaaaccttattcaacagatggtattctgaagattggggatccaagttgactgtttgtggtgctgtcattgggtggaccacaaggtacagttttgatgagtgcccacaacattattgcctaaacgttttgaaaaattgggtgtcaaaacttcctcccaac

SEQ ID NO: 3758 - DNA, 222 bp, Candida albicans
gaattcctatgggattggggccgttcaagacgtttattcaatgaatttgaacttaattttgggcaatttaattttgtgataggagaaacattcaaccaatgtattcaattcatgaacagagccaatccaactttaatcaagtttatgcaatatcatatcgaccattgtccagaatataaaggtgaaacttataaatggccaagagattgggtcaacaattga

SEQ ID NO: 3759 - DNA, 1131 bp, Candida albicans
gaaacaatgggttattcattctacaagtctgatccaagaattgctccattgagaggagcattggctgccttcaacttaaccatcgatgatattggtgttgcatccttccatggtacttccaccgttgctaacgataagaatgaatcagccacaatcaacaacatgatgaaacacttgggtagatccgaaggtaacccagtatttggtgttttccaaaaatacttgacaggtcatccaaaaggtgcagctggtgcttggatgttgaatggtgccattcaaattcttgagtctggtcttgttccaggtaacagaaatgcggataatgttgataagcttttagaacaatacgaatatgtattgtacccatcaagatcaattcaaaccgatggtattaaggccgtttctgttacatcatttggtttcggtcaaaaaggtgcacaggctgttgttgttcatccagattacttatttgctgttttggatagatccacttatgaagaatatgctactaaggtctctgctagaaataaaaagacctaccgttacatgcacaatgcaatcaccagaaacactatgtttgttgccaaagacaaagctccatatagtgacgaattggaacaaccagtttacttggatccattggctcgtgttgaagaaaacaagaaaaagttggtattcagtgacaaaacaattcaatcgagccaatcttatgttggagaagttgctcaaaaaactgctaaggcattgtcttctttaaacaaatcatcaaagggagtcggtgtagatgttgaattgttgtcagcaatcaatatcgacaatgaaacctttattgaaagaaactttactggtaatgaagttgaatactgtttgaatactgctcacccacaagcttcattcactggaacttggtcagcaaaggaggctgttttcaaagccttgggtgttgaatcaaaaggtgctggagcaagcttgattgatattgaaatcactcgtgacgttaatggtgctcctaaagtaattttgcatggtgaggccaaaaaagctgctgctaaagctggtgttaaaaatgtcaatatttcaatttctcatgatgatttccaagctactgctgttgctttaagtgaattttaa

SEQ ID NO: 3760 - DNA, 240 bp, Candida albicans
gtgtgtgaagacgccaagactcaaactccaattgacgaaaaggatatcaaatccaaatatgaagaagaaattttagaacattccggtattagattgattgagccagaattgttcaatggctatgatccaaagaaaaaacaaatgattcaagaagttgttgttcaacacgatttagaaccatttgaatgttctaaagaaacagctgagcaatacaaacacgaacacgggagaaaaatgtga

SEQ ID NO: 3761 - DNA, 1095 bp, Candida albicans
  unsure (1089): Identity of nucleotide sequences at the above locations are unknown.
aaccatttgaatgttctaaagaaacagctgagcaatacaaacacgaacacgggagaaaaatgtgaaatttttgaaattgaagaaagtggtgaatacacagttagaatcttgaaaggtgcaacattgtacgttccgaaagctttgagatttgatagattagttgctggtcaaattccaactggttgggacgctcgtacctatggtatcccagaagacactattagtcaagttgatccaatcactttgtacgtgttggttgccactgttgaagccttgttgtctgctggtattactgatccatatgaattctacaaatacgttcatgtgtctgaagttggtaactgttctggttccggtatgggatgtgtctctgctttgagaggaatgttcacagatagatatgctgacaaaccagttcaaaatgacattttgcaagaatcatttatcaacactatgtctgcttgggtccatatgttgttgttgtcttcctctggtccaatcaagacaccagtcggtgcttgtgccactgctgttgaatcggttgacattggtattgaaacaattttgtctggtaaagctaaagtagttttggtaggtggttacgatgacttccaagaagaagggtcttatgaattcgccaatatgaatgctacttctaattctattgaagagttcaaacacggaagaacaccaaaggaaatgtcaagaccaaccactactaccagaaatggtttcatggaagctcaaggttctggtattcaagttatcatgacggctgatttggcacttaagatgggtgttccaatccacgctgtattggccatgactgctactgccactgataagattggtagatctgttccagcaccaggtaaaggtattttgaccactgccagagaacatcatggcaacttgaagtacccatctccacttttgaacatcgagtacagaaagagacaattgaacaaaagattggaacaaatcaaatcttgggaagaaacagaactttcttacttgcaagaagaagccgagttggctaaagaagagttccgtgacgaatttgttttacaacgagccggcaggcaaatncatgct

SEQ ID NO: 3762 - DNA, 1185 bp, Candida albicans
aacaccatatatataataatgagtcaagattctcatgctaaaattaattatttattacacattataaattctcaacggacacccccaataattaataatcccagtatatcgtccaatacccacagagttcgaactaaaactaaaacaagaacaagaactagtcctaattccaaaacaaagattaagacaaaaattatgaacattatgaaaactaacaatagaaactcgatacttactgaaacagaagaattatttactaatgaatcacaaatcattgaatcatttaattctaattgtaccatcgtcgattcaaattcagactttcatgataaactacatgtatataaatcacccattattgatataacaaaatatttctcacccacagtggaatcacaaatggatttagaattgataatattaaatgaatattattcaaaaacacatcaacaccaccaagaacaacagaatgatgaggatgaggatgaggacgacgagttgaactatttttatattgatgctcatttaaaatatattttatcatcattaattgatccaatgccatcaggttatcaagtattagatgttaatcattcatggatgatttattggttacttaattcttattatcttatacaaaaccccactatggaaatcaatcaatcaattttggatttaattgttaataaaatcactaaatgtataaattatggggattcattatctggagtcccttttgatggaattggtggtggtaataatcaattgggtcatttggcttcaacttatgcagcgattttgacattaattttaactgatcaatatgaattattagataatttaagagaattaattcgtgattggttattaaccttgaaaaaacgaagtagttgtggtagtggggcatcatttataatgcatgaaaatggagagatggatgctcgatcaacttattgtgccttgattattataaatttattaaatcttaccaattatgaagaaaattcatcatcaccagaagaattagatccattgattgatggggttgaaaattggcttaattcatgtcaaacatatgaaggaggatttagtaatataccaaatactgaagctcatggaggttatacttattgtgcccttgcaagttatttcttattatatgtaaaccgcaaacattttcttctg

SEQ ID NO: 3763 - DNA, 288 bp, Candida albicans
cgcgtgattcttccagccccggtggtcgaagatcaaggacaaggacagcaacaagaagtgaaagtatttgatgaagagaaattacgacaatatttattgattatagctcaagatgaatcaggaggatttaaagataaaccagggaaacaagttgattattatcatacaaattatagtttatctggattaagtattcttgaacatagttataattttagtcaagatgatgagggaagaagtttagcatttcaaattgatgtggaacgagaagaagaagaaagaggatga

SEQ ID NO: 3764 - DNA, 1425 bp, Candida albicans
acaattggcacgaaacgttccaaccatgccgaatcattagcgttgaaagggtgtataatatttcaaacaaatggcaataaagacgatgccagatcatacattgaccgagcagcagcaaaaaatccaaacaattatttagttgatcatttgatagggttatattaccgtgccaatgaaaactatgcagaagctgccaaatggttatctgcagccatggaaaatggatcaaccaacaaagcaattttacgtgatttatcatttatgcaaattcatattagagattataaaaacttgagagatagcagacaacaatatttggaacacgcccctggctatagggccaattggaccggggttgctgtggctcatcatttaaacaaagattatgcatcagccgtggggactttggcaaaaattgaggatatcattaaagaccacttgacagaaagtgacatgtatgaacaaagtgaatgtgttttgtataaaaaccaattgattggtgaactgggtgattttgccaaggcattggatgtcttgcagaaggatgataatagtattaaggatagattatctttcttagaatacaaggccaagtacttgttgttattgggtcaaaaaaaggaagcatccttggtttatcgagaattgttaaagagaaatcctgataatgtttcgtactataatttattggaaactgcattaggtacaactacacaatcacctgaaattagatataaattatatcaaaaattgagcaaattctatcctcgttcagatccaccaaagtttctccccttgacttttttaccttcagatagttctttatttgaaaaggctgccagggactacattatccctcaattgttacgtggtgtccctgctacatttgtcaatgtcaaacctttgtataaaaacccagcaaaattgaaggtcattgaatctattgttaaagatttttatgaacacgatgtaccaaaaatttccaacccaacagtcaaagtatggacgtgttactattttgctcaacattatttgtatcaaaatgacttgacagcagcatcaaagtatattgatatagccattgaacattcaccaacattggttgaactatacattattaaggcaagaattattaagcaccaaggagattttgtcaaggctagtgatgtaatgaatgaaggaagattattggatttacaagatcgttttatcaattccaagacaacaaaatatttgttgagggctaataaggtcaatgaggcaattgattgtatatcattattcaccaaattggatgaaaacgctgttaatggttgtaaagatttacatactatgcaagctaattgggttttagttgaatcggctgaagcatattcaagaatctaccatgatcttcacctcgggaatggcagtccgcgttattaa

SEQ ID NO: 3765 - DNA, 807 bp, Candida albicans
atgataaggaacaaaatgatgaatcatttaatgagattgttgagaatactgaaatctacggtggattggcaattgaaacgtttccatgctgttttgaagaatttcgatatattttataatgatcaatttgatttccactcctattgtttgagacgtggtacaccaagagattatattgatactttgaaatgggaggataagattcatacaactccaatatataccagagctttaaaaggtttatctgaattatattttgaaatctatgaagagcaacaacaacaacaacagaaatctaaggctgatgaaaatgatgcagttgtggttaaaaagaatagtaagaagcagaagaaggccaagtcccaacttaataagaaacgagctgaattagtcagtaaagttgagagtgaaaaggatgatgctgatccatttggaattaagttgtatcatgatttaattgaaacggatgttttggaatccttatttgaactttttaaaccattgagtgaagaaggtaaaaacttgcgtttgacatgggaagtcttgtttagaatttatttattacaaggtaaatatgttttagcattacaagccatcaaaagcttgaataagattttaacaagaggtgatctggacaagaaattaaaacaaattggtgaaatggtattggagttgtcaaccacggtgactaatgattctaatgccaacgttgccattgtgaaagtggttgaaaaggggttgaatagtgcattcccggattttgaaaaattatcctgtgacgaatttgccaaactatataatcaatag

SEQ ID NO: 3766 - DNA, 1080 bp, Candida albicans
ttacaaacatcaaattcaaaaccacaagccatacaaaacaacatgaataggttacttagtttcatactacctatttttcttattttcagcacagtgttatcatctgattcaccaaatgactctgtaaatatcaataattctgatccaagtcgtcattcaaataactgggccgtcttagtgtcaacatcacgattttggttcaattatcgtcatatggccaacacattaagcttgtaccgtactgtcaaaagattagggattccagattctcaaattattcttatgttatcagatgatattgcttgtaatccaagaaatgctttcccagggtcagttttcaacaatatggatgaagctattgatttgtatggtgaatcgatagaagtggattaccgaggatatgaagttaccgttgaaaattttatgcgtttattaactgataaatgggattcagatcaacctagatcaaaaagattattgtctgatgaaaattccaatatttttatctatttgacaggtcatgggggtaatgagtttttgaaattccaggatgcggaagaaattagtgctcatgatcttgctgatgcattttctcaaatgtatgatcaaaaaaggtataacgaaatatttttcatgattgatacttgtcaagctaataccatgtatgaaaaaatccattctccaaatatcttggcagttggatcctcagagatagaagaatcgtcctactcacaccattccgacatggatattggtgtagcagtgattgatagatttacttattatactttggatttccttgaaaagatcgatagagattcaaaggagaccatggacaaattatttgctgaatacacttttgaaaatgttcattctcatccaggtattagaactgatttattcaagcgtaatgttagtgaagtcttattaactgatttctttggtaatgttcagaatgttgtcgttgatgatgtcaatatggagttgttggagaatgaaaaagtcacggaatctaacgaggacaacaatcaaactaagaatattatcaaagaaagaggcccaacacaattcagtttttga

SEQ ID NO: 3767 - DNA, 408 bp, Candida albicans
  unsure (18): Identity of nucleotide sequences at the above locations are unknown.
ttatgggacaatttattncgaagtttaagtatgtatactgcaaaatcatcatttaatcattatattcaaaaagaaaagaaggctacaacctctattactggctcttcacttgaacatatagataatacatccgataatgatgaccaagacgacgatatggatggtcataaattaataactacgggaatatatctgattttccgtcatccatcatattttgggtttttcatttggtttttaggattacaaatttttatgaataatttaattatattaattattggtgggattatattatggaaattttttaatgaaagaattcaatttgaagaaatttatttaattaaattttttggtattgattatataaattatcgtaataaaactaaaacttggatgatgatataa

SEQ ID NO: 3768 - DNA, 843 bp, Candida albicans
  unsure (560): Identity of nucleotide sequences at the above locations are unknown.
tggagttatgatataactacttccccaatttttctaccattacttatcaaacatacaaaaacaacacttacaatgtcactaacttataatcctaggaataataatttattagaaatattcattatttgttttataatgggtattacattcactatatccatcatcacactactactaggtacatcttccttgtctaataaatacatttggctagtcatttattcccttttattgcatggatttttcatattggaatttataaattcttcattatatcaatataattccgttacatcaaaatcatttttaatatatggtaataaaggtaataaacaattttggtatttacaattattaaccatttgggaatatcttttattaagattggggaaattaaatgtgattgtcaaatatttccccaacataggtaattggagttggtggtggtggtggacaattttacaagtatttggattacttatcagtttattgggattatttattcgtcatttagctatgaaaacttgtggattatcatttaatcattatttaattacccntagtccaagtcctagcaaaaatcaatatgagaataaattaatcactcatggaatttataaatatgttagacatcctagttatttaggattttggttatattgtattggtatacaattaatgttattaaatattggcaatttaaccttgacgatctatattttaaattggtttttcagaattcgtattgaatatgaagaaaatcaattaattaacaaatatggtgataaatatattaattatcaacaaactacaaaacaaaaaatattaattccacttatataa

SEQ ID NO: 3769 - DNA, 912 bp, Candida albicans
ggcaatattcaatatgctttaagtttgggtactgctattggattccctcagggcctttctccgttgacccttcttgatgatgttaaagtgtggaaaccagacttattggcattggttcctcgtgtttataccaaattagaagctgccattagagcacaaaccattaataatatggaaaaaccttggttgcaatcaattttttctactgccattaatgcaaaaatggaagctcatgccaaaaaagaaaatgaacatacaaatccaagtttcttagtttatgatagaatcttgggacttttaaagaaaaaaattgggttcgacaatgttattacaatgactactggtagtgcaccaatcgctccggaaacaattaaatttttaaaagcagccgtgaacgttggatttgctcaaggatatgggttgagtgaatcatttgctggggttatggcttcttccaaatatgaaactgaatcgacttcatgtggtgccattagtgtcaccacggaaatgaaaattagagatatccctgaaatgggatattccgctcatgacaaagaaggggctagaggtgaattattgttaagaggtccacaaattttcaaagaatattacaagaacccagaagaaactgctaaagcggttgatgaagatggttggttctacactggtgatgttgcatgtattgattctgaagggaaagtgaaaattattgatcgtgttaagaatttctttaaattggctcaaggagaatatgtatctccagaaaaaatcgaaggtttatacttgtctcaattcccatatattgctcaattatttgttcatggtgattcattacaaacattccttgttggtgttgttgggattaaatccaaccactattggtacttatatcaagaaaagattctaagatga

SEQ ID NO: 3770 - DNA, 975 bp, Candida albicans
  unsure (963): Identity of nucleotide sequences at the above locations are unknown.
aaacgatcaatgctcatttgccagttgatccccgttcacttgccaaatcagttccattacctaatactgaagcaccaggattttccccaatttacagaaatggattttccccacgatgcattacttaatgttccttatccaggattggacactttatacaagttatttgaatatgccgtagatgttcatggaaataaaccagctttaggttcaagggtcaagaattctgatggcacgtttggcgattacgtattccaaaattatgatactatcagaactagaagaaacaatcttggatcagggattttctttattttacaaaataatccttataaaactgatagtgatgcccataaaaaattgaaatacgatccaaattctgaaaattcatttattttaactattttttctcataatcgtccagaatgggccttgtgtgatttagcaagtgttgcttattcaatcactaatactgccttgtatgatactttgggtcctgatactagtaaatatattttgaatttaactgaatctcccattgttatttgttccaaagataaaattagaggattgattgatatgaaaaataaatatcctgaagaattgagtaatttgatcactttagtatcaatggatgatttgactactgaagattcaattttgaaaaattatgctcatgaaaataatatcacggttttcgatattaaacaagtggaaaaattgggtgaaatcaatcaattggatccaattccaccaactccagaaactgaatttactatcacatttacttctggtactactggtgctaatccaaagggggttgttttaactcataaaaacgctgctgctggtgtaacatttttgtattgtaattttatgggtaaagaaaatgtccggttctattcattcttaccattggcccatatttatgaacgtgccaatatagttccaccacgggccagnaggtccgccaat

SEQ ID NO: 3771 - DNA, 1380 bp, Candida albicans
cccattgcaccaatcccacctaaacctgatgatgttttcaccatatctttcacttcaggtaccactggtgctgcacctaagggggtcgttttaacccacaaaaatttggtgtgtggaatcactgttcacgttgctggatttgggttggttcctggacgtatccattacagttttttgcctttggcccacatatacgagagagtttttcttcaatatggtttaatatccggtatgaagattggatatcctcagggtccactgccaacaaccttatttgaggacattaaggtattagagccaacatttttgtgcttagtgccaagagtttatacaaagttggaggcagcaattaaagcccaaacagtggacagtgacaagcccttaatgaagtatttgtttacaaaagccattaataataaattggagttgcaacaacaggaagaccatgttaatcctagcaatttggcttacgactggttgttgaatctgttgcggaaaaagataggtatgaaaaatgtggagctttttgttactggatcagccccgcttgcagaggaaacttatttctttttaagggcagctttgaatttaccacggggattccactctggttacgggttaacagaaagtgttagtggttgctctgtgtctcctggccatgccaacaaattctcgtcaggtccaattggtgtgtcaacagaaatgagattgagagacattccagaaatgggatactttgctaaagatgaagtaggtcctcgtggagaattgttattaagaggaccccaaattttccctcgttactacaagaaccctgaggaaacagccaaagcttttgacgaaaatggctggttctgtacaggtgatgtggcacacattgacgcagctactggaagaatcaacattatagacagagtgaaaaactttttcaaattggcacaaggggaatacgtcagtccagagaagattgaagggttatatttggcacaattcccttatatctctcaattgtttgtccatagtaattcattacaaacatatcttgttggtgttgtagggttagatccaacaaccattgccagttacatcaagaagagatttcatgataagattgaaaaagaggcagatattctccagtttttgaactctcctcagaataaaaagattatgttacaagatatgaacaaggtcattgctaaggagttgcaaggttttgaaaaattgcataatatcacagtttcttttgagcctttgacagttgaaaagggtgtcattacaccaacaatgaaaatcagaagaccaattgctgccaaatacttccaaaatgagattgatcaaatgtatgaagaaggctctttggtgaagaatggagctttatag

SEQ ID NO: 3772 - DNA, 186 bp, Candida albicans
ttagaaatattacataagattcatattgaaattaatccattaaccgtggaaagagaagtagttaccccaacatttaaattaagacgtccagttgcttcaaaattctttgctaatgttttccatagattatatgaaattgaacagagtttattgcatcaagctaaattaagaactgccaaattatag

SEQ ID NO: 3773 - DNA, 1851 bp, Candida albicans
attaaaatgtcactcgatttgttttctgcttctgatttcagcaaagaagtcgcaatatctcatttaccattcactcgtgatattaccgagagtgtaccattgaaaccagatgctaataaaaatgacaattattcaccaattttcagaaacaaagccactgctagtcgtttgattcagcgcatccatcctgatttagatacacaccacaagttgtttaataatgctgcagatatgtttggtgatcgtccatgtcttggtaaaagaccttatgattacaaaaacaaaactctggctccaagatttgattatttcacttattcagaggtgaaaactaagaagaacaatattggtgctgggttcatccgctcattgttaggaaacccattccttgaccctcaattggaatctcacaagaaggtggttaatcatttacgtgattggccaacctatgggttgcaaaaatccggaagagataatcaagattttgaaattgaaaagaatgcttcatttatcttgactttatttgctgttaaccgtttagaatgggtcttgactgatttggcatgtagttcatattccatcaccaacactgctttatatgacactttgggttctgatgtttcacaatatattttgggattgactgaatcccctattgtcgtcactaccaacgataaaatcccagtgttgttagatttgaaaaaaaatttccctgaacagacaaaatccttgatttcaattgtttcaatggatccaattgatttggtatcacaaaactggtttgatcaagcaaaagaattgaaaatcactattcaagacttgaatcaaattgaagagttaggttctcgcaatccaatccgtgaattgccacctaaaagggatgcattatttacaatttcgtttacttcgggaactacaggtagtaaaccaaagggagttatgttatcccaagctggtgccgctgcttatattacgtcattgacatgtattaaacctcatgctgctcctggtgacaaggtatttatttttttgccattaactcatgtgtatgaacgtcaaactagtgcctttgcgtggtccaccggttattacttggcattcccacaagtgaccattggacaagaaaacgtcaatgctttttccaatatgcttgaagatttaagaattttcaaaccaacctacatgtcaattgttcctcgattattgacaagaatagaagctttgatcaagggtaaaatcaaggaattatcaccagaagaacaagataaagtcaatcaaatcattgagtataaaattaaagaacaagctaaacatgatggtgccaaagggttgaatgcagcttttgatcaatacccgccttacaaatttttacgagaaattgttgggtatgataatatcaaatgggttcaaaccgcctctgccccaattgctccttctaccttggtatatttaaaggcaagtttaaatatgggtattagacaacaatatgggttgacagaaagtggtgctgctattaccagtactgatgattacgaggcaaaagctggatcttgtggaactattttaccaacaggacaattgaaattacgaagtgttaaagacatgggatacagtatcgatagattagaaggtgaagtaatgcttcaaggaccacagatgtttaaaggttactactataacaaagaagagactgacaattcaattgatgcagatggttggttccattccggtgatattgctcgaattgatcctaaaaccgggagagttagtattattgatagagttaaaaatttcttcaagatgcaacaaggagaatatgtcttcaccacgccgtgcaggatccgcactgaa

SEQ ID NO: 3774 - DNA, 765 bp, Candida albicans
atactgtttaatatctttttctttattttttgcttaactaagaatcaacaaatagtaatgacaaagttaccttcgatttcagaaactgataccgtctacgcagacgacactaaaccttatatttttgaaaaccccaatgactacccaatagaaactttagttaaccacattttaccattcccgcaagaggttgctggagaatctgttaaaattcccggtactgctgagacaggattttcagaaatataccgtaacgcagccactcccaatggaatcaaatcaggtttaattcaaggattagatacttatcatgcgatatttgaaaattcagcacaggtatatgctgatgaaccatgtcttgctttccatgaatacgactacgaaaactctcagcatttggagagatacgcttcaatcagctacaaagaggtccatgaaaggaaaaacaatttggctgcagggttgttctttttgttatcggccaacccgttcaaaaacaattcgttggagtcgcaccgcaagatcgatagccatagcaaggattataaaacttataatagcgacaatttatcctttgttgtgacattctattccggtaatagagttgaatggatcttgtcagatttggcgtgttcctccaactcaatcacctcgactgcattgtatgacactttgggacatgatgcatcgaaatatattttacagtctactgaatccccagttattcatttcctcccaaagaacatattccgtgggttaatttga

SEQ ID NO: 3775 - DNA, 1494 bp, Candida albicans
ttgtgtccatgggaacctttaacccaaaggattcacacttggtggattttgctgagtcaaacaaaattaaatggtatgatttttctcaagttgaacgttcggggggcatttttcctcccaaagaattgcccaccacatttcaaaaaattttttacaatcaccttcacctcaggtaccactggtgcaaaccccaagggagttcttttaccacaaagatgttgtgcttcagcaataattggttacagtgcattagtcccccaccataaaggaactaaagaatttgcgtttttgccgttagctcatatttttgaaagacacatgctgtcagcaatgtttttatttggagggtcagtagcatttccaagactaggtggaactccattgactcttttcgaagatttgaaattgtggaaaccaacatttatggcgaacgtaccaagaatatttaccaagatcgaagctggaattaaggcaaccacgattgactccacttcatcagttactcgctctctttatagccgagccattgaaactaaacgcagcagacaaataaaagatggtgaaagtggcgaccatttcgtttacgatcaattattgattaagaagttaagaaaagcgattgggtttgacaatatggaattttgctttactggtggtgctccaatttctccagacactatcaagtttttgaaagcaagtttgggtattggttttgctcaaggttacggtagcagtgaatcttttgctgggatgttaatgtcgttgccgttcaagcactcatcggtggggacctgtggagttatttcaccaacaatggaagctagaatcagagagttgccatcaatgggatacaatttaaacgatgaaaatggtcctcgtggtgagttacagcttcgtggtgctcagttgtttaccaagtactacaaaaacgaagaggaaacaagcaaggcaattgataaagatggttggttttccactggagatgttgcacaaatcactgatgatgggttgtttaagattattgacagagtaaagaactttttcaaattggcacaaggggagtatgtgaccccagaaaagattgaaggggtttatttgtcgtcgaattcgttattgacccaacttttcgttcacggtgactttttacagacatatcttgttggaattgttggtgtcgaccctgttggtatccgcagctacataaaaaccacgtttcagaaagatatcagcacaaacgaggaagtaattgcattttttgaatctcctaaaaatagaagagtcttgttacaagatatcaatggaaatgttgctggtaaacttcaagggtttgaaaagatacataatatagaggttgcatttgaaccattaacacttgacagaggggttgtgaccccaacaatgaaaataagaagaccaatatgtaccaaattcttcaagaaggaaattgaaaagttgtacaacgaagggtctttagttaaaaatggtaatttgtag

SEQ ID NO: 3776 - DNA, 483 bp, Candida albicans
ccacaaactactactactactactaccaccaccaccacgacctttccgatgaatcaattattaatcaataaacatgagaaatttttcaatagatgtgtaattggacttccatcaacggctcaatctgaagattcaaataaattagccataatatatttttgtttacatggacttcaattaattcaaaaatttcaattcactaatcaagaattaatttattatcgaaatttcattattaatcaatttatgattgaaaataatcaaattatatcatttcgttcaacttattattttcaaaaaaccaatcaaaaatatgattgtcctaatttatcatcgacattatttgcattatataatttattgattttaaaatcaccttatcatactatgataaatcgaaagaaaatcaggaattttttatgtaaatgtcaagttaaagatggtatcaataaaaggtgggtttgtgccgacactctattatga

SEQ ID NO: 3777 - DNA, 477 bp, Candida albicans
atagcatcattaaaattacttaattatccattagagaaattaaaatctaccaaagaatggttaattcatagacaagttgattatcctgaaaatttatatcctaaagatggtaatggtgataattatgaatattatcgtaatatagatattggtggttttaatggtagagaaaacaaattgagtgatacatgttattcttggtggtgtactggaagtttatataatattgatgttaatttcattaaattggtagatttaaacaaggcggaagattatttattaaataaaactcaaaatcaattatttggtggatttggaagagatcctgattcaacacctgatcctatgcatagttatttggcattagctagtttatcattatggaatcatgaaaaatttgctttacaagaaattaatccaattttaacaattacaaaagaactgtatcaattttttaaagaagaaataaagtattaa

SEQ ID NO: 3778 - DNA, 525 bp, Candida albicans
atgggaataacgattcgacaggcaactatagaagatatacaggcaatgcaaaatgccaatttgcacaatcttccggaaaactatcaattgaaatactatatgtatcacatattgtcatggccacaagcatcatttgttgcaacaacctatgatgaggtgataaatgtgaatgatggggaaatagatgtgccagttactcaggatccaaaaggtgatacagcatacataaatagaggtgagaaaattgttgggtatgtgttgggtaaaatggaggatgatccagaagctgctgacaaaactcctcatgggcacattacttcattgtctgtaatgagaacgtatcgtcgaatgggtatagctgagaaattaatgcgacaatctttatatgccatgtgtgaactgtttggagcacagtatgtttctttgcatgtgagaaaatccaatcgtgctgcattacatttatatagagactcattaaagtttgaggttcaatcaatatcaaaaatcatactatcaagacggtga

SEQ ID NO: 3779 - DNA, 294 bp, Candida albicans
agacagtcccatcgcgccagttacgtttcgctgcatgtgcgtgtctccaacactgccgccctgcgtctgtaccgggatacccttggcttcaaggtcgagtccgtcgagagcaagtactatgcggatggagaggatgcgtacgccatgcgcctggaccttaccgatcaatggttggactggaaggaaattgaacgcaaggacagagagcgcgctaagagtgacgaaaaggacgctgatgagggcgacgaggttggaagtttgggcaagaaggaagaaaagaccgttcgcgtctag

SEQ ID NO: 3780 - DNA, 543 bp, Candida albicans
agttcgggaccatttctgaatttttctgcatggcataatcgaactaaattaatacctaaaatatataatttaattcaacaacaacaacaaaaagatggaaaaatatttggtgatctcccaggaatagaattatttcaaaatccaatattattattgaaaaatgatttagaaatgattaaaactggtgtttatatgagtcccgaagatacgtcggtttggttatatttatattggttattaactgatgatcttttcacaaatgcttttaaatcacatcaacaagattatatgaatattttacatgaacaattacaattaattaacgaagttaatgaaatggaaaaagaagatactggtcaagataatgttggatgtttgaaaagtatgatttttataaatgctttaattcaaaatgaaaataataaaccagtattgactgaacaagttaagagttgtttaaaacaattagccaaaattgatccccttcggaaaaataaatatttagatcaacttgccggtaatgccccaatttttcaccattaa

SEQ ID NO: 3781 - DNA, 792 bp, Candida albicans
tattattttcaacagtggaggaaatacaagtcccagattaacgagactgcaaataccgataagagtgccatatttaaagccatagggttgatcgcttttgaggttggcaatcagatggcgacttatttagatgcaatattggataatattagagagggattatcgtatacctctaatgcaggggtacagctgattttggccaaagcggcatcgaatgaatctccaaacatcagtacgactaacattgcatctttagcgtccggctttaagtacacagcgagcagaaaggagactgaacctgctatatttgattgtatcagtaaattatccatagcagtagggcctgctttgacaaaacacttgcaaagagatatattggatatgatgttcgcaaactgttcattatcaaagcacatgcaagatgtactccaagttttgatagaaaatataccaactttaacaaacttgatcaacgaaaaactattaaatttgcttagcttagttttatcaggcaagggattccaaccaccgggatcaccatttggaaccataaaggtaaatgcctcgcttgccagggattgccgattaattatgatatctagagacacggggatgagtatcaacactattttgatgaatcaggagaggtatgaaaaacttgatagtaagatattgattcaagcattagaaatgttggcattttttaaatttgaaaattatcagttaaatgagtttgtcaggtactgcactatcacatcttcaccaggcggctgccaggacccgaactctgaa

SEQ ID NO: 3782 - DNA, 816 bp, Candida albicans
agacgacttcgtgagtcatgtataaatactttgacgtacatgttggttcagttgggtcctgagtttactgtttttatccccgtgatcaaaaagactttgttgcaaaaaaacatacacgcaattaagtttgagcaattggttggaaaattgattggtggagacccgttaccactacacttggatatttacaaagattatgactatagtctttatgatattgctgatacggatatgccatctaaaaaattacctgtaaatcaagcatctttaaaggcagcctgggatgcaagtcaacgaagaactaaggaagattggcaagagtggattggtagattgagtaaggaactcttgcttcaaagtccttctcatgctatcagagcttgtgccgggttggcatcggattattacccacttgcaaaagacctttttaatgctagttttgctagttgctggagtgagttatattctcagcacaaggaagaattagtggaatcattttgtattgcactttcatcaccaagtaatcctccggaaatacatcaaactatattgaatcttgctgagtttatggagcatgatgataaaccacttccgatgtcaatttctacattggggcaatatgcacaacgtgcccatgcgtttgccaaggcattgcattataaggaattggagttttatgatcaacccacaacgcctacaatcgagtcattgatcagtattaataatcaattgcaacaatcggatgctgccataggttatttgaaacatgctcagttgcaccatgatttgcaattgaaagaaactgggtatgaaaaa

SEQ ID NO: 3783 - DNA, 444 bp, Candida albicans
cataatgacgcaaaagaattatcgtttgttgataaagtcatcgatactgatttgaaaaataatagtgcttggtctcatcgattctttctattgtttagtaagacacatttggccaccgataatacaattgatgaggagctaaattatgttaaagataagattgttaaatgtccacagaatccaagtacttggaattatttattggggattcatgaacggtttgatcgatcaattactcaattagaagagtttagtttgcaatttgttgatttggaaaaagatcaagtgacgagttcatttgctttggagacattggcaaaaatatacacacaacaaaagaaatacaatgagtctagaactgtttatgatttgttgaaatctaaatatgatccaattagatccaatttctgggattatcagatttccaaactcacatcggtgtaa

SEQ ID NO: 3784 - DNA, 231 bp, Candida albicans
aaacctttaatgatgaattgggattggtgtgaagaaattgctttggacaatgaaaaaaactatcagatctggaattatggaccattaattattgttcaaattatggaattgaataataatgactttgacccatatcgagaattccttatattagaagcaatgttaagttcagaccccaagaaccatcatgtttggtcgtatcgtaagtggttggttgatacgtttgattaa
